United States Patent 9,675,668 (MODIFIED POLYNUCLEOTIDES ENCODING HEPATITIS A VIRUS CELLULAR RECEPTOR 2) - sequence listing, part 19

SEQ ID NO: 39992 - DNA, 711 bp, Artificial Sequence
  Description of Artificial Sequence: Synthetic coding sequence
atggccgaggccgaggagagccctggggaccctggaacagccagcccccggcccctgtttgctggcctgagtgacatcagcatcagccaggacatccctgtggagggggagatcaccatccccatgaggagccgcatccgggagtttgacagcagcaccctgaatgaatctgtgaggaacaccatcatgagggacctgaaggctgtgggcaagaagttcatgcacgtgctgtaccccaggaagagcaacaccctgctgcgggactgggacctgtggggccccctcatcctgtgtgtgaccctggccctgatgctgcagagggacagcgctgacagcgagaaggatggcggcccccagtttgctgaggtgtttgtgattgtgtggtttggagctgtgaccatcaccctgaacagcaagctgctgggcggcaacatctccttcttccagagcctgtgtgtgctgggctactgcatcctgcccctgactgtggccatgctgatctgccgcctggtgctgctggccgaccccggccctgtgaacttcatggtgcggctgtttgtggtgattgtgatgtttgcctggagcatcgtggccagcacagccttcctggccgacagccagccccccaacagaagagccctggccgtgtaccctgtgttcctgttctacttcgtcatctcctggatgatcctgaccttcaccccccagtag

SEQ ID NO: 39993 - DNA, 843 bp, Artificial Sequence
  Description of Artificial Sequence: Synthetic coding sequence
atggacctgctgaagatcagccacaccaagctgcacctgctggaggacctgagcatcaagaacaagcagaggatgagcaacctggcccagtttgacagcgacttctaccagagcaacttcaccatcgacaaccaggagcagagcggaaatgacagcaatgcctacggcaacctgtatggcagcaggaagcagcaggccggggagcagccccagcctgccagctttgtgcccagcgagatgctgatgagcagcggctacgccggccagttcttccagcctgccagcaacagcgactactacagccagagcccctacatcgacagctttgatgaggagccccccctgctggaggagctgggcatccactttgaccacatctggcagaagaccctgactgtgctgaaccccatgaagcctgtggatggcagcatcatgaatgaaacagacctgaccggccccatcctcttctgtgtggccctgggcgccaccctgctgctggccggcaaggtgcagtttggctacgtgtatggcatgtctgccatcggctgcctggtgattcatgccctgctgaacctgatgagcagcagcggcgtgtcctatggctgtgtggcctctgtgctgggctactgcctgctgcccatggtgatcctgagcggctgtgccatgttcttcagcctgcagggcatcttcggcatcatgagcagcctggtgatcatcggctggtgcagcctgagcgccagcaagatcttcatcgccgccctgcacatggagggccagcagctgctggtggcctacccctgtgccatcctgtatggcctgtttgccctgctgaccatcttctag

SEQ ID NO: 39994 - DNA, 774 bp, Artificial Sequence
  Description of Artificial Sequence: Synthetic coding sequence
tgaatgagcaacctggcccagtttgacagcgacttctaccagagcaacttcaccatcgacaaccaggagcagagcggaaatgacagcaatgcctacggcaacctgtatggcagcaggaagcagcaggccggggagcagccccagcctgccagctttgtgcccagcgagatgctgatgagcagcggctacgccggccagttcttccagcctgccagcaacagcgactactacagccagagcccctacatcgacagctttgatgaggagccccccctgctggaggagctgggcatccactttgaccacatctggcagaagaccctgactgtgctgaaccccatgaagcctgtggatggcagcatcatgaatgaaacagacctgaccggccccatcctcttctgtgtggccctgggcgccaccctgctgctggccggcaaggtgcagtttggctacgtgtatggcatgtctgccatcggctgcctggtgatccacgccctgctgaacctgatgagcagcagtggagtgtcctatggctgtgtggcctctgtgctgggctactgcctgctgcccatggtgatcctgagcggctgtgccatgttcttcagcctgcagggcatcttcggcatcatgagcagcctggtgatcatcggctggtgcagcctgagcgccagcaagatcttcatcgccgccctgcacatggagggccagcagctgctggtggcctacccctgtgccatcctgtatggcctgtttgccctgctgaccatcttctag

SEQ ID NO: 39995 - DNA, 900 bp, Artificial Sequence
  Description of Artificial Sequence: Synthetic coding sequence
atgcctggcagcgccagcaagaggcgcatccctgtgtcccagcccggcatggctgacccccaccagctgtttgatgacaccagcagcgcccagagccggggctatggagcccagagggcccctgggggcctgagctacccagctgccagccccacccctcatgctgccttcctggccgaccctgtgagcaacatggccatggcctacggcagcagcctggccgcccagggcaaggagctggtggacaagaacatcgaccgcttcatccccatcaccaagctgaagtactactttgctgtggacaccatgtatgtgggcaggaagctgggcctgctcttcttcccctacctgcaccaggactgggaggtgcagtaccagcaggacacccctgtggcccccaggtttgatgtgaatgccccagacctgtacatcccagccatggccttcatcacctacgtgctggtggccggcctggccctgggcacccaggaccgcttctccccagacctgctgggcctgcaggccagcagcgccctggcctggctgaccctggaggtgctggccatcctgctgagcctgtacctggtgacagtgaacacagacctgaccaccatcgacctggtggccttcctgggctacaagtatgtgggcatgattggaggagtgctgatgggcctgctgtttgggaagattggctactacctggtgctgggctggtgctgcgtggccatctttgtgttcatgatccgcaccctgcggctgaagatcctggctgatgctgctgctgagggcgtgcctgtgcggggggccaggaaccagctgaggatgtacctgaccatggctgtggccgccgcccagcccatgctgatgtactggctgaccttccacctggtgaggtag

SEQ ID NO: 39996 - DNA, 876 bp, Artificial Sequence
  Description of Artificial Sequence: Synthetic coding sequence
atgcaccctgctggcctggccgctgctgctgctggcaccccccggctgcccagcaagaggcgcatccctgtgtcccagcccggcatggctgacccccaccagctgtttgatgacaccagcagcgcccagagccggggctatggagcccagagggcccctgggggcctgagctacccagctgccagccccacccctcatgctgccttcctggccgaccctgtgagcaacatggccatggcctacggcagcagcctggccgcccagggcaaggagctggtggacaagaacatcgaccgcttcatccccatcaccaagctgaagtactactttgctgtggacaccatgtatgtgggcaggaagctgggcctgctcttcttcccctacctgcaccaggactgggaggtgcagtaccagcaggacacccctgtggcccccaggtttgatgtgaatgccccagacctgtacatcccagccatggccttcatcacctacgtgctggtggccggcctggccctgggcacccaggaccgcttctccccagacctgctgggcctgcaggccagcagcgccctggcctggctgaccctggaggtgctggccatcctgctgagcctgtacctggtgacagtgaacacagacctgaccaccatcgacctggtggccttcctgggctacaagtatgtgggcatgattggaggagtgctgatgggcctgctgtttgggaagattggctactacctggtgctgggctggtgctgcgtggccatctttgtgttcatgttccccctgctgcctggagctgtggcccacgcctgcaaccccagcaccctgggcggccggggcggccgcatcaccaggagcggccgctgtggctag

SEQ ID NO: 39997 - DNA, 945 bp, Artificial Sequence
  Description of Artificial Sequence: Synthetic coding sequence
atgcaccctgctggcctggccgctgctgctgctggcaccccccggctgaggaagtggcccagcaagaggcgcatccctgtgtcccagcccggcatggctgacccccaccagctgtttgatgacaccagcagcgcccagagccggggctacggggcccagagggcccctgggggcctgagctacccagctgccagccccacccctcatgctgccttcctggccgaccctgtgagcaacatggccatggcctacggcagcagcctggccgcccagggcaaggagctggtggacaagaacatcgaccgcttcatccccatcaccaagctgaagtactactttgctgtggacaccatgtatgtgggcaggaagctgggcctgctcttcttcccctacctgcaccaggactgggaggtgcagtaccagcaggacacccctgtggcccccaggtttgatgtgaatgccccagacctgtacatcccagccatggccttcatcacctacgtgctggtggccggcctggccctgggcacccaggaccgcttctccccagacctgctgggcctgcaggccagcagcgccctggcctggctgaccctggaggtgctggccatcctgctgagcctgtacctggtgacagtgaacacagacctgaccaccatcgacctggtggccttcctgggctacaagtatgtgggcatgattggaggagtgctgatgggcctgctgtttgggaagattggctactacctggtgctgggctggtgctgcgtggccatctttgtgttcatgatccgcaccctgcggctgaagatcctggctgatgctgctgctgagggcgtgcctgtgcggggggccaggaaccagctgaggatgtacctgaccatggctgtggccgccgcccagcccatgctgatgtactggctgaccttccacctggtgaggtag

SEQ ID NO: 39998 - DNA, 852 bp, Artificial Sequence
  Description of Artificial Sequence: Synthetic coding sequence
atggctgacccccaccagctgtttgatgacaccagcagcgcccagagccggggctatggagcccagagggcccctgggggcctgagctacccagctgccagccccacccctcatgctgccttcctggccgaccctgtgagcaacatggccatggcctacggcagcagcctggccgcccagggcaaggagctggtggacaagaacatcgaccgcttcatccccatcaccaagctgaagtactactttgctgtggacaccatgtatgtgggcaggaagctgggcctgctcttcttcccctacctgcaccaggactgggaggtgcagtaccagcaggacacccctgtggcccccaggtttgatgtgaatgccccagacctgtacatcccagccatggccttcatcacctacgtgctggtggccggcctggccctgggcacccaggaccgcttctccccagacctgctgggcctgcaggccagcagcgccctggcctggctgaccctggaggtgctggccatcctgctgagcctgtacctggtgacagtgaacacagacctgaccaccatcgacctggtggccttcctgggctacaagtatgtgggcatgattggaggagtgctgatgggcctgctgtttgggaagattggctactacctggtgctgggctggtgctgcgtggccatctttgtgttcatgatccgcaccctgcggctgaagatcctggctgatgctgctgctgagggcgtgcctgtgcggggggccaggaaccagctgaggatgtacctgaccatggctgtggccgccgcccagcccatgctgatgtactggctgaccttccacctggtgaggtag

SEQ ID NO: 39999 - DNA, 609 bp, Artificial Sequence
  Description of Artificial Sequence: Synthetic coding sequence
atgagcggccgctctgtgcgggcagagaccaggagccgggccaaggatgacatcaagaaggtgatggccgccatcgagaaggtgaggaagtgggagaagaagtgggtgacagtgggggacaccagcctgcgcatcttcaagtgggtgcctgtgacagacagcaaggagaaggagaagagcaagagcaacagcagcgctgcccgggagcccaacggcttccccagtgatgccagcgccaacagcagcctgctgctggagttccaggatgagaacagcaaccagagctctgtgtctgatgtgtaccagctgaaggtggacagcagcaccaacagcagccccagcccccagcagagcgagagcctgagccctgcccacaccagtgacttcagaacagatgacagccagccccccaccctgggccaggagatcctggaggagcccagcctgcccagcagcgaggtggctgatgagccccccaccctgaccaaggaggagcctgtgcccctggagacccaggtggtggaggaggaggaggacagcggggccccacccctgaagcgcttctgtgtggaccagcccaccgtgccccagacagccagcgagagctag

SEQ ID NO: 40000 - DNA, 495 bp, Artificial Sequence
  Description of Artificial Sequence: Synthetic coding sequence
atgaagctgtacagcctgtctgtgctgtacaagggggaggccaaggtggtgctgctgaaggccgcctatgatgtgtcctccttctccttcttccagaggagctctgtgcaggagttcatgaccttcaccagccagctgattgtggagaggagcagcaagggcacccgggcctctgtgaaggagcaggactacctgtgccacgtgtatgtgagaaatgacagcctggccggcgtggtgattgctgacaatgagtaccccagccgggtggccttcaccctgctggagaaggtgctggatgagttcagcaagcaggtggacagaattgactggcctgtgggcagccctgccaccatccactacccagccctggatggccacctgagccgctaccagaacccccgggaggccgaccccatgaccaaggtgcaggccgagctggatgagaccaagatcatcctggccaggaagcagaacagctgctgtgccatcatgtag

SEQ ID NO: 40001 - DNA, 1119 bp, Artificial Sequence
  Description of Artificial Sequence: Synthetic coding sequence
atggccagcaatgaagacttcagcatcacccaggacctggagatcccagctgacatcgtggagctgcatgacatcaacgtggagcccctgcccatggaggacatccccacagaatctgtgcagtatgaagatgtggatggcaactggatctatggaggccacaaccacccccccctgatggtgctgcagcccctcttcaccaacacaggctatggagaccatgaccaggagatgctgatgctgcagacccaggaggaggtggtgggctactgtgacagcgacaaccagctgggcaatgacctggaggaccagctggccctgcctgacagcattgaagatgagcacttccagatgaccctggccagcctgagcgccagcgctgccagcaccagcaccagcacccagagccgcagcaagaagcccagcaagaagcccagcggcaagagcgccaccagcacagaggccaacccagctggcagcagcagcagcctgggcaccaggaagtgggagcagaagcagatgcaggtgaagaccctggagggggagttctctgtgaccatgtggagccccaatgacaacaatgaccagggcgctgtgggggagggccaggctgaaaatcctccagactacagcgagtacctgaagggcaagaagctgcccccaggcggcctgcccggcatcgacctgagtgaccccaagcagctggccgagttcaccaaggtgaagcccaagaggagcaaaggagagccccccaagacagtgccctgcagctacagcggctgtgagaagatgttccgggactatgctgccatgaggaagcacctgcacatccacggcccccgggtgcacgtgtgtgctgaatgtgggaaggccttcctggagagcagcaagctgcggcggcaccagctggtgcacactggagagaagcccttccagtgcacctttgagggctgtgggaagcgcttcagcctggacttcaacctgcggacccacctgcgcatccacactggagacaagccctttgtgtgcccctttgatgtgtgcaacaggaagtttgcccagagcaccaacctgaagacccacatcctgacccacgtgaagaccaagaacaacccctag

SEQ ID NO: 40002 - DNA, 2301 bp, Artificial Sequence
  Description of Artificial Sequence: Synthetic coding sequence
atggccagtgacaccccagagagcctgatggccctgtgcacagacttctgcctgaggaacctggatggcaccctgggctacctgctggacaaggagaccctgcggctgcacccagacatcttcctgcccagcgagatctgtgaccggctggtgaatgaatatgtggagctggtgaatgctgcctgcaactttgagccccatgagagcttcttcagcctcttcagtgaccccaggagcacccggctgacccgcatccacctgcgggaggacctggtgcaggaccaggacctggaggccatcaggaagcaggacctggtggagctgtacctgaccaactgtgagaagctgagcgccaagagcctgcagaccctgcggagcttcagccacaccctggtgtccctgagcctgtttggctgcaccaacatcttctatgaggaggagaaccctgggggctgtgaagatgagtacctggtgaaccccacctgccaggtgctggtgaaggacttcacctttgagggcttcagccggctgcgcttcctgaacctgggccgcatgattgactgggtgcctgtggagagcctgctgcggcccctgaacagcctggccgccctggacctgagcggcatccagaccagtgatgctgccttcctgacccagtggaaggacagcctggtgtccctggtgctgtacaacatggacctgagtgatgaccacatccgggtcatcgtgcagctgcacaagctgcggcacctggacatcagccgggaccggctgagcagctactacaagttcaagctgacccgggaggtgctgagcctgtttgtgcagaagctgggcaacctgatgagcctggacatcagcggccacatgatcctggagaactgcagcatcagcaagatggaggaggaggccggccagaccagcattgagcccagcaagagcagcatcatccccttccgggccctgaagaggcccctgcagttcctgggcctgtttgagaacagcctgtgccgcctgacccacatcccagcctacaaggtgtctggggacaagaatgaggagcaggtgctgaatgccatcgaggcctacacagagcacaggcctgagatcaccagccgggccatcaacctgctgtttgatattgcccgcatcgagcgctgcaaccagctgctgcgggccctgaagctggtgatcacagccctgaagtgccacaagtatgacaggaacatccaggtgactggatctgctgccctcttctacctgaccaacagcgagtacagaagtgagcagagcgtgaagctgcggcggcaggtgatccaggtggtgctgaatggcatggagagctaccaggaggtgacagtgcagaggaactgctgcctgaccctgtgcaacttcagcatccctgaggagctggagttccagtaccgccgggtgaatgagctgctgctgagcatcctgaaccccacccggcaggatgagagcatccagagaattgctgtgcacctgtgcaatgccctggtgtgccaggtggacaatgaccacaaggaggccgtgggcaagatgggctttgtggtgaccatgctgaagctgatccagaagaagctgctggacaagacctgtgaccaggtgatggagttctcctggagcgccctgtggaacatcacagatgagaccccagacaactgtgagatgttcctgaacttcaacggcatgaagctgttcctggactgcctgaaggagttccctgagaagcaggagctgcacaggaacatgctgggcctgctgggcaatgtggccgaggtgaaggagctgcggccccagctgatgaccagccagttcatctctgtgttcagcaacctgctggagagcaaggcagatggcatcgaggtgtcctacaatgcctgtggggtgctgagccacatcatgtttgatggccctgaggcctggggcgtgtgtgagccccagcgggaggaggtggaggagaggatgtgggccgccatccagagctgggacatcaacagcagaagaaacatcaactaccgcagctttgagcccatcctgcggctgctgccccagggcatcagccctgtgtcccagcactgggccacctgggccctgtacaacctggtgtctgtgtacccagacaagtactgccccctgctgatcaaggagggcggcatgcccctgctgcgggacatcatcaagatggccacagcccggcaggagaccaaggagatggccaggaaggtgattgagcactgcagcaacttcaaggaggagaacatggacaccagcaggtag

SEQ ID NO: 40003 - DNA, 498 bp, Artificial Sequence
  Description of Artificial Sequence: Synthetic coding sequence
atggccagtgacaccccagagagcctgatggccctgtgcacagacttctgcctgaggaacctggatggcaccctgggctacctgctggacaaggagaccctgcggctgcacccagacatcttcctgcccagcgagatctgtgaccggctggtgaatgaatatgtggagctggtgaatgctgcctgcaactttgagccccatgagagcttcttcagcctcttcagtgaccccaggagcacccggctgacccgcatccacctgcgggaggacctggtgcaggaccaggacctggaggccatcaggaagcaggacctggtggagctgtacctgaccaactgtgagaagctgagcgccaagagcctgcagaccctgcggagcttcagccacaccctggtgtccctgagcctgtttggctgcaccaacatcttctatgaggaggagaaccctgggggctgtgaagatgagtacctggtgaaccccacctgccaggtgctgtag

SEQ ID NO: 40004 - DNA, 306 bp, Artificial Sequence
  Description of Artificial Sequence: Synthetic coding sequence
atggccagtgacaccccagagagcctgatggccctgtgcacagacttctgcctgaggaacctggatggcaccctgggctacctgctggacaaggagaccctgcggctgcacccagacatcttcctgcccagcgagatctgtgaccggctggtgaatgaatatgtggagctggtgaatgctgcctgcaactttgagccccatgagagcttcttcagcctcttcagtgaccccaggagcacccggctgacccgcatccacctgcgggaggacctggtgcaggaccaggacctggaggccatcagatag

SEQ ID NO: 40005 - DNA, 1239 bp, Artificial Sequence
  Description of Artificial Sequence: Synthetic coding sequence
atgatggccctgtggagcctgctgcacctgaccttcctgggcttcagcatcaccctgctgctggtgcacggccagggcttccagggcacagctgccatctggcccagcctcttcaacgtgaacctgagcaagaaggtgcaggagagcatccagatccccaacaatggaagtgcccccctgctggtggatgtgcgggtgtttgtgtccaatgtgttcaacgtggacatcctgcgctacaccatgagctccatgctgctgctgcggctgtcctggctggacacccggctggcctggaacaccagcgcccaccccaggcatgccatcaccctgccctgggagagcctgtggaccccccggctgaccatcctggaggccctgtgggtggactggagggaccagagcccccaggcccgggtggaccaggacggccacgtgaagctgaacctggccctggccacagagaccaactgcaactttgagctgctgcacttcccccgggaccacagcaactgcagcctgtccttctacgccctgagcaacacagccatggagctggagttccaggcccacgtggtgaatgaaattgtgtctgtgaagcgggagtatgtggtgtatgacctgaagacccaggtgcccccccagcagctggtgccctgcttccaggtgaccctgcggctgaagaacacagccctgaagagcatcatcgccctgctggtgcctgctgaggccctgctgctggctgatgtgtgtggcggcctgctgcccctgcgggccatcgagcgcatcggctacaaggtgaccctgctgctgagctacctggtgctgcacagcagcctggtgcaggccctgcccagcagcagcagctgcaaccccctgctgatctactacttcaccatcctgctgctgctgctcttcctgagcaccattgaaacagtgctgctggccggcctgctggcccggggcaacctgggcgccaagagcggccccagccctgcccccagaggagagcagcgggagcacggcaaccctggcccccaccctgctgaggagcccagccggggcgtgaagggcagccagaggtcctggccagagacagctgaccgcatcttcttcctggtgtatgtggtgggcgtgctgtgcacccagtttgtgtttgctggcatctggatgtgggccgcctgcaagagtgatgctgcccctggagaggccgccccccacggccggcggccccggctgtag

SEQ ID NO: 40006 - DNA, 381 bp, Artificial Sequence
  Description of Artificial Sequence: Synthetic coding sequence
atgatggccctgtggagcctgctgcacctgaccttcctgggcttcagcatcaccctgctgctggtgcacggccagggcttccagggcacagctgccatctggcccagcctcttcaacgtgaacctgagcaagaaggtgcaggagagcatccagatccccaacaatggaagtgcccccctgctggtggatgtgcgggtgtttgtgtccaatgtgttcaacgtgtcctctgtgctgccccgggccacagccctgcacagccatggagactgcagcggcagcgccccctgcagcaaggcccggggcagcggctgccacggcctgaccccaggcaaccacctgaaggtgcagcccccctgcatcaaccccagcggggacatctag

SEQ ID NO: 40007 - DNA, 3393 bp, Artificial Sequence
  Description of Artificial Sequence: Synthetic coding sequence
atgtgcaagtgctgcaacctcttcagccccaaccagagcgagctgctgagccacgtgtctgagaagcacatggaggagggcgtgaatgtggatgagatcatcatccccctgcggcccctgagcaccccagagccccccaacagcagcaagacaggagatgagttcctggtgatgaagaggaagaggggccggcccaagggcagcaccaagaagagcagcacagaggaggagctggccgagaacatcgtgagccccacagaggacagccccctggcccctgaggagggcaacagcctgccccccagcagcctggagtgcagcaagtgctgcaggaagttcagcaacacccggcagctgaggaagcacatctgcatcatcgtgctgaacctgggggaggaggagggggaggccggaaatgaaagtgacctggagctggagaagaagtgcaaggaggatgaccgggagaaggccagcaagaggcccaggagccagaagacagagaaggtgcagaagatcagcggcaaggaggcccggcagctgagcggggccaagaagcccatcatctctgtggtgctgacagcccacgaggccatccctggggccaccaagatcgtgcctgtggaggccggccccccagagaccggggccaccaacagcgagaccaccagcgctgacctggtgccccggcggggctaccaggagtatgccatccagcagaccccctatgagcagcccatgaagagcagccggctgggccccacccagctgaagatcttcacctgtgagtactgcaacaaggtgttcaagttcaagcacagcctgcaggcccacctgcgcatccacaccaatgagaagccctacaagtgcccccagtgcagctatgccagcgccatcaaggccaacctgaatgtgcacctgaggaagcacactggagagaagtttgcctgtgactactgcagcttcacctgcctgagcaagggccacctgaaggtgcacatcgagcgggtgcacaagaagatcaagcagcactgccgcttctgcaagaagaagtacagtgatgtgaagaacctgatcaagcacatcagagatgcccatgacccccaggacaagaaggtgaaggaggccctggatgagctgtgcctgatgacccgggagggcaagaggcagctgctgtatgactgccacatctgtgagaggaagttcaagaatgagctggtggaggaggagtttgccctgcagggcgtgaatgccctgaaggaggaggcctgccctggggacacccagctggaggagggcaggaaggagcctgaggcccctggagagatgcctgccccagctgtgcacctggccagcccccaggccgagagcacagccctgcccccctgtgagctggagaccaccgtggtgagcagcagtgacctgcacagccaggaggtggtgtctgatgacttcctgctgaagaatgacaccagcagcgctgaggcccatgctgcccctgagaagcccccagacatgcagcacaggagctctgtgcagacccagggcgaggtgatcaccctgctgctgagcaaggcccagagcgctggcagtgaccaggagagccatggagcccagagccccctgggggagggccagaacatggctgtgctgtctgctggggaccctgaccccagccgctgcctgcggagcaacccagctgaggccagtgacctgctgccccctgtggccggcggcggggacaccatcacccaccagcctgacagctgcaaggccgcccctgagcacaggagcggcatcacagccttcatgaaggtgctgaacagcctgcagaagaagcagatgaacaccagcctgtgtgagcgcatcaggaaggtgtatggagacctggagtgtgagtactgtgggaagctgttctggtaccaggtgcactttgacatgcacgtgaggacccacacccgggagcacctgtactactgcagccagtgccactacagcagcatcaccaagaactgcctgaagagacatgtgatccagaagcacagcaacatcctgctgaagtgccccacagatggctgtgactacagcaccccagacaagtacaagctgcaggcccacctgaaggtgcacacagccctggacaagaggagctacagctgccctgtgtgtgagaagagcttcagcgaggacaggctcatcaagagccacatcaagaccaaccaccctgaggtgtccatgagcaccatcagcgaggtgctgggccggcgggtgcagctgaagggcctcatcggcaagagggccatgaagtgcccctactgtgacttctacttcatgaagaatggaagtgacctgcagaggcacatctgggcccacgagggcgtgaagcccttcaagtgcagcctgtgtgaatatgccaccaggagcaagagcaacctgaaggcccacatgaacagacacagcacagagaagacccacctgtgtgacatgtgtgggaagaagttcaagagcaagggcaccctgaagagccacaagctgctgcacacagcagatggcaagcagttcaagtgcaccgtgtgtgactacacagctgcccagaagccccagctgctgcggcacatggagcagcacgtgtccttcaagcccttccgctgtgcccactgccactacagctgcaacatcagcggcagcctgaagaggcactacaacaggaagcaccccaatgaggagtatgccaacgtgggcaccggggagctggccgctgaggtgctgatccagcagggcggcctgaagtgccctgtgtgcagctttgtgtatggcaccaagtgggagttcaacagacacctgaagaacaagcacggcctgaaggtggtggagattgatggagaccccaagtgggagacagccacagaggcccctgaggagcccagcacccagtacctgcacatcacagaggccgaggaggatgtgcagggcacccaggccgctgtggccgccctgcaggacctgcgctacaccagcgagagcggggaccggctggaccccacagctgtgaacatcctgcagcagatcatcgagctgggcgctgagacccatgatgccacagccctggcctctgtggtggccatggcccctggcaccgtgacagtggtgaagcaggtgacagaggaggagcccagcagcaaccacacagtgatgatccaggagaccgtgcagcaggcctctgtggagctggccgagcagcaccacctggtggtgtccagtgatgatgtggagggcatcgagaccgtgacagtgtacacccagggcggggaggccagcgagttcatcgtgtatgtgcaggaggccatgcagcctgtggaggagcaggccgtggagcagcctgcccaggagctgtag

SEQ ID NO: 40008 - DNA, 3132 bp, Artificial Sequence
  Description of Artificial Sequence: Synthetic coding sequence
atggccatggccctggagctgcaggcccaggccagcccccagcctgagcctgaggagctgctgattgtgaagctggaggaggacagctggggcagcgagagcaagctgtgggagaaggaccggggctctgtgtctggccctgaggccagccggcagcgcttccggcagttccagtacagagatgctgctggcccccatgaggccttcagccagctgtgggccctgtgctgccgctggctgcggcctgagatccggctgaaggagcagatcctggagctgctggtgctggagcagttcctgaccatcctgccccgggaggtgcagacctgggtgcaggcccggcaccctgagagcggggaggaggccgtggccctggtggaggactggcaccgggagaccaggacagctggccagagcggcctggagctgcacacagaggagacccggcccctgaagacaggagaggaggcccagagcttccagctgcagcctgtggacccctggccagagggccagagccagaagaagggcgtgaagaacacctgcccagacctgcccaaccacctgaatgctgaggtggccccccagcccctgaaggagagcgctgtgctgaccccccgggtgcccaccctgcccaagatgggctctgtgggggactgggaggtgacagctgagagccaggaggccctgggccctgggaagcacgccgagaaggagctgtgcaaggaccccccaggagatgactgtggcaacagcgtgtgcctgggcgtgcctgtgtccaagcccagcaacaccagcgagaaggagcagggccctgagttctggggcctgagcctcatcaacagcggcaagaggagcacagctgactacagcctggacaatgagcccgcccaggccctgacctggagggacagccgggcctgggaggagcagtaccagtgggatgtggaggacatgaaggtgtctggagtgcactggggctatgaggagaccaagaccttcctggccatcctgtctgagagccccttcagcgagaagctgcggacctgccaccagaaccggcaggtgtaccgggccatcgccgagcagctgcgggcccggggcttcctgcggaccctggagcagtgccgctacagagtgaagaacctgctgaggaactacaggaaggccaagagcagccaccccccaggcacctgccccttctatgaggagctggaggccctggtgcgggccaggacagccatccgggccacagatggccctggagaggccgtggccctgccccggctgggctacagtgatgctgagatggatgagcaggaggagggcggctgggaccctgaggagatggccgaggactgcaatggagctggcctggtgaatgtggagagcacccagggccccagaattgctggggccccagccctcttccagagcagaattgctggggtgcactggggctatgaggagaccaaggccttcctggccatcctgtctgagagccccttcagcgagaagctgcggacctgccaccagaacagccaggtgtaccgggccatcgccgagcggctgtgtgccctgggcttcctgcggaccctggagcagtgccgctaccgcttcaagaacctgctgcggagctacaggaaggccaagagcagccaccccccaggcacctgccccttctatgaggagctggacagcctgatgagggcccgggctgctgtgcgggccatgggcaccgtgcgggaggccgccggcctgccccgctgtggccagagcagcgctgagacagatgcccaggaggcctggggcgaggtggccaatgaagatgctgtgaagcccagcaccctgtgccccaaggccccagacatgggctttgagatgagacatgaagatgaggaccagatcagcgagcaggacatctttgagggcctgcccggggccctgagcaaatgtcccacagaggccgtgtgccagcccctggactggggagaagattctgaaaatgaaaatgaagatgagggccagtggggcaaccccagccaggagcagtggcaggagagcagcagcgaggaggacctggagaagctgattgaccaccagggcctgtacctggccgagaagccctacaagtgtgacacctgcatgaagagcttcagccgcagcagccacttcatcgcccaccagaggatccacactggagagaagccctacaagtgcctggagtgtgggaagaacttcagtgacaggagcaacctgaacacccaccagaggatccacactggagagaagccctacaagtgcctggagtgtgggaagagcttcagtgaccacagcaacctgatcacccaccagaggatccacactggagagaagccctacaagtgtggggagtgctggaagagcttcaaccagagcagcaacctgctgaagcaccagaggatccacctgggcggcaacccagaccagtgcagcgagcccggcggcaactttgcccagagccccagcttcagcgcccactggaggaacagcacagaggagacagcccctgagcagccccagagcatcagcaaggacctgaacagccctggcccccacagcaccaacagcggggagaagctgtatgagtgcagtgaatgtggccgctccttcagcaagagcagcgccctgatcagccaccagaggatccacactggagagaagccctatgaatgtgctgaatgtgggaagagcttcagcaagagcagcaccctggccaaccaccagaggacccacactggagagaagccctacaagtgtgtggactgtgggaagtgcttcagcgagaggagcaagctgatcacccaccagagggtgcacactggagagaagccctacaagtgcctggagtgtgggaagttcttccgggacaggagcaacctgatcacccaccagaggatccacactggagagaagccctacaagtgcagagaatgtgggaagtgcttcaaccagagcagcagcctcatcatccaccagaggatccacactggagagaagccctacaagtgcacagaatgtgggaaggacttcaacaacagcagccacttcagcgcccacaggaggacccacgccggcggcaaggccagctag

SEQ ID NO: 40009 - DNA, 2934 bp, Artificial Sequence
  Description of Artificial Sequence: Synthetic coding sequence
atggccatggccctggagctgcaggcccaggccagcccccagcctgagcctgaggagctgctgattgtgaagctggagctgctggtgctggagcagttcctgaccatcctgccccgggaggtgcagacctgggtgcaggcccggcaccctgagagcggggaggaggccgtggccctggtggaggactggcaccgggagaccaggacagctggccagagcggcctggagctgcacacagaggagacccggcccctgaagacaggagaggaggcccagagcttccagctgcagcctgtggacccctggccagagggccagagccagaagaagggcgtgaagaacacctgcccagacctgcccaaccacctgaatgctgaggtggccccccagcccctgaaggagagcgctgtgctgaccccccgggtgcccaccctgcccaagatgggctctgtgggggactgggaggtgacagctgagagccaggaggccctgggccctgggaagcacgccgagaaggagctgtgcaaggaccccccaggagatgactgtggcaacagcgtgtgcctgggcgtgcctgtgtccaagcccagcaacaccagcgagaaggagcagggccctgagttctggggcctgagcctcatcaacagcggcaagaggagcacagctgactacagcctggacaatgagcccgcccaggccctgacctggagggacagccgggcctgggaggagcagtaccagtgggatgtggaggacatgaaggtgtctggagtgcactggggctatgaggagaccaagaccttcctggccatcctgtctgagagccccttcagcgagaagctgcggacctgccaccagaaccggcaggtgtaccgggccatcgccgagcagctgcgggcccggggcttcctgcggaccctggagcagtgccgctacagagtgaagaacctgctgaggaactacaggaaggccaagagcagccaccccccaggcacctgccccttctatgaggagctggaggccctggtgcgggccaggacagccatccgggccacagatggccctggagaggccgtggccctgccccggctgggctacagtgatgctgagatggatgagcaggaggagggcggctgggaccctgaggagatggccgaggactgcaatggagctggcctggtgaatgtggagagcacccagggccccagaattgctggggccccagccctcttccagagcagaattgctggggtgcactggggctatgaggagaccaaggccttcctggccatcctgtctgagagccccttcagcgagaagctgcggacctgccaccagaacagccaggtgtaccgggccatcgccgagcggctgtgtgccctgggcttcctgcggaccctggagcagtgccgctaccgcttcaagaacctgctgcggagctacaggaaggccaagagcagccaccccccaggcacctgccccttctatgaggagctggacagcctgatgagggcccgggctgctgtgcgggccatgggcaccgtgcgggaggccgccggcctgccccgctgtggccagagcagcgctgagacagatgcccaggaggcctggggcgaggtggccaatgaagatgctgtgaagcccagcaccctgtgccccaaggccccagacatgggctttgagatgagacatgaagatgaggaccagatcagcgagcaggacatctttgagggcctgcccggggccctgagcaaatgtcccacagaggccgtgtgccagcccctggactggggagaagattctgaaaatgaaaatgaagatgagggccagtggggcaaccccagccaggagcagtggcaggagagcagcagcgaggaggacctggagaagctgattgaccaccagggcctgtacctggccgagaagccctacaagtgtgacacctgcatgaagagcttcagccgcagcagccacttcatcgcccaccagaggatccacactggagagaagccctacaagtgcctggagtgtgggaagaacttcagtgacaggagcaacctgaacacccaccagaggatccacactggagagaagccctacaagtgcctggagtgtgggaagagcttcagtgaccacagcaacctgatcacccaccagaggatccacactggagagaagccctacaagtgtggggagtgctggaagagcttcaaccagagcagcaacctgctgaagcaccagaggatccacctgggcggcaacccagaccagtgcagcgagcccggcggcaactttgcccagagccccagcttcagcgcccactggaggaacagcacagaggagacagcccctgagcagccccagagcatcagcaaggacctgaacagccctggcccccacagcaccaacagcggggagaagctgtatgagtgcagtgaatgtggccgctccttcagcaagagcagcgccctgatcagccaccagaggatccacactggagagaagccctatgaatgtgctgaatgtgggaagagcttcagcaagagcagcaccctggccaaccaccagaggacccacactggagagaagccctacaagtgtgtggactgtgggaagtgcttcagcgagaggagcaagctgatcacccaccagagggtgcacactggagagaagccctacaagtgcctggagtgtgggaagttcttccgggacaggagcaacctgatcacccaccagaggatccacactggagagaagccctacaagtgcagagaatgtgggaagtgcttcaaccagagcagcagcctcatcatccaccagaggatccacactggagagaagccctacaagtgcacagaatgtgggaaggacttcaacaacagcagccacttcagcgcccacaggaggacccacgccggcggcaaggccagctag

SEQ ID NO: 40010 - DNA, 1284 bp, Artificial Sequence
  Description of Artificial Sequence: Synthetic coding sequence
atggccatggccctggagctgcaggcccaggccagcccccagcctgagcctgaggagctgctgattgtgaagctggaggaggacagctggggcagcgagagcaagctgtgggagaaggaccggggctctgtgtctggccctgaggccagccggcagcgcttccggcagttccagtacagagatgctgctggcccccatgaggccttcagccagctgtgggccctgtgctgccgctggctgcggcctgagatccggctgaaggagcagatcctggagctgctggtgctggagcagttcctgaccatcctgccccgggaggtgcagacctgggtgcaggcccggcaccctgagagcggggaggaggccgtggccctggtggaggactggcaccgggagaccaggacagctggccagagcggcctggagctgcacacagaggagacccggcccctgaagacaggagaggaggcccagagcttccagctgcagcctgtggacccctggccagagggccagagccagaagaagggcgtgaagaacacctgcccagacctgcccaaccacctgaatgctgaggtggccccccagcccctgaaggagagcggcgtgcctgtgtccaagcccagcaacaccagcgagaaggagcagggccctgagttctggggcctgagcctcatcaacagcggcaagaggagcacagctgactacagcctggacaatgagcccgcccaggccctgacctggagggacagccgggcctgggaggagcagtaccagtgggatgtggaggacatgaaggtgtctggagtgcactggggctatgaggagaccaagaccttcctggccatcctgtctgagagccccttcagcgagaagctgcggacctgccaccagaaccggcaggtgtaccgggccatcgccgagcagctgcgggcccggggcttcctgcggaccctggagcagtgccgctacagagtgaagaacctgctgaggaactacaggaaggccaagagcagccaccccccaggcacctgccccttctatgaggagctggaggccctggtgcgggccaggacagccatccgggccacagatggccctggagaggccgtggccctgccccggctgggctacagtgatgctgagatggatgagcaggaggagggcggctgggaccctgaggagatggccgaggactgcaatggagctggcctggtgaatgtggagagcacccagggccccagaattgctggggccccagccctcttccagagccgcatctag

SEQ ID NO: 40011 - DNA, 1302 bp, Artificial Sequence
  Description of Artificial Sequence: Synthetic coding sequence
atggccatggccctggagctgcaggcccaggccagcccccagcctgagcctgaggagctgctgattgtgaagctggaggaggacagctggggcagcgagagcaagctgtgggagaaggaccggggctctgtgtctggccctgaggccagccggcagcgcttccggcagttccagtacagagatgctgctggcccccatgaggccttcagccagctgtgggccctgtgctgccgctggctgcggcctgagatccggctgaaggagcagatcctggagctgctggtgctggagcagttcctgaccatcctgccccgggaggtgcagacctgggtgcaggcccggcaccctgagagcggggaggaggccgtggccctggtggaggactggcaccgggagaccaggacagctggccagagcggcctggagctgcacacagaggagacccggcccctgaagacaggagaggaggcccagagcttccagctgcagcctgtggacccctggccagagggccagagccagaagaagggcgtgaagaacacctgcccagacctgcccaaccacctgaatgctgaggtggccccccagcccctgaaggagagcggcgtgcctgtgtccaagcccagcaacaccagcgagaaggagcagggccctgagttctggggcctgagcctcatcaacagcggcaagaggagcacagctgactacagcctggacaatgagcccgcccaggccctgacctggagggacagccgggcctgggaggagcagtaccagtgggatgtggaggacatgaaggtgtctggagtgcactggggctatgaggagaccaagaccttcctggccatcctgtctgagagccccttcagcgagaagctgcggacctgccaccagaaccggcaggtgtaccgggccatcgccgagcagctgcgggcccggggcttcctgcggaccctggagcagtgccgctacagagtgaagaacctgctgaggaactacaggaaggccaagagcagccaccccccaggcacctgccccttctatgaggagctggaggccctggtgcgggccaggacagccatccgggccacagatggccctggagaggccgtggccctgccccggctgggctacagtgatgctgagatggatgagcaggaggagggcggctgggaccctgaggagatggccgaggactgcaatggagctggcctggtgaatgtggagagcacccagggccccagaattgctggggccccagccctcttccagagcagaattggcaagaacatgggcgtgtag

SEQ ID NO: 40012 - DNA, 2934 bp, Artificial Sequence; identical to SEQ ID NO: 40009
  Description of Artificial Sequence: Synthetic coding sequence

SEQ ID NO: 40013 - DNA, 1800 bp, Artificial Sequence
  Description of Artificial Sequence: Synthetic coding sequence
atgagcggcccctgtggggagaagcctgtgctggaggccagccccaccatgagcctgtgggagtttgaggacagccacagccggcagggcaccccccggcccggccaggagctggccgctgaggaggccagcgccctggagctgcagatgaaggtggacttcttcaggaagctgggctacagcagcacagagatccacagcgtgctgcagaagctgggcgtgcaggccgacaccaacacagtgctgggggagctggtgaagcacggcacagccacagagcgggagcggcagaccagcccagacccctgcccccagctgcccctggtgccccggggcggcggcacccccaaggcccccaacctggagccccccctgcctgaggaggagaaggagggcagtgacctgcggcctgtggtgattgatggcagcaatgtggccatgagccacggcaacaaggaggtgttcagctgccggggcatcctgctggccgtgaactggttcctggagcggggccacacagacatcaccgtgtttgtgcccagctggaggaaggagcagcccaggccagatgtgcccatcacagaccagcacatcctgcgggagctggagaagaagaagatcctggtgttcacccccagccggcgggtgggcggcaagagggtggtgtgctatgatgaccgcttcatcgtgaagctggcctatgaaagtgatggcatcgtggtgtccaatgacacctacagagacctgcagggcgagcggcaggagtggaagcgcttcatcgaggagcggctgctgatgtacagctttgtgaatgacaagttcatgcccccagatgaccccctgggccgccacggccccagcctggacaacttcctgaggaagaagcccctgaccctggagcacaggaagcagccctgcccctacggcaggaagtgcacctacggcatcaagtgccgcttcttccaccctgagcggcccagctgcccccagaggtctgtggctgatgagctgcgggccaatgccctgctgagccccccccgggcccccagcaaggacaagaatggccggcggcccagccccagcagccagagcagcagcctgctgacagaaagtgagcagtgcagcctggatggcaagaagctgggcgcccaggccagccctggcagccggcaggagggcctgacccagacctacgcccccagcggccgcagcctggcccccagcggcggcagcggcagcagctttggccccacagactggctgccccagaccctggacagcctgccctacgtgtcccaggactgcctggacagcggcatcggcagcctggagagccagatgtctgagctgtggggcgtgcggggcggcggccctggagagcccggccccccccgggccccctacacaggctacagcccctacggcagcgagctgcctgccacagctgccttcagcgccttcggccgggccatgggcgccggccacttctctgtgcctgctgactaccccccagcccccccagccttccccccccgggagtactggagcgagccctaccccctgcccccacccacctctgtgctgcaggagccccctgtgcagagccctggggccggccgcagcccctggggccgggccggcagcctggccaaggagcaggcctctgtgtacaccaagctgtgtggggtcttccccccccacctggtggaggccgtgatgggccgcttcccccagctgctggacccccagcagctggccgctgagatcctgagctacaagagccagcaccccagcgagtag

SEQ ID NO: 40014 - DNA, 1800 bp, Artificial Sequence; identical to SEQ ID NO: 40013
  Description of Artificial Sequence: Synthetic coding sequence

SEQ ID NO: 40015 - DNA, 1281 bp, Artificial Sequence
  Description of Artificial Sequence: Synthetic coding sequence
atgccacccaagaagcaggcccaggccggcggcagcaagaaggccgagcagaagaagaaggagaagatcatcgaggacaagaccttcggcctgaagaacaagaagggggccaagcagcagaagttcatcaaggctgtgacccaccaggtgaagtttggccagcagaacccccggcaggtggcccagagcgaggccgagaagaagctgaagaaggatgacaagaagaaggagctgcaggagctgaatgagctgttcaagcctgtggtggccgcccagaagatcagcaaaggagctgaccccaagtctgtggtgtgtgccttcttcaagcagggccagtgcaccaagggggacaagtgcaagttcagccatgacctgaccctggagaggaaatgtgagaagaggtctgtgtacattgatgccagagatgaggagctggagaaggacaccatggacaactgggatgagaagaagctggaggaggtggtgaacaagaagcacggggaggccgagaagaagaagcccaagacccagatcgtgtgcaagcacttcctggaggccatcgagaacaacaagtatggctggttctgggtgtgccctgggggcggggacatctgcatgtacagacatgccctgcccccaggctttgtgctgaagaaggacaagaagaaggaggagaaggaggatgagatcagcctggaggacctgattgaaagagagaggtctgccctgggccccaacgtgaccaagatcaccctggagagcttcctggcctggaagaagaggaagaggcaggagaagattgacaagctggagcaggacatggagaggaggaaggctgacttcaaggccggcaaggccctggtgatcagcggccgggaggtgtttgagttccggcctgagctggtgaatgatgatgatgaggaggctgatgacacccgctacacccagggcactggaggagatgaggtggatgacagcgtgtctgtgaatgacatcgacctgagcctgtacatccccagagatgtggatgaaacaggcatcaccgtggccagcctggagcgcttcagcacctacaccagtgacaaggatgagaacaagctgtctgaggccagcggcggccgggcagaaaatggagagaggagtgacctggaggaggacaatgaaagagagggcacagaaaatggagccattgatgctgtgcctgtggatgagaacctcttcaccggggaggacctggatgagctggaggaggagctgaacaccctggacctggaggagtag

SEQ ID NO: 40016 - DNA, 1179 bp, Artificial Sequence
  Description of Artificial Sequence: Synthetic coding sequence
atgccacccaagaagcaggcccaggccggcggcagcaagaaggccgagcagaagaagaaggagaagatcatcgaggacaagaccttcggcctgaagaacaagaagggggccaagcagcagaagttcatcaaggctgtgacccaccaggtgaagtttggccagcagaacccccggcaggtggcccagagcgaggccgagaagaagctgaagaaggatgacaagaagaaggagctgcaggagctgaatgagctgttcaagcctgtggtggccgcccagaagatcagcaaaggagctgaccccaagtctgtggtgtgtgccttcttcaagcagggccagtgcaccaagggggacaagtgcaagttcagccatgacctgaccctggagaggaaatgtgagaagaggtctgtgtacattgatgccagagatgaggagctggagaaggacaccatggacaactgggatgagaagaagctggaggaggtggtgaacaagaagcacggggaggccgagaagaagaagcccaagacccagatcgtgtgcaagcacttcctggaggccatcgagaacaacaagtatggctggttctgggtgtgccctgggggcggggacatctgcatgtacagacatgccctgcccccaggctttgtgctgaagaaggacaagaagaaggaggagaaggaggatgagatcagcctggaggacctgattgaaagagagaggtctgccctgggccccaacgtgaccaagatcaccctggagagcttcctggcctggaagaagaggaagaggcaggagaagattgacaagctggagcaggacatggagaggaggaaggctgacttcaaggccggcaaggccctggtgatcagcggccgggaggtgtttgagttccggcctgagctggtgaatgatgatgatgaggaggctgatgacacccgctacacccagggcactggaggagatgaggtggatgacagcgtgtctgtgaatgacatcgacctgagcctgtacatccccagagatgtggatgaaacaggcatcaccgtggccagcctggagcgcttcagcacctacaccagtgacaaggatgagaacaagctgtctgaggccagcggcggccgggcagaaaatggagagaggagtgacctggaggaggacaatgaaagacatgtgctgtag

SEQ ID NO: 40017 - DNA, 489 bp, Artificial Sequence
  Description of Artificial Sequence: Synthetic coding sequence
atgtacagacatgccctgcccccaggctttgtgctgaagaaggacaagaagaaggaggagaaggaggatgagatcagcctggaggacctgattgagcgggagaggtctgccctgggccccaacgtgaccaagatcaccctggagagcttcctggcctggaagaagaggaagaggcaggagaagattgacaagctggagcaggacatggagaggaggaaggctgacttcaaggccggcaaggccctggtgatcagcggccgggaggtgtttgagttccggcctgagctggtgaatgatgatgatgaggaggctgatgacacccgctacacccagggcactggaggagatgaggtgcggggcagctttgtgccccacctgctgatgctgattgaaagaaacaacaggaagtaccacaacatggtgaagagccaccagcaccagagccacagcgcctgggtgcagatcctgacccccaccatgggcaactag

SEQ ID NO: 40018 - DNA, 1269 bp, Artificial Sequence
  Description of Artificial Sequence: Synthetic coding sequence
atgttccagacagcctggaggcaggagcctgtgacctttgaagatgtggccgtgtacttcacccagaatgagtgggccagcctggacagcgtgcagagggccctgtaccgggaggtgatgctggagaactatgccaacgtggccagcctggccttccccttcaccacccctgtgctggtgtcccagctggagcagggcgagctgccctggggcctggacccctgggagcccatgggccgggaggccctgcggggcatctgccctggagatgaggccaggacagagaaggagggcctgacccccaaggaccacgtgtccaaggagacagagagcttccggctgatggtgggcggcctgcctggaaatgtgtcccagcacctggactttggcagcagcctggagcagccccagggccactggatcatcaagaccaagagcaagaggaggcacttcacagacaccagcgcccggcaccacgaggcctatgaggtgaagaatggagagaagtttgagaagctgggcaagaacatctctgtgtccacccagctgaccaccaaccagaccaaccccagcggccagatctcctatgaatgtggccagtgtggccgctacttcatccagatggctgacttccacagacatgagaagtgccacactggagagaagagctttgagtgcaaggaatgtgggaagtacttccgctacaacagcctgctgatccgccaccagatcatccacacaggcaagaagcccttcaagtgcaaggaatgtgggaagggcctgagcagtgacacagccctgatccagcaccagaggatccacactggagagaagccctatgagtgcaaggaatgtgggaaggccttcagcagcagctctgtgttcctgcagcaccagcgcttccacactggagagaagctgtatgaatgtaatgaatgctggaagaccttcagctgcagcagcagcttcaccgtgcaccagaggatgcacactggagagaagccctatgagtgcaaggaatgtgggaagaggctgagcagcaacacagccctgacccagcaccagaggatccacactggagagaagccctttgagtgcaaggaatgtgggaaggccttcaaccagaagatcaccctcatccagcaccagagggtgcacactggagagaagccctatgagtgcaaggtgtgtgggaagaccttctcctggtgtggccgcttcatcctgcaccagaagctgcacacccagaagacccctgtgcaggcctag

SEQ ID NO: 40019 - DNA, 354 bp, Artificial Sequence
  Description of Artificial Sequence: Synthetic coding sequence
atgttccagacagcctggaggcaggagcctgtgacctttgaagatgtggccgtgtacttcacccagaatgagtgggccagcctggacagcgtgcagagggccctgtaccgggaggtgatgctggagaactatgccaacgtggccagcctggccttccccttcaccacccctgtgctggtgtcccagctggagcagggcgagctgccctggggcctggacccctgggagcccatgggccgggaggccctgcggggcatctgccctggagatgaggccaggacagagaaggagggcctgacccccaaggaccacgtgtccaaggagacagagagcttccggctgatggtgggctag

SEQ ID NO: 40020 - DNA, 933 bp, Artificial Sequence
  Description of Artificial Sequence: Synthetic coding sequence
atgggcctgtgcaagtgccccaagaggaaggtgaccaacctcttctgctttgagcaccgggtgaatgtgtgtgagcactgcctggtggccaaccacgccaagtgcatcgtgcagagctacctgcagtggctgcaggacagcgactacaaccccaactgccgcctgtgcaacatccccctggccagccgggagaccacccggctggtgtgctatgacctcttccactgggcctgcctgaatgaaagagctgcccagctgcccaggaacacagccccagctggctaccagtgccccagctgcaatggccccatcttcccccccaccaacctggccggccctgtggccagcgccctgcgggagaagctggccaccgtgaactgggcccgggccggcctgggcctgcccctgattgatgaggtggtgtccccagagcctgagcccctgaacaccagtgacttcagtgactggagcagcttcaatgccagcagcaccccaggccctgaggaggtggacagcgccagcgctgccccagccttctacagccaggccccccggcccccagccagccctggccggcctgagcagcacacagtcatccacatgggcaaccctgagcccctgacccacgcccccaggaaggtgtatgacaccagagatgatgacaggaccccaggcctgcatggagactgtgatgatgacaagtacagaagaagacctgccctgggctggctggcccggctgctgcggagccgggccggcagcaggaagaggcccctgaccctgctgcagagagctggcctgctgctgctgctgggcctgctgggcttcctggccctgctggccctgatgagccggctgggccgggctgctgctgacagcgaccccaacctggaccccctgatgaacccccacatccgggtgggccccagctag

SEQ ID NO: 40021 - DNA, 567 bp, Artificial Sequence
  Description of Artificial Sequence: Synthetic coding sequence
atgggcctgtgcaagtgccccaagaggaaggtgaccaacctcttctgctttgagcaccgggtgaatgtgtgtgagcactgcctggtggccaaccacgccaagtgcatcgtgcagagctacctgcagtggctgcaggacagcgactacaaccccaactgccgcctgtgcaacatccccctggccagccgggagaccacccggctggtgtgctatgacctcttccactgggcctgcctgaatgaaagagctgcccagctgcccaggaacacagccccagctggctaccagtgccccagctgcaatggccccatcttcccccccaccaacctggccggccctgtggccagcgccctgcgggagaagctggccaccgtgaactgggcccgggccggcctgggcctgcccctgattgatgaggtggtgtccccagagcctgagcccctgaacaccagtgacttcagtgactggagcagcttcaatgccagcagcaccccaggccctgaggaggtggacagcgccagcgctgccccagccttctacagccaggccccccggcccccagcctag

SEQ ID NO: 40022 - DNA, 624 bp, Artificial Sequence
  Description of Artificial Sequence: Synthetic coding sequence
atgggcctgtgcaagtgccccaagaggaaggtgaccaacctcttctgctttgagcaccgggtgaatgtgtgtgagcactgcctggtggccaaccacgccaagtgcatcgtgcagagctacctgcagtggctgcaggacagcgactacaaccccaactgccgcctgtgcaacatccccctggccagccgggagaccacccggctggtgtgctatgacctcttccactgggcctgcctgaatgaaagagctgcccagctgcccaggaacacagccccagctggctaccagtgccccagctgcaatggccccatcttcccccccaccaacctggccggccctgtggccagcgccctgcgggagaagctggccaccgtgaactgggcccgggccggcctgggcctgcccctgattgatgaggtggtgtccccagagcctgagcccctgaacaccagtgacttcagtgactggagcagcttcaatgccagcagcaccccaggccctgaggaggtggacagcgccagcgctgccccagccttctacagccaggccccccggcccccagccagccctggccggcctgagcagcacacagtcatccacatgggcaaccctgagcccctgtag

SEQ ID NO: 40023 - DNA, 1458 bp, Artificial Sequence
  Description of Artificial Sequence: Synthetic coding sequence
atgtacaagatgaacatctgcaacaagcccagcaacaagacagcccctgagaagtctgtgtggacagccccagcccagcccagcggccccagccctgagctgcagggccagaggagcagaagaaatggctggagctggccaccccaccccctgcagatcgtggcctggctgctgtacctgttctttgctgtgattggatttggcatcctggtgcccctgctgccccaccactgggtgcctgctggctacgcctgcatgggcgccatctttgctggccacctggtggtgcacctgacagctgtgtccattgatcctgcagatgccaacgtgcgggacaagagctatgccggccccctgcccatcttcaacagaagccagcacgcccacgtgattgaggacctgcactgcaacctgtgcaatgtggatgtgtctgcccggagcaagcactgcagcgcctgcaacaagtgtgtgtgtggctttgaccaccactgcaagtggctgaacaactgtgtgggggagaggaactaccgcctcttcctgcacagcgtggccagcgccctgctgggcgtgctgctgctggtgctggtggccacctacgtgtttgtggagttctttgtgaaccccatgaggctgcggaccaacagacactttgaggtgctgaagaaccacacagatgtgtggtttgtgttcctgcctgctgcccctgtggagacccaggccccagccatcctggccctggccgccctgctgatcctgctgggcctgctgagcacagccctgctgggccacctgctgtgcttccacatctacctgatgtggcacaagctgaccacctatgagtacatcgtgcagcacaggcctccccaggaggccaagggcgtgcaccgggagctggagagctgcccccccaagatgaggcccatccaggagatggagttctacatgaggaccttccgccacatgaggcctgagcccccaggccaggccggccctgctgctgtgaatgccaagcacagcaggcctgccagcccagaccccaccccaggccggcgggactgtgccggcccccctgtgcaggtggagtgggacaggaagaagcccctgccctggaggagccccctgctgctgctggccatgtggggcccccaggccccaccctgcctgtgcaggaagaggggccgcggggcctgcatcaagtgtgagcggctgcggccccgcatcagaagaagaggcctgggccccccagctgctgccccagcccggcggcgcatccccaggaccccagccctgtgcacccccctggccctgcctgcccccaccacccggcggcggcagagcccctggacccgcttccagtggaggagaagagcctgggccgcccccctgtggccacccaggggggccggggctgacagcccccgctggaggggccggcgggtgcggccccccttctcctag

SEQ ID NO: 40024 - DNA, 1239 bp, Artificial Sequence
  Description of Artificial Sequence: Synthetic coding sequence
atggacaccaggagcggcagccagtgcagcgtgaccccagaggccatcctgaacaatgagaagctggtgctgcccccacgcatcagccgggtgaatggctggagcctgcccctgcactacttccaggtggtgacctgggccgtgtttgtgggcctgagcagcgccaccttcggcatcttcatccccttcctgccccacgcctggaagtacatcgcctacgtggtgactggaggcatcttctccttccacctggtggtgcacctgattgccagctgcattgatcctgctgacagcaatgtgcggctgatgaagaactacagccagcccatgcccctgtttgacaggagcaagcacgcccacgtgatccagaaccagttctgccacctgtgcaaggtgacagtgaacaagaagaccaagcactgcatcagctgcaacaagtgtgtgtctggctttgaccaccactgcaagtggatcaacaactgtgtgggcagcaggaactactggttcttcttcagcacagtggccagcgccacagctggcatgctgtgcctgattgccatcctgctgtatgtgctggtgcagtacctggtgaaccctggggtgctgaggacagaccccaggtatgaagatgtgaagaacatgaacacctggctgctcttcctgcccctcttccctgtgcaggtgcagaccctcatcgtggtgatcatcggcatgctggtgctgctgctggacttcctgggcctggtgcacctgggccagctgctgatcttccacatctacctgaaggccaagaagatgaccacctttgagtacctgatcaacaacaggaaggaggagagcagcaagcaccaggccgtgaggaaggacccctacgtgcagatggacaagggcgtgctgcagcagggcgctggggccctgggcagcagcgcccagggcgtgaaggccaagagcagcctgctgatccacaagcacctgtgccacttctgcacctctgtgaaccaggatggagacagcacagcccgggagggagatgaggacccctgccccagcgccctgggcgccaaggccaggaacagccgcctcatctgccggcggctgtgccagttcagcaccagggtgcacccagatggcggctccatggcccaggaggctgatgatgcccccagcatcagcaccctgggcctgcagcaggagaccacagagcccatgaagacagattctgctgagagtgaagattag

SEQ ID NO: 40025 - DNA, 1239 bp, Artificial Sequence; identical to SEQ ID NO: 40024
  Description of Artificial Sequence: Synthetic coding sequence

SEQ ID NO: 40026 - DNA, 804 bp, Artificial Sequence
  Description of Artificial Sequence: Synthetic coding sequence
atggccccctgggccctgctgagccctggggtgctggtgaggacaggccacacagtgctgacctggggcatcaccctggtgctcttcctgcatgacacagagctgcggcagtgggaggagcagggcgagctgctgctgcccctgaccttcctgctgctggtgctgggcagcctgctgctgtacctggccgtgtccctgatggaccccggctacgtgaatgtgcagccccagccccaggaggagctgaaggaggagcagacagccatggtgcccccagccatccccctgcggcgctgccgctactgcctggtgctgcagcccctgcgggcccggcactgcagagaatgtagaagatgtgtgagaagatatgaccaccactgcccctggatggagaactgtgtgggggagaggaaccaccccctgtttgtggtgtacctggccctgcagctggtggtgctgctgtggggcctgtacctggcctggagcggcctgcgcttcttccagccctggggccagtggctgcggagcagcggcctgctgtttgccaccttcctgctgctgagcctcttcagcctggtggccagcctgctgctggtgagccacctgtacctggtggccagcaacaccaccacctgggagttcatcagcagccaccgcatcgcctacctgcggcagaggcccagcaacccctttgaccggggcctgaccaggaacctggcccacttcttctgtggctggcccagcggctcctgggagaccctgtgggccgaggaggaggaggagggcagcagccctgctgtgtag

SEQ ID NO: 40027 - DNA, 648 bp, Artificial Sequence
  Description of Artificial Sequence: Synthetic coding sequence
atggccccctgggccctgctgagccctggggtgctggtgaggacaggccacacagtgctgacctggggcatcaccctggtgctcttcctgcatgacacagagctgcggcagtgggaggagcagggcgagctgctgctgcccctgaccttcctgctgctggtgctgggcagcctgctgctgtacctggccgtgtccctgatggaccccggctacgtgaatgtgcagccccagccccaggaggagctgaaggaggagcagacagccatggtgcccccagccatccccctgcggcgctgccgctactgcctggtgctgcagcccctgcgggcccggcactgcagagaatgtagaagatgtgtgagaagatatgaccaccactgcccctggatggagaactgtgtgggggagaggaaccaccccctgtttgtggtgtacctggccctgcagctggtggtgctgctgtggggcctgtacctggcctggagcggcctgcgcttcttccagccctggggccagtggctgcggagcagcggcctgctgtttgccaccttcctgctgctgagccacttcttctgtggctggcccagcggctcctgggagaccctgtgggccgaggaggaggaggagggcagcagccctgctgtgtag

SEQ ID NO: 40028 - DNA, 846 bp, Artificial Sequence
  Description of Artificial Sequence: Synthetic coding sequence
atggccccctgggccctgctgagccctggggtgctggtgaggacaggccacacagtgctgacctggggcatcaccctggtgctcttcctgcatgacacaggagagccagaccctgagcggcccaggacccaccccatcccccagctgcggcagtgggaggagcagggcgagctgctgctgcccctgaccttcctgctgctggtgctgggcagcctgctgctgtacctggccgtgtccctgatggaccccggctacgtgaatgtgcagccccagccccaggaggagctgaaggaggagcagacagccatggtgcccccagccatccccctgcggcgctgccgctactgcctggtgctgcagcccctgcgggcccggcactgcagagaatgtagaagatgtgtgagaagatatgaccaccactgcccctggatggagaactgtgtgggggagaggaaccaccccctgtttgtggtgtacctggccctgcagctggtggtgctgctgtggggcctgtacctggcctggagcggcctgcgcttcttccagccctggggccagtggctgcggagcagcggcctgctgtttgccaccttcctgctgctgagcctcttcagcctggtggccagcctgctgctggtgagccacctgtacctggtggccagcaacaccaccacctgggagttcatcagcagccaccgcatcgcctacctgcggcagaggcccagcaacccctttgaccggggcctgaccaggaacctggcccacttcttctgtggctggcccagcggctcctgggagaccctgtgggccgaggaggaggaggagggcagcagccctgctgtgtag

SEQ ID NO: 40029 - DNA, 648 bp, Artificial Sequence; identical to SEQ ID NO: 40027
  Description of Artificial Sequence: Synthetic coding sequence

SEQ ID NO: 40030 - DNA, 633 bp, Artificial Sequence
  Description of Artificial Sequence: Synthetic coding sequence
atggccccctgggccctgctgagccctggggtgctggtgaggacaggccacacagtgctgacctggggcatcaccctggtgctcttcctgcatgacacagacaagtctgcagatgagctgctggccacccacagccacagctggaaccagcacctgcaggcctttgcccagcccggcacccacttccccaccagcaactgcacccccaccccacccacccctgtgctgcccggccctgccagcctgtgcagccctgccagccctgagctgcggcagtgggaggagcagggcgagctgctgctgcccctgaccttcctgctgctggtgctgggcagcctgctgctgtacctggccgtgtccctgatggaccccggctacgtgaatgtgcagccccagccccaggaggagctgaaggaggagcagacagccatggtgcccccagccatccccctgcggcgctgccgctactgcctggtgctgcagcccctgcgggcccggcactgccgggagtgccgccgctgtgtgcggcgctatgaccaccactgcccctggatggagaactgtgtgggggagaggaaccaccccctgtttgtggtgtacctggccctgcagctggtggtgctgctgtggtag

SEQ ID NO: 40031 - DNA, 618 bp, Artificial Sequence
  Description of Artificial Sequence: Synthetic coding sequence
atggccccctgggccctgctgagccctggggtgctggtgaggacaggccacacagtgctgacctggggcatcaccctggtgctcttcctgcatgacacagagctgcggcagtgggaggagcagggcgagctgctgctgcccctgaccttcctgctgctggtgctgggcagcctgctgctgtacctggccgtgtccctgatggaccccggctacgtgaatgtgcagccccagccccaggaggagctgaaggaggagcagacagccatggtgcccccagccatccccctgcggcgctgccgctactgcctggtgctgcagcccctgcgggcccggcactgcagagaatgtagaagatgtgtgagaagatatgaccaccactgcccctggatggagaactgtgtgggggagaggaaccaccccctgtttgtggtgtacctggccctgcagctggtggtgctgctgtggggcctgtacctggcctgcacccggcccctgagccctgccccccaggtgcggccccctgtgctgcctgccctgggctctgtggtggccgtgcagagggcccctgtgcgccacctgcctgctgctgtgcccctgctggtgggcggccagccctag

SEQ ID NO: 40032 - DNA, 1467 bp, Artificial Sequence
  Description of Artificial Sequence: Synthetic coding sequence
atgcctcctgggggcggcggccccatgaaggactgtgagtacagccagatcagcacccacagcagcagccccatggagagcccccacaagaagaagaagattgctgcccggaggaagtgggaggtgtttcctggcaggaacaagttcttctgcaatggccgcatcatgatggcccggcagacaggagtcttctacctgaccctggtgctgatcctggtgaccagcggcctcttctttgcctttgactgcccctacctggccgtgaagatcaccccagccatcccagctgtggccggcatcctcttcttctttgtgatgggcaccctgctgcggaccagcttcagtgaccccggggtgctgccccgggccaccccagatgaggccgctgacctggagcggcagattgatattgccaacggcaccagcagcggcggctaccggcccccacccaggaccaaggaggtgatcatcaatggccagacagtgaagctgaagtactgcttcacctgcaagatcttccggcccccccgggccagccactgcagcctgtgtgacaactgtgtggagagatttgaccaccactgcccctgggtgggcaactgtgtgggcaagaggaactaccgcttcttctacatgttcatcctgagcctgtccttcctgactgtgttcatctttgcctttgtgatcacccacgtgatcctgcggagccagcagacaggcttcctgaatgccctgaaggacagccctgcctctgtgctggaggccgtggtgtgcttcttctctgtgtggagcatcgtgggcctgagcggcttccacacctacctgatcagcagcaaccagaccaccaatgaagacatcaagggctcctggagcaacaagaggggcaaggagaactacaacccctacagctatggcaacatcttcaccaactgctgcgtggccctgtgtggccccatcagccccagcctgattgaccggcggggctacatccagcctgacaccccccagcctgctgcccccagcaatggcatcaccatgtatggagccacccagagccagagcgacatgtgtgaccaggaccagtgcatccagagcaccaagtttgtgctgcaggccgccgccacccccctgctgcagagcgagcccagcctgaccagtgatgagctgcacctgcccgggaagccaggcctgggcaccccctgtgccagcctgaccctgggcccccccaccccaccagcctccatgcccaacctggccgaggccaccctggctgatgtgatgcccaggaaggatgagcacatgggccaccagttcctgaccccagatgaggcccccagccccccccggctgctggccgccggcagccccctggcccacagcaggaccatgcacgtgctgggcctggccagccaggacagcctgcacgaggacagcgtgcggggcctggtgaagctgagctctgtgtag

SEQ ID NO: 40033 - DNA, 1422 bp, Artificial Sequence
  Description of Artificial Sequence: Synthetic coding sequence
atgcctcctgggggcggcggccccatgaaggactgtgagtacagccagatcagcacccacagcagcagccccatggagagcccccacaagaagaagaagattgctgcccggaggaagtgggaggtgtttcctggcaggaacaagttcttctgcaatggccgcatcatgatggcccggcagacaggagtcttctacctgaccctggtgctgatcctggtgaccagcggcctcttctttgcctttgactgcccctacctggccgtgaagatcaccccagccatcccagctgtggccggcatcctcttcttctttgtgatgggcaccctgctgcggaccagcttcagtgaccccggggtgctgccccgggccaccccagatgaggccgctgacctggagcggcagattgatattgccaacggcaccagcagcggcggctaccggcccccacccaggaccaaggaggtgatcatcaatggccagacagtgaagctgaagtactgcttcacctgcaagatcttccggcccccccgggccagccactgcagcctgtgtgacaactgtgtggagagatttgaccaccactgcccctgggtgggcaactgtgtgggcaagaggaactaccgcttcttctacatgttcatcctgagcctgtccttcctgactgtgttcatctttgcctttgtgatcacccacgtgatcctgcggagccagcagacaggcttcctgaatgccctgaaggacagccctgcctctgtgctggaggccgtggtgtgcttcttctctgtgtggagcatcgtgggcctgagcggcttccacacctacctgatcagcagcaaccagaccaccaatgaagacatcaagggctcctggagcaacaagaggggcaaggagaactacaacccctacagctatggcaacatcttcaccaactgctgcgtggccctgtgtggccccatcagccccagcctgattgaccggcggggctacatccagcctgacaccccccagcctgctgcccccagcaatggcatcaccatgtatggagccacccagagccagagcgacatggccgccgccacccccctgctgcagagcgagcccagcctgaccagtgatgagctgcacctgcccgggaagccaggcctgggcaccccctgtgccagcctgaccctgggcccccccaccccaccagcctccatgcccaacctggccgaggccaccctggctgatgtgatgcccaggaaggatgagcacatgggccaccagttcctgaccccagatgaggcccccagccccccccggctgctggccgccggcagccccctggcccacagcaggaccatgcacgtgctgggcctggccagccaggacagcctgcatgaagattctgtgcggggcctggtgaagctgagctctgtgtag

SEQ ID NO: 40034 - DNA, 1479 bp, Artificial Sequence
  Description of Artificial Sequence: Synthetic coding sequence
gaggtggcccctgaggaggccggcggcggcggccccatgaaggactgtgagtacagccagatcagcacccacagcagcagccccatggagagcccccacaagaagaagaagattgctgcccggaggaagtgggaggtgtttcctggcaggaacaagttcttctgcaatggccgcatcatgatggcccggcagacaggagtcttctacctgaccctggtgctgatcctggtgaccagcggcctcttctttgcctttgactgcccctacctggccgtgaagatcaccccagccatcccagctgtggccggcatcctcttcttctttgtgatgggcaccctgctgcggaccagcttcagtgaccccggggtgctgccccgggccaccccagatgaggccgctgacctggagcggcagattgatattgccaacggcaccagcagcggcggctaccggcccccacccaggaccaaggaggtgatcatcaatggccagacagtgaagctgaagtactgcttcacctgcaagatcttccggcccccccgggccagccactgcagcctgtgtgacaactgtgtggagagatttgaccaccactgcccctgggtgggcaactgtgtgggcaagaggaactaccgcttcttctacatgttcatcctgagcctgtccttcctgactgtgttcatctttgcctttgtgatcacccacgtgatcctgcggagccagcagacaggcttcctgaatgccctgaaggacagccctgcctctgtgctggaggccgtggtgtgcttcttctctgtgtggagcatcgtgggcctgagcggcttccacacctacctgatcagcagcaaccagaccaccaatgaagacatcaagggctcctggagcaacaagaggggcaaggagaactacaacccctacagctatggcaacatcttcaccaactgctgcgtggccctgtgtggccccatcagccccagcctgattgaccggcggggctacatccagcctgacaccccccagcctgctgcccccagcaatggcatcaccatgtatggagccacccagagccagagcgacatgtgtgaccaggaccagtgcatccagagcaccaagtttgtgctgcaggccgccgccacccccctgctgcagagcgagcccagcctgaccagtgatgagctgcacctgcccgggaagccaggcctgggcaccccctgtgccagcctgaccctgggcccccccaccccaccagcctccatgcccaacctggccgaggccaccctggctgatgtgatgcccaggaaggatgagcacatgggccaccagttcctgaccccagatgaggcccccagccccccccggctgctggccgccggcagccccctggcccacagcaggaccatgcacgtgctgggcctggccagccaggacagcctgcacgaggacagcgtgcggggcctggtgaagctgagctctgtgtag

SEQ ID NO: 40035 - DNA, 891 bp, Artificial Sequence
  Description of Artificial Sequence: Synthetic coding sequence
atgaggggccagaggagcctgctgctgggccctgcccggctgtgcctgcggctgctgctgctgctgggctacagaagacgctgcccccccctgctgcggggcctggtgcagcgctggaggtatggcaaggtgtgcctgcggagcctgctgtacaacagctttggaggcagtgacacagctgtggatgctgcctttgagcctgtgtactggctggtggacaacgtcatccgctggtttggagtgggcagaaatgacatcgccaccgtgtccatctgcaagaagtgcatctaccccaagccagcccggacccaccactgcagcatctgcaacagatgtgtgctgaagatggaccaccactgcccctggctgaacaactgtgtgggccactacaaccaccgctacttcttctccttctgcttcttcatgaccctgggctgtgtgtactgcagctatggctcctgggacctcttccgggaggcctatgctgccatcgagacctaccaccagaccccaccacccaccttctccttccgggagaggatgacccacaagagcctggtgtacctgtggttcctgtgcagctctgtggccctggccctgggcgccctgactgtgtggcatgctgtgctgatcagcagaggagagaccagcattgaaagacacatcaacaagaaggagcggcggcggctgcaggccaagggccgggtcttcaggaacccctacaactacggctgcctggacaactggaaggtgttcctgggcgtggacaccggccgccactggctgaccagggtgctgctgcccagcagccacctgccccacggcaatggcatgtcctgggagcccccaccctgggtgacagcccacagcgcctctgtgatggctgtgtag

SEQ ID NO: 40036 - DNA, 1086 bp, Artificial Sequence
  Description of Artificial Sequence: Synthetic coding sequence
atgaggggccagaggagcctgctgctgggccctgcccggctgtgcctgcggctgctgctgctgctgggctacagaagacgctgcccccccctgctgcggggcctggtgcagcgctggaggtatggcaaggtgtgcctgcggagcctgctgtacaacagctttggaggcagtgacacagctgtggatgctgcctttgagcctgtgtactggctggtggacaacgtcatccgctggtttggagtggtgtttgtggtgctggtgattgtgctgaccggcagcatcgtggccatcgcctacctgtgtgtgctgcccctcatcctgcggacctacagcgtgccccggctgtgctggcacttcttctacagccactggaacctgatcctgattgtgttccactactaccaggccatcaccaccccacctggctacccaccccagggcagaaatgacatcgccaccgtgtccatctgcaagaagtgcatctaccccaagccagcccggacccaccactgcagcatctgcaacagatgtgtgctgaagatggaccaccactgcccctggctgaacaactgtgtgggccactacaaccaccgctacttcttctccttctgcttcttcatgaccctgggctgtgtgtactgcagctatggctcctgggacctcttccgggaggcctatgctgccatcgagacctaccaccagaccccaccacccaccttctccttccgggagaggatgacccacaagagcctggtgtacctgtggttcctgtgcagctctgtggccctggccctgggcgccctgactgtgtggcatgctgtgctgatcagcagaggagagaccagcattgagcggcacatcaacaagaaggagcggcggcggctgcaggccaagggccgggtcttcaggaacccctacaactacggctgcctggacaactggaaggtgttcctgggcgtggacaccggccgccactggctgaccagggtgctgctgcccagcagccacctgccccatggaaatggcatgtcctgggagcccccaccctgggtgacagcccacagcgcctctgtgatggctgtgtag

SEQ ID NO: 40037 - DNA, 1017 bp, Artificial Sequence
  Description of Artificial Sequence: Synthetic coding sequence
atgaggggccagaggagcctgctgctgggccctgcccggctgtgcctgcggctgctgctgctgctgggctacagaagacgctgcccccccctgctgcggggcctggtgcagcgctggaggtatggcaaggtgtgcctgcggagcctgctgtacaacagctttggaggcagtgacacagctgtggatgctgcctttgagcctgtgtactggctggtggacaacgtcatccgctggtttggagtggtgtttgtggtgctggtgattgtgctgaccggcagcatcgtggccatcgcctacctgtgtgtgctgcccctcatcctgcggacctacagcgtgccccggctgtgctggcacttcttctacagccactggaacctgatcctgattgtgttccactactaccaggccatcaccaccccacctggctacccaccccagggcagaaatgacatcgccaccgtgtccatctgcaagaagtgcatctaccccaagccagcccggacccaccactgcagcatctgcaacagctatggctcctgggacctcttccgggaggcctatgctgccatcgagaagatgaagcagctggacaagaacaagctgcaggccgtggccaaccagacctaccaccagaccccaccacccaccttctccttccgggagaggatgacccacaagagcctggtgtacctgtggttcctgtgcagctctgtggccctggccctgggcgccctgactgtgtggcatgctgtgctgatcagcagaggagagaccagcattgaaagacacatcaacaagaaggagcggcggcggctgcaggccaagggccgggtcttcaggaacccctacaactacggctgcctggacaactggaaggtgttcctgggcgtggacaccggccgccactggctgaccagggtgctgctgcccagcagccacctgccccacggcaatggcatgtcctgggagcccccaccctgggtgacagcccacagcgcctctgtgatggctgtgtag

SEQ ID NO: 40038 - DNA, 1086 bp, Artificial Sequence; identical to SEQ ID NO: 40036
  Description of Artificial Sequence: Synthetic coding sequence

SEQ ID NO: 40039 - DNA, 924 bp, Artificial Sequence
  Description of Artificial Sequence: Synthetic coding sequence
atgaggggccagaggagcctgctgctgggccctgcccggctgtgcctgcggctgctgctgctgctgggctacagaagacgctgcccccccctgctgcggggcctggtgcagcgctggaggtatggcaaggtgtgcctgcggagcctgctgtacaacagctttggaggcagtgacacagctgtggatgctgcctttgagcctgtgtactggctggtggacaacgtcatccgctggtttggagtggtgtttgtggtgctggtgattgtgctgaccggcagcatcgtggccatcgcctacctgtgtgtgctgcccctcatcctgcggacctacagcgtgccccggctgtgctggcacttcttctacagccactggaacctgatcctgattgtgttccactactaccaggccatcaccaccccacctggctacccaccccagggcagaaatgacatcgccaccgtgtccatctgcaagaagtgcatctaccccaagccagcccggacccaccactgcagcatctgcaacagatgtgtgctgaagatggaccaccactgccacatcctgcccccagccctgagcaagctgcccaccagcctgcggcccagcttcctgagctctgtggccctggccctgggcgccctgactgtgtggcatgctgtgctgatcagcagaggagagaccagcattgagcggcacatcaacaagaaggagcggcggcggctgcaggccaagggccgggtcttcaggaacccctacaactacggctgcctggacaactggaaggtgttcctgggcgtggacaccggccgccactggctgaccagggtgctgctgcccagcagccacctgccccatggaaatggcatgtcctgggagcccccaccctgggtgacagcccacagcgcctctgtgatggctgtgtag

SEQ ID NO: 40040 - DNA, 1134 bp, Artificial Sequence
  Description of Artificial Sequence: Synthetic coding sequence
atgaggggccagaggagcctgctgctgggccctgcccggctgtgcctgcggctgctgctgctgctgggctacagaagacgctgcccccccctgctgcggggcctggtgcagcgctggaggtatggcaaggtgtgcctgcggagcctgctgtacaacagctttggaggcagtgacacagctgtggatgctgcctttgagcctgtgtactggctggtggacaacgtcatccgctggtttggagtggtgtttgtggtgctggtgattgtgctgaccggcagcatcgtggccatcgcctacctgtgtgtgctgcccctcatcctgcggacctacagcgtgccccggctgtgctggcacttcttctacagccactggaacctgatcctgattgtgttccactactaccaggccatcaccaccccacctggctacccaccccagggcagaaatgacatcgccaccgtgtccatctgcaagaagtgcatctaccccaagccagcccggacccaccactgcagcatctgcaacagatgtgtgctgaagatggaccaccactgcccctggctgaacaactgtgtgggccactacaaccaccgctacttcttctccttctgcttcttcatgaccctgggctgtgtgtactgcagctatggctcctgggacctcttccgggaggcctatgctgccatcgagaagatgaagcagctggacaagaacaagctgcaggccgtggccaaccagacctaccaccagaccccaccacccaccttctccttccgggagaggatgacccacaagagcctggtgtacctgtggttcctgtgcagctctgtggccctggccctgggcgccctgactgtgtggcatgctgtgctgatcagcagaggagagaccagcattgagcggcacatcaacaagaaggagcggcggcggctgcaggccaagggccgggtcttcaggaacccctacaactacggctgcctggacaactggaaggtgttcctgggcgtggacaccggccgccactggctgaccagggtgctgctgcccagcagccacctgccccatggaaatggcatgtcctgggagcccccaccctgggtgacagcccacagcgcctctgtgatggctgtgtag

SEQ ID NO: 40041 - DNA, 1134 bp, Artificial Sequence; identical to SEQ ID NO: 40040
  Description of Artificial Sequence: Synthetic coding sequence

SEQ ID NO: 40042 - DNA, 642 bp, Artificial Sequence
  Description of Artificial Sequence: Synthetic coding sequence
atgaggggccagaggagcctgctgctgggccctgcccggctgtgcctgcggctgctgctgctgctgggctacagaagacgctgcccccccctgctgcggggcctggtgcagcgctggaggtatggcaaggtgtgcctgcggagcctgctgtacaacagctttggaggcagtgacacagctgtggatgctgcctttgagcctgtgtactggctggtggacaacgtcatccgctggtttggagtggtgtttgtggtgctggtgattgtgctgaccggcagcatcgtggccatcgcctacctgtgtgtgctgcccctcatcctgcggacctacagcgtgccccggctgtgctggcacttcttctacagccactggaacctgatcctgattgtgttccactactaccaggccatcaccaccccacctggctacccaccccagggcagaaatgacatcgccaccgtgtccatctgcaagaagtgcatctaccccaagccagcccggacccaccactgcagcatctgcaacagatgtgtgctgaagatggaccaccactgcccctggctgaacaactgtgtgggccactacaaccaccgctacttcttctccttctgcttcttcatgaccctgggctgtgtgtactag

SEQ ID NO: 40043 - DNA, 906 bp, Artificial Sequence
  Description of Artificial Sequence: Synthetic coding sequence
tgagctgtggatgctgcctttgagcctgtgtactggctggtggacaacgtcatccgctggtttggagtggtgtttgtggtgctggtgattgtgctgaccggcagcatcgtggccatcgcctacctgtgtgtgctgcccctcatcctgcggacctacagcgtgccccggctgtgctggcacttcttctacagccactggaacctgatcctgattgtgttccactactaccaggccatcaccaccccacctggctacccaccccagggcagaaatgacatcgccaccgtgtccatctgcaagaagtgcatctaccccaagccagcccggacccaccactgcagcatctgcaacagatgtgtgctgaagatggaccaccactgcccctggctgaacaactgtgtgggccactacaaccaccgctacttcttctccttctgcttcttcatgaccctgggctgtgtgtactgcagctatggctcctgggacctcttccgggaggcctatgctgccatcgagaagatgaagcagctggacaagaacaagctgcaggccgtggccaaccagacctaccaccagaccccaccacccaccttctccttccgggagaggatgacccacaagagcctggtgtacctgtggttcctgtgcagcagaggagagaccagcattgagcggcacatcaacaagaaggagcggcggcggctgcaggccaagggccgggtcttcaggaacccctacaactacggctgcctggacaactggaaggtgttcctgggcgtggacaccggccgccactggctgaccagggtgctgctgcccagcagccacctgccccatggaaatggcatgtcctgggagcccccaccctgggtgacagcccacagcgcctctgtgatggctgtgtag

SEQ ID NO: 40044 - DNA, 960 bp, Artificial Sequence
  Description of Artificial Sequence: Synthetic coding sequence
tgaagacgctgcccccccctgctgcggggcctggtgcagcgctggaggtatggcaaggtgtgcctgcggagcctgctgtacaacagctttggaggcagtgacacagctgtggatgctgcctttgagcctgtgtactggctggtggacaacgtcatccgctggtttggagtggtgtttgtggtgctggtgattgtgctgaccggcagcatcgtggccatcgcctacctgtgtgtgctgcccctcatcctgcggacctacagcgtgccccggctgtgctggcacttcttctacagccactggaacctgatcctgattgtgttccactactaccaggccatcaccaccccacctggctacccaccccagggcagaaatgacatcgccaccgtgtccatctgcaagaagtgcatctaccccaagccagcccggacccaccactgcagcatctgcaacagatgtgtgctgaagatggaccaccactgcccctggctgaacaactgtgtgggccactacaaccaccgctacttcttctccttctgcttcttcatgaccctgggctgtgtgtactgcagctatggctcctgggacctcttccgggaggcctatgctgccatcgagacctaccaccagaccccaccacccaccttctccttccgggagaggatgacccacaagagcctggtgtacctgtggttcctgtgcagcagaggagagaccagcattgagcggcacatcaacaagaaggagcggcggcggctgcaggccaagggccgggtcttcaggaacccctacaactacggctgcctggacaactggaaggtgttcctgggcgtggacaccggccgccactggctgaccagggtgctgctgcccagcagccacctgccccatggaaatggcatgtcctgggagcccccaccctgggtgacagcccacagcgcctctgtgatggctgtgtag

SEQ ID NO: 40045 - DNA, 729 bp, Artificial Sequence
  Description of Artificial Sequence: Synthetic coding sequence
atgaggggccagaggagcctgctgctgggccctgcccggctgtgcctgcggctgctgctgctgctgggctacagaagacgctgcccccccctgctgcggggcctggtgcagcgctggaggtatggcaaggtgtgcctgcggagcctgctgtacaacagctttggaggcagtgacacagctgtggatgctgcctttgagcctgtgtactggctggtggacaacgtcatccgctggtttggagtgggcagaaatgacatcgccaccgtgtccatctgcaagaagtgcatctaccccaagccagcccggacccaccactgcagcatctgcaacagatgtgtgctgaagatggaccaccactgcccctggctgaacaactgtgtgggccactacaaccaccgctacttcttctccttctgcttcttcatgaccctgggctgtgtgtactgcagctatggctcctgggacctcttccgggaggcctatgctgccatcgagaagatgaagcagctggacaagaacaagctgcaggccgtggccaaccagacctaccaccagaccccaccacccaccttctccttccgggagaggatgacccacaagagcctggtgtacctgtggttcctgtgcagctctgtggccctggccctgggcgccctgactgtgtggcatgctgtgctgatcagcagaggagagaccagcattgaaagacacatcaacaagaaggagtag

SEQ ID NO: 40046 - DNA, 1167 bp, Artificial Sequence
  Description of Artificial Sequence: Synthetic coding sequence
atgaaggactgtgagtaccagcagatcagccctggagctgcccccctgcctgccagccctggggcccggcggcccggccctgctgccagccccaccccaggccctggccctgcccctcctgctgccccagccccaccccgctggagcagcagcggcagcggcagcggcagcggcagcggcagcctgggccggcggcccaggaggaagtgggaggtgtttcctggcaggaaccgcttctactgcggcggccgcctgatgctggccggccacggcggcgtgtttgccctgaccctgctgctgatcctgaccaccaccggcctcttctttgtgtttgactgcccctacctggccaggaagctgaccctggccatccccatcatcgccgccatcctcttcttctttgtgatgagctgcctgctgcagaccagcttcacagatcctggcatcctgccccgggccaccgtgtgtgaggccgccgccctggagaagcagattgacaacacaggcagcagcacctacagacctccacccaggacccgggaggtgctgatcaatggccagatggtgaagctgaagtactgcttcacctgcaagatgttccggccccccaggaccagccactgcagcgtgtgtgacaactgtgtggagagatttgaccaccactgcccctgggtgggcaactgtgtgggcagaagaaactaccgcttcttctacgccttcatcctgagcctgtccttcctgacagccttcatctttgcctgtgtggtgacccacctgaccctgcgggcccagggcagcaacttcctgagcaccctgaaggagaccccagcctctgtgctggagctggtgatctgcttcttcagcatctggagcatcctgggcctgagcggcttccacacctacctggtggccagcaacctgaccaccaatgaagacatcaagggctcctggagcagcaagaggggcggggaggcctctgtgaacccctacagccacaagagcatcatcaccaactgctgtgctgtgctgtgtggccccctgccccccagcctgattgaccggcggggctttgtgcagagcgacacagtgctgcccagccccatccgcagtgatgagcccgcctgccgggccaagccagatgcctccatggtgggcggccacccctag

SEQ ID NO: 40047 - DNA, 930 bp, Artificial Sequence
  Description of Artificial Sequence: Synthetic coding sequence
atgaccctgctgacagatgccacccccctggtgaaggagccccaccccctgcccctggtgccccggccctggttcctgcccagcctgtttgctgccttcaacgtggtgctgctggtgttcttcagcggcctcttctttgccttcccctgccgctggctggcccagaatggagagtgggccttccctgtgatcaccggcagcctgtttgtgctgaccttcttcagcctggtgtccctgaacttcagtgaccccggcatcctgcaccagggcagcgctgagcagggccccctgactgtgcacgtggtgtgggtgaaccacggggccttccggctgcagtggtgccccaagtgctgcttccaccggccccccaggacctaccactgcccctggtgcaacatctgtgtggaggactttgaccaccactgcaagtgggtgaacaactgcatcggccacaggaacttccgcttcttcatgctgctggtgctgagcctgtgcctgtacagcggggccatgctggtgacctgcctgatcttcctggtgaggaccacccacctgcccttcagcacagacaaggccatcgccatcgtggtggccgtgtctgctgctggcctgctggtgcccctgagcctgctgctgctgatccaggccctgtctgtgtcctctgctgacaggacctacaagggcaaatgtcgccacctgcagggctacaacccctttgaccagggctgtgccagcaactggtacctgaccatctgtgcccccctgggccccaagtacatggccgaggccgtgcagctgcagagggtggtgggccctgactggacctccatgcccaacctgcacccccccatgagccccagcgccctgaaccccccagcccccaccagcggcagcctgcagagccgggagggcacccctggggcctggtag

SEQ ID NO: 40048 - DNA, 1104 bp, Artificial Sequence
  Description of Artificial Sequence: Synthetic coding sequence
atggcccccagcggccctggcagcagcgcccggcggcgctgcagaagagtgctgtactggatccctgtggtgttcatcaccctgctgctgggctggagctactatgcctatgccatccagctgtgcatcgtgtccatggagaacacaggagagcaggtggtgtgcctgatggcctaccacctgctgtttgccatgtttgtgtggagctactggaagaccatcttcaccctgcccatgaaccccagcaaggagttccacctgtcctatgcagagaaggacctgctggagcgggagcccagaggagaggcccaccaggaggtgctgcggcgggccgccaaggacctgcccatctacaccaggaccatgtctggggccatccgctactgtgaccgctgccagctgatcaagccagaccgctgccaccactgcagcgtgtgtgacaagtgcatcctgaagatggaccaccactgcccctgggtgaacaactgtgtgggcttcagcaactacaagttcttcctgctcttcctggcctacagcctgctgtactgcctcttcatcgccgccacagacctgcagtacttcatcaagttctggaccaacggcctgcctgacacccaggccaagttccacatcatgttcctgttctttgctgctgccatgttttctgtgtccctgagcagcctgtttggctaccactgctggctggtgtccaagaacaagagcaccctggaggccttccgcagccctgtgttcagacatggaacagacaagaatggcttcagcctgggcttcagcaagaacatgaggcaggtgtttggagatgagaagaagtactggctgctgcccatcttcagcagcctgggagatggctgcagcttccccacctgcctggtgaaccaggaccctgagcaggccagcaccccagctggcctgaacagcacagccaagaacctggagaaccaccagtttcctgccaagcccctgcgggagagccagagccacctgctgacagacagccagagctggacagagagcagcatcaaccctgggaagtgcaaggccggcatgagcaacccagccctgaccatggagaatgagacctag

SEQ ID NO: 40049 - DNA, 963 bp, Artificial Sequence
  Description of Artificial Sequence: Synthetic coding sequence
atggccccctggaccctgtggcgctgctgccagagggtggtgggctgggtgcctgtgctcttcatcacctttgtggtggtgtggagctactatgcctacgtggtggagctgtgtgtgttcaccatctttggaaatgaagaaaatggcaagacagtggtgtacctggtggccttccacctgttctttgtgatgtttgtgtggagctactggatgaccatcttcaccagccctgccagccccagcaaggagttctacctgagcaacagcgagaaggagagatatgagaaggagttcagccaggagcggcagcaggagatcctgcggcgggccgcccgggccctgcccatctacaccaccagcgccagcaagaccatccgctactgtgagaagtgccagctgatcaagccagaccgggcccaccactgcagcgcctgtgacagctgcatcctgaagatggaccaccactgcccctgggtgaacaactgtgtgggcttcagcaactacaagttcttcctgctcttcctgctgtacagcctgctgtactgcctgtttgtggccgccaccgtgctggagtacttcatcaagttctggaccaatgagctgacagacacccgggccaagttccacgtgctcttcctgttctttgtgtctgccatgttcttcatctctgtgctgagcctcttctcctaccactgctggctggtgggcaagaacagaaccaccatcgagagcttccgggcccccaccttctcctatggcccagatggaaatggcttcagcctgggctgcagcaagaactggaggcaggtgtttggagatgagaagaagtactggctgctgcccatcttcagcagcctgggagatggctgcagcttccccacccggctggtgggcatggaccctgagcaggcctctgtgaccaaccagaatgaatatgcccggcgcagcaagctgcagaggtag

SEQ ID NO: 40050 - DNA, 1065 bp, Artificial Sequence
  Description of Artificial Sequence: Synthetic coding sequence
atggccccctggaccctgtggcgctgctgccagagggtggtgggctgggtgcctgtgctcttcatcacctttgtggtggtgtggagctactatgcctacgtggtggagctgtgtgtgttcaccatctttggaaatgaagaaaatggcaagacagtggtgtacctggtggccttccacctgttctttgtgatgtttgtgtggagctactggatgaccatcttcaccagccctgccagccccagcaaggagttctacctgagcaacagcgagaaggagagatatgagaaggagttcagccaggagcggcagcaggagatcctgcggcgggccgcccgggccctgcccatctacaccaccagcgccagcaagaccatccgctactgtgagaagtgccagctgatcaagccagaccgggcccaccactgcagcgcctgtgacagctgcatcctgaagatggaccaccactgcccctgggtgaacaactgtgtgggcttcagcaactacaagttcttcctgctcttcctgctgtacagcctgctgtactgcctgtttgtggccgccaccgtgctggagtacttcatcaagttctggaccaatgagctgacagacacccgggccaagttccacgtgctcttcctgttctttgtgtctgccatgttcttcatctctgtgctgagcctcttctcctaccactgctggctggtgggcaagaacagaaccaccatcgagagcttccgggcccccaccttctcctatggcccagatggaaatggcttcagcctgggctgcagcaagaactggaggcaggtgtttggagatgagaagaagtactggctgctgcccatcttcagcagcctgggagatggctgcagcttccccacccggctggtgggcatggaccctgagcaggcctctgtgaccaaccagaatgaatatgcccggagcggcagcaaccagcccttccccatcaagcccctgtctgagagcaagaaccggctgctggacagcgagagccagtggctggagaatggagctgaggagggcatcgtgaagagcggcgtgtag

SEQ ID NO: 40051 - DNA, 1098 bp, Artificial Sequence
  Description of Artificial Sequence: Synthetic coding sequence
atggccccctggaccctgtggcgctgctgccagagggtggtgggctgggtgcctgtgctcttcatcacctttgtggtggtgtggagctactatgcctacgtggtggagctgtgtgtgttcaccatctttggaaatgaagaaaatggcaagacagtggtgtacctggtggccttccacctgttctttgtgatgtttgtgtggagctactggatgaccatcttcaccagccctgccagccccagcaaggagttctacctgagcaacagcgagaaggagagatatgagaaggagttcagccaggagcggcagcaggagatcctgcggcgggccgcccgggccctgcccatctacaccaccagcgccagcaagaccatccgctactgtgagaagtgccagctgatcaagccagaccgggcccaccactgcagcgcctgtgacagctgcatcctgaagatggaccaccactgcccctgggtgaacaactgtgtgggcttcagcaactacaagttcttcctgctcttcctgctgtacagcctgctgtactgcctgtttgtggccgccaccgtgctggagtacttcatcaagttctggaccaatgagctgacagacacccgggccaagttccacgtgctcttcctgttctttgtgtctgccatgttcttcatctctgtgctgagcctcttctcctaccactgctggctggtgggcaagaacagaaccaccatcgagagcttccgggcccccaccttctcctatggcccagatggaaatggcttcagcctgggctgcagcaagaactggaggcaggtgtttggagatgagaagaagtactggctgctgcccatcttcagcagcctgggagatggctgcagcttccccacccggctggtgggcatggaccctgagcaggcctctgtgaccaaccagaatgaatatgcccggagcagcggcagcaaccagcccttccccatcaagcccctgtctgagagcaagaaccggctgctggacagcgagagccagtggctggagaatggagctgaggagggcatcgtgaagagcggcaccaacaaccacgtgacagtggccatcgagaactag

SEQ ID NO: 40052 - DNA, 1098 bp, Artificial Sequence; identical to SEQ ID NO: 40051
  Description of Artificial Sequence: Synthetic coding sequence

SEQ ID NO: 40053 - DNA, 393 bp, Artificial Sequence
  Description of Artificial Sequence: Synthetic coding sequence
atggccccctggaccctgtggcgctgctgccagagggtggtgggctgggtgcctgtgctcttcatcacctttgtggtggtgtggagctactatgcctacgtggtggagctgtgtgtgttcaccatctttggaaatgaagaaaatggcaagacagtggtgtacctggtggccttccacctgttctttgtgatgtttgtgtggagctactggatgaccatcttcaccagccctgccagccccagcaaggagttctacctgagcaacagcgagaaggagagatatgagaaggagttcagccaggagcggcagcaggagatcctgcggcgggccgcccgggccctgcccatctacaccaccagcgccagcaagagcctgatgcagagcaccaagtag

SEQ ID NO: 40054 - DNA, 879 bp, Artificial Sequence
  Description of Artificial Sequence: Synthetic coding sequence
atgtttgtgtggagctactggatgaccatcttcaccagccctgccagccccagcaaggagttctacctgagcaacagcgagaaggagagatatgagaaggagttcagccaggagcggcagcaggagatcctgcggcgggccgcccgggccctgcccatctacaccaccagcgccagcaagaccatccgctactgtgagaagtgccagctgatcaagccagaccgggcccaccactgcagcgcctgtgacagctgcatcctgaagatggaccaccactgcccctgggtgaacaactgtgtgggcttcagcaactacaagttcttcctgctcttcctgctgtacagcctgctgtactgcctgtttgtggccgccaccgtgctggagtacttcatcaagttctggaccaatgagctgacagacacccgggccaagttccacgtgctcttcctgttctttgtgtctgccatgttcttcatctctgtgctgagcctcttctcctaccactgctggctggtgggcaagaacagaaccaccatcgagagcttccgggcccccaccttctcctatggcccagatggaaatggcttcagcctgggctgcagcaagaactggaggcaggtgtttggagatgagaagaagtactggctgctgcccatcttcagcagcctgggagatggctgcagcttccccacccggctggtgggcatggaccctgagcaggcctctgtgaccaaccagaatgaatatgcccggagcagcggcagcaaccagcccttccccatcaagcccctgtctgagagcaagaaccggctgctggacagcgagagccagtggctggagaatggagctgaggagggcatcgtgaagagcggcgtgtag

SEQ ID NO: 40055 - DNA, 798 bp, Artificial Sequence
  Description of Artificial Sequence: Synthetic coding sequence
atgggcctgcgcatccactttgtggtggacccccacggctggtgctgcatgggcctcatcgtgtttgtgtggctgtacaacatcgtgctgatccccaagatcgtgctcttcccccactatgaggagggccacatccctggcatcctgatcatcatcttctacggcatcagcatcttctgcctggtggccctggtgcgggccagcatcacagaccccggccgcctgcctgagaaccccaagatcccccatggagagcgggagttctgggagctgtgcaacaagtgcaacctgatgaggcccaagaggagccaccactgcagccgctgtggccactgtgtgcggaggatggaccaccactgcccctggatcaacaactgtgtgggggaggacaaccactggctgttcctgcagctgtgcttctacacagagctgctgacctgctacgccctgatgttctccttctgccactactactacttcctgcccctgaagaagaggaacctggacctgtttgtgttcagacatgagctggccatcatgaggctggccgccttcatgggcatcaccatgctggtgggcatcaccggcctcttctacacccagctgattggcatcatcacagacaccaccagcattgagaagatgagcaactgctgtgaggacatcagccggcccaggaagccctggcagcagaccttcagcgaggtgtttggcacccgctggaagatcctgtggttcatccccttccggcagaggcagcccctgcgggtgccctaccactttgccaaccacgtgtag

SEQ ID NO: 40056 - DNA, 792 bp, Artificial Sequence
  Description of Artificial Sequence: Synthetic coding sequence
atgctggccctgcggctgctgaatgtggtggccccagcctacttcctgtgcatcagcctggtgacctttgtgctgcagctgttcctgttcctgcccagcatgagggaggaccctgctgctgcccggctcttcagccctgccctgctgcacggggccctcttcctgttcctgagcgccaatgccctgggcaactacgtgctggtgatccagaacagcccagatgacctgggcgcctgccagggcgccagcgccaggaagaccccctgccccagccccagcacccacttctgccgggtgtgtgcccgggtgaccctgcggcatgaccaccactgcttcttcaccggcaactgcatcggcagcaggaacatgaggaactttgtgctcttctgcctgtacaccagcctggcctgcctgtacagcatggtggccggcgtggcctacatctctgctgtgctgagcatcagctttgcccaccccctggccttcctgaccctgctgcccaccagcatcagccagttcttctctggagctgtgctgggcagcgagatgtttgtgatcctgatgctgtacctgtggtttgccatcggcctggcctgtgccggcttctgctgccaccagctgctgctgatcctgcggggccagaccaggcaccaggtgaggaaaggagtggccgtgcgggcccggccctggaggaagaacctgcaggaggtgtttgggaagcgctggctgctgggcctgctggtgcccatgttcaacgtgggcagcgagagcagcaagcagcaggacaagtag

SEQ ID NO: 40057 - DNA, 126 bp, Artificial Sequence
  Description of Artificial Sequence: Synthetic coding sequence
atgctggccctgcggctgctgaatgtggtggccccagcctacttcctgtgcatcagcctggtgacctttgtgctgcagctgttcctgttcctgcccagcatgagggaggaccctgctgctgcctag

SEQ ID NO: 40058 - DNA, 330 bp, Artificial Sequence
  Description of Artificial Sequence: Synthetic coding sequence
atgctggccctgcggctgctgaatgtggtggccccagcctacttcctgtgcatcagcctggtgacctttgtgctgcagctgttcctgttcctgcccagcatgagggaggaccctgctgctgcccggctcttcagccctgccctgctgcacggggccctcttcctgttcctgagcgccaatgccctgggcaactacgtgctggtgatccagaacagcccagatgacctgggcgcctgccagggcgccagcgccaggaagaccccctgccccagccccagcacccacttctgccgggtgtgtgcccgggtgaccctgcggcatgaccactag

SEQ ID NO: 40059 - DNA, 1230 bp, Artificial Sequence
  Description of Artificial Sequence: Synthetic coding sequence
atgacccagaagggctccatgaagcctgtgaagaagaagaagacagaggagcctgagctggagcccctgtgctgctgtgagtacatcgacagaaatggagagaagaaccacgtggccacctgcctgtgtgactgccaggacctggatgagggctgtgaccgctggatcacctgcaagagcctgcagcctgagacctgtgagcgcatcatggacaccatcagtgaccggctgcgcatcccctggctgcggggggccaagaaggtgaacatcagcatcatcccccccctggtgctgctgcccgtcttcctgcacgtggcctcctggcacttcctgctgggcgtggtggtgctgaccagcctgcctgtgctggccctgtggtactactacctgacccacaggaggaaggagcagaccctcttcttcctgagcctgggcctcttcagcctgggctacatgtactacgtgttcctgcaggaggtggtgcccaagggccgggtgggccctgtgcagctggccgtgctgacctgtggcctcttcctgatcctgctggccctgcaccgggccaagaagaaccctggctacctgagcaacccagccagcggggacaggagcctgagcagcagccagctggagtgcctgagcaggaagggccaggagaagaccaagggcttccctggagctgacatgagcggcagcctgaacaacagaaccaccaaggatgaccccaagggcagcagcaagatgcctgctggcagccccaccaaggccaaggaggactggtgtgccaagtgccagctggtgcggcctgcccgggcctggcactgccgcatctgtggcatctgtgtgcggaggatggaccaccactgtgtgtggatcaacagctgtgtgggggagagcaaccaccaggccttcatcctggccctgctgatcttcctgctgacctctgtgtatggcatcaccctgaccctggacaccatctgccgggacagatctgtgttcaccgccctcttctactgccctggggtgtatgccaactacagcagcgccctgtccttcacctgtgtgtggtacagcgtcatcatcacagctggcatggcctacatcttcctgatccagctgatcaacatctcctacaacgtgacagagcgggaggtgcagcaggccctgcggcagaagacaggaagaaggctgctgtgtggcctcatcgtggacaccggcctgctgggctag

SEQ ID NO: 40060 - DNA, 447 bp, Artificial Sequence
  Description of Artificial Sequence: Synthetic coding sequence
atgacccagaagggctccatgaagcctgtgaagaagaagaagacagaggagcctgagctggagcccctgtgctgctgtgagtacatcgacagaaatggagagaagaaccacgtggccacctgcctgtgtgactgccaggacctggatgagggctgtgaccgctggatcacctgcaagagcctgcagcctgagacctgtgagcgcatcatggacaccatcagtgaccggctgcgcatcccctggctgcggggggccaagaaggtgaacatcagcatcatcccccccctggtgctgctgcccgtcttcctgcacgtggcctcctggcacttcctgctgggcgtggtggtgctgaccagcctgcctgtgctggccctgtggtactactacctgacccacaggaggaaggagcagaccctcttcttcctgagcctgggcctcttctcctag

SEQ ID NO: 40061 - DNA, 855 bp, Artificial Sequence
  Description of Artificial Sequence: Synthetic coding sequence
atgggccagccctgggccgccggcagcacagatggagccccagcccagctgcccctggtgctgacagccctgtgggccgctgctgtgggcctggagctggcctacgtgctggtgctgggccctggccccccacccctgggccccctggcccgggccctgcagctggccctggccgccttccagctgctgaacctgctgggcaatgtgggcctcttcctgcggagtgaccccagcatccggggcgtgatgctggccggccggggcctgggccagggctgggcctactgctaccagtgccagagccaggtgccccccaggagcggccactgcagcgcctgccgggtgtgcatcctgcggcgggaccaccactgccgcctgctgggccgctgtgtgggctttggaaactaccggcccttcctgtgcctgctgctgcacgccgccggcgtgctgctgcacgtgtctgtgctgctgggccctgccctgagcgccctgctgcgggcccacacccccctgcacatggccgccctgctgctgctgccctggctgatgctgctgaccggccgggtgtccctggcccagtttgccctggcctttgtgacagacacctgtgtggccggggccctgctgtgtggggccggcctgctcttccacggcatgctgctgctgcggggccagaccacctgggagtgggcccggggccagcacagctatgacctgggcccctgccacaacctgcaggccgccctgggcccccgctgggccctggtgtggctgtggcccttcctggccagccccctgcctggagatggcatcaccttccagaccacagcagatgtgggccacacagccagctag

SEQ ID NO: 40062 - DNA, 984 bp, Artificial Sequence
  Description of Artificial Sequence: Synthetic coding sequence
atgatgctgatccccacccaccacttcaggaacatcgagaggaagccagagtacctgcagcctgagaagtgtgtgcccccaccctacccaggccctgtgggcaccatgtggttcatcagagatggctgcggcatcgcctgtgccatcgtgacctggttcctggtgctgtatgcagagtttgtggtgctgtttgtgatgctgatccccagccgggactatgtgtacagcatcatcaatggaattgtgttcaacctgctggccttcctggccctggccagccactgccgggccatgctgacagaccccggggctgtgcccaagggaaatgccaccaaggagttcatcgagagcctgcagctgaagccaggccaggtggtgtacaagtgccccaagtgctgcagcatcaagccagaccgggcccaccactgcagcgtgtgcaagcgctgcatcaggaagatggaccaccactgcccctgggtgaacaactgtgtgggggagaacaaccagaagtactttgtgctcttcaccatgtacatcgccctgatcagcctgcacgccctgatcatggtgggcttccacttcctgcactgctttgaggaggactggaccacctacggcctgaaccgggaggagatggccgagaccggcatcagcctgcacgagaagatgcagcccctgaacttcagcagcacagagtgcagcagcttcagcccccccaccaccgtcatcctgctgatcctgctgtgctttgagggcctgctcttcctgatcttcacctctgtgatgtttggcacccaggtgcacagcatctgcacagatgaaacaggaattgagcagctgaagaaggaggagcggcgctgggccaagaagaccaagtggatgaacatgaaggctgtgtttggccaccccttcagcctgggctgggccagcccctttgccaccccagaccagggcaaggctgacccctaccagtatgtggtgtag

SEQ ID NO: 40063 - DNA, 588 bp, Artificial Sequence
  Description of Artificial Sequence: Synthetic coding sequence
atcaagccagaccgggcccaccactgcagcgtgtgcaagcgctgcatcaggaagatggaccaccactgcccctgggtgaacaactgtgtgggggagaacaaccagaagtactttgtgctcttcaccatgtacatcgccctgatcagcctgcacgccctgatcatggtgggcttccacttcctgcactgctttgaggaggactggaccaagtgcagcagcttcagcccccccaccaccgtcatcctgctgatcctgctgtgctttgagggcctgctcttcctgatcttcacctctgtgatgtttggcacccaggtgcacagcatctgcacagatgaaacaggaattgagcggctgaagaggaagaaccagccccgggagcacatgggctcctggcagagcgtgaaggagaccttcggcggggacttcagcctgaactggttcaaccccttcagccggccctgccagcctgagatccccagcgacaaggacatggtgcggcaggtgaccagcctgagtgacacagagaccatggaggaccccagcgaggagaccaaggatgaagattctgtggaggtgacagatgaatag

SEQ ID NO: 40064 - DNA, 900 bp, Artificial Sequence
  Description of Artificial Sequence: Synthetic coding sequence
atgatgctgatccccacccaccacttcaggaacatcgagaggaagccagagtacctgcagcctgagaagtgtgtgcccccaccctacccaggccctgtgggcaccatgtggttcatcagagatggctgcggcatcgcctgtgccatcgtgacctggttcctggtgctgtatgcagagtttgtggtgctgtttgtgatgctgatccccagccgggactatgtgtacagcatcatcaatggaattgtgttcaacctgctggccttcctggccctggccagccactgccgggccatgctgacagaccccggggctgtgcccaagggaaatgccaccaaggagttcatcgagagcctgcagctgaagccaggccaggtggtgtacaagtgccccaagtgctgcagcatcaagccagaccgggcccaccactgcagcgtgtgcaagcgctgcatcaggaagatggaccaccactgcccctgggtgaacaactgtgtgggggagaacaaccagaagtactttgtgctcttcaccatgtacatcgccctgatcagcctgcacgccctgatcatggtgggcttccacttcctgcactgctttgaggaggactggaccaagtgcagcagcttcagcccccccaccaccgtcatcctgctgatcctgctgtgctttgagggcctgctcttcctgatcttcacctctgtgatgtttggcacccaggtgcacagcatctgcacagatgaaacaggaattgagcagctgaagaaggaggagcggcgctgggccaagaagaccaagtggatgaacatgaaggctgtgtttggccaccccttcagcctgggctgggccagcccctttgccaccccagaccagggcaaggctgacccctaccagtatgtggtgtag

SEQ ID NO: 40065 - DNA, 1035 bp, Artificial Sequence
  Description of Artificial Sequence: Synthetic coding sequence
atggacttcctggtgctcttcctgttctacctggcctctgtgctgatgggcctggtgctgatctgtgtgtgcagcaagacccacagcctgaagggcctggcccggggcggggcccagatcttcagctgcatcatcccagaatgtctgcagagagctgtgcacggcctgctgcactacctgttccacaccaggaaccacaccttcatcgtgctgcacctggtgctgcagggcatggtgtacacagagtacacctgggaggtgtttggctactgccaggagctggagctgagcctgcactacctgctgctgccctacctgctgctgggcgtgaacctcttcttcttcaccctgacctgtggcaccaaccctggcatcatcaccaaggccaatgagctgctcttcctgcacgtgtatgaatttgatgaggtgatgttccccaagaatgtgcgctgcagcacctgtgacctgaggaagccagcccggagcaagcactgcagcgtgtgcaactggtgtgtgcacagatttgaccaccactgtgtgtgggtgaacaactgcatcggggcctggaacatccgctacttcctgatctacgtgctgaccctgacagccagcgctgccaccgtggccatcgtgtccaccaccttcctggtgcacctggtggtgatgtctgacctgtaccaggagacctacattgatgacctgggccacctgcacgtgatggacaccgtcttcctgatccagtacctgttcctgaccttcccccgcatcgtgttcatgctgggctttgtggtggtgctgtccttcctgctgggcggctacctgctgtttgtgctgtacctggccgccaccaaccagaccaccaatgagtggtacagaggagactgggcctggtgccagcgctgccccctggtggcctggcccccatctgctgagccccaggtgcacaggaacatccacagccacggcctgcggagcaacctgcaggagatcttcctgcctgccttcccctgccacgagaggaagaagcaggagtag

SEQ ID NO: 40066 - DNA, 1035 bp, Artificial Sequence; identical to SEQ ID NO: 40065
  Description of Artificial Sequence: Synthetic coding sequence

SEQ ID NO: 40067 - DNA, 1035 bp, Artificial Sequence; identical to SEQ ID NO: 40065
  Description of Artificial Sequence: Synthetic coding sequence

SEQ ID NO: 40068 - DNA, 1035 bp, Artificial Sequence; identical to SEQ ID NO: 40065
  Description of Artificial Sequence: Synthetic coding sequence

SEQ ID NO: 40069 - DNA, 1035 bp, Artificial Sequence; identical to SEQ ID NO: 40065
  Description of Artificial Sequence: Synthetic coding sequence

SEQ ID NO: 40070 - DNA, 1035 bp, Artificial Sequence; identical to SEQ ID NO: 40065
  Description of Artificial Sequence: Synthetic coding sequence

SEQ ID NO: 40071 - DNA, 498 bp, Artificial Sequence
  Description of Artificial Sequence: Synthetic coding sequence
atggacttcctggtgctcttcctgttctacctggcctctgtgctgatgggcctggtgctgatctgtgtgtgcagcaagacccacagcctgaagggcctggcccggggcggggcccagatcttcagctgcatcatcccagaatgtctgcagagagctgtgcacggcctgctgcactacctgttccacaccaggaaccacaccttcatcgtgctgcacctggtgctgcagggcatggtgtacacagagtacacctgggaggtgtttggctactgccaggagctggagctgagcctgcactacctgctgctgccctacctgctgctgggcgtgaacctcttcttcttcaccctgacctgtggcaccaaccctggcatcatcaccaaggccaatgagctgctcttcctgcacgtgtatgaatttgatgaggtgatgttccccaagaatgtgcgctgcagcacctgtgacctgaggaagccagcccggagcaagcactgctag

SEQ ID NO: 40072 - DNA, 2148 bp, Artificial Sequence
  Description of Artificial Sequence: Synthetic coding sequence
atgcctgctgagagcggcaagcgcttcaagcccagcaaatatgtgcctgtgtctgctgctgccatcttcctggtgggcgccaccaccctcttctttgccttcacctgccccggcctgagcctgtatgtgtccccagctgtgcccatctacaatgccatcatgttcctgtttgtgctggccaacttctccatggccaccttcatggaccccggcatcttccccagggctgaggaggatgaggacaaggaggatgacttccgggcccccctgtacaagacagtggagatcaagggcatccaggtgaggatgaagtggtgtgccacctgccgcttctaccggcccccacgctgcagccactgcagcgtgtgtgacaactgtgtggaggagtttgaccaccactgcccctgggtgaacaactgcattggaagaagaaactaccgctacttcttcctgttcctgctgagcctgacagcccacatcatgggcgtgtttggcttcggcctgctgtatgtgctgtaccacatcgaggagctgtctggagtgaggacagctgtgaccatggctgtgatgtgtgtggccggcctcttcttcatccctgtggccggcctgaccggcttccacgtggtgctggtggcccggggccgcaccaccaatgagcaggtgacaggcaagttccggggcggcgtgaaccccttcaccaacggctgctgcaacaacgtgtcccgggtgctgtgcagcagccctgccccccgctacctgggccggcccaagaaggagaagaccatcgtcatccggccccccttcctgcggcctgaggtgtctgatggccagatcaccgtgaagatcatggacaatggcatccagggcgagctgcggaggaccaagagcaagggcagcctggagatcacagagagccagagcgcagatgctgagcccccacctccacccaagccagacctgagccgctacacaggcctgcggacccacctgggcctggccaccaatgaagacagcagcctgctggccaaggacagcccccccacccccaccatgtacaagtaccggcccggctacagcagcagcagcaccagcgctgccatgccccacagcagcagcgccaagctgagcagaggagacagcctgaaggagcccaccagcattgctgagagcagccgccaccccagctacagaagtgagcccagcctggagcctgagagcttccgcagccccaccttcggcaagagcttccactttgaccccctgagcagcggcagccgcagcagcagcctgaagagcgcccagggcaccggctttgagctgggccagctgcagagcatccgctctgagggcaccaccagcaccagctacaagagcctggccaaccagaccagaaatggcagcctgtcctatgacagcctgctgacccccagcgacagcccagactttgagagcgtgcaggccggccctgagccagacccccccctgggctacaccagccccttcctgagcgcccggctggcccagcagcgggaggccgagcggcacccccggctggtgcccaccggccccacccaccgggagcccagccctgtgcgctatgacaacctgagccgccacatcgtggccagcctgcaggagcgggagaagctgctgcggcagagcccccccctgcccggccgggaggaggagcccggcctgggggacagcggcatccagagcaccccaggcagcggccacgcccccaggaccagcagcagcagtgatgacagcaagaggagccccctgggcaagacccccctgggccggcctgctgtgcccaggtttgggaagccagatggcctgcggggccggggcgtgggcagccctgagcccggccccacagccccctacctgggccgctccatgagctacagcagccagaaggcccagcccggggtgtctgaaacagaggaggtggccctgcagcccctgctgacccccaaggatgaggtgcagctgaagaccacctacagcaagagcaatggccagcccaagagcctgggcagcgccagccctggccctggccagccccccctgagcagccccacccggggcggcgtgaagaaggtgtctggagtgggcggcaccacctatgagatctctgtgtag

SEQ ID NO: 40073 - DNA, 1989 bp, Artificial Sequence
  Description of Artificial Sequence: Synthetic coding sequence
atgttcctgtttgtgctggccaacttctccatggccaccttcatggaccccggcatcttccccagggcagaagaagatgaggacaaggaggatgacttccgggcccccctgtacaagacagtggagatcaagggcatccaggtgaggatgaagtggtgtgccacctgccgcttctacagaccaccccgctgcagccactgcagcgtgtgtgacaactgtgtggaggagtttgaccaccactgcccctgggtgaacaactgcatcggcagaagaaactaccgctacttcttcctgttcctgctgagcctgacagcccacatcatgggcgtgtttggatttggcctgctgtatgtgctgtaccacatcgaggagctgagcggcgtgaggacagctgtgaccatggctgtgatgtgtgtggccggcctcttcttcatccctgtggccggcctgaccggcttccacgtggtgctggtggcccggggccgcaccaccaatgagcaggtgacaggcaagttccggggcggcgtgaaccccttcaccaacggctgctgcaacaacgtgtcccgggtgctgtgcagcagccctgccccccgctacctgggccggcccaagaaggagaagaccatcgtcatccggccccccttcctgcggcctgaggtgtctgatggccagatcaccgtgaagatcatggacaatggcatccagggcgagctgcggaggaccaagagcaagggcagcctggagatcacagagagccagagcgcagatgctgagcccccacctccacccaagccagacctgagccgctacacaggcctgcggacccacctgggcctggccaccaatgaagacagcagcctgctggccaaggacagcccccccacccccaccatgtacaagtacagacctggctacagcagcagcagcaccagcgctgccatgccccacagcagcagcgccaagctgagcagaggagacagcctgaaggagcccaccagcattgctgagagcagccgccaccccagctacagaagtgagcccagcctggagcctgagagcttccgcagccccaccttcggcaagagcttccactttgaccccctgagcagcggcagccgcagcagcagcctgaagagcgcccagggcactggatttgagctgggccagctgcagagcatccgctctgagggcaccaccagcaccagctacaagagcctggccaaccagaccagaaatggcagcctgtcctatgacagcctgctgacccccagcgacagcccagactttgaatctgtgcaggccggccctgagccagacccccccctgggctacaccagccccttcctgagcgcccggctggcccagcagcgggaggccgagcggcacccccggctggtgcccaccggccccacccaccgggagcccagccctgtgcgctatgacaacctgagccgccacatcgtggccagcctgcaggagcgggagaagctgctgcggcagagcccccccctgcccggccgggaggaggagcccggcctgggggacagcggcatccagagcaccccaggcagcggccacgcccccaggaccagcagcagcagtgatgacagcaagaggagccccctgggcaagacccccctgggccggcctgctgtgcccaggtttgggaagccagatggcctgcggggccggggcgtgggcagccctgagcccggccccacagccccctacctgggccgctccatgagctacagcagccagaaggcccagcccggggtgtctgaaacagaggaggtggccctgcagcccctgctgacccccaaggatgaggtgcagctgaagaccacctacagcaagagcaatggccagcccaagagcctgggcagcgccagccctggccctggccagccccccctgagcagccccacccggggcggcgtgaagaaggtgtctggagtgggcggcaccacctatgagatctctgtgtag

SEQ ID NO: 40074 - DNA, 1230 bp, Artificial Sequence
  Description of Artificial Sequence: Synthetic coding sequence
atgggcaccttctgcagcgtcatcaagtttgagaacctgcaggagctgaagaggctgtgccactggggccccatcatcgccctgggcgtgattgccatctgcagcaccatggccatgattgacagcgtgctgtggtactggcccctgcacaccaccggcggctctgtgaacttcatcatgctgatcaactggacagtgatgatcctgtacaactacttcaatgccatgtttgtgggccctggctttgtgcccctgggctggaagccagacaccatgtacctgcagtactgcaaggtgtgccaggcctacaaggcccccaggagccaccactgcaggaagtgcaacagatgtgtgatgaagatggaccaccactgcccctggatcaacaactgctgcggctaccagaaccacgccagcttcaccctcttcctgctgctggcccccctgggctgcatccacgccgccttcatctttgtgatgaccatgtacacccagctgtaccaccggctgagctttggctggaacacagtgaagattgacatgtctgctgcccggcgggaccccctgcccatcgtgcccttcggcctggccgcctttgccaccaccctgtttgccctgggcctggccctgggcaccaccatcgctgtgggcatgctgttcttcatccagatgaagatcatcctgaggaacaagaccagcattgagagctggattgaggagaaggccaaggaccgcatccagtactaccagctggatgaggtgtttgtgttcccctatgacatgggcagccgctggaggaacttcaagcaggtgttcacctggagcggcgtgcctgaaggagatggcctggagtggcctgtgcgggagggctgccaccagtacagcctgaccatcgagcagctgaagcagaaggctgacaagagggtgcgctctgtgcgctacaaggtgattgaggactacagcggggcctgctgccccctgaacaagggcatcaagaccttcttcaccagcccctgcacagaggagccccgcatccagctgcagaagggggagttcatcctggccacccggggcctgcgctactggctgtatggagacaagatcctggatgacagcttcatcgagggcgtgagccgcatccggggctggttccccaggaaatgtgtggagaagtgcccctgtgatgctgagacagaccaggcccctgagggggagaagaagaacagatag

SEQ ID NO: 40075 - DNA, 1242 bp, Artificial Sequence
  Description of Artificial Sequence: Synthetic coding sequence
atgggcaccttctgcagcgtcatcaagtttgagaacctgcaggagctgaagaggctgtgccactggggccccatcatcgccctgggcgtgattgccatctgcagcaccatggccatgattgacagcgtgctgtggtactggcccctgcacaccaccggcggctctgtgaacttcatcatgctgatcaactggacagtgatgatcctgtacaactacttcaatgccatgtttgtgggccctggctttgtgcccctgggctggaagccagagatcagccaggacaccatgtacctgcagtactgcaaggtgtgccaggcctacaaggcccccaggagccaccactgcaggaagtgcaacagatgtgtgatgaagatggaccaccactgcccctggatcaacaactgctgcggctaccagaaccacgccagcttcaccctcttcctgctgctggcccccctgggctgcatccacgccgccttcatctttgtgatgaccatgtacacccagctgtaccaccggctgagctttggctggaacacagtgaagattgacatgtctgctgcccggcgggaccccctgcccatcgtgcccttcggcctggccgcctttgccaccaccctgtttgccctgggcctggccctgggcaccaccatcgctgtgggcatgctgttcttcatccagatgaagatcatcctgaggaacaagaccagcattgagagctggattgaggagaaggccaaggaccgcatccagtactaccagctggatgaggtgtttgtgttcccctatgacatgggcagccgctggaggaacttcaagcaggtgttcacctggagcggcgtgcctgaaggagatggcctggagtggcctgtgcgggagggctgccaccagtacagcctgaccatcgagcagctgaagcagaaggctgacaagagggtgcgctctgtgcgctacaaggtgattgaggactacagcggggcctgctgccccctgaacaagggcatcaagaccttcttcaccagcccctgcacagaggagccccgcatccagctgcagaagggggagttcatcctggccacccggggcctgcgctactggctgtatggagacaagatcctggatgacagcttcatcgagggcgtgagccgcatccggggctggttccccaggaaatgtgtggagaagtgcccctgtgatgctgagacagaccaggcccctgagggggagaagaagaacagatag

SEQ ID NO: 40076 - DNA, 927 bp, Artificial Sequence
  Description of Artificial Sequence: Synthetic coding sequence
atgcagcccagcggccaccggctgagagatgtggagcaccaccccctgctggctgaaaatgacaactatgacagcagcagcagcagcagcagcgaggctgatgtggccgacagagtgtggttcatcagagatggctgcggcatgatctgtgctgtgatgacctggctgctggtggcctatgctgactttgtggtgacctttgtgatgctgctgcccagcaaggacttctggtacagcgtggtgaatggagtcatcttcaactgcctggccgtgctggccctgagcagccacctgcggaccatgctgacagatcctggagctgtgcccaagggaaatgccaccaaggagtacatggagagcctgcagctgaagccaggagaggtgatctacaagtgccccaagtgctgctgcatcaagccagagcgggcccaccactgcagcatctgcaagcgctgcatcaggaagatggaccaccactgcccctgggtgaacaactgtgtgggggagaagaaccagcgcttctttgtgctcttcaccatgtacatcgccctgagctctgtgcacgccctgatcctgtgtggcttccagttcatcagctgtgtgcggggccagtggacagaatgtagtgacttcagcccccccatcaccgtcatcctgctgatcttcctgtgcctggagggcctgctcttcttcaccttcaccgctgtgatgtttggcacccagatccacagcatctgcaatgatgaaacagaaattgaaaggctgaagtctgagaagcccacctgggagcggcggctgcgctgggagggcatgaagtctgtgtttggaggcccccccagcctgctgtggatgaacccctttgtgggcttccgcttccggcggctgcccacccggcccaggaaaggaggccctgagttctctgtgtag

SEQ ID NO: 40077 - DNA, 1038 bp, Artificial Sequence
  Description of Artificial Sequence: Synthetic coding sequence
atgcagcccagcggccaccggctgagagatgtggagcaccaccccctgctggctgaaaatgacaactatgacagcagcagcagcagcagcagcgaggctgatgtggccgacagagtgtggttcatcagagatggctgcggcatgatctgtgctgtgatgacctggctgctggtggcctatgctgactttgtggtgacctttgtgatgctgctgcccagcaaggacttctggtacagcgtggtgaatggagtcatcttcaactgcctggccgtgctggccctgagcagccacctgcggaccatgctgacagatcctgagaagagcagtgactgccggcccagcgcctgcaccgtgaagacaggcctggaccccaccctggtgggcatctgtggggagggcacagagagcgtgcagagcctgctgctgggcgctgtgcccaagggaaatgccaccaaggagtacatggagagcctgcagctgaagccaggagaggtgatctacaagtgccccaagtgctgctgcatcaagccagagcgggcccaccactgcagcatctgcaagcgctgcatcaggaagatggaccaccactgcccctgggtgaacaactgtgtgggggagaagaaccagcgcttctttgtgctcttcaccatgtacatcgccctgagctctgtgcacgccctgatcctgtgtggcttccagttcatcagctgtgtgcggggccagtggacagagtgcagcgacttcagcccccccatcaccgtcatcctgctgatcttcctgtgcctggagggcctgctcttcttcaccttcaccgctgtgatgtttggcacccagatccacagcatctgcaatgatgaaacagaaattgagcggctgaagtctgagaagcccacctgggagcggcggctgcgctgggagggcatgaagtctgtgtttggaggcccccccagcctgctgtggatgaacccctttgtgggcttccgcttccggcggctgcccacccggcccaggaagggcggccctgagttctctgtgtag

SEQ ID NO: 40078 - DNA, 4620 bp, Artificial Sequence
  Description of Artificial Sequence: Synthetic coding sequence
atggacagctacttcaaggctgctgtgtctgacctggacaagctgctggatgactttgagcagaacccagatgagcaggactacctgcaggatgtgcagaatgcctatgacagcaaccactgcagcgtgtcctctgagctggccagcagccagaggaccagcctgctgcccaaggaccaggagtgtgtgaacagctgtgccagcagcgagaccagctatggcaccaatgaaagcagcctgaatgagaagaccctgaagggcctgaccagcatccagaatgagaagaatgtgacaggcctggacctgctgagctctgtggatggcggcaccagtgatgagatccagcccctgtacatgggccgctgcagcaagcccatctgtgacctgatcagtgacatgggcaacctggtgcacgccaccaacagcgaggaggacatcaagaagctgctgcctgatgacttcaagagcaatgctgacagcctcatcggcctggacctgagctctgtgtctgacaccccctgtgtgagcagcacagaccatgacagcgacacagtgcgggagcagcagaatgacatcagcagcgagctgcagaaccgggagattggaggcatcaaggagctgggcatcaaggtggacaccaccctgagtgacagctacaactacagcggcacagagaacctgaaggacaagaagatcttcaaccagctggagagcatcgtggacttcaacatgagcagcgccctgacccggcagagcagcaagatgtttcatgccaaggacaagctgcagcacaagagccagccctgtggcctgctgaaggatgtgggcctggtgaaggaggaggtggatgtggccgtcatcacagctgctgaatgtctgaaggaggagggcaagaccagcgccctgacctgcagcctgcccaagaatgaagacctgtgcctgaatgacagcaacagcagagatgagaacttcaagctgcctgacttctccttccaggaggacaagacagtcatcaagcagagcgcccaggaggacagcaagagcctggacctgaaggacaatgatgtgatccaggacagcagcagcgccctgcacgtgagcagcaaggatgtgcccagcagcctgagctgcctgcctgccagcggctccatgtgtggcagcctgattgagagcaaggcccggggggacttcctgccccagcacgagcacaaggacaacatccaggatgctgtgaccatccacgaggagatccagaacagcgtggtgctgggcggggagcccttcaaggaaaatgacctgctgaagcaggagaagtgcaagagcatcctgctgcagagcctcatcgagggcatggaggacaggaagattgatcctgaccagaccgtcatccgggcagagagcctggatggaggagacaccagcagcacagtggtggagagccaggagggcctgagcggcacccacgtgcctgagagcagtgactgctgtgagggcttcatcaacaccttcagcagcaatgacatggatggccaggacctggactacttcaacattgatgaaggagccaagagcggccccctcatcagtgatgctgagctggatgccttcctgacagagcagtacctgcagaccaccaacatcaagagctttgaggagaatgtgaatgacagcaagagccagatgaaccagattgacatgaagggcctggatgatggcaacatcaacaacatctacttcaatgctgaggccggggccatcggggagagccacggcatcaacatcatctgtgagatcgtggacaagcagaacaccattgaaaatggcctgagcctgggggagaagagcaccatccctgtgcagcagggcctgcccaccagcaagtctgagatcaccaaccagctgtctgtgtctgacatcaacagccagagcgtgggcggggcccggcccaagcagctgttcagcctgcccagcaggaccaggagcagcaaggacctgaacaagccagatgtgcctgacaccatcgagagcgagcccagcacagctgacacagtggtgcccatcacctgtgccatcgacagcacagctgacccccaggtgtccttcaacagcaactacatcgacatcgagagcaacagcgagggcggcagcagctttgtgacagccaatgaagattctgtgcctgagaacacctgcaaggagggcctggtgctgggccagaagcagcccacctgggtgcctgacagcgaggcccccaactgcatgaactgccaggtgaagttcaccttcaccaagagaagacaccactgccgggcctgtgggaaggtgttctgtggggtgtgctgcaacaggaagtgcaagctgcagtacctggagaaggaggcccgggtgtgtgtggtgtgctatgagaccatcagcaaggcccaggcctttgagaggatgatgagccccaccggcagcaacctgaagagcaaccacagtgatgagtgcaccaccgtgcagcccccccaggagaaccagaccagcagcatccccagccctgccaccctgcctgtgtctgccctgaagcagcccggggtggagggcctgtgcagcaaggagcagaagagggtgtggtttgctgatggcatcctgcccaatggagaggtggccgacaccaccaagctgagcagcggcagcaagcgctgcagcgaggacttcagccccctgagcccagatgtgcccatgacagtgaacacagtggaccacagccacagcaccaccgtggagaagcccaacaatgagaccggggacatcaccagaaatgagatcatccagagccccatcagccaggtgcccagcgtggagaagctgtccatgaacacaggaaatgaaggcctgcccaccagcggcagcttcaccctggatgatgatgtgtttgctgagacagaggagcccagcagccccaccggggtgctggtgaacagcaacctgcccatcgccagcatcagtgactaccgcctgctgtgtgacatcaacaagtatgtgtgcaacaagatcagcctgctgcccaatgatgaggacagcctgccccccctgctggtggccagcggggagaagggctctgtgcctgtggtggaggagcaccccagccatgagcagatcatcctgctgctggagggggagagcttccaccctgtgacctttgtgctgaatgccaacctgctggtgaatgtgaagttcatcttctacagcagtgacaagtactggtacttcagcaccaacggcctgcacggcctgggccaggccgagatcatcatcctgctgctgtgcctgcccaatgaagacaccatccccaaggacatcttccgcctcttcatcaccatctacaaggatgccctgaagggcaagtacatcgagaacctggacaacatcaccttcacagagagcttcctgagcagcaaggaccatggaggcttcctgttcatcacccccaccttccagaagctggatgacctgagcctgcccagcaaccccttcctgtgtggcatcctgatccagaagctggagatcccctgggccaaggtgttccccatgaggctgatgctgcggctgggcgctgagtacaaggcctacccagcccccctgaccagcatccggggcaggaagcccctgtttggagaaattggccacaccatcatgaacctgctggtggacctgaggaactaccagtacaccctgcacaacatcgaccagctgctgatccacatggagatgggcaagagctgcatcaagatccccaggaagaagtacagtgatgtgatgaaggtgctgaacagcagcaatgagcacgtgatcagcatcggggccagcttcagcacagaggccgacagccacctggtgtgcatccagaatgatggcatctatgagacccaggccaacagcgccaccggccaccccaggaaggtgactggagccagctttgtggtgttcaacggggccctgaagaccagcagcggcttcctggccaagagcagcatcgtggaggatggcctgatggtgcagatcaccccagagaccatgaatggcctgcggctggccctgcgggagcagaaggacttcaagatcacctgtgggaaggtggatgctgtggacctgcgggagtatgtggacatctgctgggtggatgctgaggagaagggcaacaagggcgtcatcagctctgtggatggcatcagcctgcagggcttccccagcgagaagatcaagctggaggccgactttgaaacagatgagaagatcgtgaagtgcacagaggtgttctacttcctgaaggaccaggacctgagcatcctgagcaccagctaccagtttgccaaggagatcgccatggcctgcagcgctgccctgtgcccccacctgaagaccctgaagagcaatggcatgaacaagattggcctgcgggtgtccattgacacagacatggtggagttccaggccggcagcgagggccagctgctgccccagcactacctgaatgacctggacagcgccctgatccctgtgatccacggcggcaccagcaacagcagcctgcccctggagattgagctggtgttcttcatcatcgagcacctgttctag

SEQ ID NO: 40079 - DNA, 4620 bp, Artificial Sequence; identical to SEQ ID NO: 40078
  Description of Artificial Sequence: Synthetic coding sequence

SEQ ID NO: 40080 - DNA, 4620 bp, Artificial Sequence; identical to SEQ ID NO: 40078
  Description of Artificial Sequence: Synthetic coding sequence

SEQ ID NO: 40081 - DNA, 2355 bp, Artificial Sequence
  Description of Artificial Sequence: Synthetic coding sequence
atggccagcctggatgatcctggagaggtgcgggagggcttcctgtgccccctgtgcctgaaggacctgcagagcttctaccagctgcacagccactatgaggaggagcacagcggggaggacagagatgtgaagggccagatcaagagcctggtgcagaaggccaagaaggccaaggaccggctgctgaagcgggagggagatgacagagctgagagcggcacccagggctatgagagcttctcctatggaggagtggacccctacatgtgggagccccaggagctgggcgctgtgcgcagccacctgagtgacttcaagaagcacagagctgccagaattgaccactacgtggtggaggtgaacaagctgatcatccggctggagaagctgacagcctttgacaggaccaacacagaaagtgccaagatccgggccatcgagaagtctgtggtgccctgggtgaatgaccaggatgtgcccttctgcccagactgtggcaacaagttcagcatccggaacagaagacaccactgccgcctgtgtggcagcatcatgtgcaagaagtgcatggagctgatcagcctgcccctggccaacaagctgaccagcgccagcaaggagagcctgagcacccacaccagccccagccagagccccaacagcgtgcacggcagcagaagaggcagcatcagctccatgagctctgtgtcctctgtgctggatgagaaggatgatgaccgcatccgctgctgcacccactgcaaggacaccctgctgaagcgggagcagcagattgatgagaaggagcacaccccagacatcgtgaagctgtatgagaagctgcggctgtgcatggagaaggtggaccagaaggcccctgagtacatccgcatggccgccagcctgaatgctggggagaccacctacagcctggagcacgccagtgacctgcgggtggaggtgcagaaggtgtatgagctgattgatgccctgagcaagaagatcctgaccctgggcctgaaccaggaccccccaccccaccccagcaacctgcggctgcagaggatgatccgctacagcgccaccctgtttgtgcaggagaagctgctgggcctgatgagcctgcccaccaaggagcagtttgaggagctgaagaagaagaggaaggaggagatggagaggaagagagctgtggagcggcaggccgccctggagagccagaggcggctggaggagcggcagagcggcctggccagccgggccgccaacggggaggtggccagcctgcggcggggccctgcccccctgaggaaggccgagggctggctgcccctgagcggcggccagggccagagcgaggacagcgaccccctgctgcagcagatccacaacatcaccagcttcatccggcaggccaaggccgccggccgcatggatgaggtgaggaccctgcaggagaacctgcggcagctgcaggatgaatatgaccagcagcagacagagaaggccatcgagctgagccggcggcaggccgaggaggaggacctgcagcgggagcagctgcagatgctgcgggagcgggagctggagcgggagcgggagcagttccgggtggccagcctgcacaccaggaccaggagcctggacttccgggagatcggccccttccagctggagcccagccgggagcccaggacccacctggcctatgccctggacctgggcagcagccctgtgcccagcagcacagcccccaagacccccagcctgagcagcacccagcccaccagggtgtggagcggccccccagctgtgggccaggagcggctgccccagagctccatgccccagcagcacgagggccccagcctgaacccctttgatgaggaggacctgagcagccccatggaggaggccaccaccggccccccagctgctggggtgtccctggaccccagcgcccgcatcctgaaggagtacaacccctttgaggaggaggatgaggaggaggaggccgtggccggcaaccccttcatccagcctgacagccctgcccccaaccccttctctgaagaagatgagcacccccagcagaggctgagcagccccctggtgcccggcaacccctttgaggagcccacctgcatcaacccctttgagatggacagcgacagcggccctgaggccgaggagcccatcgaggaggagctgctgctgcagcagattgacaacatcaaggcctacatctttgatgccaagcagtgtggccgcctggatgaggtggaggtgctgacagagaacctgcgggagctgaagcacaccctggccaagcagaagggcggcacagactag

SEQ ID NO: 40082 - DNA, 438 bp, Artificial Sequence
  Description of Artificial Sequence: Synthetic coding sequence
atggccgccagcctgaatgctggggagaccacctacagcctggagcacgccagtgacctgcgggtggaggtgcagaaggtgtatgagctgattgatgccctgagcaagaagatcctgaccctgggcctgaaccaggaccccccaccccaccccagcaacctgcggctgcagaggatgatccgctacagcgccaccctgtttgtgcaggagaagctgctgggcctgatgagcctgcccaccaaggagcagtttgaggagctgaagaagaagaggaaggaggagatggagaggaagagagctgtggagcggcaggccgccctggagagccagaggcggctggaggagcggcagagggccagccaccccccctgcctgtgcttcggcagccgcctcttccccagcagcaagcagcacagcagccaggaccccttcacctag

SEQ ID NO: 40083 - DNA, 627 bp, Artificial Sequence
  Description of Artificial Sequence: Synthetic coding sequence
atggccagcctggatgatcctggagaggtgcgggagggcttcctgtgccccctgtgcctgaaggacctgcagagcttctaccagctgcacagccactatgaggaggagcacagcggggaggacagagatgtgaagggccagatcaagagcctggtgcagaaggccaagaaggccaaggaccggctgctgaagcgggagggagatgacagagctgagagcggcacccagggctatgagagcttctcctatggaggagtggacccctacatgtgggagccccaggagctgggcgctgtgcgcagccacctgagtgacttcaagaagcacagagctgccagaattgaccactacgtggtggaggtgaacaagctgatcatccggctggagaagctgacagcctttgacaggaccaacacagaaagtgccaagatccgggccatcgagaagtctgtggtgccctgggtgaatgaccaggatgtgcccttctgcccagactgtggcaacaagttcagcatccggaacagaagacaccactgccgcctgtgtggcagcatcatgtgcaagaagtgcatggagctgatcagcctgcccctggccaagatcaccaccctgcatggagagagctag

SEQ ID NO: 40084 - DNA, 2355 bp, Artificial Sequence; identical to SEQ ID NO: 40081
  Description of Artificial Sequence: Synthetic coding sequence

SEQ ID NO: 40085 - DNA, 126 bp, Artificial Sequence
  Description of Artificial Sequence: Synthetic coding sequence
atggccagcctggatgatcctggagaggtgcgggagggcttcctgtgccccctgtgcctgaaggacctgcagagcttctaccagctgcacagccactatgaggaggagcacagcggggaggactag

SEQ ID NO: 40086 - DNA, 4278 bp, Artificial Sequence
  Description of Artificial Sequence: Synthetic coding sequence
atggagaactacttccaggccgaggcctacaacctggacaaggtgctggatgaatttgagcagaatgaagatgagaccgtgagcagcaccctgctggacaccaagtggaacaagatcctggacccccccagccaccggctgtccttcaaccccaccctggcctctgtgaatgaatctgctgtgtccaatgaaagccagccccagctgaaggtgttcagcctggcccacagcgcccccctgaccacagaggaggaggaccactgtgccaacggccaggactgcaacctgaaccctgagatcgccaccatgtggattgatgaaaatgctgtggccgaggaccagctgatcaagaggaactacagctgggatgaccagtgcagcgctgtggaggtgggggagaagaagtgtggcaacctggcctgcctgcctgatgagaagaatgtgctggtggtggccgtgatgcacaactgtgacaagaggaccctgcagaatgacctgcaggactgcaacaactacaacagccagagcctgatggatgccttcagctgcagcctggacaatgaaaatcggcagacagaccagttctccttcagcatcaatgaaagcacagagaaggacatgaacagcgagaagcagatggaccccctgaaccggcccaagacagagggccgctctgtgaaccacctgtgccccaccagcagtgacagcctggcctctgtgtgcagccccagccagctgaaggatgatggcagcatcggccgggaccccagcatgtctgccatcaccagcctgactgtggacagcgtcatcagcagccagggcacagatggctgcccagctgtgaagaagcaggagaactacatcccagatgaggacctgaccgggaagatcagcagccccaggacagacctgggcagccccaacagcttcagccacatgtctgagggcatcctgatgaagaaggagcctgctgaggagagcaccacagaggagagcctgcggagcggcctgcccctgctgctgaagccagacatgcccaatggaagtggaagaaataatgactgtgagcgctgcagcgactgcctggtgcccaatgaggtgcgggcagatgaaaatgaaggctatgaacatgaggagaccctgggcaccacagagttcctgaacatgacagagcacttcagcgagagccaggacatgaccaactggaagctgaccaagctgaatgagatgaatgacagccaggtgaatgaggagaaggagaagttcctgcagatcagccagcctgaggacaccaacggggacagcggcggccagtgtgtgggcctggctgatgctggcctggacctgaagggcacctgcatcagcgagagtgaagaatgtgacttcagcaccgtcatcgacaccccagctgccaactacctgagcaatggctgtgacagctatggcatgcaggaccccggggtgtcctttgtgcccaagaccctgcccagcaaagaagattctgtgacagaggagaaggagattgaggagagcaagtctgagtgctacagcaacatctatgagcagagaggaaatgaggccacagagggcagcggcctgctgctgaacagcactggagacctgatgaagaagaactacctgcacaacttctgcagccaggtgcccagcgtgctgggccagagcagccccaaggtggtggccagcctgcccagcatctctgtgccctttggaggagcccggcccaagcagcccagcaacctgaagctgcagatccccaagcccctgagtgaccacctgcagaatgacttccctgccaacagcggcaacaacaccaagaacaagaatgacatcctgggcaaggccaagctgggagaaaattctgccaccaacgtgtgcagccccagcctgggcaacatcagcaatgtggacaccaatggagagcacctggagagctatgaggccgagatcagcacccggccctgcctggccctggccccagacagcccagacaatgacctgcgggccggccagtttggcatcagcgccaggaagcccttcaccaccctgggggaggtggcccctgtgtgggtgcctgacagccaggcccccaactgcatgaagtgtgaggcccgcttcaccttcaccaagagaagacaccactgccgggcctgtgggaaggtgttctgtgccagctgctgcagcctgaagtgcaagctgctgtacatggacaggaaggaggcccgggtgtgtgtgatctgccacagcgtgctgatgaatgcccaggcctgggagaacatgatgtctgccagcagccagagccccaaccccaacaacccagctgagtactgcagcaccatcccccccctgcagcaggcccaggccagcggggccctgagcagccccccacccaccgtgatggtgcctgtgggcgtgctgaagcaccctggagctgaggtggcccagccccgggagcagaggagagtgtggtttgctgatggcatcctgcccaatggagaggtggctgatgctgccaagctgaccatgaatggcaccagcagcgctggcaccctggccgtgtcccatgaccctgtgaagcctgtgaccaccagccccctgcctgctgagacagacatctgcctcttcagcggcagcatcacccaggtgggcagccctgtgggcagcgccatgaacctgatcccagaagatggcctgccccccatcctgatcagcactggagtgaagggggactatgctgtggaggagaagcccagccagatctctgtgatgcagcagctggaggatggcggccctgaccccctggtgtttgtgctgaatgccaacctgctgtccatggtgaagatcgtgaactacgtgaacaggaagtgctggtgcttcaccaccaagggcatgcatgctgtgggccagagcgagatcgtcatcctgctgcagtgcctgcctgatgagaagtgcctgcccaaggacatcttcaaccactttgtgcagctgtacagagatgccctggccggaaatgtggtgagcaacctgggccacagcttcttcagccagagcttcctgggcagcaaggagcacggcggcttcctgtatgtgaccagcacctaccagagcctgcaggacctggtgctgcccaccccaccctacctgtttggcatcctgatccagaagtgggagaccccctgggccaaggtgttccccatccggctgatgctgcggctgggcgctgagtaccgcctgtacccctgccccctcttctctgtgcgcttcaggaagcccctgtttggagagaccggccacaccatcatgaacctgctggccgacttcaggaactaccagtacaccctgcctgtggtgcagggcctggtggtggacatggaggtgaggaagaccagcatcaagatccccagcaaccgctacaatgagatgatgaaggccatgaacaagagcaatgaacatgtgctggccggcggggcctgcttcaatgagaaggctgacagccacctggtgtgtgtgcagaatgatgatggcaactaccagacccaggccatcagcatccacaaccagcccaggaaggtgactggagccagcttctttgtgttcagcggggccctgaagagcagcagcggctacctggccaagagcagcatcgtggaggatggagtgatggtgcagatcacagctgagaacatggacagcctgcggcaggccctgcgggagatgaaggacttcaccatcacctgtgggaaggcagatgctgaggagccccaggagcacatccacatccagtgggtggatgatgacaagaatgtgtccaaaggagtggtgagccccattgatggcaagtccatggagaccatcaccaacgtgaagatcttccacggcagcgagtacaaggccaacgggaaggtgatccgctggacagaggtgttcttcctggagaatgatgaccagcacaactgcctgagtgaccctgctgaccacagccggctgacagagcacgtggccaaggccttctgcctggccctgtgcccccacctgaagctgctgaaggaggatggcatgaccaagctgggcctgcgggtgaccctggacagcgaccaggtgggctaccaggccggcagcaatggccagcccctgcccagccagtacatgaatgacctggacagcgccctggtgcctgtgattcatggaggagcctgccagctgtctgagggccctgtggtgatggagctgatcttctacatcctggagaacatcgtgtag

SEQ ID NO: 40087 - DNA, 4101 bp, Artificial Sequence
  Description of Artificial Sequence: Synthetic coding sequence
atggagaactacttccaggccgaggcctacaacctggacaaggtgctggatgaatttgagcagaatgaagatgagaccgtgagcagcaccctgctggacaccaagtggaacaagatcctggacccccccagccaccggctgtccttcaaccccaccctggcctctgtgaatgaatctgctgtgtccaatgaaagccagccccagctgaaggtgttcagcctggcccacagcgcccccctgaccacagaggaggaggaccactgtgccaacggccaggactgcaacctgaaccctgagatcgccaccatgtggattgatgaaaatgctgtggccgaggaccagctgatcaagaggaactacagctgggatgaccagtgcagcgctgtggaggtgggggagaagaagtgtggcaacctggcctgcctgcctgatgagaagaatgtgctggtggtggccgtgatgcacaactgtgacaagaggaccctgcagaatgacctgcaggactgcaacaactacaacagccagagcctgatggatgccttcagctgcagcctggacaatgaaaatcggcagacagaccagttctccttcagcatcaatgaaagcacagagaaggacatgaacagcgagaagcagatggaccccctgaaccggcccaagacagagggccgctctgtgaaccacctgtgccccaccagcagtgacagcctggcctctgtgtgcagccccagccagctgaaggatgatggcagcatcggccgggaccccagcatgtctgccatcaccagcctgactgtggacagcgtcatcagcagccagggcacagatggctgcccagctgtgaagaagcaggagaactacatcccagatgaggacctgaccgggaagatcagcagccccaggacagacctgggcagccccaacagcttcagccacatgtctgagggcatcctgatgaagaaggagcctgctgaggagagcaccacagaggagagcctgcggagcggcctgcccctgctgctgaagccagacatgcccaatggaagtggaagaaataatgactgtgagcgctgcagcgactgcctggtgcccaatgaggtgcgggcagatgaaaatgaaggctatgaacatgaggagaccctgggcaccacagagttcctgaacatgacagagcacttcagcgagagccaggacatgaccaactggaagctgaccaagctgaatgagatgaatgacagccaggtgaatgaggagaaggagaagttcctgcagatcagccagcctgaggacaccaacggggacagcggcggccagtgtgtgggcctggctgatgctggcctggacctgaagggcacctgcatcagcgagagtgaagaatgtgacttcagcaccgtcatcgacaccccagctgccaactacctgagcaatggctgtgacagctatggcatgcaggaccccggggtgtcctttgtgcccaagaccctgcccagcaaagaagattctgtgacagaggagaaggagattgaggagagcaagtctgagtgctacagcaacatctatgagcagagaggaaatgaggccacagagggcagcggcctgctgctgaacagcactggagacctgatgaagaagaactacctgcacaacttctgcagccaggtgcccagcgtgctgggccagagcagccccaaggtggtggccagcctgcccagcatctctgtgccctttggaggagcccggcccaagcagcccagcaacctgaagctgcagatccccaagcccctgagtgaccacctgcagaatgacttccctgccaacagcggcaacaacaccaagaacaagaatgacatcctgggcaaggccaagctgggagaaaattctgccaccaacgtgtgcagccccagcctgggcaacatcagcaatgtggacaccaatggagagcacctggagagctatgaggccgagatcagcacccggccctgcctggccctggccccagacagcccagacaatgacctgcgggccggccagtttggcatcagcgccaggaagcccttcaccaccctgggggaggtggcccctgtgtgggtgcctgacagccaggcccccaactgcatgaagtgtgaggcccgcttcaccttcaccaagagaagacaccactgccgggcctgtgggaaggtgttctgtgccagctgctgcagcctgaagtgcaagctgctgtacatggacaggaaggaggcccgggtgtgtgtgatctgccacagcgtgctgatgaatgtggcccagccccgggagcagaggagagtgtggtttgctgatggcatcctgcccaacggggaggtggctgatgctgccaagctgaccatgaatggcaccagcagcgctggcaccctggccgtgtcccatgaccctgtgaagcctgtgaccaccagccccctgcctgctgagacagacatctgcctcttcagcggcagcatcacccaggtgggcagccctgtgggcagcgccatgaacctgatcccagaagatggcctgccccccatcctgatcagcactggagtgaagggggactatgctgtggaggagaagcccagccagatctctgtgatgcagcagctggaggatggcggccctgaccccctggtgtttgtgctgaatgccaacctgctgtccatggtgaagatcgtgaactacgtgaacaggaagtgctggtgcttcaccaccaagggcatgcatgctgtgggccagagcgagatcgtcatcctgctgcagtgcctgcctgatgagaagtgcctgcccaaggacatcttcaaccactttgtgcagctgtacagagatgccctggccggaaatgtggtgagcaacctgggccacagcttcttcagccagagcttcctgggcagcaaggagcacggcggcttcctgtatgtgaccagcacctaccagagcctgcaggacctggtgctgcccaccccaccctacctgtttggcatcctgatccagaagtgggagaccccctgggccaaggtgttccccatccggctgatgctgcggctgggcgctgagtaccgcctgtacccctgccccctcttctctgtgcgcttcaggaagcccctgtttggagaaacaggccacaccatcatgaacctgctggccgacttcaggaactaccagtacaccctgcctgtggtgcagggcctggtggtggacatggaggtgaggaagaccagcatcaagatccccagcaaccgctacaatgagatgatgaaggccatgaacaagagcaatgagcacgtgctggccggcggggcctgcttcaatgagaaggctgacagccacctggtgtgtgtgcagaatgatgatggcaactaccagacccaggccatcagcatccacaaccagcccaggaaggtgactggagccagcttctttgtgttttctggggccctgaagagcagcagcggctacctggccaagagcagcatcgtggaggatggagtgatggtgcagatcacagctgagaacatggacagcctgcggcaggccctgcgggagatgaaggacttcaccatcacctgtgggaaggcagatgctgaggagccccaggagcacatccacatccagtgggtggatgatgacaagaatgtgtccaagggcgtggtgagccccattgatggcaagtccatggagaccatcaccaacgtgaagatcttccacggcagcgagtacaaggccaacgggaaggtgatccgctggacagaggtgttcttcctggagaatgatgaccagcacaactgcctgagtgaccctgctgaccacagccggctgacagaacatgtggccaaggccttctgcctggccctgtgcccccacctgaagctgctgaaggaggatggcatgaccaagctgggcctgcgggtgaccctggacagcgaccaggtgggctaccaggccggcagcaatggccagcccctgcccagccagtacatgaatgacctggacagcgccctggtgcctgtgatccacggcggggcctgccagctgtctgagggccctgtggtgatggagctgatcttctacatcctggagaacatcgtgtag

SEQ ID NO: 40088 - DNA, 2289 bp, Artificial Sequence
  Description of Artificial Sequence: Synthetic coding sequence
atggagaactacttccaggccgaggcctacaacctggacaaggtgctggatgaatttgagcagaatgaagatgagaccgtgagcagcaccctgctggacaccaagtggaacaagatcctggacccccccagccaccggctgtccttcaaccccaccctggcctctgtgaatgaatctgctgtgtccaatgaaagccagccccagctgaaggtgttcagcctggcccacagcgcccccctgaccacagaggaggaggaccactgtgccaacggccaggactgcaacctgaaccctgagatcgccaccatgtggattgatgaaaatgctgtggccgaggaccagctgatcaagaggaactacagctgggatgaccagtgcagcgctgtggaggtgggggagaagaagtgtggcaacctggcctgcctgcctgatgagaagaatgtgctggtggtggccgtgatgcacaactgtgacaagaggaccctgcagaatgacctgcaggactgcaacaactacaacagccagagcctgatggatgccttcagctgcagcctggacaatgaaaatcggcagacagaccagttctccttcagcatcaatgaaagcacagagaaggacatgaacagcgagaagcagatggaccccctgaaccggcccaagacagagggccgctctgtgaaccacctgtgccccaccagcagtgacagcctggcctctgtgtgcagccccagccagctgaaggatgatggcagcatcggccgggaccccagcatgtctgccatcaccagcctgactgtggacagcgtcatcagcagccagggcacagatggctgcccagctgtgaagaagcaggagaactacatcccagatgaggacctgaccgggaagatcagcagccccaggacagacctgggcagccccaacagcttcagccacatgtctgagggcatcctgatgaagaaggagcctgctgaggagagcaccacagaggagagcctgcggagcggcctgcccctgctgctgaagccagacatgcccaatggaagtggaagaaataatgactgtgagcgctgcagcgactgcctggtgcccaatgaggtgcgggcagatgaaaatgaaggctatgaacatgaggagaccctgggcaccacagagttcctgaacatgacagagcacttcagcgagagccaggacatgaccaactggaagctgaccaagctgaatgagatgaatgacagccaggtgaatgaggagaaggagaagttcctgcagatcagccagcctgaggacaccaacggggacagcggcggccagtgtgtgggcctggctgatgctggcctggacctgaagggcacctgcatcagcgagagtgaagaatgtgacttcagcaccgtcatcgacaccccagctgccaactacctgagcaatggctgtgacagctatggcatgcaggaccccggggtgtcctttgtgcccaagaccctgcccagcaaagaagattctgtgacagaggagaaggagattgaggagagcaagtctgagtgctacagcaacatctatgagcagagaggaaatgaggccacagagggcagcggcctgctgctgaacagcactggagacctgatgaagaagaactacctgcacaacttctgcagccaggtgcccagcgtgctgggccagagcagccccaaggtggtggccagcctgcccagcatctctgtgccctttggaggagcccggcccaagcagcccagcaacctgaagctgcagatccccaagcccctgagtgaccacctgcagaatgacttccctgccaacagcggcaacaacaccaagaacaagaatgacatcctgggcaaggccaagctgggagaaaattctgccaccaacgtgtgcagccccagcctgggcaacatcagcaatgtggacaccaatggagagcacctggagagctatgaggccgagatcagcacccggccctgcctggccctggccccagacagcccagacaatgacctgcgggccggccagtttggcatcagcgccaggaagcccttcaccaccctgggggaggtggcccctgtgtgggtgcctgacagccaggcccccaactgcatgaagtgtgaggcccgcttcaccttcaccaagagaagacaccactgccgggcctgtgggaaggtgttctgtgccagctgctgcagcctgaagtgcaagctgctgtacatggacaggaaggaggcccgggtgtgtgtgatctgccacagcgtgctgatgaatggcaagtactag

SEQ ID NO: 40089 - DNA, 4278 bp, Artificial Sequence; identical to SEQ ID NO: 40086
  Description of Artificial Sequence: Synthetic coding sequence

SEQ ID NO: 40090 - DNA, 2514 bp, Artificial Sequence
  Description of Artificial Sequence: Synthetic coding sequence
atggccagcaagaggaagagcaccaccccctgcatggtgaggaccagccaggtggtggagcaggatgtgcctgaggaggtggaccgggccaaggagaagggcatcggcaccccccagccagatgtggccaaggacagctgggccgctgagctggagaacagcagcaaagaaaatgaggtgattgaggtgaagtccatgggagagagccagagcaagaagctgcagggcggctatgagtgcaagtactgcccctacagcacccagaacctgaatgagttcacagagcacgtggacatgcagcaccccaacgtcatcctgaaccccctgtatgtgtgtgccgagtgcaacttcaccaccaagaagtatgacagcctgagtgaccacaacagcaagttccaccctggagaggccaacttcaagctgaagctgatcaagaggaacaaccagacagtgctggagcagagcattgagaccaccaaccacgtggtgtccatcaccaccagcggccctggcaccggggacagcgacagcggcatctctgtgtccaagacccccatcatgaagccaggcaagcccaaggcagatgccaagaaggtgcccaagaagccagaggagatcaccccagaaaatcatgtggagggcacagcccggctggtgacagacacagctgagatcctgagccggctgggcggcgtggagctgctgcaggacaccctgggccacgtgatgcccagcgtgcagctgccccccaacatcaacctggtgcccaaggtgcctgtgcccctgaacaccaccaagtacaacagcgccctggacaccaatgccaccatgatcaacagcttcaacaagttcccctaccccacccaggccgagctgtcctggctgacagctgccagcaagcaccctgaggagcacatccgcatctggtttgccacccagaggctgaagcacggcatctcctggagccctgaggaggtggaggaggccaggaagaagatgtttaatggcaccatccagagcgtgccccccaccatcaccgtgctgcctgcccagctggcccccaccaaggtgacccagcccatcctgcagacagccctgccctgccagatcctgggccagaccagcctggtgctgacccaggtgaccagcggcagcaccaccgtgtcctgcagccccatcaccctggccgtggccggcgtgaccaaccacggccagaagaggcccctggtgaccccccaggccgcccctgagcccaagaggccccacatcgcccaggtgcctgagcccccacccaaggtggccaacccccccctgaccccagccagtgacaggaagaagaccaaggagcagatcgcccacctgaaggccagcttcctgcagagccagttcccagatgatgctgaggtgtaccgcctgattgaggtgacaggcctggcccggtctgagatcaagaagtggttcagtgaccaccgctaccgctgccagaggggcatcgtgcacatcaccagcgagagcctggccaaggaccagctggccatcgccgccagccgccacggccgcacctaccacgcctacccagactttgccccccagaagttcaaggagaagacccagggccaggtgaagatcctggaggacagcttcctgaagagcagcttccccacccaggccgagctggaccggctgcgggtggagaccaagctgagccggcgggagattgacagctggttcagcgagaggaggaagctgcgggacagcatggagcaggccgtgctggacagcatgggcagcggcaagaagggccaggatgtgggcgcccccaacggggccctgagccggctggaccagctgagcggggcccagctgaccagcagcctgcccagccccagccctgccatcgccaagagccaggagcaggtgcacctgctgcggagcacctttgcccggacccagtggcccaccccccaggagtatgaccagctggccgccaagacaggcctggtgaggacagagatcgtgcgctggttcaaggagaaccgctgcctgctgaagacaggaacagtgaagtggatggagcagtaccagcaccagcccatggctgatgaccacggctatgatgctgtggccaggaaggccaccaagcccatggccgagagccccaagaatggaggagatgtggtgccccagtactacaaggaccccaagaagctgtgtgaggaggacctggagaagctggtgaccagggtgaaggtgggcagcgagcccgccaaggactgcctgcctgccaagcccagcgaggccaccagtgacagaagtgagggcagcagcagagatggccagggcagtgatgaaaatgaggagagctctgtggtggactatgtggaggtgacagtgggggaggaggatgccatcagtgacagaagtgacagctggagccaggccgctgctgagggcgtgtctgagctggccgagagtgacagcgactgtgtgcctgctgaggccggccaggcctag

SEQ ID NO: 40091 - DNA, 501 bp, Artificial Sequence
  Description of Artificial Sequence: Synthetic coding sequence
atggccagcaagaggaagagcaccaccccctgcatggtgaggaccagccaggtggtggagcaggatgtgcctgaggaggtggaccgggccaaggagaagggcatcggcaccccccagccagatgtggccaaggacagctgggccgctgagctggagaacagcagcaaagaaaatgaggtgattgaggtgaagtccatgggagagagccagagcaagaagctgcagggcggctatgagtgcaagtactgcccctacagcacccagaacctgaatgagttcacagagcacgtggacatgcagcaccccaacgtcatcctgaaccccctgtatgtgtgtgccgagtgcaacttcaccaccaagaagtatgacagcctgagtgaccacaacagcaagttccaccctggagaggccaacttcaagctgaagctgatcaagaggaacaaccagacagtgctggagcagagcattgagaccaccaaccacgtggtgtccatcacctag

SEQ ID NO: 40092 - DNA, 465 bp, Artificial Sequence
  Description of Artificial Sequence: Synthetic coding sequence
atggccctgctgctgtctgtgctgcgggtgctgctgggcggcttctttgccctggtgggcctggccaagctgtctgaggagatcagcgcccctgtgtctgagaggatgaatgccctgtttgtgcagtttgctgaggtgttccccctgaaggtgtttggctaccagcctgaccccctgaactaccagattgctgtgggcttcctggagctgctggccggcctgctgctggtgatgggcccccccatgctgcaggagatcagcaacctcttcctgatcctgctgatgatgggcgccatcttcaccctggccgccctgaaggagagcctgagcacctgcatcccagccatcgtgtgcctgggcttcctgctgctgctgaatgtgggccagctgctggcccagaccaagaaggtggtgcggcccaccaggaagaagaccctgagcaccttcaaggagagctggaagtag

SEQ ID NO: 40093 - DNA, 1296 bp, Artificial Sequence
  Description of Artificial Sequence: Synthetic coding sequence
atgatgctgcgcttctccatgtgcagaggaaatgatgagggctttgccatggagcagatctggctgctgctgctgctgaccatccgggtgctgcccggcagcgcccagttcaacggctacaactgtgatgccaacctgcacagccgcttccctgctgagcgggacatctctgtgtactgcggcgtgcaggccatcaccatgaagatcaacttctgcaccgtgctcttcagcggctacagcgagacagacctggccctgaatggccgccacggggacagccactgccggggcttcatcaacaacaacaccttccctgctgtggtgatcttcatcatcaacctgagcaccctggagggctgcggcaacaacctggtggtgtccaccatccctggggtgtctgcctatggaaatgccacctctgtgcaggtgggcaacatcagcggctacatcgacaccccagacccccccaccatcatctcctacctgcccggcctgctgtacaagttcagctgcagctaccccctggagtacctggtgaacaacacccagctggccagcagcagcgctgccatctctgtgagagaaaataatggcacctttgtgtccaccctgaacctgctgctgtacaatgacagcacctacaaccagcagctgatcatccccagcatcggcctgcccctgaagaccaaggtgtttgctgctgtgcaggccaccaacctggatggccgctggaatgtgctgatggactactgctacaccacccccagcggcaaccccaatgatgacatccgctatgacctcttcctgagctgtgacaaggacccccagaccaccgtgattgaaaatggccgcagccagaggggccgcttctcctttgaggtgttccgctttgtgaagcacaagaaccagaagatgagcacagtgttcctgcactgtgtgaccaagctgtgcagagcagatgactgccccttcctgatgcccatctgcagccaccgggagaggagagatgctggaagaaggaccacctggagcccccagagcagcagcggcagcgctgtgctgtctgctggccccatcatcaccaggagtgatgagacccccaccaacaacagccagctgggcagccccagcatgccacccttccagctgaatgccatcaccagcgccctgatcagcggcatggtgatcctgggcgtgaccagcttcagcctgctgctgtgcagcctggccctgctgcacaggaagggccccaccagcctggtgctgaatggcatccggaaccctgtgtttgattag

SEQ ID NO: 40094 - DNA, 1248 bp, Artificial Sequence
  Description of Artificial Sequence: Synthetic coding sequence
atggagcagatctggctgctgctgctgctgaccatccgggtgctgcccggcagcgcccagttcaacggctacaactgtgatgccaacctgcacagccgcttccctgctgagcgggacatctctgtgtactgcggcgtgcaggccatcaccatgaagatcaacttctgcaccgtgctcttcagcggctacagcgagacagacctggccctgaatggccgccacggggacagccactgccggggcttcatcaacaacaacaccttccctgctgtggtgatcttcatcatcaacctgagcaccctggagggctgcggcaacaacctggtggtgtccaccatccctggggtgtctgcctatggaaatgccacctctgtgcaggtgggcaacatcagcggctacatcgacaccccagacccccccaccatcatctcctacctgcccggcctgctgtacaagttcagctgcagctaccccctggagtacctggtgaacaacacccagctggccagcagcagcgctgccatctctgtgagagaaaataatggcacctttgtgtccaccctgaacctgctgctgtacaatgacagcacctacaaccagcagctgatcatccccagcatcggcctgcccctgaagaccaaggtgtttgctgctgtgcaggccaccaacctggatggccgctggaatgtgctgatggactactgctacaccacccccagcggcaaccccaatgatgacatccgctatgacctcttcctgagctgtgacaaggacccccagaccaccgtgattgaaaatggccgcagccagaggggccgcttctcctttgaggtgttccgctttgtgaagcacaagaaccagaagatgagcacagtgttcctgcactgtgtgaccaagctgtgcagagcagatgactgccccttcctgatgcccatctgcagccaccgggagaggagagatgctggaagaaggaccacctggagcccccagagcagcagcggcagcgctgtgctgtctgctggccccatcatcaccaggagtgatgagacccccaccaacaacagccagctgggcagccccagcatgccacccttccagctgaatgccatcaccagcgccctgatcagcggcatggtgatcctgggcgtgaccagcttcagcctgctgctgtgcagcctggccctgctgcacaggaagggccccaccagcctggtgctgaatggcatccggaaccctgtgtttgattag

SEQ ID NO: 40095 - DNA, 1248 bp, Artificial Sequence; identical to SEQ ID NO: 40094
  Description of Artificial Sequence: Synthetic coding sequence

SEQ ID NO: 40096 - DNA, 1131 bp, Artificial Sequence
  Description of Artificial Sequence: Synthetic coding sequence
atgggcctgctggccttcctgaagacccagttcgtgctgcacctgttggtgggctttgtgtttgtcgtttccgggctggtgatcaattttgtgcagttgtgcaccttggccctgtggcccgtctcgaaacagctctatcgcaggctgaattgccgactagcttattcactttggagccaactggtgatgcttctggagtggtggtcgtgcaccgagtgtacactgttcaccgatcaagcgactgttgaaagattcggcaaagagcatgctgtgattatcttgaaccacaatttcgagattgatttcctctgcggctggacaatgtgtgagcgttttggtgtactaggctcctccaaagtcctggccaagaaagagctactttacgtgcctctgatcggctggacgtggtatttcctggagatcgtgttttgtaaaaggaaatgggaggaggatcgggataccgttgtcgaggggctccgccgcctgagcgactatcctgagtacatgtggttcttactgtattgcgagggaactcgtttcactgagacgaagcatagggtatctatggaagttgctgctgctaaggggcttcccgttttgaaataccatctgctccctcgtactaagggcttcaccacggccgtgaaatgcctacgcggtacagtagctgccgtgtatgatgtaaccctgaacttcaggggcaacaaaaatccctcgttgctgggtattctgtacggtaagaagtatgaagctgatatgtgcgtacgccgatttcccctggaagatatccctctggatgagaaagaggctgcccagtggttgcacaagctgtatcaggaaaaagacgcactgcaggagatctacaaccagaaggggatgttcccgggggaacaatttaagcccgctcggcgcccatggacactgctaaacttccttagttgggctacaattctgctgtcccctcttttctcttttgtgctcggtgtgtttgcttccgggtcaccgctgctaattctcacgttcctgggattcgtgggggctgccagctttggtgtgagaaggcttatcggagttacagaaatcgagaaaggctctagttacggcaatcaggagttcaaaaaaaaggaatag

SEQ ID NO: 40097 - DNA, 1131 bp, Artificial Sequence
  Description of Artificial Sequence: Synthetic coding sequence
atgggcctgctggccttcctgaagacccagttcgtgctgcacctgttagtaggcttcgtcttcgtggtctcaggtttggtgattaattttgtgcagctgtgcacgctagcgctgtggcccgtgagcaagcagctttatcgccgcctgaactgccggttggcctattctctgtggtcccagctggtgatgttgctagaatggtggagctgtactgagtgcaccctctttaccgaccaggcaactgtagaaaggttcggcaaagaacacgctgtgattattctgaatcacaatttcgagattgatttcctgtgcggctggacaatgtgcgaacggtttggggtgctcggttcgtcaaaagtgctggccaaaaaggagctcctgtacgtccctctcatagggtggacctggtatttcctggaaatcgtgttctgtaagcgaaagtgggaggaggatagggacaccgtggtagaggggctgagacggctctctgactacccagaatatatgtggttcctgctgtattgtgaaggcacgcggtttactgagacaaaacatcgagtcagcatggaggtggctgctgctaagggtctgcccgtcctgaagtatcatctactccccagaacgaagggatttacaactgcagttaaatgccttaggggcacagtggcagctgtctatgatgtcaccctgaacttccgcggaaataagaatccatcattactgggcatcctctatggcaaaaaatatgaagccgacatgtgtgtccgcagattccccctggaggacatacctttggacgaaaaggaagcagcacagtggcttcacaaactataccaggagaaagacgccctccaggagatatataaccagaaaggcatgttcccaggggaacagttcaagccggctaggcgtccatggaccctccttaattttctgtcctgggccaccattttactcagcccactgtttagctttgtgctcggcgttttcgctagtggcagcccattgttgattctcactttcttgggtttcgtgggggccgccagtttcggcgtcagaagactgatcggagtgacagagatagaaaaaggatcctcatacggaaatcaggaatttaagaaaaaagagtag

SEQ ID NO: 40098 - DNA, 1131 bp, Artificial Sequence
  Description of Artificial Sequence: Synthetic coding sequence
atgggcctgctggccttcctgaagacccagttcgtgctgcacctgctcgtaggcttcgttttcgtggtgagcggtctggtaattaacttcgtacaactgtgtaccctcgctctctggccggtcagtaaacaactataccggcggctaaattgccgacttgcctatagcctatggagccaactcgtgatgctccttgaatggtggtcctgcactgagtgcactcttttcacagaccaggctacagtggaaaggttcggaaaggagcacgcagtgattatcctgaatcacaatttcgagatcgatttcctctgcggttggactatgtgcgaacgcttcggagtcttggggagctccaaggtactagccaaaaaggaactcctctacgtgccactgatagggtggacgtggtacttcctagaaatcgtgttttgcaaacggaaatgggaggaggatcgagataccgtggttgaaggcctgcggagactgtcagattacccggagtatatgtggtttctgctgtattgcgagggaactaggtttactgaaactaaacaccgtgtttccatggaggtggctgccgcaaagggcctgccagtgctgaaataccacctgctccctcggacaaaaggtttcaccaccgctgtgaagtgccttcgaggtactgtggctgcagtctacgacgtgactcttaacttcagaggtaataaaaacccctcccttctagggatattgtacgggaagaaatatgaggccgatatgtgcgtcagacgtttccccctcgaggatatcccgttggatgaaaaagaggccgcccagtggctgcacaagttgtaccaggagaaggacgcactgcaggagatatataaccagaaagggatgtttcccggggaacagttcaagccggcccggagaccctggacactgctcaattttctgagctgggcaactatcctgctctctccactgttcagttttgtcctgggggtcttcgcatcagggagccccctgcttatacttaccttcctaggatttgtgggcgctgcctctttcggcgtgcggcggctgatcggggttacggagatcgaaaagggaagtagctatggaaatcaagagtttaaaaagaaggaatag

SEQ ID NO: 40099 - DNA, 1131 bp, Artificial Sequence
  Description of Artificial Sequence: Synthetic coding sequence
atgggcctgctggccttcctgaagacccagttcgtgctgcacctgcttgtcggtttcgtttttgttgtctccgggctggtgataaatttcgtccagttgtgcacactcgcactatggccggtaagtaagcagttgtatcgccgcctaaactgccggctggcctattcactatggtcccagttggttatgctcctggagtggtggtcgtgtactgaatgtaccctcttcaccgaccaggccaccgtggagcggttcggtaaggagcatgcagtcatcatcctgaaccacaacttcgagattgatttcctatgtgggtggacgatgtgcgagcgcttcggggttttggggtcttccaaagttctcgctaagaaggagttgctctatgtgcccttaatcgggtggacctggtattttctggagatcgtgttctgcaaacgtaagtgggaagaggacagggatacagtagttgaaggcctcagacggttgtccgattatcccgaatacatgtggttcctattatactgcgaagggaccagattcacagaaaccaagcacagagtttccatggaggtggcagctgctaaaggacttcctgtgctgaagtaccatttactgcctcggactaaaggattcactactgcagttaagtgtctcaggggcaccgtggcggccgtgtatgatgtgacattaaacttccgtggcaataaaaacccgtcccttcttggtatcctgtacggaaagaagtacgaggctgatatgtgtgtgcggagatttcctctcgaggacatccctctggatgagaaagaggctgcccaatggctacacaaactgtatcaagagaaggatgccctccaagagatctacaaccagaaaggaatgttcccaggggaacagttcaagcccgctagacggccatggacactgttaaattttttgagctgggctacgatcctcttgagtcctctcttctcttttgtcctgggagtgttcgctagtgggtccccacttctcatcctaacattcctaggatttgtgggcgcagcctccttcggtgtgaggaggttaataggggttacggagatcgagaaggggtccagttatggtaatcaggaattcaaaaaaaaggagtag

SEQ ID NO: 40100 - DNA, 1131 bp, Artificial Sequence
  Description of Artificial Sequence: Synthetic coding sequence
atgggcctgctggccttcctgaagacccagttcgtgctgcacctgctcgtcggatttgtcttcgttgtgagcggcctggtcatcaacttcgtgcagctgtgtaccctggccctttggccagtgtcaaaacagttgtataggcggttgaactgtcggttagcgtactccctctggagccaactagtcatgctcttggaatggtggtcttgtacggaatgcaccctattcaccgaccaggccactgtggagaggttcggtaaggagcacgccgttatcatattaaaccacaattttgagatcgatttcctgtgtggatggactatgtgcgagcggttcggtgtactcggcagttctaaagtgctggccaaaaaggaacttctgtacgtgcctttgataggctggacttggtattttctagaaatcgttttttgcaaaagaaagtgggaggaggatcgcgataccgtggtggagggtcttagacgactatctgactacccagagtacatgtggtttctcctgtactgtgagggcactcgattcaccgagaccaagcaccgcgtgtctatggaggtggcagccgccaagggcctccctgtactgaagtaccacctgctgcctcggactaagggatttaccaccgccgtgaaatgcctgaggggaacagtagcagctgtttatgacgtcactctcaattttagagggaataagaacccaagcctcctgggaattctatacggaaagaagtacgaagccgatatgtgtgtccggaggtttcctctggaggacatcccactggacgagaaggaggcagctcagtggctgcataaactgtatcaggaaaaggacgcattgcaagaaatctacaaccaaaaaggtatgttccccggagagcagtttaaacccgctagacgtccctggaccttactcaatttcctctcctgggccactatactgctcagccctctgtttagctttgtgctgggggtgtttgcctcaggctcacccctactgatactcactttcctgggcttcgtgggggctgcatcatttggcgtgaggaggcttatcggggttacagagatcgagaaaggatcctcatatggtaatcaggagttcaagaagaaagaatag

SEQ ID NO: 40101 - DNA, 768 bp, Artificial Sequence
  Description of Artificial Sequence: Synthetic coding sequence
atgggcctgctggccttcctgaagacccagttcgtgctgcacctgctggtgggattcgtgttcgtggttagcggcctcgtcatcaattttgtgcagttatgcacgctggctctgtggcctgtgagcaaacagctctatcgcaggcttaattgtcgtctggcctatagtctgtggtctcagttggtcatgcttcttgagtggtggtcgtgcaccgagtgtaccctgttcaccgatcaggccactgtggaaaggttcgggaaggagcatgccgttatcattctgaaccataactttgagatcgatttcctgtgtggctggactatgtgcgagaggtttggcgtgctcggctcatccaaggtgctggcaaaaaaggagctcctgtatgtgccattaatcgggtggacctggtattttttggaaatcgtgttttgcaagcgcaagtgggaggaagacagagacactgtcgtcgaaggcctccggcggctctccgactacccggagtatatgtggtttctgctgtactgtgagggcactcgcttcactgagacaaagcaccgagtatctatggaggtggccgccgcaaaaggcctgccggtcttaaagtatcaccttctcccgagaacaaagggatttacaaccgctgttaaatgcctcagaggcacagtggccgctgtctacgatgtgaccctcaacttcagaggtaataagaacccatctcttctgggcatcctgtatggcaagaaatatgaggcggatatgtgcgtgtag

SEQ ID NO: 40102 - DNA, 1113 bp, Artificial Sequence
  Description of Artificial Sequence: Synthetic coding sequence
atgggcctgctggccttcctgaagacccagttcgtgctgcacctgctcgtagggttcgtgtttgtggtgtccggactggtaataaattttgtccaattgtgtaccctcgcactgtggccagtgtctaaacaactttatagacggcttaattgccgtctggcttatagcttatggtcacagctggtgatgctgctggagtggtggagctgcaccgaatgcactttgtttaccgaccaggccaccgtggagaggttcgggaaggaacatgccgtgatcatcctcaatcacaactttgaaatagactttctctgtgggtggaccatgtgcgaaaggtttggcgtcctgggctcttctaaagtgcttgcaaagaaggagcttctatacgtgccgttaatcggctggacatggtacttccttgagatcgtgttctgcaagaggaaatgggaagaggacagagatacagttgtggagggacttaggaggctatccgactaccccgaatatatgtggttccttctatattgcgaagggacgcggttcaccgagacaaagcaccgcgtcagcatggaggtagccgccgccaaaggcctgcctgtgctcaagtatcatctgctcccacggaccaaggggttcacaacagcagtgaagtgcctaagaggtaccgttgcagctgtgtatgacgtcacccttaattttagaggcaataaaaacccctccctgcttggcatcttgtatggtaagaagtacgaggccgacatgtgcgttagacgattccccttggaagacatcccccttgacgagaaggaggggcactgttggcctgtcgccccagtcactcatccagagcctggcgccactcttgaagcgccccgccgcgaaggtccagggcctccgaccggggtttggccagtcaagctgcctgcttgggcggtggtgagctggggcagacgttggcctccctccctcggaccaggggcccggtgtcatggcgtcagttgtccctcttcccaaggatgtcactgctgccttcatagactgcccccttgtgaaactctggtggtatggtactcggccactgtgtatcagaccagaactttatgcgaggtactgtag

SEQ ID NO: 40103 - DNA, 387 bp, Artificial Sequence
  Description of Artificial Sequence: Synthetic coding sequence
atgggcctgctggccttcctgaagacccagttcgtgctgcacctgctcgtgggcttcgtctttgttgtgagcggtctagtgataaattttgtgcaactttgcacgctggcactctggcccgtcagcaagcagctctaccgacgcctgaattgccgtctggcctattccctttggtcgcagctcgtgatgctcttggagtggtggtcctgcacggagtgcacactgttcactgaccaggcaacagtggagagattcggaaaggagcacgcggtgattatcttaaatcataattttgaaattgatttcctatgcggatggaccatgtgcgagcgattcggggtcctggggtcttcaaaagttctcgctaagaaagagttgttgtattag

SEQ ID NO: 40104 - DNA, 240 bp, Artificial Sequence
  Description of Artificial Sequence: Synthetic coding sequence
atgggcctgctggccttcctgaagacccagttcgtgctgcacctgcttgtcgggttcgtgttcgtggtttctggcctggtgattaatttcgtgcagctgtgtactctggccttatggcctgtgtctaagcaactctacaggcgcctgaactgccgtctggcttattcgctgtggtcccaattggtcatgctgctggagtggtggtcttgtaccgaatgtacactgtttaccgaccaatag

SEQ ID NO: 40105 - DNA, 117 bp, Artificial Sequence
  Description of Artificial Sequence: Synthetic coding sequence
atgggcctgctggccttcctgaagacccagttcgtgctgcacctgcttgtaggctttgtgtttgtagtctctggacttgtgataaactttgttcaactctgcacacttgccctttag

SEQ ID NO: 40106 - DNA, 768 bp, Artificial Sequence
  Description of Artificial Sequence: Synthetic coding sequence
atgggcctgctggccttcctgaagacccagttcgtgctgcacctgctggtcgggtttgtgttcgttgtctccgggctggttataaactttgtccagctgtgtaccctagcactctggccagtttcaaaacaactataccgccgactgaattgtcggctagcctattccctctggagccagctggtgatgctgctggaatggtggtcctgcaccgaatgcactctgttcacagaccaggcgactgtggagcgattcggcaaggagcatgccgtgataatcctgaatcataattttgagattgacttcctgtgcggttggacaatgtgtgagcgcttcggagtgctgggcagcagcaaagtgttggctaagaaggagctgctgtatgtgcctctgattggctggacatggtactttttggagatcgtgttttgcaaaaggaagtgggaggaggatcgggatactgtggttgaaggactgcggcggttgtcggattacccggagtacatgtggtttttactctattgcgaaggcacccgattcaccgaaaccaagcacagggtgagtatggaggtggcggccgccaaggggttgcccgttttgaaatatcatttactcccaagaacgaaaggctttaccacagctgttaaatgtctccgaggcaccgtggccgctgtgtatgatgtaaccctgaatttccgaggtaataaaaacccatcattacttggtatactctacgggaagaaatacgaagctgatatgtgcgtttag

SEQ ID NO: 40107 - DNA, 1131 bp, Artificial Sequence
  Description of Artificial Sequence: Synthetic coding sequence
atgggcctgctggccttcctgaagacccagttcgtgctgcacctgctcgtcggattcgtttttgttgtgagtggtctggtgattaatttcgtccagctgtgtaccttggcgctgtggccggtgagcaaacaactgtaccgccgcctgaactgtaggctggcctacagtctgtggtcacaactcgtgatgctattggagtggtggtcctgcaccgagtgtacattgtttacagatcaagcgacagttgagaggttcggcaaagagcacgccgtaattatccttaaccacaatttcgagattgactttctgtgtggctggacaatgtgtgaacgtttcggggtgctgggctcttcaaaagtgttggctaagaaggaactgctgtatgttccactgattgggtggacttggtatttcctggagatcgtgttctgcaaaagaaaatgggaggaggaccgagatacggtggtcgagggactcaggagactgagtgactatccagagtacatgtggttccttttgtattgtgaggggacccgattcaccgagactaagcaccgggtgtctatggaggtggcggcggctaagggattgcccgtcttgaagtaccacctcttgccacgtactaagggatttacgaccgcagtgaagtgtttacggggcaccgtcgcagcagtgtacgatgtgaccctcaattttcgcggcaataaaaatccttccctgctgggaatactgtatgggaagaagtacgaagccgacatgtgcgtaaggcgattccccttggaagatatccctctcgacgagaaagaagccgctcagtggctgcataagctctaccaagagaaagatgctctccaagagatctacaaccagaagggcatgttccccggcgaacagttcaagcctgctagacggccatggacgttactgaacttcctgagctgggcgaccatcttgctctctcccctcttctccttcgtactcggggtctttgctagcggaagtcccttactgattctgactttcttgggattcgtcggcgccgctagcttcggagtccgacgcctcattggcgtgaccgaaattgagaaagggtcatcttatggcaaccaggagttcaaaaagaaagagtag

SEQ ID NO: 40108 - DNA, 1137 bp, Artificial Sequence
  Description of Artificial Sequence: Synthetic coding sequence
atggacctggccggcctgctgaagagccagttcctgtgccacctggtgttctgttatgtgttcatcgctagcggactgatcattaacacaattcagctttttacattgttgttatggccaatcaacaagcagctgtttcggaaaatcaactgcagactcagctattgtataagttcacagttagtgatgcttttggaatggtggagcggtaccgaatgtacaatttttacagatccacgagcttaccttaagtatggcaaagagaacgcaatcgtcgtgctgaatcataaatttgaaatcgacttcctgtgtggctggtccttatctgaacgttttggactcctgggaggtagtaaagtactggcgaaaaaggagttggcctacgtacccattattggttggatgtggtacttcacagaaatggtcttttgcagccgaaaatgggaacaggatcgaaaaaccgttgcaacgagtcttcagcatctgagggattacccggagaaatacttcttccttatccactgcgagggtacaagatttacagagaaaaaacacgaaatttccatgcaggttgctagagcaaagggacttcccaggttgaaacatcatcttctcccgagaacgaagggatttgctattaccgttcggagtctaaggaacgtggtaagtgccgtttacgattgcacactcaacttcagaaataacgagaatcccactcttctgggggtgctcaacggtaagaagtatcatgctgacctgtacgtccgacgaatacccttagaagacatccctgaggacgacgatgagtgttctgcatggctacacaaattgtatcaggaaaaagacgcctttcaagaagagtattatagaaccggcacatttcctgagacacctatggttcccccacgtaggccctggaccctggtgaactggctcttctgggcaagcctggtgttgtaccctttctttcagttcctggtgtctatgattaggagcgggagcagcctgacactggcatcatttattcttgtatttttcgtcgcatcagttggggtaagatggatgatcggagtgactgagattgacaagggctccgcttatggcaatagcgacagcaagcagaaattaaatgattag

SEQ ID NO: 40109 - DNA, 480 bp, Artificial Sequence
  Description of Artificial Sequence: Synthetic coding sequence
atggacctggccggcctgctgaagagccagttcctgtgccacctggtgttttgctatgtttttatcgcatccggtttgattataaacacgattcagttgtttaccctcttgctgtggccgattaacaaacagctctttcgcaaaattaattgcagacttagctactgcatctctagtcaactcgtgatgttgctggagtggtggtccgggacggaatgtaccatctttacagacccccgtgcctatctaaagtatggcaaggaaaacgccatcgtggtcctgaaccataagtttgagatagacttcctctgtggatggtctttatctgagaggttcggactcctcggggtctcccagaagtgcatccccccctgcctcacgcacttttcaggcagcgcacctcccctggtttttttgctactggtcatccagaaccttcagaagaaccagcaaagtttctacctgatgaagtggagctag

SEQ ID NO: 40110 - DNA, 375 bp, Artificial Sequence
  Description of Artificial Sequence: Synthetic coding sequence
atgctgctggagtggtggagcggcaccgagtgcaccatcttcaccgatccccgcgcctacctgaaatacggtaaagagaacgcaatagtcgttttgaaccataaattcgaaatcgatttcctctgcgggtggagtctgtcagagcggtttggcctcctgggcggctctaaggtcctggccaagaaggaactggcctacgtccctattatcggctggatgtggtactttacagagatggtattctgtagccggaagtgggagcaggatcggaagacggttgccacgtcactccaacatctaagagactatcccgaaaagtattttgtttgccgccatcagtctagttgcgttcctcgcgctccggctggactgtag

SEQ ID NO: 40111 - DNA, 402 bp, Artificial Sequence
  Description of Artificial Sequence: Synthetic coding sequence
atggacctggccggcctgctgaagagccagttcctgtgccacctggtcttctgttacgtgtttatcgcgtcaggtctgatcatcaatacaattcagctcttcactttgctgctatggccaattaataagcagttgttcagaaagattaactgtagactgtcctactgcatttcatctcagctggtcatgcttttggagtggtggtcgggcactgagtgtacgatcttcaccgacccgcgggcgtacctgaagtacggcaaagagaatgccatcgtcgtattgaatcataaatttgagatcgactttctctgcgggtggtccctgtctgagcgctttggcctgctgggattcgatctactgcacgtcgcctgtatgcccctcgaattaggactgttttcctag

SEQ ID NO: 40112 - DNA, 357 bp, Artificial Sequence
  Description of Artificial Sequence: Synthetic coding sequence
atggacctggccggcctgctgaagagccagttcctgtgccacctggtcttctgctatgtgttcattgcaagcggcctgattatcaacacaatccagttgttcactctcctgctttggcctattaataagcagttgtttcggaaaataaattgcaggctgtcatactgcatatccagccgcttgcaggggcccgggcaggagagagcaggtttgtgccccaactatagactcgatgttgtgttacaccgcgacggcctcttgttcgcccaggtgggcgcgggctctcaagacggttgtcaccagtttgctgcccctcccggcttacccagggaggtgttctttccagactccctctag

SEQ ID NO: 40113 - DNA, 318 bp, Artificial Sequence
  Description of Artificial Sequence: Synthetic coding sequence
tgaagcgccgtgtacgactgcaccctgaacttccggaacaacgagaatcccaccctgctgggagtgctaaatggaaagaagtatcacgccgacttgtacgtcagaagaattccattggaagacatcccagaggatgatgatgaatgcagtgcctggctccacaaactatatcaagaaaaaggatggggtgataccgaattcagcaaacagtacgtgtctgtttcaaggcccggccggctcgccctctgtccctctgagaaaatcgcagagcaacaagtcgaggtggtacacggttttagcaagcagagcggagagtag

SEQ ID NO: 40114 - DNA, 651 bp, Artificial Sequence
  Description of Artificial Sequence: Synthetic coding sequence
atggacctggccggcctgctgaagagccagttcctgtgccacctggtgttctgttacgtcttcatagcctccggcttgataataaacaccatccagttattcacgctgctgctgtggccaatcaacaaacagctgttccgcaaaatcaactgccgcctgagctattgcatcagtagcctttctgctgtatacgactgcactctgaatttcagaaacaacgaaaatcccacactcttgggagtgttaaacggcaagaagtaccacgcagacctgtatgtgcgacggatcccactggaagacattcccgaagatgatgacgaatgttcggcttggctccataaactttatcaagagaaagacgcatttcaagaagaatactataggacaggcacatttcccgaaacacctatggtcccacctcgcaggccctggacgcttgtgaattggctgttctgggcctcccttgttctgtatccattctttcagtttctggtgagtatgattcggagtggcagcagcctcacattagctagtttcattctggtgtttttcgttgctagcgtgggagtcaggtggatgatcggagtgaccgagatcgataagggaagcgcttacggaaattccgactccaagcagaagctcaacgattag

SEQ ID NO: 40115 - DNA, 1095 bp, Artificial Sequence
  Description of Artificial Sequence: Synthetic coding sequence
atgctgctgagcctggtgctgcacacctacagcatgcggtacctgctgccatcagttgttctgctaggaacagctcccacgtacgtattagcctggggggtctggcgcctcctgagcgcctttctgcctgcccggttctatcaggcactggacgacaggctctactgtgtgtatcaatcaatggtgttattttttttcgaaaactacaccggcgtgcagatcctgctctatggggatttgccaaagaacaaagaaaatatcatctatctggccaaccaccaaagtacagtggattggatcgttgccgacatccttgccattagacagaacgctctggggcacgtgcggtatgtccttaaggaaggactgaaatggctccctctctatggttgttattttgcacagcacggcggtatctacgtgaagcgtagcgccaagtttaatgaaaaggagatgcgcaataagctccagtcctatgtggatgctgggacaccgatgtatctcgtgatattccccgagggcacccgctacaaccccgagcaaaccaaggtactttctgctagccaggctttcgctgcacaaaggggtctggccgtattaaagcatgtgcttaccccccgcattaaggcaacacacgtcgcttttgactgcatgaaaaactaccttgacgcaatatacgacgtcactgttgtgtacgaaggaaaggacgatggaggacagcgaagggaatctccgaccatgactgagttcctttgtaaagagtgtccaaagatccacattcatattgatcgcatcgacaaaaaggacgttccagaggaacaggagcatatgcgacggtggctgcacgaacggtttgagataaaagacaaaatgcttattgaattttacgagagccccgatccggaacggcgcaagagatttcccgggaaatccgtaaatagcaagctgtccataaaaaaaacactgccctcgatgctcattctctctgggttaaccgccgggatgttgatgacagatgccggacgcaagctctacgtcaatacttggatttacggcacactgctgggttgcctgtgggtcacaatcaaggcttag

SEQ ID NO: 40116 - DNA, 564 bp, Artificial Sequence
  Description of Artificial Sequence: Synthetic coding sequence
atgggcggcctgttctggcggagcgccctgcggggcctgcggtgcggccctcgtgctcctgggcctagtctcctggtcagacatgggagtgggggtccttcgtggacacgcgagcgcactcttgtggccgtgaagccagacggagtgcagagaaggctggttggggatgtgattcagcggtttgagagaaggggctttactctagtcgggatgaaaatgttgcaggctcccgaaagtgtgctcgctgagcactatcaggatctccggcgaaagccattctaccccgccttgatcagatacatgtcctccggaccagtagttgccatggtctgggaaggttacaacgtggtgagagctagccgggcaatgatcggacacacagattcagcagaagcagctcccggtacaatcagaggcgatttctctgtacatatctctcgtaatgttatccacgcctccgattcagttgaaggggctcagagggaaatccagctgtggtttcagtcgtcggaactcgttagctgggcagatggcggccagcacagtagcattcatccagcatag

SEQ ID NO: 40117 - DNA, 636 bp, Artificial Sequence
  Description of Artificial Sequence: Synthetic coding sequence
atggcccagcccccccccgacgtggagggcgacgactgcctgcccgcctatcggcacctattttgtcctgatttgttgagggacaaggtggcctttattaccggcggcggctccgggattggctttagaatcgctgagatctttatgagagcctcggaggatcagatgggccactgttccagctcgggtacctgtctggcaggggtcgcaaccttcatggtaattgttggcaagcagccgccaaatcagaaaagtagggaaactaaagaacaaggacgccagatcccctttgtgtgcgtgaggcacggctgccacactgtgattgcctcacgttcattgccacgcgttctgaccgccgcgcgcaaattggctggcgccaccggaaggagatgcctgcccctgagtatggatgttcgggcccccccagccgttatggctgccgttgaccaagccctaaaagagtttgggaggatcgatatcctcatcaactgctctagcagttcatgcggtcttccattctgccgttgcggtcgggaacttccagtcccaaggtggcgccttgtgctgcagagacttcaggaccgcgatggacacaggtatcagcggcatctccagtgcgtgagctgcgccctgtag

SEQ ID NO: 40118 - DNA, 813 bp, Artificial Sequence
  Description of Artificial Sequence: Synthetic coding sequence
atgccccgggacaacatggccagcctgatccagcggatcgcccggcaggcttgcctgacattccgaggatccggaggaggtcggggcgctagcgaccgcgatgccgcctcaggacctgaagctcccatgcagcccggcttcccggagaacctttccaaattgaagagcttgctcactcagttacgggcagaagatctaaatattgcgcctagaaaggctactctgcagcctctgcctcccaatctgccacccgttacctacatgcacatctacgagaccgatggtttttcattgggcgttttcctgttgaaatcggggactagcattcctttacacgaccatcctgggatgcacggcatgctgaaggtgctgtatggaacagttagaatttcttgcatggacaagctcgatgctggcggcgggcagcgtccgagggcactgccaccagaacagcagtttgaaccccctctccagcctagggagcgggaggctgtgagacccggagttctgcggtctcgcgccgaatacaccgaggcatccggaccctgcattctgacccctcacagggacaacctgcatcagatcgatgctgtcgagggcccagcagcatttctggacattcttgccccgccttacgacccagatgatggacgggactgccactactatcgcgttctcgagcctgttcggcccaaagaagcgagttcatctgcttgcgatctgccacgggaagtgtggctgcttgaaacccctcaggcggatgacttctggtgcgagggagaaccctaccccggaccaaaggtgtttccctag

SEQ ID NO: 40119 - DNA, 1032 bp, Artificial Sequence
  Description of Artificial Sequence: Synthetic coding sequence
atgctggccacccggctgagccggcccctgagccggctgcccggcaagacccttagtgcctgcgacagagagaatggggccagaaggccattactattaggcagtacaagttttataccgatcggccgccggacgtatgctagtgccgccgagcctgtaggtagtaaggcagtgctggttacgggctgcgacagcggattcggattcagcctggcaaaacacctgcatagcaagggtttcttagtgttcgcaggatgcctgatgaaagacaaaggacacgacggcgtcaaggaactggactcacttaactccgacaggctgcgaacggtgcagttgaatgtgtgctcgtccgaggaggtggagaaagtcgttgaaatcgtcaggagctccctcaaggatcctgagaagggaatgtggggactcgtgaacaacgccggaatctccaccttcggagaggtcgagttcactagtctggaaacttataagcaggtggccgaagtaaatctgtggggtactgtacgcatgactaaaagcttcctcccgttgatccgccgagccaagggcagggttgtgaacattagttccatgcttggccgcatggccaaccctgcccgaagcccatactgcattaccaaatttggcgttgaagccttcagtgattgtttgaggtatgaaatgtacccccttggtgtcaaagttagtgtcgtcgagccgggcaacttcattgcagccacttcattatactcaccagagagtatccaggctattgctaaaaaaatgtgggaagaactgcccgaggtggtgagaaaagattatgggaagaagtatttcgacgagaaaatcgcaaaaatggagacctattgcagcagtggtagcactgacacatccccagtaatagacgctgttactcatgcactaacggccaccacaccttatactagataccatccaatggactactattggtggttaagaatgcagatcatgacccacttgcccggtgcaatctctgatatgatttacatacgttag

SEQ ID NO: 40120 - DNA, 1032 bp, Artificial Sequence
  Description of Artificial Sequence: Synthetic coding sequence
atgctggccacccggctgagccggcccctgagccggctgcccggcaagaccctgtctgcctgtgatagggagaatggcgctcgaagacccctcctgctgggcagcacctcattcattccaattgggagacgcacttatgcctcagcagccgaacctgtaggttccaaggccgtactggtcaccggatgcgactccgggttcgggttctccctagctaaacacttgcactctaagggttttcttgtattcgccggttgtctgatgaaggataaggggcatgacggcgtaaaagagttagattcccttaatagtgacagactcaggacagtgcagctcaatgtgtgcagctctgaagaggtggaaaaagtggtggagatcgtgcggagctcactgaaggatcctgaaaaaggaatgtgggggctggtgaacaacgctggtatctctacattcggcgaggtggagttcacgtcgctagaaacttacaaacaagttgctgaagttaatctctggggcactgtaagaatgacaaagagctttttgccacttattagaagggcgaaaggccgcgtcgtcaacatatcttctatgctggggaggatggctaaccccgctaggagcccctattgtattacgaagtttggagtggaagctttcagcgattgtctgaggtatgaaatgtaccccctgggcgtgaaggtatcggtggttgagccaggtaactttatcgccgcaacctctctctattctccagagtccatccaggcaatcgccaagaagatgtgggaggagttgcccgaggttgtgcggaaagactacggcaagaagtatttcgatgaaaaaattgccaaaatggagacatattgttcttcaggctcaacagacacaagccctgtgatcgatgccgtgacccatgctctgacggccacgaccccctacaccaggtaccatccgatggactattactggtggctccgaatgcagatcatgacacatctacctggcgctatttcagacatgatctatattcggtag

SEQ ID NO: 40121 - DNA, 1032 bp, Artificial Sequence
  Description of Artificial Sequence: Synthetic coding sequence
atgctggccacccggctgagccggcccctgagccggctgcccggcaagacactgtccgcctgcgatagagaaaacggagctagaagaccactgctactgggcagcacatcatttattcccattggtcgtcggacttatgcttccgcagccgaaccagtcggaagcaaagctgtcctggtcactggatgcgattctggttttgggttctcgctcgccaagcatttgcactcaaagggatttctggtctttgccggttgcctgatgaaggataaaggccacgacggcgtgaaggaacttgactccctaaacagcgatcgactgcgcacagttcagctaaacgtatgctccagtgaggaagtcgagaaggtagtggagatcgtgcgatcatctttgaaggaccctgagaagggcatgtggggacttgtgaacaatgccggcatttcgacatttggcgaggttgagttcacttcactcgaaacatataaacaggtggccgaggttaacctgtggggaactgtgcggatgacgaaatcgtttctgcccctaatacgccgggccaaggggagggtcgtgaatatttcgtccatgttgggcaggatggccaaccccgcgcggtcaccttattgtatcactaaattcggcgtggaagctttttcagattgtctccgctatgagatgtatccactgggcgtcaaggtctcggtggtcgaacctgggaactttattgctgccaccagtttatattcccccgagtcaatccaggcgattgccaaaaagatgtgggaggagctgccagaagttgtgcgtaaggactatggcaaaaagtacttcgatgagaagattgctaagatggagacttactgctcttccggcagcaccgacacatcacctgttatcgatgccgtcacccacgctctgactgccaccaccccttacactcgatatcatcctatggactactattggtggctccgaatgcagatcatgactcatctcccaggggccatctccgacatgatttatatcaggtag

SEQ ID NO: 40122 - DNA, 270 bp, Artificial Sequence
  Description of Artificial Sequence: Synthetic coding sequence
atgctggccacccggctgagccggcccctgagccggctgcccggcaagaccttatcagcatgtgatagagagaacggggctcgtcgccctctgctcctcggaagtacgtccttcatccctatcggccgccgcacctacgcttccgcggctgagccggtgggcagtaaagccgttctggttacgggttgtgattctggatttggcttctcgctggccaagcacctgcactcaaagggcttcctggtgttcgcaggatgtctcatgaaatag

SEQ ID NO: 40123 - DNA, 771 bp, Artificial Sequence
  Description of Artificial Sequence: Synthetic coding sequence
atgaaggacaagggccacgacggcgtgaaggagctggacagcctgaactcagatcgtctgcgcacggtacaactgaacgtttgcagctcggaagaggtggaaaaggtggtcgaaattgtgagaagcagcttgaaagaccctgaaaaaggcatgtggggtctggtcaacaatgccgggatcagtacattcggagaagtcgaatttacttccctggagacatacaagcaggtggctgaggtgaatctgtgggggacagtacggatgacaaaaagcttcttgccgctaataagacgcgcaaagggtagagttgtaaatatcagcagcatgctgggacggatggccaaccccgccaggagcccctactgtataaccaagttcggcgtggaagctttttcagattgtttgaggtacgagatgtatccgctgggcgtgaaggtgtctgtggtcgagccgggaaactttatagcagcaacatctctgtacagccccgaaagtatccaggcaattgcaaagaagatgtgggaggagctgcctgaggtcgtccgtaaagattacggaaagaaatacttcgacgagaaaatcgctaagatggagacctattgcagctccggatcaacagacacatcgcccgtgatcgacgcagtgacccacgcccttactgccacgacaccatataccagatatcacccaatggattattactggtggctccgtatgcaaattatgacccatctgcccggggctatcagcgatatgatctatatccgctag

SEQ ID NO: 40124 - DNA, 153 bp, Artificial Sequence
  Description of Artificial Sequence: Synthetic coding sequence
atgctggccacccggctgagccggcccctgagccggctgcccggcaagaccttgtccgcgtgcgaccgggaaaatggggcacggcgcccccttctgctgggatccacatcgtttattcccatcggccgccgcacttacgctagcgccgcatag

SEQ ID NO: 40125 - DNA, 1011 bp, Artificial Sequence
  Description of Artificial Sequence: Synthetic coding sequence
atggccgccagcctgcggctgctgggcgccgccagcggcctgcggtattggtcaagacggttgcgcccagctgctggctccttcgccgctgtctgctcaagaagcgtggcttcgaagacacctgttgggtttattggactcggcaatatggggaatcctatggcaaaaaacttaatgaaacacggttacccgctgatcatctacgatgttttccccgacgcttgcaaagagttccaagacgctggagagcaggtcgtttccagccccgcagatgtggctgagaaggccgacaggatcattaccatgctgcccacgtccattaatgctatcgaggcgtattctggggcgaacggtatcttgaagaaagttaagaagggatcacttcttatcgactcatcaacgatcgatcccgccgtgtccaaggagctggccaaagaagtcgagaaaatgggcgctgtgtttatggatgcacctgtatccggaggagtaggcgccgcaagatccggcaacctcacattcatggttggtggcgtcgaagacgaattcgccgcagcacaagagctcctcgggtgtatgggatccaacgtcgtctattgtggagcagtcggtactggacaggccgctaagatttgtaataatatgctgctcgccatcagtatgataggaaccgctgaggctatgaacttgggaattcgactcggtctagaccccaagctcttggccaaaatcctgaacatgagtagcgggaggtgttggtcgtccgatacatataacccagtgcccggggtgatggatggagtaccctcggcaaataattaccagggtgggttcggaacgaccctgatggcaaaggatctgggcttagcccaggactccgccaccagtaccaagtctcccatccttctgggctccttagcccaccagatttatcgaatgatgtgcgcaaagggctattccaaaaaggatttctctagtgtcttccagtttctgagagaggaagagaccttctag

SEQ ID NO: 40126 - DNA, 1554 bp, Artificial Sequence
  Description of Artificial Sequence: Synthetic coding sequence
atggccgccctgcggctgctggccagcgtgctgggccggggcgtgcccgctgggggcagcggcctagccctgtcccaaggatgcgcccgctgcttcgccaccagcccaaggctgcgggccaaattttatgctgacccggtcgaaatggttaaagacattagcgacggcgctacagtgatgatcggcggtttcgggctctgtgggattcctgagaacctcatagccgcactgctccggacacgggtgaaggatctgcaggtggtgtcaagcaacgtgggtgtagaagactttggtcttggtttgctgctggccgcccggcaggtgagaagaatagtttgctcctatgtgggggagaacacgctctgcgagagccagtacctcgcaggcgaactggagttggagctgaccccacagggaacccttgctgaacgaattcgcgccgggggagctggtgtccctgctttctacacaccaacgggatatggaactctagtacaagagggcggcgctccaatacggtacactccggacggccacctggccttgatgtcccagccccgtgaagtgcgagaatttaatggagaccatttccttttagaaagggccatccgggcggactttgccctggttaagggatggaaagcagacagggcagggaatgtggtattcagacgctccgctcgcaactttaatgtcccaatgtgtaaagctgccgatgtgacggctgtggaggtcgaagagatcgtggaggttggcgcgttccctccagaagacattcatgtgccaaacatttatgtggacagggtgatcaagggccagaaatacgagaagcgtatcgaaagactaaccattctcaaagaagaagatggcgacgcagggaaggaggaggatgcccgcaccagaattattagacgagctgctctcgaattcgaggatggcatgtatgctaacctcggtatcggcattccccttctcgcctcaaactttatcagcccgtcaatgaccgtccacttgcacagcgagaacggaattcttggactcgggccttttccgaccgaagacgaagtggatgccgatctgatcaatgcaggaaaacagactgtaaccgtgctccctggagggtgcttcttcgccagcgatgacagctttgccatgattagaggaggccatattcaactaaccatgttaggtgcgatgcaagttagtaagtacggcgacctggccaactggatgatccccggcaagaaggtgaagggcatgggcggtgcaatggatctggtgagcagtcagaagacccgagtggtcgtgactatgcagcattgcactaaggacaatacccctaagattatggaaaagtgcacgatgcccttaactggcaaacgctgcgtcgaccgcataattaccgaaaaggcagtgtttgacgtgcaccgcaagaaggagctcactctgagagagttgtgggagggcctgaccgttgacgatattaagaagtcaacgggttgtgcatttgctgtttctccaaaccttcggcctatgcagcaagttgccccgtag

SEQ ID NO: 40127 - DNA, 798 bp, Artificial Sequence
  Description of Artificial Sequence: Synthetic coding sequence
atggccgccctgcggctgctggccagcgtgctgggccggggcgtgcctgcaggtggctcagggctggcattgtctcaaggatgcgctcgctgtttcgcaacgtctccaagactcagggccaagttctatgccgaccctgtagagatggtaaaggacatttccgatggagctacggtaatgatcggtgggttcggcctgtgtggcattccagaaaacctgatcgccgcgctgttgcgcacacgcgtgaaggacctgcaggtggtttcctctaacgtcggtgttgaggatttcggtctgggtctgctcctggctgccaggcaggtccgcagaattgtctgtagttatgtaggcgaaaacacgctctgtgaatctcagtatctcgccggcgagttggaactcgaacttaccccccaaggaacgctggctgaaagaattcgcgccggaggagccggggtacccgcattttacacacccaccgggtacggcactttggtgcaagagggcggagctcccattaggtatacacctgacggtcacctggccttgatgagccagcctcgggaggtgagggagtttaacggcgaccacttcctgctcgagcgagctatacgggcggatttcgctctggtcaagggttggaaagcagacagggcgggtaatgtggtattccgtcgctccgcccgcaactttaatgtaccgatgtgcaaagccgccgatgtgactgcagtggaggtggaagagattgttgaggtcggggcctccccacagaagacttctacatttcttacatttatgtag

SEQ ID NO: 40128 - DNA, 984 bp, Artificial Sequence
  Description of Artificial Sequence: Synthetic coding sequence
atgctgggcccccaggtgtggagcagcgtgcggcagggcctgagcagaagtttgtcaaggaatgtcggcgtgtgggcatccggcgaggggaagaaggtggacatcgccggtatctacccacctgtcaccactcccttcacagctaccgcggaagttgactatggcaaacttgaagagaacctccacaagctcgggacctttcccttcagggggtttgtggttcagggaagtaacggtgagtttcctttccttaccagctccgagcgcctggaagttgtcagtcgggtgagacaggcaatgcccaaaaatcgcctcctgctggcaggttctgggtgtgagagcacgcaggccactgtggagatgactgtgtcaatggctcaggtgggcgcagatgctgcgatggttgttaccccgtgctattaccgcggccgcatgagcagcgctgccctgattcaccactacactaaggtggcagacttaagtcctattcctgtggttctttactcagtccctgcaaataccgggcttgatcttcctgtggacgctgtggtcactttaagtcagcaccccaacatagtggggatgaaagactcaggcggggacgtcactcgcattggtctgattgtccacaagactcgcaagcaggatttccaagttctagcggggtccgccggattcctcatggcctcttatgccttaggggccgtcggcggggtgtgcgcactcgcgaatgtgctgggcgcgcaggtttgccagctggagcggctgtgttgcacaggtcagtgggaggacgcccagaaactgcagcaccgactgattgagccgaacgccgctgtcacaagacgctttggtatcccaggattgaagaaaatcatggactggtttggctattatggaggcccctgtcgggcccccctgcaagagctgagccctgcggaggaggaggccctccgcatggacttcacctctaatggctggttatag

SEQ ID NO: 40129 - DNA, 495 bp, Artificial Sequence
  Description of Artificial Sequence: Synthetic coding sequence
atgctgggcccccaggtgtggagcagcgtgcggcagggcctgagccggtccctgagtcgaaatgtgggagtttgggcttctggggaggggaaaaaagtcgacatcgcggggatatatccaccagttactactccgtttacagccaccgccgaagttgactacggaaagttagaggagaatctccacaaattaggtacattcccattcaggggggcggtaggcggggtttgtgccctggctaacgtgctgggtgcgcaagtttgccaactggagagactgtgctgcacaggtcagtgggaagacgcccaaaaactccaacaccggctgattgaacctaatgctgcagtcactagaagattcggcattcctggcctcaagaagatcatggactggttcggctattatggtggtccctgccgcgcacctttgcaagaactgagtccagctgaagaagaagccctgcgtatggacttcacctcaaatgggtggctctag

SEQ ID NO: 40130 - DNA, 612 bp, Artificial Sequence
  Description of Artificial Sequence: Synthetic coding sequence
atggccgccgccgccgtgagcagcgccaagcggagcctgcggggcgagctgaaacaacgccttagagctatgtccgctgaggagcgcctgcgccaaagccgtgtgctttcgcagaaggtgatagcccatagcgaataccaaaagtctaagcgcatctctatttttctgtctatgcaggatgagatcgagacggaggagatcattaaagacatcttccagcgtggaaagatttgtttcatccctagatatcgctttcagagtaaccatatggacatggtgcgtatcgaaagcccagaggagatcagtcttctccccaaaactagctggaacattccacaacctggcgaaggagatgtacgggaagaagcactgtccacaggagggctggatctaatctttatgccaggccttggcttcgataaacacggaaacagactgggtcgggggaaaggctattacgacgcatatctgaagagatgcctccagcaccaagaggtcaagccttatacactggccctggcattcaaagaacagatttgtttgcaggtcccggttaacgagaatgatatgaaagtggacgaagtcctgtatgaggattctagtaccgcgtag

SEQ ID NO: 40131 - DNA, 1392 bp, Artificial Sequence
  Description of Artificial Sequence: Synthetic coding sequence
atgcaccggagcttcctgcaggcccggcggagccggaacaccacccgtcctgccctactgcgtctgtccgactacctactcactaactacagaaaaggcgttcgacctgttcgagattggaggaagccgacaactgtcagtatcgatgtgatagtatacgcgattctgaacgtagacgagaaaaaccaagtgttgaccacctacatctggtacaggcaatattggactgacgaattcctccagtggaaccccgaggacttcgataatatcactaaactgtcgatcccgacggactccatttgggtcccagatatcctaataaatgaattcgtggacgtgggaaagtcccccaacataccttatgtttacattagacatcagggcgaggtgcaaaactataaaccgctgcaggttgtcaccgcctgctccctagacatatacaatttcccttttgatgtgcagaactgcagcctaacatttaccagctggctccataccatccaggatattaacatttccctctggagactaccggaaaaagtaaaatcagataggagtgtttttatgaaccagggggagtgggagctcctcggagttctcccgtattttagagagtttagtatggagtcaagtaattactacgccgaaatgaaattttacgtggttattagacgcaggccactgttctacgtggtgtcccttctactgccatctatttttctgatggtcatggatatcgtgggattttaccttccccccaactccggagagagggtctcctttaagataacgcttcttttaggatatagcgtattcttgataatcgtgtccgatactttgcctgcaaccgctatcggtacgccactgatcggagtctatttcgtggtgtgcatggcgctgctggtgatcagtctggccgagaccatctttatagtccgcctcgtgcacaagcaggacctccaacagcctgtgcccgcatggcttcgtcacttagtgctggagcgaattgcgtggttactctgtctgcgtgagcagtctacaagccagaggccccctgccaccagtcaggccaccaaaactgacgattgtagcgcaatggggaaccattgttctcacatgggcggtccccaagatttcgaaaagagcccgcgggatcgctgtagccctccccccccaccacgagaagccagccttgcagtgtgtggcctgcttcaggaactttcgtcaatccgtcagttcttagaaaagcgtgacgagatccgggaggtcgccagagactggctcagggtcggctctgtactcgataaactgttatttcacatttacctgcttgccgtgcttgcctacagcatcaccctcgtcatgctctggtcaatatggcagtacgcgtag

SEQ ID NO: 40132 - DNA, 1551 bp, Artificial Sequence
  Description of Artificial Sequence: Synthetic coding sequence
atgctgggcaagctggccatgctgctgtgggtgcagcaggccctgctggctctgcttttaccgacactactggctcaaggcgaggcccgccgttctcggaacacaaccagacctgcgttgctgcgcctatccgattacctcctcactaattacaggaagggtgtgcgaccagtccgggactggcggaagcccactaccgtgagcatagacgtgattgtctatgccatcctgaacgtggacgaaaagaaccaagtgctcacaacttacatctggtaccgacagtattggacagacgaatttctgcaatggaatccggaggactttgacaatatcaccaaactatccatccctaccgattcaatctgggttcccgacatattaatcaacgaattcgttgatgtaggaaaaagtcctaacatcccttacgtctatataagacaccagggtgaggtgcagaattacaagccgctgcaggtggtcacagcatgtagtctcgatatctataattttcccttcgacgtgcagaactgttcccttacctttacttcttggcttcataccatccaggacattaatattagcctctggaggctcccggaaaaggtgaaatctgatcggtcagtgttcatgaatcagggggagtgggagctattgggagtgctaccttatttcagagaattcagcatggaaagcagtaactactatgcagaaatgaaattctacgtggtgatcaggagaaggccactattttacgtagtttctctccttttgccctcaatcttccttatggtgatggatatcgtcggattctacctgccaccaaatagcggggagcgggtcagtttcaaaattacccttctgctaggctatagtgtgttcttaatcatcgtctctgataccttgcccgctacggctatcgggacgcctctgattggaaaggctcctccggggtcacgtgctcaatccggggaaaaacccgcgccatcccacctgctccatgtatcactggcaagcgctctcggctgcaccggagtttatttcgtcgtgtgcatggccctgctcgtcatcagcctcgccgagaccatcttcatcgttaggctggtacacaaacaggatctgcaacagcccgtgcccgcttggctgcggcaccttgtgctcgagaggatcgcatggctgttgtgcctgagggaacagtcgaccagtcaaaggcctcctgcaacatcgcaagcgacaaagacggatgactgtagtgctatgggcaatcattgttcgcacatggggggccctcaggacttcgaaaaaagcccaagggatagatgcagtccgcctccgccaccaagagaggcttcgcttgccgtgtgcggtctgctccaggagctgtcctcgatccggcaatttctcgaaaaacgggatgagatacgcgaagtcgcccgtgattggctacgagtggggtccgtgctggataagctcctcttccatatatacctgttagctgttctggcctactccatcactttagttatgctctggtcaatctggcagtacgcatag

SEQ ID NO: 40133 - DNA, 1455 bp, Artificial Sequence
  Description of Artificial Sequence: Synthetic coding sequence
atgctgggcaagctggccatgctgctgtgggtgcagcaggccctgttggccctgctacttccaacactattagcccagggggaagcccgccgctccaggaatacgaccagacccgcccttctgagattgtctgattacttgcttactaactaccggaaaggagttcgtcccgtgcgagattggcgtaagccaaccacagtctctatcgacgtgatcgtgtatgccattctcaatgttgacgaaaagaaccaagtgctgacgacctacatctggtaccgccagtattggaccgacgaatttctgcagtggaaccccgaggatttcgacaatatcaccaaactgtccattcccacagacagcatctgggtgccagatatcctcattaacgagttcgtcgacgtggggaagtctcctaacatcccctacgtatacattcggcaccaaggtgaagtgcagaactataaacccctgcaggtcgtaacggcgtgttccctggacatttacaatttccccttcgatgtccagaactgcagcttaacctttacatcctggttacatacgatccaggacattaacatctccctctggaggctccccgaaaaggtgaagagtgacagatccgtgttcatgaatcagggagaatgggaactattaggcgtccttccctacttcagagagttttctatggagtcctcaaactactacgcagaaatgaaattttatgtggtaattcgacggaggcccctgttttatgttgtgtcactgctgctccctagtatatttctgatggtgatggacatcgtggggttttatctccccccaaattctggtgagagggtttcctttaagatcactctcctcttggggtactccgtgttcttaattatcgttagcgatactcttccagctacagctatcggcacgcccctgataggggtatattttgtggtgtgtatggctctccttgtgatatcccttgcagaaacgatctttatcgtgcgcctggttcacaagcaagacttacagcaacccgttcccgcctggctcagacacctcgtgcttgagagaatagcctggcttctttgtctcagggaacagagcacgtcacagcgaccacccgcaacctctcaggcgactaagacggacgattgcagcgccatgggaaaccactgttcgcatatgggcgggcctcaagactttgagaagagcccacgagatcggtgttcacccccaccacccccgcgtgaggctagtctcgctgtttgtggcctcctgcaggaattaagttctatcagacagttcctggaaaagcgagatgagattagggaggtagccagagactggttgagagtcggaagcgtattggacaagctcctattccatatatatctgttggcagtgctggcttacagtattacgcttgtgatgctttggagcatctggcagtatgcatag

SEQ ID NO: 40134 - DNA, 1437 bp, Artificial Sequence
  Description of Artificial Sequence: Synthetic coding sequence
atgctgctgtgggtgcagcaggccctgctggccctgctgctgcccactctgctggcccagggagaagcacgccggagtaggaataccacccgccctgctttgctacgtctgtccgactatctgttgaccaactataggaagggcgtgagaccggtgagagactggcggaagccgactactgtcagtatcgatgttatcgtatacgcaattctgaatgttgatgaaaaaaatcaagttctcaccacctatatctggtatcgccagtactggactgatgaattcctgcagtggaaccccgaggatttcgataacataaccaaactgtccatcccgaccgattcaatatgggtcccagacattttgataaatgagttcgtcgacgtcggcaaaagtccaaatattccctatgtgtacataagacaccagggagaagttcagaattataaaccattgcaggtagtgacagcttgttcccttgatatttataacttcccatttgacgttcagaattgttcactcactttcaccagctggctgcacacgatacaagacatcaacatctcattgtggagactgcctgaaaaggtcaaatcagatcgaagcgttttcatgaaccagggcgaatgggagctgctgggagtactgccctatttccgcgagtttagcatggaatcctctaactattacgcagaaatgaagttttatgtcgtgattaggcgccgcccattattttatgtggtgtccctgttgctgccatccatcttcctcatggtgatggatattgttggcttctatctaccaccgaactcaggagaaagagttagctttaaaattaccttgctcctcggctacagcgtgttcctgatcattgtcagtgatacacttcccgcgacggcaattgggaccccccttatcggagtgtatttcgttgtgtgcatggcgctgctcgtaatttcactggccgaaaccattttcatcgtgagactggttcataaacaggaccttcaacagccggtgcctgcatggttacgccacctagtactcgaaaggatcgcttggctgctctgtcttagggagcagtccacaagtcagcgcccaccagccaccagccaggccacaaaaaccgatgattgtagcgctatggggaatcactgtagccacatgggggggcctcaggacttcgagaaatctcccagagacaggtgttcaccacccccaccacctcgagaggctagccttgccgtatgcggcctactccaggagctctcctccatccggcagtttttagaaaagagggacgagataagagaagtggccagggattggctgagggtgggctcagttctggataaactgttgttccacatctacctactcgccgttctggcatacagcattactctcgtcatgctgtggtccatatggcagtatgcctag

SEQ ID NO: 40135 - DNA, 1533 bp, Artificial Sequence
  Description of Artificial Sequence: Synthetic coding sequence
atgctgctgtgggtgcagcaggccctgctggccctgctgctgcccacactgctagcgcagggcgaggctcgacgttcgaggaatacaacccgccctgccctgctgcggctttccgactacctgctgactaattacaggaagggcgtgcgcccggtgagagactggcggaaacccacaacagtatccatcgatgtgatcgtatatgccattcttaacgtggacgagaaaaatcaagtcctgactacgtatatatggtaccgccagtactggacagatgagttcctacagtggaatccagaggattttgataacataacaaaactgagtatccctactgactcaatctgggttcccgacattctcattaatgagtttgtggacgtggggaaaagccctaatattccgtacgtctacatacggcatcaaggagaggttcagaactacaagccgttacaggtagtgaccgcctgtagtcttgacatctacaatttcccgttcgacgtccaaaactgctctcttaccttcacctcctggctgcacacaatccaggatattaacatctccttgtggagactccccgagaaagtaaagtccgataggtcagtgtttatgaatcagggggaatgggagttgttgggggtgctgccctactttagagagttctccatggagagtagtaactactacgccgaaatgaaattctacgtggttatacggagacgacctctgttttatgtagtgtcgctgctgttaccttccattttccttatggtaatggacatcgtgggtttttacttaccaccaaatagtggcgagcgggtatctttcaagattactttgctcctcgggtactctgtatttttgatcattgtaagcgacactctccccgcgacagcaatcggcacacctctgattggcaaagctcccccaggaagtagggcacagagcggggagaagcccgcccctagtcacctgttgcacgtgtcactcgcttctgcccttgggtgcaccggagtgtacttcgtggtctgcatggctctactggttatctcactggctgagaccatctttattgttcggctggttcacaagcaggatcttcagcagcctgtgcctgcctggcttaggcacttagtgctcgaaagaatagcctggctgctttgtctcagggaacagagcacaagccaaaggcccccggccaccagtcaggctacaaagacagacgattgttccgcaatggggaaccactgctcccatatgggaggccctcaggactttgagaaatcaccaagagaccgatgttctcccccccctcctcctagagaggcaagcttggcagtttgcggattgttgcaggagctgtcaagcattagacagttcttggaaaagcgggatgaaattagggaggtcgcgcgtgattggctgcgagtgggcagcgtgctcgataaactgttgtttcatatttaccttctggccgtattggcctactccattaccctcgtaatgctctggtctatttggcagtacgcatag

SEQ ID NO: 40136 - DNA, 717 bp, Artificial Sequence
  Description of Artificial Sequence: Synthetic coding sequence
atgctgctgtgggtgcagcaggccctgctggccctgctgctgcccacactactagcccagggagaagcaagacgctcaagaaacacgacacgacccgcattgctgaggctaagcgactacctgctcactaactataggaaaggcgtgcgccctgtgagagattggcgtaaacctacgacagtgtctatagacgtaatagtgtacgctattctcaacgttgatgaaaagaaccaggtgctgacaacttatatatggtacaggcagtactggacagacgagttcctgcaatggaatcctgaggactttgataacattacaaaattatctatccctacagactcgatctgggtgcccgacattctcattaacgagtttgtcgacgtggggaaatctcctaatatcccttacgtgtatattcggcaccagggggaggtgcagaactataagcctctgcaggtggttaccgcttgttccttggacatctataacttccctttcgacgtgcagaattgttcactgacttttaccagctggcttcacaccagtggacacccacccgctgctccacttctgtgtgggcagccagcaaccgcgcagcacctgcctcacggccatggacatcgcggcctgttgccagcaccccagcagtggagggagggcctctttcaggactataccccgcccgggctgcttggcttaccagaccaccggttctag

SEQ ID NO: 40137 - DNA, 669 bp, Artificial Sequence
  Description of Artificial Sequence: Synthetic coding sequence
atggtgatggacatcgtgggcttctacctgccccccaacagcggcgaacgagtgtcctttaaaatcactctgttgttgggctattctgtcttcctgatcattgtcagtgatactctgcccgccactgccatcgggacccccttgatcggggtctactttgtggtgtgtatggccttattggtcatatcccttgccgagacaatttttattgttaggctggttcataagcaggacctgcaacagccagttcctgcttggcttagacatctcgttctggaaagaatcgcctggctgctctgtctccgcgaacagtccacttcacaacgcccacccgccacttcacaggccaccaaaactgatgattgctccgccatgggaaaccattgcagtcacatggggggcccacaggattttgaaaagtcacctcgtgaccggtgctctcctcctccacccccacgcgaagcttctctggcggtgtgtggacttctccaggagctttccagtatcagacagtttctggagaagcgggacgaaattcgagaagttgctcgcgattggctgagagtcggaagcgtgttagataagctactcttccacatttatctgctcgcggtactggcctacagcattacactggtaatgctgtggagtatctggcagtacgcatag

SEQ ID NO: 40138 - DNA, 5349 bp, Artificial Sequence
  Description of Artificial Sequence: Synthetic coding sequence
atgggcgccggcagcagcaccgagcagcggagccccgagcagccccctgaagggagctccacaccggctgagcccgaacctagcggtgggggtccatccgccgaggccgcaccagacaccaccgccgacccagccatcgcagccagcgaccccgcaactaagttgctccagaaaaatgggcagctgagtacgatcaacggcgtagctgagcaggatgagctatcactccaggaaggggatcttaatggacaaaaaggcgcgcttaacggtcaaggggcattgaacagccaagaagaggaggaggtgattgtgacagaagtcggacaaagggactccgaagatgtgtctaagcgggactcggataaggagatggccactaaaagcgccgtggtgcacgatattaccgatgatggtcaggaagaaacgccagagataatcgaacaaatcccttcgagcgaaagcaatcttgaggagcttacacagcccacagaatcacaggccaatgacatagggttcaagaaggttttcaagttcgtaggatttaaattcacagttaagaaggataagacagagaaaccagataccgtgcagctgctcaccgtcaaaaaggacgagggagagggtgctgctggcgcgggggaccataaggatccgtctctgggcgccggtgaggccgcatcgaaagagtccgagccaaaacaaagtaccgagaagccggaggagacactaaaacgggaacagagtcacgcagaaatctccccgcctgcggagagcggccaggctgtggaggagtgtaaggaagagggagaagaaaagcaggagaaggaaccctccaaaagcgcggaaagccccactagtcccgtgaccagcgaaactggctcgaccttcaaaaagttcttcacccaaggatgggccggatggagaaagaagactagcttccgcaagcccaaggaagacgaagtcgaggcttccgaaaagaaaaaggagcaggaaccagagaaagtggataccgaagaggatggtaaagccgaagtggcttccgagaagctgaccgcaagtgagcaagcacaccctcaggaacccgctgagtcagctcacgaacccaggttgagcgccgagtatgagaaggttgagctgcccagcgaagaacaagtctccggatcacagggcccttctgaagaaaagcccgctccgctggcgactgaggtctttgacgaaaagatagaggtgcaccaggaggaggtagtggcagaggtccacgtgtcaacagtggaggaacgcactgaagagcagaagaccgaggtggaagaaacggctggttctgtcccggccgaggagttagtcgaaatggacgcagagccacaggaggcggaacccgcgaaagaattggtgaagctcaaggaaacttgcgtgagtggcgaggatccgactcaaggagcagacctgtcgccagacgagaaagtcctctccaagccacctgagggcgtggtgagtgaagtggagatgctgtcctcccaggagcggatgaaagtgcaagggtcccccttaaagaagctttttacctccacaggcctgaaaaagctttctggcaaaaaacaaaaaggcaaaagggggggcggtgatgaggagtctggagagcatacccaggtaccagccgactcacctgacagccaggaggaacagaaaggcgaatcgagcgcatcaagtccagaagagccagaagagatcacctgccttgaaaagggccttgctgaggttcagcaagatggtgaagctgaggagggcgccacctctgatggcgaaaaaaaaagagaaggtgtaacaccgtgggcgtccttcaagaagatggtcacaccaaagaaaagggtccggcgcccaagcgagtccgacaaggaggacgagctggataaagtcaagtcagccactctctcctccaccgaaagcacagcttctgagatgcaggaggaaatgaagggctccgtggaagagcccaaaccggaagaaccaaagcgaaaggtggacaccagcgtttcttgggaagccctcatttgcgttggttcgagcaaaaagcgcgctagacgggggtcatcctctgacgaagaagggggccctaaggcaatgggcggagaccaccaaaaggctgatgaagccggtaaggacaaagagaccgggaccgacggtattctggccggttctcaggagcatgaccctggccaggggtcctcaagtccagaacaggccggctctcccactgagggagagggcgtgagtacatgggaaagttttaaaagactcgtgaccccacgcaagaaatctaagtctaagctcgaggaaaagagcgaggacagcattgcagggagcggggtggagcacagcacacctgatacagagccaggtaaggaggaatcctgggtgagtatcaaaaaatttattcctggccgtagaaagaaaagaccggatggaaaacaggagcaggccccagttgaagacgcagggcctactggagcaaatgaagacgactctgatgtaccggcagtggtgcctctctccgaatacgacgccgtggagcgggaaaaaatggaggcccagcaggcgcagaaatctgccgaacaacctgagcagaaagccgcaaccgaagtcagcaaggagctgagtgagagccaggtgcatatgatggcagctgctgtcgccgatggcacccgggccgccacaattatagaggagcgcagcccatcctggatctccgccagtgtcacagaaccactggaacaggttgaggccgaggcagccctgttgaccgaagaagttttggagagagaggtgatcgcagaggaggaaccaccaaccgtgactgaacccctgccagagaacagggaggctcgaggcgacacagtagtgagtgaagccgagctgacacccgaggccgtgacagccgcggagactgcagggcccctaggcgcagaagagggcacggaggccagcgcggcagaggagactaccgagatggtgtctgcggtcagtcaactcaccgatagccccgataccacagaagaggcaactccggtccaggaagtggagggcggcgtgccagatattgaggagcaggagagacggactcaagaggtgctgcaggctgtggccgaaaaagtgaaggaagaaagccagctccccgggacaggaggacccgaggatgtgctgcagccagtacagcgcgcggaggcagagcgcccagaagagcaggccgaagcaagcggactgaagaaggagacggatgttgtcctgaaggtcgatgcccaggaggccaagacagaaccattcacacaggggaaggtggtcggccagaccacgccagaatcgtttgagaaagctcctcaggtcactgagtcaattgaatcctctgagctggtgacaacttgccaggctgaaacactggccggggttaagagccaagagatggtcatggagcaggccattccacctgacagcgttgagacaccaaccgatagtgagaccgacggctccacccctgttgcagacttcgacgccccaggaaccacacagaaagacgagattgtcgagattcacgaggaaaatgaagtggcttctggtactcaatctggaggtactgaagccgaggctgtccccgcccagaaggaacgtccaccagccccaagttcgttcgtgtttcaggaagagaccaaagaacagtctaagatggaggacaccctcgagcacacagataaggaagtttctgtcgaaacagttagcatcttgtctaagacggaggggacccaagaggctgatcaatatgctgatgagaagaccaaagacgtaccgttttttgagggactagaagggtctatcgatactggcataaccgttagtagagagaaagtgactgaagtcgcccttaagggagagggaacagaagaggccgaatgcaaaaaggatgacgcactagaactgcagagccacgctaagagcccaccatcccctgtggaaagggagatggttgtgcaggtagaaagagaaaaaacagaagctgagcccacccacgtgaacgaagagaagcttgagcacgagacagcagtcaccgtgagtgaggaagtgtccaaacagttgctacaaactgtgaatgttccaatcattgacggcgccaaggaagtgagctcgctggaagggagtccacctccttgcctcgggcaagaagaagccgtctgcactaagatccaggtccagtcgtcagaagcatcttttactctgacagccgcagccgaggaggagaaggtactgggggagacagcaaacattcttgaaaccggtgagactctggaaccagccggcgctcatctcgtgctggaggagaagagctcagagaaaaatgaagactttgccgcccatcctggagaggatgccgtgcctacaggacctgattgtcaggctaagtcaacacctgtgatcgtatccgccactacaaagaaaggcctgagtagtgacctcgaaggagagaaaacaaccagcctcaaatggaagagcgacgaggttgatgaacaggtagcctgccaggaagtgaaagtcagcgtggctattgaagaccttgagcccgagaacggtatccttgaacttgaaaccaaatcaagcaaactcgtgcagaacatcattcagacggccgttgatcagttcgtgcggaccgaggagacagccaccgagatgctgacaagtgagctgcagacacaagcccacgtgattaaggccgacagccaggatgccgggcaagagaccgagaaggagggcgaagaaccccaggcttctgctcaggacgaaacccctatcacctccgcgaaagaggaaagtgaatcgaccgccgtcggacaggcccatagtgatattagcaaggacatgagcgaggcatcggagaaaacaatgactgtggaggtggagggatctacagtgaatgatcagcagctggaagaggtggtactgcctagcgaagaggagggtggcggtgccgggactaagagtgttcccgaggacgacggacatgccttgttagctgaacgcatcgagaaatcactcgtcgagcctaaggaggacgagaagggagatgacgtcgacgaccctgaaaatcagaatagcgcgcttgctgatactgacgcctctgggggtctgactaaggaaagccctgataccaatggccccaagcagaaagaaaaggaagatgcacaggaagtggagctccaggaaggtaaggttcattctgagagtgacaaggccattaccccacaggctcaggaagaactccagaagcaggagcgcgaaagcgcgaaatcagagctgaccgagtcatag

SEQ ID NO: 40139 - DNA, 5055 bp, Artificial Sequence
  Description of Artificial Sequence: Synthetic coding sequence
atgctgggcaccatcaccatcaccgtgggccagcgggacagcgaggacgtcagcaaaagagacagcgacaaagagatggcaactaagtcagctgtcgtgcatgacattactgatgacggacaggaagagaccccagagattatagaacagattccttctagtgaatccaatcttgaagaactgacgcagcccactgagagtcaagccaacgacatcggctttaaaaaggtctttaagttcgtcggttttaagttcaccgtcaaaaaggataaaacagaaaagcctgacacagtacagttactcacagtaaagaaggacgagggggaaggagccgcaggagctggagatcataaggaccctagtctgggggccggagaagctgccagtaaggaatccgagcctaagcaatccacagagaagccggaagaaactctaaagcgggagcagtcacatgcagaaatttccccccccgcagaatccggccaggctgtcgaagaatgtaaagaagagggggaagaaaaacaagagaaggaaccttccaagagcgctgaatctcctaccagccctgtcacatccgaaacgggatctacgttcaaaaaattttttacccagggatgggccggctggagaaagaagacaagttttcggaagccaaaggaggacgaagtggaggccagcgaaaaaaaaaaggaacaggaaccagagaaagtggacaccgaagaggacggcaaggccgaagtggcctcagaaaaactcaccgcctcggagcaagctcatccccaagagcccgccgaaagcgctcacgagccaagactgagcgcggaatacgagaaggtggaactgcccagcgaggaacaggtgtctgggtcccaggggccttcagaggaaaaaccggcgccactggctaccgaggtgttcgacgaaaagattgaggtgcaccaggaggaagtcgtggcggaagttcacgtgagtaccgtagaagagcgtaccgaggaacaaaaaacagaagtcgaggaaacagcagggtccgttcctgccgaagagctcgtggagatggacgcggaaccccaggaagctgagcctgctaaggaacttgtgaagttgaaggaaacctgcgttagtggcgaggatcccacccagggcgcagatctcagccctgacgaaaaggtcctatctaaacctccagagggggtggtgtcggaagtggagatgttaagtagccaggaacgtatgaaagtacaaggttctcctctcaaaaagctgttcacgtcaactggccttaagaagctatccggaaaaaagcagaagggaaagaggggcggaggtgacgaagagtctggggaacacacacaggtgcctgcagattcccccgactcacaggaggaacagaaaggagagtcctccgcaagttccccagaggaacctgaggagatcacatgccttgaaaaaggattggctgaggtgcagcaggatggggaggcggaggaaggagcaacttccgacggggagaagaaaagagagggcgtaacaccctgggccagtttcaaaaaaatggtgacaccaaagaagcgggtaaggcgcccctcagagagtgataaggaggatgaactcgataaagtgaaatctgccacactctctagtaccgagagcactgccagcgagatgcaggaggaaatgaaggggtctgtggaagaacccaagcctgaggagccaaagaggaaagtggatacatctgtgtcatgggaggctcttatttgcgtaggctctagcaaaaagagagcacggcgcggctcctctagtgatgaggaggggggccccaaagctatgggcggagatcatcagaaggccgacgaagccggtaaagacaaggaaactgggaccgatggcatcctggcaggctcccaggagcacgatccagggcaggggtcttcttcccctgagcaagctgggtctcccacagagggggagggcgtaagtacttgggagagttttaaaaggttagtgacgccacggaaaaagtcaaagtccaaactggaggagaagtcagaagattcaatcgcaggatccggcgtggaacacagtactcccgacacagagcctgggaaggaggagagttgggtttctattaaaaagttcatccctggccgtagaaaaaaacggccagacgggaaacaggaacaagcccccgtggaagatgcgggtcccacaggcgcaaacgaggacgactcagatgttccggccgtcgtacctctgtctgagtacgacgccgttgaacgagaaaagatggaagcccagcaggctcaaaaatccgcagagcagccagaacagaaggctgctacggaggtttccaaggaactttcagaatcccaggtccatatgatggctgctgccgtggccgacggaacacgggcggctaccatcatagaggagcgctctccatcctggatctcggcctctgttacagagcccctggaacaggtggaggctgaggccgccctgttgacggaagaggtactcgagagggaagtaatcgctgaggaggagcctccaacagtaacagaacccctgcccgagaatagggaagcacgaggcgatacagtggtctccgaagccgagcttaccccggaggcggtcaccgcagccgagaccgcgggtcccctgggggccgaagaaggcaccgaggccagtgccgccgaagagaccactgagatggtaagtgccgtgtctcagttgacagacagccccgacactactgaggaagccacccctgtgcaagaggtggaggggggggtaccagacattgaagagcaggagcggcgcacgcaagaagtcctgcaggcagtagccgagaaggtcaaggaggaaagccagcttcccggaactggcggacccgaggacgttctacagccagttcagcgggcagaggcagagcgcccagaagaacaggcagaagcatctggtttgaaaaaagagacggatgttgtactgaaagtggacgctcaggaagccaaaacggaaccctttacacagggtaaggtcgtaggccagacaacacctgaatcattcgagaaggctcctcaggtgacagaatccatagaaagctccgagcttgtaaccacgtgtcaggcagagacactcgcgggtgttaaaagccaagaaatggtaatggaacaggctattcctccggactccgtggaaacccccactgacagcgagaccgatggatcaacccccgtggccgacttcgatgctcccggcacgacccagaaagacgagattgtggaaattcatgaagaaaacgaagtggcgtcgggtacccaatccgggggcactgaggctgaggccgtccctgcccaaaaggagagaccacccgctccttcctcttttgtgttccaggaggagaccaaagagcaaagcaagatggaagatacgcttgaacatactgataaggaggtgagtgtcgagaccgtgagtattctcagcaaaacggagggtacccaggaggcggatcaatatgctgacgaaaaaactaaagacgtaccattctttgaggggctggaggggagcattgatacgggaattactgtttctcgcgagaaggttactgaggttgccctgaaaggcgagggaaccgaggaggccgagtgtaaaaaagatgacgcactggaactgcaaagccatgcaaagtcccctccatctccggtcgagagagaaatggtggtacaggttgaacgggagaagaccgaggcggagccgacccatgttaacgaggaaaagctggaacacgagacggcggtgacagttagcgaggaagtgagtaaacagctgttacagacggtgaatgtgcccataattgatggagccaaggaggtgagctctctcgaaggtagccccccaccttgccttgggcaggaggaagccgtgtgcaccaagattcaggtgcagtccagtgaggctagtttcactctcaccgctgcagccgaagaggaaaaagtgctcggcgagactgccaatattttagaaactggcgagacactagagcccgccggagcacacctggtgttggaagaaaaatcaagcgaaaaaaatgaggacttcgccgcccacccaggggaggacgctgtcccgacgggacctgactgtcaagctaagagcactccagtgattgtctccgccaccactaagaaagggcttagcagtgaccttgagggcgaaaagaccacgagcctgaaatggaaaagtgacgaggttgacgagcaggtagcatgtcaggaggtgaaggtgtcagttgccatcgaagacctggagcctgaaaatggaatcctggaactagagaccaagtcttccaaactagttcagaacattatccaaaccgccgtggaccagttcgtgcggacagaggagacagccaccgaaatgctgacttccgagctgcaaacccaggctcacgtgattaaggctgattcccaagacgcaggtcaggagaccgaaaaggagggagaggaaccacaggcgtcagctcaggacgagacacctattaccagcgccaaagaagaatctgaaagcaccgccgtcgggcaagctcattccgacatcagcaaagacatgtccgaagcctccgagaagaccatgacagttgaagttgagggcagtacagtgaacgatcagcaactagaagaagtggtcttaccctccgaggaagagggcggcggcgcagggactaagtctgtacctgaagacgatggacacgcattactggctgagaggatcgagaagtccctggttgagccgaaggaggatgagaagggagacgatgtagacgacccggagaatcagaactccgccctggctgacactgacgcctccggcggtctgaccaaggagtctcctgatacaaatggtccaaaacagaaggagaaggaagacgcgcaggaggttgagctgcaggagggcaaagtacattccgaaagcgacaaagccataacaccccaggcccaggaagagcttcagaagcaagagcgcgagtctgcaaagtccgaactgactgaatcttag

SEQ ID NO: 40140 - DNA, 5034 bp, Artificial Sequence
  Description of Artificial Sequence: Synthetic coding sequence
atggtgggccagcgggacagcgaggacgtgagcaagcgggacagcgacaaggagatggccaccaagtccgccgtggtacatgacattactgacgatggccaggaagagacgcccgagatcattgaacagatccccagcagtgaatcgaatctagaggaacttacccagccaaccgagagccaggctaacgacattggattcaaaaaagtctttaagtttgtgggctttaagtttaccgttaaaaaggataagaccgaaaaacctgacaccgtccagctacttacagtgaagaaggacgaaggggagggagctgccggcgctggagatcacaaggacccctctctaggcgcaggcgaagctgcctcaaaagaatcagaaccgaaacagtccaccgagaagcctgaggaaaccctgaagcgggaacagtcccacgccgaaattagcccaccagcagagtctggacaggcggttgaagaatgtaaggaagagggtgaagaaaaacaggaaaaggaaccaagcaaatctgccgagtcccccacgtcccccgtgacatctgagactggaagcaccttcaaaaaattcttcacccagggttgggccgggtggcggaaaaaaacatcattccggaaacctaaggaggatgaggtagaagccagcgaaaaaaaaaaggaacaagagcccgagaaagtggataccgaagaagacggcaaagccgaggtcgcaagcgaaaaactgactgcgagtgaacaggcacatcctcaggagcctgccgagagtgcccacgagcctagacttagtgcagagtatgagaaagtggagctgccgagcgaagagcaggtttctgggtcccagggaccctccgaggaaaagcccgcccctctggccaccgaagtattcgatgagaaaattgaagtacatcaggaagaggtagtggcagaagttcatgtatcaaccgttgaggagcgtacggaggagcaaaaaactgaggttgaggagaccgctggcagtgtgcccgccgaggaactggtggaaatggatgcagaaccacaggaggccgagccagccaaagaactggtgaagcttaaagagacatgtgtgagtggcgaagatcccacgcagggcgcggatctcagcccggatgagaaggtgctaagcaagcctcctgagggggtggtttcagaggttgagatgctatcttcccaggagaggatgaaggtgcagggatctcccctgaaaaaattgtttacctcaaccggtctgaagaagctatccgggaaaaagcaaaagggtaagcggggaggaggcgatgaggagagcggggaacacacacaggttcccgccgacagccccgatagccaggaggaacaaaagggcgagagtagcgccagctcacctgaagaacctgaagagattacatgtctcgagaaaggcctggccgaggtgcagcaggacggcgaggcagaagagggagccacgagcgatggagagaagaagagggagggcgttacaccttgggcttcctttaagaaaatggtgacccctaaaaaacgggtgcggaggcccagtgaatccgataaggaggacgagctggacaaagtgaaatcagctaccctatcttctacggagtcaactgccagcgagatgcaggaagaaatgaagggttccgtcgaggagcccaaacctgaagagccaaagcggaaggtcgacacaagtgtcagttgggaggcactgatctgcgttggatccagcaagaaacgcgccaggcgaggctcttccagcgacgaagaggggggccccaaagctatggggggcgaccaccagaaagcagatgaggcggggaaggacaaggaaacaggaactgacggcatacttgccgggtcccaggagcatgacccgggacagggatcttcctccccagaacaggcaggatccccgactgagggtgaaggagtctccacttgggagtccttcaagaggctggtgactcccaggaagaaaagcaaatcaaaactggaggagaaatccgaagacagtattgctggctcaggggtcgagcactctacacccgatactgagcctggcaaagaggaatcctgggtgagtatcaaaaagttcatcccgggccgacggaaaaaacggcccgatgggaaacaggagcaggctccagttgaagatgccgggccaaccggagctaacgaagacgacagtgatgtgcccgcagtggtgcccctgtctgaatatgacgccgttgagcgggagaaaatggaagcacagcaggctcagaagagtgcagaacaaccggaacaaaaagcagccactgaagtgagtaaggagcttagtgagagccaagttcacatgatggcggccgcagtggccgacggcaccagggccgcgaccatcattgaggagcgcagccccagctggatctcagcctccgtcaccgaacctttggaacaggtcgaggccgaggccgctctgcttacggaagaggttcttgagagggaggtcatcgccgaggaagagcccccgacagtcacagagccacttcccgaaaatcgcgaggctcgaggagataccgtggtgagtgaggccgagttgacccccgaggcggtgaccgctgcagaaacagcagggcccttgggcgctgaggaagggacagaagcgtctgccgctgaggagaccactgagatggtgtctgccgtgagtcaactgaccgactcccctgataccacggaagaagcgaccccagtccaagaggtggaaggaggcgtacctgatatcgaagaacaggaacggcgaacacaggaagtgctccaggccgtggcagaaaaagtgaaggaagagtcccagctccctgggactggtggacctgaagacgtccttcagcctgtacaacgagctgaggctgagcgccccgaggagcaggctgaggctagtgggcttaagaaggaaaccgacgtggtcctgaaggtggacgcccaggaggctaagacagagccatttacacaggggaaagtcgtaggtcagaccactcccgagtccttcgagaaagctcctcaagtgactgagtcaattgaaagctccgagctggtgactacttgtcaagctgagaccctggccggggtcaagagccaagagatggtgatggaacaggcaattccgcccgacagcgtggaaactcccaccgattctgaaaccgacgggagcactcccgtagccgatttcgatgcccctgggacaactcagaaagatgaaatcgtggagatccacgaggaaaatgaggtggcctcaggcacacagagcggaggcaccgaggctgaggcagttcctgcccaaaaagagcgcccacctgcccccagtagtttcgtgtttcaggaagagaccaaggagcaatcgaagatggaagatactctggagcataccgataaggaggtctctgtggagacggtaagcatcctctctaagaccgagggaacacaagaagcagatcagtatgctgatgagaagaccaaggatgtccccttcttcgaggggttggaggggagcatcgatacagggattactgtgtctagggagaaagtaaccgaggtagcgcttaagggcgagggaacagaagaagccgagtgtaagaaagatgatgccttggaattgcagagccacgcgaagtctccaccttcccccgttgaacgggaaatggtggtgcaggttgagagagaaaaaacagaagccgagcccacgcatgttaatgaggagaagctggaacatgagaccgccgtaacagtgtccgaggaggtctccaagcaactgctccagacggtcaacgtgcccatcatcgacggcgcaaaagaagtttcatcccttgagggaagcccacccccttgcttgggacaggaggaggctgtctgcacaaagatccaggtgcagagttccgaggcttcatttactcttactgccgccgcggaagaagaaaaagttctgggggaaactgcaaatatcctggagacaggtgaaaccttggagcctgccggcgctcatctggtgctggaggagaagagttcagaaaaaaacgaagactttgccgctcaccccggagaggacgccgtccctactgggcccgactgccaggctaaatccacacctgtgatagtgagtgctacaacaaagaagggcctttcctctgacctcgaaggagaaaagacaacctctttgaagtggaagagtgatgaagtggacgagcaagtggcatgccaggaggtaaaggtcagcgtggccatcgaggacctcgaacctgagaacggcattcttgagctggaaacaaaaagctctaagttagtgcagaatatcatccagactgcggttgaccagtttgtaaggacggaggaaaccgccacagaaatgttgacgtctgaactgcaaacgcaagcccacgtgatcaaggccgattctcaggacgctggtcaggaaaccgaaaaggagggggaggagccgcaagcttcagctcaggatgaaacgccaatcacgtctgccaaagaagaatccgagagcaccgctgtcggacaggcccacagcgatatcagcaaggatatgtccgaggcaagtgaaaagacaatgactgtcgaggtggagggttctacagtgaacgaccagcaactggaggaggtggtcctaccctctgaggaggaaggcggtggagcaggtacgaagagcgtacccgaggacgatgggcacgctctgctagccgaacggatcgaaaagtcactggttgagcccaaagaagatgaaaaaggtgacgacgtggatgaccctgagaaccagaattccgcactcgcggatacagacgcctctggaggcctcacgaaagaaagccccgacactaatgggcctaagcagaaagagaaggaggatgcccaggaagtggaattgcaggagggaaaagtccactcagagtcagataaggcaattacaccgcaagctcaggaggaactccagaagcaagagagagaaagcgctaagtctgagctcaccgaaagctag

SEQ ID NO: 40141 - DNA, 5349 bp, Artificial Sequence
  Description of Artificial Sequence: Synthetic coding sequence
atgggcgccggcagcagcaccgagcagcggagccccgagcagccccctgaaggctcctctaccccggccgaaccagaacccagcggagggggcccaagcgctgaggcagcccctgacaccaccgctgatccggcaatcgccgcctccgacccagctaccaagctgctccaaaagaatggccaactgagcaccataaatggcgtggcagaacaggatgagcttagtctccaggagggcgatttaaacggccagaaaggcgcgctcaatggtcaaggggctcttaattcccaggaggaagaagaggtaattgtcaccgaagtgggccagcgcgacagcgaagatgtttcgaaaagggatagcgacaaggagatggctactaaaagcgccgtagtgcacgacatcacggacgatggccaggaggagactcctgagatcatagagcagattccaagcagcgaatcgaacctggaagagttgacccaacccaccgagtcacaggccaatgacatcggtttcaagaaggtcttcaagtttgtgggatttaagttcacagtgaaaaaggataaaacagagaaacccgacacagtgcagctcttgacggtaaaaaaggacgaaggcgaaggcgctgccggtgctggtgaccacaaggatcccagcctaggagctggtgaggccgcgtcaaaggaaagtgaacctaaacagtccaccgaaaagcctgaggagacactcaagagagagcaaagccacgcagagattagtccacccgcagagtcaggccaggccgtagaagagtgcaaagaggagggagaggaaaagcaggagaaggagccttccaaaagcgctgaatcgcctacgtcccccgttacttccgaaaccggcagcacattcaagaaattttttactcaggggtgggctggatggaggaaaaagacctcattccggaagcctaaagaggacgaggtggaagcgtcggaaaagaaaaaagaacaggagcccgagaaggtcgatacggaggaggatggtaaggccgaggtggccagcgaaaagttaacagcgtcagagcaggcccacccccaggagcctgcagagagcgcccacgagcccagactctccgcggagtacgagaaggtcgaattgccgtccgaggagcaggtgtctggctcccagggcccatctgaagaaaagcccgccccgctcgccactgaggtattcgacgaaaaaattgaagtccaccaggaggaggtcgtggcggaagtgcacgtcagcaccgtggaggagcgtacagaggagcagaagaccgaggtggaggaaacagctggctctgtgcctgccgaggaattagtcgaaatggatgcagaaccccaggaagccgagccagctaaagaacttgtcaaacttaaggaaacatgcgtttctggagaagacccaacccaaggggctgacctgtcacctgatgagaaggtgttatcaaagcctcccgagggagtggtgtcggaggtggaaatgctgagcagccaggagaggatgaaggtgcaggggagtccacttaagaaactgtttaccagtaccggcctgaaaaagttgagtggaaaaaaacagaaggggaagcgaggtggcggagatgaggaatctggcgaacacactcaggtgcccgccgactcccctgattcccaggaagaacagaagggtgaatcctcagcatcatcaccagaagagcctgaagagattacttgcttagagaaagggctggcagaggtgcagcaggatggggaggcggaggaaggcgcgacatctgacggcgaaaagaaaagagagggtgtgacaccatgggctagttttaagaagatggtcacccccaaaaagcgcgtccggcgaccaagtgaaagtgacaaggaggacgaactcgataaggttaagtctgcaaccctgagttcaacggaatctaccgcatcagagatgcaggaggaaatgaagggcagtgtggaagagccaaagcctgaggagcccaagcggaaagtggacaccagcgtaagctgggaggcacttatctgcgtgggcagttcaaaaaaacgggcacgcaggggtagctcctcagatgaggagggcggacccaaggctatggggggggatcaccagaaggctgatgaagcaggtaaagacaaggaaacgggcaccgatggaatcctagcaggttcccaggagcatgaccctggccaaggctccagcagtccagaacaagcgggaagtccaactgaaggcgagggagtcagcacctgggagtcattcaagaggcttgtcactcctcggaagaaatccaaaagcaagctcgaggaaaaatcagaggattctattgccggctccggcgtggaacacagcaccccggatactgagcctgggaaggaagaaagttgggtcagcataaagaaatttatacccggaaggcggaagaaacggcccgatggaaaacaggaacaagccccagttgaggacgctgggcccacaggtgccaatgaagacgattccgatgtgcccgctgtagtacccctgagcgagtatgacgcggtagaacgggaaaagatggaggcgcagcaggcccagaaatctgccgaacagcctgagcaaaaagcggctacggaggtcagcaaggagctgtctgagtctcaggttcatatgatggcggccgcagttgccgacggcacgcgggctgcgaccattatcgaggaacgatctccgtcctggatctctgcttccgtgactgaacctctggaacaggttgaagcggaggctgcccttctcacagaggaagtgctggagagggaggtaattgcagaagaagagccccccacagttactgagccactccctgagaaccgggaagctaggggtgatacagtagtgtccgaggccgagcttaccccggaggccgtgactgctgcagagaccgccggcccgctcggggccgaggagggtacagaagcctcagccgcagaggagacaactgagatggtgtctgcagtctcccaactgaccgacagtcccgatacaaccgaagaggccaccccggtgcaagaggtggaggggggcgtccccgacatcgaggagcaagagaggcggactcaggaggttttgcaggccgtggcagagaaggtcaaagaggagtctcaactgcccgggactggagggccggaagatgtattgcagcctgtgcaacgagccgaggccgaacgacccgaggaacaggctgaagcctcagggctgaagaaggagacggacgtagtgcttaaggtggatgcccaggaggccaagactgagccattcacccagggtaaggtggtaggccaaaccacaccggagtctttcgagaaagctccccaggtcacagaatccatcgagtcctctgaattggtcaccacgtgtcaggctgagactctggctggtgtgaagagtcaggaaatggttatggagcaggcaatccccccggatagtgtggagacccctacagactctgaaaccgacgggtccacacccgttgctgacttcgacgctccaggaactacccagaaagacgaaatcgttgagatacatgaagagaacgaggtcgcctcaggaacccagagcggggggacagaagctgaggctgtgcctgcccagaaagaacggccgcccgctcctagcagctttgtgtttcaagaagaaacaaaggaacagtccaagatggaagacacccttgagcacacggataaggaggtaagcgtggaaaccgtctccattctgtctaaaacagagggcacccaggaggccgaccagtacgcagacgaaaagacaaaggacgtgcctttcttcgaaggactcgagggatctatagacacaggcatcacagtgagcagagaaaaggtgacagaggtcgcccttaaaggagaggggactgaggaagcagaatgtaaaaaggatgacgcactagaactgcagtcgcatgctaaatcaccgccatcacctgtggagcgagaaatggttgtccaggtggaaagagagaagacagaggccgaacctacgcatgttaatgaagagaagctcgaacatgagactgcagtaactgtgtccgaagaagtttccaaacagctcctgcaaaccgtgaatgtcccaatcatcgatggcgccaaggaagtcagcagcctggagggctccccccccccttgcctagggcaggaggaagccgtgtgtaccaagattcaagtgcagagctcagaagcatccttcactctaactgctgcagccgaggaagagaaggtactgggcgagaccgccaacattctggagaccggggagacactggagccagccggtgctcacctggtgttggaggagaagagctcagaaaagaatgaagattttgcggctcaccccggagaagacgccgtaccgaccggacccgactgccaggccaaaagtactcccgtgatcgtctccgccactacgaagaaggggctcagtagcgatttggagggtgaaaagacaacttcgcttaaatggaagtcagacgaggtcgatgagcaggtggcatgccaagaggttaaggtgagcgttgccatcgaagacttggagcccgagaacgggatactcgagctcgagacaaagtcaagtaagctagtgcagaacattatccagaccgcagtcgatcagttcgttcgcaccgaggaaaccgccacagagatgctgaccagcgagctccagacacaagcacatgtgatcaaggccgattcccaagacgcgggtcaggaaacggagaaggagggtgaagaaccacaggcctccgcccaggacgagacgccgattacaagtgcgaaggaggaaagtgagtctacagctgtgggacaagcacacagtgacatcagtaaggacatgtctgaggccagcgagaagaccatgactgtcgaagtcgaaggttcaaccgtgaacgaccaacagttggaggaggtggttctacccagcgaggaagaagggggaggagccggtaccaagagcgtccccgaagatgatggacacgcactcctggccgaaagaattgaaaaatctcttgtagagcccaaggaggatgagaaaggcgatgatgtagacgacccggagaaccagaactccgccctggcagacacagatgcgagcgggggattgacaaaggaatccccggataccaacgggcctaaacaaaaggagaaagaagatgcgcaggaagtggagctgcaagaggggaaggtccactccgagtcggacaaggcgataacaccgcaagcacaggaagagctgcagaagcaggagcgcgagagcgccaagtcagagctgacggagagttag

SEQ ID NO: 40142 - DNA, 1284 bp, Artificial Sequence
  Description of Artificial Sequence: Synthetic coding sequence
atggagaccaccatcagcgagatccacgtggagaacaaggacgagaagcggagcgctgagggcagtccaggcgccgaacgtcaaaaagaaaaggcctctatgctctgctttaaacgcagaaaaaaagctgccaaggcgttgaaaccaaaagctggctccgaggccgcagatgttgctagaaagtgcccacaagaggctggggcaagcgatcagccagagccaacaagaggtgcttgggccagtctgaagaggcttgtgactcgtaggaagaggtctgaatctagcaagcagcagaaaccactggagggagagatgcagcccgccatcaacgcggaggacgctgatctcagtaagaaaaaggcaaagtcccgcctcaagataccctgcatcaagttcccccgaggcccgaagcgttcaaaccactcgaaaatcatcgaggattctgactgctccatcaaggtgcaggaagaggccgagattcttgatatccaaacacagaccccactgaacgatcaggccactaaagccaaatctacacaggacctgtccgagggcattagcaggaaagacggcgacgaggtttgtgagagtaacgtgagtaattccacgaccagtggtgaaaaggtcatctccgtggagttagggttagacaatggtcacagtgccattcagacaggcacattaattctggaggagattgagaccataaaagaaaagcaggatgttcaaccccaacaagcatcacccctggaaacgagcgagacagaccaccagcaacccgtcctcagtgatgtgcctcctctgcctgctattccagaccagcagattgtggaggaagcttccaatagtacactcgaaagcgcccctaatggaaaggactacgagagcaccgagatagtggctgaggagactaaacccaaagacactgagctgtcccaggaatctgacttcaaggagaacggtataaccgaggagaaatctaagtctgaagagtctaaaagaatggagcctatcgccatcataattacagacaccgaaatatccgaattcgatgtgactaaatcgaagaacgtgcccaaacagtttctgatttctgccgagaatgaacaggtgggggttttcgccaacgacaatggattcgaggatcgtacgtccgaacagtacgaaactttgctaatagaaaccgcatcaagtcttgtcaagaatgctatccagctctccatcgaacagttggtgaacgaaatggcgtcagatgataacaaaattaacaatctcctgcagtag

SEQ ID NO: 40143 - DNA, 1284 bp, Artificial Sequence
  Description of Artificial Sequence: Synthetic coding sequence
atggagaccaccatcagcgagatccacgtggagaacaaggacgagaagaggtccgccgaggggtcacccggagccgagcgccagaaagagaaagcttccatgctgtgttttaaaagacgcaagaaggccgctaaagctctaaaaccaaaagcaggatctgaggctgctgacgtcgcccggaagtgtccacaggaggccggggcatctgaccagcctgagccaacccgcggcgcgtgggccagcttgaaacgactagtgacccggcgaaaaagaagtgagagctcaaaacaacaaaagcccctggagggagaaatgcaacctgccatcaatgccgaagacgctgatctttcaaaaaaaaaggcgaagagcagactgaaaatcccctgcatcaaatttcccagggggccaaagcggtctaaccacagtaaaatcattgaagattccgactgtagtatcaaagtccaggaagaggccgaaatcttagatatacagacccagacccctctgaacgatcaggcgaccaaggccaagtctacccaggatttgtccgaaggtatctctcgcaaagatggggatgaagtttgtgagagcaacgtttcaaacagcacgaccagcggggagaaggttatttctgtagagttgggcctcgataatggacactctgccattcaaaccggcacattaatcctggaggaaattgaaacaatcaaagagaaacaagacgtccaaccccaacaagcctcacctctggagactagtgagactgaccatcagcaacccgtcctgagcgacgtgcccccactcccagcaatccctgaccagcagattgtcgaagaggccagtaattccacattagagagcgccccaaacggcaaggactacgagagtacggagatcgtcgcagaggaaactaagcctaaggacactgagctgtcacaggagtccgattttaaggagaatggtatcaccgaggaaaagtccaaatcggaagagagcaagcgcatggaaccaattgccattatcatcaccgataccgaaatatctgagttcgacgtgaccaagagcaaaaacgtacctaaacagttcctcattagcgctgaaaatgaacaggtcggagtattcgccaacgacaatggctttgaggatcgaacctccgaacagtacgaaacacttctgatcgagacagcgtctagcttggttaagaacgccatacagcttagcatcgagcagttggtaaatgagatggcgtcggacgacaacaaaataaacaatttgctgcagtag

SEQ ID NO: 40144 - DNA, 6960 bp, Artificial Sequence
  Description of Artificial Sequence: Synthetic coding sequence
atgctgaccatgagcgtgaccctgagccccctgcggagccaggacctcgatcctatggcaactgatgcctcccctatggcgattaacatgacccccacagtggagcagggcgagggtgaagaggctatgaaagatatggattcagaccagcaatacgaaaagcccccgcccctccacacaggcgccgattggaagatcgttttgcaccttcccgaaatcgagacctggctgcggatgacaagtgagagagtgagggacctgacctacagtgtgcagcaagattcagactcaaagcatgtcgacgtgcacttggtgcaactcaaggacatctgtgaggacataagtgatcacgtcgaacagattcatgccctcctcgagaccgagttttctttaaaattactgagctatagtgttaacgtgatcgtagatatacacgctgtccaattattgtggcatcagctaagggtatctgtgctggtgttacgagagagaattttacaaggactccaagacgctaatgggaactacaccagacagacggatattctgcaggcgttctctgaggaaactaaggaagggaggctcgactcattaacagaagtggatgatagcggccagctgaccatcaaatgtagccagaactatctgtcacttgactgcggtataaccgcctttgaactgtccgactatagtccgtccgaggatctcctatctggattaggcgacatgactagctctcaagtcaagactaagccttttgattcatggtcttactccgagatggagaaagaattccccgagttgatccgcagcgtggggctccttacagtcgccgccgacagcattagcacaaacggttccgaggcggttactgaagaggtcagtcaggttagcctttctgtggacgataagggagggtgtgaggaggacaacgccagcgccgtcgaagagcagcctggccttaccctgggcgtgagcagctccagcggtgaagccctgaccaatgctgcccaaccatcttctgagacagtgcagcaggagtcttcttctagctcccaccatgacgcgaaaaaccagcagccagtgccttgtgaaaatgccacccctaaacgcacaatccgcgattgcttcaactacaatgaagactctcccacccagccaaccctccctaagcgggggctcttcttgaaagaggaaactttcaaaaacgatctaaagggaaacggtggaaagaggcagatggtggaccttaaacccgagatgtcgagatccacaccctctctggtggatcccccagatcgctctaagctctgcctcgtgctgcagagttcttaccccaacagcccgagtgctgctagtcagagctacgagtgtctgcacaaggtgggcaacggaaacctggagaatacagtgaagtttcacataaaagagatttcatcaagtctcggacgattgaacgattgttacaaggagaagtcacgcctgaagaagcctcataagacatcagaagaggtacctccctgtagaacacccaagcggggcacagggtcgggcaaacaagccaaaaacacaaaatcctccgccgtgcccaatggcgagttgtcatacacatcaaaagctatcgagggaccacagaccaactcagcctccactagcagcctcgagccgtgcaaccagcggagctggaacgctaaactgcagcttcagtcagagacatcatcgagccctgctttcacacaatctagtgagagtagtgtcggatctgacaacatcatgagtcccgtacctctcctcagtaagcataaatcaaagaaagggcaagcttccagtccctctcacgttacacggaacggggaggttgtggaggcctggtatggctctgatgaatatctggctttgcccagccacctgaagcaaacagaggtcctggctctgaaactggagaatctcacaaagctgttgccgcaaaagccacgcggtgagacaatccaaaatatcgacgattgggagctctctgagatgaattccgactcggagatatatccaacataccacgtgaaaaagaaacacacgaggcttggcagggtgtccccatcaagcagcagtgatatcgcttcctcgctaggagagagtatcgaatcagggcctctctcagacatcctgtcagacgaagagtcttcaatgccactcgccgggatgaaaaagtacgccgatgaaaagtccgagcgggcctcttcttcagaaaagaacgaaagccattcagccactaaaagcgctttgatccagaagctgatgcaggacattcagcaccaagataactacgaggccatttgggagaagatcgaggggtttgtgaataagctggacgagttcatacagtggttaaacgaagccatggaaacaactgagaattggacaccccctaaagctgaaatggacgacctgaaactctacttagaaacgcacctatcgtttaagctgaacgtggacagccattgtgctctgaaggaggctgtggaggaggaaggtcaccaactgctggaactgattgcttcccacaaggcaggacttaaggatatgctaagaatgatcgcatctcagtggaaggaattgcaaagacaaataaagcgacagcacagctggattcttcgcgccctggatacaatcaaagctgagatacttgccaccgacgttagcgtcgaggacgaggagggtactggctccccaaaggccgaagtccagctttgctatctggaggctcagcgcgatgccgttgaacagatgagccttaagctctacagcgagcagtacacaagcagtagtaagcgaaaggaggagttcgccgatatgtcgaaggtccatagcgtcgggtctaatggtctgctcgatttcgactctgagtaccaggaactgtgggactggcttattgacatggaatcactggttatggattctcacgaccttatgatgagcgaagagcaacagcaacacctgtacaagcgttattctgtcgaaatgagtattagacaccttaagaagacagagctgttaagtaaagtagaggctctgaaaaagggaggggtgctgctgcctaatgatctacttgagaaggtggacagtatcaacgagaagtgggagctcttgggaaagaccctgggtgagaagattcaggacactatggccgggcatagtggcagttctcctcgcgacctgttgtctccagagagcgggtcattggttcgtcagcttgaggtgaggatcaaggagctcaaaggatggcttagagacactgaattattcatatttaacagctgcctgaggcaggagaaagagggtaccatgaataccgagaagcagctgcaatattttaaatccttgtgtcgtgaaatcaagcagcgtcggcgaggcgtcgcgtccattcttcgcttgtgccagcacctgctggatgatcgagaaacatgtaaccttaatgcagatcatcaacccatgcagctgatcattgttaatctggagcgcagatgggaagccatagtgatgcaagccgtccagtggcaaaccaggcttcagaagaagatgggaaaagagagtgagaccctcaatgtgatcgatccggggctcatggatctgaatgggatgtctgaggacgcactggaatgggatgaaatggatattagcaacaagctcatcagcctgaacgaagagtccaacgacctggaccaggaactgcaaccggtgattccctctcttaaactgggcgaaaccagcaatgaagatcctggttatgacgaggaagccgacaaccacgggggttctcaatacgcttccaacattaccgcaccatccagcccgcatatctatcaagtttactctttgcataacgtggagttgtacgaggacaaccacatgcccttccttaagaataatccaaaggtcacaggaatgacccagcccaacgtgctcacgaaaagcttgagtaaggatagtagtttctccagcacgaaaagtcttcccgaccttctagggggctccaacttggtgaaaccctgcgcctgccacggcggtgacatgagtcaaaatagtggaagtgagagtggtattgtgtcggaaggagatacggagactacaactaacagtgagatgtgcttgctcaatgctgttgacggctcaccgtccaacctggagactgagcatctggatcctcaaatgggggacgccgtgaatgtactgaaacaaaaatttactgacgaaggggagagcatcaagctccctaattcctcacagagtagcatctccccagtgggttgcgtgaacggaaaagtgggcgatctcaacagcattaccaaacatacccctgattgtctcggcgaggaactccaggggaaacatgacgtgtttaccttttatgattactcctacttgcagggatccaagctaaagctacccatgataatgaaacagtcccagagcgagaaggctcacgtagaagatccattgctgagaggcttttatttcgataagaagtcctgcaagagcaaacaccaaaccacagaacttcagccagatgtgcccccacatgagcgtattctggcctccgcgtcccatgaaatggaccggatctcttacaaatcaggaaatatcgaaaaaacttttaccggcatgcagaacgccaaacaactctccctactgtcccacagttcctctatcgaaagtctctctcctggcggggatttgtttggcctgggcatatttaaaaatggctccgactctttgcagaggagcacttctttggaaagctggctgacctcttacaaatccaatgaagatctctttagctgccacagtagtggggatattagcgtctctagtggttccgtgggtgagctcagcaaacggactctggatctgctgaacagactggaaaacatccaatccccctcagaacagaaaattaaacgctctgtttctgatattactctgcagtcctcttcccagaaaatgtccttcaccggtcagatgtctctggacatagcctcctccatcaacgaggattcagcggcttctcttaccgagttgagttcctctgatgaactgtcattgtgctccgaggatatcgtattgcataagaacaaaatccctgagtcaaatgcctcattcaggaaacgcctgacaaggtcagtagctgacgagagcgatgtgaatgtgagtatgattgtcaacgtatcttgcacatccgcctgcacggatgatgaagatgacagcgatctcctctcaagctctacccttaccctgacagaggaggagctgtgcattaaagatgaagatgacgacagctcaatcgccacggacgatgagatttacgaggattgcaccctcatgtctggactggactacatcaagaacgaacttcagacctggatccggcccaagctctcgctcactcgcgacaaaaagagatgtaatgttagtgacgagatgaaaggctctaaggatatctcgtcaagcgagatgacaaatccttcagacaccctgaatatcgagacgctgctgaacggctctgtgaaaagagtgtctgaaaacaatggcaatggaaaaaattcctcacatacacacgaattgggcacaaaacgggagaacaaaaagaccattttcaaggttaataaggatccttacgtggccgacatggaaaacgggaacatcgaaggaatcccagaaagacagaagggaaagccaaacgttacaagtaaagtatctgaaaacctgggctcacatggtaaggaaatctcagagtctgagcactgcaaatgtaaagcactgatggatagcctcgatgattctaacaccgctggtaaagaatttgtttctcaggacgtgaggcacctacccaagaagtgtcccaaccatcaccattttgagaatcagtcaacagcttccacacccaccgagaagagcttctccgagctcgccctggaaacacggttcaacaataggcaggattccgatgcgcttaaatcatctgatgacgctccttctatggcaggaaaatcagcgggttgttgtttggcgctggagcaaaacgggaccgaagaaaacgcttcaatctctaatatcagttgctgtaattgcgagcccgatgtattccatcagaaggacgccgaagactgttcagtccacaattttgtaaaggaaatcattgacatggcatccacggctctcaaatctaaatcccagccagaaaacgaagtcgccgctcccacctccttaacgcagattaaggaaaaagttctggagcacagccatagacctatccagctgaggaagggcgatttctattcctacctgagtctaagcagccacgacagcgactgtggggaggtgacgaactatattgaggaaaaaagcagcacgccactgccactcgatacaaccgatagtggcctggacgacaaagaggacatagaatgcttctttgaagcatgtgtcgagggggactctgatggggaggaaccgtgctttagcagcgctcctcctaatgaaagtgcggtacccagcgaggccgcaatgccgcttcaggccactgcctgcagtagtgaattctccgatagtagcctgagcgccgacgatgccgacacggtcgctctaagctcaccgtccagccaggagcgtgctgaggtaggaaaggaggttaacggactgccccaaaccagcagcgggtgtgcagaaaatctggaatttacccctagtaaattagattctgagaaagaatctagcgggaagcctggggaaagtggtatgcccgaggagcacaatgcggcctcagcaaagtctaaggtgcaagatcttagcttgaaggcgaatcagcccactgacaaggctgcactccatccgtcccccaaaaccctgacctgtgaggagaatctcctgaacttgcatgaaaagaggcatcgtaacatgcacagatag

SEQ ID NO: 40145 - DNA, 327 bp, Artificial Sequence
  Description of Artificial Sequence: Synthetic coding sequence
atgctgaccatgagcgtgaccctgagccccctgcggagccaggacctggatccgatggccacagatgcatccccaatggccatcaacatgactccaacagttgaacaaggcgagggggaggaagccatgaaagacatggattctgatcagcagtacgaaaaacccccacctctccatactggggccgactggaagatcgtgttgcacttgccagagatcgagacttggctccgaatgacatcagaacgcgtgcgggatctcacttatagcgtgcagcaggatagcgactcaaaacatgtagatgtgcatctcgtgcagctaaaatag

SEQ ID NO: 40146 - DNA, 246 bp, Artificial Sequence
  Description of Artificial Sequence: Synthetic coding sequence
atgggccagctgtgctgcttccccttcagccgggacgagggcaagatatcagaaaagaacggcggggaaccagatgatgctgagctcgtgagactgtccaagaggctggtggagaatgccgtactgaaggctgtgcaacagtacctggaagagacacagaacaagaacaagccaggcgagggtagctcagtgaagaccgaggcagctgatcagaatggaaatgataacgagaacaaccgcaagtag

SEQ ID NO: 40147 - DNA, 981 bp, Artificial Sequence
  Description of Artificial Sequence: Synthetic coding sequence
atgagcgaggagttcgaggccaacaccatggacagcctggtggacatgccatttgccaccgtagacattcaggatgactgcggaattacagatgagccccagattaatctgaaacgctcgcaggaaaacgaatgggtgaaaagcgaccaggtcaaaaagaggaagaaaaagaggaaagattatcagcccaactacttcctgtccatcccaataaccaataaagagatcatcaagggtatcaagatcttacagaatgctataattcaacaggacgagcgcctggccaaggctatggtgtctgacggcagtttccacatcaccctgctcgtcatgcaactgctcaacgaggatgaggtaaacattggaattgacgccctgctggagttgaagcccttcatcgaggagcttctgcagggtaagcacctcaccctcccgttccagggcatcggcacattcggaaaccaggtgggcttcgtcaaactcgcggagggcgatcacgttaattcccttttggagatcgctgaaacggcgaatcggaccttccaagagaaggggatacttgttggtgagagtagatcctttaaacctcacctcacatttatgaaactgagcaagagtccttggcttcgtaaaaatggggtgaaaaagatcgaccctgacctgtatgaaaagtttatttcccatcgtttcggcgaggaaatcttgtatcgcatcgacctatgctccatgttgaaaaaaaagcagtccaacggctattatcattgtgagtcgagcattgtgattggcgaaaaaaatgggggtgaacccgatgacgccgagctggtgcggcttagtaaacgcctagtcgagaacgccgtgctgaaggccgtacagcaatatcttgaggaaacccagaacaagaacaaacccggtgagggctccagcgtgaaaacagaagccgccgatcagaacggcaacgataatgagaacaatagaaagtag

SEQ ID NO: 40148 - DNA, 1047 bp, Artificial Sequence
  Description of Artificial Sequence: Synthetic coding sequence
atggagcggcccgaggccggcggcatcaacagcaacgagtgcgagaatgtatcacgcaagaaaaaaatgagcgaagagtttgaggctaataccatggattctctcgtggatatgccgttcgccacagtcgacatccaggacgactgcggtatcaccgatgagccacagattaatttaaaaaggagccaagagaatgaatgggtgaaaagcgatcaagtgaaaaagaggaagaaaaaacgaaaggactatcagcccaattattttttgagtatacctataacaaacaaagaaattataaaaggaataaagatcctgcagaacgccattatccagcaggacgaacgactggccaaagctatggtgagcgacgggtcattccacatcactctccttgtcatgcagctgttaaatgaagacgaggtgaacattgggatcgacgctctgctcgagttaaagcctttcatcgaagagttgttacaaggaaaacacttaacattaccatttcaggggatcggaaccttcgggaaccaagtcggatttgtaaagctggctgagggagaccatgtgaacagcttgctcgagattgctgagaccgctaatcggacattccaggaaaaaggcattctggtgggtgagagtcgaagttttaagccccacttgaccttcatgaagctgtctaaaagcccatggttaaggaaaaacggggtcaaaaagattgatcccgatctgtacgagaaatttattagccatcggtttggtgaggaaattctgtacagaatagacctttgcagcatgctgaagaaaaagcaaagtaatggttactaccactgcgaatctagtattgtaatcggggagaaaaatggtggcgagcctgacgatgcagagttggtgcgcctgtccaaacgcctcgtcgaaaacgccgtactgaaggcggtgcaacaatacctcgaagagacccagaataagaataaacctggagaaggtagctctgtcaaaaccgaagctgcagaccagaacggcaacgacaatgagaacaatcgaaagtag

SEQ ID NO: 40149 - DNA, 315 bp, Artificial Sequence
  Description of Artificial Sequence: Synthetic coding sequence
atgggccagctgtgctgcttccccttcagccgggacgagggcaagattagcgaacttgagagctcatcgtcagcagttctccagaggtactctaaggacattccctcctggtccagcggagagaaaaacggcggcgaaccggatgacgctgagctggtgagattgtctaagagactggtggagaacgcggtgttgaaagcagtgcagcagtatttggaggagacccagaacaagaataaacctggtgagggaagttcagtaaaaactgaagctgctgaccaaaatggcaacgacaatgagaacaaccgcaaatag

SEQ ID NO: 40150 - DNA, 684 bp, Artificial Sequence
  Description of Artificial Sequence: Synthetic coding sequence
atggcccccgactacggcgtgatgggcatgcagggcgccggcggctacgatagcaccatgccatacgggtgtggccgatctcagccacggatgagagatcgggacaggccgaagagacgcggattcgaccgctttggccctgatggaaccggaagaaagagaaaacaattccagctgtacgaggaaccggatacaaaattagcccgcgtggacagtgaaggagatttctccgaaaatgatgacgccgcaggagattttcgctccggggacgaagaattcaagggtgaggacgaattgtgtgactcgggtcggcagcgcggagagaaggaggacgaggacgaagacgtcaaaaagcggcgggagaaacagcgaagacgcgacagaaccagagatcgcgccgccgacaggattcagttcgcatgttcagtgtgtaagttccgcagtttcgacgatgaagagatccagaagcacctgcaaagcaaatttcacaaggagacattgagatttatctcaaccaaacttcctgataagacagtggagtttctccaggagtacatcgttaatcgcaacaagaaaattgagaagagacgacaggagctgatggaaaaggaaacagccaaaccaaaaccagacccttttaaaggagagcttagcagccaggacgagtgctttccaggatggtag

SEQ ID NO: 40151 - DNA, 2079 bp, Artificial Sequence
  Description of Artificial Sequence: Synthetic coding sequence
atggaccagggctacggcggctacggcgcctggagcgccggccccgccaatactcagggcgcatacggaactggcgttgctagctggcaggggtatgagaactataactactatggtgcacagaatacatcggtcacaaccggcgctacgtattcctatgggcccgcatcatgggaagctgcaaaggccaacgacggtggactggcagcaggggccccagccatgcacatggcctcctatggcccggaaccctgtacggataatagtgattccttgattgcaaagatcaatcagagactcgacatgatgagtaaggagggcgggcgcgggggctcaggcggaggtggtgagggaatacaagatcgcgagagttcattcagatttcaaccattcgaaagctacgatagcagaccctgtctgccagaacataacccgtatagaccctcgtatagctatgactacgagtttgatctgggctcagatcgcaatggatcctttgggggtcagtactcagaatgcagagatccggcgagagagagaggctcactcgacggctttatgcgcggcagagggcagggcaggttccaggaccggtccaaccctggaacctttatgaggagcgatccctttgttccccctgccgcctctagtgagcctctgtctaccccttggaacgagctgaattatgtgggcgggcgcgggcttgggggacctagcccctcaaggcccccaccctcattgttcagtcagtccatggcccctgactatggagttatgggtatgcagggcgccggcggctatgactcgacaatgccatacgggtgtgggcggagccagcctcggatgagggatcgagacagacccaaacgtcgtgggtttgaccgcttcggacccgatggtactgggaggaaaagaaaacagtttcaattgtatgaagaaccagacacaaagctggctcgggtggacagcgaaggagattttagtgaaaacgatgacgcagcaggggactttaggtcgggagatgaggagtttaaaggcgaagatgagctctgcgactcaggaagacagaggggcgagaaagaggacgaggatgaagatgtaaagaagcggcgtgaaaaacagagacgaagagaccgcacaagagatcgagcggctgacagaatccagtttgcttgctcagtttgcaagttcagatcttttgatgatgaagagatacagaagcatcttcagagtaagttccataaggaaactttgcggttcatttcaacaaaacttcccgacaagaccgtcgagtttctccaggaatacattgtgaaccggaacaagaagatcgagaaacgacggcaggagcttatggagaaagaaaccgcaaagcccaaacctgaccccttcaaaggtatagggcaggagcatttcttcaagaagatcgaagcagcacattgtctggcttgtgatatgctgatccccgctcaaccccagctactccagcgacacctacactccgtcgaccataaccataatcgaaggcttgccgcagagcaattcaagaagacatcactgcacgttgctaagtccgttctcaataacaggcatatagtgaagatgctggaaaagtacctaaaaggggaggacccctttacgtcagagacagtggaccccgaaatggagggcgacgacaatctgggtggggaagataagaaagaaacacctgaagaggtggctgccgatgtgttggcggaggtaataactgccgcggttagggccgtcgacggcgagggcgcccccgcccccgaaagttctggagagcctgctgaggacgaagggcccaccgacacagcggaagcagggtccgatcctcaggccgaacagctgttggaagagcaagtcccatgcgggaccgcgcatgagaagggagtgcccaaagcccgctcagaggctgcagaggcaggtaatggagccgaaactatggccgcagaagcagagagcgcccagacaagggtcgcacctgctcctgcggcggccgatgcggaggtggagcagaccgacgcggaatcaaaggacgctgtcccaaccgagtag

SEQ ID NO: 40152 - DNA, 1881 bp, Artificial Sequence
  Description of Artificial Sequence: Synthetic coding sequence
atggtggccccctggcgggtgagcgtgcgggtgtgcctgagccacctccgatgctttgaactgcgccaaggtctgtctctattacgcccctccgaatgtccacgcgatgcaagactttgttggctccttcttggaacgctgcccaaggttgtttcactgtgtggcgatgtcggagagggggcccccgacgttctgtcaagaagaagagttaggtgcagtggcgcagctggtgccggtccagcagagtcccttcccagagcaggaccgctgggtggagtatttttgcacttgcgcctgtggctcagggccggagccctactggtgaagttctttccacttttattattgtatccactgacataccttgcccctagcgtgtccaccctctggctgcatctgttattgaaggctacagaaaccagcggccccacatatatcaagctggggcagtgggcaagcacgcgacgtgacctcttctcagaagccttttgcgcacagttcagtaagctccacgttagggtcactcctcacccctggacccatactgagaggtttcttcgacaagcgttcggcgacgattggggatctattctgtccttcgagaacagagagcccgtaggaagcggctgcgtggctcaagtttacaaagcttatgctaacactgcctttctggagactgattccgtgcagaggcttggtagggcaagttgtctcccaccgttcagccacactggagctgtgggaggactgagggagctgttcggctacctgggtaacgggcggaaaccaccggagaacctggccgaccaatccttcctcgagcgcctcctgttacctaaagcggatcttgtggggtctaatgcgggcgtgagccgtgcgcaggtaccgggtcatcagcctgaagccaccaaccttatcagcgttgctgtgaaagttttgcatcctggactgctcgctcaggtgcacatggacctgctgttgatgaagatcggatctcgggtgctgggagtactgccggggatcaagtggttgtcattgcctgagattgtcgaagaattcgaaaagctcatggtgcagcaaatcgacttgagatatgaagcccagaatcttgaacattttcaagtgaatttccgaaacgttaaggccgtcaaattccctactcccctccgcccatttgtcactcgcgaagtcctggtggaaacatacgaagaaagcgtgcccgtatccagctatcagcaggccggcattcccgtagacttgaaacgaaaaatagcccggctgggaatcaacatgcttcttaagatgatcttcgtggataacttcgtacacgctgatcttcatcctgggaacattttagttcaaggcgcgaacggattatctagcagtcaggaggcacagctgcagcaggccgacatctgcgataccctcgtggtggctgtcccatccagcctctgccctttgagactcgtgctgctggacgcagggatcgtggccgagctgcaggcaccagatctccgaaacttcagggcggtgttcatggcagtggtgatggggcagggccagcgcgtcgcagaactgattctacaccatgcccgcgcaagcgagtgtcgggatgtggaaggttttaagactgagatggcaatgctggtcacccaggcccgcaagaacactatcactttagaaaaattgcacgtgtcctctctcctgagctccgtgttcaagcttctgatgacccacaaagtgaaattggaatctaacttcgccagcattgtcttcgcaatcatggtgcttgaaggccttggaaggagtctggatcccaagctggacatcctcgaagctgcccgcccatttctgttgactggccccgtgtgtcccccctag

SEQ ID NO: 40153 - DNA, 1512 bp, Artificial Sequence
  Description of Artificial Sequence: Synthetic coding sequence
atgtggctgaaggtgggcggcctgctgcggggcaccggcggccagcttgggcaaactgtcgggtggccatgcggggcattgggaccagggccccaccgctggggaccgtgcggggggagctgggcacagaagttttaccaggatggacctgggaggggcctaggcgaggaagatataaggagagcccgtgaagcccggccccgcaagacaccccgcccgcagttaagtgatagatctagggaacggaaagtgcccgcctccaggatttctcggctagcgaactttggagggcttgcagtgggactgggactgggcgtgctcgctgaaatggcaaagaagagcatgcctggaggcaggctccagtcagataattcctttatcagccctcaacttcaacacatttttgagcgtgtacgacaaagcgcggattttatgccaagatggcagatgcttcgcgtccttgaggaggagctgggacgggactggcaagctaaggttgcctcacttgaggaggtgccattcgccgctgccagcatcggtcaagtgcatcagggactgctcagggatggaacagaggtcgccgtcaagatccagtatcctggtattgctcagagcatccagtccgacgtgcagaacctcctggccgttcttaagatgtctgccgcattgccagccggcttgttcgccgagcagagcttgcaggctctccagcaggaactggcttgggagtgcgattatcgccgtgaagccgcctgtgcacagaactttcgccagctgcttgccaacgaccctttttttcgggttccagctgtggtgaaggaactctgtacgaccagagttctcggcatggagctcgcaggtggagttcctctggaccaatgtcaggggcttagccaggacttaaggaaccaaatatgcttccagctactgactctgtgtctgagagagctcttcgagttcaggtttatgcagacggacccgaactgggctaatttcctttatgacgcttcttctcaccaggtcacccttttggactttggcgccagtcgcgagttcggaactgaatttacagaccactacatcgaagtggtgaaggctgccgctgatggggatcgggactgtgtgcttcagaagagccgggacctcaagtttttaacggggttcgaaaccaaggctttcagtgacgcacatgtcgaggccgtgatgattctcggggaaccttttgctacacaaggcccctacgactttggctctggcgagaccgcacggaggatccaggatctgattcctgtgctgttaaggcataggctatgtccaccaccggaggagacatacgcacttcacaggaagctggcaggggcatttcttgcctgcgcccacttgcgcgctcatatcgcatgccgggacctctttcaagacacatatcatagatattgggcatccagacagcccgacgccgccaccgcagggagtctgcctactaagggtgatagctgggttgacccctcctag

SEQ ID NO: 40154 - DNA, 1635 bp, Artificial Sequence
  Description of Artificial Sequence: Synthetic coding sequence
atgtggctgaaggtgggcggcctgctgcggggcaccggcggccagctggggcagacagtaggttggccctgtggcgctttaggtccaggcccccatcggtgggggccttgtggtggaagctgggcacagaaattttatcaggacgggccgggaagaggactgggcgaagaagatattagaagggccagagaggcccgaccacgaaaaacacccaggcctcagctgagtgaccgcagccgggagagaaaagtgccggcttcccggatatctagacttgccaatttcggtggccttgccgtcgggctgggactgggcgtcttggctgagatggctaaaaaaagcatgcccgggggacgccttcagtccgagggaggcagcgggctcgactccagtccattcctgtccgaggccaatgctgagagaattgtccagaccctgtgcaccgtcagaggcgctgcactcaaagtcggccaaatgttgtccatccaagacaattcatttatttctcctcagcttcagcacatattcgaacgagtccgccaatccgctgacttcatgccccgatggcagatgctgcgcgtgctggaggaggagttgggacgggactggcaagctaaagtggcctcccttgaagaggttccttttgctgcagctagcataggccaggtgcaccagggcttactacgagatggtactgaggtggcagtgaaaattcagtacccagggatagcacaatccatccagagcgacgtccagaacctcttggcagtcttgaaaatgtccgccgccttgccagctgggctatttgctgagcaatctctgcaggctcttcagcaggagttggcctgggaatgcgactatagaagagaggccgcctgcgcccaaaacttcagacagttacttgccaatgaccccttcttcagagtgccagccgtggtgaaggagctctgcactacaagggtcctcgggatggagctggccggcggtgtccctcttgaccaatgccaaggtctgagccaggatctgaggaaccaaatttgtttccaactactcacgctctgcttgcgtgagttgttcgagttccgctttatgcaaacggacccgaattgggcaaactttctatacgacgcctcgagtcatcaggtaacattgctggacttcggagcctctagagagttcggaaccgaatttacagaccattatatcgaggtagtcaaagccgcagccgatggagatcgcgactgcgtacttcaaaagagcagggacctgaagttcctcaccggctttgagacaaaggccttcagcgatgcgcacgtagaggccgtcatgatcctgggggaaccatttgccacccaggggccatatgacttcggatccggcgagacagctagaaggattcaggacctgatccctgtgctcctgaggcaccgcctgtgtccaccccctgaagagacctatgcgctgcaccgaaaactcgccggcgctttcctcgcctgcgctcaccttcgcgctcacattgcgtgtcgcgatcttttccaggacacttaccaccggtactgggcttccagacagcccgatgctgccacggccgggagcctgccgacaaaaggtgactcctgggtcgatccttcatag

SEQ ID NO: 40155 - DNA, 1512 bp, Artificial Sequence
  Description of Artificial Sequence: Synthetic coding sequence
atgtggctgaaggtgggcggcctgctgcggggcaccggcggccagttaggacagaccgttggttggccctgcggagccctcggtcccggcccccataggtgggggccatgtggaggttcgtgggctcaaaagttctatcaggatggtccgggacgcggcttgggtgaagaagacattaggcgggctagagaggcccgtccccggaagacccctagaccccagctctccgatcgcagtagggagaggaaggttccagccagccgtatcagccgcctggctaattttgggggcctagctgtgggattgggactgggggtcctggcggaaatggccaagaagtccatgcctggcggtcggctgcagagtgataactcttttattagtcctcagctgcagcatattttcgaaagggtaaggcagagcgcggatttcatgccccggtggcagatgctgcgagtccttgaagaggaactcggacgtgattggcaggccaaggtcgccagcctggaagaagtgccattcgctgcagccagtattgggcaggtacatcaagggctgctgagagatgggacggaagtggcggtgaagattcagtatcccggcatcgcccagtctattcaaagtgacgttcagaacctgctggcagtgctcaaaatgtcagctgccctccctgccggccttttcgccgaacagtccttacaagcccttcagcaggagctcgcctgggaatgtgattacagacgggaggcagcgtgtgcgcagaactttcggcagctccttgccaatgatccattctttcgggtacctgccgttgtgaaggagctttgtacaacaagggtcctcgggatggagctggctgggggggtccccttagaccagtgtcagggcctgtctcaagacctgaggaaccaaatttgttttcagctattgaccttgtgtttacgcgagctctttgagttccggtttatgcagaccgatcctaattgggcgaactttctgtatgacgcgtcatcccaccaggtcactctgctggacttcggagcaagtcgggaattcggcactgagtttaccgatcattatattgaagtcgtaaaggccgctgccgatggcgacagggattgtgtcctacaaaaatcacgcgacctgaagttcttaaccggctttgagaccaaagcttttagcgatgcccacgtcgaagcagtgatgattctcggggaaccgttcgccactcagggaccatatgatttcggatccggtgaaacagcccggcgtattcaagacctgatccccgtgcttcttcggcataggctgtgcccccctccggaggaaacatacgcactacataggaagctggcaggcgcctttcttgcttgcgcacatctcagagcccacattgcctgcagagatttgtttcaggacacttatcaccgctattgggcctctcgacagcccgacgccgctaccgccggatcgctgcccaccaagggggatagctgggtggatcctagttag

SEQ ID NO: 40156 - DNA, 1743 bp, Artificial Sequence
  Description of Artificial Sequence: Synthetic coding sequence
atgtggcggcccgtgcagctgtgccacttccacagcgccctgctgcaccgcaggcagaaaccatggcccagccctgccgtgtttttcagaagaaatgttaggggattgccccctagattctcgagcccaacccctttatggagaaaggtgctgtcgactgctgtcgttggtgccccactgctactcggcgcacgctacgtcatggcagaggctcgagaaaaaaggaggatgcggctggtggtggacgggatgggacgattcggccggtccctcaaagtgggcttgcagatcagtctggattattggtggtgcacaaacgttgtgctcaggggcgtcgaagagaactcccctggttaccttgaggtcatgagtgcttgtcatcagcgcgccgctgatgcactggtcgctggggccatttcaaatggtgggttatacgtcaagctcggtcagggcctttgctcatttaaccacctgttacctcctgaatatacgaggacgctcagagtgctggaggatcgggccttgaagagagggttccaggaggttgatgaattgttcctggaggatttccaggcactcccgcacgagctgttccaagaatttgactatcaacctattgcggccgcttcacttgcacaggtgcatagagccaaactgcatgacggcacctccgtggccgtgaaagtgcaatatatagacttgagagaccgattcgatggggacatccatactctggagcttctcctgagactggtggaagtgatgcatcccagcttcggcttctcttgggttctgcaagatttgaagggaacactcgcacaggaattggactttgagaatgagggaaggaacgcagagcgctgcgcccgggagctggcccatttcccttacgtggtagtccctcgcgtacactgggataagtcaagtaagagggtactgacagccgatttttgcgcgggatgcaaagtgaatgacgtggaagctataaggtcacagggcttggccgtccacgacattgccgaaaagctcataaaggcctttgccgaacagatcttttataccgggttcatccactcggacccccatccgggcaatgtgctggtacgcaagggccctgatggtaaggccgagctggtcttactcgatcacggactgtatcagtttttggaagaaaaggatagggcagcactgtgccagctgtggagagcaataatcctgcgggacgacgccgctatgagagcccatgccgccgctctgggagtacaagactacctcctttttgctgaaatgcttatgcagcggcctgtccgccttgggcagctctggggatctcaccttctgagtagagaggaagcggcatacatggtcgatatggctagagaacgtttcgaagctgtgatggctgtgctccgagagctgcccagacctatgctcctggtgctcaggaatattaacactgtcagggccatcaacgtggccctgggtgcaccagttgatagatattttctaatggctaagcgtgccgtacggggatggtcccgcctggctggcgcaacataccggggggtttacggcacaagcctgctgcgacacgctaaggtagtatgggaaatgctcaagttcgaagttgccctacggcttgagactctcgcgatgaggctgacagccttgctcgctagggctcttgtccacctgtccctagtgccacccgctgaggaactatatcaatacctggagacttag

SEQ ID NO: 40157 - DNA, 921 bp, Artificial Sequence
  Description of Artificial Sequence: Synthetic coding sequence
atggccgtggcccggctggccgccgtggccgcctgggtgccctgcagaagttggggctgggcagccgttccctttgggccccaccgcggtctgtctgttctgctggcccgaatcccacagagagccccacgttggttgcccgcctgccggcagaagacctccttgtcatttctgaacaggcctgacttgcctaacctcgcgtataaaaaactcaaaggcaaaagccctgggatcatattcatacctggctatctgtcctacatgaatgggaccaaggccctggccattgaggaattttgcaagtcacttgggcacgcatgcatcaggtttgattactccggggtgggctcgtccgacgggaatagcgaagaaagcacgctggggaagtggcgaaaagatgtgcttagtatcatcgacgacttggccgacggcccccagattttggtggggagttcccttggaggttggctaatgctgcacgcagcaatcgctcggcctgaaaaggttgtcgcccttatcggggtggccaccgccgctgacaccctggtcactaagtttaaccaactccctgttgagctgaaaaaggaggtggagatgaagggagtgtggtcaatgccctctaagtatagtgaggagggggtgtataatgttcaatacagttttattaaagaggcagagcatcactgtctgctgcatagtccgattccggtgaattgcccaatccggctgctgcacggcatgaaggacgacatcgtcccctggcacacttcaatgcaagtggctgacagggtgctgtcgacagacgttgacgtgatccttcgaaagcatagtgaccacagaatgcgggagaaggctgacattcaactgctcgtttatacaatagatgatctgatcgacaagctgtctaccatcgtgaattag

SEQ ID NO: 40158 - DNA, 450 bp, Artificial Sequence
  Description of Artificial Sequence: Synthetic coding sequence
atgctgcacgccgccatcgcccggcccgagaaggtggtggccctgatcggcgtcgctacggctgccgacacactcgttacaaagttcaatcagctgccagtcgagttaaaaaaagaggtggagatgaagggcgtgtggtccatgcccagtaaatactcagaagaaggcgtatacaacgtgcagtactcatttattaaagaggctgagcatcactgcctgctgcattcgccaatccccgtgaactgccccattcgcctacttcacggtatgaaggatgatatagtgccttggcacacatctatgcaggtcgctgatagggtgctctcaaccgacgtggatgtaatcctgcgtaagcactctgatcataggatgagggagaaggcagatatccagctgctggtttatacaattgacgacctgatagacaagctatctaccatcgtcaactag

SEQ ID NO: 40159 - DNA, 1407 bp, Artificial Sequence
  Description of Artificial Sequence: Synthetic coding sequence
atggccgccagcagcaacagcagcctgagcggcagcagcgtgagcagtgacgccgaggagtatcagccgccaatttggaaatcttacctgtatcaattgcagcaagaggccccgcgccccaagcggattatctgccctagagaagtggaaaatagacctaagtattacggccgcgaatttcacggaattataagccgtgagcaggcagatgaactactggggggagtggaaggggcctacattctgagggagtcacaaagacagcccggctgttatacactggcactccggtttggaaaccagactctgaactataggctctttcatgacggtaagcacttcgttggggagaagaggttcgagagtatccatgacttggtgacggatgggctgatcacactgtatatagagaccaaggcagcagagtacattagcaaaatgacaactaacccaatttacgagcacattggctatgcaaccttgctgcgggaaaaggtctcccgacgtctgagccgaagcaaaaacgagccccgaaagactaacgtgacccacgaggagcatactgcagtcgagaagatttcttcgctggtgcgtagggctgccctaacacataatgataaccatttcaactatgagaaaacgcataactttaaggtacacacattccgtggaccccattggtgtgaatattgtgccaactttatgtggggcctaatcgcacaaggcgttagatgctctgattgcgggctgaatgtgcataagcaatgttctaagcacgttccgaacgattgtcagcccgacttgaaaaggatcaaaaaggtgtattgctgcgacctgaccaccctagtaaaagcacataatacacagcgaccaatggtggttgatatctgcatccgggagatcgaggcccgagggctgaaaagcgaagggctctacagagtgtctggatttactgaacacatagaagacgtaaagatggcctttgatcgtgatggggagaaggcagatatctccgcaaatgtgtacccggacatcaacattataaccggcgctctgaagctctactttcgtgatttgccaataccggtgatcacttatgacacttactcaaaattcatcgacgctgccaagatcagcaatgcagacgagcgccttgaggccgttcatgaagtcctgatgcttctcccacccgcacactatgaaaccctgcgatatctcatgatccacttgaagaaggtgaccatgaacgagaaagacaattttatgaacgcggaaaatctggggatagtgttcggacctaccttgatgagacccccggaagattccactctcaccactctgcacgacatgagataccagaaactgatagtgcagatacttattgagaacgaggacgttctgttctag

SEQ ID NO: 40160 - DNA, 438 bp, Artificial Sequence
  Description of Artificial Sequence: Synthetic coding sequence
atgcgggccggccagcagctggccagcatgctgcggtggacccgggcctggcgcctcccacgcgagggcttgggaccacatggcccatcatttgcccgcgttcccgtcgcgcctagcagcagttccggaggaagaggcggcgctgagcctagactattggacggggaggccgcactgccagccgtggtgtttctgcacgggttatttgggtccaagaccaacttcaatagcattgccaaaatcctggctcagcagacagggagacgggtgctcacagtggatgcccggaatcacggagattctccacattcaccagatatgtcatacgagatcatgtcccaggacttacagccagcacctcaccttggaaccgaggggttacgccaggccctgtgcggccacgaggtgctgcaaggatggagtgacctaagactgtag

SEQ ID NO: 40161 - DNA, 777 bp, Artificial Sequence
  Description of Artificial Sequence: Synthetic coding sequence
atgcgggccggccagcagctggccagcatgctgcggtggacccgggcctggaggctgccccgcgagggcctgggccctcatggaccgagttttgcaagagtcccagtagcgccttcctcttccagtggaggcagaggcggggccgagccaaggcctctgcccttgtcgtacagacttctggacggcgaggctgccctgcccgctgtcgttttcctgcacggcttgtttgggtctaaaacaaactttaactccatcgcaaagatcctggcccaacagacagggcgccgcgtcctcacagtcgatgcccgcaatcacggggatagtccacacagtcccgatatgtcctatgagattatgagccaggatttgcaagatctgcttccacagcttggcctggtcccgtgtgtggttgtaggacattcaatgggcggcaagacagccatgcttctcgcactccaaagggatatggcggtccggcagcacctattgactaacctggttgaagttgatgggagatttgtgtggagggttaaccttgatgccctgactcagcatcttgacaaaattctcgccttcccgcagaggcaggaatcgtatctggggccaacactgtttctgcttggtggcaatagccagttcgtccacccgtcccaccatcctgagatcatgagattgtttccacgcgcccaaatgcagacagtgcccaacgccggtcattggatccacgccgacaggcctcaggattttatcgcagcaatccgcggatttttagtctag

SEQ ID NO: 40162 - DNA, 927 bp, Artificial Sequence
  Description of Artificial Sequence: Synthetic coding sequence
atgcgggccggccagcagctggccagcatgctgcggtggacccgggcttggcggctcccacgcgagggacttggccctcacggcccatcttttgcaagagtcccagtcgccccttctagcagctcaggagggaggggaggggccgaacctcggctcctggacggagaggccgctctgcctgctgtggtgtttctccacggcctgtttgggagtaagactaactttaactcaatcgctaagatattggcgcagcagaccggaaggagagtgcttacagtggacgcaagaaatcatggcgattctccgcactctcccgatatgtcatatgagatcatgtctcaggatctacaggatctcttgccacaactgggcctggttccatgcgtggttgttggccatagcatgggtgggaaaacggcgatgttactggcattgcagagacctgaacttgtcgagcggctcatcgctgtggacatctcccctgtcgagagtacaggagtcagtcatttcgccacctacgtagcagcaatgagagccatcaatattgcagatgagctccctcgctctcgggcaaggaagcttgctgacgaacagttgagctccgtgattcaggacatggcagtaagacagcatctcctgacaaatctggtcgaggtggacggccggtttgtttggcgggttaacttggatgccctgacacagcacctcgacaagatcctggccttccctcagcgacaggagtcatacttgggtcctaccctgttcctgctggggggtaatagccaatttgtgcaccccagtcaccatccggaaatcatgaggttgttcccaagagcccagatgcaaactgtgcccaacgctggtcactggatacatgctgacagaccccaggattttatcgcggccattagggggtttctcgtgtag

SEQ ID NO: 40163 - DNA, 1014 bp, Artificial Sequence
  Description of Artificial Sequence: Synthetic coding sequence
atggagaagagctggatgctgtggaacttcgtggagcggtggctgatcgcccttgcgtcctggtcatgggcactatgcaggatttcattgctgccgctaatcgttacttttcacctgtacggagggataattctgctgctgctgatcttcatatccatagccggtattctgtacaagtttcaggatgttctcctgtatttccccgaacaaccgagctctagccgactttacgttcctatgcctaccggcataccacacgaaaatattttcattcggacaaaggatggtattcgacttaacttgattcttatacgctacacaggagataatagcccatattcgcccacgatcatttatttccacggcaacgccgggaacattggacataggcttccaaacgcccttctcatgttagtgaatctgaaggttaacttgctgctggttgactacaggggatacggtaagtccgagggggaggcctctgaggagggcctttatttggactccgaagctgttttggattatgtgatgaccagaccagacctggacaaaaccaaaatcttcctgttcgggagatctcttggaggagctgttgccattcatctggccagcgaaaacagtcaccggatctcggctatcatggttgagaacacatttttaagtatcccacacatggccagcacactgttttccttctttcccatgcggtatctgccactttggtgctataagaataagtttctgagctaccggaagataagccagtgccggatgcctagcctgttcatcagcggacttagcgaccaactcattccccctgttatgatgaagcagctgtatgaattgagtcctagccgcacaaaacgcctggccatcttccccgatggtacccacaacgacacctggcagtgtcagggatattttaccgccctggagcagtttatcaaggaagtggttaaatcccattccccggaggagatggcaaagacctcctcgaacgtcaccatcatttag

SEQ ID NO: 40164 - DNA, 816 bp, Artificial Sequence
  Description of Artificial Sequence: Synthetic coding sequence
atggtgggcgccctgtgcggctgctggttccggctgggcggcgcccggccgctgattccactgggccccaccgtcgtccagactagtatgagtaggagtcaggttgccctgctgggcctgtctctcctgctgatgctcctactgtacgtgggcctgccaggacccccagagcagacctcttgtctttggggcgatcccaatgtgacggtactcgccggcctaaccccgggtaattcccccattttctatcgagaggtgctgcctctgaatcaggcccatagagttgaagtggtgctgttgcatgggaaagctttcaactctcacacgtgggaacaattaggcaccctgcagctgctgtcccaacggggctatcgtgctgtggcattagatttgccaggattcggtaactcagccccctccaaggaagccagcactgaagccggacgggcggctctacttgaacgggcgctgcgcgacttggaggtgcagaatgcagtgctggtgagcccatccttatcaggacactatgctttgccgtttttgatgcgtggtcaccatcaacttcacggctttgttccaattgcgcccacaagcacccagaattatacacaggaacaattctgggccgttaaaactcccactctcatcctttacggcgaactggaccatatcctggcaagggagagcttgcgccagctcagacacctgcccaaccactctgtggtgaagctgcgcaatgcagggcatgcctgttatctccataagcctcaggacttccatcttgtgctcttagcatttctcgatcacttaccctag

SEQ ID NO: 40165 - DNA, 690 bp, Artificial Sequence
  Description of Artificial Sequence: Synthetic coding sequence
atgctgctgctgtacgtgggcctgcccggcccccccgagcagacctcatgcctctggggagaccccaacgtcacagtgctggctggcctcactccagggaactctcccatcttctacagagaggttttgccccttaaccaggcacatagagttgaagtcgtcttactccacggaaaggcgtttaactctcatacatgggagcagcttggcaccttgcagcttctgagccagcggggctaccgggccgtggctttagatctacccgtccccggaagtagtaattcacccgcctccgcctctcccgttgccgagattacggagaattccttttgggcggttctggttagggacctggaagttcagaatgccgtccttgtgagcccaagcctcagcggacattacgctcttccgttccttatgcgggggcaccaccagctgcacggtttcgtccccatcgcccctacatccacgcagaattacacccaggagcaattctgggctgtgaagacacctactctgatcctctacggcgagcttgatcatatcttagcacgcgaatcactgaggcaattgcggcaccttccaaatcacagcgtggtaaagcttagaaacgccgggcacgcttgctatctccacaaaccccaggacttccacctggtgttgctggcctttctcgatcatttgccctag

SEQ ID NO: 40166 - DNA, 618 bp, Artificial Sequence
  Description of Artificial Sequence: Synthetic coding sequence
atgctgctgctgtacgtgggcctgcccggcccccccgagcagacctcttgtctttggggcgacccaaacgtaacagtcctggctggtctgacacccggcaattcaccgattttttaccgagaggtgctgccccttaatcaggcacaccgggtggaggtggtactgctccacgggaaagcgttcaattcacatacgtgggaacagctgggtactcttcagttgttgtctcagagaggttatcgggcggtggcccttgatctccctgtccctggctcaagtaacagccctgcaagtgctagccctgtagccgagattactgggtttgtctttttgatgtgtgcctctgcgtccgggcctcagctatttccaccattatggccaattgcgcccaccagcacacaaaactacacccaggaacagttctgggcagtaaagacccccaccctcatactctatggtgagctagatcacatcctggccagggagtcattgagacagctgcgacacctgccaaaccacagcgtggtgaaacttagaaacgcagggcacgcttgctatcttcacaaaccccaggattttcatctggtcctcctggctttcctggatcatctgccctag

SEQ ID NO: 40167 - DNA, 465 bp, Artificial Sequence
  Description of Artificial Sequence: Synthetic coding sequence
atgctgctgctgtacgtgggcctgcccggcccccccgagcagacctcatgtttgtggggcgatccgaatgtcactgtcctcgctggtcttacgcccgggaacagtccgatcttctatagagaagttcttcctctgaaccaagcacaccgcgttgaggtggtcttgctccatgggaaggcctttaatagccatacatgggagcagcttgggactctccaactactcagccaacggggctacagggcggttgccttggacctacctgtgctggggttcggcaattccgcccccagcaaagaggccagcactgaggccggtagggctgcactcctggagcgggctctgcgcgacttagaagtgcagaatgcagttcttgtttccccttcccttagcggccactacgcattgcctttccttatgaggggacaccatcagctccacggtttcgtaccaattgcaccatag

SEQ ID NO: 40168 - DNA, 1014 bp, Artificial Sequence
  Description of Artificial Sequence: Synthetic coding sequence
atggacctggacgtggtgaacatgttcgtgatcgccggcggcaccctagccatacccattctcgcctttgtcgcgtccttcctgctgtggccatctgcactcattagaatttactattggtactggcgacgcacactcgggatgcaagtgcggtacgttcaccatgaagattatcagttttgctactcttttcgggggcggccaggtcataagcctagcatcctcatgctccacggattctccgctcataaagatatgtggttaagcgtggttaagttcttaccaaaaaacctgcatttggtctgtgtcgacatgcctggccacgaaggaacaacaagaagtagcctggatgacctgagtatagacggccaagtgaagcggatccatcagttcgtggaatgtctgaagctgaataaaaaaccatttcatctcgtcggaactagcatgggggggcaggtggctggagtctatgcagcatactaccctagtgatgtcagctccctgtgcttggtatgtcccgccggtctgcagtattctacagacaaccaattcgtgcagaggctcaaagagctgcagggcagtgccgccgtcgaaaagatacccctcatacctagcacgcctgaagagatgagtgagatgttgcaactctgtagctatgtacggttcaaggtccctcagcaaatactgcagggtctggtggatgttagaatccctcataataatttctatcggaagctcttcctcgaaatagtctcagaaaaatccaggtacagtctccaccagaatatggacaagattaaggtccccactcagattatttggggcaaacaggaccaggtgcttgatgtgtccggtgccgacatgctggctaaatcaattgctaactgtcaggtagagctcctggagaattgtggacactcagtggtaatggagagaccccgtaaaaccgcaaaattaatcatcgatttccttgctagcgtgcataacactgataacaataaaaagctcgattag

SEQ ID NO: 40169 - DNA, 678 bp, Artificial Sequence
  Description of Artificial Sequence: Synthetic coding sequence
atggacctggacgtggtgaacatgttcgtgatcgccggcggcaccctggccattccgattctggcctttgtcgccagctttctgttgtggccttctgcactgatacgtatatattattggtactggcggcggacattgggcatgcaggtgcgttacgtccatcacgaagactaccagttctgctactcttttagggggcgcccagggcacaaacccagcatccttatgctgcacggattttccgcacataaggacatgtggctatccgtcgtaaaattcctgccaaaaaaccttcacctcgtttgcgtggatatgcccggccatgagggtaccactcgatctagcctcgacgacctgagcatcgacggtcaggtgaagagaatccaccaatttgtggaatgccttaagcttaataaaaaaccgttccacctggtgggaacctcaatgggcgggcaggttgccggagtgtatgccgcatattacccatccgacgtgtcctccctttgtctggtgtgtccggcgggacttcagtactccaccgataaccagttcgtgcagcggttaaaagagcttcaggggagtgcggctgtggagaagatcccccttattcccagcacacctgaggaaatgagtgaaatgctgcagctttgctcctacgtccgcttcaaagtcccatag

SEQ ID NO: 40170 - DNA, 1014 bp, Artificial Sequence
  Description of Artificial Sequence: Synthetic coding sequence
atggacctggacgtggtgaacatgttcgtgatcgccggcggcaccctggctatcccaatcctggcattcgtggccagttttttgctgtggcccagcgcacttatcagaatctattactggtactggagacgcaccctgggaatgcaggtcaggtatgtccaccatgaggattaccagttctgctacagctttcgagggcggccgggccacaaaccttcaatcctaatgctacatgggttctccgctcataaagacatgtggttgagcgtggtaaagttcctccccaagaatcttcacctggtctgtgtggatatgcccggtcacgaggggacaactcggtcaagccttgacgacctttcaatcgacggccaggttaaacgtattcatcagtttgtagagtgtcttaaactgaacaagaaacctttccacctggtgggtacatctatgggcggacaagtcgctggcgtctacgctgcctattatccttcagatgtaagttctttgtgcttagtgtgtcccgccggtcttcaatattccaccgataaccagtttgtgcagcgactgaaggagctgcagggatcagccgccgtggagaagattcctctgattcccagtactcccgaagaaatgtcagagatgcttcagctttgttcgtacgttcgcttcaaagtcccacaacagatcttgcagggactggtcgatgtcagaataccccataataacttctatagaaaactttttctggagattgtctcggagaagagtaggtattccctgcaccaaaacatggataagataaaagtgcccactcagataatctggggcaagcaagaccaggttctggatgtctctggggctgatatgctggctaagtctatcgctaattgccaggtggagctgctggagaattgcggccattctgtcgttatggagcggccacgaaaaacagctaagttaataatcgatttcctggcctctgtgcacaacactgacaataacaagaagctggattag

SEQ ID NO: 40171 - DNA, 522 bp, Artificial Sequence
  Description of Artificial Sequence: Synthetic coding sequence
atggacctggacgtggtgaacatgttcgtgatcgccggcggcaccctcgcaattccaatcctagcttttgtagcttcttttcttctgtggcccagtgccctgatccgtatctattactggtattggaggcgcaccctgggaatgcaagtccgctacgtgcatcatgaagactaccaattttgttattcctttcgcggtcgcccaggccataaacctagtatcctgatgcttcacggcttcagcgcccacaaggatatgtggctttcagtggtgaagttcttgccaaagaacctacatctggtgtgcgtcgatatgccaggacacgaagggacaacaagaagctcccttgatgatctatccattgatggccaggtaaaacgaattcatcaatttgtcgagtgcttgaagctcaacaaaaagccctttcatttagttgggacgtcaatgggtgggcaagtggctggcgtgtacgcggcctactaccctagcgatgtgtcgtctctctgcctggtatgcccatag

SEQ ID NO: 40172 - DNA, 957 bp, Artificial Sequence
  Description of Artificial Sequence: Synthetic coding sequence
atggacctggacgtggtgaacatgttcgtgatcgccggcggcaccttggcgatcccaatacttgccttcgtggctagcttcctgttatggcctagcgccctgatccgcatctattattggtactggcggagaacactgggcatgcaggtgcggtacgtgcaccatgaagactatcagttctgctacagctttcgcggcagacctggccacaaaccatcaatactcatgttgcacggatttagcgctcataaggatatgtggctgagtgtagtcaagttcctcccaaagaacctacacttggtgtgcgtggacatgcctggtcacgaaggtacaacgagatcctccctggacgacttatcaattgacggtcaagtgaaaaggatccaccagtttgtcgagtgtttgaaactgaataagaagccctttcatctcgtgggaacaagtatgggtgggcaggtggcaggggtttacgcagcttactacccgtcagatgtctcctccctgtgcctagtgtgtcctgcaggtctgcagtactcaacggataaccagtttgtccagcgcttgaaggaactccaaggttctgcagccgtggagaaaatacccttgatccccagcacaccagaggagatgtccgagatgttgcagttgtgctcatatgtgcgcttcaaagtgccacagcagatcctccagggtttagttgatgtacgtataccacataataacttttaccgaaagcttttcctggaaatagtctctgagaagtcccgctattctctgcatcaaaacatggataaaattaaggtgcccactcagataatttggggaaaacaggaccaggttctggatgtgagtggtgctgacgttgggcaggttaactgccagctgccaggcggggcctctgggaagctgtgggcactgtcaagcgacggaaaaccaggacggcagcctagcagctag

SEQ ID NO: 40173 - DNA, 1194 bp, Artificial Sequence
  Description of Artificial Sequence: Synthetic coding sequence
atggccctgctgcggggcgtgttcgtggtggccgccaagcggacccctttcggggcctacggagggttactcaaggacttcaccgccaccgacctaagcgagttcgccgcaaaggcagcactgtctgctgggaaagtgtccccggaaaccgttgacagcgtcatcatgggaaatgtgttacagagttcttccgatgctatttacctcgcacggcacgttggactgcgtgtcggtatccccaaagagactcctgccctgacaatcaaccgcctctgtgggtctggcttccagtcaattgtcaacggatgtcaggaaatttgcgtgaaggaggctgaggttgtcctatgtgggggcaccgagtccatgtcgcaggctccatactgcgtgcggaatgtgaggttcggcacgaaactcggcagcgatatcaaacttgaggattcactttgggtgagtctgaccgaccagcatgtgcagcttccaatggcgatgactgccgaaaacctggccgtcaagcataagatctccagagaagagtgcgacaagtatgccctgcagagtcagcagaggtggaaggcagcaaatgacgccgggtatttcaatgacgaaatggcgcctatcgaggtgaagactaaaaagggcaagcagactatgcaggtggatgaacacgccagaccccaaacgaccctggaacaattgcaaaagctccctcccgtgtttaagaaggacggaacagtcaccgctggcaatgcatcaggcgtagccgacggggctggagccgtgattatcgcctctgaggatgctgtcaagaaacataactttacgcctctggcacgtattgtcggctactttgtttcggggtgtgacccttctatcatgggcataggcccggttcctgccatttccggcgctctaaaaaaggccgggctgtctctaaaagatatggacctggtagaagtaaacgaggcgttcgccccacagtatctggctgtagaacggtccttggatttggacatatccaagaccaacgtgaacggaggtgccatcgcgctgggacatcctctgggcgggagcggctccagaataaccgcccatctagtgcacgagctcaggcgccgcggcggcaagtacgcggttggtagcgcctgtattggcggggggcagggaattgccgtgataatccaatctactgcctag

SEQ ID NO: 40174 - DNA, 378 bp, Artificial Sequence
  Description of Artificial Sequence: Synthetic coding sequence
atgcccggccggcacgtgagccgggtgcgggccctgtacaagcgggtgttgcagctgcacagagtgctgccacccgacctgaagtccttgggtgaccagtatgtaaaggacgagtttaggcgccataagaccgtaggctcagatgaggcccaacgcttccttcaggaatgggaagtgtatgcgacagctttgctccagcaggctaatgagaacagacagaactctaccggtaaagcttgtttcggcacgtttttgccagaagaaaagctgaacgatttccgggacgaacaaattgggcagctacaggaactgatgcaggaggcaactaagcccaaccgtcaatttagcatcagcgagtccatgaaacctaagttttag

SEQ ID NO: 40175 - DNA, 1605 bp, Artificial Sequence
  Description of Artificial Sequence: Synthetic coding sequence
atgttccagttccacgccggcagctgggagagctggtgctgctgctgtctaatacccgccgatcgcccatgggatcgtggacagcactggcagttggaaatggctgatacccggtcagttcacgagaccagatttgaagccgccgtgaaagtgatccagtccctgcccaagaatggttcctttcaacccacaaatgaaatgatgcttaagttctattccttttataaacaggcgactgagggcccctgtaaacttagtagacctggcttctgggatcccattgggagatataagtgggatgcctggtcttcccttggagacatgacgaaggaggaggccatgatcgcatacgtcgaggaaatgaagaaaatcatcgagaccatgcccatgaccgaaaaagtcgaggaattgctcagagtaatcggacccttctacgaaatcgtagaggataagaaatctggtagatcatcggatattacctctgtgaggcttgaaaaaatatctaaatgtctggaagacctgggcaacgtcctgacctcaacacctaacgccaaaaccgtcaatggaaaagccgagagttcagattccggtgccgagtcagaagaggaggaggcacaagaggaggtcaaaggcgctgaacaaagtgacaacgacaaaaaaatgatgaaaaagtctgcagaccacaagaatctggaagtcatcgtaacaaacggctatgacaaagatggcttcgtgcaagatatccagaatgacattcatgctagctcatcgctgaacggacggtctaccgaagaggtgaaaccaattgacgagaatctcggccagactggaaaatcggctgtttgcatccaccaggatatcaacgatgatcacgtcgaagacgtcactggtattcagcatttaacttcagactctgattccgaggtttactgcgacagcatggagcaattcggtcaggaagaatcactcgattccttcaccagtaataacggaccgtttcaatattatctcgggggccactcttcacagccaatggagaactccggtttcagagaggacatccaggtacctcctggcaacggcaatataggcaatatgcaggtagtagctgttgaaggcaagggggaagtaaagcacgggggggaagacggccggaacaatagcggcgctccccatcgcgaaaagcgaggaggagagaccgatgaattcagcaatgttagacgcggcaggggacaccgcatgcaacacctatctgagggcaccaagggcagacaggtaggttccggaggggacggagagcgatggggctccgaccgcggcagcaggggtagcctgaacgagcagatcgcactggtgctaatgaggctgcaggaggacatgcagaatgtgcttcagcggctgcagaagctcgaaactctaaccgcactccaggccaagtctagtacatctaccctccagactgcacctcagccaacttcacaacgtcctagctggtggcctttcgaaatgagtcccggtgtgctaaccttcgccatcatctggccattcatcgcacagtggctggtctatttgtactatcaaaggcgaaggagaaaactgaattag

SEQ ID NO: 40176 - DNA, 1596 bp, Artificial Sequence
  Description of Artificial Sequence: Synthetic coding sequence
ttccacgccggcagctgggagagctggtgctgctgctgcctgatccccgccgaccgtccgtgggacaggggccagcactggcagctagaaatggctgatactaggtccgtacacgaaacacgattcgaagcggctgtgaaagtgatccagtccctgccaaaaaatgggtcttttcaaccaaccaatgaaatgatgctgaaattttatagtttttacaaacaggccacagagggcccctgtaagttgtcaagaccaggcttctgggaccctatcgggcggtacaaatgggatgcatggtcaagtctcggagatatgacaaaagaggaggccatgatcgcctacgttgaagagatgaaaaagataattgagactatgcccatgacagagaaagtggaagagctcctgcgggtaattgggccgttctatgagatagtggaagacaaaaagtccggacgcagtagcgatatcacctcagtgcgacttgagaagatctcgaagtgtctggaagatttaggaaatgtgctcacctccaccccgaacgcgaagacagtgaatggaaaggccgaaagtagcgattccggagccgaaagtgaagaggaggaggcccaagaagaagtgaaaggagcagaacaaagtgacaatgataagaagatgatgaagaaaagtgctgaccataagaacttggaggtgattgtgaccaacggatacgataaggacggatttgtccaggacatccagaatgatatccacgcctctagttccctgaatggaaggtcgaccgaggaagtgaagcctatcgacgagaacctggggcaaaccgggaagagtgccgtttgtattcaccaggatatcaacgacgatcacgtagaagatgtgacaggaattcagcatttaacgagcgactccgactccgaggtgtactgtgactccatggagcagttcggccaagaagagagtttagattcctttacgtctaataatggccccttccagtattatctgggcggacacagttcacagcctatggaaaatagcggattcagagaagacatccaggttccacctgggaacggcaatatagggaatatgcaggtggtggcggtagagggcaaaggcgaagtgaagcacggaggagaagacggtcgcaacaattccggtgccccacatagggagaaaagaggtggtgagacagatgagttttcgaacgtccgacgcgggcggggtcatcgaatgcagcacttatccgagggcactaaggggcgccaggtcggtagtggcggagacggtgaaagatgggggtctgaccggggctctaggggttctttgaacgagcagatcgccctggtactcatgcgcctccaggaggatatgcagaacgtgctgcaaaggctgcagaaactggagaccctcacagctctccaggcaaagtcgtctacttctacacttcagactgcaccccagcccacgtcccagcgccccagctggtggccgtttgagatgtcccctggagttctcaccttcgcaatcatctggccattcatcgcccagtggcttgtgtacttatattaccagaggcgccgccggaaactaaactag

SEQ ID NO: 40177 - DNA, 1047 bp, Artificial Sequence
  Description of Artificial Sequence: Synthetic coding sequence
atgaccaaggaggaggccatgatcgcctacgtggaggagatgaagaagattattgagacaatgccaatgacagagaaagtggaagaactgctgagggtgattggccccttctacgagatcgttgaggataaaaagagcgggaggtcctccgatataacatcagacctggggaacgtcctgacaagcacaccaaacgccaaaaccgtgaacggcaaagccgaaagcagcgattctggagccgagtccgaggaagaagaagctcaggaagaagtgaaaggtgccgagcagtctgacaacgacatcaatgacgatcatgtggaagatgtgactggaatacagcatttgacctctgatagtgatagcgaagtgtattgcgactcaatggagcaatttggccaggaagagtctctggactcctttactagcaataacgggccttttcagtactatttgggcgggcactctagccaacctatggaaaactctggattccgggaggatatccaggttccccctgggaacggcaacatcggcaatatgcaggttgttgccgtggaagggaaaggcgaggtcaagcacgggggagaggatgggagaaacaacagcggcgcaccgcaccgcgagaagagaggtggcgaaacagacgagttttcgaatgtcaggagaggtagaggccatcggatgcagcatctgtccgaagggaccaaagggagacaggtcggttctggcggcgacggcgagaggtgggggagcgatcgaggctccagaggatccctaaacgaacagatcgcactggtgctcatgcgtctgcaagaggatatgcagaacgtgctccagagattgcagaagttagaaacacttacggccctgcaagctaaatcttctacctcaaccctgcagaccgccccccagccaacctcccagagaccctcatggtggccgttcgagatgagccccggggtgctgactttcgccattatctggccgttcattgcccagtggctggtttatctgtattatcagagaaggcgacggaagttgaactag

SEQ ID NO: 40178 - DNA, 1251 bp, Artificial Sequence
  Description of Artificial Sequence: Synthetic coding sequence
atgaccaaggaggaggccatgatcgcctacgtggaggagatgaagaaaattattgagaccatgcccatgaccgaaaaagtcgaggaactgttacgagtcatcgggccattttatgagatcgtggaggacaagaagtccggcagatcctctgatataacaagtgatctgggcaatgttcttacatccaccccaaacgccaagactgtaaatggcaaggctgagtcatcagacagtggcgccgagtcggaggaggaggaagctcaggaagaagtgaagggggcagagcagtctgacaatgataaaaagatgatgaaaaaatcggcagatcataaaaatttggaagtgatcgtgaccaatggctatgacaaagacggattcgtgcaagacatccagaacgatatccacgccagttcgagtctgaatggtaggagtacagaggaggtgaaacctattgatgagaatttgggccagacaggaaagtctgccgtttgcatacatcaggacatcaacgatgatcacgtggaagatgtgacaggtatccagcacctgaccagcgatagcgactcagaagtctactgcgactctatggaacaatttgggcaggaggagagccttgattcctttacaagcaacaatggcccgttccagtattacctcggggggcactctagccagcccatggaaaactccggattccgggaggatatccaggtcccacccggcaatggaaatatcggcaatatgcaggtggttgctgtggaggggaaaggcgaggtcaaacacggaggtgaagatgggcgcaataattcaggagctccccatcgggagaagcggggcggggagactgacgagttttctaacgtgcgacgagggcgcgggcacagaatgcagcatctgtccgagggaaccaagggtcggcaagtgggctctggaggcgatggtgaaagatgggggagcgatcggggatctagaggcagcctgaatgagcagatcgccctggtattgatgagactacaggaggacatgcagaatgtgttgcagcgactgcaaaaactagagactttgacagcactccaggcgaagtcctccacatcaactctgcagaccgcaccacaacccactagtcagcggccctcttggtggccttttgagatgagtccaggggtcttgacctttgcaattatctggcctttcatcgcccaatggctggtgtatttatattaccagaggcggcggaggaaattgaattag

SEQ ID NO: 40179 - DNA, 1473 bp, Artificial Sequence
  Description of Artificial Sequence: Synthetic coding sequence
atggccgacacccggagcgtgcacgagacccggttcgaggccgccgtgaaggtaattcagtcgcttccgaagaacgggtcttttcagcccacaaatgagatgatgttaaagttctatagcttttacaaacaggctaccgaaggaccgtgcaaactgtctcgtccaggcttctgggaccctatcggacggtataaatgggatgcatggtcttctctcggggacatgaccaaggaagaggccatgatagcttatgtagaggagatgaaaaagataattgaaaccatgcctatgacggaaaaagtggaggagttgctccgagtgatcggtccattctatgagatcgtggaggataagaaatcgggccgaagctccgatatcaccagcgatctgggtaacgtgctgaccagtaccccgaatgccaaaacggttaatgggaaagcagaatcttccgacagcggagccgagagtgaggaagaagaagcccaggaagaggtgaaaggagctgagcagtcagacaatgacaaaaagatgatgaaaaagtctgccgatcataagaaccttgaggtaatcgtgacgaacggttacgataaggatggctttgtgcaggatatccagaacgatatccacgcctcttcctcactgaacggcagatcaacggaggaggttaaacccattgatgaaaacctgggacagacaggaaaaagcgctgtttgcatacaccaggacataaacgacgatcacgtcgaggacgtgaccggcatccagcacctcacatccgattccgactctgaggtatactgcgattcaatggaacaattcgggcaagaagaatctctcgacagctttacttcaaataacgggccttttcaatactacttgggaggccactcgtctcagcctatggaaaattccggttttcgcgaggatatccaggtgcccccgggtaatggaaacatcggcaacatgcaagtggtcgcggtcgaaggcaaaggtgaagtaaagcacgggggggaggacggtaggaacaacagcggagctcctcacagggaaaagcgagggggcgaaaccgatgagttcagcaatgtccgccgggggcgtggacacagaatgcagcatctttccgagggtaccaaggggcgccaggtggggagcggcggtgacggtgagaggtggggcagcgatcgcgggtcacgcgggagtctgaatgagcaaatcgccctcgtcctcatgcgtcttcaggaggacatgcagaacgttctgcagcgcctccaaaaattggagacactgacagccctgcaggcaaagagttccactagcactctgcaaacagccccccagccgacgtcccaacggccgtcctggtggccatttgagatgtctcccggggtcctaaccttcgccataatctggcctttcatcgcccaatggctggtctacctttattaccagaggcgcagaaggaagctcaactag

SEQ ID NO: 40180 - DNA, 1578 bp, Artificial Sequence
  Description of Artificial Sequence: Synthetic coding sequence
atgctgttcctgagcttccacgccggcagctgggagagctggtgctgttgctgtctcatccctgccgatagaccgtgggaccgtggtcagcactggcaactagagatggcagataccaggtcagtccatgaaactaggtttgaggccgcagtgaaggttatacagtcgcttcctaagaatggaagttttcagcctacaaatgagatgatgcttaaattctacagtttctataagcaggcgactgagggtccctgcaagttatccagacccggcttctgggaccccatcggtcggtataagtgggacgcatggagctccctgggcgatatgacaaaagaggaagccatgattgcctatgtcgaggagatgaaaaaaattattgagactatgcccatgacagagaaagtcgaagagctgctccgtgtgatcggccccttttacgagatcgtggaagataagaagtctggccggtcttccgacattacatcagaccttggcaatgtgctcactagtacacctaatgcaaagaccgtgaatggcaaagcggaaagctccgactcaggtgccgaaagcgaggaagaagaagcacaggaggaagtaaaaggtgcagaacagtccgacaacgataagaagatgatgaagaagtcagccgatcacaaaaacttggaagtcattgtcaccaacggttatgacaaagatggttttgtccaagacattcagaatgatattcacgcaagctctagcttaaacgggaggtcaacagaggaagtgaagccgatagatgagaacctcggtcagaccggaaaaagtgcggtctgcatccaccaggatattaatgacgaccacgtcgaagatgttaccggaatccagcatctgacctccgatagcgatagcgaggtgtattgcgatagcatggagcagtttggccaggaggagtccctggacagcttcacatcgaacaacgggccttttcaatattacctgggaggccacagctcacagccaatggagaacagtggcttcagggaggatatacaggtgccacccgggaatggcaatataggcaatatgcaggttgtggctgttgagggtaagggggaggtaaaacatggaggggaggacggccgcaataacagtggcgcacctcaccgggagaagagagggggcgagaccgacgagttttccaatgtgagaagggggcgcggccataggatgcagcatctatccgagggcacaaagggtcggcaggtagggagcggtggggacggggagagatggggaagcgacagaggcagccgtgggtcccttaatgaacagatcgctttagtgctaatgagactacaggaagatatgcagaatgtactgcagcgtctgcaaaaacttgagacactcacagccctgcaggccaaaagcagtacatccaccttgcaaaccgctcctcagccaacatcccagcggcccagctggtggcctttcgaaatgtcacctggcgtgcttacattcgcaatcatctggccttttattgcccagtggctcgtttacctgtactaccagcgtaggaggaggaagctgaactag

SEQ ID NO: 40181 - DNA, 756 bp, Artificial Sequence
  Description of Artificial Sequence: Synthetic coding sequence
atggccgacacccggagcgtgcacgagacccggttcgaggccgccgtgaaagttatacagtctttaccaaagaatgggtccttccaacccacaaatgaaatgatgcttaagttttacagtttttacaagcaggcaacggagggtccctgcaagctcagtcggccaggattctgggatcctatcggccggtacaagtgggacgcttggtcctctctgggcgatatgacaaaggaagaagctatgattgcctacgttgaagaaatgaaaaagatcattgaaactatgccaatgaccgaaaaggtagaagaactactgcgggtgataggacccttctatgaaattgttgaagacaagaagtccggcaggtcatccgatatcactagcgtcaggcttgaaaagatctccaaatgcctggaggaccttggaaacgtgcttacaagtacccccaacgcaaaaacagtgaacgggaaagccgaatcatctgactcaggcgccgaatccgaggaggaagaagctcaggaagaagtaaagggagccgaacaaagcgataacgacaaaaagatgatgaagaagagtgccgaccataaaaacctcgaggtcatcgtcacgaacggatacgataaggatggcttcgttcaagacatccaaaacgatattcacgctagctcttcgttaaatggccggagtacagaagaggtgaagcccatcgacgaaaatcttggtcagaccggtaaatctgccgtgtgcatacactag

SEQ ID NO: 40182 - DNA, 885 bp, Artificial Sequence
  Description of Artificial Sequence: Synthetic coding sequence
atgcccggcccccccctgagcagcgcccggcacgccctgcccctgggatcctgggagagttggtgctgctgctgtttaatacctgccgatagaccttgggatcgtggccagcactggcagctggagatggcagataccaggagtgttcacgaaaccaggttcgaggccgccgtgaaggttatccagtctctccctaaaaacggttccttccagcccaccaatgaaatgatgctgaaattttactccttctacaagcaggccaccgaaggaccatgtaaactgtctagaccaggtttttgggatccaatcggccgctacaaatgggacgcttggtcttccctgggagacatgaccaaagaagaagccatgattgcctatgttgaagaaatgaaaaagatcatcgagacaatgccaatgactgagaaggtggaagaactgctgcgggttataggacccttctacgaaatcgtggaggacaaaaaatccggcaggtcctcggatattacctccgtgaggcttgaaaagatttccaagtgtctggaggatctggggaacgttcttactagtactcctaatgccaaaactgtgaacggcaaagccgagagctcagattccggcgctgagtctgaagaagaggaggctcaggaagaggtcaaaggagcggagcagtccgacaacgataagaagatgatgaagaagagcgcagaccacaagaacctcgaagtcatagttacgaatggatatgataaagacggttttgtacaggacattcaaaacgacattcacgcctcatccagtctcaacggacggagtacagaggaggtgaagcccatcgacgagaatctgggacagaccggtaagtctgccgtgtgtattcatcagtag

SEQ ID NO: 40183 - DNA, 987 bp, Artificial Sequence
  Description of Artificial Sequence: Synthetic coding sequence
atggcccacagcaagcagcccagccacttccagagcctgatgctgctgcaatggcctctatcctacttggctattttttggatactgcagccgctttttgtgtacctcctgtttacaagcttgtggccattgcctgtgttgtatttcgcctggttgttcctggactggaagacaccagaacgagggggtagaaggagcgcatgggtgcgtaactggtgcgtatggacccacatcagggattactttcccatcacaatcctcaagacaaaagacctgtctccagaacataactaccttatgggagttcacccgcacggccttttgaccttcggcgccttctgcaatttctgtactgaggcaacgggcttctccaaaacctttccagggatcaccccacatctggcaaccctgagctggttctttaagatcccctttgtgcgcgagtacctgatggccaaaggcgtgtgttccgtcagccagcccgctatcaactacctgctctcgcacggaacgggcaatctagtgggcatcgtggtgggcggcgtgggggaagcgctccagtccgtgccaaacaccacgacattaattctccagaaaagaaagggctttgtccgcaccgcattgcagcacggagctcacctcgttccgacgtttacatttggcgagactgaggtgtatgatcaggtcctgtttcacaaggatagtcggatgtataagtttcagagttgttttcgccggattttcggattttattgctgcgtattctacggccaatctttttgtcaagggtctactgggttgctgccgtacagcaggcccattgtaacagtagtgggcgaaccactaccactgcctcagatagaaaagcctagtcaagaaatggtggataagtatcacgccttgtacatggatgcactccataaactcttcgaccagcacaaaactcactatggttgttccgagacacagaaacttttctttttgtag

SEQ ID NO: 40184 - DNA, 1002 bp, Artificial Sequence
  Description of Artificial Sequence: Synthetic coding sequence
atgctgctgcccagcaagaaggacctgaagaccgccctggacgtgttcgccgtgttccagtggagcttctctgccctgctgataaccactaccgtcatcgcagtgaatctgtacttggtcgtcttcacgccatattggccggtgactgtcctgatactgacttggctggcgtttgattggaagacgcctcagagaggcgggaggcgatttacttgcgtacgtcactggcgcctctggaaacactacagtgactatttccccctgaagctactgaagactcacgacatttgtccttcgaggaactacattttggtgtgccaccctcacggactgtttgcccacggatggtttggacacttcgcaactgaggctagtggcttttctaagatcttccccggcatcacaccctatatcctgactctgggggcttttttttggatgcctttcctgcgcgagtacgtcatgtctaccggcgcctgcagcgtgagccgctcctccatcgattttttattgacccacaaggggaccggaaatatggtgatcgttgtgataggcggcctggcagagtgcaggtattccctcccaggttctagcacattggttttgaaaaatagatccggctttgtccgcatggcactgcaacacggtgttccactaattcccgcatacgcatttggtgagactgatctgtacgaccagcatatctttacaccgggcggctttgtcaacaggttccaaaagtggttccagagtatggttcatatatacccttgtgcattttatgggagagggttcacgaaaaattcatgggggctccttccatacagccgaccggtgacaactattgttggggaacccctacccatgccaaagattgaaaaccctagccaagagattgttgctaagtaccataccctgtacattgacgctttaaggaagctcttcgaccagcataagactaaatttggtatctccgaaacgcaggagcttgagattatttag

SEQ ID NO: 40185 - DNA, 2220 bp, Artificial Sequence
  Description of Artificial Sequence: Synthetic coding sequence
atgttcctgctgctggccctgctgaccgagctgggccggctgcaggctcatgagggcagcgaaggcatttttctgcacgttacagtgcctcgcaaaattaaaagcaacgatagcgaggtgagtgaacggaaaatgatctatatcataactatcgacggccagccctatacactgcacctgggcaagcagtcattccttccccagaattttcttgtgtatacctacaatgagaccgggtctctgcatagcgtgagtccgtacttcatgatgcactgccactatcaggggtacgccgctgagttcccgaattcatttgtcaccttgtctatctgctctggcttgcgtggctttttacagtttgaaaatatatcctacggaatcgagcctgtagagagttcagctagattcgagcatatcatataccaaatgaaaaacaatgacccaaacgtgagcattctagccgtgaattacagccacatctggcagaaggaccagccatacaaagtccctctgaactcacaaataaagaatctcagtaaactactgccgcagtatttagaaatttatattatcgtggaaaaagccctctatgattatatgggatcagagatgatggcggtgacacagaagattgtgcaagttatcgggttggtcaacactatgtttacccagtttaaactaaccgtaatcttgagctccctggaactctggtccaatgaaaaccagatttccacttctggggatgctgacgatattctccaacggttcctggcctggaaacgcgactaccttatcctgcggccccatgatattgcatatttgctggtgtaccggaaacatcccaagtatgttggcgccacttttccaggaactgtatgtaacaaatcctacgacgcggggatcgcaatgtaccccgatgctattgggctggagggtttctcggttatcatcgcacagctcctgggcttaaacgtaggcctgacatacgacgacattactcaatgtttctgtttgagagccacatgcattatgaatcacgaggccgtcagcgccagcggtcgaaaaatcttcagcaattgcagcatgcatgactatcgttactttgtcagcaagtttgaaacaaaatgtttgcagaaactgagcaatttgcagccacttcaccaaaaccaacccgtgtgcgggaatggaatcctggagtccaacgaagagtgcgactgtgggaataagaatgaatgtcaatttaagaaatgctgcgactacaatacctgtaaactgaagggttcagtcaagtgtggttccggcccatgctgcacatccaagtgcgaactctccatagctggtacaccttgcagaaaatccatagaccccgagtgtgactttaccgagtattgtaatgggacctcctccaactgcgtgccagacacctatgccttgaacgggcgtttgtgcaaactgggaaccgcctattgctataatgggcagtgtcagaccactgacaatcagtgtgcaaagattttcggcaagggagcgcaaggtgcccctttcgcttgctttaaagaagttaacagtcttcacgagaggagtgagaattgtggattcaagaatagccaaccccttccttgcgagcgtaaggacgtgttgtgcggaaagctggcttgtgtgcagccacataagaacgccaacaagtccgatgcgcagtcaaccgtgtattcctacatacaggaccatgtatgcgtttcgatcgccacaggcagttccatgaggtccgatggcacagataatgcctatgtcgccgacggcacaatgtgtggccccgagatgtattgtgttaacaagacatgtagaaaggtgcacctgatgggctataactgcaatgcgacaacaaaatgtaaggggaagggcatctgtaataatttcggaaactgtcagtgcttccctggtcaccggccgcctgattgcaaattccagtttggttctccaggcggcagcatcgacgacggcaatttccagaaatccggtgatttctataccgaaaaaggctataatacccactggaataattggtttattcttagcttctgcatattcttgccatttttcatcgtgtttactaccgtaatcttcaaaaggaacgagatatccaagagttgcaatcgcgaaaacgctgaatataatagaaacagttcagttgtgagcgaaagtgacgatgtcgggcattag

SEQ ID NO: 40186 - DNA, 2148 bp, Artificial Sequence
  Description of Artificial Sequence: Synthetic coding sequence
atgttcctgctgctggccctgctgaccgagctgggccggctgcaggcacatgaaggttctgaagggatcttcctccacgttacggtccctaggaagatcaaaagtaatgatagtgaggttagcgaacggaagatgatctacatcattaccattgacggacagccatatactctgcatttgggcaaacagtcttttttgccgcagaacttcctggtctacacctataacgagacagggtccctgcattccgtttctccgtacttcatgatgcattgccattaccaggggtacgcagccgagttccccaactcctttgtcaccctgtctatttgttcggggctgcgtggtttcctgcaatttgagaatatcagctacggcattgagcctgtagagtctagcgcacgttttgaacatattatttatcagatgaagaataatgacccgaacgtgtccatactggctgtgaactacagccatatttggcaaaaagaccaaccgtacaaagttcccctaaatagccagattaagaaccttagtaaactgctacctcagtacctagaaatctatatcattgtggaaaaggccctgatgtttactcaattcaagctgactgtgattttatcatctctggaactctggagtaatgagaatcaaatatccacatcaggagatgccgatgatattctccaacgtttcctcgcctggaagagggattacctcatattgcgcccgcatgatatcgcctacctgcttgtgtacagaaaacatccaaaatacgtgggcgccacgttcccgggtacagtttgcaacaaaagttacgacgctggcatcgccatgtaccctgatgccataggcctggaggggtttagtgtcattattgcacagctgctgggcctgaacgtcggcctgacttacgatgatatcacccaatgcttttgtctacgggctacatgcatcatgaatcatgaagcagtttccgcttccggaagaaagattttctccaactgtagtatgcacgactacaggtactttgttagtaagttcgaaacaaagtgcttgcaaaagctgtccaatttgcagccactacaccagaaccagcctgtgtgtggtaacggcattctggagtctaacgaggaatgtgactgtggaaataaaaatgagtgccagtttaaaaagtgctgtgattataatacatgtaagctgaagggctctgtgaaatgcgggagcggcccatgctgcacctccaagtgtgagctcagcattgcaggcacaccttgtcgcaagtccattgatccagagtgcgacttcactgaatactgcaatggcacctcttctaattgtgtgccagatacttacgccctcaacggccggctgtgcaaattggggaccgcctattgttacaatggccagtgtcagactaccgacaaccaatgcgcaaaaatctttggcaaaggcgcccaaggagcgccatttgcctgcttcaaggaggtcaacagtctccatgagaggagtgaaaattgcgggtttaagaacagccagccactaccctgtgagcggaaggatgtgctctgtggcaaactggcttgcgtacagcctcataaaaacgcaaataagtctgatgcccagtcaactgtgtactcctacattcaggaccatgtgtgtgtatctatcgctacaggctcctccatgcgttctgatgggacagacaatgcttatgtagctgacgggacaatgtgtggccccgagatgtactgtgtaaacaagacttgccgcaaggtgcatcttatggggtataactgcaatgcaactactaaatgtaaagggaagggaatttgcaacaactttgggaactgccagtgttttcctgggcaccgaccacccgattgtaaatttcaattcgggagtcccggaggcagcattgatgatggcaactttcagaagagtggcgatttttacactgaaaaaggatataacacccactggaacaactggtttattctaagcttttgcatttttctcccatttttcattgttttcactactgtaatcttcaaaaggaacgaaattagcaaaagttgtaatcgtgaaaatgctgaatacaacaggaacagcagtgtcgtgagcgaatccgacgatgtcggtcattag

SEQ ID NO: 40187 - DNA, 462 bp, Artificial Sequence
  Description of Artificial Sequence: Synthetic coding sequence
atgcggagcgacggcaccgacaacgcctacgtggccgacggcaccatgtgcggacctgagatgtattgtgtcaataaaacgtgtagaaaggttcatcttatggggtacaattgcaacgcgacaacaaaatgtaagggtaagggcatctgcaataacttcggaaattgccagtgctttcctggacaccgaccccctgattgcaagttccaattcgggagtcctggcggttccatcgacgatgggaactttcaaaaatctggcgatttttacaccgagaaggggtataacacacattggaacaactggtttatcctgtctttttgcattttccttcctttcttcattgtgttcacgacagtcatcttcaagagaaatgagatttccaagtcatgtaaccgggagaacgctgaatataataggaattcctcagtcgttagcgagagtgatgacgtgggccattag

SEQ ID NO: 40188 - DNA, 549 bp, Artificial Sequence
  Description of Artificial Sequence: Synthetic coding sequence
atgttcctgctgctggccctgctgaccgagctgggccggctgcaggcacacgagggatccgagggtatcttcctgcacgtgacagtcccccgaaagatcaagtcaaatgattcagaagtaagcgagcgcaaaatgatctatattattactattgatggtcaaccgtacacactgcacttggggaagcagagcttcttgccacagaatttcctggtgtacacctataatgaaacgggctctctgcattctgtcagtccgtatttcatgatgcattgccattaccagggctatgctgctgaattccccaattcatttgtgacactgtcgatttgttccggcctgcgtgggttcctgcagtttgaaaacatctcctacggtatcgaacctgtcgagagttccgcgagatttgaacacatcatatatcagatgaaaaacaacgacccaaatgtgtccatcctggcggtgaattactcccacatctggcagaaagaccaaccatacaaggtgccactcaatagtcaggtcacggttatcatcctaatgctgtag

SEQ ID NO: 40189 - DNA, 2364 bp, Artificial Sequence
  Description of Artificial Sequence: Synthetic coding sequence
atgttccggctgtggctgctgctggccggcctgtgcggcctgctggcatctcggcctggcttccagaatagtctactccagattgtgattccagagaaaatacagaccaacacaaatgattcgtccgagattgagtacgagcagattagctacattatacctatcgacgagaagctttatacagtacacctcaagcagcggtatttccttgcagataattttatgatctatctgtacaatcaggggtcaatgaacacatactcctctgacatccaaacacagtgctattaccaaggcaacatagagggatatccagattccatggtgacactgtctacttgctccgggctgcgaggaatactacagttcgaaaatgtaagttacggcatcgagcctttggagtccgctgtggaatttcagcacgttctctacaagctgaaaaatgaagataacgatatagcaattttcatcgatcgaagtctcaaagagcaaccaatggatgataatatcttcattagcgagaagtcagagcctgctgtgccagacctctttcccttgtacctcgaaatgcacatagtagtggataagaccctgtacgactactggggtagcgattctatgatcgttactaataaggtaatcgaaatcgttgggctggctaactctatgttcactcagttcaaggtcacgatcgtgctatcttcactggaactctggtcagacgaaaacaaaatatctactgtcggggaggctgacgagctgctgcagaagtttttagaatggaagcagtcctatctgaacctgaggccacacgatatcgcgtatttgcttatctatatggattatccacgctacctaggagccgtgttcccaggaaccatgtgtattacccggtactcggcgggggtggctttgtatcccaaggagattacacttgaggcatttgccgtaatagtgacgcagatgttagctttgtccctggggatttcctacgacgacccaaagaagtgccagtgctccgaaagtacctgcatcatgaatccggaggtggtccagtccaatggcgtgaagacattcagttcttgtagtctacggagtttccagaattttatctcaaacgtgggagtaaagtgcttacagaacaagcctcagatgcaaaaaaagtctcccaaaccagtatgcggaaatggcagattggaaggcaacgagatatgtgactgcggtaccgaggcccagtgcggcccagcctcctgctgcgatttcagaacatgtgttctgaaggacggggcaaaatgctataaaggtctctgttgtaaagactgtcaaatcttgcaatcgggcgtagagtgtaggccaaaagcccaccccgagtgtgacattgcggagaattgcaatgggacatccccagagtgcggcccagatatcactctgataaacggtctgtcttgcaaaaacaataagtttatttgttatgacggggactgccacgacctggacgcacgttgcgagtctgtcttcggaaaaggctcacggaacgcgcctttcgcgtgttacgaagaaatccagtcccaaagcgataggttcggaaactgtggccgggacaggaacaacaagtatgttttctgcggttggcgaaatcttatctgtggacgactggtctgcacatatccaacgaggaaacctttccaccaggagaacggtgatgtcatctacgctttcgtgagagacagtgtgtgcatcacagtcgactataagctacctcgcaccgtgccagatccgctggcagtcaagaatggatctcaatgtgatattggaagagtgtgtgtgaaccgggaatgcgtcgaatctcgcatcataaaggcctccgcgcacgtttgcagccagcagtgctctggtcacggagtgtgcgattcccggaataagtgccactgctcaccagggtataaaccccccaactgtcagatccgttcgaagggcttcagcattttccctgaggaggacatgggctctattatggagcgcgctagcggaaagacagaaaatacgtggctccttggatttctgattgccctaccgatcctcattgttaccacagccatcgtcctggcacgtaaacagttaaagaagtggtttgcgaaggaggaagaattcccatccagcgagagtaagagcgagggctcaacacagacatatgcctcacagtctagcagcgagggcagcactcagacctatgcctcgcaaactagaagcgaaagctcatcacaggctgatacatccaagtcaaagtccgaggacagcgcggaggcctataccagcaggagcaagtcccaggactccacccagacccagagcagtagcaattag

SEQ ID NO: 40190 - DNA, 837 bp, Artificial Sequence
  Description of Artificial Sequence: Synthetic coding sequence
ttccggaacctgctgaacaacgtgagcctgtgccaccccggctggagcgccgttgcccagtcttggctgacggcgacatccgcatctcaagtacaagtgatcctgctaccacatcctcccaactgctggttagggcttcaagagcagatcagttatattattcccatcgacgagaagctgtacacagttcacttgaagcaaagatactttttggctgacaactttatgatctatttatacaaccagggatctatgaatacatacagcagtgacatccagacgcagtgttactatcagggcaatattgagggctaccctgatagtatggtaaccctcagcacctgctcgggtctgcgtggtatattacaatttgaaaatgtgtcctacgggatagaacctctcgagagcgccgtggaatttcagcacgtgctgtacaagctgaagaatgaagacaacgatatcgccatctttattgatcgcagtctcaaggaacaacctatggacgacaacatcttcatctcagaaaaaagcgagccagcagttccggacttattccctctatacttagagatgcatattgtggtggacaagacactttacgattactggggcagcgactcgatgattgttacaaataaagtgattgagatagttggacttgctaactcgatgttcacacagttcaaggtgactatcgtgttgtcgtctttagagttatggtccgatgagaacaaaatttccaccgtgggtgaggcagacgagctcctgcagaagtttttagagtggaagcagtcatatctcaatctgcgcccccatgatatcgcctatctgctgtag

SEQ ID NO: 40191 - DNA, 2358 bp, Artificial Sequence
  Description of Artificial Sequence: Synthetic coding sequence
atggtggtgcccagcctgaagctgcaggacctgatcgaggagatccggggggcaaaaacccaagctcaggagcgtgaggtcatccagaaggaatgcgcacacataagagcaagtttccgcgatggagatcccgtgcataggcacagacaacttgccaaactgttgtacgtgcacatgctgggctacccggcacatttcgggcagatggagtgcctgaaattgattgcctcgtcccggttcacggacaagcgggtcgggtacctcggagccatgctgctactagatgagagacatgacgctcacttgctgattaccaactccatcaaaaatgacctctcccagggtatccagccagtgcagggcctagccctgtgcaccctgagcacaatgggctctgcagaaatgtgccgggacctggctcctgaggtggaaaagttgctgttgcaaccctccccatatgttagaaaaaaagcaatcctgacagcagtgcacatgattcgcaaggtacctgagttgtcgagtgttttcttgccaccatgtgcacagctgttacacgagcgccatcatgggatactgcttggcaccataaccctgatcacagagctctgcgagaggagtcccgcagcactgcggcacttcaggaaagtcgtgccccagctggtgcacattcttcggactctggtgaccatgggatattcgaccgagcacagcatttctggagtctccgatccctttctacaagtgcagatccttcgactccttcgtatattggggcggaaccatgaagaaagctcagagaccatgaatgacctgctagcccaagtggccacaaataccgatacctcacgaaacgccggcaacgccgtactgttcgagaccgtcctgactattatggacattagatccgccgctggcctgagagtcctcgccgttaacattctgggtagatttctgctgaactcggacagaaatataaggtacgttgccctgaccagcttgctcaggctggtccagtccgatcattccgctgtgcagcgccaccgtccaaccgttgttgaatgcctgcgagagactgatgcatctttgagccgccgggccctcgaattgtccctcgctctcgtgaactcctccaacgtccgagcgatgatgcaagagttacaggctttcttggagagttgtccacccgacctcagagcggactgcgcctccggcatcttgcttgcagccgagcgtttcgccccaaccaagagatggcatatcgatacgattctgcatgtcttgaccacagcgggcactcatgtgcgggacgatgctgtcgcgaatctgactcaattaattggaggtgctcaagagcttcatgcttacagtgtgaggcgcctttacaacgccctcgccgaggatatcagtcagcaaccgttggtgcaggtggctgcgtggtgcatcggcgagtatggcgacttgctgcttgcgggaaactgtgaggagattgagccacttcaggtggacgaggaagaggtgctcgcccttttggagaaggtgttgcagtctcacatgtctcttccagcaacccgcgggtatgcactgaccgcgctgatgaagttgagtacccgactgtgtggggacaacaacaggatccgccaagtggtgtccatctacggtagttgtctagacgttgaactacagcagcgtgccgtcgagtacgacactctgtttcgaaagtatgatcacatgagagcggcaattctcgaaaagatgcctttagtcgagcgggacggaccacaggcagacgaggaggcgaaagagtcaaaggaggccgcacagttgtccgaggctgctccagtcccaactgagccacaggcttcacagcttctcgacctgctggatctcctcgatggcgcgtctggagatgtgcagcatcctcctcatctggatccttcacccggcggagctcttgtacacctgctggaccttccctgcgtgccccctcccccagcacccatccccgacctgaaggtctttgagagggagggagtgcagttgaatctgagcttcattagaccgcccgaaaatccagcccttctcctgattacaatcaccgccacaaacttctctgaaggggacgttacccacttcatctgtcaggccgctgtacccaagtccctacagctccaactgcaggcacccagcggtaacaccgtgccagcaagggggggcctgccaatcactcagctctttagaatcttaaacccaaacaaggcccctcttcggttaaagctgcgactgacatatgaccactttcaccagtctgtgcaagaaatctttgaagtgaacaatctccccgtggaaagctggcagtag

SEQ ID NO: 40192 - DNA, 2358 bp, Artificial Sequence
  Description of Artificial Sequence: Synthetic coding sequence
atggtggtgcccagcctgaagctgcaggacctgatcgaggagatccgtggagccaagactcaagcccaggaaagagaagtgatccagaaggaatgcgcccacattagggcctctttccgagatggcgatcccgttcaccggcataggcagctcgctaagctcttatacgtgcatatgctcggctatcctgcccactttggtcaaatggaatgcttgaagcttattgctagtagcagattcactgataagcgggttgggtatctgggggccatgctcctgctcgacgaacgtcatgacgcacacctgctgatcacaaacagcattaaaaacgacttatcacagggaatacaacctgtccagggattggcgctctgcactctctcaactatgggttcagctgagatgtgccgggacctggcgcccgaggtggaaaaacttctcttgcaaccgtcaccctacgtacggaaaaaggctattttaactgccgtgcacatgatcagaaaggtgccagagttgtctagtgtttttctccctccctgtgctcagctgctccatgagagacatcatggcatccttctcggaacaatcacccttatcaccgaactgtgcgagcgttcgcccgccgcactgcgccactttagaaaggtggtcccacagctggtgcacattctgcgcaccttagttacgatgggatattccactgagcatagtatcagcggggtgtccgaccctttcctgcaagtgcagatccttagattgctcagaatcctcggcagaaaccacgaggagtcatccgagaccatgaacgacctgttagctcaggtcgctactaacactgacacgagtcgcaacgcaggtaatgcagtgctgttcgagactgtcctgactattatggatatccggagcgctgccggcctgcgagtcctcgcagtgaacatactcgggagatttttgttgaattctgatcggaatatcagatatgttgccctcactagtctgcttcgactggtccagagtgatcacagtgctgttcagcgtcaccgccccaccgtggtggagtgtctgcgtgaaacggacgcttccctatctcgccgagccttagagctgtccctcgctctggtgaacagcagtaacgtgcgggcaatgatgcaggaactacaggctttcctggaaagttgcccacccgacctgcgcgcagattgcgcgagcgggatcctactggcagcagaacggtttgcgcccactaaacggtggcacatcgacacaatcctgcatgtgttaaccacagcaggaacgcatgtccgggacgacgccgtggccaacctcacacagcttatcggtggcgcacaggagctccacgcctactctgttcggcggctctacaatgcccttgctgaggatattagtcagcagcccttggtgcaggtcgccgcatggtgtatcggagagtatggcgatttattactggccggcaactgcgaggaaatcgaacccctgcaagttgatgaggaggaggtgctggccctgctcgaaaaagtgctccagtctcacatgagcctcccagcgactcgcggatacgctctgaccgcactaatgaaactgagcactagactatgcggtgataataaccgcataaggcaagtcgtgtccatatacggctcctgcctggatgttgagctgcagcagagggcagttgagtacgatactctctttcgcaagtacgatcatatgagggccgcaatcctcgaaaagatgccgctggttgaaagggacggcccccaggccgatgaagaggctaaagaatcaaaagaagccgcccaactctcagaggcagcacctgtaccaaccgagccacaggctagccagcttctggatctgcttgacctactcgatggagccagcggggacgtgcagcaccctccccacctggatccctcacctggcggtgctctggtccatttactcgacctaccctgtgtgcccccccctcccgcacccattcccgacctaaaagtgttcgaaagagaaggtgttcagctgaacctcagctttatcagaccgccagaaaaccctgccttgctccttattacaattaccgcaacaaatttttctgagggggacgtgacccactttatctgccaagccgcggttcctaagtcattgcagctgcagctgcaggcaccctctggcaatactgtgcctgctagagggggcctccctattacacaacttttcaggattctaaatcctaacaaagcgcccctgcgcctcaagctgaggttgacatacgatcacttccatcagtctgtacaggagatttttgaggtaaataacctccccgtggagtcatggcagtag

SEQ ID NO: 40193 - DNA, 1923 bp, Artificial Sequence
  Description of Artificial Sequence: Synthetic coding sequence
atggaccggcggatcgagaaccggatgggcacccccgcccaccggagacgagtggttcacacacacagacacactcgcaatcgcctctcgtgcccctggccccccccattcaccagtcccacactaacccctggaatactgttgggcaccattacactgatcaccgagttgtgtgaaagatctcctgcagctctaaggcattttaggaaggtggttcctcagctcgtacacatcctgcggacactggtaactatgggctactcaacagagcatagtatctcaggcgtaagcgacccctttttgcaggtgcaaatcctaagactgctacgcatactgggacggaatcatgaggaatcttcagagactatgaacgatttgcttgctcaggtagcaaccaatacagatactagcagaaatgctggaaatgccgtgctgtttgaaactgtcctgacaattatggatatcagatccgcagccgggctgcgcgttctggcagtgaacatcctcggtaggtttctactcaattcagaccgcaacataaggtatgtcgccctcacgtctctattgcgactggttcaatctgaccacagcgccgtccaaaggcacaggcctaccgtggttgagtgcctgagggaaactgacgcttccttatcaaggagagctctagaactctctcttgcactggtgaatagttcgaacgtgcgagctatgatgcaggaactgcaggcctttctggagtcttgcccccccgaccttcgcgccgactgcgcctctgggattctgctggccgccgagaggtttgcccccaccaaaagatggcacattgacacaattctgcacgtgctcaccactgccggcactcacgtaagggacgatgctgtggcaaacctcacccagctaatcgggggcgcacaagaattgcacgcatatagcgtgagaagactctacaacgccctggcggaagatatctcccagcagccattggtgcaggtggctgcatggtgcatcggcgagtatggcgaccttcttttggccgggaactgtgaggaaattgaaccattgcaggttgatgaggaggaagtgctggccctgctcgaaaaggttctacagagccacatgagtctccctgccacccgtggttatgctctgacagcactgatgaaactgtcaacacgtctttgcggcgacaacaatcgtattcggcaggttgtctcaatctacggcagctgcctggatgtcgaacttcagcaacgtgctgtggagtacgacactctttttcgaaagtatgaccatatgcgtgccgctatcctggaaaaaatgcccctggttgagagggatgggccccaagctgacgaggaggccaaagaatccaaggaagccgcgcagctgtccgaagccgccccggtccccactgagccacaagcatctcagctgctcgacttgctcgatctcctggatggagcctccggagacgtgcagcatccaccccatctggatcctagcccagggggtgccctggtgcacctgttggatctgccttgcgtgccaccccccccggcgcccattcccgatttaaaggtatttgaaagggagggtgttcagctcaatctctcttttataaggcctcccgagaacccagccctgttgctgataacaataacggcaacaaacttttccgagggagatgtgacacattttatctgtcaggccgcggttcccaagagcttacagctgcagctccaggctccttccgggaatactgtaccagcccgcggcggactgcccatcacacaactctttaggatcctaaatccaaacaaagcccctcttcggctgaagctacgtttaacctacgaccactttcatcaatcagtgcaggagatctttgaggtgaataacctgcctgtggagagttggcaatag

SEQ ID NO: 40194 - DNA, 1665 bp, Artificial Sequence
  Description of Artificial Sequence: Synthetic coding sequence
atgagcgtgaccatggtggtgccccagctggtgcacatcctgcggactcttgtgaccatgggctattccacagagcatagtatcagtggagtgtcagatcccttcctgcaagtgcagatactacgcctgttgagaatcttgggcagaaaccacgaagaatcaagcgagactatgaacgacctgaccgttctcactataatggatattagatctgcagctggtctgcgcgttctggccgttaatattcttggcaggtttcttctcaactccgatagaaatattagatacgtcgctctgaccagtctcctgcgcctggtacagagcgatcactcggcggtgcagagacatagacccacagtggtcgaatgtcttcgggagacagacgcatccctgtccagaagagccctggagctgtccctcgccctggttaacagctctaacgttcgcgcaatgatgcaggagcttcaagcctttctggagtcgtgcccacccgaccttcgagcagattgcgcgagcgggatcctactggctgcggagcgctttgcacccactaagaggtggcacatagataccattctgcatgttctgactaccgccggcacccacgtgagggacgacgccgtcgctaatcttacgcagctcattgggggggcccaggagctccatgcttacagcgtgagacggctgtacaatgcgctggctgaggatatctcccagcagccactggtgcaagtggctgcttggtgtatcggtgagtacggggacctgctcctcgcgggcaactgcgaagagattgagccccttcaggtcgatgaagaagaggtgctggcgctcttggagaaagttctgcagagccatatgtccttgcccgcgacacgcgggtatgcccttaccgccctgatgaaactttccactcggttgtgtggcgataacaaccgcataagacaggttgtgtccatatacggttcctgcctcgacgtagaactgcagcaaagagctgtcgagtatgatacattgttccgtaagtatgaccacatgagggccgctatcctcgagaagatgcccttggtggagcgggacgggccccaggcggatgaagaagccaaggaaagcaaggaagcagcccagctgtccgaggccgcccctgtgccgacagagccccaagcatcacaactgcttgatctgctggacctcttggatggtgctagtggcgacgtgcagcacccacctcacctggatccaagcccgggtggcgccttagttcacctgctggatcttccttgcgttccacccccaccggcccctattcccgacctgaaggtcttcgagcgagagggggtgcagctgaacctgtccttcattaggccaccagaaaaccccgctctgctgctgatcactatcaccgcaaccaatttctcagaaggcgacgtgacacatttcatatgccaggccgccgtccccaagtctctccaactacagcttcaagcaccatcgggcaatacggttcccgccagaggaggtctccccatcactcaactttttagaatacttaaccccaataaagcacctttgaggctgaagctgaggctgacgtacgaccacttccaccagagcgtgcaggagatcttcgaggtcaataatctccctgtggagagctggcagtag

SEQ ID NO: 40195 - DNA, 414 bp, Artificial Sequence
  Description of Artificial Sequence: Synthetic coding sequence
atggtggtgcccagcctgaagctgcaggacctgatcgaggagatccgcggagccaagactcaggcccaagagagagaggtgatccagaaggaatgcgctcacatcagagcatccttcagagacggagatccagtccaccgacatagacagctggccaagctcctttatgtgcatatgttgggataccctgctcactttggtcagatggaatgcctgaagcttatcgcctcatcaaggttcactgacaagagagtaggatacctgggagcaatgttactgctagatgagcgccacgatgcccaccttctgatcacgaactccattaagaacgacttgtctcagggcattcagcctgtgcagggcctcgctctctgcacactgagcacgatgggatccgcagaaatgtgtagatag

SEQ ID NO: 40196 - DNA, 603 bp, Artificial Sequence
  Description of Artificial Sequence: Synthetic coding sequence
atggtggtgcccagcctgaagctgcaggacctgatcgaggagatccggggggccaagacccaagcgcaggaaagagaagttattcagaaggagtgtgcacatattagagcctcattcagagacggagatccggttcaccggcatcgacagctggccaaactgctgtatgttcatatgctgggctatccagcccacttcggacagatggaatgtttgaaactcatcgcaagttctcgctttaccgacaagagagtgggctatctgggtgctatgctcctgctggatgaacgtcacgacgcacatttactcattacaaatagtattaaaaacgacctgagccaaggtattcagcctgttcagggactggccctctgcacactctccacgatgggaagtgccgagatgtgcagagacttggcacctgaagttgaaaaactattgctacagcccagcccctacgtgcgaaagaaagctattctgacggctgtccatatgatcagaaaggtcccagagctgagctctgttttcctccccccatgtgctcaacttctgcacgagcggcaccacggaattctgctagggactatcacgctgatcacatag

SEQ ID NO: 40197 - DNA, 465 bp, Artificial Sequence
  Description of Artificial Sequence: Synthetic coding sequence
atgatccacttcatcctgctgttcagccggcagggcaagctgcggctccaaaaatggtatatcacactgccagataaggagagaaaaaagataacacgggaaatagtacagatcatcctgagcagaggccatagaacatctagctttgttgattggaaggaactcaagcttgtctacaaacgatatgctagtctatacttctgttgcgcaatcgaaaatcaggataacgagctgctcacactcgagatagtacaccgatatgtcgagttactggataagtacttcggcaatgtgtgcgaattagacattattttcaactttgaaaaggcctactttatcctggacgaatttatcattggcggggaaatccaagagactagcaaaaagattgcagtgaaggcaattgaagatagcgacatgttgcaggagacaatggaagaatacatgaacaagcctaccttttag

SEQ ID NO: 40198 - DNA, 315 bp, Artificial Sequence
  Description of Artificial Sequence: Synthetic coding sequence
atgatccacttcatcctgctgttcagccggcagggcaagctgcggctgcagaagtggtatatcaccttacctgacaaggaacgcaaaaaaataacacgggagatcgtccagattatcctgagccggggacatcggacctccagcttcgttgattggaaggagctgaagctcgtttataagagatatgcctccctgtacttctgttgcgccatcgaaaatcaagataacgaactgctgacgttggaaattgtccatcgatatgtcgagctgctcgacaagtacttcggcaatacctggcccttcgcgagagcctag

SEQ ID NO: 40199 - DNA, 495 bp, Artificial Sequence
  Description of Artificial Sequence: Synthetic coding sequence
atgatccacttcatcctgctgttcagccggcagggcaagctgcggcttcaaaagtggtacatcacacttcctgacaaggagcgaaagaaaatcactcgcgaaatagttcaaatcattctctcgcgtggacaccgaacaagttcttttgtggactggaaagaactgaagctggtctataagcggtatgcgtccctctacttttgttgcgctattgaaaaccaggataatgaactgctgacccttgagatcgtccatcgatacgttgaactcctcgataagtacttcgggaacgtctgtgagctggacatcatctttaattttgagaaagcatacttcatcctagacgagtttattatcggcggagaaattcaagagacctctaaaaaaattgccgttaaggctatcgaagacagtgacatgctgcaggagaaccggctgtcgcccaggggtagggattgttctgaaccacgctcttgccactgtactctagcatag

SEQ ID NO: 40200 - DNA, 465 bp, Artificial Sequence
  Description of Artificial Sequence: Synthetic coding sequence
atgatccacttcatcctgctgttcagccggcagggcaagctgcggctgcagaaatggtacatcactcttcctgacaaagagcgcaaaaagatcacgagggaaattgtccagatcatcttgtccaggggacaccgcacaagcagctttgtggactggaaagagcttaagcttgtgtataaacgctatgcatccctatacttttgctgtgccatcgaaaaccaggataatgagttgttgactttagagattgtgcaccgctatgtcgaacttcttgacaagtatttcggcaatgtgtgcgaactagacattatctttaacttcgagaaggcctatttcattcttgatgaattcattatcggtggggagatccaggaaaccagcaaaaagattgccgtgaaggctatcgaagattcagatatgctccaggaagtgtccaccgtgtcccaaactatgggggagcggtag

SEQ ID NO: 40201 - DNA, 3249 bp, Artificial Sequence
  Description of Artificial Sequence: Synthetic coding sequence
atgagcgccgcccccgcctacagcgaggacaagggcggcagcgccggccctggggaacctgaatacggtcacgatcctgccagcggaggcatcttcagtagtgattacaaaaggcacgatgacttaaaagagatgctagacaccaacaaagacagcctgaaactggaagcgatgaagcgaatcgtcgctatgatcgctcgcggaaagaatgcatcagacctctttccagccgtggtcaagaacgtcgcatgcaaaaatattgaagtgaaaaaactggtgtacgtgtatttggtgagatatgctgaagagcagcaggacctggcgctgttgagtatcagcacctttcagaggggcctcaaggatcccaaccagctgatacgggcctccgccctccgtgtgctgtcgtctatccgggtcccaataattgtgcccattatgatgctagccattaaagaagctgctagcgatatgagcccttacgtacggaagactgctgcccatgcaatccctaagctctactccttggacagtgatcagaaggaccagttgattgaggtgatcgaaaaactgttggcagacaaaaccactctggtcgcgggctctgtggtgatggcctttgaggaagtctgcccagagcgaattgatttgattcacaaaaactatcggaagctgtgtaacctcttgattgatgtcgaggagtgggggcaggtcgtgattatcagcatgctgactcgctacgctcgcacacagtttctctccccaactcaaaacgagtccttacttgaagagaacgcagaaaaggccttctacgggtcagaggaggatgaggctaaaggtgcagggagcgaggagactgctgctgcggctgcaccttctagaaaaccctacgtcatggatcctgatcaccggctcctccttaggaatacaaagcctctcttgcagtctcggtcagccgccgtggttatggctgtggcacagctatatttccacttggccccaaaggcagaggtaggcgttatcgccaaagcacttgtgcgtttactgcgttcccactcagaggtgcaatatgtggtgctccagaatgtggccacgatgagcattaaaaggagggggatgtttgagccctatctgaagtctttctacatacgtagcacagacccaacacagatcaagattctgaagttggaagtgctaacgaacctggcaaacgagactaacatccctaccgtgctgcgcgaattccagacgtacatcagatctatggataaggactttgtcgccgccaccatccaagcaatcggccggtgtgctacgaacatagggagggttcgggatacttgtctgaatgggttggtccagctgctgagtaatcgcgacgaactcgttgtggcggagtccgtggtagtgatcaaaaaactactgcaaatgcagcccgcccaacacggtgagataataaagcacctggcgaagctcacagacaatattcaggtacctatggcccgtgcttctattctatggctgattggggaatattgcgaacatgtgcctcgtattgcccccgatgttttgcgtaaaatggcaaagagtttcacggctgaagaggatattgtgaaattgcaagtcattaatctcgccgctaaattatacctaaccaactcaaaacagaccaagctcctgacacagtacgttctgagccttgctaaatacgaccagaactacgacatccgggaccgggctcgtttcacacgtcaactgatagtcccaagcgagcaaggaggcgctctgtccaggcacgcgaagaaattattcctggcgcccaaacccgcaccagttcttgaatcaagttttaaggaccgggatcactttcaactgggttcactgtctcacctgctcaatgccaaagctactgggtaccaagagctgcccgactggcccgaggaggcgccagacccctccgttaggaatgtcgaagtgcccgagtggactaaatgcagtaaccgcgagaaaagaaaagaaaaggagaaaccattctattctgacagtgaaggcgagtccggacccacagagagtgcagactcagatcctgagtctgagagcgaatcggactcaaaaagtagctccgagtccgggagcggcgaatctagttctgaatccgataacgaggatcaggatgaggacgaagagaaaggccggggctctgagagcgaacagtctgaggaagatggcaaaagaaagaccaaaaaaaaggtccctgaacgcaagggagaggccagtagctccgacgaaggatccgattcttctagctcttccagcgagagcgagatgacgtcagaaagcgaagaggaacagctggagcctgcctcatggagcagaaaaacacctccaagtagcaagtctgccccggcgaccaaggaaatttccctcctggaccttgaagactttactccaccaagcgtgcagcccgtctcacccccagccatcgtgtccactagcttagccgcggatctagaagggcttaccttgactgattcaactttggtgcctagcctgttgtctcccgttagcggcgtgggtagacaagagctgctgcacagagtcgctggagaggggctggccgtggactacacgttcagccggcaaccattcagcggcgatcctcatatggtatccgtgcacattcatttttcaaacagctccgatacccccattaaggggctgcacgtgggtactcccaagctgcctgcagggatctccattcaggagtttcccgagatagaaagcctggccccaggagagtcggctacggctgtcatgggaataaacttttgtgatagcactcaggcggcgaatttccagttatgcacccaaacccgacagttttacgtgtcgatacaaccacctgtgggagagcttatggccccagtgttcatgagtgagaacgagttcaagaaggaacaaggtaaactgatgggcatgaatgagataactgaaaagctgatgctgccagatacctgcagaagcgaccatatcgtagtacagaaggtgacagccacagccaacctgggccgggtaccctgcggtacatccgatgagtacaggtttgctggcaggactcttacaggagggagcctcgtgcttctgacgctcgatgccagacctgccggggctgctcagctcaccgtcaattccgagaaaatggtcatcggaaccatgctggtgaaggacgtgatacaggccctgacacagtag

SEQ ID NO: 40202 - DNA, 3153 bp, Artificial Sequence
  Description of Artificial Sequence: Synthetic coding sequence
atgagcgccgcccccgcctacagcgaggacaagggcggcagcgccggacctggggaaccagagtacgggcacgatccagcctctggcggaattttttcatcagattacaagcgccatgacgatctgaaagagatgctggacaccaataaggattctcttaagctggaggcgatgaaaagaattgtggcaatgatcgctcggggaaaaaacgcatcagatctttttcctgcagttgtaaaaaacgtggcttgcaagaatattgaagatcccaatcagctcattcgcgcttccgccctgcgagtcttgagttccattcgagtacccattatagtgcccatcatgatgctggctattaaggaagccgcgagtgatatgagcccttacgtgaggaagacggctgcccacgccatcccaaagctgtattctctagactccgatcagaaagaccaactcattgaagtaatagagaagctactggccgataaaactacactggtggccggttctgtggtcatggccttcgaggaagtgtgccctgagaggatcgacctgatccataagaactacaggaagctgtgcaacctgttgatcgatgtcgaagaatggggccaggttgttatcatcagcatgctgaccagatacgcccgtactcaattcttgagccccacccaaaatgagtcactcttagaagaaaatgctgaaaaggctttttacgggtccgaagaggacgaagctaagggtgctggaagtgaggaaactgctgcggcggcggctccctcccggaaaccctatgtaatggaccccgaccacaggctgcttctgcgcaatactaagccattgcttcagtcccggtctgctgctgtcgtcatggctgttgcacagctctacttccacctagctccaaaggccgaggtgggggttatcgcaaaggctctggtccggctcctccgatcgcactcagaagttcagtacgtggtgctgcagaatgtagccaccatgtcaatcaagcggcgagggatgttcgaaccctatctgaagagtttctatattcggtccaccgaccccactcagatcaagatcctcaagttggaggttctgactaatcttgcaaatgagaccaatattcccaccgttttgagagaatttcagacatacattcgaagcatggacaaagacttcgtggctgctacaatccaggctatcggacggtgcgccactaacattgggagggtccgagacacttgcctcaatggtctggtgcaactactctccaatagggacgagctggtggtggctgagagcgtggttgtcatcaagaaacttctccagatgcaacccgctcagcacggagaaatcattaagcacctggccaaactgacagacaatatccaggtccccatggccagagcttccatcctatggttgattggcgagtattgcgagcatgtgcctaggattgcaccagatgtgctccgcaaaatggccaagtcatttaccgccgaggaagacattgtgaagcttcaggttattaatctggccgccaaactttacctaaccaatagcaagcagaccaagctcctcacacagtacgtgctctcgctggcgaaatatgaccagaactacgacataagagacagggcccgcttcacgaggcagcttatcgttccttcagagcaaggaggagccctgagcagacatgcgaaaaagttgtttcttgcgccgaagcctgctccagtactcgagtcatcgttcaaagatcgagatcactttcagctggggtcgttatcgcatctcctcaatgccaaagccacaggctatcaagaactgcctgattggcccgaggaagcccccgaccccagtgtgcggaacgtggaagtgccggaatggacgaagtgctcaaaccgggaaaagcgcaaggagaaggaaaagccattttattctgacagcgagggtgagtcaggccctacagaaagcgcagactccgatcctgaaagtgaatccgagtccgatagcaaatcatcctctgagagcggttctggggagtctagctctgagtccgataatgaagaccaggacgaagatgaagagaaaggccgcggctcggaaagcgaacaatcagaagaggacgggaagagaaagacaaagaagaaggtgccggaacgtaaaggagaggccagttctagcgatgaagggtctgactcctcttcgtccagcagtgaatccgaaatgacaagcgaatctgaggaggagcaactggagcccgcatcttggtcaaggaaaacccccccatcttcaaagtcagccccagccaccaaggagatctctctgctcgacctggaagactttaccccaccctccgtgcaacccgtctcaccaccggcaattgtcagcacttcactggcagctgatctggaagggctgacgctcaccgactcaacgctcgtcccatcccttcttagccctgtgtctggcgtcggtcgtcaggaactgctgcacagagtcgcgggggagggcttggccgttgactacacattcagccgtcagcccttttccggagatccccatatggtgagcgtgcacatccatttttctaattcctctgacactcctataaaaggcctacatgttggtacccctaaattaccagcaggcattagcatccaggagtttcctgaaattgagagtctggcccccggggaatctgccacggccgtgatggggatcaatttttgcgactctactcaggctgccaatttccaactctgtactcagaccaggcagttctacgtctcaatccagccacccgttggagagcttatggcccctgtgttcatgtcggagaacgaattcaaaaaggaacagggaaaacttatgggaatgaacgagattaccgaaaaacttatgctgccggacacgtgtcgctctgatcatattgtggtacagaaagttaccgccacagcaaacctgggtcgggtgccatgcggcacgtccgatgagtatagatttgccggaagaacattaactggtggaagcctggtgcttctcactctggatgctcgaccagccggggctgctcagctaacggtcaattctgagaagatggtgatagggactatgttggtgaaggatgtcatccaggcgctaacacaatag

SEQ ID NO: 40203 - DNA, 3306 bp, Artificial Sequence
  Description of Artificial Sequence: Synthetic coding sequence
atgagcgccgcccccgcctacagcgaggacaagggcggcagcgccggacccggtgaacctgaatacggccatgaccctgcttccgggggaatcttttcctccgattacaaacgtcacgatgatctcaaagagatgctagacactaacaaggactctctgaagctcgaagcaatgaaaaggatagtcgccatgatagcccgaggaaaaaacgcctctgacttatttccggcagtggtcaagaatgtcgcctgtaagaacattgaggtcaaaaaactggtctatgtttacctagtccggtacgctgaggaacagcaagacttggcccttctgagcatttctacctttcagcgcggcctgaaagaccccaaccaattgatcagagcctcagccctgagagttctgtctagcatcagagtgcccatcattgtgccaattatgatgctggccattaaggaggctgcgagtgatatgtccccatatgtgcgaaagaccgcagctcatgccattccaaagctttactctcttgactctgaccaaaaagaccaactgatcgaagttatcgagaagttattagcggataaaactacactcgtcgccgggtctgtggtaatggctttcgaggaggtttgccccgagcgaatcgatctgatacataaaaattatagaaagttatgcaacttgctgattgacgtcgaagagtggggacaggttgttatcatttctatgctcaccaggtacgctcgcacacagttcctgagtccaacccagaacgagtccctgctcgaggagaacgccgagaaagccttttacggctctgaggaggacgaagcaaaaggcgccggcagcgaggagaccgccgccgctgcggccccatctagaaaaccatacgtgatggacccagaccatcgactactcctgcggaacacaaaacccttgctgcagagcagatccgccgccgtggtgatggccgtcgcacaactatactttcacctagctcctaaggcagaagtcggcgtcatcgccaaagccctcgtaagactgctgaggtctcatagcgaagttcaatatgtggtgctccagaatgtggcaaccatgagcataaagagaagagggatgttcgagccttacttgaaaagcttctacattagatccacagatcccacgcagatcaaaatcctgaaattggaagtgttgactaacctggccaacgaaactaatatccctacagttctcagggaattccagacctacatacgttctatggataaggactttgtcgcagcaaccattcaggctattggaaggtgtgcaaccaatatcggccgggtgagagacacatgcctgaacggcctggtgcagctgctgagcaatcgcgatgagttggtcgttgcggagagcgttgtcgtcatcaagaaattattgcagatgcaaccggcccaacatggtgaaataatcaagcacctcgcaaagctgactgacaatatccaggtcccaatggcgcgcgcctctatcctttggttgatcggagaatactgcgagcacgtgcccaggatagcaccagacgtcttgcgcaaaatggctaagtcttttaccgcagaagaggacatcgtaaagctacaagtgataaacctggccgccaagctgtatctcactaatagtaaacagacaaagctcctcactcaatatgtactttcattggccaagtatgatcagaactacgatattcgggacagagccaggtttacacgtcagctgattgtgcctagtgagcagggtggcgcgctgagtcgacacgcgaagaagctcttccttgccccaaagccagcccctgtgcttgaatcatcttttaaagaccgcgatcatttccagcttgggagcctgtctcacctacttaatgctaaggctactggctatcaagaactgcctgattggccagaggaagcaccggacccaagcgtgcggaacgtggaagaggaggacctgtctctgatcgaaacccatgttggattgctgggagagtatactgaggtgcccgagtggaccaagtgttctaaccgcgagaagagaaaagaaaaggagaaaccattttactcagacagcgaaggggaaagtggcccaacagaatccgctgacagcgatcccgaatcagagagtgaatccgacagcaaatcctcctcagaatcgggcagcggcgaatcctcatccgagtcagataatgaggatcaggatgaagatgaggagaagggtcggggttcagaaagtgaacaatcagaagaagacgggaaaaggaaaactaaaaagaaagttcccgagcggaaaggtgaggcctcaagctctgatgaaggatcagactcgtcttctagctcttccgagtcagaaatgacctcggaaagtgaggaagagcagctggagcccgcgagctggtccagaaaaactccgccctcctcaaaaagtgcgccagctacaaaagagatctcccttctggacctagaagatttcacccctccaagcgtgcagcccgttagtccacctgcaattgtttccaccagtctggcagctgacctagaagggctgaccctgaccgactccacactcgtacctagcctgttatcaccagttagcggtgtcggaaggcaggaactgctccaccgagtagctggggaaggcctggctgttgactacacgttctccaggcaaccttttagcggtgatccccatatggtgtccgtacacatacacttctcaaacagtagcgatacgccaataaagggcctgcatgtcgggacaccgaagttacccgccgggatcagtattcaagagttccctgagatcgagagcctcgcgcccggagagagcgccacggctgttatgggcatcaacttctgcgactccacacaggccgctaactttcagctgtgcacccagacccggcagttctacgttagcatccaacccccagtgggggagttaatggcaccagtttttatgagcgaaaacgaatttaagaaagagcagggtaagcttatgggcatgaatgaaatcaccgaaaagctcatgttacccgacacgtgtaggtctgatcacattgtggttcagaaggtgacagcaaccgctaatctaggccgcgtcccctgtggcaccagtgatgagtacagatttgccggccggaccttgaccggtggtagcttggtgctgctgacactcgatgcccgccccgcaggtgctgctcagctgactgtgaactcagagaagatggtgataggcacaatgctggtgaaggatgtgattcaggccctcacacagtag

SEQ ID NO: 40204 - DNA, 3066 bp, Artificial Sequence
  Description of Artificial Sequence: Synthetic coding sequence
atggccctgaagatggtgaagggcagcatcgaccggatgttcgacaaaaacctccaggacttggtgagaggtatacgtaaccataaagaagatgaggcgaaatatatttcccagtgtattgatgagatcaaacaggaactgaagcaggataacattgcagtcaaagctaatgctgtgtgcaagctgacctatctacaaatgctcggctatgatattagctgggctgcctttaatatcatagaagtgatgtcggcctccaagtttacgtttaaaagaatcggctatcttgccgcctcacaatctttccatgagggcaccgacgttataatgctcaccactaaccaaatccgcaaggatctgtcttccccaagtcaatacgataccggcgtcgcactcaccggactcagttgcttcgtaacgccagacctcgcccgtgacctcgcaaatgatatcatgaccctcatgtcccacacaaagccgtatattcgaaaaaaagctgtactgatcatgtataaggtattcttgaagtacccagaatctctgagaccagccttcccaaggttaaaggagaagctggaggaccccgaccccggcgtccaaagcgccgcagttaatgtgatttgcgaactagcacgacgcaacccaaagaactacctgtcgctcgcaccgcttttttttaagctgatgacttctagcacaaacaattgggttcttatcaaaatcatcaagctctttggcgccctcacaccactcgaaccacgcttgggtaagaaactcatcgagccgttgacaaacctcattcacagcacctccgctatgtccctcttgtatgagtgcgtcaacactgtcattgctgtactgatatccctgtcttccggtatgccaaaccactctgcttcaatccaactatgtgtgcagaagctgcgcatcctaatcgaggattcagatcagaacctgaaatacctggggttattggcaatgtccaagatcctgaagacacatccaaaaagcgtgcaatcccataaggacctcattctgcagtgccttgatgataaggatgaaagcattcggctgcgcgctctcgacctgctttacggtatggtgagcaagaaaaacctaatggagatcgtcaagaagctgatgacccatgtagataaggctgagggaactacttatcgcgatgaactgctcacgaaaatcatcgacatttgtagtcaatccaactaccagtacatcaccaactttgagtggtacatctctatcctggtggagttaacccggcttgaaggaacccgacacggtcacctgatcgctgcccagatgctggacgtagcaatccgagtgaaggcaatacggaagttcgcggtttctcaaatgtctgcccttctggattctgcccatctgctggcttcctcaacgcagcgcaatgggatatgtgaagtactttatgcagcagcctggatctgcggcgagttttccgaacatcttcaggagcctcaccatacactcgaggcgatgctgcgtccccgtgtgacgacgcttccaggtcatatccaagcagtgtatgttcagaatgtggtgaaattgtatgcgagtatcctacaacagaaagagcaggcgggcgaggccgagggggcccaggcagtaacccagctcatggtggatcggctcccccaattcgtccagagcgccgaccttgaggtccaggagagagctagctgtatacttcagcttgtgaagcacatacaaaagctgcaggctaaggacgtgcccgtggccgaggaagtcagtgccctattcgcgggggaactgaaccctgttgcgccaaaggcacagaagaaagtgcccgtaccagaggggctggaccttgacgcctggattaatgaaccgctgagtgacagcgaatctgaggatgaacgaccacgagctgtattccacgaagaggagcaacgcagacctaaacatcgcccctccgaggctgacgaggaagagcttgcacgccggcgcgaggctaggaaacaagaacaagctaacaatccattctacatcaaaagcagtccaagcccacagaaacgatatcaagatacgcctggcgtggagcatattccagtggtgcagatcgacttatctgtcccgcttaaggtgcccgggctgcccatgtccgaccagtacgtcaaacttgaggaggaacggcgacacagacagaagctggaaaaagacaagagaaggaagaaacgcaaagaaaaggaggaaaggaccaaagggaaaaagaagagcaagaaacaacccccagggtccgaggaggcagctggcgagccagtgcagaatggcgcaccagaggaggaacagctgcctcctgagtcctcctacagcttgctcgccgaaaatagctacgttaagatgacatgtgatatccgtggatccctgcaggaagattctcaagtgacggtggccattgtgctcgaaaatcgaagttccagcatcttaaaaggcatggagttgtccgtgctcgacagcctgaatgcccgcatggctcggccacaggggagtagtgtccacgacggggtgcctgttccgtttcaactgcctccaggggtctccaatgaggcgcaatacgtgttcaccatccagagcatcgtgatggcacagaaattgaagggtactctgagcttcatcgcgaagaacgacgagggagccacccatgagaagcttgactttcggctgcacttctcttgctcttcctatctgataactaccccctgttattctgatgcctttgccaagctcctcgaatctggcgatctgagtatgagttcaatcaaagttgacggcattcgcatgtcctttcaaaatctgctggccaagatctgctttcaccaccacttctccgtagtggagagggtggatagctgtgcttcaatgtatagtcgcagtatccaggggcaccatgtttgtcttctagtgaagaagggagaaaattctgtgagcgtggatgggaaatgcagtgatagcaccttactgtcaaatctgctggaggagatgaaagcgacgctggcaaagtgctag

SEQ ID NO: 40205 - DNA, 3462 bp, Artificial Sequence
  Description of Artificial Sequence: Synthetic coding sequence
atggccctgaagatggtgaagggcagcatcgaccggatgttcgacaagaacttacaggacttggtccgaggaattcggaatcacaaggaagatgaggccaagtatatctcacagtgcatagacgagatcaagcaggagcttaaacaagacaacattgccgttaaagccaatgcggtgtgcaaactgacctatctgcaaatgctggggtatgacatttcctgggcggcctttaatatcatagaagtgatgtctgccagtaagttcacattcaaacgtattggctatttggctgcatctcaatccttccacgaaggaaccgatgtgatcatgcttacaacaaatcagatacggaaggacctctccagcccaagtcagtatgacacaggggtcgctctaactgggctttcctgctttgtgactcccgacctggcaagggatctcgctaatgacataatgactttgatgagtcatactaaaccttatatacgcaagaaagcggtgctcataatgtataaggtgttcctgaagtaccccgagtcacttagaccagcattccccagactgaaggaaaagctcgaagaccccgacccaggcgtgcagagcgcagcagtcaacgtgatctgcgagttagctcggaggaatcccaagaattacctctccctggcccctcttttcttcaagctgatgacttcctctactaataattgggttctgatcaagatcattaagttgttcggagctttgacacctttagagccacgtttaggcaagaagcttatcgaaccgctgacaaacctcatccactcaacaagcgccatgtccctgctgtatgaatgcgtaaacacagtgatcgctgttctgatctccctgtcctccgggatgcctaaccattcagccagtatccagctgtgcgtgcagaagcttcgaatactgattgaggactcagatcagaatctgaaatacctggggttgttggctatgtctaaaatcctaaaaacccatcccaaaagcgtacaaagccacaaggacttgatactccagtgccttgatgacaaggacgagtcaatccggcttagggccttagatctcctgtacggcatggtgtccaagaaaaatctcatggaaatcgtgaagaagttaatgacacacgtcgataaagctgaggggacgacttaccgtgacgagctgctcactaagataattgatatatgctcccagagtaactatcagtatattacaaatttcgagtggtacatctccatcctcgtggaactgactagactggaaggcacgcgacatggtcatcttatagctgcccagatgctcgacgtggccattcgcgtgaaggcgatcagaaagtttgccgtgtcccagatgtctgccctgttggattctgcccaccttctcgcttcttcaacccagagaaacgggatctgcgaggttctatatgctgctgcatggatatgcggcgagttctcagaacatctgcaagagccacaccatactctggaggctatgctccggccgagagtcactacactgcctggccatatacaggcagtctatgtgcagaatgtcgtaaagctgtatgcctccatcttacagcagaaggagcaggcgggtgaagcagagggagcccaggctgttacccagctgatggtagaccggctcccacagttcgtgcagtccgctgacttggaagtccaagagcgggcgagctgcattctgcagctggtgaagcatattcagaagctgcaggccaaagatgtccctgtcgccgaagaagtgtcagcgctcttcgcaggcgagctgaatccagtggcacccaaagctcagaagaaggtgccagtgcccgagggtttagatctcgacgcttggattaacgaaccactttcagatagcgagagcgaggatgagaggccacgcgcagtgttccacgaagaggaacagaggaggccgaagcatagaccatctgaggccgacgaagaggagctggcgaggcgtagggaagcccgtaagcaagagcaagcgaacaaccctttctacataaagtcttcgcccagccctcagaagcgttatcaagacacacctggggtggagcacattccagtcgtccagatagatctatccgtacccttaaaagtgccaggacttcctatgtccgaccagtacgttaagttagaggaggaacgtcgacatcgccagaaactggagaaggataaacggcgcaagaaaaggaaagagaaggaaaagaagggcaagcggagacattctagtctgccaacagagtccgatgaggacatcgctcctgcccagcaggttgatatcgtgaccgaggagatgccggagaacgccttgccttccgacgaggacgataaggaccccaatgatccatatagagcactagacatcgatctcgacaaaccgcttgcggactcagagaagctgccaattcaaaagcatcgcaatactgaaacatccaagtctcctgagaaagacgtgcccatggtagagaagaaatcaaagaagcccaagaaaaaggaaaagaaacataaagagaaggaaagggataaagaaaagaagaaagagaaagagaagaagaaatccccaaagcccaagaagaaaaaacaccgtaaagagaaggaagaacgtacaaagggtaagaagaagtcgaagaaacagccaccaggctccgaagaagcagctggcgaacccgtgcaaaacggagcccccgaagaagagcagctacctcctgagtctagttatagcctcctggcggagaacagctatgtcaagatgacttgcgacatccgtgggagccttcaggaggattcacaagtaactgtagctatcgttctcgagaaccgatcaagctctatcctgaagggcatggagctgagtgtgttggatagtctcaatgctaggatggctaggccacagggatccagcgtccacgatggtgttcccgtgccttttcagttaccacctggggtgtctaacgaggcacagtacgttttcaccatacagtccattgtgatggctcaaaagttgaagggtacactgagcttcattgccaagaacgacgagggggccacgcatgaaaaactggactttcggctccacttctcttgctcatcttacctcataacaaccccctgctattccgacgccttcgctaagttattagaatccggtgacctctctatgagtagcattaaagtggatgggattcgaatgtcttttcaaaacctgctggccaagatctgtttccaccatcatttctcagttgtggagcgagtcgacagctgtgcatcgatgtattcacggtcaattcagggccaccatgtgtgcttacttgtaaagaaaggagaaaactccgtgagcgtcgatggtaaatgttccgatagcactctcttgtccaatctcctggaggaaatgaaggccaccctggcaaagtgttag

SEQ ID NO: 40206 - DNA, 2955 bp, Artificial Sequence
  Description of Artificial Sequence: Synthetic coding sequence
atggccctgaagatggtgaagggcagcatcgaccggatgttcgacaagaatctacaggacttggttcgcgggatacgaaaccataaggaggatgaagctaaatacattagtcaatgtatcgacgagataaaacaggagctgaagcaggacaatatcgccgtcaaagcaaacgccgtgtgcaaactcacctacctgcaaatgctagggtacgatatcagttgggccgcctttaacattatcgaggtgatgtccgcatcaaaatttacatttaaaaggatagggtatcttgctgcatcacagtccttccatgaaggtacagacgtgatcatgcttacaacaaatcagattctcctgatcagcttaagctccggcatgccgaaccacagcgccagtattcagctctgcgtgcagaagctccgaattttaatcgaggacagcgatcagaacctgaagtatctcggcttactcgcgatgagcaagatcttgaaaacacatccaaaatcagtccaatcccacaaagatttaatcctgcagtgtttagatgacaaggacgagtctattcgccttagggccctggatttattatatgggatggtgagcaaaaagaacctgatggagatcgtcaaaaaactgatgactcatgtcgacaaggcagagggtaccacatatagagacgagcttcttaccaagataattgacatctgctctcaatccaactaccagtatattacaaactttgaatggtatatcagcattctcgtcgaattaacgagactcgaggggactcggcacgggcaccttattgccgcacagatgttggatgttgccatcagggtgaaggctatccggaaattcgctgtttcacaaatgtctgcactgctagatagcgctcatcttctggcttccagtacacagcgcaatggcatttgcgaggtgctttacgccgccgcctggatctgtggggagttcagcgagcaccttcaggagccacaccacaccttagaagcaatgctcaggcctcgagtgacaaccttgcccggccacatccaggccgtatacgtccaaaacgtggtgaaactgtatgcatctatccttcagcagaaagagcaggccggcgaggccgaaggggcccaagcagtgacacagctgatggttgatcggctccctcagtttgtgcaatctgccgatctggaagtgcaagaaagagcatcgtgcatcttacaacttgtgaagcacattcaaaaactgcaagcgaaagatgttcccgtagctgaggaagtgtccgccctgtttgctggcgagcttaatccagttgcccccaaagcacagaagaaggtccccgtaccggagggtttagacctggacgcgtggattaatgagcctttaagcgacagcgagtctgaggacgagcggcctcgggcagtgtttcacgaagaggagcagcgccgcccgaagcaccggcccagcgaggctgacgaggaagaattggctcggcgtcgtgaagccagaaagcaagaacaggctaataatcctttctatatcaaatccagccctagtccacaaaagcggtatcaggatactccgggcgtggaacatattccagtcgttcagatcgacctgagtgtgccattaaaggtgcccggcctcccaatgagcgatcagtacgtaaagttagaagaagaacgacgtcacagacagaagttggaaaaagacaaacgtaggaaaaagcgaaaggagaaagagaagaagggcaaacggagacatagctcccttcccacagagtccgacgaggacatcgccccagctcagcaggttgatatcgttaccgaggagatgcccgagaacgctctgccctccgacgaggacgataaggatcctaatgacccataccgggccctcgatatcgatctggataaaccactcgccgacagtgaaaagcttcccatccaaaaacatcggaataccgagacgtcaaagtctcctgaaaaggacgtgcctatggttgagaaaaaaagcaaaaaaccaaaaaaaaaggaaaaaaagcacaaggagaaggaacgggacaaagagaagaagaaagaaaaagaaaagaaaaaatcccccaaaccaaaaaaaaaaaagcacagaaaggagaaggaagagcgaactaaaggaaagaagaagtccaaaaaacagccccccgggagcgaggaagcagccggtgagcctgttcaaaacggcgctcctgaggaagagcagttaccccctgaaagttcctatagcctgctcgccgagaacagttacgttaagatgacctgtgatattagggggagcctgcaggaggattctcaagtcactgtggccattgtgctcgagaatcgaagtagcagcatattaaaaggtatggagttatcagtgcttgactccctcaacgctaggatggctagaccgcaggggagctcagtgcatgatggcgtacccgtgccctttcaacttccccccggtgtgtccaatgaagctcaatacgtattcacaatacagagtatagtgatggctcaaaaactgaaagggaccttaagcttcatcgcgaagaatgacgagggggctacccacgaaaaactcgatttcagactgcatttttcttgtagcagttatctcatcactaccccgtgttactctgacgcctttgcgaaacttctcgagtccggagatctgtcaatgtctagtattaaagtcgatggaattcgaatgagctttcagaacctgttagcaaagatctgcttccatcatcacttttccgttgtggaacgagttgactcgtgcgcaagcatgtattcccgtagcatacagggacaccatgtgtgcctgttagtgaaaaaaggtgaaaatagcgtgtccgtggatggcaagtgcagtgactctactctcttgagtaacctattggaggaaatgaaggcgacgttggcaaaatgctag

SEQ ID NO: 40207 - DNA, 3648 bp, Artificial Sequence
  Description of Artificial Sequence: Synthetic coding sequence
atggccctgaagatggtgaagggcagcatcgaccggatgttcgacaagaacctacaggacctagtcaggggtattcgaaaccacaaggaggacgaggctaagtacatatcccaatgcatagacgaaatcaagcaggaattaaaacaggacaatatcgccgtgaaggcaaatgccgtgtgtaagctcacctacctgcaaatgctggggtatgatatcagctgggcggctttcaatattatcgaggttatgagcgcttccaagttcacattcaagcgaatcggatacctagccgccagccagagtttccacgaaggcaccgatgtgatcatgcttaccacgaatcagattcgaaaggacttatcttctccaagccaatatgataccggagtcgcactgaccggcctcagttgcttcgtgacacctgatctggcacgcgacctcgcaaatgatatcatgacactgatgagccatacgaaaccttacatcagaaaaaaagccgtgctgatcatgtacaaagtgtttctcaaatatccagaatcactgcgcccggcctttcctcgtctcaaggaaaagcttgaggacccagaccccggcgtgcagtctgctgctgtcaatgttatctgcgagctggcaaggcgcaatccaaagaactatctctctctggccccactgtttttcaaactgatgacctcaagtactaacaattgggtgttaataaagatcatcaagctgtttggcgccctcacaccattggaaccacgtctggggaagaagctgattgagcccttaaccaacctgatacactcaacaagtgccatgagcttgctgtatgagtgtgtgaacacagtcattgccgtgctgatctctctgagctccggtatgcccaaccactctgcgtccatacagctttgtgtgcaaaagctgaggattctgatcgaagattcagaccagaatctcaaatatttagggctattggcaatgtctaagatcctgaagacccatcctaagagtgtgcaatcacacaaagatcttatcctacagtgcctggacgataaggacgaatctataagattgagggccctggacctcctgtacggaatggtgagtaagaagaatcttatggaaattgtgaagaaactcatgactcacgtagacaaggccgaaggcacaacctaccgtgatgaactcttgacaaaaatcattgacatttgttcacagagcaattaccagtacatcacaaacttcgagtggtatattagtatcctcgtggaactgacccggctagagggaacaagacacgggcatcttatcgctgcgcagatgctcgacgttgccatcagagtgaaagccataaggaagttcgccgttagtcagatgagcgctcttctggatagtgctcatttgctggcgtcttccacacagagaaacggcatttgtgaggtgctgtacgcagctgcctggatttgtggggaattcagtgaacatctgcaggagccgcatcacaccctggaagcaatgcttcgaccacgggtcactactctgcctggacatattcaggccgtgtacgtccagaacgtcgtcaagctctatgcatctatcctgcagcagaaggagcaggctggcgaggctgaaggagcccaggccgtcactcagctgatggtagacagactgcctcaatttgtgcagtccgcggatcttgaagtgcaggagcgcgcttcatgcattctacagcttgtgaagcatatacaaaagttgcaagctaaagatgtaccagtcgctgaggaggtaagtgcattgttcgccggggaattgaatcccgttgcaccaaaagcacagaagaaggtacctgtgccggagggcttagacttggatgcgtggattaatgaaccgctgagcgacagtgagtctgaagatgagcgccctagagcagtttttcacgaagaggagcaacgtagaccaaaacatcgtcccagcgaagctgacgaggaagagttggcacgcagacgcgaagcaaggaagcaagaacaggctaacaacccattctatatcaagtcttcgccttctccacagaagagatatcaggacacacccggggtggagcacattcccgtagtccagattgacttatccgtgcctttgaaggtgccggggctcccaatgtctgatcaatatgtaaagctggaggaggagcgccgtcaccggcaaaagctggagaaggataagcgcagaaagaaacgtaaagaaaaggagaagaaaggaaagcgcaggcacagttccctgcctacagaatccgatgaggacatcgcccccgcccagcaagtggacatagtaaccgaggaaatgcccgaaaacgcccttccttccgacgaggacgataaagatcccaacgacccctatcgtgctctcgatatagacctggataaaccattagctgactcagagaagttaccgatacagaaacatagaaataccgaaaccagtaaaagccctgaaaaggatgtccccatggtagagaaaaagtctaagaaacccaaaaaaaaggagaaaaagcataaagagaaggagagggacaaagagaaaaaaaaggagaaggaaaagaaggcagaagacctggatttttggctgtctacaacaccgcccccagcgcctgcccctgcgccagccccagtcccaagcacgggcgagctgagcgttaatacggtgacaacccccaaggacgaatgcgaagacgccaaaacggaggctcaaggtgaagaagacgatgcagagggccaggaccaagacaaaaaaagcccgaaacccaaaaagaaaaaacatcgtaaggagaaagaagagagaaccaaagggaaaaagaagtcgaaaaaacagccccccggatcggaggaagcagcaggcgaacccgtccagaacggtgcccccgaggaggagcaactcccccccgagagttcctatagcttgttggcagaaaattcgtacgtgaagatgacctgcgacatacgcggatcactccaggaggattcccaggtcaccgtcgccattgtgctcgaaaatcggtcaagctcaatccttaagggcatggagctgtctgtcctggatagcctcaacgcgagaatggcccgaccacaaggcagttccgtgcacgacggagttcccgtgcccttccagttaccccccggagtcagcaatgaggcacagtacgtttttacgatccagtccatagtgatggcacagaagctgaaggggaccttgagctttatcgctaagaacgatgagggagccacccacgagaagttagactttcgcctccatttttcttgcagttcttatctcataaccaccccgtgttattcagacgctttcgccaaactattggaatccggcgatctgtcgatgtcttcaatcaaggtagatggcataagaatgagcttccagaacctgttggccaagatctgctttcaccaccacttctctgtggttgaaagagtggactcttgcgcctcaatgtattcccggtctatccaaggccatcacgtgtgtctgttagtgaagaagggagaaaattccgtgtccgtcgatggcaagtgttccgattcaacgctgttgtccaacctcttggaagagatgaaggccacattagcaaaatgctag

SEQ ID NO: 40208 - DNA, 3339 bp, Artificial Sequence
  Description of Artificial Sequence: Synthetic coding sequence
atggccctgaagatggtgaagggcagcatcgaccggatgttcgacaagaacttgcaagacctggtccgcgggattcgaaaccacaaagaggatgaggccaaatatatatctcagtgtatcgatgagataaaacaggaactgaaacaggataatatcgccgttaaggccaatgccgtgtgcaagctgacctacctgcagatgctcggctacgacatctcatgggctgccttcaatattatcgaagtaatgagtgcttcaaagttcacctttaaacgaatcggttatctagccgcctcgcagtctttccacgagggcacagatgtaattatgctgactactaatcagataagaaaagatctgtcctctccttcacaatatgataccggcgttgcgttgaccggcctaagctgtttcgtcactcctgatctagcacgggacctcgccaatgacattatgactcttatgagccatacaaagccatacattaggaagaaggccaaactgatcgaacctctgactaacctgattcattccacatctgctatgagcctgctgtatgagtgcgtgaatacagtcattgctgtgttaatcagtctgagcagcggcatgccaaatcactcagcgagcattcagctgtgtgtgcagaaactacgcatcctgatcgaagactctgaccaaaacctcaaatacctgggcttactggctatgtctaagatcctgaagacccacccaaaatctgtgcagagtcataaagacctgattttacagtgccttgatgataaagacgagagtatccggctgagagctctcgacctgctttacggaatggtgagcaaaaagaatctgatggagatagtgaagaagctaatgactcacgtcgacaaagcagaggggaccacataccgagacgaactgctgacgaaaattatcgacatttgcagccagtccaactatcaatacataacaaattttgagtggtacatctctatccttgtggagctgactcgacttgaggggacgaggcatggacacctgattgcagcgcaaatgctggacgtcgcaattagggttaaagctatccggaaattcgcagtctcacagatgtcagcccttctggattcagcgcatcttcttgcctcttctactcagaggaacggaatatgcgaggttctttatgccgcagcgtggatttgcggtgaattttccgagcaccttcaagagccccatcacaccctcgaggccatgctccgacccagggtgacaaccctcccaggccatattcaggctgtctacgtgcagaatgtagtgaagctgtacgcctctattctccagcaaaaagagcaggccggcgaagccgagggcgcacaggcagtcacccaattgatggtggaccgactgccacaatttgttcagagcgccgacctggaagtgcaagagagggcctcatgcatccttcagctggtgaagcatatacagaagcttcaagcaaaagatgtgcctgtggccgaagaagttagtgcactcttcgctggagaacttaacccagtggccccgaaagcccagaaaaaggtgcctgtgccagaagggcttgacctggatgcctggattaatgagccgctgagcgatagcgaatccgaggacgaacgcccaagggctgtgttccacgaggaggagcagaggcgaccaaagcataggccaagcgaagctgatgaggaggagttagccagaaggagggaggctcgaaaacaggaacaggctaacaacccgttttacatcaaatcctccccttctccacagaaacggtaccaggatacccctggtgtagaacatatccctgtggttcagatcgacctctcagttcctctcaaagtacctggccttccaatgagcgatcaatatgtgaagctcgaggaggaaagaaggcaccggcagaagctggagaaggataaacggcggaagaaaagaaaagagaaagaaaaaaaggggaagcgaaggcacagcagcctgcctacggagtctgatgaagacattgccccggctcagcaggttgatatcgtcactgaagagatgcccgaaaatgctctcccaagcgacgaggacgacaaggatccgaacgatccctacagagctctagatatcgatctggataagccgctggcagattctgaaaagctgcccattcaaaagcatagaaatactgaaacctcaaagtcgcccgagaaggatgtccctatggttgagaaaaagtccaagaaaccaaaaaaaaaagaaaagaagcataaggaaaaggagcgggataaggagaagaagaaggagaaggaaaagaaggccgaggatctagacttttggctgagcacgactccacccccagccccagcccctgctccagcccccgtgcctagcaccgacgaatgtgaagatgcaaagactgaggcccagggtgaagaagatgatgctgaaggccaggaccaagacaaaaaatcacccaagccaaagaaaaaaaagcaccgcaaggagaaggaagagcggaccaaggggaagaagaaatctaaaaagcagcccccagggagtgaagaagctgccggggagccagtccaaaacggtgctcctgaggaagagcagctaccaccagagtcatcatactctttgctcgccgagaactcatacgtgaagatgacctgtgacattcggggttctcttcaagaggactcccaggtaacggtggcaatcgttctagaaaataggagtagtagtatccttaagggtatggagctgagtgttctagattcactgaatgctagaatggcccgaccacagggtagttccgtacatgacggtgtgccagtcccattccaactccctccaggagtgtcaaacgaggcgcagtacgtcttcactattcagagtattgtcatggcacagaaattaaagggcacgctgtccttcatcgcaaagaatgacgagggcgctacgcatgagaagctcgattttaggctccactttagctgttccagctacctgattactactccttgctatagtgacgccttcgcgaaattactcgaaagcggggacttgtctatgtcgtctattaaagtcgacggcattcgaatgtcgtttcagaacctgctagcaaagatctgcttccaccaccactttagtgtggtagagcgggtagactcgtgtgcttccatgtattccagaagtatacaagggcaccatgtttgcctgcttgtgaaaaagggagaaaactcagtgtcagtggacggcaaatgttctgatagcaccctgctgtcaaatttactggaggaaatgaaggcaactctggccaaatgctag

SEQ ID NO: 40209 - DNA, 1257 bp, Artificial Sequence
  Description of Artificial Sequence: Synthetic coding sequence
atgatccacagcctgttcctgatcaactgcagcggcgacatcttcctggagaagcactggaaatctgtggtctctcagagcgtctgcgactatttcttcgaggcccaggaaaaagccgctgacgtggaaaatgtgcccccagtcatcagtacaccccatcactatctgatatcaatctacagagacaaactgttctttgtaagcgtcattcagaccgaggttccacctttgttcgtgatcgaattcctgcatcgcgtggcagatacctttcaggattacttcggagaatgcagcgaagccgccatcaaagacaatgtggtgattgtctatgagctgcttgaggaaatgttggacaatgggttccccctagccactgagtcaaacatcctgaaggagctgattaaaccacccacaatcttgcgttcagtggtgaattctatcactggcagctccaacgtcggtgataccctcccgacagggcagctttccaacataccctggaggagggcaggggttaagtacaccaacaatgaggcatatttcgatgtagtcgaggagattgacgccataatagataagtccggatcaacggtgttcgcagagattcaaggggtgatcgatgcttgcatcaagctgagcggcatgcccgatcttagcctgagcttcatgaatcctaggttgctggatgatgtgtcttttcatccctgcatacgattcaaaaggtgggagtcagagagggtcctcagtttcatccccccggacggaaacttccgccttattagttatagggtgagctcacagaacctggtggcaatccccgtgtatgtgaagcattccatttcatttaaggaaaacagttcctgtggaagattcgacatcacaattggccccaaacagaacatggggaaaacgattgagggcataacagttaccgtccatatgcccaaggttgttctgaatatgaatctgacacctacacagggttcttacacctttgatccagttacaaaggtattgacttgggacgtgggcaaaatcacccctcagaagctgccctccttgaaggggcttgtgaatctacagagcggcgccccaaaacctgaggagaacccgtctctgaacatccagtttaaaatccagcagttggccatctcaggtttgaaagtaaatcgcctggacatgtacggcgagaaatacaagccattcaagggtgtgaagtatgtcacaaaggccggaaagttccaggtacggacatag

SEQ ID NO: 40210 - DNA, 1257 bp, Artificial Sequence
  Description of Artificial Sequence: Synthetic coding sequence
atgatccacagcctgttcctgatcaactgcagcggcgacatcttcctggaaaaacactggaaatccgtagtgtctcagagcgtgtgcgactactttttcgaagcccaagagaaggctgcggacgtggagaacgtcccacctgtcatcagcacaccacatcattacctgatttctatataccgtgataagctgttcttcgtatccgttatccagaccgaagttcctccactattcgtgatagaatttctgcaccgggtggcggatacttttcaagactacttcggcgagtgcagtgaggcagcaatcaaggacaatgtggttattgtttacgagctgctggaagagatgctggacaacggattcccactcgccacggaatccaatatcttgaaggaactcatcaagccgccaactatcctcagaagcgtcgttaactccatcacaggttcaagcaacgtgggagatacactgccaaccggtcagttaagcaatatcccatggcggagagccggagtgaaatatacaaataacgaagcatacttcgacgtcgtcgaagaaatcgacgccataatcgataagagcggtagcaccgtgttcgctgagatccagggcgtgattgacgcctgtattaagctgtctggtatgccagacctgagtttatcattcatgaatcctaggctcctagatgacgtaagttttcatccctgtatccgattcaagaggtgggaatccgagcgagttttgtcatttatcccgcctgacgggaattttcgactgatctcctatcgggtgtcatctcagaatttggtcgcaatccctgtctatgtgaagcactcaatttcatttaaagagaacagtagttgcggaagattcgacatcactatcggcccaaagcagaatatgggtaagaccattgagggaatcacagtaacagtccatatgcctaaggttgtcctgaacatgaatttgacgcccactcaaggcagctacacctttgacccagtgaccaaggtcctaacctgggatgtaggcaagattacgccccagaagctaccatcactgaaaggattggttaacctacagagcggggccccaaagccagaggagaatccctccctaaacatccagtttaagatacaacagctcgccatctccgggctgaaggtgaatcgccttgatatgtacggggagaaatacaagccattcaaaggagttaagtatgtgacaaaggccgggaaattccaggtgcgtacctag

SEQ ID NO: 40211 - DNA, 1257 bp, Artificial Sequence
  Description of Artificial Sequence: Synthetic coding sequence
atgatccacagcctgttcctgatcaacagcagcggcgacatcttcttggagaagcattggaaaagtgttgtgtccaggagtgtctgtgattacttctttgaagcccaggagcgtgccactgaggccgaaaatgtaccaccagtgatccctaccccccatcactacctcctttcagtttaccgccacaagattttttttgtggcggtgatccagacggaagtgcctccactgtttgtgatcgaatttctccatagggtcgtggacaccttccaggattatttcggcgtttgctcagaaccagtcattaaagacaatgtggtggtggtgtacgaggtgctggaagagatgttggacaatggcttccctctcgctacagaaagcaatattctcaaagaactgatcaagccccccaccattcttcgaacagtggtgaataccatcactggatccacgaacgtcggggaccagctacccactggacaactcagcgtggtaccctggcgccggactggtgtcaagtacactaacaacgaagcttacttcgatgtgatagaggagatagacgctattattgacaaatctggttctactattacagctgagattcagggcgtgatcgatgcctgtgtgaaactgactggtatgcccgacctcacattgtctttcatgaatcccaggttgctcgatgacgtgagttttcatccgtgcgtgcgcttcaagcggtgggagagcgaaaggattctttcatttatccctcctgatggtaacttcagactccttagctatcacgtgagcgcccagaacctggtggctattccagtttatgtgaagcacaatatcagtttcagagacagtagcagtctgggaagatttgagattactgtcggaccaaaacagaccatgggcaaaacaatagaaggcgtcactgtgactagccaaatgccaaagggcgtgcttaatatgagtctcacgccaagccagggcactcacacctttgatcctgtgaccaagatgctgagttgggatgtgggcaagattaacccccagaagctgcctagcctgaagggtactatgtcactccaagcaggcgccagcaaacctgatgagaaccccacaattaacctgcagttcaagattcagcaattagcgatctctggcctgaaagtgaataggctggacatgtatggtgagaagtacaagccctttaagggcatcaagtacatgaccaaggctggaaaatttcaggtgagaacttag

SEQ ID NO: 40212 - DNA, 1257 bp, Artificial Sequence
  Description of Artificial Sequence: Synthetic coding sequence
atgatccacagcctgttcctgatcaacagcagcggcgacatcttcctggagaagcattggaaatcagtggtctcccgctccgtgtgtgattactttttcgaagcacaggagcgtgccactgaagctgaaaatgtcccccctgtgattccaacaccacaccactacctcttgagtgtctaccggcacaaaatcttttttgtggccgtgattcagaccgaagtcccgcccctctttgtgattgaatttttacatcgagtcgttgatacctttcaggactactttggagtgtgcagtgaacctgtcataaaggacaatgttgtggtcgtgtatgaggtgttggaagagatgttagataacggctttcccctggcaacggaatccaatatcctgaaggaattgatcaaacctccaactatcctgcgtaccgttgtaaacaccataactggctcaactaacgtcggtgaccagctcccaactggacagctgtccgtcgtgccctggcgccggactggtgttaagtacactaacaatgaagcttacttcgacgtgattgaggaaatcgatgccatcattgataaaagtgggagtactattacagctgaaattcaaggagtcatcgacgcttgcgtgaagcttaccgggatgccagacttgacactgtcttttatgaatccccggctcctggatgacgttagcttccatccttgtgtgcgcttcaagcgatgggagtctgaaaggatcttatcattcattcccccagacgggaacttccgactgttgagctaccatgttagcgcccagaacctcgtggccatcccggtttacgtgaaacacaatattagcttcagggactcctcttccttggggcgcttcgagatcaccgtgggccccaaacagacaatgggaaagaccatagagggggtaacagtgacatcacaaatgcctaagggcgtactgaatatgagcttgaccccatcacagggtacacacaccttcgaccctgtgaccaagatgctaagctgggatgtaggaaagattaatccacagaagttaccctccctgaaaggaaccatgtccttacaggcaggtgcaagtaaacctgatgaaaatccaacaatcaacctgcagtttaaaattcaacaattagccatctctggcctcaaggtgaatcggcttgacatgtatggggaaaagtataagcctttcaaaggcattaagtatatgacgaaagccggcaagttccaggtgcggacatag

SEQ ID NO: 40213 - DNA, 33 bp, Artificial Sequence; identical to SEQ ID NO: 16249
  Description of Artificial Sequence: Synthetic coding sequence

SEQ ID NO: 40214 - DNA, 1257 bp, Artificial Sequence
  Description of Artificial Sequence: Synthetic coding sequence
atgatccacagcctgttcctgatcaacagcagcggcgacatcttcctagagaagcattggaagagcgtagttagcaggagcgtgtgcgattattttttcgaggcgcaggagagggctaccgaggcagaaaatgtacctcctgtcatacctacacctcaccactaccttctctctgtgtaccgacataagatcttctttgtggccgttatccagactgaggtaccccccctcttcgtgatcgagtttctgcatagggtcgtggacacattccaagactattttggtgtctgttccgaacctgtcatcaaagataacgttgtggtggtgtatgaagtgttggaagaaatgctcgacaacggatttccgctggcgacagaaagtaacattctcaaagaactgatcaagccgccaacgatcctgagaaccgtcgtcaataccatcacggggagcacaaatgttggcgatcagctcccgaccggtcagttatcagtcgtgccctggcgacgaacaggggtgaagtacacaaataacgaggcctattttgacgtcattgaggagatagacgccattattgataaatcaggcagcacaatcacagcggagattcagggggtcattgatgcttgtgttaagttgaccggtatgccagacctcactctttcttttatgaatcccaggctccttgacgacgtgtctttccacccttgtgtgagatttaaacggtgggagagcgaaagaattctgtccttcattcctcccgacggcaatttccgccttctatcgtatcacgtgtcggcccagaatcttgtagccatccctgtgtacgtaaagcataatatcagctttagggattcctcctccctgggcaggtttgagattacagtcgggcccaaacaaactatgggtaaaactatagagggcgttaccgtaacatcccagatgcccaagggagtgctcaatatgtccctgactccctctcaagggacacatacattcgaccctgttaccaaaatgctgtcctgggacgtgggcaaaattaatccacagaagctccctagccttaagggtacgatgagtctccaggctggggcatctaaacccgatgagaacccaacaatcaacctgcaattcaaaattcaacagctggctatttcaggcctgaaagtcaatcggctcgacatgtacggagagaaatacaagccattcaaagggatcaaatacatgacaaaggctggaaaatttcaagtcagaacctag

SEQ ID NO: 40215 - DNA, 420 bp, Artificial Sequence
  Description of Artificial Sequence: Synthetic coding sequence
atgatccacagcctgttcctgatcaacagcagcggcgacatcttcttggagaaacattggaagtcggtggtgtcaaggtcagtgtgtgactacttcttcgaagcccaggaacgcgctaccgaggctgaaaacgtgccacccgtcatccctactccacaccattaccttctgtcagtttatcggcacaagatttttttcgtggctgtgattcaaacagaagtgcctcccctgttcgtgatcgaatttctacacagagtggtcgacactttccaagattactttggcgtatgcagcgagcccgtaattaaagataatgtggtagttgtgtacgaagtcctggaggaaatgctagacaatggcttccctctggccacggaaagcaatatcttgaaggagctgataaaacccccaaccatctag

SEQ ID NO: 40216 - DNA, 822 bp, Artificial Sequence
  Description of Artificial Sequence: Synthetic coding sequence
atgatccacagcctgttcctgatcaacagcagcggcgacatcttcctggagaagcactggaagagcgtagtgagccgttcagtatgtgattatttttttgaagcccaggagcgggcaactgaggcagagaatgtgccaccggtgatccctacacctcaccactatctcctctctgtgtacaggcataaaatcttcttcgtagccgtcattcagaccgaagtgccacctctgtttgtcatcgaatttctacacagagtggtcgatacctttcaagactacttcggtgtgtgttctgaacccgttattaaggacaacgtggtcgtcgtgtatgaggtcctggaggaaatgctggacaatggatttcccttggctacagaaagcaacattctgaaagagttgatcaaacctcctacaatactgagaactgtggttaataccatcactggctccacgaacgtgggtgaccagctcccaacaggccagctatccgtggttccatggcggaggacgggggttaagtacactaataatgaggcctacttcgacgtgattgaggaaatagatgcaattattgacaaatccggcagcactataacagctgagattcagggtgtaatcgacgcttgcgttaaactcactggaatgccggatttgacactctcattcatgaacccacgactgctagatgatgtgagctttcatccttgtgtgcgttttaagcggtgggaaagtgagaggattttgagcttcatccctccagacggaaacttccgactcttgagctaccacgtgagtgcgcaaaaatgttgtttgggaatgtag

SEQ ID NO: 40217 - DNA, 582 bp, Artificial Sequence
  Description of Artificial Sequence: Synthetic coding sequence
atgatccaggccatcctggtgttcaacaaccacggcaagccccggctggtgcggttctaccagcgcttccctgaggaaatccagcagcagattgtcagagagactttccacctcgttttgaagagggacgacaacatatgtaactttctggagggaggctcgttgattggagggagtgactataaactcatataccgtcattatgccacattgtattttgtattttgtgtggactcttcagagagcgagctgggcatactcgacctcatccaggtctttgtggagacccttgacaagtgctttgaaaacgtgtgtgagctggacctcatattccacatggataaggtgcactacatcttacaggaggtagtcatggggggaatggtgctagagaccaacatgaacgaaatcgtggcacagattgaggcccagaaccgcttggaaaagagcgaaggtggactttctgccgcccctgcccgtgcagtgtctgctgtcaagaacatcaacctgcctgagattcccaggaacataaatattggagacctgaacatcaaggtgccgaacctgagtcagttcgtctag

SEQ ID NO: 40218 - DNA, 375 bp, Artificial Sequence
  Description of Artificial Sequence: Synthetic coding sequence
atgatccaggccatcctggtgttcaacaaccacggcaagccccggttagtgagattttaccagcgtttcccggaagagattcagcaacagatcgtgcgggagacctttcacctcgtgttgaagagagatgacaacatctgcaactttttagaaggcgggagcctgatcggaggcagtgattataagttgatataccgacactatgcaacgctgtacttcgtgttctgcgtcgatagtagcgaatccgagctgggtatcctggacctaattcagctgaagaagcgcgagcgcaaaaagagtcaatgtaatacgttacaaacaggaacactcgccctttgggagcaggggcctgacatccggactaggcggctgtag

SEQ ID NO: 40219 - DNA, 375 bp, Artificial Sequence
  Description of Artificial Sequence: Synthetic coding sequence
atgatccaggccatcctggtgttcaacaaccacggcaagccccggctggtcagattttaccagcgctttccagaagaaattcaacaacagattgtgcgtgagaccttccatcttgtgctcaagagagatgataatatttgcaacttcctggaaggaggctcgttgatcggtgggtccgactataaattgatttacaggcattacgctacactgtacttcgtgttttgcgtggacagcagcgaatcagagttggggattctcgatctcatccaactgaagaagcgggagaggaagaaatcgcagtgtaataccctgcagacggggaccctggccctatgggagcagggacccgatattcgcacaaggaggctgtag

SEQ ID NO: 40220 - DNA, 1506 bp, Artificial Sequence
  Description of Artificial Sequence: Synthetic coding sequence
atgcccgccgccatgctgccctacgcctgcgtgctggtgctgctgggggcccatacagcccccgccgcgggggaagccggcgggtcttgcctgagatgggagccgcactgtcagcagcctcttcccgatcgggtgccctcgactgctattctgcccccccgtttgaacgggccctggatttcaactgggtgtgaagttaggccagggcccgaatttctgactcgcgcatacaccttctacccctcccgcctcttccgcgcccaccagttttactacgaagaccctttctgtggtgaacctgcgcatagccttcttgtgaagggtaaggttcgtctgaggcgggcatcttgggtcacacggggcgcgacagaggccgactaccacttgcacaaagtcggaatcgtgtttcactcccggcgggccctcgtagatgtgactggacgcctgaaccagacacgggcgggccgcgattgcgctaggaggcttccacctgcgagagcatggttgcctggcgccctgtatgaactacggtctgcgagggcacagggcgactgtctggaagctctgggcctcactatgcatgagttatccttagtcagagtgcagcgcagactgcaaccgcagcccagagcgtctcccagattggtggaagagctgtacctgggcgatattcacacagaccccgctgagcgtcgtcattataggccaactggataccagagacctctccagtctgctctgcaccacgtgcagccttgccccgcttgtggcttgatcgctcgcagcgacgtacatcacccaccagtgttgccacctcccctagcgctgccgcttcaccttggcggatggtgggtctcaagtggatgtgaagttagaccagctgtgctgtttctgaccagactctttacgttccacggacatagcagaagctgggagggatattatcatcacttcagcgacccggcctgtcgccagcccacatttacagtgtacgcggcaggccgctatacccggggtacgccctcaacccgcgtccgcggtggtactgagctggtgtttgaggttaccagagcacacgttacccctatggatcaagttactacggcaatgctgaatttcagcgaaccttcgtcttgtggcggagcaggtgcttggagcatgggcaccgagcgagacgtcaccgcaaccaacggatgcttacctctgggcattcgactcccccatgtggagtacgagctctttaagatggaacaagatcctctgggccagtcgctcctcttcattggtcaacgcccgacagatggaagttccccagacacgcccgagaagaggcctacatcttaccaggctccacttgtcctctgccatggagaagctccagatttttctcgccccccccaacatcgaccatctctccagaagcacccctcaaccggaggcctgcacatcgctccatttcccctactgccactggtgctcggcttggcctttctgcactggctttag

SEQ ID NO: 40221 - DNA, 1539 bp, Artificial Sequence
  Description of Artificial Sequence: Synthetic coding sequence
atggccgagaacagcggccccggcgtgcggccccccggctgggaggcccaaattaatatcatcagcacgagactggccttggctcacactgctcccgcggccggggaggccggagggtcctgcctgagatgggaacctcattgccaacagcccctacccgaccgagtaccctcaaccgctattctgccaccacgactaaatggcccgtggatttcaaccggatgtgaagtccgtcccggtcctgaatttctcacgcgggcctacactttttatccttccaggctgtttcgggcccaccagttttactatgaggatcctttctgtggtgagcccgctcatagcctgttggtcaaggggaaggtcaggctccgcagagccagctgggtaacccgcggcgctacagaagctgattaccatctgcacaaggtcggcatagtttttcattcaaggagagcgttagtagatgtgaccggcaggctcaaccaaactcgtgctgggagagactgtgctcgcaggttaccacccgctcgagcttggctaccgggtgctttgtatgaacttcgatctgccagggcccagggggattgcctggaggcactgggcttgaccatgcatgagctgagcctagtcagggtccagaggcgcctgcaaccccagccccgcgcttcaccaagattagtcgaagaactatatcttggagacatacacactgacccagctgagcggcggcattaccgtccaacgggataccagcgtccgttgcagagcgctctgcaccacgtgcaaccgtgcccagcctgtgggcttattgccaggtctgatgtgcatcaccctcccgtgctgcctccccctcttgccctacctctgcatctgggcgggtggtgggtgtcttctggctgcgaggtgcggccagcagtgctgtttcttaccagactgtttacattccatggccattccaggagctgggaaggctactaccatcacttttctgatcctgcttgtcgccagccaacatttacagtatatgccgctggccgctacaccagggggacaccctcaacgcgggtcagaggaggaactgagctggtttttgaagttactcgggcccacgttacgcctatggatcaggtgacaactgcaatgctgaactttagtgagccgagtagctgtgggggtgctggcgcctggtctatgggtacagagcgggacgtcaccgccacaaatgggtgtttacctctgggaataaggttgcctcacgtggaatacgaactgttcaaaatggaacaagatcctttggggcagtcacttttgttcattggccagaggccaacagatggatcgtctcctgatacaccagagaagcggcccacatcttatcaggctccactcgtcctgtgccacggcgaggcacctgacttcagccgccccccccaacacaggcccagccttcagaagcatcccagtacaggtgggctgcacatcgcgccgtttcccctattgcctctggtcctgggcctggccttcctgcattggctctag

SEQ ID NO: 40222 - DNA, 1452 bp, Artificial Sequence
  Description of Artificial Sequence: Synthetic coding sequence
atgcaggagttcaccaagttccccaccaagaccggccggcggagcctcagcagatccatcagccagtccagcaccgactcatactcttccgctgctagctacacagacagttccgatgatgaggtttccccccgagagaagcagcagacaaactcaaaaggatcttcgaacttctgcgtgaagaacattaaacaagctgagtttggccgacgggaaattgaaatcgctgagcaggatatgtcagccctaattagcctccggaagcgagcccagggtgaaaaaccgctggcaggagccaagattgtaggatgcacccacattaccgcgcaaacagccgtcttgatcgaaaccctgtgcgcacttggagcccagtgtcgatggtctgcatgtaacatctactcaacgcaaaacgaggtggctgccgccttggcagaggccggggtagccgtgttcgcctggaagggtgagtcggaagacgatttctggtggtgcatcgacaggtgtgttaatatggatgggtggcaggccaatatgatccttgacgacggcggcgacttaacacattgggtgtacaagaagtacccaaatgtctttaaaaagatccgaggaatcgttgaagagtctgttacgggcgttcataggctctaccagctaagtaaagctgggaagttatgtgtgcctgccatgaacgttaatgactctgtgacaaagcaaaagttcgacaatctgtattgctgtagagagtccattttagacggcctgaaacgaaccacagatgtgatgtttggcggcaagcaagtggtggtatgcgggtacggagaggtgggcaaggggtgctgcgctgctctgaaggcgctgggtgcgatagtatacattaccgaaatcgacccaatatgcgcccttcaggcatgtatggacgggttcagagtagtgaaactaaacgaggtgattcgtcaagtggatgtcgtaattacctgtaccggaaataaaaacgttgtcacgcgcgaacacctggatagaatgaagaactcatgtatcgtgtgcaacatgggtcactccaacacagagatcgacgtcaccagcctcaggactccagaactgacttgggaacgtgtgcgatcccaggtcgatcacgtcatctggcccgacgggaaaagagtggtgctgctggctgagggtagactgctgaacctgtcctgcagcaccgtgccgaccttcgtactttctatcaccgctactacacaggctctcgccctgatcgagctctacaacgcaccggaaggtcgttacaagcaagacgtctatcttctgcctaaaaaaatggatgaatacgttgcatctcttcatctcccgagtttcgatgcccatctgaccgaattgacagacgatcaggccaagtacctggggctcaacaaaaatggtccattcaaacctaactactatcggtattag

SEQ ID NO: 40223 - DNA, 1593 bp, Artificial Sequence
  Description of Artificial Sequence: Synthetic coding sequence
atgagcatgcccgacgccatgcccctgcccggcgtgggcgaggagctcaagcaagccaaggagattgaggatgccgagaagtactccttcatggctaccgtgacgaaagcccccaagaagcagatacagttcgcggatgacatgcaggaatttactaagtttccgacaaagaccggccgtcggagtctttctcggagcatttcccagagtagtaccgacagctacagctccgcggcaagttacaccgattcatcagacgatgaagtctcaccgcgcgagaagcaacaaaccaattccaagggatcttcaaatttttgtgttaaaaacattaaacaggctgaatttggacggcgagagattgagattgccgaacaggacatgagtgccttgatcagcctccgaaaacgggcccagggcgaaaagccgctggcgggcgccaaaatcgtcggatgcacacatatcaccgcccagactgcagtcctgatcgagaccttatgcgcgctgggcgctcaatgcaggtggagcgcctgcaatatatacagcacgcagaatgaggtcgcagctgctctagccgaagccggcgtagcagtttttgcatggaagggcgagagcgaagacgatttctggtggtgtatagacagatgcgtcaacatggacgggtggcaggcaaacatgatcctcgatgatgggggtgatctgacccattgggtttataagaagtacccaaacgtgttcaagaagatccggggtatagtcgaagaaagcgtgacaggtgtgcacagactctatcagctctcgaaagcaggcaagctctgcgtccctgccatgaacgttaatgatagcgtaactaaacaaaagttcgacaatttgtactgctgccgcgagagcatactggatggattgaagagaacaacagatgtaatgttcggagggaagcaggttgtcgtgtgcggttatggagaggtggggaagggctgctgcgctgcacttaaagctctgggagcaatcgtgtatattaccgaaatcgaccccatatgcgcactacaggcttgtatggatggctttcgcgtggtgaaattaaacgaagtcataaggcaagttgacgtcgtaatcacttgtactggcaataaaaacgtggtgactcgcgagcacctggataggatgaagaatagctgtattgtgtgcaacatggggcattccaatactgagatcgatgtcaccagccttaggacgcccgaattgacttgggaacgagtgagatctcaggtagaccatgtgatttggcctgacggtaagcgcgtcgtgctgttggctgagggtaggctgcttaacctctcctgctctactgtgccaaccttcgtgctctctatcactgctactactcaggcccttgccttgatagaactctataatgcccctgagggccgatacaaacaggacgtgtatctcttgcccaagaaaatggacgagtatgtcgcctccttgcacctccctagcttcgatgcccatctcacagagcttaccgatgaccaggccaagtaccttggtctgaacaagaatggcccctttaagccgaactattacagatattag

SEQ ID NO: 40224 - DNA, 1452 bp, Artificial Sequence
  Description of Artificial Sequence: Synthetic coding sequence
atgcaggagttcaccaagttccccaccaagaccggccggcggagcttgagtaggagcatctcacagtccagcacggattcatacagctcagcagcctcgtacaccgattcgagcgacgacgaagtttcccctagggagaaacagcaaactaacagcaagggctcctcaaatttttgcgtgaaaaacattaagcaggcggaattcggtaggcgcgagattgagatcgccgagcaggacatgagtgccctcatcagtctgaggaagcgagcacagggggagaaacccctcgctggtgcaaagattgtgggttgtacccacattaccgctcagaccgccgtccttatcgagactctctgcgcgttgggcgctcagtgtaggtggtctgcttgcaacatttacagcacgcagaatgaagtggcagcggctttagccgaggctggggtggccgtttttgcctggaagggcgaatctgaagatgatttttggtggtgtatcgatcgttgcgtaaatatggacggctggcaggccaacatgattctggacgatggaggtgatctgacacactgggtatacaagaaataccctaatgtgtttaagaagataaggggtattgttgaagagtccgttaccggcgtgcaccggctctatcagcttagcaaggccggaaaattatgcgtgccagcaatgaacgtcaacgacagtgttaccaaacagaagtttgacaatctctactgctgccgcgagtctattctggacgggctgaaacgaaccactgatgtaatgtttggcggaaagcaggtagtcgtctgtggctacggcgaggtgggaaaagggtgctgtgccgcgctcaaagctttaggcgctatagtctatataactgaaattgatcctatttgcgcgttacaggcctgcatggacggcttccgggtggtcaagctcaatgaagtgattaggcaggtcgatgtggtgatcacctgtacaggcaataaaaacgttgtgactagagaacacctggaccggatgaaaaactcttgtatagtgtgcaacatgggacattctaacaccgaaatcgatgttacctccctgcggactcccgagctgacctgggaacgggtccgatctcaggtggaccatgttatttggcccgatggaaagagggtcgtcctcttagcagagggaagactcctgaacctgtcttgcagcacagtgccaacgtttgtgttgagcattactgcgacaacacaagctttggctcttattgagttgtataacgcgcccgagggccggtataaacaagacgtctatttgttgcctaagaagatggatgagtacgtggcttccctgcatttaccctcttttgacgctcacctcacagaattgacagacgatcaagccaaatacctcggcctgaataagaacggcccatttaaacctaactactatagatattag

SEQ ID NO: 40225 - DNA, 1119 bp, Artificial Sequence
  Description of Artificial Sequence: Synthetic coding sequence
ttcgtgttcaaggcctacatgtacctgaacgagggccagaagctgttaaaaacccttaagaaggataagtcgtggagtcagaccttcgagagtgctactttttattccttaaaaggagaagtttgcttcaacatggggcaaatcgtcctagccaaaaagatgctgcgaaaagcccttaagttgctcaaccggatatttccctacaatctgatcagcttatttttacacattcatgtcgagaaaaatcgccacttccattatgttaacagacaggcccaggagtccccaccccctggcaagaaaaggctggctcagctctaccggcagaccgtgtgtcttagtctcctgtggcgcatatactcatatagctacttgttccattgcaaatattacgcacatcttgctgtcatgatgcagatgaacactgcacttgaaactcagaactgtttccagatcatcaaggcttaccttgactactcgctgtaccatcacctagcgggttataaaggagtgtggttcaagtacgaagtgatggcaatggagcacatcttcaatctgccactgaagggagaaggaatcgagattgtagcatacgtggccgagaccctggtcttcaataagcttatcatgggccatctcgatcttgctattgaactagggtcccgcgctctccaaatgtgggccctgttgcagaaccccaatcggcactatcagtctctatgccggctgtccaggtgcttgttgttgaactcccgctaccctcaacttatccaggtgctcgggcggctgtgggagctgagcgtgacacaggaacatatattctccaaagcctttttttactttgtgtgcttagacatactgttgtatagtggttttgtgtacagaacatttgaagagtgtctagaatttatccaccagtatgagaacaatcggattctgaagttccattccggcctgcttctgggcctatactcgtccgtcgctatctgggagtgtgaggcgggggtcgggaggagacttcatacctcacgtgatcctggaatgcccgacttccgtaacggcactacattcaccaactttccgattgagttaaaaattttttgccaggaggaaccatag

SEQ ID NO: 40226 - DNA, 4557 bp, Artificial Sequence
  Description of Artificial Sequence: Synthetic coding sequence
atgagcctgagcgagggcgacgccctgctggccctgtggcgggtggagcgtaagcagctaaagaatataattaccgtggttattaagtgcagccttgagattcatggcctgtttgagacccaggagtgggaggagggtctggatattcgtgtgaaaataggcctggccgcagggcacatttccatgctagttttcggcgatgaaacacattcacactttttggtaattggtcaggcggtggatgacgtgcggctagcacaaaatatggcgcagatgaatgacgttattctttctccgaactgttggcagttatgcgatcggagtatgattgaaattgaatctgttccagatcagcgggcggttaaagtgaatttcctgaaaccaccaccaaatttcaacttcgacgaattctttacaaaatgcaccacattcatgcattattatccttccggggagcataagaacttgctgaggctggcctgtaccttaaagcctgatcccgagctggagatgagtctccaaaaatacgttatggagtccatactgaagcagattgataataagcagttgcaggggtatttgagtgaactgcggcccgtaactatagttttcgtaaaccttatgttcgaggaccaggacaaggctgaggagattggacccgctatccaggatgcttacatgcacatcactagcgttctcaagatttttcagggacagatcaacaaagtgttcatgtttgacaagggctgctcctttctatgcgtctttggattccccggagaaaaagtccccgacgagctgacccatgccctagaatgtgccatggacatattcgacttttgtagtcaggttcacaaaatccagactgtgtctatcggcgtggcctctggaattgtgttctgcggtatagtcggtcacacagtgcgtcacgagtataccgttattggccaaaaagtgaatctcgccgctcggatgatgatgtactaccctggcatcgtcacatgtgattcagtaacctacaatggctcgaatctccccgcctactttttcaaagagctgccaaagaaggtgatgaagggagtggctgatagcggacccctgtatcagtactgggggcgcacagaaaaagtgatgttcggcatggcttgtctgatatgtaatcgcaaggaagattaccctctgctcggaagaaacaaagagatcaactactttatgtacactatgaagaaattcttgatcagtaatagctcgcaggtgctgatgtatgagggcctgcccgggtacgggaagtcccagatcttaatgaagattgagtacctggctcagggtaagaatcacaggatcatcgccatcagtctgaataagatcagctttcaccagaccttctacacaattcagatgtttatggccaacgtgctgggactcgacacatgcaagcactacaaggagcgccagacaaatcttcgtaataaagtgatgactttgctggatgagaaattttattgtctactgaacgatatcttccatgtgcaattccccatttcccgggagatatccagaatgtcgactctgaaaaagcaaaagcagctggaaattctatttatgaaaatcctgaagctcatcgtgaaggaggagcggatcatcttcataatcgatgaggcacagttcgtggactcaaccagctggcgctttatggagaaactcattaggacgctgcccatatttattataatgtcactttgtccgttcgtaaacatcccttgtgctgccgcccgtgcagtcattaaaaatagaaatacgacgtacattgtaatcggtgcagttcagcccaatgatatcagtaacaagatttgtcttgatctaaacgtgagctgcatttcaaaggagcttgatagctacctgggtgaagggagctgtggcattcctttctactgtgaggagctgttaaagaacctggagcatcatgaggtgttggtgtttcagcagaccgagagcgaggaaaagaccaaccgtacctggaacaacctctttaaatatagcatcaagctgacagaaaagctcaacatggtcacattacacagcgataaagagagcgaagaggtgtgccatttaacctcaggcgtgcgcctcaaaaatctgtccccaccaacatcactgaaggagatcagccttattcagctagacagcatgcgcctgtctcatcagatgctggtgaggtgtgccgcgatcatcgggctcacatttaccacagagttactgtttgagattctaccctgttggaatatgaaaatgatgattaaaacacttgccactctcgtggaatcaaacatattctactgttttcgtaatgggaaggaactgcaaaaggccctcaaacagaatgacccctcatttgaggttcattacaggtctctctccctcaaacccagcgagggaatggatcacggagaggaggagcagctccgagagcttgaaaacgaagtgattgaatgccacaggattagattctgtaaccctatgatgcagaaaacagcttatgagttgtggctgaaggatcagaggaaagccatgcatctcaagtgcgctcgcttcctggaggaggacgcccaccggtgtgatcattgtaggggacgcgacttcataccataccatcactttacagttaacatacgcttgaacgccctggatatggatgctattaaaaaaatggctatgagccacggctttaaaactgaagaaaagctgatactctctaactctgaaatcccagaaacaagcgctttctttccagagaatagatctccagaggaaattagggagaaaatcctaaatttcttcgaccatgtactcaccaagatgaagacctctgatgaagacattatacctctcgaaagttgccagtgcgaggagatcctagagattgttattcttccactcgcgcaccacttcttggctttaggagagaacgataaggctctgtattattttctggagatagcttctgcttacctaattttctgcgataattacatggcttatatgtatctgaacgaaggccagaagctgttgaagacattaaaaaaggacaaaagttggtcccagacctttgagagcgcaaccttttactcactaaagggcgaagtctgcttcaacatggggcagattgtcctggccaaaaaaatgttgagaaaagccctgaagctgttgaaccggatattcccctacaatctgatcagcctgttcttacatatccacgttgagaagaatcggcacttccactacgtcaacaggcaagcgcaagagtccccgccccccggaaagaagaggttggctcagctgtacaggcagacagtctgtttgtctctgttatggaggatttattcttattcctatctgtttcactgtaaatattacgcacacctagctgtgatgatgcagatgaacacagccctcgaaacccagaattgttttcaaattattaaagcttatctcgactatagtttgtatcatcaccttgctgggtacaagggagtctggttcaaatatgaagtgatggcaatggaacacatctttaatctgcccctgaagggtgagggcattgagatcgtggcctacgtggccgaaaccctggtattcaacaagcttataatgggccacctggatttggccatcgaactgggtagcagagcactgcagatgtgggccctgttgcagaacccaaatcggcattaccagagtctgtgccgcctgagcagatgtctccttctgaacagtcggtacccccagctgatacaggttctggggaggctctgggagctctcagtaacacaggaacatattttttccaaagcgtttttttacttcgtttgtctggacatactcctctacagcggtttcgtgtaccgcacctttgaggaatgcctggaattcatccaccagtatgaaaataatcggatcctaaaatttcattccggcctgctgctcggcctttacagctccgtggctatttggtacgcacggctgcaagagtgggataacttctataaattctccaacagagccaaaaatctgctgccacgccgaaccatgaccctgacctattatgatgggatttcgagatatatggaagggcaggtgctgcacttacaaaaacagatcaaagagcagtcagaaaatgcccaagcttctggtgaagaactcctgaaaaacttagaaaatctggtcgcacaaaacaccaccggaccggttttctgcccaagactttatcatttaatggcctatgtctgcatactgatgggtgatggccagaagtgtggcttgtttcttaataccgctcttcgcctctctgaaactcagggaaatattcttgaaaaatgctggctcaatatgaacaaggaaagctggtactccacctctgagttaaaggaggaccagtggctgcagacgatcctatcacttccctcctgggagaaaatcgtggccggtcgcgtcaatatacaagatctgcaaaagaataagttcttgatgagagcgaacaccgtggataatcacttttag

SEQ ID NO: 40227 - DNA, 4833 bp, Artificial Sequence
  Description of Artificial Sequence: Synthetic coding sequence
atgaacacccccaaggaggagttccaggactggcccatcgtgcggattgctgcccacctgcctgacctgatcgtgtacggacacttctcccccgaaagaccgtttatggattatttcgatggggtgctgatgtttgttgacatttccggttttacggcaatgaccgaaaaatttagctctgcgatgtacatggaccggggggcggaacaactcgtggaaattttaaactatcacatatctgccattgtggaaaaagtactgatcttcgggggggatatactaaagttcgccggcgatgctctacttgctctgtggagggtggaaaggaagcagttgaaaaacataataacagtagtcatcaagtgcagcttggagatacatggtctgtttgaaacacaggagtgggaggagggcttggatatcagggtcaagatcggattggccgccggtcacatctccatgctggttttcggggacgaaacacactctcattttctcgtcattgggcaggctgtggacgacgtgcggctggcacagaatatggcgcagatgaatgatgtgatcttatctccaaattgttggcagctttgcgaccgaagcatgatcgagatcgaaagtgttcccgatcagagggccgtgaaggtgaactttctcaagccacctccaaatttcaactttgacgaattctttacaaaatgtactacatttatgcactattacccaagtggagaacacaagaatttgctgcggctcgcctgtacactaaaaccagatcccgaactcgagatgtcacttcagaagtatgtgatggaatcaatcttgaagcaaatcgacaacaaacagctccaggggtacttaagtgagttgcgtccagtgaccatcgtctttgtgaatctaatgtttgaagatcaggacaaagctgaagagatcggccctgcaatacaagacgcatatatgcacatcactagcgtactgaagatcttccaaggtcaaatcaataaagtgtttatgtttgacaagggctgttccttcctgtgcgtgtttggcttccccggagagaaagttccggacgagctgactcatgcactcgagtgcgctatggatattttcgacttttgcagccaggttcacaagatccagacagtgtccattggagttgcgtcgggcattgtgttttgcgggattgttggccataccgtgcgacacgaatacactgtgatcggacaaaaagtgaacttagccgctagaatgatgatgtattatccaggcatagtcacatgcgactcagtgacttataatggatcaaacctgcctgcatattttttcaaagagctcccaaaaaaggtgatgaagggtgtggcagattccggacctctgtaccagtactgggggcgcacagagaaagtgatgttcggcatggcatgcttgatttgtaaccggaaggaagactatccattgctgggaaggaacaaagagattaactacttcatgtacacgatgaagaaatttctaatttccaactcctcccaggttctaatgtacgaaggtctgcctggttacggcaaatctcaaatcctaatgaaaatcgagtacctcgcccagggaaaaaatcaccgaattatcgctattagcctcaacaaaatctccttccaccagactttttataccatccaaatgtttatggccaacgtactcggcctggatacgtgcaagcactacaaagagcgccaaaccaaccttagaaacaaagtcatgacattactggatgagaagttctactgtttgttgaacgacatcttccacgtgcagtttccaatttctcgcgaaatttctaggatgagtaccctgaagaaacagaagcaactagaaattctttttatgaagatcctgaagctgatcgtgaaggaggagcgcataatcttcataatagacgaagctcagttcgtagatagcacttcttggcggtttatggagaagttgattagaactctgcccatatttatcattatgagtctgtgtcctttcgtaaacatcccatgtgcagcggcccgggctgtcatcaaaaatcgaaataccacttatatagtcattggtgctgttcagccaaacgatattagtaacaagatctgcttagatctcaatgttagttgcatctctaaagaacttgacagctacttgggagagggctcttgtggaatccctttttattgcgaggaactactgaagaacctggagcaccacgaggtgctggtattccaacagacagaaagcgaggaaaagacaaatcgcacctggaacaatctgtttaagtattctatcaaactcactgagaaactcaatatggtcaccttgcattctgacaaagagagtgaagaggtgtgccatctaacatctggagtgaggctgaaaaaccttagtccccccacctcgttgaaggaaatcagcctcattcaactagattcaatgcgcctctctcatcaaatgctggtgcgatgcgccgccataattgggctgaccttcaccactgaactgctttttgaaatcctcccctgctggaacatgaaaatgatgatcaaaacgctggccacgttagtggagagtaacatcttctactgtttccgtaatggcaaggagttgcagaaggccctgaaacagaacgacccttcttttgaggtccactatcgctccttaagcctgaagcctagcgagggcatggaccacggggaggaagagcaactccgcgaactggagaatgaagtaatcgagtgtcacaggatccggttctgtaatcccatgatgcagaagaccgcatatgagctgtggctgaaagaccagcgaaaggccatgcacctgaagtgcgctaggttcctggaagaggatgcccaccgctgcgatcactgtaggggaagggactttattccctaccaccattttaccgtgaatatccggcttaacgctcttgatatggacgctatcaagaaaatggcaatgtcccacggcttcaagacagaggaaaagctaattctgagtaatagcgaaatccccgagacttctgcttttttccctgaaaacaggtcccccgaggagattcgggaaaagatcctaaattttttcgatcacgtcttgactaagatgaaaacatccgacgaggatattatcccacttgaaagctgccagtgcgaggagatcctcgagattgtcatcctccccctggcccaccacttcttggcactgggtgagaacgacaaagccctgtattacttcctggaaatagcgagcgcctatctgatcttttgtgataattacatggcttacatgtatctcaatgagggacagaaactgctcaaaacgctgaaaaaggacaagtcctggagccaaacatttgagtcagcaacattctattcattaaaaggcgaagtctgctttaacatgggtcagattgttttagccaaaaaaatgctgcgaaaggcgctgaaactgctaaacagaatctttccatacaacctcatcagcctcttcctccacattcacgtcgagaagaacaggcacttccactatgtgaatagacaggcgcaagaatcccctcctccgggcaagaagagactcgctcagctctacagacagaccgtgtgtctctcactgctgtggcgaatatactcttatagttatctctttcattgcaaatattacgctcacctggctgttatgatgcagatgaatactgccctagagacccaaaactgtttccagattatcaaggcctatctggactactcgttgtaccatcacctggcaggctacaaaggcgtatggttcaaatacgaggtgatggctatggagcacatttttaatttgcctctgaagggggagggcattgagatagttgcatatgtggcagagacactggtttttaacaagttgatcatgggccatctcgacctagccatagaacttggctctagggcactacagatgtgggctctgctgcaaaaccctaatcggcactaccagtcattgtgcaggctgtcccgatgcctgctgctcaattcccggtacccccagctaatccaggtgttaggaagattatgggaactgtccgtgactcaggaacatatttttagcaaggctttcttctatttcgtttgcttagacattttactgtactcaggtttcgtctatcggacgtttgaggagtgtttggagttcattcatcagtatgagaacaaccggatacttaagttccattctggtctcctgctgggactctattccagtgtcgcaatttggtatgcaagactccaggaatgggacaacttctataaatttagtaacagggccaagaacttgctgccaagacggaccatgactttgacctactatgatggaatctcccgttacatggagggccaggtcctgcacctgcagaaacagatcaaggagcaatcagagaacgcgcaggcttcgggggaagagctcctcaagaacttggaaaatctggtggcacagaataccaccggtcctgttttttgtcctcggttgtatcacttgatggcgtacgtctgtatactgatgggcgacggtcagaagtgtggcctatttctgaataccgcgctgcgcttaagcgaaacccagggcaacatcctcgaaaagtgttggttgaatatgaacaaggagtcttggtacagcactagcgagctgaaggaagaccagtggttgcagacaatattaagcttgccaagctgggagaaaatcgtggcaggccgcgtgaatatacaagatctacaaaagaacaaatttttgatgcgagccaacacagtagataatcacttttag

SEQ ID NO: 40228 - DNA, 4374 bp, Artificial Sequence
  Description of Artificial Sequence: Synthetic coding sequence
atgctggtgttcggcgacgagacccacagccacttcctggtgatcggccaggccgttgatgacgtcaggctagcccagaacatggcacagatgaacgatgtcatcttgagtcctaactgttggcaactatgtgatcggagcatgatagagatcgagagcgttccggaccaacgtgcagtcaaggtgaactttctgaagccaccccccaatttcaactttgatgagttttttaccaagtgcacaacctttatgcattattatccatctggagagcacaagaacttgttacgcttagcatgtactctgaaacctgacccagaacttgagatgtcactgcaaaaatatgtgatggagtccatcttgaagcagatcgacaacaaacagctgcagggctatctgtccgaactacggccagttaccattgtctttgtgaacctaatgttcgaggaccaggacaaagccgaagaaatcgggcccgctattcaggacgcatacatgcacatcaccagcgtgctgaagatctttcagggccagatcaacaaggtgtttatgtttgataagggatgctccttcctgtgcgtttttggcttcccgggtgaaaaagtgcccgacgagctcacccacgcccttgagtgtgcaatggatatattcgacttctgtagtcaggttcataagatccagacagtttccattggggtggcttcagggatagtgttttgtggaatcgtcggccatacggtaaggcacgaatacacagtgatcggtcaaaaggtgaatctggctgcgcggatgatgatgtactatccggggatagtcacttgcgactcagtaacttataatgggtcaaacctgccggcgtacttcttcaaggagctgcctaagaaagttatgaagggtgtggcagactctgggccactgtaccagtattgggggcggaccgaaaaggtaatgtttggtatggcctgcctgatttgcaataggaaggaagactatccactgcttggcaggaataaagaaattaattattttatgtacacgatgaaaaaattcctgatatctaattcatctcaagtgctgatgtatgagggcttgccaggttatggtaaatcccagatcctgatgaaaatcgaatacctggcacagggcaagaaccaccgcatcattgccattagcctgaacaaaatcagcttccatcaaacgttctatacaattcaaatgttcatggcaaacgtccttggactggatacttgcaagcattacaaagagcgtcagaccaatctgaggaataaggtgatgacattactggatgagaaattttactgcctcctgaatgatattttccacgtgcagttccctatctccagggagatctcaagaatgtccaccttgaagaaacagaagcagttggaaatactcttcatgaagatcctgaagctgatcgtgaaagaagagcggattattttcatcatcgatgaggcacaatttgtggattccacttcttggaggttcatggagaaattgatcaggacactgcccattttcatcatcatgagtttgtgtccttttgtgaacatcccatgcgcagctgctagggccgtgatcaagaatcgcaacactacatacatagtgattggggctgttcagcccaatgacatcagcaacaaaatttgcttggacctgaacgtgagttgtattagcaaggaacttgactcttatctgggagaggggtcgtgtggaatccccttctactgcgaagaactgctcaagaatctagaacaccatgaggtgctggtctttcagcaaaccgaaagtgaagaaaagacaaatcgaacatggaacaatcttttcaaatattctatcaagctcacagaaaaactcaatatggtcacactgcattccgataaggaatctgaagaggtgtgtcacctgacctcaggcgtccgcctgaagaacttgtccccgcctacatccttgaaagaaatcagcctgatacagctggatagcatgagattgagccatcaaatgcttgtgcgctgtgccgccatcattgggttgacctttacgaccgaactgctatttgagatcctcccttgttggaatatgaagatgatgattaagaccctcgcaactctggttgagtcaaacatcttttactgcttccgtaacgggaaggagcttcaaaaggctttgaagcaaaacgacccttcttttgaagtgcactaccggtctctgagcctgaagccctctgagggcatggaccacggggaagaggaacagctgagagagctggagaacgaggtaatcgagtgccacagaatccggttttgcaatcccatgatgcaaaaaaccgcttacgaattatggcttaaggaccagcgcaaagccatgcacttgaagtgtgcacgtttccttgaagaggatgctcaccggtgtgaccactgccgaggacgcgattttatcccttaccaccattttaccgtgaacataagactcaatgctctcgatatggacgcaatcaagaagatggccatgtctcacggctttaagaccgaggagaagctgatcttatccaatagcgagataccggaaacaagcgcattcttccccgaaaatcgcagccccgaggagatacgcgaaaagatactcaatttttttgaccacgtgctgaccaagatgaaaacaagcgatgaagacatcattccgctcgagagttgtcagtgtgaagagatccttgagatcgttatcctgcctttggcacaccatttcctggccctgggtgaaaacgacaaggccttgtactacttcctggagatcgccagcgcatacctgattttctgcgacaactatatggcttacatgtatctgaatgaagggcaaaagctcttaaaaacactgaaaaaggataagtcatggtcacagacattcgaatccgccacgttttatagcctcaagggtgaagtctgcttcaacatgggacagatagtactcgcaaagaaaatgctgcggaaggcactcaagctcctgaatagaatctttccttacaacctgatcagcctatttctgcacattcatgttgagaaaaatagacacttccactacgtgaatcgccaagcccaagagagcccccccccgggcaagaaaagactggcacagctttacaggcagactgtttgtttgtctctgctgtggcggatttactcttatagttatctgttccactgcaaatactacgcgcacctggcagtgatgatgcagatgaacactgcgctcgaaacccagaattgttttcaaattattaaggcctacctcgactattctctctaccaccacctggccggctacaagggcgtatggtttaagtacgaggtcatggcaatggagcacatttttaacctgcctctcaagggcgagggaatcgagattgtggcctatgtggctgagaccctcgtcttcaacaagcttattatggggcacctcgatctcgctatagagctagggtcaagagctctgcagatgtgggcgttacttcagaatccaaatcggcactaccagtcactgtgccgactgtcacgttgtctcttgttgaacagtcgttacccccagttgatccaagtcttgggcagactctgggaattgtccgttacgcaagagcacattttttctaaggcatttttttatttcgtctgcttggacatcctgctatacagcggatttgtttataggactttcgaggaatgtctggaatttatccatcagtacgaaaacaaccgtatacttaagttccacagcggactgttgttgggcctttactcctccgtggccatctggtacgcccgacttcaggaatgggacaacttttacaaattctcaaatcgagcaaaaaacttactgcctagacgaaccatgaccctgacttactacgacgggatcagccggtatatggaggggcaagtgctgcatttgcaaaagcagattaaggagcagtccgaaaacgcgcaggctagcggcgaagaactactgaaaaacctcgaaaatctggtcgcacagaatactactggtccggtattttgccccagactgtatcatctcatggcctatgtctgcattctgatgggtgacggccagaaatgcggtctgttcctgaatactgctcttcggctgagcgagacgcaggggaatattttagaaaaatgttggctcaacatgaacaaagagtcttggtattcaacgtccgagttgaaggaagaccagtggctgcagactattctgtcgctgcccagctgggagaaaatcgtcgcaggccgtgttaatattcaagatcttcagaaaaacaaatttttgatgcgcgctaacactgtggacaatcatttttag

SEQ ID NO: 40229 - DNA, 672 bp, Artificial Sequence
  Description of Artificial Sequence: Synthetic coding sequence
atggccagcaagctgctgcgggccgtgatcctgggcccccccggctcagggaaggggacagtgtgccagcgtatcgcccaaaactttggactgcagcatctgagtagcggccactttcttcgtgaaaatattaaagcctcgacagaggtgggcgaaatggcaaaacagtacatcgagaagagcctcctcgtgcctgatcacgtgattactagactgatgatgtccgagctcgagaataggagaggtcaacattggctgttggacggtttcccacgcacactcggtcaggcagaggccctggacaagatctgtgaggtggatctggtgatctctctgaacattccctttgaaaccctgaaggatcgcctcagtagaaggtggattcacccaccgtctggtcgggtgtacaatctggacttcaaccctccccatgtgcatggaatcgacgatgttactggtgaacctctcgttcagcaggaagatgacaaaccagaggctgtggccgctaggctcaggcagtacaaagatgtggctaagcccgtcattgagctgtataaaagcaggggggtactgcaccaattcagcgggacagagacaaacaaaatttggccatacgtctacactctgttttcaaacaagataacgcccattcagagtaaagaagcttactag

SEQ ID NO: 40230 - DNA, 672 bp, Artificial Sequence
  Description of Artificial Sequence: Synthetic coding sequence
atggccagcaagctgctgcgggccgtgatcctgggcccccccggcagcggcaagggcaccgtatgccagagaatcgcccaaaactttggactgcagcacctctcatccgggcattttctgagggaaaacattaaggccagcacagaggtcggcgaaatggctaagcagtatatagaaaagagcctgttagtccctgaccatgttatcacaaggctgatgatgtccgagctggaaaaccgtaggggtcagcactggctgttggatgggtttccacgaacgctggggcaagcggaagccctggataagatctgcgaggtggacttggtgataagtctgaatattccgttcgagacactcaaagacaggttaagccgacgctggatccacccaccgagcgggcgggtatacaacctggattttaacccaccccacgtgcatgggattgatgatgtgacaggcgaacctctcgtgcagcaggaggacgacaagcctgaggctgttgctgctcggctgcgccagtacaaagatgtagcaaaacccgtgattgaattgtataagtccaggggcgtcctccatcagttttccgggactgaaaccaacaaaatctggccatatgtgtacacactcttctccaacaaaattactccaatacaaagtaaggaggcttattag

SEQ ID NO: 40231 - DNA, 672 bp, Artificial Sequence
  Description of Artificial Sequence: Synthetic coding sequence
atggccagcaagctgctgcgggccgtgatcctgggcccccccggctccgggaaagggaccgtatgccagaggatcgcccagaactttggccttcaacacctatcatctggccacttcctgagggaaaatatcaaggcctccaccgaggtgggggaaatggctaaacagtacatcgagaaaagtctgctggtgcctgatcacgtcattacaaggcttatgatgagcgaacttgagaaccgacgtggccagcactggctcctcgatggcttccctcgaacactaggacaggccgaggccctggacaaaatctgcgaagtagatctggtgatttctctgaacattccttttgagacgctcaaggatcgcctgagccggcgctggatccatccaccctcaggtagggtgtacaacttggactttaatcctccgcacgttcacggtatcgatgacgtgaccggagagcccctcgtccagcaggaagacgataaacccgaggccgtggctgccagactgcggcagtacaaggatgtagccaaacctgtcattgaactctataaaagtagaggcgtgctccatcagttctctggaaccgaaaccaataagatttggccctatgtgtacactctgtttagcaacaaaatcacccctatccagtcaaaggaggcatattag

SEQ ID NO: 40232 - DNA, 1482 bp, Artificial Sequence
  Description of Artificial Sequence: Synthetic coding sequence
atgcacccccaccgggacccccggggcctgtggctgctgctgccctcacttagtttgctcctgtttgaggtggcccgcgcggggcgggcagtcgtcagttgtccagccgcctgcctctgcgctagcaacatcttgtcatgctccaagcagcagctccctaatgtaccacattctctcccttcctataccgccctgcttgatttgtcgcataataacctgtctcggctgagggctgaatggaccccaacccgtctgacccagctgcattctctgttgctgtcacacaaccatctgaactttatctccagcgaggccttttcacccgtccctaaccttaggtaccttgacctgtccagcaatcagctgcgtactttggacgagttcctttttagtgatctgcaagtgcttgaagtactcctgctgtataacaaccacataatggcggtggacaggtgtgccttcgatgacatggcccagctgcagaaactgtacctgtctcagaatcaaatttctcgattcccgttggagttggttaaagagggagccaagctgcctaagctgactctcctggacctgagttcaaataagctcaaaaatctcccactgccagacttacagaaattaccagcatggatcaaaaatggcctctatctccacaacaatccactcaattgcgactgcgaactgtatcaacttttctcccactggcagtaccgccagctgtcctccgtcatggatttccaggaagatctctactgtatgaactctaagaaactccacaacgtgtttaacctgtccttcctcaactgcggggagtacaaagaacgggcttgggaagctcacctgggggacaccttgattattaagtgtgataccaaacagcaggggatgactaaggtatgggtgacgccttcaaacgagcgtgtcctcgacgaggtgacaaatggaacggtgtccgtgtccaaggacggtagtctgctttttcaacaagtgcaggtggaagacgggggggtttatacatgctacgcgatgggcgagacatttaatgaaacactttccgtggaattgaaggttcataatttcacacttcatggccatcatgacacgctgaacaccgcctacaccacactggtaggctgtatactgtcggtggtattagtgctgatttacctctaccttaccccctgcagatgttggtgcagaggggtggagaaaccatccagccatcagggagactcgttgtcgtcatccatgctgtccaccacgcccaatcacgacccaatggccggcggggacaaggacgacggattcgaccgtcgcgtcgcattcctggaacctgcgggacctggccaaggtcaaaatggtaaactgaagcctggcaataccttacctgtgcccgaagcgaccggaaaggggcagagacggatgtctgatccggagagcgtctcctcagttttttctgatacccctattgtggtgtag

SEQ ID NO: 40233 - DNA, 1482 bp, Artificial Sequence
  Description of Artificial Sequence: Synthetic coding sequence
atgcacccccaccgggacccccggggcctgtggctgctgctgccctcactaagcctgctgttattcgaggttgcgcgggccggaagagccgtagtgtcctgtccagccgcttgcctgtgcgcctctaatatcctgtcttgttcaaaacagcagctgccaaacgtgccacacagcctcccgtcttataccgcgctccttgaccttagccacaacaacctctctcgcctgagagcagagtggacccctacacggctgacccagctgcacagcctgctgttgtcccacaaccatcttaatttcatttcttcggaggcattcagtccagtgcccaacctcagatacttagatctttcctccaatcagctgcggacacttgacgaattcctcttctctgaccttcaggtgctggaggtgcttttgttgtataacaatcacattatggctgtggatagatgcgcgtttgatgacatggctcagctgcagaagctgtacctatcccagaaccaaataagtagatttccccttgaactagtgaaggaaggtgccaaactgcccaaactgacattactcgatcttagttccaacaagctgaagaacctcccccttccagacctgcagaagttgcctgcttggattaagaacgggttatacttacacaacaacccgctgaactgtgattgcgagctttatcagcttttcagtcactggcagtacaggcagctctcttccgtaatggactttcaggaagacctctattgcatgaattccaagaaactgcataacgtattcaacctttcattcctcaattgtggggaatacaaggagagggcatgggaggcccacctaggggatactctgatcattaagtgcgacactaagcagcagggcatgactaaggtgtgggtcaccccatccaacgaaagagtgctggacgaggttactaatgggactgtgtctgttagtaaagacggttcactcctattccaacaagttcaggtggaggacgggggagtgtacacctgctatgcgatgggggaaactttcaacgagacactgagcgtggaattgaaggtgcacaatttcaccctccacggacaccatgacactctgaacaccgcttacacaactttagtaggttgcatcctctctgtggtgcttgtcctgatttacctatatttgacgccttgccgatgctggtgccgcggggtggaaaaacctagcagccaccagggtgatagcctgtcctccagtatgctgtccaccacaccaaatcacgaccctatggccggcggagacaaggatgacggttttgacaggcgagtggcttttctggagcccgctggccctggccaaggccagaacgggaaactcaagcccggaaatacactccccgtgccagaagcaacaggcaagggccaaaggaggatgagcgacccagaatccgtttcttctgtgttctctgacacccctattgtcgtgtag

SEQ ID NO: 40234 - DNA, 1569 bp, Artificial Sequence
  Description of Artificial Sequence: Synthetic coding sequence
atgagcctgcgggtgcacaccctgcccaccctgctgggcgccgtggtgaggccaggttgtagggagctcctgtgtctcctgatgattaccgtgacagtagggcccggcgccagcggtgtgtgtccgactgcctgtatttgcgcaactgacattgtttcgtgcaccaataagaacctgtccaaagtgcccggaaacctattcaggctcatcaagcgtttggatctgagttacaatcgcatcggcctcctggacagtgaatggattccagtctcgtttgcaaaactgaatacattgatccttcgtcataataatattacttcaatctctaccggttccttttccacgacacccaacctgaaatgcctggacctttcaagcaacaagctaaaaacagtcaagaatgccgtattccaagaactcaaagttctggaggtcctcctcctgtataataaccatatttcgtacctcgatccatcggcatttgggggtttgagccagcttcagaaattgtatctgtctggtaacttcctcacacagttccctatggatctgtatgtggggaggttcaaactcgccgagctaatgttcctcgacgtgagttacaatagaattccttcaatgcctatgcaccacatcaatctggtgcccggcaaacagctgcgaggaatctacctgcacggaaacccattcgtttgtgactgcagcttgtatagtctcctcgtgttctggtacaggcggcacttctccagtgtgatggacttcaagaatgattatacttgcagactctggtcggacagcagacacagtcgacaggtgcttctcctgcaagactcctttatgaactgctccgactcgataatcaatggcagcttccgcgctcttggctttatccatgaagcccaggttggcgaaaggctgatggtccactgcgattccaagactggaaacgctaacaccgatttcatctgggtgggcccggataaccgcctgttagagccagataaagaaatggaaaacttctacgttttccacaacggttccctggtgattgaatcccctcgattcgaggatgcaggcgtgtactcctgtattgccatgaataagcaaaggctgctgaacgaaaccgttgacgtgaccatcaacgtctcaaacttcactgtgagccggtctcacgcacatgaagcctttaataccgccttcacaacattagcagcatgcgttgcatcaatcgttcttgtactcctctatttatacttaaccccctgtccatgcaaatgcaagactaagcgacagaaaaatatgcttcaccagtcaaacgcccactccagtatactcagcccaggtccagcttctgacgcctctgcagacgagcggaaagctggcgccggtaagagagttgtgtttctggaacctttaaaggacaccgcggctggccagaacgggaaggtcagactctttccttctgaagcggtaattgccgaaggaatactgaagagcactcggggcaagtctgactctgactctgtgaactctgtgttcagcgacacacctttcgtggccagcacgtag

SEQ ID NO: 40235 - DNA, 1569 bp, Artificial Sequence
  Description of Artificial Sequence: Synthetic coding sequence
atgagcctgcgggtgcacaccctgcccaccctgctgggcgccgtggtgcgtccaggttgccgcgaattactgtgccttctaatgattacagtgaccgtcgggccaggagcgtcaggcgtgtgcccaacggcttgtatatgcgccaccgacattgttagctgtactaataagaatttaagtaaggtgcccgggaatttgttcaggctgattaaacggttggatctctcatacaaccgcataggactgctcgacagcgagtggatccccgtgtccttcgcaaagcttaacaccctgatccttcgccataacaacatcacaagcatctccactggctccttttcgacaacacctaacctgaagtgtctggacttgagcagcaataaactgaagacagtgaaaaatgcagtgttccaagaattgaaggtgcttgaagtcctgctcttatacaacaatcacattagctacctggacccatcagcgtttggagggctaagccaattgcagaagctttacctgtcagggaactttttgacccagttcccaatggacctgtatgtgggcaggtttaaattggccgagctcatgttcctcgacgttagctataaccgaatacccagtatgcccatgcatcacatcaatttagtcccgggcaagcagctgaggggcatctacttgcatggcaacccatttgtgtgcgactgcagtctgtatagcctgctggtgttttggtatcggaggcacttttcaagcgtgatggacttcaagaacgattatacctgtagactgtggtcagatagcagacactcccggcaagtcctgctcctgcaggattcctttatgaactgctcagacagcatcatcaatggatcttttagggcattaggcttcatccatgaggcccaggtcggcgagcgccttatggtgcattgtgatagcaagaccggtaatgctaatacagatttcatctgggtgggacccgacaatcggctacttgaacctgacaaagagatggagaatttctatgtctttcacaatgggtcattagttatcgagtccccacgatttgaggatgctggagtctattcttgtatagctatgaataagcagagactattgaatgagaccgtcgacgtaaccatcaatgtcagcaatttcaccgtgagccggtcgcatgctcacgaagcttttaatacagcatttaccacattggcagcatgtgtcgcaagcatcgtactggtactgctatatttgtatttaacgccatgtccgtgtaaatgtaagacaaaacgacagaagaatatgctgcaccaaagcaatgcacattcctcaatcctgtctcccgggccggcctctgatgcttccgcagacgaacgaaaggcgggggcgggcaaaagggttgtttttctcgagccactaaaggatacagctgcagggcagaacggtaaagttcggctgttcccctctgaggccgtcatcgccgagggaatccttaaatcaacaagaggtaagtctgactctgattcagtcaattcagtcttcagcgacacgcccttcgtggccagcacatag

SEQ ID NO: 40236 - DNA, 1569 bp, Artificial Sequence
  Description of Artificial Sequence: Synthetic coding sequence
atgagcctgcgggtgcacaccctgcccaccctgctgggcgccgtggtgagacccggttgtcgagagctgttatgcttgctgatgatcactgtaaccgtagggccaggcgccagcggtgtgtgtccgaccgcctgtatttgtgctaccgatatcgtgagctgtaccaataagaatctctcaaaagtcccaggcaatctattccgactgatcaagcggttagatctgtcctataatcggatcggactcctagactccgagtggattcctgtgtcctttgcaaaactgaacacccttattcttagacacaataacattacttccatttctaccgggtctttttctacgacaccgaaccttaaatgcctggacctgtccagcaataaattaaagacggtgaaaaacgcagtgtttcaggaactgaaggtgctggaggtactgcttctgtataacaatcacatttcttacttggatccttcagccttcggcggcctgtcccagctgcagaagctttacctctccgggaattttttaactcagtttcccatggacttatacgtgggcagatttaagctggctgaattgatgtttcttgacgtgagttacaatcggatcccaagtatgcctatgcaccacatcaatctggttcctggaaagcagttgcgcggcatttatttacatgggaatccctttgtctgtgattgttccctctattctttgcttgttttctggtaccggagacacttttcctccgtgatggacttcaaaaatgactacacctgcagactgtggtctgactcaaggcacagcagacaggtcctcctcctgcaggatagctttatgaactgtagtgactctatcatcaatggctcattccgcgccttaggatttattcatgaagcccaggtgggggagcggctgatggtgcattgcgattctaaaaccggaaatgccaatacggacttcatttgggtgggccccgataacaggttgcttgagcccgataaagagatggaaaacttctacgtgtttcacaacggctcattggtgatcgaaagccctaggtttgaagacgcaggtgtttatagctgcattgccatgaataagcagaggctgcttaacgagacagtcgatgtgaccatcaatgtcagcaatttcactgtgagcagatcacatgcgcacgaggccttcaacaccgctttcactacccttgcggcttgcgttgccagtatcgtcttggtgttactttacctctatctgactccctgtccttgtaaatgcaaaactaaaaggcagaaaaacatgcttcaccagagcaatgcacattcctctatcctgtcccccggacccgcatctgatgcctccgcagacgaacggaaggctggcgccggaaaacgcgtggtgtttctggaaccactcaaagatacggcagccggacagaatggaaaggttagattgtttcccagtgaggcagtcatcgccgaaggcatccttaagtcaacgaggggtaagtcggatagcgactccgtgaacagcgtgttctcagacaccccgtttgtggccagtacctag

SEQ ID NO: 40237 - DNA, 1569 bp, Artificial Sequence
  Description of Artificial Sequence: Synthetic coding sequence
atgagcctgcgggtgcacaccctgcccaccctgctgggcgccgtggtaagacctggatgtcgggagctgctttgtctgttgatgattacggtcactgtaggaccaggcgcttcgggcgtttgtcccactgcttgtatatgcgctactgatattgtttcatgcacgaacaagaatctgtccaaagttcctgggaatctgtttcggttaatcaagcgactggacctgtcctacaaccggatcgggcttctggactctgaatggatcccggtgagctttgctaagcttaacacgctgatccttagacataataatatcaccagcatctcgaccggttctttctccactaccccgaatctgaaatgccttgacctctccagtaacaaactcaagacagtgaagaatgcggtgttccaggaactgaaagtcctggaagtactactgctgtacaacaaccacatctcttacttggacccctctgcctttggggggctgagtcagttgcaaaagctctatctgagcggcaatttccttacacaatttccaatggatctctacgtgggccggttcaagctcgctgaactcatgttcctcgacgtgagttataataggataccctccatgccaatgcaccatattaatcttgtccccgggaagcaactacgcggaatttacctgcacggtaacccattcgtttgcgactgttccttgtatagcctattggttttttggtataggcggcactttagctccgtcatggatttcaagaatgattacacctgtcgactttggagcgattctcgacacagtaggcaggtcctcttgcttcaggatagcttcatgaattgcagcgattccattattaacggttcattcagagctttagggtttattcacgaggctcaggtgggagagagactgatggtccattgtgattccaagacaggcaacgcgaacacagatttcatatgggtgggtcccgataaccgattgctggaacccgataaggagatggaaaatttctacgtattccacaatgggtctctagtcatagagtcccctagatttgaagacgctggtgtgtactcatgtattgcaatgaacaagcaacgcttacttaacgagaccgtggacgtgaccataaacgtgtctaatttcacggtaagccggtcacacgcacatgaagcctttaatactgcttttacaaccctcgccgcctgcgtagcaagcattgtactggtcttgctgtacctatatctgacaccatgtccttgcaagtgtaaaacaaaacgacagaaaaacatgctgcaccagtccaacgcacactcaagcatcctgtcaccagggcccgcctcagatgcctcagccgatgagcggaaagctggagccggcaagcgagtggtttttctggaaccgctgaaggataccgccgccggacaaaacggaaaggtccgattgttcccatcagaggctgtgatcgctgagggaatcctaaagagcacaaggggaaagtcggatagtgattcggtgaactcggtgttttctgatacgccattcgtggctagtacttag

SEQ ID NO: 40238 - DNA, 1515 bp, Artificial Sequence
  Description of Artificial Sequence: Synthetic coding sequence
atgacctggctggtgctgctgggcaccctgctgtgcatgctgcgggtggggttaggcacaccggacagtgagggcttccctccaagggctctgcataattgtccgtacaagtgcatttgcgcagctgacttgctgagctgcactggactcggcctgcaggacgtgcccgcagagctgccggcagctacggcagaccttgacctctcccataatgccctgcagagactaaggcccggctggttagcccccttgttccaattgagagctctgcacctggaccataatgaattggatgcattgggacgaggtgtattcgtcaacgcaagtgggctgcggctgctggatctttcctctaatacactgcgagccctgggacgccacgatctggatggactgggtgccctggaaaaactgctcctatttaataacaggttagtgcaccttgacgaacatgcctttcacggcctgagagctctgagccatctgtacctgggctgtaatgagttggcttcatttagctttgatcatctccatggattgtctgctacccatctcttaaccctggacttgagctctaacagactgggccacatcagcgtacctgaactggcagccttgccagcctttctgaagaatggtctctatctccataacaatcctctgccttgtgattgtcggctgtatcacctgctgcagcgatggcatcagaggggtctctcagctgttcgcgatttcgcccgagaatatgtttgcctggcgtttaaggtcccggccagccgagtgcgtttctttcagcattccagagttttcgagaactgctcatccgctcccgctcttggccttgaacgcccagaggagcatctctatgctctggtagggcgctccctcagactgtactgtaacaccagtgtgccagccatgcgcattgcctgggtgtccccacagcaagaactgctgcgcgctcccggttcacgagacgggagcatcgcagttctcgcagacggatctctggcaattgggaacgtccaggaacagcacgccggactgttcgtatgcctcgctaccggaccccgactgcaccataaccaaactcacgagtacaatgtctcagtgcactttcccaggcctgaaccagaggcgttcaatacagggttcactaccctgctcggctgcgctgttggtctcgtgctcgttctgctgtatctcttcgcccccccctgccgctgctgtagaagggcttgcaggtgtcgcaggtggccccagaccccatcaccattacaagagctaagtgcgcagtcctcagtcctgtctaccacgcccccagacgcccccagtcgcaaagctagcgtccataaacatgttgtatttcttgaaccagggagacgaggtctcaacggtcgagttcaacttgcggtggctgaagagttcgatctgtacaatcccggaggactccaactcaaagctggatctgaatctgcctcctcaatcggctctgagggaccaatgaccacttag

SEQ ID NO: 40239 - DNA, 1515 bp, Artificial Sequence
  Description of Artificial Sequence: Synthetic coding sequence
atgacctggctggtgctgctgggcaccctgctgtgcatgctgcgggtcggtctgggcacacctgatagcgaaggtttcccaccaagagccttgcacaactgtccatacaagtgcatctgtgccgccgatttgctgtcctgtacgggactcgggctccaggatgttcccgcagagctgcccgctgcaacagccgatctggacctgtcccacaacgcacttcagagacttagacctggatggttagctccactgttccagctgagggctctccatctcgaccacaatgagttggacgcgctgggcagaggcgtattcgtaaacgcaagtgggctcagactgctggacctcagtagcaatactctcagggctctggggagacatgatctcgatggcctgggagcgttggagaaactcctcctctttaataaccggctggttcatctggacgagcatgctttccacggattgcgtgctctttcacatctttatttggggtgcaacgaactggcttcgttttcatttgaccacctccatggcttgagcgcaacgcatttactgactcttgacctgagttccaaccggctgggacacatatctgtcccagagttagcagcccttccagcttttctcaaaaacggattatatctgcataataaccctctcccttgtgattgccggctgtaccacctgttacagcgctggcaccaaagagggttgagtgccgtgcgggactttgccagagagtacgtgtgcttagcgttcaaggtgcccgcttccagagtgagattcttccagcactcccgtgttttcgagaattgtagttccgccccagcattgggactggagcgcccagaggagcacctttacgctttggtgggccgtagcctgcgcctttattgtaatacgagtgtgcctgctatgcgaatagcttgggtatcgccccagcaagagttgctgagggcaccaggctctcgcgatggcagcatcgcagttctggcagatggctcgctggctatcggaaatgttcaggagcagcacgctggactatttgtctgcctcgcgaccggccccaggctccatcataaccagacccacgaatacaacgtgtctgtgcattttccccgcccagaacccgaagcttttaacacgggattcaccacactcctcgggtgtgctgttgggctcgtgctagtattactgtatttgttcgcccctccctgtcggtgttgccgccgagcatgccgctgtcggagatggcctcaaaccccgtcgcccctgcaagagctgtcggcacaaagctctgtgttgagcaccacaccccctgatgcgccatcacggaaggcaagcgtgcataagcacgtggtgttcctagagcccgggagaaggggactcaatggaagagtgcaactggcagtcgctgaggagtttgatctgtataatccaggaggcctgcagctcaaggccggcagcgagagcgcgtcttcaatcggaagcgaaggacccatgacaacctag

SEQ ID NO: 40240 - DNA, 1224 bp, Artificial Sequence
  Description of Artificial Sequence: Synthetic coding sequence
atgaccaccagcggcgccctgttccccagcctggtgcccggcagcagaggcgcctcgaacaaatacctcgtcgagtttcgggcagggaaaatgtccctaaaaggcacaaccgtgacaccagacaagagaaaaggacttgtgtatattcagcagaccgatgactcccttattcacttctgttggaaggatcgaacatccgggaatgtcgaagatgatctcattattttcccagacgactgtgaattcaagcgagtgccgcagtgcccttcagggcgggtctatgttctgaaattcaaggctgggtccaaacgcctgtttttctggatgcaggaacccaagacagaccaagatgaagagcactgtcgaaaggtgaatgaatacctcaataacccaccaatgcctggtgccctcggggcgagcgggagctcagggcacgaattatctgcccttggaggagagggtgggctgcagtccctgctgggcaacatgtctcatagccagctgatgcagctgatcggacctgcaggtctgggtgggttgggcggacttggcgccctgactggaccagggttagcatctctattaggttcctcgggaccccctggtagctcctcttcttcaagctcacggtcccagtccgcggctgtcacccccagtagcaccacttctagtacacgggcgacaccagcgcccagcgcccctgctgccgcgtcggcaaccagtccttctccagcaccaagctctgggaacggcgcgtccacagccgcatcacccactcagccaattcagctttctgatttgcaatcaatcctggctacaatgaacgtgccagccggcccggcaggtggccagcaagtggacctcgcctctgtgctgactcctgaaattatggccccaatcttagccaacgccgacgtgcaggaaaggttgctcccttaccttccttctggggagtcactcccccagacggccgatgagatccagaataccctcacctccccacagttccagcaggccctgggcatgttttctgctgcccttgcctctgggcagctcggaccgctgatgtgtcagtttgggctgccagccgaagctgtagaagcagctaacaagggcgacgtagaggctttcgcaaaggcaatgcaaaacaatgccaaaccagaacagaaggaaggggacacgaaggataaaaaggacgaggaagaagacatgtctctggactag

SEQ ID NO: 40241 - DNA, 954 bp, Artificial Sequence
  Description of Artificial Sequence: Synthetic coding sequence
atgaccaccagcggcgccctgttccccagcctggtgcccggcagcaggggagccagtaataagtaccttgtggaatttagagccggcaaaatgagtctaaaagggacaaccgttacacccgataaacgaaaggggcttgtgtacatccagcaaaccgacgacagtctgattcatttctgctggaaggaccggacatcaggaaacgtagaggatgacctgattattttccctgacgattgtgagttcaagcgcgttcctcagtgtccgtcagggcgggtttatgttcttaagttcaaggccgggtcgaagcggttattcttttggatgcaagaacccaagaccgaccaggacgaagaacattgccgaaaagtgaatgagtaccttaacaatccacccatgcctggagcattaggagccagcggttcgtctggtcacgagctcagcgcccttggcgcgggcggactgggggctttaaccggccctggtctggcaagcttgctcggcagctcagggccgccaggatccagctcttcgtcctcaggcgctctcagcctccggtccagccgatctcagtctgcagctgtcaccccatctagcaccacatcatcaactcgagcaaccccagctcccagtgctcccgcagcggcgtccgccactagccctagcccggccccctcctcaggtaacggtgcctcaaccgccgccagccccacccagccaatccaactcagtgacctgcagagcatcctggctacaatgaatgtccctgcaggacccgctgggggacaacaggtcgatctcgcttccgtgttaacgcccgagattatggcgccaatattagctaacgcagatgtccaagaacgccttctgccttatttgccttccggagagtcacttccgcagactgcagacgagattcagaacaccctcacgagccctcaatttcagcaatag

SEQ ID NO: 40242 - DNA, 243 bp, Artificial Sequence
  Description of Artificial Sequence: Synthetic coding sequence
atgaagtaccccctgatgcccctggtgaacgacctgaccttcagcttccttgttttttggttctgcctgcccgttggcctgctgcttcttctcattatttggttgcgcttcctgctttcacaggacagcgaagagaatgatagcagtgtgtgcctggattgggagccttggagcaaaggaccagcagaattctgttggaaggggacactccacgggcaggagaaagaacgcccttgctggtag

SEQ ID NO: 40243 - DNA, 579 bp, Artificial Sequence
  Description of Artificial Sequence: Synthetic coding sequence
atgcccctggtgaacgacctgaccttcagcttcctggtgttctggttttgcttgccagtgggattgctgctcttactgattatttggctgcgattcctcttgagccaggattccgaggaaaatgattcttctgtgtgtcttgactgggagccctggagtaaggggcccgctgagttttgctggaagggaacgctccatgggcaggaaaaagagcgcccttgctgtctcgtctttttggagtccgcaggacagtggcagtggcagaagtggatgggggaaacatgccaaggtggcaaaaggaccctcgcaaccgtggtccctccttggaatcctcagctgatctcatcctctgaccgccacgtgaaggcttcccgagggccgtcgccttctcctgcctctcagatgaccagcagcccagccgggagtagatcctccctaggcgggcacggttcatccgaacaagcccacggggagaagctggccaacctcattcaaaggggactgaaggctggccttggtcgcagggtgtgggtccatataaaggaggcccgagtcttcccttaccccggcgatccgtag

SEQ ID NO: 40244 - DNA, 1026 bp, Artificial Sequence
  Description of Artificial Sequence: Synthetic coding sequence
atgaccgacggcatcctgggcaaggccgccaccatggagatccccattcatgggaatggagaagcgcggcagttacctgaggacgatgggcttgagcaagatctgcagcaggtcatggtgtctggcccgaatctgaacgagacttcgatcgtatcaggcggctatggtggaagcggcgacggtctcataccaacagggtctggacgtcacccttcccactctacgaccccatccggcccgggtgacgaagtggccagaggcattgctggcgaaaaattcgacatcgtcaaaaaatggggcataaacacttataagtgcaccaagcagctgctctctgaacggtttggtcgtggttcacgcacagtagatctcgaattagaactccagatcgagctgcttcgggagaccaaacggaagtacgaatcggtgctgcagcttgggcgggctctgaccgcgcatctgtacagtctcttgcagactcaacacgctctcggcgatgcctttgccgacctgtcccaaaaatcacctgagctacaggaggagtttggctacaatgctgagacacagaagttgctttgtaagaacggagagaccctcttgggagccgtgaactttttcgtgagctccattaacacgttagttaccaaaactatggaggacaccttgatgacagttaagcagtacgaagctgctcggcttgagtacgatgcctacaggactgatcttgaggaattatcacttgggcctcgggacgctggcacacgcgggcgtttggaatcggctcaggccaccttccaagcacatcgagacaagtacgaaaaactgaggggtgatgtcgccatcaaactcaaattccttgaggaaaataaaataaaagtcatgcacaaacagctgctcctttttcataacgcagtttcagcctatttcgccgggaatcagaagcagctggaacagaccctacagcagttcaatataaagttgaggcccccaggcgcagagaagccttcctggctggaggaacagtag

SEQ ID NO: 40245 - DNA, 1026 bp, Artificial Sequence
  Description of Artificial Sequence: Synthetic coding sequence
atgaccgacggcatcctgggcaaggccgccaccatggagatccccatccacgggaatggagaggcgcggcagttgcctgaggatgacggtctggagcaggatctgcagcaggtgatggtctccggccccaacctcaatgagaccagtatcgtgagcggggggtacggcggcagcggggacggattgatccccactgggtctgggagacatcctagccattccacaacaccctccgggcctggagatgaggtagcacggggcattgcaggggagaaatttgacattgttaaaaagtggggcatcaatacctataagtgcaccaagcagctcctgtctgagcgatttggacgcggatctcggacggttgatttagaacttgaactgcagattgagctccttcgggagacaaagcgaaaatacgagtccgtgttgcaactggggagggctttgaccgcgcacctgtattctcttctgcaaactcagcatgcgttgggcgacgcattcgccgatctgtcacagaagtcccctgagctgcaagaagaatttggctataatgctgaaacacaaaaactgctatgtaaaaacggggagactttattgggcgcggttaatttttttgtgtcaagcatcaacacattagtgaccaaaacgatggaagatacactgatgaccgtaaaacagtatgaagcagctcgcctcgaatatgatgcatacagaaccgacctggaagaactgtctctgggtccacgcgatgcgggcacccgtggaagacttgagtccgcccaggccaccttccaggcacatagagataagtatgagaagctgcgaggcgacgttgctattaagttaaaattcttggaagagaacaaaattaaggtaatgcacaagcaactcctgttgttccacaatgccgtatctgcctatttcgctggcaatcagaagcagctggaacagactcttcaacagtttaatataaaactacgcccccccggagccgaaaagcctagttggctggaagagcagtag

SEQ ID NO: 40246 - DNA, 912 bp, Artificial Sequence
  Description of Artificial Sequence: Synthetic coding sequence
atggtgagcggccccaacctgaacgagaccagcatcgtgagcggcggctacggtggctccggcgacggcctgatcccaacgggcagcggccggcaccccagtcactccacgacccctagtggcccaggagacgaggtggctagggggattgcaggagagaaattcgacatagttaagaaatggggcataaacacttacaagtgtaccaagcagctcctgtccgaacgtttcggacgcggcagcagaactgttgatctggagctcgagctgcaaatcgagttattgagggaaacgaaacggaaatacgagtccgttttgcaactgggcagagcgctcaccgcacacctgtattcgcttctccagacacaacacgccctgggcgatgccttcgcggatcttagccagaagagcccagagctgcaagaggagttcggctacaacgcagagacccaaaagttgctctgcaagaacggagaaaccttgctaggcgccgtgaactttttcgtgtcctctatcaacaccctggtcacaaaaaccatggaggacaccttaatgactgtgaaacagtacgaggcagccaggcttgagtatgacgcctaccgcactgatcttgaggagctgagtctgggacctagagatgccgggacccggggacggctggaatcagcccaggccacattccaggctcatcgtgataaatacgagaagctccgtggcgacgttgcgattaaactgaagtttttggaggagaataaaatcaaggtaatgcataagcagctgcttctgttccataatgctgtctctgcctacttcgcgggaaatcaaaagcagcttgagcagaccctgcagcagttcaacattaagttgcgccctcccggcgcagagaagccctcatggctggaagaacaatag

SEQ ID NO: 40247 - DNA, 771 bp, Artificial Sequence
  Description of Artificial Sequence: Synthetic coding sequence
atgaagcccgccctgtgcctggtggccatgggcgccctggtgatggatagctcccctcagtgtactaagcagctcctgagtgagaggttcgggcgcgggagtaggactgtggatttggaactggagttgcaaattgagcttctgcgcgagacaaagcgcaaatatgaaagtgtgctacagctgggtcgtgccttgacggcccacttgtacagcctcctccagactcagcatgcccttggtgacgcatttgccgatttgtcacaaaagagcccagagttacaggaagagtttggttataatgccgaaacccagaaactgctctgcaagaacggcgagactctattgggcgcagtcaatttttttgtgagttccatcaatacactagtcacaaaaaccatggaggatactctgatgacggtgaagcaatatgaggcagccaggctcgaatatgacgcttaccgtacagatctggaagagctctctctcggaccacgagatgcagggacaagaggccgacttgagtcagcgcaagcaaccttccaagctcaccgggacaaatatgagaaattacggggcgacgtggcaattaaactaaaattcctggaggagaataagattaaagtgatgcacaaacagttgcttctgttccataatgcagtgtcagcatattttgcagggaaccagaagcaattggagcagacattacagcagtttaatatcaaacttcgtcccccaggggccgaaaaaccctcatggctggaagagcagtag

SEQ ID NO: 40248 - DNA, 378 bp, Artificial Sequence
  Description of Artificial Sequence: Synthetic coding sequence
atgggcaacatcttcgagaagctgttcaagagcctgctgggcaagaaaaagatgcgcattctgatcctgagcctggatacagcaggtaagacaaccatactgtataaacttaagctcggagaaacagtccccgccgtgcccacagtgggcttctgtgttgagacagtcgagtataagaataacacttttgcagtttgggacgttggcagccatttcaagatccggccactgtggcagcacttcttccagaatacgaaagagctgtcggcgtcacagtttgcccagttcatcaagaagctctgcggcgtgactggaacgaacgacgaagcctccccaggctccctcacttcttacccgtctcatttgttggatcggtag

SEQ ID NO: 40249 - DNA, 534 bp, Artificial Sequence
  Description of Artificial Sequence: Synthetic coding sequence
atgggcaacatcttcgagaagctgttcaagagcctgctgggcaagaagaaaatgagaatcctaatcttatctttggacactgcgggaaaaactaccatcctatacaagttaaagcttggcgaaactgttcctgccgtcccaacagtgggcttctgtgtggaaactgtggaatacaagaataacacctttgccgtgtgggacgtcgggtcccactttaagatccggccattatggcagcactttttccaaaatacaaagggcgccaggtcaccgggttctacacatcaaggttccctggcatcgggcgttttgcccataaaatgcagccacgtggaatttggcatgtggaaaggcgggcggtcacaccctttcctgccacactctagtaggtgtgcagggagcggaggccaattggacagtattctcccgcaccagtccccagcttggggtccttggggatgtaaggatctgagtagcggtttccccagcttcctgaccagctccattttgtggaaaagtgccgtcgtgaaatag

SEQ ID NO: 40250 - DNA, 612 bp, Artificial Sequence
  Description of Artificial Sequence: Synthetic coding sequence
atgggcaacatcttcgagaagctgttcaagagcctgctgggcaagaaaaaaatgcgtattctgatcctatccctcgatacagcagggaagactaccatactctataaattgaaactgggcgagaccgtccccgcggtgccaactgtggggttctgtgttgaaactgtggaatacaaaaacaatacctttgctgtttgggacgtcggttcacatttcaagattcggcctctgtggcagcattttttccagaataccaagggggcccggtctccgggcagcacccaccaggggtcgctggcctccggagtcctgcccattaaatgctctcacgtggaattcgggatgtggaaaggtggtagaagtcaccctttcctcccgcacagcagtaggtgcgccggcagcggaggccagttggatagcatcctcccccatcagtcccctgcttgggggccctggggctgcaaagacttgagttcagggtttccctcatttcttacctcctccatcttgtggaagagcgccgtgtcatatcaacttccgagcctgcataactcaagcagaaactatgcagggtcaccggctcagatgatgaggcatcttctggaggcctag

SEQ ID NO: 40251 - DNA, 393 bp, Artificial Sequence
  Description of Artificial Sequence: Synthetic coding sequence
ggcgcccggagccccggcagcacccaccagggcagcctggccagcggagttcttcccatcaagtgttctcacgtcgaattcgggatgtggaaaggtgggcgttctcatcctttcctccctcattcctcacgatgtgcaggaagcgggggacagctagattccatactccctcaccaatcacccgcgtgggggccatgggggtgcaaagatttgtcttctggcttcccctctttcctgacttcgtctatcttgtggaagtctgccgttgtccgggagcctcatatcagcccccatcaggcccccccatacaagacttcagactgcattacagcgatttctttccctgtgtgtaccatccaccaagaaatcatgcgtggccatagacacaagtag

SEQ ID NO: 40252 - DNA, 378 bp, Artificial Sequence
  Description of Artificial Sequence: Synthetic coding sequence
atgggcaacatcttcgagaagctgttcaagagcctgctgggcaagaaaaagatgaggattttgattctgtctctagacactgcaggcaagactaccattttatacaaactgaagctgggcgaaaccgttcctgcagttccaaccgtcggtttttgtgtcgaaaccgtagagtacaagaataatacctttgccgtctgggatgtcggaagccatttcaagatcaggcctctgtggcaacatttttttcagaataccaaggagctgtcagcctcccagtttgcgcagttcatcaagaaattatgcggcgttacaggaaccaatgacgaggccagtcccggatcactaaccagctatccgtcccacctgctcgatcgctag

SEQ ID NO: 40253 - DNA, 378 bp, Artificial Sequence
  Description of Artificial Sequence: Synthetic coding sequence
atgggcaacatcttcgagaagctgttcaagagcctgctgggcaagaaaaagatgaggatcctgatactgtccctggatacggccggaaaaaccaccattttatacaagctcaaacttggggaaacagtcccggcagtgcccacagtgggattttgtgtggaaacagtggagtacaaaaataatacattcgcggtctgggatgtcgggagccactttaagattcggcctttgtggcagcattttttccaaaataccaaggaactgagtgctagtcagttcgcccagttcattaagaaactgtgtggtgtgacaggcacgaatgatgaagcttctccgggttctctcacaagttatccctcccacctcctcgaccgctag

SEQ ID NO: 40254 - DNA, 393 bp, Artificial Sequence
  Description of Artificial Sequence: Synthetic coding sequence
ggcgcccggagccccggcagcacccaccagggcagcctggccagcggcgtcctacctattaaatgttctcacgttgagtttggaatgtggaaggggggaagatcacatccattcttgccacatagctccagatgcgccggatcaggaggtcagcttgattccattctcccacaccagtcaccggcttggggtccctgggggtgcaaagatctgtcctcaggctttcccagcttcctgacctcatccatcttgtggaaatcggccgtcgtcagggagcctcacatttcaccccaccaggcgccaccttacaaaaccagcgactgcattaccgccatcagtttccctgtgtgcaccatacaccaagagattatgagggggcattggcataaatag

SEQ ID NO: 40255 - DNA, 534 bp, Artificial Sequence
  Description of Artificial Sequence: Synthetic coding sequence
atgggcaacatcttcgagaagctgttcaagagcctgctgggcaagaagaagatgcgcatcttgattcttagcctagatactgccggtaagaccacgatcctgtataaactgaagctgggtgaaacagtcccagctgttcccactgtggggttttgcgtggagacagtcgaatacaagaataataccttcgcagtgtgggatgtgggcagtcacttcaaaattagaccactgtggcagcacttcttccaaaatacaaagggagcacgcagcccaggatcgacccaccagggatctttagcaagtggggtgttacctattaagtgctctcacgtagaattcggcatgtggaagggagggagatcacacccctttctgccacactcctcccggtgtgctgggagcggaggccagctggactccatcctgcctcatcagtcccctgcatgggggccctggggctgtaaggacctgtcctctgggtttcctagcttcctgacctccagcattctgtggaagtcagcagtggttaaatag

SEQ ID NO: 40256 - DNA, 612 bp, Artificial Sequence
  Description of Artificial Sequence: Synthetic coding sequence
atgggcaacatcttcgagaagctgttcaagagcctgctgggcaagaagaagatgagaattcttattctgtccctggatacagctggcaaaaccacgattctgtacaagctgaaacttggggagactgttcctgcggttccgacagtcgggttttgtgtggagaccgtcgaatacaaaaacaacaccttcgcggtgtgggatgtcgggagccacttcaaaataagaccactgtggcagcacttctttcaaaacaccaagggtgcaaggtcccctggctccacacatcagggcagcctagccagtggcgtactgccgatcaaatgctctcatgttgaattcggaatgtggaagggagggcggagccacccctttcttccacattcttcgaggtgtgctggtagcggcggacagctggatagcatccttccacaccagtctccagcttggggaccttggggatgtaaagatctgagctctggctttccctcttttcttacgtccagcattttgtggaagagcgctgtgtcatatcagttaccatctttgcacaactcctctagaaattatgctggatcacttgcacagatgatgagacacttattggaggcgtag

SEQ ID NO: 40257 - DNA, 378 bp, Artificial Sequence
  Description of Artificial Sequence: Synthetic coding sequence
atgggcaacatcttcgagaagctgttcaagagcctgctgggcaagaagaaaatgaggatcctgattctaagcttagacaccgcaggtaaaactacgatcctatacaaactgaagcttggggaaactgtgcccgccgtcccaactgtcggattctgcgtggaaaccgtggagtacaagaacaataccttcgcagtgtgggatgtcggttcacatttcaaaatcaggccactgtggcagcacttctttcagaacaccaaagaactgagcgcaagtcagttcgcacagttcattaaaaagctctgcggcgtgactgggacaaatgatgaggcatcccccggatcactcactagttacccttcacatctgctggaccgctag

SEQ ID NO: 40258 - DNA, 534 bp, Artificial Sequence
  Description of Artificial Sequence: Synthetic coding sequence
atgggcaacatcttcgagaagctgttcaagagcctgctgggcaagaaaaaaatgcgcatcctaattttgtccctcgacacagctggcaagaccacaattttgtataagctgaagctcggcgagactgtgcctgctgtgccaaccgtcggattctgcgtggagaccgtcgagtataagaataacactttcgccgtgtgggacgtgggtagccatttcaaaataaggcccttgtggcagcactttttccaaaatacaaaaggcgctaggagcccaggctctacacaccaggggagcctggccagcggcgtgctgcccatcaaatgctcacacgtcgagtttggaatgtggaaaggtggcaggagccacccctttttgccccactccagccggtgtgccgggtcaggggggcagcttgatagtattctgccccaccagtcacctgcatggggcccttggggctgtaaggacttatccagtggcttccctagtttcctcacctcctccatactctggaagtccgccgtcgtgaaatag

SEQ ID NO: 40259 - DNA, 330 bp, Artificial Sequence
  Description of Artificial Sequence: Synthetic coding sequence
gcccggagccccggcagcacccaccagggcagcctggccagcggcgtgcttccaatcaaatgcagtcatgtggagtttggcatgtggaagggaggaaggtcccacccattcctgccacactccagtagatgcgcaggtagcgggggacaattagactcaattctgcctcaccagagcccggcttggggaccctgggggtgcaaagacctctctagcggctttccttcatttctgacctcttccattttgtggaagagcgccgtggtgcgcgagccacacattagcccccaccaagctcctccctataagacctctgactgtatcacgtag

SEQ ID NO: 40260 - DNA, 603 bp, Artificial Sequence
  Description of Artificial Sequence: Synthetic coding sequence
atgggcaacggcctgagcgaccagaccagcatcctgagcaacctgccaagtttccagtccttccacatagtgattctggggctcgattgcgccgggaagacaactgtgctctatcgattacagttcaacgagttcgtgaatactgtacccacaaagggctttaacactgaaaaaatcaaagttactctcggtaattccaaaaccgtcacatttcacttctgggacgttggaggtcaggagaaacttagacctctctggaagtcttatacgcggtgtacagatgggattgtttttgttgtagattcagttgatgtggagcgcatggaggaggcaaaaaccgagttgcacaagataacccggatctccgagaaccaaggcgtgcctgtgttgattgtggcaaacaaacaggatttacggaactcactgtccctaagcgagattgagaaattactagcgatgggcgaactgtcttcgtctacaccttggcacctgcagcctacttgcgcaataataggtgacgggctgaaagagggccttgaaaagttgcatgatatgatcatcaagcgccgaaaaatgcttagacagcaaaaaaagaagcggtag

SEQ ID NO: 40261 - DNA, 603 bp, Artificial Sequence
  Description of Artificial Sequence: Synthetic coding sequence
atgggcaacggcctgagcgaccagaccagcatcctgagcaacctgccctcctttcagtcattccatatcgtgatattaggcctcgactgtgctgggaagaccacagtgttgtatcggctccagttcaacgagttcgtgaacaccgtgcccaccaagggcttcaatactgagaagattaaggtcaccttgggcaatagtaagactgtgactttccatttctgggacgtgggcggccaagagaagctgcgtcccctgtggaagtcctatacaagatgcactgatggaattgtcttcgtggttgactccgttgacgtcgagaggatggaagaggccaagacagagctgcataagatcacccgtatcagtgaaaaccagggggtgccggtcctcatagttgctaataaacaggatttacgtaatagcctatctctaagtgagattgagaaacttctggcaatgggcgaactgtcaagcagcaccccatggcacctccaacccacgtgtgccattattggcgatggtctcaaggaaggcttggagaagctacacgatatgatcattaagaggagaaaaatgctgcggcagcagaaaaagaagcggtag

SEQ ID NO: 40262 - DNA, 603 bp, Artificial Sequence
  Description of Artificial Sequence: Synthetic coding sequence
atgggcaacggcctgagcgaccagaccagcatcctgagcaacctgccatcatttcagagctttcatattgtgattttaggtctcgattgcgccgggaaaacgacagtactctaccgcctgcagttcaatgagttcgtaaatactgtacctacaaagggctttaacacggaaaaaattaaggtgaccctcgggaactcgaagactgtcacttttcatttttgggacgttggaggacaagagaaactaaggcccctttggaagtcttatacgcgctgcacagacggcattgtatttgtggtggactctgtcgatgtggagcgaatggaggaggccaagacagaactgcacaaaattacaaggatctctgaaaatcagggagtacctgtactcattgtagctaacaaacaggacctaaggaattctctgagtctaagtgaaatcgagaagcttctggcaatgggtgaactctcctcttccactccatggcatctgcagcccacatgcgctataattggcgatggactcaaggaagggctggagaagctgcatgacatgatcataaaacgcaggaagatgttgcgtcaacagaaaaagaagagatag

SEQ ID NO: 40263 - DNA, 603 bp, Artificial Sequence
  Description of Artificial Sequence: Synthetic coding sequence
atgggcaacggcctgagcgaccagaccagcatcctgagcaacctgccatcttttcagtcattccacatagtgattttgggcctagactgtgcagggaagacaacagtgctataccgcttgcaattcaacgaattcgtgaacaccgttccgactaaaggcttcaatacagagaaaatcaaagtcacgttagggaattctaagacagtcacttttcacttttgggatgtaggggggcaagagaagctgcggcctctctggaagagttatacccgctgcaccgacggcatcgttttcgtcgtggatagcgtggacgtagaaagaatggaagaggccaagacagagctccataagataaccaggatcagcgagaaccaaggggtgccagtgctgatagtagctaataaacaggacttaaggaattccctctctctctctgaaattgagaagctcctggcaatgggcgagctgagctctagcactccatggcacctccagcccacttgtgctatcataggcgatggcctgaaagaaggcttggagaagctgcatgacatgatcatcaaaagaaggaagatgctcagacagcaaaagaagaagcgctag

SEQ ID NO: 40264 - DNA, 603 bp, Artificial Sequence
  Description of Artificial Sequence: Synthetic coding sequence
atgggcaacggcctgagcgaccagaccagcatcctgagcaacctgccttcctttcagtcatttcatatcgtcatcttgggactggactgcgcgggcaagactacagtgctgtatagactacagtttaatgagttcgtcaatacggtgcccacaaaaggttttaacaccgaaaagatcaaggtgacactagggaacagcaagactgtcaccttccatttttgggatgtcggaggacaagaaaagctgcggccgctctggaagtcatatacccggtgcacagatgggattgtgttcgtagtggattctgtggatgtcgagaggatggaagaagctaaaaccgaactacacaagattactcgtatatccgagaatcaaggcgttcccgtgcttatcgttgcaaataagcaagatctgcgaaacagcctgtcattaagcgagatcgagaaattgctagcaatgggcgagctatcaagctccactccttggcatctccagcccacatgtgccattatcggtgatgggttaaaagaagggctggaaaaattgcatgacatgattattaagaggagaaagatgctccggcagcagaaaaaaaaaagatag

SEQ ID NO: 40265 - DNA, 156 bp, Artificial Sequence
  Description of Artificial Sequence: Synthetic coding sequence
atgggcaacggcctgagcgaccagaccagcatcctgagcaacctgcctagcttccagtcatttcacatagtaatccttgggctcgactgcgccggtaaaacaacagtactctatagactccagttcaacgaattcgtgaacacggttcccacttag

SEQ ID NO: 40266 - DNA, 606 bp, Artificial Sequence
  Description of Artificial Sequence: Synthetic coding sequence
atgggcaacatcagcagcaacatcagcgccttccagagcctgcacattgtgatgctggggctcgatagcgcaggcaagactactgtgctgtatcgcctgaagttcaatgagttcgtgaacacagtgcctactatcggatttaataccgagaagatcaaactgagtaatggaaccgctaagggcatttcctgccacttttgggatgtcggtggccaagaaaagctccggcctctgtggaagtcttactcccgttgcacggacgggatcatctatgtggtggattccgttgacgtagacagattggaggaggccaaaaccgagctgcacaaggtgacgaagtttgcggagaaccaaggcacccctttgttggtgattgcaaacaaacaggacctgcctaaaagtttgccggtggctgagattgagaagcaactggcactgcatgagctcatcccagcaacaacataccacgtgcaacctgcttgtgctatcattggtgaaggactaaccgagggtatggataagctctacgaaatgatcctcaaacgacgtaaaagtctgaaacagaagaagaagcggacgggggatcttagatcttgcgaggtgtag

SEQ ID NO: 40267 - DNA, 579 bp, Artificial Sequence
  Description of Artificial Sequence: Synthetic coding sequence
atgggcaacatcagcagcaacatcagcgccttccagagcctgcacattgtcatgttaggactggactctgctggcaaaaccacagtgttgtaccgtctgaagtttaacgagtttgtcaatacggtgccaacaattggctttaataccgaaaagattaaactgtctaacggaactgccaaaggcatatcttgccatttttgggacgttggcggccaggagaaactaagacccctctggaagtcctactcgagatgtacggacggaatcatctacgtggtagattcagtggatgtcgaccgcctagaggaagctaagacggaactgcataaggtgactaaattcgctgaaaaccagggcacaccacttctagtgatagctaacaaacaggatctgcccaagagcctgcccgtagccgaaatagagaaacagctggcattgcacgagttgataccggctaccacctatcacgtccagcccgcttgtgccattatcggcgaaggactgacggagggtatggacaaactgtatgagatgattcttaagagacggaagagtttgaagcaaaaaaagaagcggtag

SEQ ID NO: 40268 - DNA, 612 bp, Artificial Sequence
  Description of Artificial Sequence: Synthetic coding sequence
atggccgagggcgacaaccggagcaccaacctgctggccgccgagaccgcgtcgttggaggaacaactgcagggctggggagaggtaatgctcatggccgacaaggtactgcggtgggaaagggcgtggtttcctccagccatcatgggagtggtctcacttgttttccttattatctattaccttgatccatctgtgctatcgggagtgtcttgttttgtgatgtttctgtgtcttgccgactacttggtccccatcctggctccgaggatttttggctcaaataagtggacaactgaacaacagcagcgctttcacgagatttgctccaatctggtgaaaacgcgcaggagagccgttggctggtggaaacgcctctttactttgaaagaagagaaacccaagatgtattttatgaccatgattgtgagcctcgctgctgtagcttgggtcggacagcaggtgcacaacctcctcttgacctacctgatcgtaacatccctcttactcctcccggggctgaaccagcatggcattatcctaaagtatattggaatggccaagcgggagatcaataagctcctcaagcagaaggaaaaaaaaaacgagtag

SEQ ID NO: 40269 - DNA, 468 bp, Artificial Sequence
  Description of Artificial Sequence: Synthetic coding sequence
atgggcgtggtgagcctggtgttcctgatcatctactacctggaccctagcgtcttaagtggcgtgagctgctttgtgatgttcttgtgcttggctgactatctggtaccgattctggcaccccgaattttcgggagtaataagtggacaactgagcaacagcaacgattccacgaaatatgcagtaatctcgtgaagacaagacggcgtgccgtgggctggtggaagcggctatttactcttaaagaggagaaaccgaagatgtacttcatgactatgattgtgagtttggctgctgtagcatgggtgggacagcaggtgcacaatctcctccttacgtacctaatcgttacatccttgctactgttgccagggctgaatcagcatggaatcattttaaaatatatcggaatggccaaacgagaaatcaacaaactgctgaagcaaaaggagaaaaagaatgagtag

SEQ ID NO: 40270 - DNA, 525 bp, Artificial Sequence
  Description of Artificial Sequence: Synthetic coding sequence
atgctgatggccgacaaggtgctgcggtgggagcgggcctggttcccacctgcgattatgggagtcgtgtcattagtgttcctgataatttactacctggatccgtccgtgctgtccggagtttcctgtttcgtgatgttcctttgcctggccgattatctcgtgccaattctggctccccggatcttcggcagcaacaagtggaccacggaacagcagcagcgtttccacgaaatctgttcaaacctggtcaaaacaaggagaagagcggtggggtggtggaagcggttattcacactgaaagaagagaagccaaagatgtactttatgacaatgattgtcagtctcgcagcggtcgcgtgggttggccagcaagtgcacaatctcctgcttacatacctgattgtgacatccctgcttttactgccagggctgaaccagcacggaattatcctcaagtacatcggcatggcgaaacgggagataaacaaactcctgaagcagaaggagaagaagaatgaatag

SEQ ID NO: 40271 - DNA, 561 bp, Artificial Sequence
  Description of Artificial Sequence: Synthetic coding sequence
atgatcgccctgttcaacaagctgctggactggttcaaggccctgttttggaaggaagagatggagctcacactcgtggggctgcagtattccggtaagaccacctttgtaaacgttatcgcctccggccagttcaatgaggacatgattcctaccgtcggttttaatatgagaaagatcaccaaagggaatgtgaccattaagctgtgggacattggtggccagccaagatttagatccatgtgggagagatattgcagaggtgtgtctgcaatagtgtatatggtcgacgcagctgatcaggagaaaatcgaggccagcaaaaatgagctgcacaatctattagataaaccacagctacagggcattcccgtcttagtgttaggaaataaacgtgacttacccggtgcgctggacgagaaggaactgattgaaaagatgaacctaagtgcgatccaggatagggaaatctgctgttacagtatttcctgtaaggagaaagacaatatcgacatcactcttcagtggttgatacagcactccaagtcacgacgctcatag

SEQ ID NO: 40272 - DNA, 561 bp, Artificial Sequence
  Description of Artificial Sequence: Synthetic coding sequence
atgctggccctgatcagccggctgctggactggttccggagcctgttttggaaggaagagatggagctcaccctagtggggctgcagtactctgggaagacaacatttgttaacgtgatcgctagtgggcaattctcagaagacatgatacccacagttggcttcaacatgaggaaagtgaccaagggaaatgttacaatcaagatctgggatattggcgggcagccccgcttcagatctatgtgggagagatactgcaggggagtgaatgccatcgtgtatatgatcgatgctgcagacagagagaagattgaggcctctcggaacgagcttcataacctgctcgataaaccccaactgcagggtatccctgtgctggtgctcggcaacaagagagatctgccaaatgcactggatgagaagcagttaatcgaaaagatgaatctgagcgccatccaggaccgtgagatttgttgctacagcatatcatgtaaagagaaggacaacattgacatcaccctgcagtggctgatccagcattcaaaaagtagaaggtcgtag

SEQ ID NO: 40273 - DNA, 492 bp, Artificial Sequence
  Description of Artificial Sequence: Synthetic coding sequence
atgctggccctgatcagccggctgctggactggttccggagcctgttctggaaagaggagatggagctcacccttgtgggactgcaatatagcggcaagaccactttcgtgaatgtgatcgcatcaggccagttctccgaagacatgatacctacagttggcttcaatatgcgcaaggtgaccaagggaaacgtcaccatcaaaatttgggatatcggggggcagcctcgattcagaagcatgtgggagcgctactgtaggggtgtcaacgcaatagtgtatatgattgacgcagctgatcgggagaaaatcgaggctagcaggaatgagttacataaccttctagataagccacaactccagggtatcccaatctctcacttttccggccttttctccattcaaaacctggaagaggccgaagcctctcctgaagtgttccagagtttcctggccataatcttggaacttctgtcagtgcccctgaaatag

SEQ ID NO: 40274 - DNA, 717 bp, Artificial Sequence
  Description of Artificial Sequence: Synthetic coding sequence
atgatccggagcgccagctgggtgtggctgctgccccccgccggcgtccgaccttgtcgcgccggcgcgccgaggtcccggtggcgggttcgggcagaagcacggtcatgcgggagtaggccttcttcacggccctttagtttgcctgccgcaataatgcttgcactgataagccgactattggactggtttcgttcccttttctggaaggaggagatggaactgactctagtcggcctgcagtactccggcaaaacaacgtttgtaaacgtgatcgcatccggtcagttctcggaagacatgattcccactgttggattcaacatgaggaaggtgaccaaagggaatgtgactatcaaaatatgggatattggtggccaaccccggttcaggagcatgtgggagaggtactgtcgcggagtaaatgccatcgtttatatgatcgacgccgccgatagggaaaaaatcgaggcttctagaaacgagctacataatctattggataaaccgcaacttcagggaattccggttctggttcttgggaataagcgggacctccccaacgccttggatgagaaacagctgatcgagaagatgaacctgagcgccatccaagacagggagatctgctgttactccatatcgtgcaaagaaaaagacaatattgatataactctccaatggcttatccagcacagcaaaagcagaagatcatag

SEQ ID NO: 40275 - DNA, 681 bp, Artificial Sequence
  Description of Artificial Sequence: Synthetic coding sequence
atgagcttcgccgagagcggctggcggagcgccctgcggcggcggggacctggcacgcccgggcctgttgctaggccttcgtactccagtttcactcagggcgacagttggggagagggcgaggttgatgaagaggagggttgcgatcaggttgcccgcgaccttagagccgaattctccgccggagcgtggtctgagcctcggaagagatcagtgcttccgccagatggcaacggtagtcctgtgctacccgacaaacgcaatggcatctttccagccgccgccggatcaagggcacagccacgcagatggcctgtgcaggtgctgagtatattgtgttctctcctcttcgctattctcttggccttcctgctggctatcgcctacctgatcgtgaaggagttgcacgcagagaacttgaagaatgaggatgacgtggataccggcttattgggcttctggacactcctgatcatcagcctcaccgcaggtttcagctgttgtagtttcagttggactgtgacttactttgatagctttgagcccgggatgttccccccaactcccctttctcccgcccggtttaaaaaacttacagggcacagtttccatatgggatactcaatggccattctgaacgggatagtggccgctttgaccgtggcctggtgtctcatgtag

SEQ ID NO: 40276 - DNA, 3492 bp, Artificial Sequence
  Description of Artificial Sequence: Synthetic coding sequence
atgaaccgggaggaccggaacgtgctgcggatgaaggagcgggagcggaggaatcaggaaatccagcagggcgaggacgcattccccccatccagccctctgtttgccgagccctacaaggtaactagtaaggaagataagttatcttcccgtatccagagtatgctagggaactatgatgagatgaaagacttcattggtgatcgtagcattcctaagctggtagctattcccaagccaaccgtacccccttcagcggacgaaaaatcaaaccccaactttttcgagcagcggcacggaggcagccatcagtcatcaaagtggactcctgtaggcccagcccccagtacttcacaatcccagaagaggtcctctggcctccaaagtggccactcctcacagcgcacctctgctgggagttcttctgggaccaacagctcaggccagcggcacgatagagaatcttataacaacagcggctcttcttctagaaaaaagggacagcacggctcagaacatagcaagtctagatcctcctctccaggaaaaccccaagcggtctcgagcctgaactcaagccactccagatcccatgggaatgaccatcacagcaaagaacatcaaagaagtaagagcccccgagatcctgatgccaattgggactcaccatccagagtcccgttttcgagtgggcagcactctactcagtcgttcccacccagtctgatgagcaaaagcaacagcatgttacagaagcccactgcatacgtgaggcccatggatgggcaggaatctatggagccaaaactgtcttctgaacactattcatcacagtcacatggcaactcaatgacagaactcaagccctcttccaaggctcatttaacgaaactcaaaatcccaagccaacctctggacgcatcagcgtccggcgacgtgtcttgcgtcgacgagattttaaaggaaatgacccattcatggccacctccactgactgcaattcataccccttgcaaaacagaacccagcaagtttccttttccaacaaaggagtcccaacagtctaactttggaacaggggaacaaaagcgatataatccctcgaaaacctccaatggccatcaatctaaatcgatgttaaaggatgatctgaaactgtcaagctctgaggactcagatggggaacaagactgtgataaaaccatgcctcggtctacacccgggtcgaatagcgagccgtcccatcacaacagtgagggtgccgataacagccgagacgacagctctagccactctggtagcgaatccagttccggatccgacagcgaatcagagtcctcgtccagcgactccgaggccaatgaaccatcccagagtgcgtctccagaaccagagccccctcccacgaataagtggcagctcgacaactggctgaacaaggtgaacccgcacaaggtaagtcctgcttcatcagtggacagcaatatccctagtagccaggggtacaagaaggagggtcgggagcagggtacgggcaactcctacaccgatactagcggccccaaagaaacgtcaagtgctacccccggcagggactccaaaacaatccagaaaggctctgaaagcgggcggggcaggcagaagtcccctgcacagtccgatagcaccacgcagaggcggacggtcggaaagaaacagccgaagaaggccgaaaaagccgcagcggaggagcctcggggtggtctgaagatcgagtccgaaacccccgtcgacctagcatcgtcaatgccgtcatccaggcataaggccgccaccaagggctcccgcaagccaaatattaagaaagagtcaaaatccagccctcgtcccactgccgagaagaaaaagtataagtctaccagcaaaagctctcagaaaagccgggagatcatagagacggatacctccagctctgattctgatgagtccgaaagcctgcccccttcttctcaaactccgaagtacccagagtcaaataggaccccggtcaaacccagcagcgtcgaggaggaggattccttctttcggcagcggatgttctccccaatggaggaaaaagagctgctgtcccccttatcagagcctgatgaccgataccccctcattgtgaagatcgacctgaacttgctcactcggatcccaggaaaaccttacaaggaaaccgaaccccccaaaggcgaaaagaaaaacgttcccgagaaacacacccgcgaggcacaaaagcaggcatctgaaaaagtttcaaataaaggtaagcgcaaacataagaacgaagatgataaccgtgcaagtgagagtaaaaagcctaagaccgaagataagaactccgccggccacaagcccagttcaaatcgtgaaagttccaagcagtccgctgctaaagagaaagacttactgccatcccctgccggtcccgtcccctcaaaagatcccaaaacggagcacgggtcccgcaagcgcacaatttctcagtccagctccttgaaatcatccagcaattccaataaagaaacaagcggatcctcgaagaacagcagcagcacgagcaagcagaagaagaccgagggtaaaaccagctcttcaagcaaggaggtgaaggagaaggcaccgagttcttcttcgaactgtccgccctccgctccgaccctggacagcagcaaacccagacgcactaagctggtttttgacgatagaaattattcagccgaccattatcttcaggaggccaagaagctgaagcacaatgccgatgccctgtcagatcggttcgaaaaagccgtatactacctggacgctgtggtgtctttcattgagtgtggcaacgccctcgagaaaaatgctcaagaatctaagagccccttcccaatgtatagtgagacggtggacttgatcaagtacacgatgaaactcaagaattaccttgcccccgacgccacagcagccgataaacgccttacagttttgtgtttgcgttgcgaaagcttgctgtacctgaggcttttcaagcttaagaaggaaaacgccctcaaatacagtaaaacactcacagagcatctgaagaacagctataacaacagccaggccccgtctcctggtctcggctcaaaggccgttgggatgccctcgcccgtgtccccgaaactgtctccagggaactccggcaattattcatccggcgcatcatccgcctctgctagcggatctagtgtcactattccacagaaaatccaccaaatggcggcttcctacgtgcaggttacctctaacttcttgtacgcaactgagatatgggaccaagcagagcagctgtccaaagagcagaaggaattttttgctgagctcgataaagtgatggggcccctgatctttaatgcttctattatgactgatcttgtgcggtatacccgccagggtctgcactggctcaggcaagatgcgaagctgatttcttag

SEQ ID NO: 40277 - DNA, 447 bp, Artificial Sequence
  Description of Artificial Sequence: Synthetic coding sequence
atgaaccgggaggaccggaacgtgctgcggatgaaggagcgggagcgccggaaccaagaaatccagcagggtgaagacgcatttccaccctcctcaccactgttcgcagaaccctataaggtgacatctaaagaggataagctcagtagtcggatccagtccatgctgggtaattacgatgagatgaaggacttcattggtgatcgcagtatcccaaaactcgtggcgatccccaaacctactgtccctccaagtgcagacgagaaaagcaaccctaatttcttcgagcaacgacacgggggctctcaccagagtagcaaatggacaccagtcggtccagctcctagcaccagtcagagccagaagaggagttccggccttcaatccggacatagctctcagcgcaccagtgcgggttctagttcaggaacgaacagctcggggtag

SEQ ID NO: 40278 - DNA, 1059 bp, Artificial Sequence
  Description of Artificial Sequence: Synthetic coding sequence
atgctgcggctgctggccagcggctgcgcccggggccccggccccggggtgggagctcgccccgcagccggcctgtttcatccagggcgcagacagagccgccaagcgagcgatgctccgcgcaatcagcctcctagtccagaatttgtggccagaccagtgggcgtctgtagcatgatgaggttgccagtgcagacaagcccggaaggcctagacgctgctttcattggcgtccccctggacactgggactagcaaccgcccaggagcacgattcggaccccgcaggatccgggaggaatccgtgatgctgggcacagtgaacccctctacgggcgcactgcccttccagtccctgatggtcgccgatctgggggacgtcaatgtgaatctctacaacctgcaggatagctgccgccgcatacaggaggcctatgaaaaaatagtcgccgccgggtgcattcctctgaccctgggaggtgatcacactatcacctacccgatcctgcaggcgatggccaagaagcatggccccgttggtcttttgcatgtggacgcacatactgatactacagacaaagcgctgggagaaaaactctaccacggagcgccatttcggaggtgtgtggatgaggggctgctcgattgtaagagggttgtgcagatcggtatacgggggagctccactaccctggatccctaccgctataatcggtctcaggggtttagagttgtgctagccgaggattgttggatgaaatctttagtgcccctaatgggcgaagttcggcagcagatgggtggaaagcccatctacatcagctttgatattgacgccctggaccctgcctacgcccctggcaccggaaccccggagatcgctggcttaacgccatctcaagctctggagattattaggggctgtcagggactaaatgttatgggctgcgacctcgtcgaagtgagccccccgtatgacctaagcgggaacacggcccttttggctgccaatctcttgttcgaaatgctctgcgctctccccaaggtgacaacagtctag

SEQ ID NO: 40279 - DNA, 1617 bp, Artificial Sequence
  Description of Artificial Sequence: Synthetic coding sequence
atggagcggctgggcgagaaggccagccggctgctggagaagttcggacgaagaaaaggcgaaagcagccggtccgggtcagacggtacacccgggcccggcaaaggcaggctgagcggcttggggggcccccgaaaaagcgggccgagaggtgctaccgggggcccaggtgacgagccgctggagcctgctcgcgaacaggggtctctcgacgcagagcgaaatcagagaggctcattcgaagcacccaggtatgaggggagcttccccgctggcccacctcccacaagggctctgcctttgccgcagagcctgcctccagactttcgactcgaaccgactgcgccggcgctgtccccaaggagtagttttgcatcaagctctgcctccgacgcatctaagccatcatctccccgtggctccttactcctcgatggagcgggcgccggcggtgctggggggagtagaccttgttctaaccgaacatcgggcatttcaatgggctatgatcagcgtcacggctctcccctgcctgctgggccctgtctgtttgggccgccccttgcgggggcacccgccggatactcccccggtggcgtccctagtgcgtatccagagctacacgccgcacttgacaggctctatgctcagagacccgctgggttcgggtgccaggaatcccgacactcgtaccctcctgcgctgggctctcctggggcattggccggagcaggcgtcggcgcagccggcccactggaacggcgcggtgcacagccgggaagacattccgtgaccggttacggagactgtgccgtaggagctaggtaccaggacgaactaactgctctcctgcgtctgaccgtcggtacaggcgggcgcgaggccggggctcgcggcgagcctagtgggatagagccttcaggcttggaagagccccccggtcctttcgtcccagaagccgccagagctaggatgagagagcccgaagcaagagaagattatttcggtacttgtataaaatgcaacaaaggcatttacgggcagtcgaacgcgtgccaggcactggatagtctgtatcacactcaatgtttcgtgtgttgcagttgcggccggacactgaggtgtaaagccttctatagcgtgaacggatccgtgtactgcgaggaggattatctcttctctgggttccaggaagctgccgaaaagtgctgcgtttgtggacatctgatcctcgagaaaatcctccaggcgatggggaaatcctaccacccaggttgtttccggtgcatcgtctgcaataagtgccttgatggaattcccttcacagtggatttttcaaaccaggtatactgcgttacggattatcacaaaaattacgctcctaaatgcgctgcatgtggccagccgattctcccgagtgaaggctgcgaggacatcgtgagggtaatttctatggatagagactaccactttgaatgctaccattgtgaggactgtcgaatgcagctatcagatgaagaggggtgctgttgtttccccctcgacggccatctgctgtgccacgggtgccatatgcagagactgaatgctagacaacctcctgcaaactacatttag

SEQ ID NO: 40280 - DNA, 1617 bp, Artificial Sequence
  Description of Artificial Sequence: Synthetic coding sequence
atggagcggctgggcgagaaggccagccggctgctggagaagttcggccggcgcaaaggtgagagcagccggagcggatccgacgggacgccgggacctgggaagggccgcctgtccggcctgggcggacctcgcaagtctggaccacggggcgccactggcgggccgggggacgaacccctggagcccgccagagagcaaggtagcttggacgctgaacgcaaccagcgcggttccttcgaggctcctcggtatgaaggcagtttccccgctggcccccccccaacaagagcactgcccctccctcagtcattgcctcctgacttccggctggagcctacagccccagccctcagtccacggtcttctttcgcttccagctcagctagcgatgccagtaaaccttcctcacctagaggttcactcctcctggacggagccggagctgggggagcgggagggagtagaccctgcagtaatcgcaccagtgggatatcgatgggatacgaccagcgacatggctcccctctacctgccggtccatgcctcttcggaccgcccctggccggcgcaccagctggctactcacctggcggagtaccgagtgcttacccagaactacacgctgcgctggaccgcctgtatgcccagagacccgcgggcttcgggtgtcaggagagccgacactcatacccacccgcactcggtagtcccggagccttggccggggcgggagtaggggctgctggtccacttgaacggaggggggcccagccagggcgtcatagcgtaaccggctacggcgactgcgccgtgggggcgcgctatcaagatgagctcactgccttgctccgcctgacggtagggactggagggcgggaggccggggctcggggggagcctagtgggatcgaacctagtgggttggaggaaccccctggcccattcgtccccgaagctgcaagggcacgaatgagggagccggaagcccgggaggattacttcggaacatgtattaagtgcaataagggtatatacggccagtccaacgcctgccaggccctcgacagcctctatcacacccagtgtttcgtgtgttgttcttgtggacggacgttgaggtgcaaggctttctattcagttaatggcagtgtttattgtgaggaggattatctcttttccgggtttcaggaagcagcagagaaatgctgtgtgtgtggacatctgatcctcgagaaaattcttcaggcaatgggaaaatcttaccatcctgggtgctttagatgtattgtttgcaataagtgtctcgacgggatcccatttacagtcgatttcagcaaccaggtttattgcgttactgactaccacaaaaattatgcacctaaatgcgctgcttgtgggcagcctatcctccctagcgagggctgcgaagatatagtcagggtaattagtatggatagggattatcactttgagtgctaccattgcgaggactgcagaatgcaactatccgatgaggagggctgctgctgcttccctttggatggccatctgttatgtcacggctgccatatgcagcgactgaacgcgaggcagccacccgccaattacatatag

SEQ ID NO: 40281 - DNA, 366 bp, Artificial Sequence
  Description of Artificial Sequence: Synthetic coding sequence
atgggcaagagctaccaccccggctgcttccggtgcatcgtgtgcaataagtgtctggacgggatacccttcacggtggactttagcaatcaagtatactgcgtaactgattaccacaagaattatgcccccaagtgcgctgcctgtggtcagcccatccttccaagcgaaggctgcgaggacatagtccgtgtcatctccatggatcgcgattaccacttcgagtgctatcactgcgaagactgccgcatgcagttgagcgacgaagaggggtgctgttgcttccccctggatggacatctcctatgtcacggatgtcatatgcagaggctcaacgcgcgccaaccccctgcaaattatatttag

SEQ ID NO: 40282 - DNA, 243 bp, Artificial Sequence
  Description of Artificial Sequence: Synthetic coding sequence
atgggcaagagctaccaccccggctgcttccggtgcatcgtgtgcaataagtgtttagacggtattccattcactgtggacttctccaaccaggtgtactgtgtgactgattaccacaagaactatgcccccaaatgcgcagcgtgtgggcagccgatcttgccatcggaggggtgcgaggatatcgtgcgagtcatctctatggatcgcgattatcacttcgagtgttatcactgtgaatag

SEQ ID NO: 40283 - DNA, 198 bp, Artificial Sequence
  Description of Artificial Sequence: Synthetic coding sequence
atgggcaagagctaccaccccggctgcttccggtgcatcgtgtgcaacaaatgcttggatggaattccgtttaccgtggacttttccaatcaggtttattgcgtgactgactaccacaagaattacgcccctaagtgtgccgcatgtggccagcccattctgcccagcgaggggtgcgaagacatcgtcagagtttag

SEQ ID NO: 40284 - DNA, 243 bp, Artificial Sequence
  Description of Artificial Sequence: Synthetic coding sequence
atgggcaagagctaccaccccggctgcttccggtgcatcgtgtgcaacaaatgcctggacggaatcccattcaccgtcgatttttcgaatcaggtttactgtgtcacagattaccacaagaattatgctcccaagtgcgcagcgtgcggtcagccaattttgccatccgagggttgtgaggacatcgtgcgtgtgatctcgatggaccgcgactatcatttcgagtgctatcattgcgagtag

SEQ ID NO: 40285 - DNA, 309 bp, Artificial Sequence
  Description of Artificial Sequence: Synthetic coding sequence
atggccaacacccagctggaccacctgcactacaccaccgagttcactcgtaatgatttgcttatcatttgtaaaaagtttaacctgatgcttatggatgaagatattatcagcttactcgctatcttcataaagatgtgtctgtggctctggaaacagtttctgaaaagagggagcaaatgctctgaaacatcagaactgcttgagaaggttaagctgcagctcgccttcactgcatataaatatgtggatatctgtttccctgaacaaatggcttattctcgttacatcaggtggtacatccactag

SEQ ID NO: 40286 - DNA, 1500 bp, Artificial Sequence
  Description of Artificial Sequence: Synthetic coding sequence
atgtgcgagctgtacagcaagcgggacaccctgggcctgcggaagaagcacattggtccctcatgcaaggtcttttttgcctccgatcctattaagattgtgagggcccagcgtcagtatatgttcgatgagaacggggaacagtacctagattgtattaacaatgtggctcatgtgggccattgtcatcctggggtcgtgaaggcggcattaaagcaaatggagctcctgaacacaaactcccgattcctacacgataatatagtggaatatgctaagcggctgtctgcaacactgcccgagaagttaagtgtttgctattttacaaatagtggtagcgaggccaatgacctggcactaaggctcgctcggcaattcagaggtcatcaggacgtgatcactcttgatcatgcctaccatggccacctctcctcattaatcgaaatcagcccatacaaattccagaagggaaaggacgtgaagaaagaattcgtccatgtggcccccaccccggatacgtatagaggaaaataccgggaagaccatgcagattccgcctcagcttacgctgacgaggtcaagaagatcatcgaggacgcacataactcaggccgcaagatcgctgcctttatcgccgagtcaatgcagtcatgcggtgggcagattatcccacccgccggctacttccagaaggtggcagaatatgtgcacggcgctggcggagtgttcattgccgacgaagtacaagtagggttcggacgggtaggcaagcatttttggagcttccagatgtatggggaagacttcgtgccggatatcgtaaccatgggaaaaccaatggggaatggtcatccagtggcctgtgtcgtgacaacaaaagaaatcgctgaagctttcagtagctccggtatggagtattttaacacttacggcgggaatcctgtctcgtgcgcggttgggctggcagttctggacatcatcgagaatgaggatcttcaaggcaatgcaaaacgagtcgggaactatctgactgagctgttaaaaaagcaaaaggccaaacataccctgattggggatatcaggggaattggccttttcataggaatcgacctagttaaagaccatttgaaacggaccccggcaaccgccgaggcccagcacattatctataagatgaaggagaagcgggtgctactgtcagctgacggaccccatagaaacgtcctaaagattaagcctccgatgtgcttcaccgaggaagacgctaagttcatggttgaccaattggataggattctgacggtgctggaggaagccatgggcactaaaacagagtcagtcacgtcagaaaacactccttgcaagacaaaaatgctgaaagaagcccacatcgagctgcttcgggactcaactacagactcgaaggagaaccctagcaggaagcgcaatggcatgtgcacggacacgcattcactcctgtcaaagcgcctcaaaacgtag

SEQ ID NO: 40287 - DNA, 1482 bp, Artificial Sequence
  Description of Artificial Sequence: Synthetic coding sequence
atgtgcgagctgtacagcaagcgggacaccctgggcctgcggaagaagcatatcggccccagctgcaaggtattcttcgcctcagatccaataaaaattgtgcgagcccagagacaatacatgtttgacgaaaatggcgagcagtacctggattgcattaataatgtagcccacggcgtagtgaaagccgccttgaaacagatggaattactcaacactaacagccgctttctacacgacaatatcgtcgagtatgccaaacgcctgtccgctactttgcccgagaagctgtcagtgtgttattttaccaattccggatcagaggccaacgacctggcacttcgcttggccagacagttccgcggccatcaggatgttatcacacttgaccacgcctaccacgggcatttatcaagcctgatcgagataagtccatacaaattccagaagggcaaagacgtgaaaaaggagtttgtccacgtagctcctactcccgacacgtaccggggaaaataccgggaggatcatgccgactccgcgtctgcatacgctgacgaagtgaaaaagatcattgaggacgctcataactccggccgcaagattgcagcctttattgccgagtccatgcagagttgtggagggcaaatcatcccccctgctggctatttccagaaagtcgctgagtatgtgcatggtgccggcggggttttcatcgccgatgaggtccaagtcgggttcgggcgagtcgggaagcacttctggagctttcagatgtacggagaggattttgtgccagatatcgttactatgggtaaaccaatgggaaatggccatccggtggcctgtgtcgtgaccacaaaggagatcgcagaagctttctctagttcgggaatggaatatttcaatacttacggcggtaaccccgtctcctgtgccgtgggtctggctgtgctggatattatagagaatgaagatctgcagggaaacgctaagcgcgtgggaaactatttgaccgaactgctcaagaagcaaaaggcgaagcacactctgataggcgatatccgagggatcggactgttcataggaattgacctcgtcaaggatcacctgaagcgaacgcctgctactgcggaagcccagcatattatctataaaatgaaggagaaacgagttctgctgagcgcggacggccctcaccgaaacgtgctgaagattaaacctcctatgtgcttcactgaggaagacgccaagttcatggtggatcagctggatcgtattttaactgttcttgaggaagccatgggcacaaaaacagaatcggtcacaagtgaaaacacaccttgtaagaccaaaatgctgaaagaggctcatatcgaactattaagggacagtactaccgattctaaggagaatcccagcaggaaacggaacggaatgtgcaccgatacacattctctcctttctaagcggttaaaaacctag

SEQ ID NO: 40288 - DNA, 1326 bp, Artificial Sequence
  Description of Artificial Sequence: Synthetic coding sequence
atgggccactgccaccccggcgtggtgaaggccgccctgaagcagatggaacttttaaataccaattccaggttcctgcacgacaacattgtggagtacgccaaacgcttgtccgcgacgttgcctgagaagctgtctgtgtgctattttaccaactccggaagcgaagccaacgacctggctttacgccttgctcgccagttccgcggtcaccaggatgtgatcacactcgaccacgcctaccacggacacctgagctcactgatcgaaatctcaccctataagttccagaagggaaaagatgttaaaaaggagtttgtccatgtagcccctacccccgacacttaccgtggcaaatacagagaggatcacgctgattccgccagtgcttacgctgacgaagtgaagaagatcatagaggacgcacataatagcggacgcaagatcgctgcgttcatcgctgagagcatgcagagctgcggaggtcagatcattccccctgcagggtacttccagaaggttgccgaatacgtgcacggggcaggcggtgtttttatcgcagatgaagtgcaggttggttttgggagggtgggtaaacatttctggtcctttcagatgtacggtgaggattttgttccagacatcgtcaccatggggaaacccatggggaatgggcaccctgttgcgtgcgtggtcaccactaaagaaatcgctgaagccttctcaagtagcggaatggaatatttcaatacttatgggggaaatccggtctcttgcgccgtgggtctggcagttctggatattattgagaatgaagatctgcaaggaaacgccaagcgggttgggaactacctcacggagctcctgaaaaagcaaaaggctaaacataccctgattggagacatccggggcatcggactcttcatcgggatcgatctggtgaaggaccacctgaagcgtacacctgcgacggcggaagctcagcatatcatttataagatgaaagagaaacgggtgttgcttagtgcagatggtccacatcgcaacgtcctcaagataaagccaccaatgtgttttacagaggaagatgcaaaatttatggtggatcagctggacaggatcctcactgtacttgaggaggccatgggcaccaaaaccgagtccgtgacctcagaaaatacaccttgtaagactaagatgctaaaagaggcccacatcgaattactcagagatagcacaacagactcaaaagaaaacccatctagaaagcgcaatggaatgtgtaccgacacccactctctgttgagtaaaaggctgaagacttag

SEQ ID NO: 40289 - DNA, 1353 bp, Artificial Sequence
  Description of Artificial Sequence: Synthetic coding sequence
atggccgccgaccagcggcccaaggccgacaccctggccctgcggcagagacttatctcaagttcctgccggctcttttttccagaagaccctgtgaaaatcgttcgcgcccagggacaatatatgtatgatgagcagggagctgagtatatcgattgtataagcaatgttgctcacgttggtcactgtcatccgctcgtggtacaggcagctcacgagcagaaccaggttctgaacacaaactcgcggtacttgcacgacaatatcgtggactatgcacagcgcctgtcggagaccttacctgaacaactctgtgtgttctacttcttgaactccggaagcgaggccaacgatctggccctgaggctcgcccggcactatactggacaccaagatgtagtggtcctggatcacgcctaccatggacacctgtcctctctcatcgatatcagcccttacaagttccggaacctggacggccagaaagagtgggtgcatgtcgcccccctcccagatacgtatcggggcccatatcgggaagatcatccaaaccccgccatggcatatgcgaacgaggttaaaagagtagtgtctagtgcccaagagaaaggtagaaaaatagcagcatttttcgcagagtctctgcccagcgtggggggccagatcataccgcccgccggctacttctctcaggtggccgagcacattcgcaaggcagggggggtgttcgtcgcggatgaaatccaggtgggcttcggccgcgtgggcaagcacttttgggcctttcagctccagggcaaggatttcgtccccgatatagtgacgatgggcaaaagcatcggaaatggccaccccgtggcctgcgttgctgccacacaaccagtggcacgcgcatttgaggccaccggtgtggaatatttcaacaccttcgggggttcccctgtaagttgcgcagttggcctcgcggtgttgaatgtcctggagaaagaacagctgcaggatcacgctacaagtgtggggtcgtttctcatgcagctcctgggacagcagaaaatcaagcatccaattgtgggcgatgtgcgcggggtgggcctgttcattggggtcgatctgatcaaggatgaggcgaccagaacaccagccacagaagaagccgcttatttggtttctcgactaaaagagaactacgtcttgctgagcaccgatggccccggcagaaacatcctgaagtttaagccacccatgtgtttcagtttggataatgccaggcaggtggtcgccaagttggacgccattctgaccgacatggaagaaaaagtgagaagctgtgagaccttaagattgcagccttag

SEQ ID NO: 40290 - DNA, 519 bp, Artificial Sequence
  Description of Artificial Sequence: Synthetic coding sequence
atgatctacagctgctgcatcttcgtgtactgcatgttcgagtgcttcaagatcaagaatagcgtcaactatcatttgctattcacccttgtgctgttctcactgatagtgaccactgtgtacctgaaggtaaaggagcccatctttcaccaggtgatgtacggtatgctggtttttactctcgtgctcaggagcatctatattgtcacttgggtgtacccatggctgagaggactcggatacacaagcctgggtattttcttactgggatttcttttctggaacatagacaatatattctgcgaatcactgcggaactttagaaagaaagtacctcccataattggaatcacaacccagtttcatgcatggtggcatatcctcaccgggctgggttcctacctacacattctattttcactgtatacacgcactctgtacctgcgttaccgcccaaaggtgaaatttttatttggtatctggcccgtgatactgttcgagccccttcgtaagcactag

SEQ ID NO: 40291 - DNA, 804 bp, Artificial Sequence
  Description of Artificial Sequence: Synthetic coding sequence
atggcccccgccgccgaccgggagggctactggggccccaccaccagcaccctggattggtgtgaagagaactactctgtaacatggtatattgctgagttctggaatactgtgagcaaccttatcatgataattccccccatgtttggcgcggttcagagtgtgcgcgatggactcgagaaacgttatattgcatcctatctggcgctgactgtcgtgggtatgggttcgtggtgctttcacatgaccctcaagtacgaaatgcagttgttagatgaactacctatgatttattcttgctgtatattcgtgtactgcatgtttgagtgctttaaaattaaaaattctgttaattatcacctgctttttactctggtactgttttcgctcattgtgaccacagtctacctgaaggtgaaagaaccgatattccaccaggttatgtacggaatgctggtcttcactctcgtactgcgctcaatatacatcgtcacctgggtctacccatggcttagagggcttggctacacttcgctgggaatattcctactgggcttcctattttggaatattgataatatcttttgtgaatccctgagaaattttcgcaaaaaagtgcctccgattattggcattactacccagttccacgcgtggtggcacatccttaccggtttaggctcgtacctccatattctttttagtctatacacccggaccctatacttaagatacagacccaaggtgaagttcttgttcggcatctggcccgttattctgttcgagccgctgagaaagcactag

SEQ ID NO: 40292 - DNA, 693 bp, Artificial Sequence
  Description of Artificial Sequence: Synthetic coding sequence
atggcccccgccgccgaccgggagggctactggggccccaccaccagtaccctcgactggtgcgaggagaactattcagtgacatggtacattgccgagtttttggtaggtatgggatcctggtgcttccacatgacattaaagtacgagatgcagctactggacgaactgccaatgatttattcgtgctgcatttttgtctactgtatgttcgaatgtttcaaaatcaaaaattctgtaaactaccacctccttttcaccctcgtcctctttagcctgatagtgactaccgtgtacttgaaggtcaaagagccaatctttcatcaggtgatgtacggcatgcttgtgtttactcttgtcctacggtcaatatatatcgtcacctgggtctacccttggttgagaggccttggttatacatcacttgggatcttccttctaggcttcctgttctggaacattgataatattttttgcgagtcactgagaaactttcgcaaaaaggtccctcctattatcggtatcacaacccagttccacgcgtggtggcacatcttaactggcctggggtcttatctacatattcttttctctctctatactaggactctttatctgcgataccggcccaaggttaagttcctgtttggtatatggccagtgattctcttcgaaccactgagaaagcattag

SEQ ID NO: 40293 - DNA, 678 bp, Artificial Sequence
  Description of Artificial Sequence: Synthetic coding sequence
atgatcatcccccccatgttcggcgccgtgcagagcgtgcgggacggcctcgaaaagaggtatatcgcttcatatctagccttgactgtggtgggtatgggttcctggtgctttcacatgacattaaaatacgagatgcagctcctagacgagttgccgatgatttatagttgctgtatatttgtgtattgtatgttcgaatgcttcaaaatcaagaacagtgtcaattaccacctccttttcaccctggttctcttcagtctgatcgtgactacggtctatctgaaggtaaaagagccgatcttccatcaggtaatgtacgggatgttggtgtttaccctggtcctacgcagtatctacattgtgacatgggtatacccgtggctcagaggacttggctacacttcactcgggatttttttgctcggcttcctgttctggaacatcgacaatatcttctgcgagagcctcaggaatttccgtaagaaagtgccacctattattggaattactacccagttccacgcatggtggcatatactgaccggtctcggatcctacctgcacattctgtttagcttgtacaccagaactttgtatctgagataccggccgaaagtgaagtttctgttcggtatttggccagtaatcttatttgagccgctccgaaaacactag

SEQ ID NO: 40294 - DNA, 405 bp, Artificial Sequence
  Description of Artificial Sequence: Synthetic coding sequence
atggcccagagccggctgatcggcaccagcaccagccaggtgatgtacggcatgcttgtttttactcttgttctgcgcagcatatatatcgtgacctgggtttacccttggctaagaggacttggttacacctccctcggtatcttccttcttggctttttgttttggaacatcgataacattttctgcgagtcactgaggaactttaggaagaaggtacctccaattattggaatcaccacccagttccacgcttggtggcacatactgacagggctcggatcatatctgcatatcctcttctcgctgtatacccgcaccttgtacctccgatatcgaccgaaggtgaagtttttgtttggaatttggcctgtcattctgttcgaaccccttagaaaacactag

SEQ ID NO: 40295 - DNA, 453 bp, Artificial Sequence
  Description of Artificial Sequence: Synthetic coding sequence
atgagcggcgagctgagcaaccggttccagggcggcaaggccttcggattacttaaggcaaggcaggaaaggcgccttgctgagatcaatcgtgaattcttgtgcgaccaaaagtactcagacgaagagaaccttcctgaaaaattgaccgccttcaaggagaagtatatggagttcgatctgaataacgagggggagattgatctgatgtctttgaagcggatgatggagaagctgggtgtccctaaaacacacctggagatgaagaagatgatatctgaggtgactggtggggttagcgacaccattagctacagggactttgtgaacatgatgctcggaaagcgtagtgctgtgctgaaactggttatgatgtttgaaggaaaagcaaacgagtcttctccaaagccggtcggacctccacctgagcgcgatattgcctctctcccctag

SEQ ID NO: 40296 - DNA, 309 bp, Artificial Sequence
  Description of Artificial Sequence: Synthetic coding sequence
atgagcggcgagctgagcaaccggttccagggcggcaaggccttcggactgcttaaggctaggcaagaaaggagactggccgagattaatagggagttcctctgcgaccagaagtacagcgacgaggagaatctccctgaaaagcttaccgcctttaaagaaaagtacatggagtttgacctgaacaatgaaggagaaatcgacctaatgagcctgaaaaggatgatggaaaaactgggagtaccaaagacccatctggaaatgaaaaaaatgatcagtgaggtcacggggggaagtcatgatgtgtag

SEQ ID NO: 40297 - DNA, 285 bp, Artificial Sequence
  Description of Artificial Sequence: Synthetic coding sequence
atggagttcgacctgaacaacgagggcgagatcgacctgatgagcttgaagaggatgatggagaagctcggggtacccaagacgcacttggagatgaaaaaaatgatcagcgaagtaaccggtggggtgagcgacactattagctatagggatttcgtaaatatgatgctgggaaagcgtagcgctgtgctgaagctggtaatgatgttcgaaggtaaggcgaatgaatcatccccaaagcccgtgggtccacctccggaaagggacatcgcatctctcccatag

SEQ ID NO: 40298 - DNA, 429 bp, Artificial Sequence
  Description of Artificial Sequence: Synthetic coding sequence
atgagcggcgagctgagcaaccggttccagggcggcaaggccttcggactgttgaaggccagacaggagcgcagactcgccgaaattaatagggaattcctatgtgaccagaagtatagcgacgaagagaatctgcccgaaaaattaaccgctttcaaggagaagtatatggaatttgacctgatgtctctgaagagaatgatggaaaagctaggagtacccaagacccacctggagatgaaaaagatgatttctgaagtgactggcggggtgtcagatacaatttcctaccgtgacttcgtcaatatgatgcttgggaagaggtctgctgtgctgaaattggtcatgatgtttgaaggaaaagctaatgagagcagtccaaagcccgtcggccctcctccagaaagggacatcgccagcctgccatag

SEQ ID NO: 40299 - DNA, 531 bp, Artificial Sequence
  Description of Artificial Sequence: Synthetic coding sequence
atgagcggcgagctgagcaaccggttccagggcggcaaggccttcgggctgctaaaagcccgccaagaaaggcggctagccgagatcaatcggtattgcgccggaagggaaccccaactgcagcgcatctcatgtagtcagcattcttgcctgctggcgctgctcttccaggagtttctctgcgatcagaagtactcggacgaagaaaacctgcctgaaaagctgacggcattcaaggagaaatatatggagttcgacctgaacaatgaaggcgagatcgacctgatgtccctaaagcggatgatggagaaactgggcgtgccaaagacacatttagagatgaaaaaaatgatttcggaagtaaccggcggcgtctctgatacgatttcctatcgcgattttgtgaatatgatgctcggtaagcgctcagcggtgctcaagttggtgatgatgtttgagggcaaggctaatgaatcaagcccgaaaccggtcggacctcccccagaacgtgatattgcatcattgccatag

SEQ ID NO: 40300 - DNA, 468 bp, Artificial Sequence
  Description of Artificial Sequence: Synthetic coding sequence
atggccagcaagatggtgatcagcgcccaccccaagatcctgctgcagcttattcagaaagataagcctggcggacctggagccagagtaaggcaaaaggtgctggaagagtttctgtgcgaccagaagtactcggatgaggaaaacctgcccgagaagctgacagctttcaaagagaaatatatggagttcgatctgaacaacgaaggagagatagacttgatgtcacttaaaaggatgatggagaagcttggcgtgccaaaaacccacttggagatgaagaagatgatatctgaagtcacagggggcgtctctgacaccattagctacagggactttgtgaatatgatgttaggaaaaagatccgcagttttgaaattagtcatgatgttcgagggtaaggccaacgaatcctctccaaaacccgtggggccaccaccagaacgcgacatcgcgtcactaccgtag

SEQ ID NO: 40301 - DNA, 1023 bp, Artificial Sequence
  Description of Artificial Sequence: Synthetic coding sequence
atgcggaaggagctgcagctgagcctgagcgtgaccctgctgctggtgtgcggcttcttataccagttcacactgaaatcatcttgtctgttctgtctccccagcttcaagagccatcaggggctagaagccttacttagccacaggcgcggtatcgtgtttctggaaacatccgagaggatggaaccgcctcatctcgtgtcctgtagtgtggaatctgcagccaaaatttaccccgaatggcccgtggtgtttttcatgaaaggtctcacagactctacacccatgccatcaaatagtacttacccagcatttagctttttatcagctatcgataatgtgttcctgttcccccttgatatgaaaaggctccttgaggatactccccttttctcatggtacaaccagattaacgcaagtgccgagaggaactggttgcatatttcttccgatgcaagtcgattggctattatttggaaatacggaggaatctacatggatacagatgtgatatccatccggcccatccctgaagagaattttctggctgctcaagcctccaggtatagctctaatggaatcttcggatttctcccacatcatcccttcctgtgggagtgcatggaaaatttcgtggaacactataattcagccatctggggaaatcagggtcccgagctaatgacgagaatgctccgcgtctggtgtaagctggaggacttccaggaagtgagcgacctgcgatgtcttaacatctcatttttgcaccctcagcgcttttaccccatctcctatagggagtggcgcagatactatgaagtgtgggatactgaacccagcttcaatgtcagctacgctctacatctttggaaccatatgaatcaggaaggtcgtgcagtgatacgggggtctaacacgctcgtagagaacctctaccgcaaacattgcccacgcacatatcgggatctcataaaaggacctgagggctccgttactggcgaactggggcccgggaataagtag

SEQ ID NO: 40302 - DNA, 1518 bp, Artificial Sequence
  Description of Artificial Sequence: Synthetic coding sequence
atggagcagaccgagaagagcaaggtgtacgccgagaacggcctgctcgagaaaattaaactgtgcttgtccaaaaagcccctgccctcccccacagagcgaaaaaagttcgatcatgattttgccatctctacatcatttcatggcattcataatatcgtacagaatagatccaaaatccggagagttctgtggctcgtagtggtcctcggctccgtgtcactagtaacatggcagatctatatccggttgctgaactacttcacttggccgacaacaaccagcattgaagtgcagtatgtggaaaaaatggagttccctgcggtgacattctgtaacctgaataggttccagacagacgccgttgccaagttcggcgtgatattcttcctatggcatattgttagcaaagtgctgcacctgcaagaaatcactgccaattctacagggtcaagggaagcgacggacttcgccgcttcccaccagaatttcagcatcgttgagtttatccggaacaaaggcttttacctaaacaatagcactctgttggactgtgagttttttgggaaaccatgttctcccaaggactttgcacacgtgttcaccgagtatggcaactgcttcacctttaaccacggcgagaccctccaggcaaaacgaaaggtcagcgtgtctggcaggggcctatctctcctgttcaacgtgaaccaggaagcgtttacggataacccagccctgggcttcgtcgatgcagggattatcttcgtgattcactccccgaaaaaagtcccacagttcgacggtcttggcctgctctctccggtgggaatgcacgctagggtgaccattcgccaggtcaaaacggttcatcaggagtacccttggggggaatgcaaccccaacatcaagctgcagaacttttcgtcttacagcacctctggctgtctgaaggagtgcaaagctcagcatataaaaaagcaatgcggctgtgttccctttctactaccggggtacggaatcgaatgcgacctgcagaagtacttttcatgcgtgagccctgtgcttgatcatatcgaattcaaggatctgtgtacagttgggacgcataatagcagctgtcctgtctcctgcgaggaaatcgaataccctgcaacaatcagttacagctcatttccttctcagaaagctctgaagtaccttagcaagaagctaaatcagagtcgtaagtacatcagggaaaacctcgtcaagatagaaattaactattccgatttgaattataagattactcagcagcagaaggccgtatctgtgtctgagttactggccgaccttggtggccagcttggcctcttctgcggagccagcctcatcaccatcatcgaaattatcgagtatctgtttacaaatttttactggatctgcatttttttcctcctgaagatctccgagatgacgcagtggacgccacccccacagaatcaccttgggaataaaaaccggatcgaggagtgctag

SEQ ID NO: 40303 - DNA, 2973 bp, Artificial Sequence
  Description of Artificial Sequence: Synthetic coding sequence
atgggcccccccagcagcagcggcttctacgtgagccgggccgtggcccttttgttagcaggtctcgtggccgcacttctcttagccctggctgtgctggccgctctgtacggacactgcgaacgagtgcctccctccgaactcccgggcctccgggatcttgaagcagagagctcccctcctctccggcagaaacctactcccacacccaaaccgagctctgctagagagctcgcggtcacaactaccccaagtaactggcgcccaccaggtccttgggatcaacttaggctgccaccatggctcgtgccactccactacgacctggaactttggccacagctgagacctgacgaactgccagcaggcagcctgccatttacggggagggtgaatatcaccgtgcgttgcactgtggcaacctcccgactgttattacacagcctgtttcaagattgcgagcgggcagaagtgcggggaccgttaagcccaggcacggggaacgcgacagtggggagagttcccgtggacgatgtatggttcgcactggatacggagtatatggtgctggaactgagcgaacctctgaagcccggtagctcctatgagttgcagctaagcttttctggtctagtgaaagaggacttacgggagggactcttcctgaatgtgtatactgatcagggtgaaaggagggccctgctagcatcccagttggagcctacatttgccagatatgtgttcccgtgcttcgacgagccagcgctgaaagctacattcaatataactatgatccaccacccgtcttatgtggctctcagcaacatgcccaaattgggtcagtcggagaaggaagatgtgaatggcagtaagtggacagtgactaccttttctaccacccctcacatgccaacctacttggtcgccttcgtaatctgcgactacgaccatgtgaatcggactgaacgaggcaaagaaatcaggatctgggcccggaaggacgccatcgcgaacggcagcgccgattttgcgcttaatatcaccggacctatattttcgtttttggaggatcttttcaacatctcatatagccttccaaaaaccgacatcatagcccttccaagtttcgataatcatgcgatggagaactggggtttgatgattttcgatgagagtggactactcctggagccaaaggatcaactgaccgagaagaaaactctcatctcctacgtggtttcacacgaaatcggccaccagtggttcgggaatctggtcaccatgaactggtggaacaacatctggctaaatgaagggttcgcctcctatttcgagttcgaagtgattaactatttcaacccaaaattgcccagaaatgagatctttttttccaacatcttacacaatatccttcgtgaagaccacgccctggtcacccgggccgtggctatgaaagtggaaaactttaagacctctgaaatacaagaactctttgacatcttcacctactccaagggggccagtatggctaggatgttaagttgttttctgaatgagcatctgtttgtgagtgccctgaaatcctacctcaagactttttcttactctaatgcagagcaggacgacctgtggaggcacttccagatggctattgacgaccagagtaccgtgatcctgcccgcgacgatcaaaaatattatggacagctggactcaccagtcaggctttccggtgatcaccctgaacgtctctacgggagtgatgaagcaggaacccttctatctagagaacattaagaataggaccttgctcacaagtaatgacacgtggattgtgcctattctctggatcaagaacgggacgacacaacctctggtttggctggaccaaagctcaaaagttttcccagagatgcaggtgtccgattccgaccacgattgggtcattcttaacttgaatatgacaggatactatcgggtcaattacgacaaactgggttggaaaaagctaaaccagcagcttgagaaggaccctaaagcaatccccgtcattcatagactccagctcatcgatgatgccttctccttgtctaagaataactacatcgaaattgaaacagccctggaattgaccaagtacctcgccgaggaggatgaaattatcgtatggcatacagtcctggttaacctggtgactcgcgacttggtctcagaggtgaacatatatgatatttacagcttgctcaagcgatatctcctgaaacgcttgaacctgatctggaatatctatagtacaataatcagggaaaacgtcctcgcactgcaagacgactacttagctctgatctccctggagaaattatttgtgacggcgtgctggctgggcttggaggactgtctgcagctcagtaaagagctgtttgctaagtgggtggaccacccggagaatgagataccctatccgataaaagacgtggtcctgtgctacggcatcgcactggggtcagataaggagtgggatatactcttaaacacttataccaacacaacaaacaaagaggaaaaaattcagctggcatatgccatgagctgcagtaaggacccatggatcctaaacaggtatatggaatacgccattagcacctcccctttcacttccaacgagactaacatcattgaggtggttgcaagcagtgaggttggccgctatgtggctaaagacttccttgtgaacaactggcaggccgtttccaaacgctatgggactcagagcttgatcaatcttatctataccatagggagaactgtgactaccgatctacagatagttgagctgcagcaatttttcagtaacatgctggaggagcatcagcggatccgtgtccacgccaatctgcaaacaataaaaaacgagaatttgaagaataagaagctgagtgctaggatagctgcatggcttcgccggaatacttag

SEQ ID NO: 40304 - DNA, 2940 bp, Artificial Sequence
  Description of Artificial Sequence: Synthetic coding sequence
atgggcccccccagcagcagcggcttctacgtgagccgggccgtggcacttttacttgccggtttagtggctgccctcttactggctctggccgtgcttgcagccctttatgggcactgtgagcgcgtgccaccctccgagttgcccgggctgagggaccttgaggccgagagcagtcctcccctgaggcagaagcccacccccacaccgaagccttcatcagctcgagagcttgccgttactacgaccccaagtaattggcgccccccaggcccgtgggatcagttgcgcttgccgccttggctggttccccttcactacgatctagagctatggccacagcttcgacccgacgagcttcctgctggctccctgccatttacaggaagagtgaatatcacagtgagatgtacagtggcaacgtcccgcctgttactccactcactattcttgagccccgggactggaaatgctacggtcgggcgggttccggtcgatgacgtatggtttgctctcgacacagaatatatggtgttggaattatctgagcctctcaaacccggtagttcctacgaactgcagcttagcttctcaggcctggtgaaagaggatttgcgggagggcttgtttctcaacgtatacacagatcagggcgaacggagggcactcctggctagccagctggagccaacattcgctaggtatgtcttcccttgtttcgatgaacctgccctcaaagccaccttcaatattacaatgattcatcatccctcttatgtagctttaagtaacatgcctaaactgggccagtccgaaaaggaggatgtcaatggcagtaagtggaccgtgaccacattctctacgacacctcacatgccaacctacctagtagcctttgtgatttgcgattacgatcacgtgaataggactgagcggggaaaggaaattagaatttgggctagaaaggatgctatcgcgaacggatctgcagatttcgcactgaacataactgggcctattttctcatttcttgaggatctgtttaacatctcctatagtctccccaaaaccgacatcatcgcactaccttccttcgacaatcacgcaatggagaactgggggctcatgatcttcgatgaatctggtcttctcctcgagcccaaggatcagcttaccgaaaagaagacactgatctcgtatgtcgtcagccacgaaattgggcatcagtggtttgggaacctggtgactatgaactggtggaacaatatttggcttaacgaaggcttcgcatcatacttcgagttcgaggttatcaactattttaatcccaagcttccacgtaacgagatttttttctccaatatactgcacaacatacttcgcgaagaccacgcgctggtgacaagagccgtggctatgaaggtcgagaactttaaaacatctgagatccaagaattgtttgatatctttacttactccaaaggcgcgtccatggcgcgtatgcttagttgctttctcaatgaacatttgttcgtcagcgctttaaaaagttacctgaaaactttttcatactcaaatgcggaacaggatgacctctggcgccactttcagatggcaattgacgatcagtctacagttatcctgccagctacaattaagaacattatggattcctggacccaccagtccggctttccagtgatcacgctaaatgtgtccacaggagtgatgaagcaggagccattctatctagagaatattaagaataggacccttctaacaagcaatgatacatggattgtccctatcttatggataaagaacggcactactcagcctctcgtctggttggaccagtcaagcaaagtattccctgagatgcaggtgtctgattccgaccacgattgggtgatcttgaatctcaatatgaccggctattaccgggtcaactacgacaagcttggctggaagaagctcaatcaacagctggagaaagaccccaaggccattcctgtcattcacaggctgcagctgatcgacgatgccttcagtctgtcgaagaacaactatatcgagattgaaacagccctcgagttgaccaaataccttgccgaggaagacgaaattattgtgtggcacacagtccttgtgaacctcgtcactagagacctggtgtccgaagtcaatatttatgacatctattccctgctgaagcgctatctcttaaagcgactgaatctgatatggaacatttactcaacaatcatcagggagaacgttctggcactccaggacgactaccttgccctgatcagtttggaaaaactcttcgtaacagcctgctggcttggcctggaagactgtcttcagctgtccaaagaactgttcgccaagtgggtggatcacccggagaatgaaattccgtatccaatcaaggatgtcgtgctgtgctacggcatcgcattagggtcagacaaggagtgggacatactgctgaatacttatacaaacaccaccaacaaagaggagaaaatccagttggcgtacgctatgtcatgctccaaggacccctggatcctaaatagatacatggagtacgctatatccaccagcccattcacatctaatgaaaccaacatcatcgaggtggtggcaagcagtgaagttggaagatacgtggcaaaggattttctggtgaataactggcaggcagtttctaagaggtacggcacccagtctctgattaacctcatttacacaatcgggcgcacagtgacgaccgacctccaaatcgtggagcttcagcagttcttctcaaatatgctggaagaacaccagcgcatcagagtgcacgctaatctgcagaccatcaagaacgagaacctgaaaaataagaagctgtccgccaggattgctgcctggctgagacgcaatacatag

SEQ ID NO: 40305 - DNA, 681 bp, Artificial Sequence
  Description of Artificial Sequence: Synthetic coding sequence
atgaaggtggagaacttcaagaccagcgagatccaggagctgttcgatatcttcacctactctaaaggagcaagcatggcgcggatgctatcctgctttcttaatgaacacctgttcgtgtctgctctcaaaagttacctcaaaacgttcagttatagcaatgctgagcaagacgatctgtggcgacattttcagatggcaattgacgatcagagcacagttattctcccagcgacgataaagaacatcatggattcatggacacatcagtctgggtttcccgttatcaccttgaacgttagcaccggggtcatgaagcaggagcctttctatctagaaaatattaagaatagaaccctcttaacatctaacgatacctggatcgtgcctatcctctggatcaagaatgggacaacgcagcctctagtgtggctggaccagtcctctaaagtgttcccagagatgcaggtgtccgacagcgatcatgattgggtaatactgaatttaaacatgaccggctattaccgagtaaattacgacaagctcgggtggaagaagcttaatcagcagctggaaaaagatcctaaagccataccagtaattcatagattgcagttgatagacgacgcgttttctctgtccaatttacaggactttggacatttgaaggtccctaactag

SEQ ID NO: 40306 - DNA, 519 bp, Artificial Sequence
  Description of Artificial Sequence: Synthetic coding sequence
atgggcgagagcagcgaggacatcgaccagatgttcagcaccctgttaggcgagatggacctgctcacgcagtccctgggagtcgatacgcttccaccaccagatcctaatcctccacgagcagagtttaattactccgtcgggtttaaagatctgaacgaatcattaaacgcactcgaggaccaggatctcgacgcactcatggccgacctggttgctgacatttccgaggccgaacagcgcaccatacaggcccagaaggaaagcctgcagaatcaacaccacagtgcctctctgcaggccagtatcttctccggagccgcatctctcggctacgggacaaacgtggccgccacagggatctctcaatatgaagatgatcttccccctccccccgctgatccggtgttggatttaccacttccaccacccccaccagaaccactgtcccaagtgtcaatgtgggaccaacggtggcaagatcatcagcctttgcttcccataaccgatgtgccatag

SEQ ID NO: 40307 - DNA, 2001 bp, Artificial Sequence
  Description of Artificial Sequence: Synthetic coding sequence
atgggcgagagcagcgaggacatcgaccagatgttcagcaccctgctgggcgagatggatttactgacccagtctctcggagtcgacacccttccgcctcctgatcccaatcctccgagggctgaattcaattattccgtaggtttcaaagacttgaacgagagcctgaacgctctggaagatcaagacttagatgccctcatggcagaccttgttgccgacatctcggaggcagagcagaggactatccaggcccagaaggagtcactgcagaaccagcaccactctgcaagcctgcaggcgagtatcttcagcggagcagcatccctgggctacgggaccaacgtggccgccacaggcatctcacagtatgaggatgatctgcccccaccccccgcagaccccgtgctagatttgcccctgcctccaccaccacctgagcctctgtctcaagaggaagaggaagcccaagcaaaggctgataagatcaaattagcactggagaagctcaaagaggctaaggtaaagaagctggttgtcaaggtgcatatgaacgacaattcaactaagtccctcatggtcgacgagaggcaattagctagagacgtactcgacaacctattcgaaaaaacccattgcgactgtaacgttgattggtgcttgtacgaaatttatcccgagctccagatcgagaggttttttgaggatcatgaaaatgttgtggaagtcttatccgactggaccagggacaccgaaaacaaaatactgtttctggagaaggaggagaagtacgccgtgtttaaaaatcctcagaatttttacttagacaacagaggcaagaaagagtcgaaggaaacaaacgaaaaaatgaacgctaagaataaggaatcacttctggaggaaagcttttgtgggacatccataattgtccccgaactggagggtgctctgtatctgaaggaagacggaaaaaaaagttggaagcgccgttatttcttacttcgagctagcgggatctattatgtccccaaagggaaaaccaagacctcccgggacctcgcctgctttattcagtttgagaatgttaatatctattatggcacccagcataaaatgaaatacaaagcccccaccgactattgcttcgttctcaagcacccccagatccagaaggagagccagtacatcaagtacctatgctgcgacgacactcgaacattaaatcaatgggtgatggggataaggattgccaagtacggaaaaacactctatgataactaccagcgggctgtcgcgaaggctggtctggcctctcgctggacgaatctgggaaccgtgaatgccgcagccccagctcagccatctacgggcccgaaaaccgggactacccagcccaacggccaaatcccacaggccacccacagcgtttccgcagtcctgcaggaagcgcagcgacatgcagagacctctaaggataagaagccggctctggggaatcaccacgatcctgcagtccctagagctcctcacgctcctaaaagctctctgcccccgcccccccccgtgcgccgcagtagtgatacatcagggtcacctgcaaccccactaaaggcaaagggcactggcggggggggattgcctgctccacccgatgacttccttcctccccctcctccgcctcccccactggacgacccagagctgccgccgcctcccccagattttatggaacctccccccgacttcgtccccccaccaccccccagctacgccggcattgcaggaagcgaattaccaccaccaccacctccaccaccagctccagcacctgcaccagtcccggattccgccagacccccgccagctgtggctaaacgtccacctgtgcctccgaagcgccaggagaaccccggtcaccctgggggcgcaggcggcggggagcaggattttatgagtgacctcatgaaagcgctgcagaagaagcgagggaatgtttcctag

SEQ ID NO: 40308 - DNA, 1908 bp, Artificial Sequence
  Description of Artificial Sequence: Synthetic coding sequence
atgggcgagagcagcgaggacatcgaccagatgttcagcaccctgctgggagaaatggacttactcactcagtcccttggtgtggacacgctcccgccacccgatccgaatccaccgagggccgagtttaactactcggtggggttcaaggatctgaatgagagcctgaatgcactggaggaccaggatttagatgctttgatggccgatctggtcgccgacatcagcgaggccgagcagagaactatacaggcacagaaggaatcccttcagaaccagcatcacagtgcgtctctacaagcgtcaatcttttcaggtgcagcatcattgggctacggaacaaatgttgccgccactggaatcagccagtacgaggacgacctacctcctcccccagcagatcccgtcttggatctcccccttcctcccccccctccagagcccctatctcaggaagaagaagaggctcaggccaaggcagataagatcaaattggcactggagaagctgaaagaagcaaaagttaaaaagctagtcgtaaaagtccacatgaacgataacagcaccaagagtctcatggtcgacgagcgccagcttgctcgcgacgtgttggacaatttgttcgaaaagacccactgcgactgcaacgtggattggtgtctgtatgagatttacccggagctacaaattgaaaggtttttcgaggaccacgagaatgtggtggaggtgctctctgactggacccgggatactgaaaacaagatattgtttctggagaaggaggagaagtacgcggtttttaaaaacccacagaatttttacctggacaacagaggaaaaaaagagtctaaagaaaccaacgaaaaaatgaatgctaaaaataaggaaagcctgctggaggaatctttctgcggtacaagcattattgtaccagaattagagggggctctgtatctgaaagaggacggtaaaaagtcttggaaacggagatattttctgctgcgtgctagcggaatttactacgtgcctaagggcaagaccaagaccagccgagaccttgcttgctttatccagtttgaaaacgtgaatatctactacggcacgcagcataaaatgaagtataaggccccaacagactattgctttgtgcttaagcatccccagatccaaaaagagtcccaatatattaaatacctctgttgtgacgacactagaacattaaatcagtgggttatgggcataagaatcgccaagtacggtaagaccctatatgataactatcaacgcgcagttgccaaagccgggttggcttcccgctggacgaatctgggcacagtgaacgccgctgcccctgctcagcccagtacaggccccaaaactggcacgactcagcctaacggtcaaataccccaagccacccatagtgtcagcgctgtgctccaggaggcccagaggcacgctgagacttccaaagacaaaaagccagcattggggaaccatcacgaccccgcagtccccagggctccacacgcgccaaagtcctcgctacctcctccacccccggttcgccggtcttcagacacaagcggatctcccgccactcctctgaaagccaaggggacaggcggaggaggactgcccgcagctcgcgcccgcgccagacctcgcccccggctacgtcaggcagctccgagaggcgggcaagaggcgtcttgcgcgccccaagaagctcgagagccacgggccccaagaaggtcccgccggaggggtgccaggttccatgtgcggccccatgagtcgtttgccaaagaagagagacagcgagtgcttggaacaggaatgatgtctgtgccagaaggcgaggctagcctgactcctagtgcgggctttgctagccgccttccatag

SEQ ID NO: 40309 - DNA, 738 bp, Artificial Sequence
  Description of Artificial Sequence: Synthetic coding sequence
atggccctggtgccctgccaggtgctgcggatggccatcctgctgagttattgttcaatcctctgtaattataaggccattgagatgccgagccatcagacttacggcggatcgtggaagttccttacattcatcgatctcgtgattcaggcagtgtttttcgggatatgtgtcctcacagacctgagttcactactcactcggggttccgggaaccaggaacaggagagacagttgaagaagctgatttcactgcgtgactggatgcttgccgtacttgccttccccgtcggcgttttcgttgtggcggtgttctggataatttacgcctatgatagagaaatgatctaccctaaacttctggataacttcatcccagggtggctaaaccatggtatgcacactactgtgcttcccttcatactgatcgagatgaggacaagtcaccaccagtacccctcgcgcagtagcggactcactgctatttgtacgttctctgtgggatacatcctttgggtttgctgggtgcatcacgtgaccgggatgtgggtatatccatttttagagcacataggaccaggcgcccgcattattttctttggatcaacaaccatattgatgaacttcctctatctgctgggagaggtactcaataactacatctgggatactcaaaaaaagccaccatcctggcaggacatgaagataaagtttatgtacctgggaccaagtagctag

SEQ ID NO: 40310 - DNA, 561 bp, Artificial Sequence
  Description of Artificial Sequence: Synthetic coding sequence
atggccctggtgccctgccaggtgctgcggatggccatcctgctgagttactgttccatcctctgtaactacaaagcaattgaaatgcctagccatcagacctacggtggttcctggaaattcctcactttcattgatttattcgttgtagccgtcttctggattatttatgcatacgatcgcgaaatgatttatcccaagttgctagataattttatccccggttggcttaatcatggtatgcatactaccgtgctaccattcatccttatcgagatgagaacttctcatcatcagtatcctagtagatcttcaggcctgactgccatttgcaccttttcggtgggatatattctatgggtgtgctgggtgcaccacgtcacgggtatgtgggtgtaccctttcctggagcacatcggccctggcgcccggattattttctttggctctaccaccattctgatgaacttcctgtatctcctgggtgaggtcctgaacaattacatttgggacacacagaaaagcatggaagaagaaaaggaaaaacccaaattagaatag

SEQ ID NO: 40311 - DNA, 717 bp, Artificial Sequence
  Description of Artificial Sequence: Synthetic coding sequence
atggccctggtgccctgccaggtgctgcggatggccatcctgctgtcgtactgttccattctgtgtaattataaagcaattgagatgcctagtcaccagacctatggcgggtcctggaaatttttaaccttcattgacctggtcattcaggccgtgttcttcggtatttgcgtgctaaccgatttgagtagccttcttactagggggtcaggcaaccaggagcaggaacgtcaactaaaaaagcttatttcattacgggactggatgctggcagtgctagccttccccgtgggggtttttgtcgtggccgtgttttggattatctatgcgtacgaccgagaaatgatttaccctaaactccttgacaatttcatccccgggtggctaaaccacggcatgcacaccacagtgctcccattcattttaattgagatgcggacctctcatcatcaatatccttcccgcagctccggcctaactgctatttgtacattttccgtagggtacatcctgtgggtttgctgggtgcatcacgttaccggaatgtgggtgtacccattcctggagcacatcggtcctggggcacgcatcatcttcttcggtagcacgaccatcctcatgaatttcctgtatctgctgggagaggttttaaacaactatatctgggatactcagaagtcgatggaagaggagaaggagaaaccgaagctggaatag

SEQ ID NO: 40312 - DNA, 144 bp, Artificial Sequence
  Description of Artificial Sequence: Synthetic coding sequence
atggccctggtgccctgccaggtgctgcggatggccatcctgctgtcttactgctcgatcctgtgcaactacaaagctatcgagatgccgtcacaccagacctacggagggagctggaagttcttgacgttcattgatctctag

SEQ ID NO: 40313 - DNA, 405 bp, Artificial Sequence
  Description of Artificial Sequence: Synthetic coding sequence
atggccctggtgccctgccaggtgctgcggatggccatcctgctgtcctattgctcaatcctctgcaattataaggcaatcgaaatgccgtcccatcagacttacggtggatcttggaaattcctgacattcatcgacctcgtgatccaagcagtctttttcggcatatgtgttttgaccgacctgtcaagcttgctgacgcgtggctctggaaatcaggagcaagaacgacagctgaagaagctcatttccctgagagattggatgctggctgttcttgcttttcccgtgggcgtcttcgtggtggctgtcttctggatcatatatgcatatgatagggagatgatttatcccaaactgttggataacttcattcctggatggcttaaccacggcatgctgtag

SEQ ID NO: 40314 - DNA, 579 bp, Artificial Sequence
  Description of Artificial Sequence: Synthetic coding sequence
atgaccaaggtgctgcggatggccatcctgctgagctactgcagcattttgtgcaattacaaagcgatcgaaatgccctctcatcagacctatgggggatcgtggaagttccttaccttcattgatctggtcatccaggctgtgttttttgggatatgcgttcttactgatctgtccagtctgcttactcggggatctggcaatcaagaacaggaaaggcagcttaagaaactgatcagcttacgggattggatgctggctgtgctggcattccctgtaggggtgtttgttgtggccgtgttctggattatctacgcctacgatcgggaaatgatatacccaaagcttctggacaatttcatccctggctggctgaatcatggcatgcacaccacggtcttgccctttatcctcatcgaaatgcgcactagtcaccaccagtatccatcccggagctctgggctcactgcaatttgcacatttagcgtcggatacatactgtgggtgtgctgggtacaccacgtgaccgggatgtgggtgtacccattcctggagcacatcggaccaggggcacgctag

SEQ ID NO: 40315 - DNA, 705 bp, Artificial Sequence
  Description of Artificial Sequence: Synthetic coding sequence
atgaccaaggtgctgcggatggccatcctgctgagctactgcagcattctttgtaactacaaagcaatcgaaatgccatcccatcagacatacggtggttcctggaaattcctgacttttatcgacctggtgattcaggccgtgtttttcggcatttgcgtgcttacagacctcagtagcctccttaccaggggatcaggcaaccaggaacaagagcgccagctgaaaaagctgatctcccttcgcgattggatgctcgctgtgctcgcatttccagtcggagtcttcgtcgttgcagttttttggattatctacgcctatgaccgagagatgatttatcccaagctgctggacaactttattcccggctggctaaaccacggcatgcataccaccgtgttgccttttatcctgattgagatgagaacctcccaccaccagtacccttcacggtcatccgggctgaccgcgatatgcactttctcggtcggctacattttgtgggtgtgttgggtacatcacgtcaccggaatgtgggtgtatccttttctggaacatattggccccggagctaggattatcttttttggatccaccacaattctcatgaattttttgtacctgctgggggaagtgctcaacaactacatctgggacacccagaagtcaatggaggaagagaaggagaagcctaaattagagtag

SEQ ID NO: 40316 - DNA, 375 bp, Artificial Sequence
  Description of Artificial Sequence: Synthetic coding sequence
atggccctggtgccctgccaggtgctgcggatggccatcctgctgtcctactgctccatcctgtgcaactacaaagccattgaaatgccaagccatcagacctacggaggcagctggaagttcttgacttttatagatctcttcgttgtcgcagtgttctggatcatttacgcttacgatagggagatgatctaccctaagctgctggacaacttcatcccgggttggttaaaccacggcatgcacactactgtcctcccgtttatcctcatagagatgaggaccagtcatcatcaatatccatccagatctagtggcctaacagcaatatgcactttctctgtaggctacatactctgggtatgttgggtctag

SEQ ID NO: 40317 - DNA, 417 bp, Artificial Sequence
  Description of Artificial Sequence: Synthetic coding sequence
atgctggccgtgctggccttccccgtgggcgtgttcgtggtggccgttttttggatcatctacgcatacgatcgtgagatgatctaccccaagctgctcgacaattttatcccagggtggctgaatcacggaatgcatactactgtgctgccattcattctgattgaaatgcggacatctcaccatcaatacccaagccgatcgtccggacttactgctatatgcacttttagtgtggggtacattctgtgggtctgttgggtccatcacgtaacgggtatgtgggtttaccctttcctggagcatattgggccaggagctcggatcattttctttggctccactactatcttaatgaactttctataccttcttggagaggtgctcaataactatatttgggatactcagaagtag

SEQ ID NO: 40318 - DNA, 1305 bp, Artificial Sequence
  Description of Artificial Sequence: Synthetic coding sequence
atggagagcgagagcgagagcggcgccgccgccgacaccccccccctggagacactgtccttccacggggacgaggagataattgaagtggtcgaattggatcctggccctcccgatccagacgacctggcgcaggaaatggaggatgtcgactttgaagaagaggaggaagaagaaggcaatgaagaaggttgggtgctcgaacctcaagagggggtcgtcggctccatggagggtcccgacgactccgaggttactttcgcactgcacagtgcctccgtgttctgcgtgagcctcgatccaaagaccaacacactggccgtcactggcggagaggatgataaggcctttgtgtggcgactttccgatggcgaattgctgttcgaatgcgccggtcacaaggatagcgtgacctgcgcagggttcagccatgactccacccttgttgcgacaggtgatatgtccggtttgctgaaggtgtggcaagttgacaccaaagaagaagtgtggtcctttgaagcaggcgaccttgagtggatggaatggcacccccgagctccggttctgctcgctgggaccgcagacggcaatacttggatgtggaaagtgcctaacggagactgtaaaacctttcagggacctaactgcccagccacctgcgggagagtccttccggatggaaagagagccgtggtgggctatgaggatggaacaattcgaatttgggaccttaagcagggtagtccaattcacgtattgaaggggaccgaggggcaccagggaccgttgacctgtgttgctgcaaatcaggacggtagcctgatcctgaccggcagcgtagactgtcaagcaaaactggtgagtgcgaccacggggaaagtggtgggagtgtttagacccgagactgttgccagccaaccgtccctcggcgaaggcgaagagagcgaatctaattcagtagagtccctgggcttctgcagtgtaatgcctttagccgcagtgggttatctcgacgggacattagccatttatgacctcgctacccagaccttaaggcaccagtgccaacaccagtcaggaatcgtccagctcctctgggaagccggaactgcggtagtgtacacatgttccttagacgggattgtgcgcctttgggacgccagaactgggaggctgttaacagactatcgggggcatacggccgaaatccttgatttcgcactgtccaaagacgcctcactggtcgtgactacatctggggaccataaagccaaagtgttttgtgtccagcgccctgaccgctag

SEQ ID NO: 40319 - DNA, 2721 bp, Artificial Sequence
  Description of Artificial Sequence: Synthetic coding sequence
atgtggcgggccaagctgcggcggggcacctgcgagcccgccgtgaaagtagaggatcccctttgcaattttcactcgcccaacttcctcagaatttccgaagtcgaaatgagggggtctgaagacgccgcggctggaaccgtattacagcgactgatccaggaacagctgcggtatggaacacctactgagaatatgaaccttctggctatccaacaccaagcaactggatctgccgggcctgctcatccaaccaataacttttccagcaccgagaacctaacccaagaggatccccagatggtgtatcaaagcgcacgccaagaaccccaggggcaagagcaccaggttgataatacagtgatggagaagcaggtgcgatccacccaaccccagcagaacaacgaggagctgcctacctatgaagaggcaaaggcccagtcccaattctttcgaggccagcagcagcagcaacagcagcagggtgccgtgggccatggctattatatggctgggggcaccagtcagaaaagccggacagagggacggcccacagtgaatagggcgaattcaggccaagcccacaaggacgaggccctgaaggagctcaaacaggggcacgtccgatcgctgtctgagcgtattatgcagctctctcttgagcgcaacggagctaaacagcacttacctggatcagggaatgggaaaggcttcaaggtgggagggggcccttccccagcacagcccgcagggaaggtgctggatcctcgaggaccacccccagagtatccattcaaaactaagcagatgatgtcacccgttagcaaaacccaggagcacggcttgttttacggcgatcaacaccctggaatgctccatgagatggtcaagccctaccctgctcctcaaccagtgcgcacggacgtggcagtgttgcgctaccaacccccgcccgagtacggcgtgacaagtaggccttgtcagcttccatttccatcaactatgcaacaacacagccctatgagttcccagacttcaagtgcctccggaccactccattcagttagcctgcccctaccacttcccatggccctcggcgcgccgcagccacccccagcggctagcccttctcagcaactcggtcctgatgcctttgccatagtggagcgcgcccagcagatggttgagatcttaactgaagaaaaccgggtgctgcatcaggaattacaaggatattatgacaacgctgataaactccacaaattcgagaaggagctgcaacgaattagtgaggcctatgagtccctcgtgaagtcaaccaccaaacgggaatcactggacaaggccatgaggaacaagttggaaggcgagatacgcagattgcatgacttcaaccgggaccttcgggatcggcttgagaccgccaataggcaactctcctctcgcgaatatgagggccatgaagacaaggccgcagagggtcactacgcgagccaaaataaagaatttttgaaagagaaggaaaaactggaaatggagctagccgcggtgagaaccgccagtgaggaccatcgtagacatattgaaattctcgatcaggccctttctaatgcccaggccagagtgattaagctcgaagaagaattacgcgaaaagcaggcctacgtggaaaaggtggagaaattacagcaggctctcacccagctgcagtctgcttgtgagaaacgagagcagatggagcgaagactacggacatggctcgaacgcgaactcgatgcactcagaacacaacagaaacacgggaatgggcagccggcgaatatgcccgagtacaacgctccagccctcctcgagctggtgagggaaaaggaggagcggattctagccctcgaggcagacatgaccaagtgggaacaaaagtacctggaggaaagcactatcagacactttgctatgaacgccgccgcaaccgctgccgctgagagagatacaacaatcatcaatcactcccggaatggctcctatggcgagtctagtttggaagcccatatatggcaagaggaagaggaggtcgtgcaggctaacaggcgctgtcaggatatggaatataccattaaaaaccttcacgccaaaattatcgagaaagatgccatgataaaagttctgcagcagcgctcccgcaaggacgccggcaaaaccgactcctccagtctacgccccgctaggtcagttcctagcatcgccgcggcaacaggcacccattccaggcaaacatcgttaactagttcccagctggccgaggaaaagaaggaggagaaaacgtggaagggctcaattggtctgcttctgggaaaagaacatcatgagcacgctagcgctccattactgccgcctccccctactagtgcgctgtccagcattgcctctactactgcagcgtcgtctgcccacgccaaaacaggatccaaagattcatctacccagacggataaaagtgccgagctgttttggccctctatggctagcctcccatcccgagggcgcctgagcaccacacccgcccactcccccgtgctgaagcacccagccgcgaagggcaccgcggagaagcttgagaactcccctggacacggtaaatcaccggatcatcggggccgggttagctctctgctccataagcccgagtttccagatggcgaaatgatggaagtgctaatatag

SEQ ID NO: 40320 - DNA, 1632 bp, Artificial Sequence
  Description of Artificial Sequence: Synthetic coding sequence
atgtggcgggccaagctgcggcggggcacctgcgagcccgccgtgaaagggtccccatctgcttgttactcaccatcgtcacctgttcaggtcctggaggattccacatatttctccccagactttcaactctactctggacgccacgagacatctgcgcttacagttgaggctacgagctcaatccgcgagaaagtagttgaggatccgctctgtaactttcacagccccaactttcttcgaattagtgaagttgaaatgagaggatccgaggacgccgccgcgggcactgtgctgcagcgtcttattcaggagcaactccggtatggaactccaactgagaatatgaatctgctggctattcaacaccaagccacagggagtgccggcccagcccatcccacaaataatttcagttcaacagagaatctcacacaggaggacccccagatggtgtaccagagtgcccgtcaggagccgcagggtcaggaacaccaggtagataacaccgtcatggagaagcaggtccggtcaacgcaaccacagcagaacaacgaagagttgcctacctatgaagaggccaaggctcaaagccagttctttcgcgggcaacagcagcagcaacagcaacagggagctgtgggtcacggatactatatggctgggggcaccagccaaaaaagtagaacggaagggagaccgaccgttaacagagcgaattccgggcaggcccacaaagatgaggctttgaaggaactcaaacaggggcacgtccggtccctctcagagcggatcatgcaactttcacttgagcgtaatggggcaaagcagcaccttcccggaagcgggaacggcaagggattcaaggtaggaggcgggccttccccagcccagccggccggaaaggtgctggacccccgaggcccccctcccgagtatccctttaagaccaaacagatgatgtctcccgtcagtaaaacccaggaacacggtctattctacggggaccagcacccaggcatgctccatgagatggttaaaccttatccagcaccgcagcccgtacgcaccgacgtggcggtgttgcgctatcagcctcccccagagtacggtgtgacttcacgcccatgccagcttccctttccatcaaccatgcagcagcacagccccatgaatttcaggactagtctaacaagttctcagctcgcggaggaaaaaaaagaagaaaaaacctggaaaggaagcatcggacttctgctggggaaagagcatcacgagcacgctagtgccccattgttgcctcccccacccaccagcgccctgagcagtattgcatccacaactgctgcctcttccgcccacgccaagactggctccaaggatagttcaacgcagactgataaaagcgctgaactgttctggccttccatggcatcactgcccagtcgtggaagactgagcactacaccagcccactctccagttctaaagcatcctgcagccaaaggcacagccgaaaagttagagaattcacccgggcacggcaagtccccggatcacagagggcgggtgagttctttactgcacaaacccgaattcccagacggagaaatgatggaagtgttgatctag

SEQ ID NO: 40321 - DNA, 2871 bp, Artificial Sequence
  Description of Artificial Sequence: Synthetic coding sequence
atgtggcgggccaagctgcggcggggcacctgcgagcccgccgtgaaggggagtccttccgcctgttactctccctcctccccagttcaagttttagaggactccacctattttagtcctgatttccagctgtactctggccgccacgagacctcagctctgaccgtggaggcaacctcttctatccgggagaaagtcgtggaggaccccctgtgtaatttccacagtcctaatttcttaagaatatccgaagttgagatgagaggaagcgaagatgcagctgcagggacagtcctgcaaaggctaatccaggaacagctgcgttacgggactcccactgagaacatgaatctgcttgctatccagcatcaagcgaccggctctgcaggtccagctcatccaactaataatttcagctccacagagaacctgacccaggaggacccccagatggtgtatcagtcggcacgtcaggaaccacaaggccaggagcatcaggttgacaacactgtgatggagaagcaggtgcgaagcactcagccccagcagaacaatgaggaactgccaacatatgaagaggccaaagcccagtcgcagttcttcaggggccagcagcaacagcagcagcaacagggagccgtggggcacgggtactacatggcagggggtacatcgcagaagtctaggaccgaaggccggccgaccgtcaatagggctaacagcggacaggcacataaagatgaggccctgaaagaactgaagcagggacatgtgcgctccctaagcgaacggatcatgcagctgagccttgagcgtaacggtgccaaacagcacttgcctggcagtggtaacgggaaaggcttcaaggtggggggcggccccagcccggcccagcctgccggcaaagtgctggaccccagggggccaccccccgaataccctttcaagactaagcagatgatgagtcctgtgtccaaaacacaagaacacggcctgttctatggcgatcaacatcctggtatgctccatgaaatggtgaagccctatccagcgcctcagccagtgagaaccgacgtggccgttctgcgatatcagccacctccagagtacggggtgacttcccgtccctgtcagctcccgttcccttcaaccatgcagcagcactctccaatgagtagccaaacttcctcagccagtgggcccctccacagcgtctccctgccactccccttgcccatggcactgggggcccctcagccccccccagccgccagtcctagccagcagttgggtcccgacgctttcgcaatagttgaaagggctcaacagatggtggaaatcctcacggaagaaaaccgcgtgttacatcaggagctgcaaggttactatgataacgccgacaaactgcataagttcgaaaaggaactccagaggattagtgaggcctacgagtcactggtgaaatctaccacgaaaagagaatccctggataaggccatgagaaacaagttagaaggcgagattagacgcctgcacgacttcaaccgcgacttgcgcgatcgcctggaaaccgccaacagacagctatcctcccgcgaatatgaagggcatgaagacaaggctgctgagggtcattacgccagccagaataaagaatttctcaaggagaaagagaagttggaaatggaattggcggcagtccggactgcttccgaggaccatcggcggcacattgagattctcgaccaggcactgtccaacgcccaggccagggtgattaagttggaggaagaattgcgtgagaagcaagcatacgtcgagaaagtcgaaaagctgcagcaggccctgactcagctccagagcgcttgcgagaagcgagagcagatggaaagaaggttgcgtacatggctagaacgcgagttggatgccctgaggacccagcagaagcacggcaacgggcagccagccaatatgcctgagtataatgccccggctttgttagagctcgtcagggaaaaagaggaaagaatcctggcgctggaggcagatatgactaagtgggagcaaaaatacctagaggaaagtaccattcggcacttcgctatgaatgctgctgccacggctgctgccgagagagacacgaccattatcaaccactcccggaacggctcttatggcgaatcctctctggaagcccatatatggcaggaagaagaggaagtcgttcaggccaataggcggtgccaggacatggagtataccataaaaaatttgcacgctaagatcattgagaaagacgccatgataaaagtgttgcagcagaggagtcggaaagatgccggcaaaactgactcctccagccttaggcccgccagaagcgtgccctcaattgcggcagccactggaacccactcgcgacagacatccctgacctcttcccagctcgcagaagagaaaaaagaggagaaaacatggaagggttccatcggattgctgctcggtaaggaacatcacgaacacgcctccgcaccactcctgccgccgccccccaccagcgcactcagttctatcgcatccactactgcagcctccagtgcgcatgcaaaaactggaagtaaggattcgagcacacagaccgacaagagtgcggagctcttctggcccagcatggcttctttaccttcacgtggacgcctgtccacaacacccgcacactcaccggttttaaaacaccccgcggctaagggcaccgcagagaaactcgagaatagccccggacacggaaaaagccccgaccacaggggacgagtgtcttcactgttgcacaagccggaattccccgatggagagatgatggaagtgctcatctag

SEQ ID NO: 40322 - DNA, 1836 bp, Artificial Sequence
  Description of Artificial Sequence: Synthetic coding sequence
accagccacgaccggctgatgtggcgggccaagctgcggcggggcacttgtgagcctgcggtgaaggggtcgccctccgcttgttattctccatccagccccgtccaggtcctggaagactcgacttacttctcacctgactttcaactctactccgggaggcatgaaaccagcgccctgactgtggaagcaaccagctccattagagaaaaagtggtcgaagaccctctatgcaattttcatagtcctaactttctacgaatttctgaagtggaaatgcgaggttccgaggatgcggccgccggaactgtgcttcaacgactcatccaggagcaactgagatatggtaccccaactgaaaacatgaacctgcttgccatacaacatcaggcaacgggatctgcaggtcctgcccacccgacaaacaatttcagctctactgagaatttgactcaggaagatccccagatggtctaccagtccgcaaggcaagaaccccaggggcaagaacaccaggtggacaacacagtgatggaaaaacaggtacgtagcacacagccacagcaaaataacgaggagttgcccacctacgaggaggccaaggctcagtcacagttcttccgcggtcagcagcagcagcagcagcagcagggtgccgtagggcacggctactacatggccggaggaacaagccagaagtccaggacagaaggtaggcctactgtgaacagagccaacagcgggcaagcccataaagatgaagccctgaaggagctgaaacaggggcatgtgaggagcctctctgagcgcatcatgcagctcagcctggagagaaatggcgcaaaacaacacctcccaggctccggaaacgggaaaggattcaaggtcggtggggggccttctccggcacaaccggctggcaaggttctggatccaaggggtcccccgcccgagtatcctttcaagaccaaacagatgatgagccccgtttcaaagacccaggagcacggactgttctatggagatcagcaccccggtatgctacacgagatggtaaagccttaccctgctccacagccggtccgcacggacgtggccgtgttgaggtaccagcccccccccgaatatggcgttactagccgcccttgtcagctcccctttcctagcaccatgcaacagcacagtcctatgagctcccaaaccagtagcgcgtctggtccgctgcactcggtaagtctgcctcttccattacccatggctctcggtgccccgcagcctccccctgccgcttctccctcccagcaactaggtcccgacgcctttgcaatcgtagaacgtgcccagcagatggtggaaatcctcactgaagaaaaccgcgtactccatcaggaactccagggttattatgataacgctgacaagctgcacaagtttgaaaaagaactgcagcgtatttctgaagcttatgagtccctggtaaagagcactaccaaacgcgagagcctcgacaaggccatgcgaaacaagttggaaggagagatccgtaggctacatgacttcaatcgcgacctgagggatcgcctggaaaccgccaatagacagctttcctctagggaatatgaaggacacgaagataaagccgcggagggccattatgcgtcccagaacaaggagttccttaaggagaaggaaaaactggagatggagttggcagcagtgcgcacagcctccgaagaccaccggcggcatatcgagatactggaccaggccctctcgaacgcacaggctcgacatcaagccggtaggggcgtcacacgcgaggcctccatttgctag

SEQ ID NO: 40323 - DNA, 2343 bp, Artificial Sequence
  Description of Artificial Sequence: Synthetic coding sequence
atgcggaccctggaggacagcagcggcaccgtgctgcaccggctgatccaggagcagttgaggtacggcaacctgactgagacacggacactgctcgccatccagcagcaggccttaagaggaggagcaggcaccgggggtaccggatccccccaagcatccttggaaattttggccccagaagatagccaggtccttcagcaggcaacgcggcaggaaccccagggccaagaacatcagggcggcgagaatcatctggccgagaacactctgtaccgcctgtgcccccaacccagtaaaggcgaggaactgcccacctatgaggaggcgaaagcacattcgcagtactatgccgcccagcaagcaggaacccgcccccacgccggcgatcgagacccccgtggggcacccggcggctcccgtcgccaagacgaggcactgcgcgagctccgccacggacacgtgcgctccctgtctgagaggctgctccagctgagccttgaacgaaatggagcccgagctccctctcacatgagctcctctcatagcttccctcagctcgctagaaatcagcagggtccccctctgaggggaccccccgcggaggggcctgagagccgcggccctccaccacagtacccccatgtggtgttggctcacgagactaccactgctgtaacggaccccaggtatagggcccgcgggagcccccacttccagcacgctgaagttaggatactacaggcgcaggtcccacccgtgtttctacagcaacaacagcagtaccagtacttacagcagtcccaagaacaccctccgcctccgcaccccgccgccctcggtcatggcccgctgtcttcactgagccccccggccgtggagggacccgtgagcgcacaggcctcttctgctacttcaggttccgcacaccttgcacaaatggaggctgtcctccgtgagaacgcgcggttgcaacgggataatgagagactgcagagggaactggaaagttccgccgaaaaagcaggccgaattgaaaagctggagagcgaaattcagagactaagtgaggctcatgaatcgcttaccagggcaagcagcaaaagagaagctttggaaaagaccatgagaaataaaatggactcggagatgcggagattgcaggactttaaccgtgatctaagggagaggctggagagcgccaaccgccggctcgctagcaagactcaggaagctcaggctgggtcacaagacatggtcgccaagctgttggcacagtcctatgaacagcagcaggagcaagaaaaactggaacgggagatggctctgcttcgcggagccatagaggaccaacgcaggcgggccgaactgcttgagcaggctctcggaaacgcacagggtagggccgctcgggccgaggaagaactgcggaagaagcaggcttacgtggagaaggttgagcgactccagcaggccctgggacaactacaggccgcctgtgagaagcgcgagcagttggaattaagactgaggaccagactcgagcaggagttgaaagcactgcgcgcacaacagcgacaagcaggcgccccaggaggaagctctggaagcggaggttcacctgagctgtccgccctgcgattgtccgaacagcttagggaaaaggaagagcaaatcttggcacttgaggcagatatgactaagtgggagcagaaatatcttgaggaacgagccatgagacagttcgctatggatgccgcagcgaccgctgccgcccagcgggacactacactgattagacactcccctcaaccctcaccaagctccagcttcaacgagggcctcctcactgggggacatagacatcaggagatggaatcgcggctgaaggtactgcatgcacaaatattagagaaagatgcggtcataaaagtgctgcagcaaaggtctagaagggatcctggaaaggccatacagggttcgcttaggcccgccaagagcgtcccgtccgtgttcgccgcagctgcagccggaacccagggttggcagggattgtccagctctgagaggcagacagccgatgctccagcgcggctgacgaccgcagatcgggcgcctactgaggaaccagttgtcaccgctcctcccgctgcacacgctaaacacggaagcagagacgggagcacacagaccgagggtcctcccgattctactagcacctgcctcccgcccgaaccggacagcctcctgggatgcagctctagccaaagggctgcttctctggacagtgttgccacttcgagagtgcaagatctaagtgacatggtggagattctcatctag

SEQ ID NO: 40324 - DNA, 2340 bp, Artificial Sequence
  Description of Artificial Sequence: Synthetic coding sequence
atgcggaccctggaggacagcagcggcaccgtgctgcaccggctgatccaggaacagctaaggtatggaaatttaactgagaccaggaccctcttagctatccagcagcaggcattgagggggggagccgggacaggaggaactggatccccacaagcgagtctggagattctggctcctgaggactcccaagttcttcaacaggctacacgacaggaaccccaagggcaggagcatcaggggggcgaaaaccacctcgcagaaaataccctttataggctgtgccctcaaccctctaagggcgaggagctgcctacctatgaagaagcaaaggcgcactctcaatactacgctgcacaacaagctgggaccagaccacacgccggggatcgtgacccacgcggtgcacctggcggctcccgacggcaagatgaggcgctacgagaacttcggcatgggcacgtgagaagtctgagtgaacgcttacttcaactttcactagagcgcaatggcgcacgagccccctcacacatgagttcttcacactctttcccccagttggcaaggaatcagcaggggcccccgcttcgaggcccccccgccgaaggtcctgagtcaaggggccctccacctcaataccctcacgtcgtgctggcccatgagaccactaccgccgttacggacccacggtacagggcccggggctcgcctcatttccagcatgctgaggttaggatcttacaggctcaagtgcctccagtgttcctccagcaacagcagcagtaccaatacctccagcagtcccaggagcatccaccgccacctcacccagccgccctcggacatgggcccctgtcttcactgagccctccggcggttgaaggccctgtgtctgcgcaggcctccagcgctactagcggctccgcccacctcgctcagatggaggcggtgctaagggaaaacgcccggctgcagcgtgataatgagcgcctccaaagagagctggagagctctgctgagaaggccggcaggatagagaaactggaatccgaaatccaaagactgagcgaagcccatgagagcctgacacgagcaagcagtaaacgtgaagccctcgaaaagaccatgcgtaataagatggactcagagatgagaaggctacaggatttcaatcgggatttacgggagcgactggagagcgcgaacaggcgcctcgccagcaagacccaggaggcccaggcgggttctcaggacatggtcgccaagctgctcgcgcaatcttatgagcaacaacaagagcaagaaaagctcgagcgtgaaatggctctcttacgaggtgctatcgaggaccagcggcgtcgggctgagctccttgagcaggcattaggaaacgctcagggtcgtgctgcacgggcagaagaggagctgagaaagaagcaggcttacgtcgagaaagtggagcggctccaacaagccctggggcagctccaggccgcatgcgagaagcgggagcagctcgagcttcgtctccggactaggctggaacaagagctgaaggctttgagagcccagcagcggcaggctggggcccctgggggatcatccggttccggcgggtcaccagaattgtccgcgctaaggctgtccgagcaactgagggagaaagaagagcagatcctggccctggaggccgatatgaccaagtgggagcagaaatacctggaggagcgggctatgcgacagtttgctatggatgcagccgccactgccgctgcccagagagatacaactctgatacgacattcaccccagccatcaccaagctctagttttaatgagggtctcttgaccggaggccatagacaccaagagatggagtccagactgaaggtcttacatgcacagattctggagaaagacgctgttatcaaggtactacagcagcgctccagacgagatcccggaaaagctatccagggctctttgagacccgcaaagagcgttccctccgtcttcgctgctgccgccgcaggcacccaaggctggcagggcctctcatcatctgagaggcagacggccgacgcacctgccagactgacgaccgacagggctcccactgaggaacccgtggtcactgctcctcccgcagcccacgccaaacatggctcacgggacggttccactcagactgagggtccccccgatagcacctctacttgccttccacccgagcccgattccttgctgggttgttcaagtagtcagagagccgcaagcctggattcagtggcaacgagtcgcgtgcaggatctgtcagacatggtggaaatactaatctag

SEQ ID NO: 40325 - DNA, 102 bp, Artificial Sequence
  Description of Artificial Sequence: Synthetic coding sequence
atgcggaccctggaggacagcagcggcaccgtgctgcaccggctgattcaggaacagttgcggtacggcaacctgacggagaccaggaccttgttggcctag

SEQ ID NO: 40326 - DNA, 456 bp, Artificial Sequence
  Description of Artificial Sequence: Synthetic coding sequence
atgcggaccctggaggacagcagcggcaccgtgctgcaccggctgattcaggaacagttgcgatacgggaatttgactgagactagaaccctgctggcaatccagcagcaagcgctgagaggaggagctggcacaggaggaactgggtctccccaggcatcactcgagatcctggccccagaggactcccaggtcctgcagcaggccacaaggcaggagccccagggtcaggagcaccaaggcggtgagaaccatctggccgaaaatacactgtaccgcctgtgcccgcagcccagcaagggggaggaacttcctacctacgaagaagcaaaggcccattcacagtattacgcggctcagcaggccgggactcggccacacgctggtgatagagaccccagaggtgcgcccggcggaagtcggagacaagacgaagccctgcgtgaactgagatag

SEQ ID NO: 40327 - DNA, 435 bp, Artificial Sequence
  Description of Artificial Sequence: Synthetic coding sequence
atgcggaccctggaggacagcagcggcaccgtgctgcaccggctgattcaggaacagctccgatatggtaacttgaccgagacccggactctgctcgccatccagcagcaggccttaagaggcggtgcaggaactgggggaactggaagcccccaggccagcctggagatcctggccccagaagatagtcaggtgctccaacaggctacccgacaggagccacagggccaagagcatcaagggggtgaaaaccacctcgccgaaaatactctataccggctttgtccccagcctagcaagggcgaagagctccccacatatgaagaagccaaagcccactcccagtactacgccgcccagcaggcagggacccgcccccatgctggagacagagacccccggggagccccaggagggtctaggaggcaagattag

SEQ ID NO: 40328 - DNA, 384 bp, Artificial Sequence
  Description of Artificial Sequence: Synthetic coding sequence
atgcggaccctggaggacagcagcggcaccgtgctgcaccggctgatccaggaacagcttcggtatggaaatctgacagaaactagaactctgttggccattcaacagcaagctctgcgaggcggggctgggacaggagggaccggctcccctcaggccagtttggaaatcctcgcccctgaagattctcaggttctccagcaggcaacaaggcaggagccacaagggcaggagcaccaaggaggagagaatcatctcgcagaaaataccttgtaccggttgtgccctcagccctctaagggagaagaactgcctacatatgaagaagctaaggctcacagccaatattatgcggctcagcaggccggaacccgaccgcactag

SEQ ID NO: 40329 - DNA, 597 bp, Artificial Sequence
  Description of Artificial Sequence: Synthetic coding sequence
atgcggaccctggaggacagcagcggcaccgtgctgcaccggctgatccaggaacagctacgttacgggaatctgaccgagacccgtactctgctggccattcaacagcaagccctgaggggcggtgccggcaccggaggcacgggctccccccaggcaagtctggagatactggcccctgaagattctcaggttctgcaacaggcgacacgccaggaaccacagggccaggagcaccagggtggggagaaccacctggctgaaaatacgctctacaggctgtgccctcagcccagtaagggcgaagaactccctacgtatgaagaggctaaagctcactctcaatattacgctgcgcaacaagcaggaacccggccacacgctggcgaccgggatccccggggggcccccgggggttcaaggaggcaggatgaagccctcagagaactcagacacggccatgttcgtagcctgtccgagcgactgctacagttgtcattggaaagaaacggcgctagagccccgagccacatgtcgagttcccacagcttcccacaactcgcgcggaaccagcagggccctcccttgcgtggctag

SEQ ID NO: 40330 - DNA, 2334 bp, Artificial Sequence
  Description of Artificial Sequence: Synthetic coding sequence
atgcggaccctggaggacagcagcggcaccgtgctgcaccggctgatccaggagcagctgcgctatggcaacttaaccgagacccgtacccttctcgccatacagcaacaagcattacgcggcggcgctgggacaggcggcacaggcagccctcaggcatccttagagatcctggcaccagaagattctcaggtgcttcagcaggcaacacggcaggaacctcagggtcaggagcaccagggtggggagaatcatttggctgaaaacaccctgtacaggctctgtccccaaccatccaaaggcgaagagctccccacatatgaagaggccaaggcccattcccagtactatgctgctcagcaggctgggacacgacctcacgctggtgacagggacccaagaggggcacccgggggcagccgacgacaggacgaagccctgagggagctcagacatggtcacgtcaggtccctgagtgagagactgctgcaactttcactggaacgcaatggagccagagcccctagccacatgtcaagttctcacagcttccctcagttggcacgcaaccagcaggggccccccctgcgcggcccacccgcagagggacctgagagcaggggccccccccctcaatatcctcatgtcgtgcttgcccatgagacaacgactgcagtaactgatcctagatatagggcaagaggttcccctcactttcaacacgccgaggtccgaattctccaagcacaggttccaccagtgtttctgcagcagcagcagcagtaccagtacttgcagcagtcacaagaacaccctcctccaccacaccccgccgctctgggacatgggcccctcagcagcttgtccccaccagcggtggagggacctgtgtcggcgcaagcctctagcgcaacatcgggtagcgcacacctggcacagatggaagctgtgctgcgcgaaaacgcccgcctgcaacgcgataacgaacgactgcagcgcgagctggagagcagcgccgagaaagccggacgcattgagaagctagagagtgagatccagcggctgtcagaggcgcacgaatcattaaccagagctagctctaagcgtgaagccctcgagaagacaatgaggaataagatggattcagagatgcggcgattgcaggacttcaatagggatctgcgcgagaggctggagtccgctaataggcgacttgcctccaaaacacaggaggcccaggctgggtcacaggacatggtcgcaaagctgttggcccagtcgtacgagcagcaacaggagcaagagaagctagaaagggagatggccctgctccgtggcgcaatcgaagaccagaggaggagagctgagctcctggaacaggctctcggaaatgctcagggtcgagcggcacgagcagaggaagaactgcgcaaaaagcaagcttatgtcgaaaaggtggagcgtctccagcaagccttggggcagctccaggccgcgtgtgaaaagcgcgagcaacttgaactgagacttcgcaccaggcttgagcaggagttgaaggcactcagggcccaacaagccggtgcaccgggtggaagttcaggcagtggtgggagccctgaactttccgcactgaggctgtcagagcagctgcgcgagaaagaggaacagatcctggccctggaggccgacatgacgaaatgggaacaaaagtatctagaggaaagagctatgagacaatttgccatggacgcagctgcgacagcggccgcccagcgggacaccactctcattcggcacagcccgcaaccaagcccaagtagctcattcaatgagggactgctcactggaggtcatcgccaccaagaaatggagtcgaggctgaaggtcttgcatgcccagattttagaaaaagacgctgtgattaaggtgctgcagcagcggtcaagaagggatcctggcaaagccatccagggaagtctgcgccccgcgaaatcagtcccatctgtctttgccgctgcagcagcaggaacccaaggctggcagggcttatcctcctccgagaggcagacagccgatgccccagccaggcttacaaccgatagagctcccaccgaggaacctgtcgtgacagctccccctgcagctcacgccaaacatggctcaagggacgggtcaacgcagaccgaaggaccacctgattcaacatcaacttgtcttcccccagagcccgacagtctgctgggctgctcttcatctcaacgggccgctagcctcgacagcgttgccacatcacgggttcaagatttgtcagacatggtggagatcctaatctag

SEQ ID NO: 40331 - DNA, 2514 bp, Artificial Sequence
  Description of Artificial Sequence: Synthetic coding sequence
atgaccggccggaaggccagcggcggcaccccctgcaccctgcggaagggggctcccatcataaccctcggcaagaactggactgaacggttggctgccggtgattcagtaggttgcagcggtgcacgttgtcaccgcccactgagcaggcaactctgcgcttctcagagatctatgcgcacgctggaggacagcagcgggactgtgctgcatcggctgatccaggaacagctacggtatggaaacctgacagaaacaaggacactcctggcgatccaacagcaggccttacgcggcggagccggcaccggtggcactggcagccctcaggctagtctcgaaatcctagccccagaagattcgcaagtgctccagcaggcaacacgccaggagccccaaggccaagaacatcagggcggcgaaaatcacctggccgagaataccctctaccggctttgcccccagcctagcaagggtgaggagctgcccacctacgaggaagccaaagcccattcccagtactacgcagctcagcaggcaggcacacgcccacatgccggggatcgggacccccggggtgcacccggaggatctagacgacaggacgaagcattaagagaacttcgacacggacacgtccgctcgctgagcgagcgcctcttacagcttagcttggaacgaaacggcgctcgggctccatcccacatgtctagcagccactcctttcctcagttagcccgcaaccagcaaggacccccgctgagagggccgcccgcggaaggccctgaaagtcggggcccgcccccccagtacccacatgttgttctcgcccatgagaccaccaccgctgtgacggatccacgctatagggctcgagggtctcctcatttccagcatgcagaggtaagaatcttacaggctcaagttcctcctgttttcctgcagcagcagcagcagtatcaataccttcaacagtcgcaggagcacccgcctcctccccatcccgctgcgctgggacacggcccactcagctcactgtctcctccagccgtggaggggcccgtatccgcccaagcctcctctgctacctcagggagcgcacaccttgcgcagatggaagcagtgcttcgagagaacgccagactgcaacgtgataacgagcggcttcagagagagctggaatcatctgccgaaaaagccggcaggattgaaaagttagagagtgagattcagagattatctgaagcacacgaaagtctgaccagagccagctcaaagagagaggcacttgaaaagactatgcggaacaagatggattctgaaatgaggagattgcaggattttaaccgcgatctgagagagcggttggagtccgctaatagacggctggccagtaaaacacaggaggctcaggctgggagccaagacatggtggccaagctactcgcacagagttatgagcaacagcaggaacaggagaaactagagcgcgaaatggccttactaaggggcgcgatcgaagaccagcgacggagggctgagttgctggaacaggcactgggaaacgcccaaggcagagcagctagggctgaagaggagttgcggaagaagcaagcgtacgtggaaaaagtggaacggctgcaacaggcactggggcaactgcaggccgcttgcgaaaaacgggaacaactcgaactaagactccgcacccggttggaacaggaactcaaagcactaagagcccagcaacgccaggcaggtgccccaggaggcagtagcggatctggaggatcccccgagctctccgccctgaggctctccgaacagcttagggagaaggaagagcagattcttgctctggaggccgacatgacaaagtgggagcagaaatacttggaggagagagccatgaggcagttcgctatggacgcagcagctaccgccgccgcccagcgcgatactactctgatccggcacagtccccagcctagcccgtcctcctccttcaatgaggggcttctgaccgggggccaccgacaccaagagatggagtcaagactcaaagtcctccacgcccagattctggagaaagatgccgtgattaaggtccttcagcagcgttctagaagagacccaggtaaagccattcagggcagtctgagaccagctaagtccgttccatccgtgttcgccgcggctgctgccggaactcaaggctggcagggactctcctcttctgagcggcagacagccgacgctcctgcccgtctgacaactgatcgcgcccccactgaggagccagtggttacggccccaccggccgctcatgccaaacacggatcccgagacggtagcacacaaaccgaaggccctccggactcgacttccacttgcctgccccctgaacccgattcactgctgggatgtagctcctcccagagagcagcatcacttgacagtgtggccaccagccgggtgcaagatctaagtgatatggttgagattcttatctag

SEQ ID NO: 40332 - DNA, 372 bp, Artificial Sequence
  Description of Artificial Sequence: Synthetic coding sequence
atgcggaccctggaggacagcagcggcaccgtgctgcaccggctgattcaggaacagctgcgctacggaaaccttactgaaacacgaacgctccttgcgatacagcagcaggcccttagaggaggggcaggcacgggaggcacaggctctcctcaggcttctttggaaatcctggcgcctgaggacagccaggtccttcagcaggccacccggcaggaaccccagggacaggagcatcagggcggtgagaatcacctggcagaaaatacactgtaccggctgtgcccacaaccatctaaaggagaagagctgccaacttatgaagaagcgaaagctcattcccaatactacgctgcgcagcaggccggctag

SEQ ID NO: 40333 - DNA, 480 bp, Artificial Sequence
  Description of Artificial Sequence: Synthetic coding sequence
atggagctgcccgccgtgaacctgaaggtgatcctgctgggccactggctcttgacgacctggggatgcattgtcttttccggcagttatgcctgggcaaactttactatccttgcactcggtgtgtgggccgtcgcacaacgggactctatcgatgccatttctatgttcctgggaggtttgttggcaaccatttttctggatattgtgcacataagtattttctatcctcgggtatcacttactgatacagggcggtttggtgtcggtatggctatcctctctctgttgctgaagcctctcagttgttgtttcgtctatcatatgtaccgtgagcgcggcggagagctcctagtacatactgggtttctgggctcaagccaagaccggagcgcctaccagactattgacagtgctgaggcacctgccgatccgttcgccgttcctgaagggaggtcccaggacgccaggggctattag

SEQ ID NO: 40334 - DNA, 459 bp, Artificial Sequence
  Description of Artificial Sequence: Synthetic coding sequence
atggagctgcccgccgtgaacctgaaggtgatcctgctgggccactggcttcttactacctgggggtgtatcgtctttagtgggtcctatgcctgggcaaacttcaccatcctcgcgctgggtgtgtgggccgtggctcagcgggactccattgatgccatctccatgttcttaggtggccttctcgctaccatcttcctggacattgtccatatctcaatcttttaccccagggtgtctctcactgataccggacgcttcggcgtaggcatggccatactgtcactcctgctgaaacctctaagctgctgttttgtgtatcatatgtaccgcgaaagaggtggctttcttggcagcagccaggatcgttctgcatatcagactattgacagcgctgaggcaccagcagacccattcgccgtgcctgagggtaggtcccaggacgctaggggatactag

SEQ ID NO: 40335 - DNA, 336 bp, Artificial Sequence
  Description of Artificial Sequence: Synthetic coding sequence
atggagctgcccgccgtgaacctgaagggcctgcactgcatcctgagactgctgtgcctgggccaactgcatcaccccggactgggccgcgtcgggtgtggatccgctggactgcaccggaggcataaacatgtgtcgggatggctggcaggtcatcacctgcctggacatagagctcaccagcacttgctgcctgcagggcagcctcatggccacgggccactgtggcgtggtcatgggcacccccagcttgcagcacaggcggcacttctactgttgcgactcccccacgtgcccggtgcccgcggttttccatgggttttctcgggaccatag

SEQ ID NO: 40336 - DNA, 444 bp, Artificial Sequence
  Description of Artificial Sequence: Synthetic coding sequence
atggagctgcccgccgtgaacctgaaggtgatcctgctgggccactggcttctcaccacctgcttctggcgacatttctcggctaagccaagactcgaaactatagaattaacctgtgccctctgcaagttgaggagcgcagcgcatcgcgctactgccggcctccattgtatccttcggctgctttgcctggggcagctccatcatccaggactgggtcgagtcgggtgtgggtccgccggcctgcataggcgccataaacatgtctccggatggttagctggccaccatctgcccggacatcgtgctcatcagcatctgctgcccgccggacagccgcacggccacgggccactttggaggggccatggccacccccagctggctgcccaggcggcactgctgctcctccgtttaccgcacgtgccaggtgctaggggttag

SEQ ID NO: 40337 - DNA, 468 bp, Artificial Sequence
  Description of Artificial Sequence: Synthetic coding sequence
atggagctgcccgccgtgaacctgaaggtgatcctgctgggccactggctactgaccacctgtttctggagacacttctcagctaaaccacgattagagacaatagagctgacctgtgccctgtgcaagctccggtctgccgctcatcgggcgaccgccgggctgcattgtattcttaggcttctttgcctggggcagctgcaccacccaggactgggtagagtgggctgtggcagcgcagggctgcaccgccgccacaagcacgtctccgggtggctcgctggccaccacctgccaggccatagagctcaccagcatctactccccgccggccaacctcatggccatggccctctctggagggggcatggacacccacagctggcggcacaggccgcattactgcttctgcggttgccacatgtgccaggagcaagagggtttccgtgggtgttttccggcccatag

SEQ ID NO: 40338 - DNA, 2406 bp, Artificial Sequence
  Description of Artificial Sequence: Synthetic coding sequence
atgaagtacgccgagaacatcatgctgaagctgaccttcagcaccacccaaatccaacagtatgagaacgtcttcatttttgaaactgggtactggctgacgaacgccataaaatataaccaggattaccttgatatctgtacctatcagcggctacagcagaggctgtacctccagaaaaaaataatccagaagcattttgagaagaagaaggacatccggcgaggaattggctaccttaaactgatttgtttcctcatcccgtttctgttgtctttgaagaaaaaaatgaaagtaccctacttatcctctctcttgcagccattcagtgacgacaaagttaaaacagagcgggaactgcctccatttatctacggccgggatttcaaatgtcaaaattttcactataaggaaaaccagtacttccacgtacacggtgggatcgagttcgacatttctacaccttcaatcgaaaatgccctcgaagacttccaaaagaatctcgaaaaaattagagattgcgctgcaaacacatttattgaagactcaggctacaaagagtactattccatccccgtaatggaattccacgggaaatcgtactatgtgatctacttcgagctagaaaccttttatcagcaactgtacaagacccagtggtggggggccatcaacgaaatcgtgaacaatctcagactgaagagattacccctaaccgacgctcagctgcatgaacagttcaaaaagaaactcggctttaaacgggcaatgaaatgcaaatcgatccctttcggaatgaagtccgctgtggagcggggtctgtcagccgtattccatacatttagcaggaaaactagtagttccacaatcaacgtcagcgatgaagcagggtatactatcttccatcacgcggctctgcacaatagggttagtatcatctgtcagttatgcaatgcaaatttcaaggtcaaccaacggcgttttgtgaccttctcccagggcccaacaccactgcatctagctgcacaagcttgttctttggaaaccacagtatgtctgctctgctctaaggcagattataccctctctgagaaacgagggtggatgccgattcatttcgctgctttttatgataacgtttgcatcattattgctctctgccgcaaggatccttcactgctcgaggccgaggcgactgctgagaaccagtgtactcctttgctcttggcggctacttccggggctctggataccatacaatatctcttcagcattggcgcaaactggagaaaaacagatatcaaagggaataacataatccatctctctgtgctcaccttccacacagaagtacttaaatatattatcaagttaaatatcccagagctgccagtgtggaaaacactggtggagatgctgcaatgcgagtcatacaaaagacggatgatggccgtaatgtctctcgaggtcatttgtctggccaatgaccagtactggagatgtattctagatgccggaacaatccccgcccttatcaaccttttgaaaagttctaagattaaacttcagtgcaaaaccgttgggctactgagcaatatcagcacccacaagtctgcggtgcacgcacttgttgaggcgggcggtatacctagtctcatcaatttattagtttgcgatgagccagaagtgcattcccgatgcgctgtaattctgtatgatatcgcccagtgcgaaaataaagatgtaatagcaaaatacaatggaattccttcactgatcaacctgctcaacttgaacatcgaaaatgttctcgtgaacgtcatgaactgtattcgcgtcctttgtattggaaacgaaaacaaccagagagcagtgcgcgagcacaaaggcttgccttatctcatccgattcctatcttccgacagcggcctgtttaatcttttcttgaactcattcgaagatgtcttgaaggcagtcagttcagccgccatagccgaggtgggcagagataacaaggagattcaggatgctatagcaatggagggagccatccccccgctggtagccttatttaaaggcaagcagatctccgtccagatgaagggcgccatggcggtcgaaagtcttgcttcccataacgccttgatccagaaggcattccttgaaaagtctttgacgaagtatcttctaaagttgctcaaggcttttcagatcgacgtcaaggagcagggagccgtcgccctgtgggctcttgccggtcagacattaaagcagcagaaatacatggcggaacaaattggctattcctttatcattaacatgctgctaagcccatcagccaagatgcagtacgtggggtacctgctcaagagccggctgtgcattaacacattctgtttacaatag

SEQ ID NO: 40339 - DNA, 4305 bp, Artificial Sequence
  Description of Artificial Sequence: Synthetic coding sequence
atgctgcggctgcccaagaagggcctgccccggttcgagcaggtgcaggatgaagatacttatcttgagaacctagccatccagagaaatgcgtcagcattttttgaaaagtatgataggtccgagatccaggaactcctaaccactgccctcgtgagctggctcagcgctaaggaagatgtaaggtctcaggtcgacttgccatgcgggatcatgtctcagatgaacaatgtaggttttagcactgcaatcttgctcacgcctgtagaccccaccgctctgctggattaccgcgaggtccaccagatgatccgggagctcgccataggtatttactgcttaaatcagatcccaagcatctctctggaggccaattacgatcaatccagctcctgccagcttccgccagcctattatgatacccggattgggcagatcttgatcaacattgattatatgctcaaggcactctggcatggaatatacatgccgaaggaaaagcgcgccagattctctgaactgtggagagccatcatggacattgacccagacggaaaaccgcagactaataaagatatcttttcagagtttagcagcgctggcttgactgatatcaccaaggatcccgactttaatgagatatacgacgaagatgtcaacgaggacccaacttatgaccctaactcacccgaagaaaccgccgtgtttatgaagtatgctgagaatataatgctgaaactcacctttagcaccacacagattcagcaatacgagaacgtttttatttttgagacagggtattggttgacaaacgctatcaaatataaccaggactatttggacatctgcacataccaacggcttcagcagcgcctgtacctgcaaaaaaaaattattcagaaacactttgagaagaaaaaagacattaggcgcggaatcggctatctgaagttgatatgctttctgatccctttcctgctttccctaaaaaagaaaatgaaggtcccctacttgtcttctttgctccagccattttccgacgataaggtaaagacggagcgtgaactgccccctttcatctacgggcgcgacttcaaatgccagaactttcactataaagaaaaccagtactttcatgttcatggcggaatcgaatttgatatttcgaccccatctatcgaaaacgcgctggaggacttccagaaaaatcttgaaaagatccgagactgcgccgcaaataccttcatcgaagatagcgggtataaggaatattatagcatcccggtcatggaattccatggcaagtcatactacgtaatttactttgagctcgagaccttttaccaacaactctacaagacccagtggtggggtgcaatcaacgagattgtcaacaatcttcggctgaaaaggctacccttaacagacgctcaactacacgagcaatttaaaaaaaaactggggttcaaaagggcaatgaaatgtaaatctattccctttggaatgaagtccgcagtcgaacgcggtctgtctgccgtattccatacctttagtcgaaaaacaagtagctctaccatcaatgtatccgatgaagcaggctataccatattccaccatgcagccctccacaatagagtgtcaataatttgtcagctctgcaatgcgaatttcaaagtgaatcaaagaagatttgtgacctttagccagggcccgacacctttgcatcttgcagcgcaagcttgctcactcgagaccacagtctgcttactgtgctcaaaagccgactacacgctctcagagaagcgcggctggatgccaatccactttgccgccttctatgacaatgtctgcattattattgctctttgtcgtaaggatccaagccttctagaggcagaagctacagctgagaatcagtgcacaccccttctgctcgcagctacttccggcgctctggacaccattcagtacctcttcagtatcggagcaaattggcgaaaaaccgatatcaaaggcaataatatcattcacctttcggtcttgacattccataccgaggtgctcaaatacataattaaactcaacatcccggaactgcccgtgtggaagacgttggtggagatgctccaatgcgagtcctacaaacggagaatgatggcagtgatgtctctggaggtgatctgtctggcaaacgaccaatattggcggtgtatactggatgccgggaccattcccgcgttaattaatctgctcaagtcgtcaaagattaaactgcagtgcaagaccgtcggcctgctatcaaacatctcgacacacaagtcagcagtgcacgccctggtggaagccggtggaatacccagccttattaacctgctggtctgtgacgagcctgaagttcacagccggtgtgccgtcatcctgtacgacatcgcacaatgcgagaacaaagacgtgatcgccaagtacaacggaattccgagtttgatcaatctcttgaatctgaatattgaaaacgtactggtgaacgtgatgaactgcattagggtgctatgcatcgggaatgaaaacaaccaaagggccgtgagggaacataaggggcttccttacctaatccggtttctatcatctgactctgatgtgctgaaggctgtctcgagtgccgctatcgccgaggtcggccgcgataataaggaaatacaagacgctattgccatggaaggggcaattccaccactggtggcactctttaaaggcaagcagatctctgttcagatgaaaggtgccatggccgtggaatctctggcttctcacaatgccctgatccaaaaggcattcctggagaaaagtcttaccaaatacttgctgaagctcctgaaggccttccagatcgatgtgaaagaacagggcgccgtcgcactatgggctttagctggacagacactgaagcaacagaagtatatggcagaacaaatcgggtactccttcattatcaatatgctgctgtcccctagcgctaagatgcagtatgtgggcggcgaggctgttatcgccctaagcaaggactcacggatgcaccagaaccagatttgcgagggcaatggtatcgccccccttgttcgcctacttaggattagtactattgccgagggtactctgctgtcggtaattagagccgtgggcagcatttgcatcggggtcgcccacactagcaatcctgtctctcagcagctcgttgtcgatgaaaacgctttccccgtcctgattcaactgctcagaaaccacccatcacccaatattaaggtggaggtggccttctcccttgcctgtatcgttctgggtaatgatgtgctgcagaaggatttgcacgaaaacgagggtttcgagtacgcggatgtactttacttattgcacagtaccgagaaagatatctgtctgagagccggctacgcgctgactttatttgcattcaataatcgtttccaacagtacttgattctggagtcaggtattatgacaataagcattttcgagcgcttcctggaaagtaccgttgaaacggagaaagctatggccgccttccagattgtggtcttggcaaaagtgataagggatatggatcacatcacactgtccgccaggggcgtcacaattctggtcgattccctgtactccgtgcaaactagtaccattgtgttaaccgggaacctgattgcatcattggcccactcccgggccgggattccagaggctttcactaccttgggcacgatccagcgactgtgctatcatctctattctggtattgaggaagtacgcgcggcttgttccagcgctttgggctacctgacctacaatgctaacgcctttcgtatactgcttaaggagtgtcgtaacaaacctaatcagtttattagaatcaagaataatatttctcgggacgcctctatcaaccccgcatttcttaaggagtttcagatgcaacagaccctggttggtctcccctccttgagcctcgagaagaacggcggccccagcatcattcccatatttaaaaggggtaaagagcacaggcgaaagctgaagccgaagatacaacccaaagacagcttgactctgctgccacccgtgaccaattttatgggtttgttcaaagctacgaagaaaaccaaagactcccacaatatctttagctttagttctacgatcaccagcgatattactaacgtgagtcgcccccgtatcgtttgcctgaaccagcttggcaagcatgtacagaaggctaatccagagccagccgaaggatag

SEQ ID NO: 40340 - DNA, 1080 bp, Artificial Sequence
  Description of Artificial Sequence: Synthetic coding sequence
atgaagggcgccatggccgtggagagcctggccagccacaacgccctgatccagaaagccttcctcgaaaagtctttgacgaagtacctgttgaaattactcaaggccttccaaattgacgtgaaggaacaaggcgcagtggctctctgggccctggccggacagacattgaagcagcagaagtacatggctgagcaaattggatatagctttataatcaacatgctcctttctccctccgccaagatgcagtatgtcggcggggaggcagtcattgcactgtctaaagacagccgaatgcaccagaatcagatttgcgaaggaaatggcatcgcacctttagtcagactgttgcggatttctactattgctgaggggacactcctgtcagtgataagggccgtcggctccatttgcatcggtgtggctcacacaagcaatcccgtctctcagcaactggtagtggatgaaaatgccttccccgtgctgattcaattgctgcgcaaccatccttcaccaaatattaaggttgaggtggccttttctctggcctgcatcgtgttaggaaatgacgttctacagaaggatttacacgaaaacgagggattcgaatatgcagatgtgctgtatttactacactcaacagagaaggacatctgcctaagggcgggatacgctctcacactgttcgccttcaataacaggtttcaacagtatctgatactggaaagtgggattatgacaataagcatcttcgagcgatttctggaatccaccgtggaaaccgagaaggcgatggccgcatttcagatcgtggtgctggctaaagtaatccgcgacatggatcacatcacccttagcgcgagaggcgttacaatccttgttgattcattgtactccgtgcaaacctccacgatcgtgcttactggcaacttgattgcctccctggcgcatagcagagctggtatcccagaggcgttcaccacattgggcaccatacagagactttgttaccatctgtactccgggatcgaggagagcggggaggagtggcgtactattcacaacagctacttgtag

SEQ ID NO: 40341 - DNA, 4092 bp, Artificial Sequence
  Description of Artificial Sequence: Synthetic coding sequence
atgagccagatgaacaacgtgggcttcagcaccgccatcctgctgacgcccgtggaccctacagcgttgcttgattatagggaggtgcatcaaatgattagggagctggccatcggaatctactgtctcaatcagatccccagcattagcctggaggccaactacgaccagagctcttcctgtcagctgcctcccgcgtactatgatacccggatcgggcagatcttgataaatatcgattacatgctgaaagcactctggcacggtatctatatgccaaaagagaagcgcgcccgctttagtgaactgtggagagctattatggacatcgatcctgatgggaaaccacagaccaacaaggacattttcagcgagttcagtagtgctggtctgacagacatcaccaaggaccctgattttaacgagatttacgatgaggacgtgaatgaagaccccacatacgacccgaattcgcccgaggagactgccgttttcatgaaatacgctgagaacatcatgctcaagttaactttctctacaacacagattcagcagtacgagaacgtgtttatctttgagacaggatattggctgaccaatgctattaagtataaccaggactatctggatatttgcacctaccagaggctccagcaaagactgtatctgcaaaaaaaaataatccagaaacactttgagaaaaaaaaggacatcagaagaggaataggttacctgaagttgatttgttttctgattcccttcctgctctccctaaaaaaaaaaatgaaagtgccctatcttagttccctacttcaacctttttccgacgacaaggtgaaaaccgagcgcgagctgccaccttttatctacgggcgcgatttcaagtgtcagaactttcactacaaggagaaccaatacttccacgtgcacggaggaattgaattcgatataagcaccccctccatagagaatgcacttgaggacttccagaagaatttggaaaagatacgcgactgtgcggcaaacactttcatcgaggacagcggatataaggaatactactcgatccctgtcatggaattccatgggaaatcatactatgttatttattttgagttggagacattttatcagcagctgtacaagacacagtggtggggggcaatcaacgagattgtcaacaacctccgtctcaaacgactccctctgacagatgctcagctgcatgagcaatttaaaaagaagctaggatttaagcgggcaatgaagtgcaaaagcatacccttcgggatgaagtctgcggttgaaagaggcctgagcgccgtattccatactttctccagaaaaaccagtagctctactattaatgtgtcggacgaggccggatatacgatttttcatcatgccgcattgcacaaccgcgtgagtattatctgccaactgtgtaatgccaattttaaagtaaatcagcgccgatttgttacgttcagtcagggtcccacacccctgcacctggcagcccaagcttgctcactcgaaacgaccgtgtgcctattgtgctccaaggctgattacacgctttcggaaaagagaggttggatgccaattcactttgctgcattctacgacaacgtatgcattatcatcgcgttgtgccgcaaagatccctccttgctggaagcggaggctaccgccgagaatcagtgcactcctctgctgctggcagcaacaagcggagccttggacacaatacagtacctgttcagcataggggccaattggaggaagacagacataaagggcaacaacattatccacctcagtgtgttgacattccacaccgaagtactcaaatatattattaaattgaatatccccgaactgcccgtctggaaaactctggtcgagatgctccagtgcgaatcctataaaaggcgtatgatggctgtgatgagccttgaagtgatctgtctggctaacgaccaatattggcgatgtatcctggacgcaggtacaatccctgccttgatcaacctcctgaaatcctccaagataaagctgcagtgtaaaactgtggggttgctctccaatattagtactcacaagagcgccgtgcatgcgctggtggaagcagggggcattccctcattaattaacctcctagtgtgtgatgaaccagaggtccacagccgctgtgcagttattctctatgacatcgctcagtgtgaaaacaaagacgtgattgcaaagtataatggtatcccctcactcatcaatctgctcaacctgaatattgaaaatgtcctggttaatgttatgaattgtatcagagtgctctgcatcggaaacgagaataaccagcgagcagtcagggagcataagggtctgccgtatctgatccggttcctgagcagtgattcagacgtcctgaaggcagtcagcagtgccgcaatcgccgaagtgggaagggacaacaaggagatccaggatgccatcgccatggaaggcgccattccacccctcgttgcgctgtttaagggtaagcaaataagcgtccagatgaagggggcgatggctgtggaatctctggccagccataatgccctgattcagaaggcctttcttgaaaagtctctgactaagtacctacttaagctactcaaagcctttcagatcgatgttaaggagcagggggctgtcgccttatgggctttggctggtcagaccctcaagcagcagaagtacatggcggagcagatcggctattcatttatcatcaatatgttgctatccccttccgcaaagatgcagtatgtcggcggagaggccgtgatcgcattgtccaaggactctcgcatgcaccagaaccagatatgcgagggcaatggaatcgcgccactcgtccggctccttcgcatcagtactatcgccgaggggaccttgctttccgtgatccgggcagtcgggagtatatgtattggggttgcgcatacttccaatccagtgtcccagcagttggttgtcgacgaaaatgcgtttcccgttctgatacagctgttgagaaaccatccaagcccaaatatcaaagtggaagtggcttttagcctcgcttgtattgtcttaggtaacgatgtgttacaaaaagatctacacgagaatgagggatttgaatacgctgacgtcctgtacttactccatagcacggagaaagacatctgcttaagggcggggtatgctctgaccctcttcgccttcaataaccgttttcagcagtatctgatactggaaagcgggataatgactatcagcatctttgaaagatttctggaatctacagtggagactgagaaggccatggctgcattccaaattgtggtactcgcaaaagtcatacgtgacatggatcatataacattgagcgctaggggagtgactatcctagttgatagcctgtactcggtgcagacctcaaccatcgtcctgacgggtaacctgattgcttcccttgcccacagccgcgcaggaatcccggaggcatttaccacgctgggtacgatccagcggttgtgctaccacctgtacagcggtattgaggaagtgcgggctgcgtgttcgagcgctcttggctatttgacctataacgcgaatgccttccggattctgttaaaggaatgtaggaacaaaccaaatcagttcatcaggatcaaaaataacatttcacgtgacgccagcatcaatccagcctttctgaaagaattccaaatgcagcagaccctcgtggggctccccagtctgtccctggagaagaacggaggcccctccattatccctatctttaagcgtggtaaagagcatcggaggaaactgaagccaaagatacaaccaaaggatagcctgaccctcctgcctcccgtcactaatttcatggggctcttcaaggcaacaaaaaagaccaaggatagtcataacatcttcagtttttccagtaccattacttctgacattactaatgtcagcaggccccgcattgtgtgcctgaatcagttgggcaaacacgtacagaaagctaaccctgaaccagccgaaggatag

SEQ ID NO: 40342 - DNA, 3243 bp, Artificial Sequence
  Description of Artificial Sequence: Synthetic coding sequence
atgctgcggctgcccaagaagggcctgccccggttcgagcaggtgcaagatgaggatacttaccttgaaaacctcgctatacaaaggaacgctagtgccttcttcgagaagtacgacagaagcgagatccaggagctgttgacaaccgcactggtctcttggctctcagctaaagaggatgttcggtcacaggtggatttaccttgcggaatcatgtcacagatgaataacgttgggtttagcacggccatcttactcacgcctgttgaccctactgctttgttagactaccgcgaagtgcaccaaatgattagggaactggccatcgggatctattgcttgaatcagattccaagtatttctttagaagcaaactacgaccaaagcagttcttgccagctaccccctgcctattacgatacacggataggacagattctcataaatatcgactatatgttgaaggccctctggcatggcatttacatgcccaaagagaagcgcgcaaggttcagtgagctatggagggccatcatggatatcgatcctgacggtaaaccccagactaataaggacattttttcagagttctctagcgcgggtctgacagatattactaaagatccagactttaatgaaatatatgacgaggacgtgaacgaggatcctacttacgaccccaattctccagaggaaactgccgtgtttatgaagtacgccgagaacatcatgttgaaactgacctttagcactacccagatccaacagtacgagaacgtgtttatcttcgaaaccgggtattggctgacgaacgcaatcaagtacaaccaggattaccttgacatatgcacctatcagaggctgcaacagcggttatacctacagaaaaaaattatccagaagcacttcgagaaaaaaaaagacattcggaggggcattggctacctgaagttgatctgcttcctaataccctttctattgtctctgaagaagaagatgaaagtgccatacctaagctctttgctgcagcccttctccgacgataaagtgaaaacagagcgggagctgcctcccttcatttacgggcgggactttaagtgccagaattttcactataaggaaaaccagtatttccatgtccatgggggaatcgaatttgatatttccacccccagcattgaaaacgccctagaggacttccaaaaaaacctggaaaagattagagactgcgccgccaatacttttattgaggactccggctacaaggaatattacagcatacccgtgatggaattccatggaaagtcatattatgtgatctacttcgaactagagaccttctaccagcagctctacaaaacccagtggtggggagccattaacgaaattgtgaataacctgaggttaaagcggttaccactaactgacgcccagttacatgagcagtttaagaagaagctgggcttcaagagagcaatgaagtgtaaatctataccgttcgggatgaagtctgctgtggaacgaggattaagtgcagtgttccacacattttccaggaagacctcgtcctctacaattaatgtctctgacgaagctggttacaccattttccaccacgctgcattgcacaatcgggtgagcataatatgtcagttatgtaatgctaacttcaaagtcaaccagcggaggttcgtgactttttcgcagggcccaacacctctgcacctggccgcgcaggcatgctcccttgagacaacagtttgcttactgtgttccaaagctgattacacactgagtgagaaacgaggatggatgcccatacactttgccgcattttacgataatgtgtgcattattatcgccttgtgtcgcaaggacccaagtctgctggaagccgaagccaccgctgaaaaccagtgtactcccttgctactggctgctacaagcggcgccttagacactatccaatacttattctctatcggcgctaactggcggaaaacagatataaaggggaacaatattattcacctctctgtgcttacttttcataccgaagtcctgaagtatatcatcaagctcaatattccagagctccccgtgtggaagacattagtagagatgttgcagtgcgagtcatataaaagacgcatgatggccgtgatgtccctcgaagtgatatgtttggctaacgatcagtactggagatgcattctggacgcaggcaccattcccgcactgatcaatcttctcaagtcttctaagattaaactgcagtgtaagactgtcggtctgctttctaacatcagcactcacaaaagcgccgtgcatgccttggtggaggctgggggaataccaagcctcattaacctgctcgtgtgcgacgagccggaagtgcacagccgctgcgctgtaatcttgtacgacatcgctcagtgtgagaataaagatgtgattgctaagtacaatggcatcccttccctgatcaacctgttaaacctcaacatcgagaatgtcctggtcaatgttatgaattgtatccgagtcctgtgtattggcaacgaaaataatcagagagctgtcagggaacacaaaggcctgccatacttgatccgttttttgtcaagtgacagcgatgtgctcaaagccgtgtctagcgctgccatcgctgaggtggggagggacaataaggaaatacaggacgctatcgctatggagggggccatccccccactggtcgctctgttcaaaggcaaacagatctcagtacagatgaagggagccatggcagtggaaagcctggcatcgcacaatgcccttattcagaaggcttttctcgagaagtctttaactaaatatcttctcaagctgcttaaggctttccagattgacgtaaaagaacagggagctgtagcactatgggcattggctggccagaccctgaaacagcagaagtacatggctgagcaaatcggctacagttttatcataaacatgctattgagccccagtgccaagatgcagtacgtcggtggggaggccgtaattgcactgtctaaagactctagaatgcatcagaatcagatctgcgaaggcaatggcatcgccccgctcgtccgattactgagaatctcaaccattgccgagggcaccctgctgagcgtgatcagagcagttggatcaatctgtataggatatctgctaaaatcacggctgtgcattaatactttttgcttgcagtag

SEQ ID NO: 40343 - DNA, 4305 bp, Artificial Sequence
  Description of Artificial Sequence: Synthetic coding sequence
atgctgcggctgcccaagaagggcctgccccggttcgagcaggtgcaggacgaagacacatatttggagaatctcgcaatacagcgaaacgcctcagccttcttcgagaaatacgataggagcgaaatccaggaattattgactactgctctggtgtcgtggctatccgctaaggaagatgtaagaagccaggtggatttgccatgcggcataatgagtcagatgaacaacgtcggcttcagcacggctattttactcaccccggttgatcctaccgcgcttctggactacagggaagtgcaccagatgatcagggagctggctatcgggatctactgcctgaaccagatcccgagtatcagccttgaggccaactacgatcagtcatcatcttgccagctcccccctgcttactacgatacccggattggccagattttgattaatattgattacatgctcaaagctctgtggcacggaatctacatgcccaaagaaaagcgggcacgcttctccgagctgtggagggctatcatggatatagatcctgatggcaagccccagaccaacaaggatatctttagcgaattttctagtgccgggctgacagacatcacaaaggaccctgactttaacgaaatttacgacgaggacgtgaacgaggatccgacctacgacccaaacagcccagaagagacagccgtttttatgaagtatgcagaaaacatcatgttaaaactgactttcagtaccacacagatccagcaatacgagaacgtcttcatattcgagaccggctactggctgactaacgcaataaaatataatcaggattatctggatatttgcacataccaacgccttcagcaaaggttgtacttacagaagaaaattatccagaagcactttgagaagaagaaagacattaggcgtgggatcgggtacctgaagcttatctgcttccttattcccttcctgctctcgctgaaaaagaagatgaaggtaccctatctcagctcattactgcagccttttagtgatgataaggtcaagactgagagagagctaccaccattcatctacgggcgtgacttcaagtgtcaaaacttccattataaggagaatcagtattttcatgtgcatgggggcatcgagttcgacatttcaacaccatctattgaaaatgccttggaggacttccagaagaaccttgaaaagatcagggattgcgctgcgaacacctttatcgaggactctggatacaaggaatattacagtattcccgtcatggaattccacggtaaaagctattacgtgatttactttgagctggagaccttctaccagcaactgtacaagacacagtggtggggtgcgatcaacgaaattgttaacaacttgcgccttaagagactccctctgaccgatgcccagctgcatgagcagttcaagaagaagctgggctttaagagagcaatgaaatgtaagtccatcccgttcggtatgaaaagtgctgtggaacgaggattatcagctgtttttcatacctttagtcgcaaaacctcttcttccaccataaacgtgagcgacgaagctggatacaccatcttccaccacgcggctctacataacagggtgagcataatatgtcaactgtgcaatgccaatttcaaggtcaatcaacggcgcttcgtaactttcagccaggggcctacacccttgcatctagccgctcaggcctgctctctggagaccacagtgtgcctgttgtgttccaaagctgattatacgctgtccgaaaagcgaggctggatgcctatccactttgcagctttttatgataatgtgtgcattattatcgctctgtgcagaaaggatccgagcctcctcgaagccgaagccacagccgaaaaccagtgcacacctctcctgctggccgcaactagcggggctctcgacactattcaatacctgttttctattggggccaattggaggaaaaccgacatcaaggggaacaatattattcacttgtcagtattgacattccatactgaggtgttaaagtacattataaaactcaacattcctgaactcccagtctggaagactctcgtggagatgctgcaatgcgagagctacaagcgccgtatgatggctgtgatgtccctcgaggtgatttgcctcgccaacgatcagtattggcgctgcattctggatgcagggactattccagccctgatcaatctgctgaagtccagcaaaatcaagttgcaatgtaagaccgtaggcctcttgtccaacatctccacccacaaaagcgcagtccatgcattggtcgaggctgggggcattcctagcttgattaacctcctcgtttgcgatgagcccgaagttcattctcgctgcgccgtgatcctttacgacattgcccagtgcgagaataaggacgtgatcgcaaaatataacggtattccctcgctgattaacctgctgaacttaaacatagagaacgtgctggtgaacgttatgaactgtattagggttctgtgtatcgggaacgaaaataatcagcgagcggtccgcgagcacaaaggacttccttacttgatccggttcctctcgagtgacagtgatgtcctgaaagccgtaagctctgccgctatcgcagaagtaggccgcgataacaaggagatccaagacgcgatcgcgatggagggtgccatccctcctctcgtcgcgctcttcaaaggtaaacaaatcagcgtccagatgaagggcgcaatggctgtggagagtctggcaagccacaacgccctcatacagaaggcctttctggaaaagagtctgaccaaatatctgttgaagctcctcaaggcattccagatagacgtcaaggagcaaggagctgtcgctctgtgggcgctggcagggcaaactctcaaacagcagaagtatatggcagagcagatcggctatagctttattattaacatgcttctgtctccctccgcaaaaatgcagtatgtgggcggcgaggctgtaatcgctctgtcaaaggactcaagaatgcatcaaaatcagatttgcgaggggaacggtatcgccccactcgtccggctccttagaatcagcactatcgccgaggggacccttctgtcggttatcagagcagtaggctcaatatgtattggggttgcccatacttcaaaccccgttagccagcaattagtggtcgatgagaatgccttccctgtcctcatacagttacttcgtaatcatccctctccaaatatcaaagtggaggtagccttttctctagcctgtattgtgctggggaatgacgtgctgcagaaggatctccatgaaaatgagggatttgagtatgcagacgtcctgtatctgttgcactctaccgaaaaggacatatgcctgcgggctggctatgcactgaccctgtttgcctttaacaatagattccaacagtacctaattcttgaatcaggcatcatgacaattagcatctttgagaggtttctcgaatccacagtggagacagaaaaagcaatggcagccttccaaatagtggtgcttgctaaagtcattcgagacatggaccacattactttgtcagcccgcggagtcactattctggtggatagtctgtattctgttcagactagtaccatcgttctaactgggaacctgatcgcctctcttgcccactcacgagcagggatccctgaagctttcaccacattaggtacaattcagcggctgtgctatcatctgtattccggcattgaagaagtgcgcgcagcgtgttccagtgccctgggatacctcacatataatgctaatgcatttcgcatcttgctgaaagaatgccgcaacaagccaaatcagttcatccgaatcaagaacaatatttccagggatgcttccataaatccagctttccttaaggaattccaaatgcagcagacgctggtcgggcttccatccctttccctggagaaaaacggcgggccctcgataatcccgatctttaagagagggaaggagcaccgccgtaaacttaaacctaagatccaaccgaaggattctttgaccctcctgcccccagttaccaatttcatgggcctttttaaggccacgaagaagaccaaggattctcataatatctttagcttctctagcacaatcacaagcgacatcacaaatgtatcccgaccgcgtatcgtttgccttaaccagctgggtaaacatgtgcagaaggctaacccagaacccgcagagggatag

SEQ ID NO: 40344 - DNA, 3513 bp, Artificial Sequence
  Description of Artificial Sequence: Synthetic coding sequence
atggccgaggaggaggtggccaagctggagaagcacctgatgctgctgaggcaagagtacgtcaagttgcagaaaaagctggcggagacagaaaaacgctgtgcgcttctcgcggcgcaagccaacaaagagtccagctccgaaagttttatctctaggctgctggctatcgtagccgatctgtatgagcaagaacaatactccgacttaaagatcaaagttggggacagacacatttccgcccacaagtttgtgctggcggccaggagcgactcgtggagcctggccaatctgtcctccacaaaagagctggatctcagcgatgccaaccccgaggtaaccatgaccatgctccggtggatctacaccgacgaactggaatttcgggaggatgacgtgttcctgacagagctgatgaagctggctaatcggtttcagctgcaacttctgagggaacgatgtgaaaagggagtgatgtcccttgttaatgttaggaactgcatccggttctaccagactgcggaggaactgaacgcaagtacgctgatgaactactgcgccgaaattatcgcttcacactgggatgatctgaggaaggaagatttttcttcgatgtccgctcagctgctctacaaaatgattaagtcaaaaacagagtacccgcttcacaaggccataaaggtcgagcgggaagacgttgtctttctgtaccttatagagatggattcccaacttcccggtaagctcaatgaggccgaccataatggtgacttagctctggatctggctctgagcagacgccttgaatccattgctaccactttggtaagtcacaaggcggatgtggatatggtggataaatctggatggagtcttttacacaaaggcatccaaagaggcgacctgtttgccgcaacatttctgatcaagaacggcgcctttgtgaacgcggccactctcggtgcacaggagactcctctgcatctggttgccttgtactcaagcaaaaaacactccgccgacgtgatgagcgaaatggctcagatcgccgaggctcttctccaagccggggctaatccaaatatgcaggacagcaagggacgaactccacttcatgtttctattatggctggcaatgagtacgtgttctcccagttgctgcagtgcaagcagctggatctggagctaaaagatcatgaaggaagtacggctctgtggctcgctgtgcagcatataaccgtgagttccgatcagtctgtgaacccgtttgaggatgtgcccgttgtgaatggaactagtttcgatgaaaacagcttcgctgccagactcattcagcgtggcagtcacacagatgctccagatacggctaccgggaactgcctgctccagagggccgcgggagctggaaacgaagcggcggccttgtttctggcgaccaatggcgcccatgtgaatcataggaacaagtggggcgagacacctctccacaccgcctgtcggcatggactagccaacttgacggcagagctcttacagcagggggccaaccctaatttacagactgaggaggctctgcctttgcccaaggaggccgccagtctcaccagtttggcagacagcgtccacctccagactcccctccacatggctatagcatacaatcatccagacgttgtgagcgtcatcctggaacagaaggcgaacgccctccacgctacaaataacctccaaattatacccgatttctcactgaaggacagtagagatcaaactgtcctgggccttgctttgtggacgggcatgcatacaatcgcagctcaactgctgggatccggcgctgctattaacgataccatgagtgatggtcagacactactccacatggctatccagcgtcaggactcgaaatccgctctgttcttgctggagcatcaggcggacattaatgtctcgcgaacgcaggatggcgagaccgctcttcagctcgctataaggaaccagctgcctctggtggttgacgcgatttgcacaaggggagccgatatgagcgttccagacgaaaagggtaacccgccactgtggctagcactcgcaaacaacttagaggatattgcctctacactggtgcgccacgggtgtgacgccacctgctggggcccaggtcccggggggtgcctgcaaactttactgcaccgggcaattgatgagaataatgagccgaccgcctgttttctgatccgctctggttgtgatgtaaactctccccgtcagcccggagcgaatggcgagggcgaggaagaggcccgagatggccagactcctctacatcttgcagcaagctggggattggaagaaaccgtgcaatgcttgctggagtttggagcaaacgtcaacgctcaagacgcggagggcagaaccccaatacacgtagcaatttctagtcaacatggggtaattattcagctactggtctcacaccccgatattcacctgaatgtgagggacaggcaaggcctgacacctttcgcatgcgccatgacgttcaaaaacaacaaaagtgcggaggccattctgaagcgcgaatctggcgccgccgagcaggtggacaacaagggcaggaatttccttcacgtggccgtccagaactccgacattgagtccgtcctgttcctcatcagtgtgcatgccaatgtcaatagtagagtgcaagacgcaagcaagcttacaccgctgcatctagccgtccaggccggaagcgagatcatcgtgagaaatctgctactggccggcgctaaggtcaacgaactgacaaaacataggcagacagccctacatctggcagcacagcaggacctgcctacaatctgtagcgtgctcctcgaaaacggagtagactttgccgctgtcgacgaaaacggcaataacgccttacatcttgccgtgatgcacgggaggcttaacaatataagggttctgctcacagagtgtacagtcgatgctgaggcctttaacctcagaggtcagagccctctgcatatcctcgggcagtatggcaaagaaaacgcggcagctatttttgaccttttcctagagtgcatgcctggatatccactcgacaagccagatgcagacggctccacagtattgttactggcatatatgaaggggaatgctaacctttgtcgggcgatcgtgagatcaggcgcccgactgggcgttaataataaccagggagtgaatattttcaattaccaggtcgctacaaagcagctcctttttcggctgctggatatgttgtccaaggaacctccctggtgcgatggaagttactgctatgagtgcacagcccgcttcggcgttacgactcggaagcatcactgcagacattgcggaagacttttatgccacaaatgttcaaccaaagagattcccatcataaaatttgacctgaataagccagtgagagtctgtaatatttgtttcgatgtacttactttaggtggcgtgtcatag

SEQ ID NO: 40345 - DNA, 1464 bp, Artificial Sequence
  Description of Artificial Sequence: Synthetic coding sequence
atggccgaggaggaggtggccaagctggagaagcacctgatgctgcttcggcaggaatatgttaagctccagaaaaagcttgctgaaaccgaaaaacgctgtgcactactagccgcacaggctaataaggagtcctcttcagagagtttcatctccaggctgctggccatagtggccgacctatacgagcaggagcaatatagtgatctgaagattaaggtgggagaccggcacatctccgcccacaaatttgtattagccgccagaagcgactcatggtctctcgccaatctcagcagtactaaggagctggacctgagcgacgctaaccccgaggtgacgatgaccatgctgagatggatctatacagacgagttagaatttagggaggatgatgtgtttctgaccgagctcatgaaacttgccaatcggttccagctgcaattgctccgggaaaggtgcgaaaagggagttatgagcttggtaaatgtgcgtaactgcatccgattctatcagactgctgaagaattgaacgcgtcgaccctgatgaactattgtgccgaaatcatagcttcccactgggatgaccttagaaaagaggattttagttccatgtccgcccaactgctttataagatgatcaagtccaagactgagtaccccctgcataaagcaattaaggtcgagagggaggatgtggtgtttttgtacctgattgagatggactcccaactacctggcaaacttaacgaggccgaccacaatggcgacctcgccctagacttggccctgtccagacgcctggaatccatcgccaccacccttgtttctcacaaggctgatgtggacatggtggataagtctgggtggtctctcttgcacaagggaatccagcgcggcgatcttttcgctgccacattcctgatcaagaacggtgctttcgtaaatgcagccaccctgggtgcgcaagaaactcccttgcacctggtggcgttgtactcgtctaaaaagcactcggctgatgtgatgagcgagatggctcagatagccgaggccctcctccaggccggggcaaaccccaatatgcaggattctaaagggaggacacctctgcatgtctccattatggccggaaatgagtacgttttctcacagcttctgcaatgcaagcagctggacttggaactgaaggaccatgagggttctacagcattgtggctggctgttcagcacatcaccgtgtcaagcgatcagtctgtaaatccatttgaagacgttcccgtggttaacgggaccagtttcgatgaaaatagctttgccgcccgcttgattcaaaggggttcccacaccgacgcaccagacaccgccacgggtaaggcaagagcttctaggagaggggatgccggggtgtgtaggcgccaggagatggcctgcaagtgtttacaccctaaattcaggaattag

SEQ ID NO: 40346 - DNA, 3336 bp, Artificial Sequence
  Description of Artificial Sequence: Synthetic coding sequence
atgagcagctgccggcggagctggcggcggcagcggagcgccgccctcagttggctgcggcggcagactaggcgcgcagcagcctccccctctagcgccgtgtgttggccaagctggcagaccagcacgtcaaggtctagtaccgatgcaaacccagaagtaacaatgacaatgcttagatggatctacactgatgagttagagtttcgggaagatgacgtgttcctgaccgaacttatgaagctggcaaacaggttccagctccagctgttgcgggagagatgtgagaagggagtgatgtctctggtgaatgtacgcaactgcatcaggttctatcaaaccgccgaagagctcaacgcctctaccctcatgaactattgtgcagagattatcgcatcccattgggacgatctgagaaaagaagattttagctcaatgtctgcccaattgctctataagatgattaaatctaagaccgaatatcctctacataaggctataaaagtagagagggaagacgtcgtgtttttgtatctgattgaaatggattcacagctgcccggcaagttgaacgaggcggatcacaatggtgacctggctttagatctggcattatctagacgattagaaagtatcgcaaccacactcgtctcccacaaggcggatgttgatatggtggataagtctggctggtctttgctgcacaaaggaatccagagaggcgatctctttgccgctaccttcttgataaagaacggggctttcgtaaacgccgccactttgggtgcacaggagactcctctccatctggtggccctgtattcttccaagaaacacagcgcagatgtcatgagtgagatggctcagatcgcagaggctctcctgcaggccggcgccaaccccaacatgcaagacagcaagggccggacccctctccatgtgtccattatggccggaaatgagtatgtcttcagtcagctcctgcagtgcaagcagctggacctggagcttaaggatcatgaaggaagcaccgccctgtggctcgcagtgcagcacataacagttagcagcgatcagtctgtcaatccattcgaggatgtgcccgtggtgaatggtacgtcctttgacgaaaactcctttgcagcccgactcattcaacgagggagccataccgacgctcccgacactgctactgggaactgcttgctgcaacgcgctgctggggcaggaaacgaggccgccgccttattcctcgctacaaacggagcccatgtgaaccaccgcaacaagtggggagagaccccattacacactgcttgtcgacacggtctcgctaacctcaccgcggaactcctgcagcagggcgccaatcccaatctgcagaccgaggaggctctgcctctccccaaggaggccgcgtctttgacaagcctggcagatagcgttcatttgcagaccccacttcatatggcaattgcatacaaccacccggatgtggtgagtgtgatcctggaacagaaggcaaacgcactgcacgctacgaataacctacagatcatccctgatttctctctgaaggacagcagagaccaaacagtcctgggactagctctgtggactggcatgcacactatcgccgctcagttgctgggcagtggcgcagcgatcaacgacacaatgagcgacggccagactcttctgcacatggccatccagagacaggactctaagtctgccctgtttctgctggagcaccaggccgatatcaacgtgtctagaacccaggatggcgaaactgccttacagctggcaatcaggaaccagctgcccctggtggttgacgcgatctgcacccgaggcgctgacatgtcagtgcccgacgagaaagggaatccacctttgtggttagctttggctaataatctggaggacatcgctagcacgctggtcaggcacggttgcgacgcaacatgttgggggcccgggcccggaggttgcctgcaaaccctgctccacagagccatcgacgaaaataacgaaccaaccgcttgctttcttattcggtctggctgcgatgtgaattcaccacggcagccaggagccaacggcgagggggaggaggaggccagagacggtcaaacccctctccacttggcagccagttggggtctggaggaaacagtccagtgcttgttggagtttggggccaatgttaatgcacaggacgccgaggggaggacacctatccatgtggcaattagcagccagcatggcgttataatacagctcctagtgtcccatccagacattcacttaaatgtgagagacagacaggggctgaccccgttcgcttgcgccatgaccttcaaaaacaacaaaagcgccgaggctattctcaagagagagtctggcgccgcggaacaggttgataataagggtagaaacttcctccatgttgcggtgcagaatagcgacattgaatcagttctgtttctcatttcagtacacgcaaatgtgaattccagggtgcaggacgcgagcaaactgactcctcttcatctggcagtgcaagcaggatcagagatcatcgtcagaaacctgctgctggcaggagccaaggtgaatgagcttacgaaacatagacagaccgctctccatctcgccgcccagcaggatctgcctaccatttgctcggtactattggagaatggagtggattttgccgctgtggacgagaacggcaataatgccctccaccttgccgtaatgcacgggcggctcaacaatattagagtactattgactgaatgcacggtcgacgcggaggcctttaatcttcggggccagagcccattgcatatcctgggacagtacgggaaagagaatgctgccgccatcttcgacctgttcttagaatgcatgcccgggtatccacttgacaagcctgacgccgacgggtctaccgtcctgctgttggcatatatgaagggtaacgcgaacctgtgcagagccatcgtcagaagcggggcccgtctcggcgtgaacaataaccagggcgttaacatatttaattaccaggtggctacaaaacaactgctgtttcgtcttttagacatgctttcgaaagaacctccctggtgtgatggcagctactgctatgaatgtacagccaggttcggagttactactaggaaacatcactgtcggcactgcgggaggctcctgtgtcacaaatgctcgacaaaggaaatccccatcatcaagtttgatttgaacaaacctgtgcgtgtctgtaacatctgtttcgacgtgttgaccttaggcggggtgtcctag

SEQ ID NO: 40347 - DNA, 3513 bp, Artificial Sequence
  Description of Artificial Sequence: Synthetic coding sequence
atggccgaggaggaggtggccaagctggagaagcacctgatgctgctaagacaagagtatgtgaagctccagaaaaagctagccgagacagagaaaagatgcgccctgctggcggcccaggctaacaaggaatcaagctcagaatccttcatctcccgccttctggctatagtggctgacttgtatgaacaggaacagtacagcgacctgaaaataaaagttggggaccgtcacataagtgcccacaagtttgtacttgctgcccgttctgacagctggagcctcgctaatctgagcagtaccaaggagctggacctctcggacgccaatcctgaagtaaccatgacaatgctgagatggatttacactgatgaactggagttccgcgaggacgatgtgttcctaacagaacttatgaaactggcgaataggttccagctccagctacttagagaacgatgcgagaagggtgttatgtcccttgtaaacgtgcgcaattgcatccgattttatcaaaccgccgaggagctgaatgcaagtactctcatgaattactgcgctgagatcattgccagccactgggacgatctccgcaaggaggattttagctctatgtccgcgcagctgctgtataagatgataaaatccaagacagagtaccctctgcataaggccatcaaggttgagagagaagacgtggtatttctgtacttaattgagatggacagtcagttaccgggcaagctcaatgaagcagatcacaacggcgacttagccctggatctggccctgtctcgtcgcttagagagtatcgcaaccaccctcgtgtcccataaggctgatgtcgatatggtggacaaatcagggtggtcacttctgcacaagggcatccaacgcggcgatctcttcgcagcgacttttttgatcaagaatggtgcatttgttaacgcagcaacactgggggctcaagaaacaccacttcacttggtggctctctactccagcaaaaaacacagtgccgatgtaatgagcgagatggcccagatcgccgaagctctgctgcaagccggagctaacccgaatatgcaggacagcaaagggagaactcctctccacgtgtcaatcatggccggtaatgagtacgtttttagccagctgctccagtgcaaacagttggacctcgagctgaaggaccacgaagggtctacagctttatggctggcagtccagcatattactgtctcatcggaccagagcgttaatcccttcgaagacgtccccgtggtcaacgggacttctttcgatgaaaactcattcgcagctcgcctgattcagagagggtcgcatacagatgcacctgatacagcaaccggcaattgtctgctgcagcgggctgccggggccggtaatgaagctgccgccctcttcctggccactaacggagctcatgtgaaccaccggaacaagtggggggagacccccctgcacaccgcatgtcggcacgggctagcaaacctaactgcggagctgcttcagcagggggcgaaccctaacctgcagaccgaagaggccttgccgttgcctaaagaggccgcttcacttacatccctggcagattccgttcatttgcagacaccactgcacatggccatcgcctataaccatcccgatgtggtatccgtcatcctggagcagaaagcgaacgcccttcacgcgaccaataacctccagattattcctgatttttctctcaaggactcgcgcgaccagaccgttctgggactcgccctgtggactgggatgcacaccatcgctgcccaactcctcggtagcggtgcagcaatcaacgataccatgagtgatggacagaccttgctgcatatggcaatacaacgccaggatagtaagtcagccctgtttctgctggagcaccaggccgatatcaacgttagtcgaacgcaggatggcgaaaccgccttgcaactggccattcgtaaccagctcccactggtggtagacgcaatctgtaccagaggtgccgacatgtccgtgcccgacgagaaaggaaacccaccactgtggttggctctggccaataacctagaggatatagcctcaactcttgtaagacacggctgcgacgccacgtgttgggggcctgggcctggtggatgcttgcaaacactcctgcatcgggccatagacgagaacaatgaacccaccgcatgcttcctaatcaggagtggctgtgacgtcaattctccaagacaaccaggcgcaaatggcgagggtgaggaggaagcccgagacggccaaacacccctgcacctggccgccagttgggggctcgaggaaacagtccaatgcctgctcgaatttggggccaatgttaatgctcaggacgccgaaggaaggacacctatacacgtagcgatttcctctcagcacggcgtgattatccaactgctggtcagccaccccgatatacatttgaatgtccgagaccggcaaggcctgacccccttcgcgtgtgcgatgaccttcaaaaataacaagagcgctgaggccatcttgaaaagagaaagtggtgcagccgaacaggtcgacaataagggcagaaacttcttacatgtggcagtgcagaatagcgatatcgagtcagtgttgtttctcatcagcgtacacgccaatgttaactcaagagtgcaggacgcaagcaagctcacccccctccacctggccgtgcaggcgggatctgagatcatcgttcggaatctccttctcgcaggcgcaaaggtgaacgaactcaccaaacatcgacaaacagccttgcaccttgccgcccagcaggacctgcccaccatctgttctgtcctactggagaacggcgttgacttcgctgccgtggacgagaacggaaacaacgcactacatcttgcagtgatgcacgggcgtctcaataatatccgggtactgttaacggaatgtaccgtcgacgctgaggcctttaaccttcggggacaatctccacttcatattctgggccagtatggtaaagagaacgccgcggccatcttcgatctcttcctcgaatgtatgcccgggtacccactggataaacccgacgctgatggtagtaccgttctcctgctggcttacatgaaggggaatgccaacctatgccgagccattgtgagatcgggagctcgcctcggtgtgaataataaccaaggcgttaacattttcaactaccaggttgcaacaaagcagctccttttccggctgctggatatgctctccaaggagccaccttggtgtgacgggtcttactgttacgagtgcacagcaaggttcggagttacaacaaggaagcaccattgtcgacactgtgggcgtctgttatgtcacaaatgctcgacgaaggaaattcccatcattaagtttgatctcaataagccagtgagagtctgcaacatatgttttgacgtgctcaccctgggcggtgtctcctag

SEQ ID NO: 40348 - DNA, 2472 bp, Artificial Sequence
  Description of Artificial Sequence: Synthetic coding sequence
atgaagctgttcggcttcggcagccggcggggccagaccgcccagggctcaatcgaccacgtctacaccggaagtgggtacaggataagagattctgagctccagaagattcatagggccgcagtgaagggcgacgcggcagaagtggaacggtgcctcgccagacgctcaggcgatttggacgccctggataagcaacacagaaccgctctccatctggcgtgtacgagcggtcacgtgcaggtagtcacactgctggtgaaccggaagtgtcagatcgacgtgtgtgacaaggaaaatagaactcccctgatccaggccgtgcattgtcaggaggaggcatgcgcagtgattctactggaacacggcgccaatcctaacctcaaagatatttatggcaacacagctttgcattacgctgtttacagtgaatcgacttcgctggccgagaagttactttcccacggtgcacatattgaagccctggataaagataacaatacccctctcctctttgccatcatctgcaagaaagaaaagatggtcgagttcctgctcaagaagaaagcatcttcccacgcggtcgaccgcctgagaaggagtgccctgatgttagccgtctattatgactcccctggtatcgtgaatattctgctcaaacagaatatcgatgtgtttgctcaggatatgtgcggaagggatgctgaagactatgcaatctcccaccatctcactaagattcaacagcagattcttgagcacaaaaagaagatccttaagaaagaaaaaagtgatgtgggttcaagcgatgagtcagcagtgtctatcttccatgagctacgagtggattccttacctgccagtgatgacaaggacctgaacgtggcaaccaaacagtgtgttcccgagaaagtgtcggaaccactgcctggatctagccacgagaaggggaatcgcatcgtaaatggacaaggtgagggacctcctgctaagcatccctcactcaaaccatcaaccgaagttgaggacccagcggtgaaaggcgctgtgcaacgtaaaaacgtgcagactctgcgagccgagcaagctctgcccgtggccagcgaggaagagcaggaaaggcatgagcggtcagaaaagaagcagcctcaagtcaaagaagggaacaatacgaataaatccgagaagatccagctatcggaaaacatttgtgactctacctcttctgcagccgcgggccgactgacacagcagaggaaaataggtaaaacctatccgcagcagttcccaaaaaagttaaaggaagaacacgataggtgcaccctgaagcaggaaaacgaggaaaaaaccaacgtgaacatgctgtataaaaagaatcgggaggagctggagcggaaggagaaacagtataaaaaggaggtggaggctaagcagctggagcccaccgtgcagtccctggagatgaaaagtaagaccgccagaaatacccccaactgggacttccataaccatgaagagatgaaaggtctgatggacgaaaactgtatccttaaggccgatatcgctatcctgaggcaggagatctgtaccatgaagaatgacaacctagaaaaagagaataagtatctgaaggacatcaagattgtaaaagagaccaacgccgcactcgagaaatatattaagcttaacgaggagatgattactgagacagcctttagataccaacaagaacttaatgatctgaaggctgagaacacccgactcaatgcagaactgcttaaagagaaagaatcaaaaaaaagattagaggcagatatagaaagttatcagagtcgcctggctgccgccattagtaaacactctgaatcagtgaagactgagcgcaatctgaaattggccctagagaggacaagggacgtatcagtgcaggtggaaatgagctcggccatctccaaggtgaaagccgagaatgaatttctgaccgagcaattgagtgaaactcaaattaaatttaacgccctcaaggataagttccggaagacccgcgacagcttgagaaaaaaaagcttggcactggagactgtccaaaacgacctatcacagactcagcagcagacgcaggagatgaaggagatgtaccagaacgccgaggcgaaagttaataacagcaccggcaaatggaactgcgtagaggagaggatctgtcatctgcaacgtgaaaatgcctggctggtccagcagttagatgacgttcaccaaaaggaggatcacaaggagatagttaccaatatacagagaggattcatcgaaagcgggaagaaagatcttgtgctcgaagagaaatctaagaagctgatgaatgaatgcgatcacttgaaggagagtctgttccagtatgagagagagaagacggagggcgtggtatccatcaaggaggataaatatttccagacttccaggaaaaccatttag

SEQ ID NO: 40349 - DNA, 1359 bp, Artificial Sequence
  Description of Artificial Sequence: Synthetic coding sequence
atgaaggtgcagcccagcgtgacctgcgtggccagctggggcggcatcgtgcacttagaagcattcggcgaccccgtcatcgtcctccgtggtgcttgggccgtccctagggtcgattgtttaatcgatactttgaggactccgaatgccagttgtatgcgcaaaggaacacacttgctggtgccctgcctggaagaggaagagctcgcacttcacagacgaagactcgatatgtctgaggctctcccttgccctggcaaagagacaccaacacccggctgcaggctcggcgctctgtactgggcctgtgtgcataacgacccaacgcagttacaggcaatcttagatggtggcgtttcaccagaagaggccacccaggtggactcaaatggtagaaccgggctgatggtggcctgttatcacggatttcagtctgtagtagctttactcagtcattgcccatttttagacgtcaaccagcaggataagggtggtgacacagccctaatgttggccgcacaggccggacacgtgcctctcgtgagcctattattgaactactatgtcggcctggatctcgagcgtagagatcagcgtggccttactgccctaatgaaggccgcaatgcgcaatcgatgtgccgacctcactgctgtggaccccgtgcgcggaaaaactgccctggagtgggctgtcttgactgatagctttgataccgtgtggcgcatccgccagctcctccggaggccgcaggtcgaacagctctcacagcattataagcccgaatggcccgccctgtcagggctggtggcccaggcccaggcccaggcccaggtggcaccaagtctgctggagcggctgcaggcaacactgagcttgccgtttgctccctctccccaagaaggcggagtgctggatcacctcgtcaccgccacaacatccttagcatcccctttcgtgacaacagcctgccatactttatgtcccgatcaccctccttccctcggtacccgatcgaaatcggttcctgagcttctcggcactgctcccccccctcctctggttcctcagtctccccctggctccccgcaacggtctccatgggttttcgtgccgtaccagagccctcagggaattctgtcaaagtgcctgcagtggctccagccgagagattctacgtctccaaggccccaggtaccaaagatactcctctcgaaagcctcttcctcatctcatcaatgccaaccaaaaccctcaccgagtggtcaccagtccctcgcactgcccctctggcgataccaagagctaagaatcgaaaaaagaaagcaggaagaggaggccaggatggcccagaaatag

SEQ ID NO: 40350 - DNA, 687 bp, Artificial Sequence
  Description of Artificial Sequence: Synthetic coding sequence
atgagctacgtgttcgtgaacgacagcagccagaccaacgtgcccctgctccaggcctgcattgacggcgacttcaactacagcaagcggctgctggaatccggattcgatcccaacatccgggactccagaggacggaccgggttgcacttggcagctgcacgcggcaatgtggacatatgtcagctactccacaagtttggcgcagacctcctcgccaccgactaccaggggaacacagcactgcacttgtgtgggcatgtggacaccattcagtttctggtcagcaacggtctgaagattgatatctgtaatcaccagggagccacaccattggtgctcgctaaacgccgcggggtcaacaaggatgttatcaggctcctggaaagcctggaggaacaggaggtgaagggatttaatcgcggcacccacagcaagctggaaaccatgcagactgcggaaagcgagtcagccatggaatcacactccctgcttaatccgaatctccaacagggcgagggcgtcctgtcaagcttcagaactacgtggcaggagtttgtcgaggatctgggattttggcgcgttctgcttttgatctttgtgattgctttgctgagcctcggaattgcctattatgtcagtggagttctgcctttcgtagaaaaccagcctgaattggttcattag

SEQ ID NO: 40351 - DNA, 588 bp, Artificial Sequence
  Description of Artificial Sequence: Synthetic coding sequence
atgagctacgtgttcgtgaacgacagcagccagaccaacgtgcccctgctgcaggcctgtatagatggagacttcaattatagcaagcggctccttgagtccggcttcgatcctaacattcgcgatagtagaggcagaactggactacacctggcggccgctagaggaaacgtcgacatttgtcagctcctgcacaaattcggtgctgacctcctcgcaaccgactatcagggtaataccgctctccatctctgtgggcatgtggacaccatacagttcctggtctccaatgggttaaagatcgatatctgtaaccatcagggggctacaccacttgttctcgctaagagacgaggcgtgaataaggacgtgatccgtcttctcgagagcctggaagaacaggaggtaaaggggtttaatagaggcactcactctaagctggaaacaatgcaaaccgcagagtcggaatccgctatggaatcacattcccttttgaatcccaacctgcagcaaggcgagggcgtcctgtcttcttttaggaccacctggcaagagtttgtagaggacctgggattttggagagtatag

SEQ ID NO: 40352 - DNA, 687 bp, Artificial Sequence
  Description of Artificial Sequence: Synthetic coding sequence
atgagctacgtgttcgtgaacgacagcagccagaccaacgtgcccctccttcaggcatgcatcgatggcgatttcaactattccaagaggctcctggaatcaggcttcgatcctaatattcgcgattcaagggggcgtactggcctgcacctggcagccgctagagggaatgttgacatatgtcagctgcttcataaattcggtgcggacctcctagccacagattaccaggggaatacagcactacacctgtgcggtcatgttgataccattcaatttctggttagtaatggactgaagattgacatctgcaaccaccagggcgccacaccgcttgtcctggctaagcgacgaggcgttaataaggacgttatcagactcttagaaagcctggaggaacaggaggtgaagggtttcaaccgcgggactcatagtaagctcgaaacaatgcagacagctgaaagcgagagcgccatggagtcacattccctgctgaacccgaacctgcagcaaggagaaggggtcctctccagcttccgtacaacatggcaggagtttgtggaagacctcggattctggagagtcttgctcttgatttttgtgatcgccctgctgagtctcggaatcgcctattatgtctctggggttctgccctttgtagaaaaccagcctgagctggtccactag

SEQ ID NO: 40353 - DNA, 687 bp, Artificial Sequence
  Description of Artificial Sequence: Synthetic coding sequence
atgagctacgtgttcgtgaacgacagcagccagaccaacgtgcccctgctccaggcttgcatcgatggagactttaactatagcaagcggctactggagtctggcttcgatcccaatattagggacagcaggggcaggactgggttgcacctcgcagcagcacgagggaatgttgatatatgtcagctgctccacaagtttggggcagacctgttagctaccgattaccagggtaacacggcactacacctttgtgggcatgtggacactatccaatttcttgtgtccaacggactgaaaatcgatatttgcaatcatcagggggctacaccactggtcctcgcaaagcgaagaggtgttaacaaagacgtgatcagactgttggaaagtctggaagaacaggaggttaagggcttcaatagaggcacacacagcaaacttgagacgatgcagaccgcagaaagcgagtctgctatggagtctcattcccttctgaaccccaatctccagcagggcgagggggttttgtcctcttttcgcactacatggcaggaatttgttgaagatctgggcttctggcgagttctgctcttgattttcgtaattgccctcctgagtctcggtattgcctactacgtgagcggcgtccttcctttcgtggaaaaccagcctgaattggttcactag

SEQ ID NO: 40354 - DNA, 699 bp, Artificial Sequence
  Description of Artificial Sequence: Synthetic coding sequence
atgagctacgtgttcgtgaacgacagcagccagaccaacgtgcccctgttacaggcatgtatcgatggagatttcaactactcaaaacggttgcttgagagtgggttcgatccaaacatccgcgactctaggggaaggacaggactccacctggctgcagcccgcggaaatgtggatatttgccaactgttgcataagtttggcgcagaccttcttgccactgattatcagggcaacacagccctacacttatgcggtcatgtggacaccattcagtttctcgtttccaatgggctgaagatcgatatctgcaaccaccagggcgcaactcccctggtgctggctaagagacgaggcgtaaacaaggatgtgatcaggctgctggaaagcctagaggaacaggaagtgaagggtttcaataggggcacacacagtaagctggaaactatgcagaccgctgaatccgaatctgcgatggaatcgcattccttgttgaaccctaacctgcagcagggggaaggtgtgctcagtagtttccgcacaacgtggcaagaattcgttgaagatctaggcttctggcgtgtgcttctcctaatctttgtgattgcactgctgtcgctggggatcgcgtattataggcgtaccctgcgcttggggtcattcgccaggcaggacaggtcacgaatccaggctatctag

SEQ ID NO: 40355 - DNA, 249 bp, Artificial Sequence
  Description of Artificial Sequence: Synthetic coding sequence
atgagctacgtgttcgtgaacgacagcagccagaccaacgtgcccctgcttcaggcttgcattgacggcgatttcaactactccaaaaggctcttagagtccggctttgaccctaatatcagggatagtagaggacggaccggcttgcacctggccgccgctagagggaatgtagatatttgccagctgctgcacaaatttggcgctgatctgctcgctacagactatcagggcaatactgcactttag

SEQ ID NO: 40356 - DNA, 261 bp, Artificial Sequence
  Description of Artificial Sequence: Synthetic coding sequence
atgagctacgtgttcgtgaacgacagcagccagaccaacgtgcccttacttcaggcatgcatagacggagacttcaactattctaagagactgctcgagagtggcttcgatccgaatattagagattcccgagggagaacaggattgcatctcgctgccgcgaggggtaatgtcgacatctgtcagctgcttcataaatttggagctgatctgttagccacagactaccaggggaacacagctctgcatctctgcggatag

SEQ ID NO: 40357 - DNA, 312 bp, Artificial Sequence
  Description of Artificial Sequence: Synthetic coding sequence
atgagctacgtgttcgtgaacgacagcagccagaccaacgtgcccctcttacaggcctgcatcgatggagacttcaattactcaaagcgactactggagtctggatttgaccctaacatcagggatagtcgggggcgtacaggcctccatctggccgccgcaagaggaaacgtcgacatctgtcagttgttgcataaattcggagccgatttgctggcaaccgactatcaggggaataccgccttgcacttgtgtgggcatgtagacacgattcagtttttggtaagtaacgggctgaagatcgacatatag

SEQ ID NO: 40358 - DNA, 1074 bp, Artificial Sequence
  Description of Artificial Sequence: Synthetic coding sequence
atgggcaaccggcacagccagagctacaccctgagcgagggcagccagcagttgcccaagggggatagtcagccctcaactgtggtgcaacccctgagccacccgtctcggaatggagagccagaagccccacagccagcgaaggcttcctcgccacagggctttgacgtggatagagacgccaagaaacttaacaaagcttgcaagggcatgggcacgaacgaagccgccatcatcgagatcctgagtggccggaccagcgacgaacgacagcagatcaagcagaagtataaagcgacatacgggaaggagttggaggaagttctgaagtcagaactgagcggaaactttgaaaaaactgccctcgcactcctcgaccgaccatccgaatatgccgcaaggcagctgcagaaagccatgaaagggctgggcacggatgagagcgttctaattgaagtgctctgtacgcgaactaataaagaaattattgcaatcaaagaggcctaccaaaggctgttcgatcggagtctcgaaagcgatgtgaaaggagatacgtccggcaatctgaagaagatcctcgtttctctcctccaagctaatcgcaatgaaggagacgacgtcgacaaggaccttgcggggcaagacgccaaggatctgtacgatgcaggagagggtaggtggggtaccgacgagctggccttcaatgaagtccttgcaaagcggtcatacaaacaacttcgtgccacctttcaggcttatcagatccttatcggcaaagatatcgaggaggctatcgaggaggagacatcaggtgaccttcagaaagcctatcttacgcttgtacggtgtgcccaggattgcgaagattattttgcggagagattgtataaatccatgaagggtgcagggactgatgaagagaccctgatccgcatcgttgttactcgggcagaggtggatttacaaggcattaaagctaaattccaggagaagtatcagaagtcgctctccgatatggtcagaagcgacacatccggagactttcggaagctcttggtagccctccttcactag

SEQ ID NO: 40359 - DNA, 951 bp, Artificial Sequence
  Description of Artificial Sequence: Synthetic coding sequence
atgggcaaccggcacgccaaggccagcagcccccagggcttcgacgttgatagggacgccaagaaattaaataaggcatgcaaaggcatgggtactaacgaagccgctatcatagagatcctgagcggaaggactagcgatgagcgccaacagatcaagcagaaatacaaagccacttacggtaaagaacttgaagaagtgctcaaatctgaactcagcggtaattttgagaagaccgcgcttgcgctgctcgatagacctagcgagtatgcagcccgtcagcttcagaaggctatgaaaggccttgggactgatgagtccgtgttaattgaagttttgtgtacccggaccaacaaggagattatagccattaaggaggcataccaaagactattcgacaggagtctcgagtctgatgttaaaggggacacatcaggtaacttgaagaaaattctggtgagtcttctccaggccaatagaaacgagggtgatgatgttgacaaagacctcgcgggacaggatgctaaggacctatatgacgcaggggaggggaggtgggggacagacgagctggcctttaatgaggttcttgcaaagagatcatataaacagctgcgggccacatttcaggcctaccagattctgattggcaaggacatcgaggaggcaatagaagaggagacatcaggtgatcttcagaaggcttacttgacactggtcagatgcgctcaagattgtgaggactactttgctgagcggctgtataaaagtatgaaaggcgctggaacggatgaggaaacactaatcaggatagtggtgaccagagcagaggtggatcttcagggcatcaaagccaagttccaagagaagtatcagaagagcctatcagatatggtcagaagtgacacttccggggactttcgcaaactcttggtggctttgctgcactag

SEQ ID NO: 40360 - DNA, 2946 bp, Artificial Sequence
  Description of Artificial Sequence: Synthetic coding sequence
atggtgcaccacagcggcagcatccagagcttcaagcagcagaagggcatgaatatttccaagtcagaaatcactaaagagacatccctgaagcccagccgcagatcactaccatgtctcgcgcaatcctacgcatatagcaagagcctctcccagtccacaagcctgttccaatcaacggagagcgagtcacaggctcctacatcaattacgttgataagcactgataaggctgaacaggtaaacaccgaagaaaataaaaacgatagcgtactcaggtgctccttcgccgatctgagcgatttctgcctggcactgggaaaagataaggattatacagatgagtccgaacatgcaacttacgatcgatcccgcctgataaacgatttcgtgattaaggataaatctgaattcaaaaccaaactgtccaagaacgacatgaactatatagcgagctccggccctctattcaaagatggcaaaaaaagaatagactacatcttggtctaccgcaaaaccaatatccagtacgacaagcggaacacctttgagaaaaatctgagagcggaaggacttatgcttgagaaggaacccgccatcgcttctccggacattatgtttattaagatccatattccctgggacactttatgcaaatacgccgagaggttgaatattcggatgcctttccgaaaaaagtgttactacactgacggacgcagtaaatccatgggccggatgcaaacgtatttccggagaattaagaactggatggcgcagaatccaatggtgctcgacaaatccgcctttccagacttggaggaatccgattgctataccggccccttcagccgtgcccgcattcaccatttcattataaacaataaggacacttttttttccaatgcaacaaggagccgcattgtgtatcacatgctcgaacgtacgaagtacgaaaatggtatctcgaaggtcggtattaggaagctcatcaataacggcagctacattgcagccttccccccccatgagggcgcctacaagtccagccagcccatcaagacacatggacctcaaaacaaccgacacctgctgtacgagaggtgggctcggtggggcatgtggtataaacaccagccactggacttgatacggctgtactttggagaaaagattggtctctatttcgcttggctcggatggtacaccggcatgctgattccagcagctatcgtgggactgtgcgtgtttttttacggcctgttcaccatgaacaacagtcaggtgtcgcaagagatctgcaaagccaccgaggtctttatgtgtccactctgtgacaagaattgctccctccagagactgaacgactcctgtatctatgcaaaagtgacctatcttttcgacaatggaggaactgtgtttttcgccattttcatggcaatttgggctaccgtttttctcgagttctggaagcgacgccgcagcatactcacatatacatgggaccttatcgaatgggaagaggaagaagagactctcagaccacagttcgaagcaaagtactataaaatggaaattgtcaaccctatcacaggcaaaccagagccacaccagcccagttctgataaggtgaccaggcttcttgtcagcgtgtccggcatcttctttatgatttccctcgtcataaccgccgtcttcggagtggtggtctacagactcgtggtgatggaacagttcgcatcgttcaagtggaattttataaagcaatattggcaatttgcaacgtcagccgccgcggtctgtattaactttatcatcatcatgctgttaaacttggcctacgaaaaaattgcctaccttttgactaacttagaatatccgagaactgagtcagagtgggagaatagctttgccctcaagatgtttctttttcagtttgtgaatttgaatagcagtattttttacatcgcttttttcttaggacgttttgtgggtcatccgggaaagtataataagctgtttgaccggtggaggctcgaggaatgccacccttccggctgtctcattgacctctgtctccagatgggcgtgataatgtttttgaaacagatctggaacaacttcatggagctgggataccctctgattcagaactggtggtcccgacacaagatcaagagagggatccatgacgcatccattccccaatgggaaaacgattggaacctgcagcctatgaatctgcacggcttgatggatgagtacttggagatggtactgcagttcgggttcacgacaattttcgttgccgccttcccgctggcccccctactcgctttgctcaataacattatcgagatccgcctggacgcctataagtttgtcacccagtggcgccggccgcttcctgcaagggcaacggacataggcatttggctcggaatactcgaaggcatcggcatcctggcagtgatcactaacgcattcgtgattgccataacatcggactatatccctagattcgtgtacgaatataaatacgggccatgcgcaaatcacgtcgagcccagtgagaattgtctcaagggatatgtgaataacagcttgtctttttttgacctttccgagctgggtatggggaagtctgggtattgtcgttacagagattacaggggtccaccttggagctctaagccgtacgaatttactttacagtactggcacattctagctgcccggcttgcatttataatcgtttttgaacacctggtgttcggaattaagagcttcatcgcctacctgatccctgacgttcccaagggactgcatgatcgcatccggagggaaaagtacctcgtgcaggagatgatgtacgaagcggagctggaacatctccagcagcagcggcggaagtcagggcagcccgtgcaccacgagtggccgtag

SEQ ID NO: 40361 - DNA, 2898 bp, Artificial Sequence
  Description of Artificial Sequence: Synthetic coding sequence
atgaacatcagcaagagcgagatcaccaaggagaccagcctgaagccatcccgccggagtttgccatgtctggcacaatcctacgcttatagcaaaagcctgagccagtcaacttccctgttccagtctaccgagagtgaaagtcaagcacccacctctataacccttatctccacagataaggctgaacaagtcaacactgaagagaataagaacgatagtgtccttagatgcagcttcgcagatctgtccgacttctgcctcgctctcgggaaggataaggactatacagacgaatccgaacacgcaacttatgatcggtctaggctcatcaatgatttcgtcatcaaagacaagtcagagttcaaaacaaaattgagcaagaatgatatgaactatatcgcgtctagcggtcctctgttcaaagacggaaaaaagcgaatagactatattttggtttataggaaaactaacatccagtacgataagcggaacacgtttgaaaagaaccttagagccgagggtctgatgctggaaaaagagcctgccatcgcctcccccgacattatgttcatcaagattcacatcccctgggataccctgtgcaagtacgccgaaaggctcaatatacgcatgccatttcgcaaaaaatgctactatacagatggtcgcagtaagtccatggggcggatgcaaacctattttcgaaggatcaagaactggatggcccagaatcctatggtactggataaatcagcattccccgacctagaggagtctgactgctatactggcccgtttagcagagcgcggatccatcactttatcatcaacaacaaagacaccttcttcagtaatgctacacgctctaggattgtctaccacatgctcgagcggacgaagtacgagaacggaatcagcaaggttgggatccgcaaactgatcaataacggttcatatatcgccgcttttcctccccacgaaggggcctacaagagtagccaacccattaaaacgcatggcccacagaacaaccgtcacctgttgtatgaacggtgggcaaggtggggaatgtggtacaaacatcagccactggatttgatcagactttacttcggggaaaagatcggcctctattttgcgtggttggggtggtataccggaatgctgatccccgcggcaatcgtcgggctctgcgtgttcttctacggtctcttcacaatgaacaattcccaagtgtcacaagagatctgtaaggcaacagaggtgttcatgtgtcccttgtgtgacaaaaactgctcacttcagcggttaaacgacagttgcatctatgccaaggttacctacctgtttgacaacggcggaactgtattcttcgccatcttcatggctatttgggccactgtgtttttagagttctggaagaggcggaggtccattctgacttacacttgggatctgattgagtgggaagaagaggaagaaactctccgtccccagtttgaggccaagtattataaaatggagattgtgaaccccattaccggtaagcccgaacctcaccagccttcttctgataaggtgacacggttactcgtatcagtgtcggggatcttctttatgattagtctggttattacagctgtgttcggagttgtggtgtaccgcctggtagtaatggagcagttcgcctccttcaagtggaacttcattaagcagtactggcagttcgctaccagcgcagctgccgtctgcataaactttataatcatcatgctgctgaacttggcatacgagaagatcgcgtacctactgaccaatctggaataccctcgaaccgagagcgaatgggagaatagctttgcactcaaaatgtttctttttcagtttgtgaatctcaacagcagcattttttacatagcgttttttctgggccgattcgttgggcatcctggtaaatacaataaactctttgataggtggagactagaggaatgccacccaagcggctgtttgatcgacttatgtctgcagatgggcgtcatcatgttcctaaagcaaatttggaataacttcatggagctgggttatcccctgatccaaaactggtggtcccggcacaagatcaaaagagggatacatgatgcaagtatccctcagtgggagaatgattggaatttgcagccgatgaacctgcatggccttatggacgagtacttggagatggtcctacagtttggctttactactatatttgtggctgccttcccacttgcacccttactagctctcttgaacaacatcatcgaaatcagactcgatgcatataaatttgtcacacagtggaggaggccattaccagcccgggctacagatataggcatttggctcgggattctcgaagggatcgggatactagctgtgatcactaatgcattcgtgatcgccatcacgtccgactatattccaagattcgtttatgagtataaatacggcccttgcgcaaatcatgtcgaaccaagcgagaactgtctgaaaggctacgtgaacaacagcttaagtttctttgacctcagcgagctcggcatgggcaaatccgggtactgcagatatcgcgactatcgaggcccgccttggagcagcaagccctatgagttcacgctacagtactggcatatcctggctgctcgactggcttttatcatcgttttcgaacacctcgtgtttggcattaagtcttttatagcttacctgatcccggatgtgccgaaggggcttcacgatcgtataagaagggagaaatacttggtccaggaaatgatgtatgaagctgaactggagcatctgcagcagcaacggcggaagtccggacagcccgtgcaccatgaatggccgtag

SEQ ID NO: 40362 - DNA, 2508 bp, Artificial Sequence
  Description of Artificial Sequence: Synthetic coding sequence
atgaactacatcgccagcagcggccccctgttcaaggacggcaagaagcgtatcgattacatcctggtttaccgcaaaactaacatccagtatgacaagaggaacaccttcgaaaaaaatctccgggcggaagggttaatgcttgagaaagagcctgccatcgcgtccccagatataatgtttattaaaattcacataccctgggataccctctgtaagtacgctgagcgattaaatatcagaatgccattccgcaaaaaatgttattatactgacggacggtcaaaaagcatgggaagaatgcagacttacttccggcgcatcaagaactggatggcccaaaatccaatggttctcgacaaatctgcttttcccgatctggaggagtcggactgctacaccggccctttcagtagggctaggatacaccactttataatcaataacaaggacacgtttttcagcaatgctacccgctcccgaatcgtctatcacatgcttgaacggacgaaatatgagaacggcatttccaaagtaggaatccgcaaactcatcaacaacggaagctatattgccgcattccctccccacgagggagcttataagtctagccagccaattaaaacacacggcccccagaataaccgtcacctgctctacgaaagatgggcaagatggggtatgtggtacaaacatcaacctttagaccttatccgactctattttggtgaaaagattggtctatattttgcctggctcggctggtacaccggcatgctcattcccgctgccatagtcgggctgtgtgtattcttttatgggctctttacaatgaacaatagccaggtgtcgcaggaaatctgcaaggcgacggaggtatttatgtgtccattatgcgacaagaattgcagcctgcagcgattgaacgattcatgtatttatgcgaaagtcacatatttgtttgacaatgggggcaccgtgttttttgcaatctttatggccatttgggccaccgtgtttctggaattctggaagcgcagacgctctattctgacatacacgtgggacctcatagagtgggaggaggaggaggaaacgctaagaccccaatttgaggccaagtattataagatggaaatcgtgaatcctatcaccggaaagcccgagccgcatcaaccatcaagcgataaagtgacccgtctgttggtctcagtgagcgggatttttttcatgatcagtttggttattactgcagtgtttggcgtggttgtgtacaggcttgttgttatggaacaattcgcaagctttaagtggaacttcatcaagcagtattggcaatttgcgacatcggcagccgcagtgtgcatcaacttcataataattatgctcttgaaccttgcatacgaaaagattgcctacctgctgaccaacctggaataccccaggacagagtccgagtgggaaaactcgtttgctctcaaaatgtttctttttcaattcgtcaatctgaactcgagcatcttctacatcgccttcttcctgggcagattcgtcgggcatcccggcaagtataacaaattgtttgacagatggaggcttgaagaatgccatccaagcggatgtctcatcgacctgtgtctccagatgggtgtgattatgttcctgaaacagatttggaataacttcatggaactcggctacccgctgattcagaactggtggagtcgacataagatcaaacgggggatccatgacgcctcaatccctcagtgggaaaacgactggaacctccaacccatgaacctgcatggactgatggacgaatatctcgagatggtgctccagtttggatttaccaccatttttgtggctgccttccccttggcccctctgctggccctcctgaataacattatcgagattaggctagacgcatacaagttcgtcactcagtggcggaggcccctccctgctcgagccacagacatcgggatctggctgggaattctagaggggatcggtatactcgctgtgatcacgaacgcatttgtgattgccatcaccagtgattatatacctagattcgtttacgaatacaaatatggcccatgcgcaaatcacgttgagccttccgaaaactgcctgaaaggttatgtgaacaattcactcagcttcttcgacctgtcagagctgggcatggggaaatcagggtattgcagatatcgggactatcgcgggcccccgtggagcagcaagccgtatgaatttaccttgcagtattggcatatccttgccgctcggctagcattcatcatcgtcttcgagcacctcgtgtttggtattaaaagttttattgcgtacctgattccagatgtgccgaaaggcttgcacgatcggattaggcgggagaagtacctggtccaggagatgatgtacgaggcagagcttgagcacttacagcagcaacgtcgcaagagcggacagcccgtccaccacgagtggccttag

SEQ ID NO: 40363 - DNA, 2898 bp, Artificial Sequence
  Description of Artificial Sequence: Synthetic coding sequence
atgaacatcagcaagagcgagatcaccaaggagaccagcctgaagccctctaggagatcccttccatgcttggctcaaagttacgcatacagcaaatcgctttctcagtccacgtccctatttcagagtaccgaatccgagagccaggcccctaccagtatcactctcatctccaccgataaggccgagcaggtgaacactgaagagaacaaaaacgactctgtgctccggtgcagctttgctgacctttctgacttttgcttggctctgggaaaggacaaggactataccgacgaatcggagcacgccacatacgaccgtagcaggttaatcaacgatttcgtcatcaaagacaaaagcgagttcaagacgaagttgtctaaaaacgacatgaactatatcgcgagctcaggcccactgtttaaagatggcaagaagaggattgactacatcttggtgtatagaaaaaccaacatacagtatgacaagcgaaacacattcgagaagaatttgcgcgccgagggcctgatgctggaaaaagagcctgccattgcgtctcccgatatcatgttcatcaaaattcacatcccatgggatactctctgtaagtatgccgaaagactgaatatccgcatgccatttaggaagaaatgctactatacagacggcaggtcgaagagcatggggaggatgcagacgtacttccgccgaattaaaaactggatggctcagaatcccatggtgctggataaaagcgcatttcctgatttagaggaatctgactgttacaccggcccctttagcagggccaggatccaccatttcattatcaacaacaaagacactttcttctctaacgctacacgcagtcgaatcgtataccacatgctggagcgtacaaaatacgaaaacggcatttctaaggtgggcattaggaagctcattaacaacgggtcctacatagccgccttcccaccccacgagggagcctataaaagttctcagcccatcaagactcacggtccacagaataatcggcatctcctttatgagcgctgggcgcgatggggcatgtggtataaacatcagccactggaccttatccgcctctatttcggtgagaagatcggcctttattttgcttggctaggctggtataccggcatgcttattcctgctgcaatcgtagggctgtgtgttttcttctatggactatttactatgaacaactcccaggtgagccaagaaatctgtaaggcaaccgaagtatttatgtgtcctctgtgcgataaaaattgtagccttcagaggctgaacgattcttgcatctacgcaaaagtcacttatctgtttgacaatggcggcaccgtgttctttgctatattcatggctatttgggctaccgttttcttagaattctggaagcgaagacggtctatccttacatacacttgggacctgatcgagtgggaggaagaggaggagaccctcagaccccaattcgaggcaaagtattacaagatggagatcgtcaatcccatcactgggaaaccagagccacaccaaccatcctctgacaaggtcacacggctgctggtgtccgtgagtgggatcttctttatgatcagtctcgtgatcaccgccgtctttggcgtggtggtgtaccggctggtagtgatggagcagtttgcaagcttcaagtggaactttattaagcagtattggcagtttgctacatctgctgcagccgtgtgtataaattttatcatcataatgctgcttaatctggcctacgagaagatcgcttacttgcttactaatttggagtatcctcggactgaatctgaatgggaaaattcttttgccctgaaaatgttcctctttcaatttgtgaatctgaactcctctattttttacattgctttcttccttgggcgctttgtgggtcatccgggaaaatataataaactattcgacagatggcgtcttgaagaatgtcacccctccggttgcttaattgacttatgcctgcaaatgggcgtgattatgtttcttaagcaaatttggaacaacttcatggagctggggtaccccctgatccagaactggtggtctaggcacaagatcaagcgaggaatacatgacgcttcaatccctcagtgggagaatgattggaacctacagcctatgaacttacatggcctcatggatgaatacttagagatggtgctccagtttggatttacaactatatttgtggccgcttttcctctggccccccttttggcactgctcaataacattatcgaaatccgcctggacgcctacaaatttgttacccagtggcgtagacccttgcctgcccgagctacggacataggtatctggctaggtatactcgagggcatcggcattctggccgttattaccaacgcgttcgtcatcgcgatcacttctgattacatccctagatttgtttatgaatacaagtacggcccttgcgccaatcacgtggagcccagcgaaaactgcctcaaagggtacgtcaacaactccctctcctttttcgacctttcagaactgggcatgggcaagtccggttattgcaggtacagggactacagagggcctccatggagttccaaaccctatgagtttacactccagtactggcatatcttagcagcccgtttggccttcattattgtattcgaacacctggtctttgggatcaagtccttcatagcttatctcatcccagacgtgccgaaaggactgcacgataggatccgtagagagaaatacctggtccaggaaatgatgtacgaggctgagctcgagcacctgcaacagcagcggcgcaaaagcggccagcccgtgcatcatgagtggccatag

SEQ ID NO: 40364 - DNA, 2652 bp, Artificial Sequence
  Description of Artificial Sequence: Synthetic coding sequence
atgcggcccggccccaacaagccctaccccagccacagcaacatcttcgcctatcactcctccgccttgggcaaagacaaggactatacagatgaatctgaacacgctacgtacgataggtcaagactgataaatgacttcgtgatcaaggacaagagcgaattcaagactaagttgagcaagaatgacatgaattacattgcaagttccgggcctcttttcaaggatggcaagaagcgaatagactacatcttagtctacaggaagaccaacattcagtatgataagcgaaacaccttcgaaaaaaatctgagggccgaaggactgatgcttgagaaagaaccagcaatcgccagccccgatatcatgtttatcaagatccacatcccttgggatacgctgtgcaagtatgctgagcggcttaacataagaatgccgtttagaatgcagacttattttaggcgaatcaagaactggatggcccagaacccgatggtgctggacaagtccgcattccccgaccttgaagaatctgattgttacactggtcccttctctcgggcccggatccaccattttattatcaataacaaggacacattcttcagcaacgcaacgcgaagtaggatagtgtatcacatgctggagaggaccaaatatgagaacggcatttctaaagtgggcattagaaagctcatcaataacgggtcgtatattgccgcctttcctccccatgaaggcgcctacaaaagctctcagccaattaaaacccacggccctcagaacaatcggcatctgctctacgagcgctgggcgagatggggaatgtggtacaaacatcaacctctggaccttattcgtctgtactttggcgagaaaatcggtctttattttgcctggctcggctggtatacaggaatgctgatccctgccgctatcgtgggcctttgtgtcttcttctacggattatttaccatgaataatagtcaggtgagccaggagatttgcaaagccaccgaagtctttatgtgccccttgtgtgataaaaactgctctcttcagcggctgaacgattcatgcatttatgccaaagtgacttatctttttgataacgggggaactgtttttttcgcgatcttcatggctatctgggcaacagtttttctcgagttttggaagcggaggagatccatcctgacatacacatgggatctgattgagtgggaggaggaggaggaaacgctgaggcctcagttcgaagcaaaatactacaagatggagatcgtgaacccaatcacgggcaaacctgagccgcaccagccaagctctgacaaggtgactcgcctcctcgtgtctgtgtccggcatcttcttcatgatatccttggtcatcaccgccgtgttcggcgtggtggtttacaggttggtcgtgatggaacagtttgcgagcttcaagtggaacttcattaaacaatactggcagttcgccactagtgccgctgcggtatgcattaatttcattattatcatgctgctgaacctggcttacgaaaaaatcgcatacctgctcacaaatttggagtatcccagaaccgagagtgagtgggagaattcctttgccctgaaaatgttcctctttcagttcgtgaacctgaactccagcatcttttacattgccttcttcctgggacggtttgtgggacatcctggtaaatataataagctttttgaccgttggaggctggaggagtgtcatccgagcgggtgcctcatagacctatgcctccagatgggcgtgatcatgtttctcaaacagatctggaataacttcatggagttgggttatccgctcatccaaaactggtggagccgccacaagattaaaagaggtatccacgatgctagcattccacagtgggagaacgactggaatttgcagcccatgaatctccacggtctgatggatgaatacctggagatggtgctacaatttggcttcaccaccatctttgtggctgccttccctttagccccgctactggccctgttgaacaatatcatcgagattagactggacgcttacaagttcgtgacgcagtggcgccggccactgccagctcgcgcgacggatatcgggatctggctcgggattctggaaggcatcggcatcctggccgtcataaccaatgcgttcgtgatcgccatcacctccgactatattcctagatttgtttatgaatacaaatacggaccatgtgctaatcatgttgagccttcagaaaattgccttaaaggctacgtaaacaattccctttcattcttcgatctgagtgagctggggatgggaaaaagcggctactgtcgatatagagactacagaggaccaccatggtcaagcaaaccttatgagtttactctgcaatattggcacatccttgcagcccggctcgcttttatcatagtgtttgagcaccttgttttcggcataaagtctttcatcgcttatctgatacctgacgttccaaaggggctgcacgatagaattcgccgcgaaaagtatctggtccaggaaatgatgtacgaggcagaactcgagcacctccagcagcagcgcaggaagagtggccagccagtgcatcacgagtggccatag

SEQ ID NO: 40365 - DNA, 1428 bp, Artificial Sequence
  Description of Artificial Sequence: Synthetic coding sequence
atggccgtgtgggccaccgtgttcctggagttctggaagcggcggagggcggtgatagcatatgattgggacctcatcgattgggaagaggaggagatttgcgtcgtcatcgcggcagtattcgggatagttatctaccgggtcgtcacggtgtccacttttgccgcattcaagtgggccctaattcgcaataattctcaggtcgctactacggggactgctgtgtgtatcaacttctgtataatcatgttgcttaatgtcctgtatgagaaagtcgccctgttgcttacgaatctagaacagccaaggacggagtccgaatgggaaaacagctttaccctcaagatgttcttattccagttcgtaaacctgaattcatcaaccttttatattgccttttttttgggaaggttcaccggccatcctggcgcatatctgagattaattaacaggtggaggctagaggaatgtcatccttctggctgcttaatagatttatgcatgcagatgggcataattatggtcctcaaacagacctggaacaatttcatggagctgggctaccctctcatccaaaattggtggacgcggcggaaagtgagacaggaacacggacctgagcggaaaatctccttcccccagtgggagaaagactacaatttgcagccaatgaacgcttacggcctctttgatgaatacttggaaatgatactgcagttcggattcaccacaatcttcgtcgcagcctttccactggcaccacttctggcgctactgaacaacatcattgagattcgcctggacgcatataagtttgtcactcagtggaggaggccactagccagtcgggcgaaggatataggaatttggtacgggatcttggaaggaatcggaattttgtccgtgataacaaacgctttcgtcatcgccataacaagtgattttattccacggctcgtgtatgcctataaatatggcccatgtgctggacagggtgaagcgggccaaaagtgtatggtgggctacgtgaacgccagcttgagcgtattcagaatctcagactttgagaacagatcagagccagaaagcgacggctcagagttttctggtaccccactgaagtattgcagatatagggattacagggaccctccccatagccttgtgccatacggatacaccctccaattctggcacgtgctcgctgctagactggcatttatcatcgtttttgagcacttagtgttttgcattaaacacctaattagttaccttattcctgacctgcctaaggatttacgcgataggatgcggagagagaagtacctgattcaggagatgatgtacgaggccgagctcgaaagactgcagaaggagcgtaaggagcgtaagaaaaatggaaaagcgcaccacaacgagtggccatag

SEQ ID NO: 40366 - DNA, 2868 bp, Artificial Sequence
  Description of Artificial Sequence: Synthetic coding sequence
atggaggccagcagcagcggcatcaccaacggcaagaccaaggtgtttcaccctgaaggaggagtcgatttacagggttaccaacttgacatgcaaatcctcccggatggtccaaaaagcgatgttgactttagcgaaatacttaatgcgatccaggaaatggccaaagatgtgaacattctgttcgatgagctagaagctgtgtcaagtccatgcaaggacgacgattcgctgcttcacccgggcaacctcacatcgacatctgacgatgcctcccgtttggaggccggaggagaaaccgtccccgaacggaacaagtcaaatggcctctattttcgcgacggcaagtgcaggattgattatattctggtgtacaggaagtctaatccccagaccgagaagcgcgaagtgttcgagagaaacattagggctgagggtctccaaatggaaaaggaatccagcctgataaacagtgatatcatcttcgtgaaattgcacgccccctgggaggtactgggccgctacgccgaacaaatgaacgtacggatgccctttcgacgcaagatctattacctgcccaggcgttacaagttcatgtctaggatcgacaaacaaatttctagattcaggcgctggctccccaagaagcccatgagactcgacaaagagacccttcccgatctggaagagaatgattgttataccgccccattcagtcagcagagaatacaccatttcataatacataacaaggagaccttttttaataatgcaactcgttcaagaattgtgcaccacatactgcaacggatcaaatacgaggaagggaagaacaagattgggcttaacagactcctgaccaacggaagttacgaggcagcctttccactgcacgaaggctcctacagaagcaagaattccatacgcacccatggggcagagaaccacagacacctcctttacgaatgttgggcttcctggggagtctggtataagtaccagcccctggaccttgttcggagatactttggagagaagatcggcctatacttcgcctggctcggatggtacactgggatgctcttccctgcagcctttatcggcctgttcgtgttcctttatggcgtcaccacactggatcactcacaagtgtccaaggaagtctgccaagctactgacatcataatgtgccctgtgtgcgacaagtactgcccattcatgagactgagcgattcatgtgtgtacgcgaaggtgactcatctctttgataacggggcaactgtgttctttgcagtgtttatggcggtttgggccacagtatttttggagttctggaagcggcgcagggcggtcatagcatatgattgggacctgattgattgggaggaggaggaggaagagatccgaccacagttcgaggcgaaatactcaaaaaaagagcgaatgaatcccatctctggcaagccggagccctaccaagcctttactgataaatgttcccgcttaatcgtgagtgcctccggaattttctttatgatctgtgttgtcatagcggccgtctttgggatcgtgatttatcgagttgtgacagtgtctacatttgccgctttcaagtgggcactcatccgtaacaattcacaggtcgccactacggggaccgcagtttgtattaacttctgcatcatcatgctcctcaacgtgctatacgaaaaagtggcattattgctgaccaacttagagcagccacgaaccgagagcgagtgggagaattcctttaccttgaagatgtttcttttccagttcgtcaaccttaactctagcactttttacatcgcattcttcctgggtcggttcacaggacaccctggcgcctacttgagactgatcaaccggtggcgactggaggagtgtcacccctcaggctgcctgattgacctctgtatgcagatgggaatcataatggtgctcaagcagacttggaataattttatggagttgggatatccccttatccagaattggtggactcgacgaaaagtgagacaggagcacggtcccgagcgcaaaataagttttcctcagtgggaaaaagattacaatcttcagcccatgaacgcgtacgggctgttcgatgagtacctggaaatgattctacagtttggcttcactaccatcttcgtcgcggcctttccgctcgccccccttttggctctgcttaataatatcattgaaattaggctggacgcgtataaattcgtgacacagtggcgtcggccactggcgagtcgagcgaaggacattgggatttggtatggcatcctggaaggcatcggtattctgtctgtgatcacaaacgccttcgtcattgcgattacaagtgatttcatcccgcgtttggtgtatgcctataagtacggtccatgtgccggccagggcgaagccgggcagaaatgcatggttggttatgttaacgcttcgttgagcgtctttcggattagcgacttcgagaatcgcagcgaaccagagagcgacggaagtgaattctctggaacacctttgaagtattgccgctacagagactaccgggaccctcctcactcactcgtgccatatgggtacacactacaattttggcacgtgctcgccgctcggttagccttcatcattgtgtttgagcatcttgtattctgtatcaagcacctgatctcctacctgatacctgatttacccaaggatttgcgtgatcggatgcgccgcgaaaagtatcttattcaggagatgatgtacgaggccgagttggagcggttacagaaggaaagaaaggagaggaaaaagaacggtaaggctcaccacaatgagtggccatag

SEQ ID NO: 40367 - DNA, 2763 bp, Artificial Sequence
  Description of Artificial Sequence: Synthetic coding sequence
atggaggccagcagcagcggcatcaccaacggcaagaccaaggtgttccatcccgtggcgaaggacgttaatatccttttcgatgagttagaagcagtcagctcaccgtgcaaagatgacgactctttacttcacccgggtaacctgacctctacgtcagacgacgcaagccggctggaggccgggggggagacagtgccggagaggaacaagtccaacgggctgtatttccgtgatggaaaatgccggatcgattatatcctggtttataggaaatcaaaccctcagacagaaaaacgagaggtgttcgagaggaatatcagggcagagggcctgcagatggagaaggagtccagcctgatcaacagcgacattatttttgtaaagctgcacgctccgtgggaggtgttaggtagatacgctgagcagatgaacgtgcggatgccctttcgacgaaagatctactacctgcctcggaggtacaagtttatgtctcgaattgataaacaaatatctcggttcagaagatggctgcccaaaaagcccatgagactggataaggaaaccctgccagatttggaggaaaatgactgttatacagcccctttttcccagcagagaattcaccattttataatccacaataaagagacattttttaataatgctacacggtcacgaatcgtgcatcacatccttcagcgcatcaaatatgaggagggaaagaataagataggccttaatcggctgttgaccaacgggtcatatgaagccgcctttcccctgcacgagggcagctaccgatcaaagaactcaatccgtactcatggagcagagaatcacaggcacctcctctatgaatgctgggcctcatggggtgtatggtataaataccaaccactggatttagtgcggcggtactttggggaaaagatcggcttgtactttgcatggttgggctggtacaccggtatgctttttcctgcagctttcattgggttattcgtgtttctgtatggtgtaaccaccttagatcatagccaggtgagtaaggaggtgtgccaggcaacggacatcatcatgtgtcccgtctgtgataagtattgtcctttcatgagactgtccgacagctgcgtgtatgcgaaagtcactcatctgtttgataatggcgccacagttttttttgctgtatttatggcagtgtgggcaacagtcttcttggagttctggaagaggaggagggcagtcatagcgtacgactgggacctgattgactgggaggaggaggaagaggagatcaggccacagttcgaagcaaaatattcgaagaaggagcgcatgaaccccattagtggtaagcctgaaccgtaccaggcctttacagacaagtgtagccgtttaatcgtcagtgcatccgggatttttttcatgatttgtgttgtgatcgcagcagtcttcggtatcgtgatttatagagtggtcaccgtgagcacattcgccgcattcaagtgggcactaatcaggaacaactcccaggtcgctaccactggaactgccgtttgcatcaacttttgcattattatgttacttaacgtcctgtatgaaaaggtagcattactgctcactaatctagaacaacctagaaccgaaagcgaatgggagaacagtttcactcttaagatgtttctcttccagtttgtgaacctgaacagtagtacgttctacatagcctttttcctcgggcgtttcaccgggcaccccggggcctatcttaggctgatcaatcgatggcggctagaagaatgccacccttccgggtgtctgattgatctgtgcatgcagatgggcatcataatggtcttaaagcaaacgtggaacaactttatggagcttggttaccctctcatacagaattggtggacacggcgaaaggtgcggcaggagcacggcccagagcgaaagatctctttcccccaatgggaaaaggattataatctgcagccaatgaacgcctacggcttgtttgatgaatacctcgagatgatcttacagtttggattcaccactattttcgtagccgccttccctttggcaccactgctcgcgctcttaaacaacattatcgaaatcagacttgacgcctacaagtttgtgactcaatggcggaggcctctggcgagtcgcgccaaggatatcggaatctggtatggcatcctggagggcatcggaatattaagcgtgatcaccaatgcgttcgtgatcgctatcactagcgacttcatcccaagactggtctatgcgtataaatatgggccatgtgccggccaaggcgaggccggccaaaaatgcatggttgggtatgtgaacgctagccttagtgtcttccgtatctccgatttcgagaacagatccgagcccgagtcagatgggagcgaattctctggtacccctttgaagtactgtcgctaccgggactacagagacccaccgcattctttagtaccttatggttatactcttcagttctggcatgtccttgctgcaagactggcatttatcatcgtcttcgagcacctggtcttctgcatcaaacacttgatttcttatctcatacccgatctgccgaaagacctgcgtgacaggatgaggagagaaaagtacctcatacaggagatgatgtatgaggccgaattagaacggctgcaaaaagaacgaaaggaacggaagaaaaacggcaaggctcaccacaatgagtggccatag

SEQ ID NO: 40368 - DNA, 1071 bp, Artificial Sequence
  Description of Artificial Sequence: Synthetic coding sequence
atggccagcctgaccgcctacgacaaggacgtgagcagcggcagctataatctgtctagcgcgaccacaggctcatattactcctgcgtttctcaaattaccatcggctacgacgtggctgggccagtggccatcggactgacacactggaaaaatccctatgtgcaaggtcgcccaacgctcccctctgatctcccactcttcgtttccaaggacgcaggcatccccgtgtaccatcggtcattcactcgaaaaaccgatcaagcgacgccactgtcatgccccgcctccctctcgatcacacccgttccctcttacagctcaagctcacaggagacactcagccaggacacaaccgggctttccctctcaatccatggtgcagagaaacgcctacagatccatcagcgccgctctgtcgcttcacggcccgccagcaggcgcagactccctgtggtacgtcatagctccctccctcctggcaggcgaagtatcaagatggaagctagcagctctgggatcactaatggcaaaactaaggtgtttcaccctgagggtggtgtggacctgcaggggtaccaacttgacatgcagatcctccccgacggtcctaaatctgatgttgattttagcgagatcctgaacgcgattcaggagatggctaaggatgttaacattcttttcgacgagttggaggccgtcagctcaccatgtaaggatgatgacagcctgctgcaccccggaaatcttacatccacctctgatgatgccagcagactcgaggctgggggagaaacagttccggaaaggaataagagcaatggactatatttcagagacggtaaatgcagaatcgactatatcctggtgtaccgcaaatcaaaccctcagacagagaagagagaggtgttcgagcggaatatcagagccgaaggcctgcaaatggaaaaagagtcgtccctcattaattccgacatcatttttgtgaagctccacgctccttgggaggttctgggaagatatgccgaacagatgaacgtgaggatgcccttttcgtcaaactgtaattag

SEQ ID NO: 40369 - DNA, 36 bp, Artificial Sequence; identical to SEQ ID NO: 16405
  Description of Artificial Sequence: Synthetic coding sequence

SEQ ID NO: 40370 - DNA, 1428 bp, Artificial Sequence
  Description of Artificial Sequence: Synthetic coding sequence
atggccgtgtgggccaccgtgttcctggagttctggaagcggcggcgggccgtcatcgcgtatgattgggatctgatagattgggaggaggaggagatctgcgtcgtgatcgcagccgtgtttggaatcgtgatttaccgcgtggtcactgtaagtacgtttgcagcatttaagtgggcacttatcaggaacaactcgcaggtagccaccactggaacagcagtgtgcatcaatttctgtattatcatgcttttgaatgtgctgtacgagaaggttgctctgctgcttactaacctggagcagcctaggacagagagcgaatgggagaactcattcaccctgaaaatgttcctgtttcagttcgtgaacttaaattcaagcaccttctacattgcattcttcctggggcgtttcaccggccacccaggcgcatacctcagacttattaatcggtggcggctggaagaatgtcatccaagtgggtgcctcatcgacctctgtatgcagatggggattataatggttttaaaacagacatggaacaattttatggaacttgggtacccacttatccagaattggtggacccggcgtaaggtgcgccaagagcatggccccgagcgcaaaatcagtttcccacagtgggagaaagactacaatctacagcccatgaatgcgtacggtttattcgacgaatatctggagatgattctccagtttggcttcacaaccattttcgtagcagcctttcctctcgctcctttactggccctactaaataatattattgaaatccggcttgacgcctacaagttcgtgacccagtggcggcggcccctggcttcacgagcaaaagacataggcatctggtatggaatcctggagggcatcggcattctgtccgttattactaatgctttcgttattgccatcacctccgacttcatcccacgcctggtttatgcgtacaagtacggaccctgcgccgggcagggcgaggcaggacagaaatgcatggtgggatatgtcaacgctagcttgtctgtgttcagaatttcggacttcgagaaccggtcggaacctgagtccgacggatcggagttttcaggcacaccgcttaagtactgtaggtatcgggattaccgagatccacctcacagtctcgtcccatatggctatacgttgcaattctggcacgtcctggcagctcgactcgcatttattatcgttttcgagcatctcgtcttttgcatcaagcacctgatatcgtaccttatacctgacctgccaaaggaccttagggaccgcatgaggcgggagaagtatctcatccaagagatgatgtacgaggcagagctggagaggctgcaaaaagaacggaaagagaggaagaaaaatggtaaggctcaccacaacgagtggccttag

SEQ ID NO: 40371 - DNA, 2802 bp, Artificial Sequence
  Description of Artificial Sequence: Synthetic coding sequence
atgcggatggccgccaccgcctgggccggcctgcagggcccccccttgccaaccctctgcccagccgtccggacagggttatactgtcgggatcaggcccacgccgagcgttgggccatgaccagcgaaacctcgagcggcagccactgtgcgcggtccagaatgctgcgcaggcgggcacaggaggaagattctacggttcttatcgatgtatctccaccagaggccgaaaaaaggggcagctacggtagcactgcacatgcctccgagccaggtggacagcaggccgccgcctgcagagccgggagccccgccaaaccacgcatcgcggatttcgttctggtctgggaagaggacctaaaactggacaggcagcaggactcagcagcacgggaccggacggatatgcaccgaacgtggcgggagacattcctggacaatctgcgtgcagcagggctgtgcgtcgatcagcaggacgtgcaagacggtaacacgactgtccattacgccctgctgtcagcaagctgggccgtactgtgctactacgccgaggacctgaggctgaagctcccactgcaggagcttcccaaccaggcaagtaattggtctgctgggttgctggcttggctaggaatcccaaacgtgctgctggaggtggtccccgacgtaccaccagaatattactcttgtagatttcgggttaataagttgcctagatttctgggcagtgataaccaggacactttctttactagtactaaaagacaccagattctttttgaaattcttgctaagacaccgtacggccacgaaaaaaagaatctgttgggcatacatcagctgctggctgagggagtcctgtccgcagcattcccactgcacgacggtccttttaaaactccccccgagggcccccaagccccaaggctgaatcaaagacaggtgctgtttcagcactgggctcgatgggggaagtggaataagtatcaacccttggaccatgtccggcggtattttggcgagaaggtggcgctgtatttcgcctggctaggattttacaccggctggctgctccccgctgcagttgtggggacgctcgtgtttcttgttggctgtttcctggtgttctccgacattcctactcaggaactttgcggcagcaaagattcttttgagatgtgtccattgtgtctcgactgtccattctggctgctcagcagcgcatgcgcactcgctcaggccggccgattgtttgaccatggaggcaccgttttctttagcctctttatggcactctgggctgtgttgctgctggaatattggaaacgaaaatccgcaactctcgcgtatcgctgggattgttccgactacgaggacactgaagagcgcccacggccccagttcgccgctagcgcacccatgaccgcacctaaccccattactggcgaagacgaaccctactttcccgaaaggtcccgggcgcggcggatgctggctggcagcgtagttatcgttgtgatggtcgccgtcgtggtgatgtgcctcgtgtctataattttgtatagagccataatggcgatcgttgtatccagatcagggaacactttactcgccgcttgggcttcccgaattgctagcctgactggatctgtcgttaatctggtcttcattctgattttatccaaaatttacgtctctctggcccatgtgttaactcgctgggagatgcacaggacccagacaaagtttgaagatgccttcacattgaaagtatttatttttcagtttgtcaacttctactcaagtccagtgtacattgcattcttcaaaggtagattcgtcgggtatccaggtaactaccatacactttttggagtccgcaacgaagaatgcgcagcgggcggctgcttgatcgagcttgcacaggaactcctcgttataatggtcggcaaacaggttattaacaacatgcaggaggtcctgatccccaagctcaagggctggtggcagaaatttcgactccgttcaaaaaaaaggaaagccggcgcgtccgccggcgcttcccaggggccctgggaagacgactacgaactggttccatgtgaaggactgtttgatgagtacctggagatggtgctgcaatttggatttgtcactatattcgtcgctgcttgccctctggcaccactgttcgctctcctgaacaactgggtggaaataaggctggacgcgaggaagtttgtgtgcgaatatcgcagaccagtcgctgagcgggctcaggatattgggatctggtttcatatactcgccgggttaacacacctggccgtgatttctaatgcgttcttgctggccttctccagtgactttttgccacgggcctattacaggtggacgcgtgcacacgatttgcgaggatttctgaatttcaccctcgcccgggctccgtccagttttgctgctgctcataaccgcacatgtcgctatcgagcctttagagacgatgatggccactactcgcagacgtattggaacctgctagccattagactggctttcgtgatagttttcgaacacgtcgtgttttccgtcggccgccttctcgatctgctcgtgccagatatcccggagtccgtggagatcaaggtgaagcgcgagtactacttggccaagcaggcattggctgagaatgaagttctatttggaactaatgggaccaaggacgaacagcccgagggctctgaactgtcgtcacattggaccccattcacagtccccaaggcttctcagctgcagcagtag

SEQ ID NO: 40372 - DNA, 2652 bp, Artificial Sequence
  Description of Artificial Sequence: Synthetic coding sequence
atgcggatggccgccaccgcctgggccggcctgcagggcccccccctccccacactatgtccagctgtcaggaccgggctgtactgccgtgatcaggcccacgctgagcgttgggccatgacttccgaaacctcctctggatcccattgcgcacgcagcaggatgctaagacgaagagctcaggaggaagatagcaccgttctaatcgacgtgtctccgcccgaagctgaaaagagagggtcatacggctcgaccgctcacgccagcgagcccggcggccagcaggccgctgcctgccgggctggcagtccagccaagcctcgaattgatttcgtattggtttgggaggaagacctcaaactggacaggcagcaggattctgctgcccgggacagaacagacatgcaccggacctggcgggaaacattcctagataaccttcgtgctgccgggctttgtgtggaccagcaggatgtccaagacggcaataccaccgtgcactatgcactgttatcagcctcctgggctgtcctgtgttattatgcagaagatctgcgcctcaaactgcctctgcaggagctccccaatcaggctagcaattggtccgccgggctgttagcctggctggggatacctaacgtgctgttggaagtagtcccggacgtccctcctgaatattactcctgtcgttttcgcgtcaacaaacttccaagattcctgggatcggataaccaggataccttcttcacatctaccaaaagacaccagattctgtttgagattttggccaagacaccctatggacatgaaaagaagaatctgctcggaatccatcaattactagccgagggtgtactgagcgctgctttcccactgcacgacggaccattcaaaacaccccctgagggaccacaagcgccccgtttaaaccagcgacaagtgctctttcaacactgggctagatggggcaaatggaacaagtaccaacctctggaccatgtgcggaggtatttcggcgaaaaggttgccttgtactttgcgtggctgggtttttacaccgggtggttgctgccagccgctgtagttggaaccctggtgttcttggtcggttgtttcctagtttttagtgacattcccacgcaggaactttgcgggagcaaggattctttcgaaatgtgccccctgtgcctagattgtccattctggttactatctagtgcgtgcgctctggctcaagcaggccggctctttgaccacggggggacggtttttttctcactcttcatggccctgtgggctgtgctgctcctggagtactggaagcgtaagtccgcgaccctggcctacaggtgggattgcagtgattatgaagacacagaggaacgcccgagaccgcagttcgccgcctccgcgccaatgaccgctcccaaccctattacgggggaagacgaaccttactttcccgaaagaagtagagcacgaagaatgttggcagggtccgttgtcatagtcgtcatggtggctgtcgtcgtaatgtgccttgtgagtattatcttgtacagggcaatcatggctatcgtggtctccaggagcggaaacacactgttagcggcctgggcatcaagaatcgcttccttaactggcagcgttgtcaatctcgtcttcatattaatactatcaaagatatatgtgagtttggcacatgtgctgacaagatgggagatgcatcggacccagacaaagttcgaagatgctttcacactgaaggtattcatattccaattcgtaaacttttacagctcccctgtttacatcgccttcttcaaggggagattcgttggttacccaggcaattatcacacactttttggcgtacggaatgaggagtgcgcagcagggggctgcctgatcgagctcgcccaggaactgctcgtgattatggtgggtaagcaggtgattaacaacatgcaggaggtgctgattcccaaactcaaagggtggtggcaaaagtttcgacttcggtctaaaaagcgtaaggcgggagcatcagcaggggcatctcagggaccctgggaagacgattacgagctggtgccatgtgaggggctctttgacgaatacctggaaatggtgctgcaatttggctttgtgactatcttcgttgccgcctgcccactcgcccctttattcgcattgctcaacaactgggttgagattcggttggatgcgaggaagtttgtgtgtgagtatagacgtccagttgccgagagggcacaggatataggcatatggttccacattcttgcagggttgacacacctggcagtgatcagcaatgctttcctcctggccttctccagcgattttctgccgagggcctattaccgctggaccagggctcacgatctgcgagggttcctgaatttcacgctggctagggcaccttcctcctttgctgctgcccataacagaacgtgcagatacagagctttccgagatgatgacggccactacagccagacgtattggaacttgttggcaataagattagcgttcgttattgtctttgaagtggcagaggcaccagccgggagtcccattcatggcatgcgccctcgaccatgcgctcttccaaacagtagcacctggtag

SEQ ID NO: 40373 - DNA, 540 bp, Artificial Sequence
  Description of Artificial Sequence: Synthetic coding sequence
atgcggatggccgccaccgcctgggccggcctgcagggcccccccttgcctacgctctgtcctgctgtgcggacgggcctctactgcagagaccaggcgcacgctgagagatgggctatgacctctgagacctcctctgggtcccattgcgctaggagtaggatgttgcgaagacgggctcaggaggaggatagcacagtgttgattgacgtgtccccccccgaggctgagaagcggggatcatatggatccactgcacacgcgtctgagcctgggggccaacaggccgctgcgtgtcgcgctggatctccggccaagcctcgaatagactttgtcctcgtgtgggaggaggatctgaaactagaccgtcagcaagattcagccgccagagaccgaaccgatatgcacaggacctggcgggaaaccttccttgacaacctgcgcgcggcaggcttatgcgtagaccaagtgcgcgggggctgtcatggacaagggcctcgaccctgcatccatagcgttacacatgacctggccgcctag

SEQ ID NO: 40374 - DNA, 3699 bp, Artificial Sequence
  Description of Artificial Sequence: Synthetic coding sequence
atggccgaggccgccagcggcgccggcggcaccagcctggagggcgagcgcggtaagaggcctcctcccgaaggagaacccgcagccccagcatctggtgtcctggacaagctatttggcaaaaggctgttgcaggccggccggtacttggtcagccacaaggcttggatgaagactgtacctacagagaattgcgacgtgctcatgacgtttccagatactacggatgaccatactttgttgtggctgcttaaccatatcagggtgggcatcccggagcttatcgtccaggttaggcatcacaggcatacacgcgcctacgcattttttgtgactgcaacctacgaaagcctgttacgaggtgccgatgagctgggactgcgaaaagccgtgaaagccgagttcggcggaggaactcgaggattttcttgcgaggaagatttcatatacgaaaacgtggaaagcgagttaaggtttttcacctcacaggagagacagtccatcatcagattctggctgcagaaccttagagcaaagcagggcgaggcactccacaacgtgagattcctcgaggaccagcccatcattccggaactcgccgcccgaggcataatacagcaggtgtttcccgttcacgagcagaggatcctgaacaggctgatgaaaagttgggtgcaggctgtatgtgaaaatcaacctttagacgacatatgtgattacttcggcgtcaaaattgctatgtactttgcctggctcgggttctacaccagcgcaatggtgtaccctgctgtgttcggcagcgtcctgtatacctttaccgaggccgaccagacctcccgtgatgtgtcctgtgtggtcttcgcactattcaatgtgatttggtctacactcttcctggaggaatggaagcgcagaggcgcggagcttgcctacaaatggggcactctagattcccccggcgaggccgttgaagaaccacgtcctcagtttagaggggtccggaggatcagccccattacgagagccgaagagttttactatcctccctggaagaggctcctcttccaactcttggtaagtctgcccctgtgtctggcctgccttgtgtgcgtatttcttctgatgctgggatgctttcagctgcaagagttggtgttgagtgttaaaggtctcccaaggctggctcgttttctgccaaaggttatgctggctttattggtgtccgtcagcgctgagggttacaaaaaattggctatctggttaaacgacatggaaaactatcggctcgagagtgcctatgagaagcatctgattattaaagtcgtgcttttccagttcgtgaactcctacctgagcctcttctacatagggttttatctaaaggatatggagaggctgaaagagatgctggctacactgctgatcacgcgccagtttctccagaacgtacgtgaggttctacagccacacctgtatcggcgtcttggcagaggggagctcggtctgagagccgtgtgggagctggctcgcgctcttctgggtctccttagcctgagaagaccggcccctagaaggctggaaccgcaggcagatgagggtgggggagggggctctggcggaggggggcggcggtgccttagtggaggctgcggagccccagaagaggaagaagaggccgcccttgtagaacggcgaagggcgggtgaaggcggcgaggagggcgacgggcccccaggtggcaaagaagaggacgaggacgacgaagaggaggaggatgaggaggaggaagaggacgaagaagagggcgaggaaggaggcctcctagactgcggccttcggcttaagaaggtgagctttgccgagcgcggcgctggacgccggagaccaggcccttcccccgaagcgctgctggaggaggggtcccccacaatggtcgagaaaggcctggagccaggtgtcttcactctcgctgaggaggacgacgaggcagaaggggcccctggctctccagaacgagagccacccgccattctctttcggagagcgggtggcgaaggccgcgatcaggggcctgatgggggacccgatcccgaacctggttccaatagcgattccactcggcggcagcgcagacagaaccggtcgtcttggatagatccgccagaggaggagcattctcctcagctaacccaggcagaattagagtcttgtatgaaaaagtatgaggatacttttcaggattaccaggagatgtttgttcagtttgggtacgtggtgctgttttcatcggcatttcccctggctgcgttatgtgcattagtgaataacctaattgagattcggtcagacgccttcaagctttgtactggccttcagaggccgtttggacagcgcgtggagagtatcggacaatggcagaaggtcatggaagcgatgggggtgctcgctatcgttgtcaattgttatctgattggtcagtgtggccagctgcaacgactgttcccatggttgtcccctgaagctgccattgtgtctgttgttgtgcttgaacatttcgcattacttctgaagtatctgattcacgtggccatccccgatatcccagggtgggtcgccgaggagatggcgaaacttgagtatcagcgcagagaagctttcaaacgtcacgaaaggcaagcacagcaccggtaccagcaacagcagcgcagacgtcgcgaagaggaggagcgtcagcgacacgccgagcatcatgcacggagggagcatgactcaggtggaagagaggaagcaagagccgaggggtccggcctcgaccctgccacttcctcggagaaggccagcgcgaaagcgaagggaagcaccgcaggtgggcacggccccgaaagaccaaagcggcccggcagtctgcttgccccaaataacgtgatgaaactcaagcaaataattcctctccaggggaaattcttaagctcaggagctacctctagccttgctgcggcaggcgcaggagctactacaagaccgcctcccgcccagtcacctaccgggtcagacacaaggcttccagcctttctgtccttcaaatttcttaagagccctgagacacgcagagactctgaaaggagtcactccccccccaaggcttttcatgccggcaagctgttccctttcggagggactcgagccgagcctggatccaacggagccggcggccaggcccgccctgacggcacgccctcttccggttcgagccgggtacagcggtccggtccagtggacgaagccctcgctgaggagcttgaggcccctcggcccgaagaggaggggtccgggacagctctggcccctgtgggcgcacccgcactgaggactcggagatcacgcagccccgctcccccgccaccgatgcccctgcctagaccaccaactccccccgctggatgttggcagtgggatggaccatggggttgcggcggcgaaggtgctgcaccaaggcaggcattggcagccgctgagtgccccccatgcgcgatggccggcccccctccagctccacagcctctgcctggtgacgcaagtttttatagtctgccacctcctcctctgccacctacatctgatcctctggagacgcccgctcccagccctagtccgtccccatctcctcaggctgtgtgttggccttcaggttggcactag

SEQ ID NO: 40375 - DNA, 2349 bp, Artificial Sequence
  Description of Artificial Sequence: Synthetic coding sequence
atgcagggcgaggagagcctgcggatcctggtggagcccgagggcgatagctttcctctgatggaaatttctacatgcgagactgaggctagcgaacaatgggattacgtattggtcgcccagagacatacccaacgtgacccacggcaggctaggcagcaacagttcctggaggaactccgccgaaaagggttccacatcaaggttattcgcgaccagaagcaggtgttctttgggataagggcggataactctgtcttcggactttaccgaacatttcttctggagcctgagggcccggctccccacgctgagctggccgctcccaccactatacctgtgacaacaagtctcagaattcgcatagtaaactttgtggtcatgaataacaagacctctgccggagaaacgtttgaagatttgatgaaagatggggtgttcgaagctcggtttcccctgcacaagggagaaggtcgcttgaagaaaacgtgggcacgctggcgacacatgttccgcgagcagcccgtagacgagatcagaaactactttggcgagaaggtggccctgtacttcgtctggttaggatggtacacatatatgctagtccctgccgccctgactggactgctagtattcttgtccgggttctcactgtttgaggcgtcccagatttctaaggagatttgtgaagctcatgatatcctgatgtgcccattgggggaccacagcagacgataccagaggctcagtgagacctgtacgttcgccaagctgactcacctgtttgacaatgacgggaccgtagtgtttgccatttttatggctctgtgggcaaccgtgtttctagagatctggaagagacaaagagcacgagtagtgttgcattgggatttgtacgtgtgggacgaagagcaagaagaaatggcactgcaactgatcaactgccctgactataaactgagaccgtaccagcactcctacctgagatccaccgtgatcctcgttctcaccctgttgatgatctgcttaatgattggaatggcccacgtactggtggtgtacagggttctggccagtgccctattctcttcctctgcggtgccctttttggaggagcaggtgaccaccgcagtggtggtgaccggtgcgcttgtgcactacgtgactatcatcatcatgactaaaatcaaccggtgcgttgctctgaagctgtgcgatttcgagatgccccggacgttcagtgagcgtgagtctagatttaccattcgcttcttcactctccagttcttcactcacttctctagcttaatatatatagcattcatcttgggacggataaacgggcaccccggaaagtcaacaaggttggccggcctgtggaaactggaggaatgtcacgcatctggatgtatgatggacttgttcgttcagatggctattatcatgggcctaaaacagacactttcaaactgtgtggagtacctcgtcccgtgggtgacccataaatgtcgatctctgcgagcttcggaatccggtcatcttccgcgcgacccagagcttcgggactggcggaggaactatctgttgaaccctgttaatacgtttagtcttttcgacgaatttatggaaatgatgatacaatatggatttaccaccatatttgtcgccgcgttccctttggcccccctcctagctctcttctctaaccttgtcgaaataaggctcgacgcaatcaagatggtttggcttcagaggagactggtgccgaggaaggcgaaggatatcggaacatggttgcaagtcctggaaaccatcggcgttttggccgtgatagccaacggtatggtcatcgccttcacctcggagtttatcccccgggtggtatacaaatatcgttactcaccttgcttaaaagaagggaattccaccgttgattgcctaaagggctacgttaaccacagtcttagtgtgttccacaccaaggactttcaggaccccgacgggattgaaggatctgaaaatgtcacactgtgccggtaccgcgactacaggaatcctcctgattacaacttttccgagcagttctggtttctcctagccatccgtttggcttttgtcatcctgttcgagcatgtggctttgtgcattaagctcattgccgcatggtttgttccagacatcccccaaagtgtaaaaaacaaggttctggaagtgaaataccagagactgcgggagaagatgtggcacggtagacagagactcgggggagtgggggccggcagcaggcccccaatgcccgctcacccgactcctgccagcatctttagcgccaggagtactgatgtttag

SEQ ID NO: 40376 - DNA, 2592 bp, Artificial Sequence
  Description of Artificial Sequence: Synthetic coding sequence
atgaagaagttcttcgacagccggcgggagcagggcggcagcggcctgggatcgggcagctctggcggtggaggatctacatcgggacttgggtccggctacattggaagggtttttggaattggcaggcagcaggtgacggtggatgaagtgctagcagaaggaggcttcgccatagtgttcctcgtgcggaccagcaatggtatgaagtgcgcgctcaagcggatgtttgtcaacaacgagcatgacctgcaggtgtgtaagcgcgagatacagattatgcgagacctctctggacacaaaaacatcgtgggctatatcgatagctcaatcaataatgtctcatccggggacgtctgggaggttctcatactgatggacttctgcagaggcggccaggtggtaaatttaatgaaccaaagactccagaccgggtttaccgaaaacgaggtcctgcagatattctgtgatacttgtgaggcagtcgccaggctgcaccagtgtaagaccccaattattcatagggacctcaaggtggagaacatcctcttacatgaccgaggacattatgttctttgtgactttggttccgctacgaacaaattccaaaaccctcagactgagggagtgaatgccgtcgaggacgaaattaaaaaatacaccactctctcctatagggctcccgagatggtgaatctgtactcaggcaagatcatcacaactaaagcggatatttgggctttaggttgcttattgtataaactgtgttactttaccctgccattcggcgagtcccaggttgccatatgtgacggcaatttcaccatccctgataattctaggtactcacaggacatgcactgcctgataagatacatgctagagcctgaccctgacaaaaggccagacatataccaggtgtcatacttttcatttaaactccttaaaaaagaatgccccattcccaatgtgcagaactcccccatccctgccaaacttccagaacctgttaaggcctcggaggccgccgcaaaaaaaacacaacctaaggctaggctgaccgatccgatccctaccacagaaacatcgattgccccacggcaaaggcctaaagctggccaaacccaacccaaccctgggatcttacccattcagcctgcactgacaccacgtaagcgggctacagtgcagcccccaccccaggcagccggtagctccaaccagccagggctcctcgccagcgtcccccaacctaagcctcaggcgccaccgtcacagcctttgcctcaaacccaagcaaaacagccccaggcaccgcccactccacaacagaccccatcgacacaggcacaaggcctgcccgctcaggcgcaggccacccctcaacatcagcagcagctgtttctgaagcagcagcaacaacagcagcagccccctccagcgcaacagcaacctgcaggcactttctaccaacagcagcaggctcagacccagcaatttcaggccgtccatcccgccacgcagaagccggccatcgcccagtttccagtggtgtcacagggcggctctcagcaacagctgatgcagaatttttatcaacaacaacagcagcaacagcagcaacagcaacaacagcaactcgccactgcgctgcaccagcagcagctcatgacccaacaggctgcgttacagcagaagccaacaatggctgctggacagcagccacagcctcagccggctgctgcccctcagccggcgccagcacaagagcctgcaattcaggccccagtgaggcagcagccaaaggtgcaaactactccgccaccagccgtccagggtcagaaggtgggctccttgactccccccagttctcccaaaacacagagagcaggtcacagacgtatcctgtccgacgtgactcacagcgccgtattcggagtgccggcttccaagagcactcagctgctgcaggcagccgcggctgaggcctcactgaacaagtccaagtcagcaactacaaccccctccggcagtcccaggacttcacagcagaacgtgtataatccctccgagggctccacctggaatccatttgatgacgataacttcagtaagctcactgccgaagagctgctcaataaggacttcgcaaaattaggtgaagggaaacacccagagaagctcggggggtcagccgagtcccttatcccagggttccaaagtacccagggcgatgcatttgcgaccacatcctttagtgctgggactgccgaaaagagaaagggggggcagacagtagatagcggcctcccactcctgagcgttagtgatccattcataccattgcaagtcccggatgccccggaaaaactgattgaaggactgaagtcccccgatacatcccttctgctccctgatctgttgcccatgaccgatccctttggtagcacatcggatgctgtaatcggcaaggtcatcataagcgtgagctctgtgatgcatgatatgtgcgcgtgcttcaagaatgacaagtacctcgtcaatcagagcttgggaaattccccagctacacctgaggccaaagctatctag

SEQ ID NO: 40377 - DNA, 2886 bp, Artificial Sequence
  Description of Artificial Sequence: Synthetic coding sequence
atgaagaagttcttcgacagccggcgggagcagggcggcagcggcctgggctccggctcgtctgggggagggggcagcacctctggcttagggagtgggtacatcgggagggtcttcggaatcggcaggcaacaggttactgttgatgaagtgctggccgaggggggctttgccatcgtctttctggttcgtacgtcaaatggaatgaagtgtgccctaaagaggatgttcgtgaacaatgagcacgacttacaggtgtgcaaaagagaaattcagatcatgcgggatctgtcgggccataagaatattgtcggctatattgatagcagtataaacaatgtgtcatcaggcgacgtctgggaggtactgattctcatggacttttgtaggggagggcaggttgtaaacctgatgaaccagcgcctgcaaacaggattcacggaaaacgaggtcctgcagattttctgcgacacttgtgaagccgtggccagactgcatcagtgcaagaccccgataattcatcgcgatctcaaagtagagaacatcctgcttcatgaccgggggcattacgtgttgtgtgactttggatccgcaactaacaaattccagaacccgcagaccgagggggtaaatgcagtggaagacgaaattaagaagtacacgacactgagttacagagcaccagaaatggtaaacctttacagcggcaaaatcattaccactaaggcagatatttgggcactcggatgtctcctgtacaaattgtgttacttcacgctgcctttcggcgaaagtcaggtagccatctgtgatgggaacttcacaatacccgataactctcgttattctcaggacatgcattgtctgatccgctacatgctcgaaccggaccctgataaaagaccagacatctaccaagtttcgtacttctcctttaagcttctcaagaaagagtgcccgattcctaacgttcaaaactccccaataccagccaagctgcccgagccggtcaaggccagcgaagcggccgccaagaagactcagccgaaggcaaggctcacagaccctatccccactaccgaaacttccattgcccctaggcaaagaccaaaagccggacagacacagcctaatcctgggatccttcccatccagccggccctcacaccccgtaagcgagccaccgtgcagcccccaccccaagcagccggctcctcgaaccagcctggcctcttggcttcggtgcctcagcccaagcctcaggccccgccaagtcagcccttgccacagacacaggccaaacagccccaggctccccccaccccccagcagactcctagtacccaagctcaggggctacctgcacaggcccaggctacaccccaacaccaacagcagctgttcctgaagcagcaacagcaacaacaacagcctcctccagcgcaacaacagcccgccggcaccttctatcagcaacagcaggcccagactcaacagttccaggccgtccatccagccacccagaagcccgctatcgctcagttccccgttgtgtcccagggagggtcccagcaacagctgatgcagaacttttaccaacagcagcagcagcagcagcaacagcagcagcagcagcaactggccaccgcgctgcatcagcaacaattaatgacacaacaggccgccttgcagcaaaaaccgaccatggctgctggccagcagccacaaccacagccagctgccgccccccagcctgccccagcacaggagcccgccatccaggcacccgtgcggcaacagcctaaggtccaaacgaccccacctccagccgttcaaggacagaaagtcggctcacttacaccaccaagctcccccaagacccagcgggccgggcacagacgcattctcagtgatgtcactcactccgccgtttttggcgttcccgcgtccaaaagcacacaactgttacaggctgcagcggccgaggccagtctaaacaaaagtaagtccgcaaccaccacaccgtcagggtctcccagaacaagtcagcaaaatgtttacaatccctcagaaggctctacctggaacccgtttgatgatgacaacttcagcaagttgaccgccgaggaactgcttaacaaggacttcgctaaattgggcgagggcaaacatcccgaaaagctcggaggtagtgcagagtctctgatacctggttttcagtctactcaaggcgatgccttcgccactacaagcttctctgccggaactgcggaaaagaggaagggcgggcagacagtcgatagcggcttgccgctgctttctgtcagtgacccctttattccgctgcaagtgcctgatgcccccgaaaagcttatcgaaggtctgaagtccccagacacctcccttctattgccggacctgctcccaatgactgaccctttcggcagcacttctgacgcagtgatcgagaaggcggatgtcgccgtcgaatcgctcatccctggcctcgaaccccctgtacctcaaagactcccgtctcaaacggagagcgtgacttccaatcgtaccgatagcttaacaggagaagattcgcttttggattgtagcctcctgtctaacccaaccacagacctcttggaagaattcgcacccactgctatttccgcccccgttcataaagccgccgaagatagcaacctcattagcgggtttgacgtgccagaaggctccgataaggtagctgaggacgagtttgaccctattccagtgcttattacgaaaaacccgcaaggcggccattctagaaacagtagtggaagttcggaaagttcattacctaatctggcgcggagtctgctgctcgtagaccagcttatcgacttgtag

SEQ ID NO: 40378 - DNA, 1143 bp, Artificial Sequence
  Description of Artificial Sequence: Synthetic coding sequence
atggaggagggcggcgacttcgacaactactacggcgccgacaaccaaagtgaatgtgagtacacagactggaaatcctcaggggccctcattccagctatttatatgcttgtgtttctgttggggaccacaggcaatggcctcgttctttggacagtctttcgcagtagcagagagaagagacgaagcgctgacatcttcattgctagcctggccgtcgccgaccttactttcgtagtcaccctcccactgtgggctacttatacctacagagattatgactggccatttggcacattcttctgcaaactgtcaagttatctgatttttgttaatatgtacgcgtctgtcttctgtctaaccgggctgagcttcgatcggtatctagcaattgtgcgtcctgtggctaatgcaagattacgcctcagagtaagtggggccgtcgccaccgccgtactttgggtccttgcagcgctcctagcgatgcccgtgatggtgctgcggacgactggcgaccttgaaaacactaccaaggtgcagtgctacatggactacagcatggtggcgaccgtgagcagcgagtgggcctgggaggttgggctgggtgtctcctccacgactgtgggatttgtggtacccttcaccataatgcttacatgttacttctttatagctcagaccatcgctggccattttcgcaaagagagaattgaggggctcaggaaaaggagacgcctgctctcgatcattgtggtgctcgtggtgacctttgccttgtgctggatgccatatcaccttgtaaagacgctgtacatgttgggttctctcctccactggccatgcgatttcgacctgttcctgatgaacatttttccatactgtacgtgtataagttacgttaattcttgtctcaacccattcttgtatgctttcttcgacccccgcttccggcaggcgtgcacatctatgttgtgttgcggccagtctaggtgcgcaggcactagccattctagctcaggcgaaaagagtgcaagttacagttcgggacacagccaaggacctggtcctaatatgggcaaaggaggagaacagatgcacgaaaagtccatcccttatagccaggagacactggtcgtggactag

SEQ ID NO: 40379 - DNA, 786 bp, Artificial Sequence
  Description of Artificial Sequence: Synthetic coding sequence
atggaggagggcggcgacttcgacaactactacggcgccgacaaccagagtgaatgcgagtacacagattggaagagctcaggagccctcatccctgcaatttatatgttggtctttctcctcgccatgccagttatggttcttcgaaccaccggagatctggagaacactacaaaggtccagtgttacatggactactccatggtggccacagtgtccagtgaatgggcatgggaggtaggtttgggcgtgtccagcactaccgtggggtttgtcgtaccatttaccatcatgctcacttgctactttttcatagcacagaccatagccggacacttccggaaggaacggattgaaggtctgcggaaacgtcgccggctgctctctataattgtcgttctggtggtgacctttgccctttgttggatgccttaccatctggtgaaaacactctacatgctgggctctcttttacattggccttgcgatttcgacttatttttaatgaacatctttccctattgcacttgtataagttacgtgaattcttgtctcaaccctttcctctatgcattctttgaccccaggtttaggcaggcttgtacaagcatgctctgctgtggacagtcgcgatgcgccggtaccagccacagttccagcggtgaaaaaagtgcttcttactcatctggccattcgcaggggcctggaccaaatatggggaaagggggtgagcagatgcacgagaagagtatcccatattctcaggagacactggtggtcgattag

SEQ ID NO: 40380 - DNA, 900 bp, Artificial Sequence
  Description of Artificial Sequence: Synthetic coding sequence
atgctggtgttcctgctgggcaccaccggcaacggcctggtgctgtggaccgtgttcagaagtagtcgtgaaaagcgcagatctgcagatattttcatcgcgtcactggcagtggcagacctgactttcgtggttacactacccctgtgggcgacctacacctacagggattatgattggccattcgggaccttcttttgcaaactgtcctcttatttgatttttgtgaacatgtatgctatgccagtgatggtcctgcggactaccggcgaccttgagaacacgacaaaggtgcagtgctacatggattattccatggttgctacagtaagttctgagtgggcctgggaagttggcctgggtgtatcgtctaccactgttggatttgtggtgccgttcacaatcatgcttacctgctacttctttatagcccagaccatcgcaggtcatttccggaaggagaggatcgaagggctgcggaagcgcagacgccttctgagcatcatcgttgtcctggttgtgacatttgctctgtgctggatgccgtatcacctcgtgaaaaccctttacatgcttggaagtctactgcactggccatgcgactttgatctgttcctgatgaacatatttccctactgtacatgcattagttatgtgaactcttgtctgaacccattcctgtatgcattcttcgaccctcgtttcagacaggcatgcacatctatgttgtgctgcggtcaatcaagatgcgcaggcacatctcacagtagctctggcgaaaaaagtgccagctacagtagcggacactcacagggccctggtccaaacatggggaagggcggagagcagatgcacgagaagagtattccttattcacaggagaccctcgttgtagactag

SEQ ID NO: 40381 - DNA, 621 bp, Artificial Sequence
  Description of Artificial Sequence: Synthetic coding sequence
atgctgccctgcgccgccggcgcccggggccggggcgccatggtggtattgcgcgccggcaagaaaaccttcctcccacccttatgccgtgcctttgcttgtcgtggttgtcagcttgcccccgagcgaggcgccgagcgccgggataccgcccctagcggtgtgtcgcgcttttgtcctccgagaaagtcatgccacgattggatcggtccccctgacaagtacagtaacttacgccccgtccatttctacataccagagaacgaaagtcccctcgaacagaagctccgcaagctccgtcaggaaactcaagaatggaatcaacagttctgggccaaccagaacctgacatttagtaaggagaaggaggagttcattcacagccggcttaagaccaagggcctgggtcttcgtacagagtccggacagaaggcaacacttaatgcagaggaaatggccgacttttataaggagttcctctccaaaaactttcaaaagcacatgtactataatagggactggtataaacggaacttcgccatcacattcttcatgggtaaggtggcattggaacggatctggaataagctcaaacaaaagcaaaaaaaaagatcaaactag

SEQ ID NO: 40382 - DNA, 1122 bp, Artificial Sequence
  Description of Artificial Sequence: Synthetic coding sequence
atgggcagccaggtgagcgtggagagcggcgccctgcacgtggtgattgtaggaggcggttttggtgggattgcggccgcttctcagttgcaggctttgaatgtgcctttcatgctcgttgatatgaaagacagctttcaccacaacgtggccgcccttagggcatctgttgagacagggttcgccaaaaaaacatttattagttacagtgtgacatttaaagataactttagacaggggctggtggtggggatagacctgaagaaccaaatggtgttgctgcagggaggcgaggctctcccattcagtcatctgattctggcaactggctccacaggcccatttccaggtaaatttaatgaagtgtccagtcaacaggctgcaattcaggcatacgaggacatggtcaggcaggttcagagaagtagattcatcgtggtggtggggggggggtccgcgggagtggagatggctgctgagattaagactgaataccctgagaaagaggtgaccttgattcatagccaagtcgcgctcgccgacaaagaactcctccctagcgtgaggcaagaggtcaaggagatacttctgcggaaaggcgtgcagctgctcctttcagagcgggtctcaaacctagaagagctgcctcttaatgaatatagagaatatattaaagtccagaccgataaaggcacagaggtggccaccaacctcgtcattttatgcaccggaattaagatcaactctagtgcctatcgcaaggcattcgaaagcaggctggcaagttcaggtgctctccgggtcaacgaacacctccaggttgagggacattccaatgtgtacgcaatcggcgactgcgctgacgtgcggaccccaaagatggcctatttggcaggcctccacgctaacattgcggttgccaatatcgtgaattccgtcaaacaacgcccactacaggcatacaagcccggagccctgaccttcctcctgtctatgggtcgaaacgacggagtgggtcagataagtggtttttatgtgggccgacttatggtgcggttaaccaagtctcgcgacttgttcgtgtctacctcctggaagacaatgcgacagtcacccccttag

SEQ ID NO: 40383 - DNA, 1122 bp, Artificial Sequence
  Description of Artificial Sequence: Synthetic coding sequence
atgggcagccaggtgagcgtggagagcggcgccctgcacgtggtgatcgtgggtggcgggttcggaggaattgcggctgcaagccagttgcaagccctgaacgtcccatttatgctggtggatatgaaagactcttttcaccataacgtggccgccctcagggcttccgtggagactggatttgcgaagaaaactttcatatcttactcggtgacctttaaagacaactttagacagggactggttgtgggcatcgacttaaaaaaccagatggtgctgcttcaagggggagaggcccttccattcagccacctgatacttgctactggttcaaccggcccctttcccgggaaatttaatgaggttagcagtcagcaggctgctattcaggcatatgaagacatggtgcgccaagtgcagcggtctagattcatcgtggtggtggggggtggctccgctggagtggagatggccgcagagataaagacagaatacccggagaaagaggtgaccctgatacacagccaggtagccttggctgacaaagaacttctacctagcgtccgccaggaggtaaaggaaatactcttgagaaaaggcgtgcaactcttactcagtgagagggtgtcaaacctggaagagcttcctttaaatgagtaccgcgagtatatcaaagttcagactgacaaaggaactgaagtggccacaaatttagtcattttgtgcaccggcataaaaataaactcatctgcctaccgaaaagcctttgagtcccggctcgctagctccggcgccttaagagtaaacgagcacttgcaggtagagggtcacagcaacgtttatgcaataggagactgcgctgatgtgaggaccccaaagatggcatatctggccggtctccacgccaatatcgccgtggctaacatcgtaaatagcgtcaagcaaaggcctctacaggcctataagcctggcgctctgacattccttctgagcatggggagaaatgatggagtcgggcagatcagcggcttctatgttggtcgcctgatggtgcgactgacgaagtccagagacctgttcgtgtctactagttggaaaaccatgagacagagccccccttag

SEQ ID NO: 40384 - DNA, 1011 bp, Artificial Sequence
  Description of Artificial Sequence: Synthetic coding sequence
atgggcagccaggtgagcgtggagagcggcgccctgcacgtggtgatcgttggtggggggtttggcgggattgctgctgcttctcagctacaggctctgaacgtgccatttatgttggtcgatatgaaggatagctttcatcacaatgttgccgcactccgagcctccgtggaaacaggcttcgccaagaagacctttatatcgtattccgttacatttaaggacaactttagacaggggttagtggtgggcattgacttgaaaaaccagatggttctgctccagggtggggaggtgcaaaggagccggtttattgtggtagtgggaggcggaagcgctggcgtggaaatggctgctgagattaaaaccgaatatccggaaaaggaagtgacactgatccacagtcaggtcgccttagccgacaaggagttgctgccatctgtgcggcaagaagtcaaagagatcctgttgcggaagggcgtccagctgttactcaccctcctgggcgaacgcgtgagtaatctagaggaacttcctctgaacgagtatcgagaatacatcaaagtccagacagataagggcacagaagtcgcgactaacctcgtgatcctgtgcacgggcatcaagatcaattctagtgcatatcgaaaggccttcgagtcacgcctagcctcttctggcgctctgcgagtgaatgaacatctgcaggtcgaagggcacagcaacgtgtatgctattggggattgtgctgacgtgaggactcccaagatggcttatctggctggccttcacgctaacattgccgtggctaatattgtgaactcagtcaaacaaagaccattgcaggcgtacaaacctggggccctgacattcctgctgtccatgggtaggaatgacggagtcgggcaaatatccggcttctacgtcggtagattaatggtgagactaaccaaatcccgggacctgttcgtgtccaccagctggaaaaccatgaggcagtcccccccatag

SEQ ID NO: 40385 - DNA, 906 bp, Artificial Sequence
  Description of Artificial Sequence: Synthetic coding sequence
atggtgttcacccaggcccccgccgagatcatgggccacctgcggatccgttctctgctggcgcggcaatgcctggccgaattcctgggagttttcgttcttatgctgttaactcagggggccgtcgcgcaggccgtgacctcaggtgaaactaagggtaacttctttacaatgttcctcgctggcagtcttgctgtaactatcgcaatttatgtgggaggcaacgtctccggagcacacttaaatcccgcattctctctggctatgtgcatcgtagggagactcccctgggtgaaactgcctatctatatcctggtgcagttattaagcgctttttgtgcatcaggtgctacatatgtgctgtaccatgacgccctgcagaattatacggggggcaatttgacagtgaccggccctaaggaaaccgcctcaatctttgctacttatcctgctccctatctgtccctgaataacggtttcctggaccaggttctgggtactggtatgctgattgtggggctgctcgcaatcctggatcggagaaacaagggcgttccagcgggtttagagcccgtagtggtgggcatgctgatcctagcactcggcctgtccatgggagccaactgtgggatacccctgaaccccgctagggacttaggaccgcgcttgtttacttatgttgcaggctgggggccagaggtgttctctgcaggaaatggatggtggtgggtgcccgtggtggcgcctctagtgggtgccaccgttggtaccgcaacttatcagctattagtcgccctgcatcaccccgaaggaccagaacccgctcaagatctcgtcagcgcccagcataaggcttctgaattagagactccagccagtgcccagatgttggagtgcaaactttag

SEQ ID NO: 40386 - DNA, 795 bp, Artificial Sequence
  Description of Artificial Sequence: Synthetic coding sequence
atggtgttcacccaggcccccgccgagatcatgggccacctgcggattcggtcattgctggccaggcagtgtctggctgagtttctcggcgtctttgtgcttatgctcttaacacagggggcagtggcgcaggctgtcacatccggagagactaagggcaattttttcacaatgttcctggcagggtccttggccgtgactattgccatctatgttggcggcaatgtgtcaggcgcccaccttaacccagctttttccctggcaatgtgcattgtggggcgtcttccttgggtcaagttacccatttacatcttggtccagttgctctctgccttttgtgcttctggggcaacctatgtcctgtaccatgatgcccttcaaaactacacaggtggcaatttgaccgtcacagggcctaaagagacagcttccattttcgctacatatcctgctccatacctgtccctcaataacggttttctggaccaggtactgggaaccggtatgctaatcgtgggcctactagcaatccttgaccgtcgcaacaagggagtccccgcgggactcgaacctgtcgtcgtggggatgctaatcttggcgctcggactatcgatgggagccaattgcggaatcccactcaatcctgctagagatcttggcccccgactgttcacctatgtggcaggatgggggcctgaggtgtttaggtgggaaactgatagccctggcgccgggctccattctccttcatcggccaaagggagtgtaccgggatctaccgctctttgcctatag

SEQ ID NO: 40387 - DNA, 1125 bp, Artificial Sequence
  Description of Artificial Sequence: Synthetic coding sequence
atggccaaggagcggcggcgggccgtgctggagctgctgcagcggccaggaaacgccaggtgtgcggattgtggggcccccgaccctgactgggcatcctacacgttaggagtctttatttgcctctcttgctcgggtattcaccgtaacatcccccaggtgtctaaggtgaagtctgtcagactggacgcctgggaggaggcccaggtggagttcatggcgtctcatggcaatgacgccgcccgggcgcgcttcgagtcaaaggtgcctagcttctattacagaccgaccccgtctgactgtcagttgctgagagagcagtggatccgcgccaagtatgaacgccaggagtttatctatccagagaagcaagaaccatactccgccggctacagggaagggttcctgtggaaaaggggacgagataacgggcagtttttgagtcggaaattcgtgttgaccgaacgggagggagcccttaagtacttcaaccggaatgacgccaaagaacctaaggcagttatgaagattgaacatctgaatgccaccttccagcccgccaagattggccatccccatggcctgcaggtgacctacctgaaggacaatagcacgcggaatatcttcatctaccacgaggatggcaaagaaatcgtcgactggttcaatgcacttcgtgcggctcggtttcattacctccaggtggcatttccaggggccggggatgctgatctggtgccaaaactgagtagaaactacctgaaggaagggtatatggaaaaaactggtccaaaacagaccgaaggtttcaggaaacgctggtttacaatggatgatagaagactcatgtactttaaggatccgctggatgcctttgcaagaggcgaagtgtttattggaagcaaggagtccggctatactgtcctgcatgggtttcctccctccacccagggtcatcactggccacacggcattactatcgtgaccccagatcgtaagttcttatttgcttgcgaaacagagtccgaccagagagagtgggtcgcagcattccagaaggcagtggatcgtcccatgttgcctcaggaatacgcagtggaggcgcactttaaacacaagccctag

SEQ ID NO: 40388 - DNA, 909 bp, Artificial Sequence
  Description of Artificial Sequence: Synthetic coding sequence
atggccagccacggcaacgacgccgcccgggcccggttcgagagcaaggtcccaagcttttactacaggcccacacccagtgattgtcaacttttgcgggaacagtggattagagcgaagtacgagcgccaggagttcatctacccggagaagcaggagccgtattctgccggttaccgggaaggctttctctggaaaagaggcagggacaacgggcaattcctgagtaggaagtttgtcctgaccgagcgggagggcgcgctcaaatactttaataggaatgatgccaaggaaccaaaagcggtgatgaaaattgagcacctgaacgctaccttccagcctgccaaaatcggccatcctcatggcctgcaggttacctatctgaaagataactcaaccagaaatatatttatttatcatgaagatggcaaagagattgtggactggtttaacgcattaagagccgcccgttttcactacctgcaggtcgctttccccggcgcaggcgatgccgatctggtccctaaactctcccggaactatctcaaggaggggtatatggagaagaccggacccaagcagacagaggggtttagaaaaaggtggtttaccatggacgatcgcagactcatgtacttcaaggaccctctggatgcctttgcaagaggggaagtcttcattggctccaaggagtcaggatatactgtgttgcacgggttcccaccttccactcagggacatcattggccacatggcataacaatcgtcactccggacagaaaattcttatttgcgtgcgagacagagtctgatcagcgggaatgggtcgccgcctttcaaaaggccgtagatagacctatgctgcctcaagagtacgccgtcgaggcccactttaagcacaaaccatag

SEQ ID NO: 40389 - DNA, 603 bp, Artificial Sequence
  Description of Artificial Sequence: Synthetic coding sequence
atgaagatcgagcacctgaacgccaccttccagcccgccaagatcggccacccgcacggcttgcaggtcacatacctcaaggataactctactcgcaatatatttatttaccacgaggacggtaaggagattgtggactggtttaacgcactgagggcagcgaggtttcattatcttcaggtcgcgttccctggcgctggggacgccgatctggttccaaagctgtccagaaattaccttaaggagggatacatggagaaaaccggacccaaacagacagagggatttaggaaacggtggttcacaatggacgaccgccgattgatgtacttcaaggatcccttggacgccttcgctcgaggagaggtgttcataggtagcaaggagtcaggttatacagtccttcacggtttcccgccatctacgcaagggcatcattggccacatggaatcacaattgtgacccctgatagaaagtttctatttgcctgcgaaacagagtctgatcagcgtgagtgggtagcggcatttcaaaaagcagtggataggcctatgcttccacaggagtacgccgtcgaagcacattttaagcataaaccatag

SEQ ID NO: 40390 - DNA, 783 bp, Artificial Sequence
  Description of Artificial Sequence: Synthetic coding sequence
atggtgctggccagcctggagctgctgcgggagcagtggatccgggcaaagtacgaacgacaggaattcatctatcccgagaagcaagaaccctattcggcaggttatcgggaaggcttcctatggaagagaggaagggataacggccagtttctgagccggaagtttgtcttgaccgagagagagggggccctgaaatactttaatcgaaacgatgccaagatcggacatccccatggactccaggtcacctacctaaaagacaattccactagaaacattttcatttatcacgaagacggtaaagagatcgtcgactggttcaacgccttgcgcgcggctagattccattacctccaggtggcattccccggcgcaggggatgctgatcttgtcccgaaactctcccgtaactaccttaaggagggctatatggagaagacgggccctaaacagacggaaggatttcggaagcggtggtttaccatggatgatagaaggctgatgtattttaaggaccccctggatgcgtttgcccgaggagaagttttcatcgggagcaaggaaagcggctatacagtattgcacggcttccccccatcaacacagggacaccactggccccacggcattactatcgtgacccccgacaggaaatttctcttcgcctgcgagaccgaatctgatcagagagaatgggtagccgcatttcagaaggccgtggataggccaatgctcccccaggaatatgcggtcgaagcacatttcaagcataagccttag

SEQ ID NO: 40391 - DNA, 1158 bp, Artificial Sequence
  Description of Artificial Sequence: Synthetic coding sequence
atgttccagttcgtgttcagccgggtgtactgcatcaaccccgccaggagaaaatggaaggagtttgaaaagatgcttgggtgtgccgaagagggccatgcttccctgggcagagatcccgactgggcgagttacactctgggcgtcttcatctgcctcagctgttcagggatacatagaaacataccccaggtgagtaaggttaaatctgtgcggttagacgcctgggaggaggcccaagtggagtttatggccagccacggcaatgatgcggcacgcgcacgcttcgagtccaaagtccccagtttttactacagaccaacaccctcggactgtcagctgctgcgcgagcaatggatccgggccaaatacgagcgccaggagttcatctatccagaaaaacaagagccttacagcgctggctacagggagggattcctgtggaaacggggccgagacaatggtcaattcctctctcgcaagttcgtcttgactgagagggaaggtgcactaaagtatttcaaccggaatgacgccaaagagccgaaggcggtgatgaagatcgagcatctcaacgctacctttcagcctgccaaaatcggacaccctcatggtcttcaggttacctatctgaaggacaattccactaggaacatcttcatctaccacgaagacggcaaggaaattgtggactggttcaacgctttgcgggctgcaagattccactatctgcaagtggctttcccgggggctggagatgccgatctggtcccgaagctgagccggaactatttaaaggaggggtacatggagaagacagggccgaaacagaccgagggatttaggaagaggtggttcaccatggacgacaggcgccttatgtactttaaggatccactagacgcatttgcccgaggagaggttttcatcgggtcgaaggaatcaggctataccgtgttacacggattccctccctctacacagggtcaccattggccacacggaattaccatagtgacgccggacagaaaattcctcttcgcatgcgagacggaaagcgaccagagggagtgggtggcagcttttcagaaggcagtagatcgtccgatgctcccccaggaatatgccgttgaagcccacttcaagcataagccatag

SEQ ID NO: 40392 - DNA, 1146 bp, Artificial Sequence
  Description of Artificial Sequence: Synthetic coding sequence
atgggcgaccgggagcggaacaagaagcggctgctggagctgctgagggccccagataccgggaatgcccattgcgctgattgtggagcagcggaccctgattgggccagctacaagcttggaatattcatttgtctgaactgctgtggagtgcatcggaattttcccgacatcagcagagtaaaatctgttcgtctggacttctgggacgatagcattgtggagttcatgattcacaacggaaatcttcgcgtcaaagccaagttcgaggctcgtgtgcccgcgttttactacatcccccaggccaacgattgcctggtattgaaagagcagtggataagagctaagtacgaacgtcgagagttcatggccgacggggagactatctccctcccagggaatcgcgaagggtttctgtggaaacggggacgggacaacagtcaatttctcaggcgtaagttcgtgcttctggcacgcgagggtctgctcaagtacttcactaaagaacagggaaaaagtccaaaggccgtaatctctattaaagacctcaatgccacatttcaaaccgagaagatcgggcatcctcatggcttacagatcacatatcgacgcgatgggcacacaagaaatttgtttgtgtaccacgagagcgggaaagaaatcgtggattggttcaatgccttgcgagctgcgcgactgcaatacctgaaaatggcttttccagagctcccggagtccgaactggtcccatttctgacccggaactacctaaaacaaggattcatggagaagaccgggccgaagcaaaaagagcctttcaagaaaagatggttcgcgctcgattgccatgagcggcgcctgctctattacaaaaatccactggacgccttcgaacagggacaagtgttcctcgggaacaaggagcagggatatgaggcttacgaggatttgcctaagggtatccgaggcaaccggtggaaggccgggctgaccatcgtgacccctgagcggaggtttgtcttgacatgcccatctgaaaaggaacaacaggaatggttggagagtttaagaggtgtgttgtcttctcctctcacccccctaaacagactgactgctagcactgagtctggcaggagctcaagatag

SEQ ID NO: 40393 - DNA, 3021 bp, Artificial Sequence
  Description of Artificial Sequence: Synthetic coding sequence
atgcccgaccagatcagcgtgagcgagttcgtggccgagacccacgaggactataaggcgccaacagctagtagcttcacaacccgtaccgcccagtgcaggaatactgtggctgccattgaggaggcccttgacgtcgaccggatggtgctttataagatgaaaaaatctgtgaaagccattaacagtagcggtctggctcacgtggagaacgaggagcagtatacgcaggcgttggagaagtttgggggtaactgtgtttgtcgggacgacccagatctgggcagtgcatttttgaaattttcagtgttcaccaaggagctcactgctctgtttaaaaatctgattcagaatatgaacaacatcatctcattcccactcgacagcttgctgaagggtgacctcaagggtgtaaagggcgatcttaagaaaccttttgacaaggcttggaaggattacgagacgaagattacaaaaattgaaaaagaaaagaaggagcatgcaaagctacatggtatgatccgaaccgagattagcggcgccgagatcgctgaggagatggagaaggagcggcggttctttcagctgcagatgtgtgagtacctgcttaaagttaatgagataaagatcaagaaaggggtcgatcttctccaaaacttaattaagtattttcatgcacagtgtaactttttccaggacgggttgaaggcagtggaaagcttgaagcccagcatagagacgctctctactgacctgcacacaatcaaacaagcccaagatgaggagagaagacagctgattcaacttcgtgatatcctcaaaagtgccttacaagtggaacagaaagaagattcacagattaggcaatcaaccgcttactcgctgcaccagccacagggcaacaaagaacatggcactgagcgcaacggctccctgtacaagaaaagcgacggcatccgtaaagtctggcagaagaggaagtgtagcgtaaagaacggcttcttgactatctcccatggaaccgccaatcgcccaccagccaagctgaacctgcttacatgtcaggttaaaacgaacccagaagagaaaaaatgctttgacctgatctcccacgatagaacttaccacttccaggccgaggacgagcaggaatgtcagatctggatgtctgttctacaaaattcaaaggaggaggcacttaacaatgcctttaaaggcgacgataacacaggagagaataacatcgtacaggaattaaccaaagagattatctcagaggtgcagaggatgactggcaacgatgtttgttgcgattgcggagctccggatccgacctggttgagtaccaatctgggcatcctgacatgcatcgagtgcagtggtattcatagagaacttggtgtccattactcacgtatgcaatccctcacccttgacgttctgggcacctctgagcttcttctggcgaagaacatcggaaacgccggatttaacgaaatcatggagtgttgtttacccgcggaggattctgtcaagcccaatcctgggtctgatatgaacgctcgcaaggactatattacagccaagtacatcgaaagaaggtatgcaagaaagaagcacgcagacaacgccgctaagttgcactccctttgcgaggcggtgaagactagagatatcttcggcctactccaggcctacgcagatggcgtcgacctcacagagaaaattcccctagccaatggacacgaaccagatgagactgctctacaccttgccgtaagatccgtggatcgcaccagcctgcatatcgtagatttccttgtgcagaatagcgggaaccttgacaaacaaacaggcaagggctctacagctctgcactactgttgccttacggataatgccgagtgcctcaagcttctgctccggggtaaagctagcattgagatcgcaaacgaatcaggcgaaacccctctcgacattgctaagaggctgaagcacgagcactgtgaagagctgctgacacaggctctgtctggacgattcaatagccacgtgcatgtcgaatatgaatggaggctgctccacgaagatcttgatgaaagtgatgacgatatggatgagaagttgcagccaagccctaaccggagggaggatcgacctatatccttctatcagctgggcagcaatcaattacagagtaatgccgtttctctagcccgggatgctgccaatctcgccaaggaaaagcagagagcattcatgccgtctatcctccagaacgagacatatggggcgctcctgtcggggtctcctccccctgcccagcctgctgcgcccagcaccacatccgcgcccccgctccctcctaggaatgtcgggaaggtgcagaccgcttccagtgccaacactctatggaaaactaacagcgtttccgtcgatggcggatcaagacagaggtcctcaagtgaccctcccgccgtccaccccccacttccaccacttcgagttactagcacgaaccctttaacccccaccccccctcctcctgtggccaagacccctagcgtcatggaggcactgtctcagccctccaagcctgcgccacctggcatttctcaaatacgtccaccacccttaccaccgcagccaccatcaagactgccgcaaaaaaagccagccccaggggctgacaagagcactccactcaccaacaaaggccagcccaggggcccggtggacctctccgcaacagaggccctgggccccctcagcaacgctatggtgctgcaacctccagccccaatgcctaggaaaagccaggcaaccaagctgaagccaaaaagagtgaaagctttgtataactgtgtagcggataaccccgacgagttaacattttccgagggagacgtgattattgttgacggggaggaggaccaggaatggtggatcgggcacatagatggagatcctggtcggaagggagcctttcctgtgtctttcgtacactttattgcagactag

SEQ ID NO: 40394 - DNA, 2886 bp, Artificial Sequence
  Description of Artificial Sequence: Synthetic coding sequence
atgcccgaccagatcagcgtgagcgagttcgtggccgagacccacgaagattacaaggccccaaccgctagttcctttacgacccggactgcccaatgtcgtaacacggtagctgctattgaagaggcactcgacgtggacagaatggttttgtataaaatgaagaagagcgtgaaagccataaattccagtggtctggcccatgtggagaacgaggagcagtacactcaggctcttgaaaaattcggggggaactgtgtgtgtcgcgacgatccagacctcggatcagcctttcttaagttctccgtgtttacaaaggagctaaccgccttatttaagaatttgatccaaaacatgaataatatcatttcgtttcctctcgactctcttctgaagggtgatctaaagggagtgaaaggcgacctgaaaaaaccctttgataaagcctggaaggattacgaaacaaagatcactaagattgaaaaggagaagaaagaacacgctaagctacatgggatgattcggacagagatttccggcgctgaaatcgcagaggagatggagaaagagcgtcggttttttcagctgcagatgtgtgagtacctgctaaaggtgaatgagattaagatcaagaagggagtcgacctgttgcaaaatctgattaaatactttcacgcgcaatgtaatttctttcaggatggcctgaaggctgtggaaagtctcaaaccttcgatcgagacactttccaccgatctgcataccatcaagcaagcacaggacgaagaacggagacaattgatacagctgagagacatcttgaagagcgcccttcaggtggagcagaaggaagattcacaaatccgccaatcaactgcttatagtctgcatcagcctcaaggaaataaagaacacgggactgagagaaacggctctctctataagaaatctgacgggatcagaaaggtgtggcagaaacgaaaatgtagtgttaagaatggttttctgacgattagccatggcacagccaatcgcccccccgctaaactgaatctcctgacatgccaagttaaaaccaatccagaggagaaaaagtgtttcgacctcatttctcacgaccggacataccactttcaggcggaggatgaacaggagtgccagatttggatgtcagtgttgcaaaatagcaaggaggaggccctgaacaatgccttcaagggcgacgacaatacaggcgaaaacaacattgtgcaagagctgacaaaggaaatcatcagcgaggttcagagaatgacaggcaatgatgtctgctgcgattgtggtgctcccgatcccacctggctatcaaccaacctgggaatcttaacttgcatagaatgtagcggaatccacagagaattaggtgtgcactacagcagaatgcagtcactgactctggacgtcttaggcacgtccgagttgctcctggccaagaacatcggtaacgctggtttcaatgagataatggaatgctgcttacccgccgaggatagtgtcaagcctaaccctggctccgatatgaacgctaggaaagattacattaccgcaaagtatatcgaaagacgctatgcacggaaaaagcacgccgacaacgccgctaagctgcactctctgtgtgaggctgtcaagactagagatatcttcggtctcctgcaggcctacgccgatggcgtggatctcacagagaagattccattggccaacggccatgagcccgacgaaacagctctccatctggcagtgcggtccgtggaccggacatctctccacatcgtggacttcttggtccagaacagcggcaacctcgataaacaaacgggaaagggatctactgcacttcactattgctgcctgaccgataatgcagagtgtcttaagctattactgcgcggcaaagcctctattgagattgccaacgaaagcggcgaaacgcctcttgacattgctaaaaggttgaagcatgagcactgcgaggaactgctgacacaggcactatctgggcgtttcaatagccacgtgcacgtagagtacgagtggcggttgctccacgaggacctggacgaatctgacgacgatatggacgagaaattgcagccctcgccaaataggagagaggatagacctatttccttctaccaactgggaagtaatcagctccagagcaacgccgtgtcacttgcgcgagacgcggccaatctggccaaggaaaaacagcgcgccttcatgcccagcatcttgcaaaacgaaacctatggtgctctgctaagtgggtcccctcctcccgcccagccagcggctccttccaccactagtgcgccccccctccctccacgaaacgtcggtaaggacccactgactccgactccacctcctccagttgcaaaaaccccgtccgtgatggaggcattatcccagcccagtaagccagcacccccaggcatttctcaaatcagacctcctcctcttccaccgcagccgccctcccgcttaccgcagaaaaagcctgcgcccggcgcggacaagtccacccccttgacaaataagggtcagcccagaggcccagtcgatctcagcgctaccgaagcattgggccctctgtccaacgcgatggtccttcaaccgcccgctcccatgccaagaaagtcccaagctactaagcttaagcccaagcgcgtcaaggccttatacaactgtgtggccgataatccagacgagctgaccttttcagagggagacgtaataattgttgacggggaggaggatcaagagtggtggatcggacacatcgacggggaccctggcagaaagggagcttttccagtctcctttgtgcactttatagcggattag

SEQ ID NO: 40395 - DNA, 849 bp, Artificial Sequence
  Description of Artificial Sequence: Synthetic coding sequence
atgaacagcagcaccagcaccatgagcgaggagcccgacgccctgtctgtcgtaaatcaattacgtgacctggcagctgatccacttaaccggagggctatcgttcaggaccagggatgtctgccagggctgatcttgtttatggaccaccctaaccctcccgtggtgcacagcgcactgctggctttaaggtatctcgcagagtgtagagctaacagagagaaaatgaagggtgagctcgggatgatgctttctctccagaacgtgatccaaaagactacgactcctggagaaactaaattgctcgcttccgaaatctatgatattctccagtctagtaatatggccgacggagattctttcaacgaaatgaactccaggcggcggaaagctcagtttttcttaggaacaaccaacaaaagagcaaagaccgtggtgctgcatattgatggactggacgatacgtctcgtagaaacctgtgtgaggaagcactgttgaagattaagggagtcatatccttcacttttcagatggcagtgcaacgctgtgtggtgcgaatacgctccgaccttaaagccgaagctttggccagcgccattgcgagcaccaaggtgatgaaagcccagcaggtcgttaagagtgaatctggggaggagatgttagtcccatttcaggacactcctgtcgaagtcgagcaaaacacagaacttcccgactatttgcctgaagacgaaagccccacaaaagagcaggacaaggctgtctctagagtaggcagccatccggaggggggtgcttcatggctttcaactgcggcaaacttcttgtcgcggtcattttattggtag

SEQ ID NO: 40396 - DNA, 543 bp, Artificial Sequence
  Description of Artificial Sequence: Synthetic coding sequence
atgagcgcctggccctacttcatctacggccccagccagcccagctcccgtcccttgcgtttcgcctgttcatcaattcttggtaggatgccctgcaagcagagaaaggacgagagacgtacagggtatgatgtcgagttaacgaagtgttataccgaatccagaaggaatctgtgtgaagaggcccttctcaagataaaaggggtgatcagtttcacctttcagatggcagtgcagcgatgtgtggtgaggattcgctccgatctgaaggccgaagccttagcaagcgccattgcaagtactaaggtcatgaaagcacagcaagtcgtcaaaagcgagtctggagaagaaatgcttgtaccttttcaggatactcccgtcgaggtcgagcagaataccgagctccctgactatctgcccgaggacgagagtccaacaaaagagcaggataaagccgtgagccgtgtggggtcccacccagagggcggcgcgtcttggctcagcaccgctgccaacttcctgagcagatccttttactggtag

SEQ ID NO: 40397 - DNA, 6873 bp, Artificial Sequence
  Description of Artificial Sequence: Synthetic coding sequence
atgggccggatccaggaggtgggctgggtgaccgccggcctggtgatctgggctggaacgtgttattatatttataagtttacaaaaggtcgcgcgcaaagtgtaagaactctcgcacggaacggttccacggtaaagatggagaccgtggtaggggtacagtcccagactttagcaatcaatgaggccgagatcaagactaaaccccaggtcgagataggcgccgaaaccggtgcaagaagcggccctcgcgctgaagttgagactaaggccacagctatagcaatacatagggcaaattcacaggccaaagccatggttggagcagaacctgaaactcagtctgaatcaaaggtggtggcgggcacgttggtgatgaccgaagccgtgacattaaccgaagtcaaggcaaaggcccgcgaggttgctatgaaagaggcagtgacccagaccgatgctgaagccggaaagatcgtcaagaaggaagccgttacccaaacaaaagccaaggcttgggctctggtggctaaaacagaggcaaagcgggaggcaatgacacaaactaaggccgagacccacatcctggccgagaaggagacagagatcaatagagttatggtcacgcagtcagaaacacttgctgtcccaagggaggttgcaaagatgggagccactaacaagaccggcatcgtcgacgaaacaaaaactagggccttggaagaaaccgtctccgtggctaagacacaaagtgaggcaaggcctggggctaccgtggatgctaggggcaacccaaacgggatgtcacgagaggttgccggagttgacatgaagtcttgtgctcagtcacaggctgtgacaaagatccagggagacgatatgcctggaacaggagtggaagatatgggtaactgcaagaccatgtctagagctgaaagtggcgccgatactcgggcctctgcccagccccagatttttgctaagacacagaccgaggcaatacctggggcaaagatcgatgcgggcggcaacacaaatgcgatgtgcaaggtaggggcaggcgccgatgtgagggcatgtatccagcctcagaccgttgccaaaaagcaagccgaggtgacctccggggccagagtggacggcagaggaaacacgaacgtgatatctaaagccattacgggagccgacatgcgggccgcggctcagccccaagcggtcgcatctactcacgcagaagccatgtcagacgccaaggtgaagaatcggggcaatcccaatgctatgaccaaagccggtgcaaaggccaatcttcgggcgaactcacaggtggaggccctcccggacgcacgggacaaaagccgcgggaatcccaatgtgatggcaaaagtcggtgatggtaccgatatgctttcttgcactcagccccagctggtcgcctctgttcaggcagataccctgtctgatggaaagatcaaggtcaggggtaatgttaacaccatgcccaaggaaggggcaggcgtcgacatgaaggcccaaggcatggcacaaagtcaaggggaagcgctccccaatacgaggggcaaggcccgaggcaaagccaaggcaaagtgcaagactggccccggaatggatatgaaaacatgcactcagccccaggccggcgtcaaaacacctgctgaggccttgctcgacagtcgcgtcgatggccggggtaatcctaatgctacgtccaaggcggggacaaaagctgaccagagagtctgcggacagcctcttgtagtggccaatccccaaggcgaagcactgccaggagccaagaacaaagtcaagggaaacccccatacagtattgaaagtgggcgccggggaaggcaccaccgactcggcacagcccgaagctgtggtgagcttccagggagaagcactgctcgggacaaaaaataaagtcaaaggaaaccctaatgtggttctcaaggcagaagtgggagaaggagcaatgggcaccgctcaactgcagatcatggcgtcttctaagggcgaagccctgctggactcaaagaataaggtgaagggcaactctaatgctgtgtctaaggcaggagcaggcacagataccacaggctcggtccagcctcagattgtggcgaattcccagggtgaggtgctccctggtgcaaagaataagatccgcgggaatcccaccaccgtgcccaatagtggagtagggccctatacaacagacagcgcccggcttcaggcagtcgccaacagccagggagaggtccttccaggtgccaagaataaagttaaggccaacctcaacgctgtttccaaagcagaggccggcatgggcgcaaccggctccgtgcagccacaggccgtggccaattctcattgcgagactcttcccggcgcaaagaataaggtccggggcaactggaatgccgtctcgaaggcaggggcaggcatggatactagaggatccgcacagcctcaggcagtggctaattcacagggcgaggtcctcccaggcgctaagaacaaagtgaagggcaatcctaacgtggtgtctaaggcaggagcccgggaggatactgttgggtcgacccagccgcaggtcctggcctcttcccagcgggaaactctgccaggggcacgcaataaggttaaaggcaattctaatgtggtttccaaagccggcgcccgggaggatacgatgggatctgcacagcctcaagtggttgccaatagccagagggagacactgcctggcgctagaaataaagtgaaagggaactcaaatgccatctccaaagctgaggctggcgccggcataatggggtcagtgcaggtgcaggtcgtcgcatcttttcagggcgaagttctcccgggggccaaaaataaagtcagaggcaatagcaacgcagttccgaaggctgaagccggggctgatactgtgggatcagcgcagcctcaggctgtcgccaatagccagtcagagaccctgctgggggctcggaacaaggtcaaaggcaatacaatcgctgttcccaaggcaggaactggcgccggaacccgccactccgcccagccccaaattgttgccgggagtcagggcgagactcttccaggcgccagggataagtctatgtcgacctcggaagccgaggccactgcagaggatgaagcgtacgcaaaaccggaagccgaagccatgcccacttccgagtctgaaggggggtccgggacgcaggcctgtcgaaagacccagcctaacatacacgactactactggaatggaataggcgtggaagattggattgccgctgagaggtggatcaagttcagatttcagacaatggatggcgattgggaaaatagtgtgtcttgggcagatgacgagaatgaggcctctatagggagctggtcaggggcctctgataaggctggtatcatccgatcttgggcagtggcatgtgacgaaacatcagtcaagtcatgggcgggagctagagcggaaaatgtggtggggatcggtacttgggcacgcgcaggcgagcaggcaagcggcggactgtgggctgggggacagaccagcgagggaacttgggccggagacaaggctagcggcggtgcctggacaggggccgaaaatcaggctagtgggggctcttgggcgctggccggaaaccaggcaattggcgagctttgggctgccggccaggcctctgatggttcttggccaggaggccaagcttctggggtaagctgggtgggcgaagaggcgataggaggcagctggacaggcgcagagaatcaagctagcgaagggtcctgggctggagctggggcgggtaacatgagttccgtctcttattgggcgggggttgtggatcaggcaggaggcggaagctgggccggaaccagcgaccaatcaggcggaggctccaaaccgaggtttgaggaccaggcctctggagaagggagctgggcaggagctggcggacaggccagcgggggttccatgctgggacctgaggaccagtcttcaggtagatcttgggccgataccgccgatcaggcctccggaggatccagactcggccatgtcgatcagtcgagcggcggagcatgggccgggaccttggaccagtccgggggaggatctaaaccacggtttgagaaccagaccactgaggagggaagctgggccggagcaggcggccaagccggaggaggttctaaagtggggcccgaagatcaatcctctggccgaagttgggccaattccggggaccagatctcaggcgggttcctggtgggtatagtagaccaggctaatggtggctcctggaccggagccggacatcccgcttccgtgggaccaaaaccaatatttgaagatcaggtgtcagggcgggggtcatgggccgacgctcgtgagcaggtggtgggagattctagattagggttgagggatcagtcctctggggatagctgggctgatacaggcgaccaagcctcaggatggttttgcgtttgtcccgggtcccagaccaatggcggatcctgggggggcgcctctggccaggacgtgggcggcagcaggcccggtccaaccaatcagagtagcgctggttcctgggatagccctggcagtcaggtgagcggctcttgctggactggcgccggggccgtggaccaggcgggcggctgcagcaagcctggattcgaggaccaagctatcggcggaggcttttggcctggcgcaggcgatcaaacgggaggtggcagcaggccgggcagcgaggatcagtcttccggaatcgggtcatggggagtggccggcggccaggtgctcggcggggcccggccaggtcctgcagaccaatcatccggagggtcttgggctggcaccggcaatcagtctagcgggcgcagctggatcgggcccggagaccaagccgtggactgttctaaacccgagtttgaggaccaggcctgtgggggggggtcttgggccggcgccgggtcccaggccagcggcgaaagctgggccggaagtcggccaggaaacgaggctattggaggctctaggatggggagtgaggatcaggcgacggggggatcatgggcccggtcggaagatcaggctagcggccgctttcaagtgtctttcgaagtggaagctaacgagggattttggtttgggcctggtgcagaggcagtcatcggttcatggtgctggactgaggagaaggccgacatcgtatctaggccagacgacaaggatgaagctactacagcttcgagatccggggctggtgaagaagccatgatctgctccagaatcgaagcagagaacaaggcgtcctccggttcttggattaggtccgaagaggttgcatacatgggatcatgcgtgggcgcagaagccggggccggggcggaggcgggggcaggagcggaggccggagcaggggccggggctgaggccggcgcagaggctggtgcaggggctggcgccggcccgggcaccgagagtggagcgggcatttggagctgggacggcgatgccactacggtggagtcccggctgggtgccggggaggaggcgggagtggaatcatggactcttgctagaaatgtcggcgaagacgaattaagtagagagtccagtccagatattgaggagatctcattgagaagcctcttttgggcggagtccgaaaactctaacacctttaggtcaaagagcgggaaggatgcttctttcgagtccggggcaggggacaacacttcgatcaaagacaagtttgaggcagctggcggcgtggacatcgggagttggttctgcgccggaaatgaaaatacgagcgaagacaaaagcgcaccaaaagctaaggctaaaaagtccagtgagtcccgaggcatctacccgtacatggtgccaggggccgggatgggcagctgggacggagccatgatctggagcgaaacgaaattcgcccaccaatcagaggcttcgttcccagtagaagacgaatctcgaaaacagactagaaccggcgaaaaaactagaccgtggagctgccggtgtaagcacgaggccaacatggaccctagggatcttgaaaagttgatttgcatgattgagatgacagaagatccttctgtgcatgagattgcaaataatgcactgtataatagcgcggactacagttactctcacgaggtggtgcggaacgttggcggcatctcagtcatcgagtcactcctgaacaacccttacccctcggtccgccagaaagccttgaacgctctgaataatatctcagttgctgccgagaatcaccgcaaggttaaaacgtatctgaaccaggtatgcgaagatacagtgacctaccccctgaactcaaatgtccaacttgccggactgcgtctcatccgccacctgaccattactagcgaataccagcacatggtcacaaactatatctctgaatttctccgtctcctaactgtggggtcgggagagacgaaggatcatgtgctgggcatgttgttaaacttctccaagaatccatccatgactaaagacctccttatcgcgaatgctcccacgtcactcatcaatatcttcagcaaaaaggagacgaaggagaacattctcaacgctctgtccctattcgaaaatataaattaccatttcaaacgccgggccaaggcctttactcaggacaagttcagcaagaactctctgtactttcttttccagagacccaaagcctgcgccaaaaaattaagagcactcgccgccgagtgtaacgacccagaagtgaaggagcgcgttgagctgcttatcagcaagctctag

SEQ ID NO: 40398 - DNA, 1083 bp, Artificial Sequence
  Description of Artificial Sequence: Synthetic coding sequence
atgagcgccgccggcctgaagatcaccggcagcaaggagaccaagaggagacttttgctaatttctattgactggtctagagatctaatgaacctctgtatttacttccgcgtgtattgtcaggaaaaacaagaagaaagaagggaactgccacgtataatcaccgggcctccacctgaagccgccgtcgttgcctttgagtggctgaaaaccagtaccctcaccggcctgcacccccagctgccactgagccttcctcaacccgagtgtgctttgccctatctcgttcgggcattttctagaggggactatatgggacggattcaggaggtcggatgggtgaccgctgggctcgtcatttgggctggtacatgttattatatatataaatttaccaagggccgggcccaatccgtgcggacccttgctcgtaacgggtccaccgtgaagatggaaaccgtcgtcggagtacagagccagaccctggctatcaacgaagccgaaattaagacaaagccacaggtggagattggcgccgagaccggggcccggtcagggccccgggccgaggtcgaaacgaaggccactgcaattgccattcatcgagctaatagtcaagccaaggccatggtgggagcagagcctgaaacacaaagcgagagcaaagtggtcgccggtactttagtgatgactgaggccgtgactctcaccgaggtgaaagctaaggctagagaagttgctatgaaggaggcggtcacccagactgacgccgaggccggaaaaatcgtgaagaaggaggccgttacccagacaaaagcgaaggcgtgggctcttgttgctaaaaccgaggccaaaagagaggcaatgacacaaacaaaggctgaaacacatattcttgccgagaaagagacagaaattaatagagtcatggtgacacagtcagaaaccttagctgttcctagggaggtggctaagatgggagccactaacaagacgggcatcgtagacgaaaccaagacacgggcgctcgaggagacagtgctgatccccagggcctttccatctaagaacgcctcatgctag

SEQ ID NO: 40399 - DNA, 1083 bp, Artificial Sequence
  Description of Artificial Sequence: Synthetic coding sequence
atgagcgccgccggcctgaagatcaccggcagcaaggagaccaagaggcggcttctcctgatctctattgactggagtcgggatttgatgaatctgtgcatttacttcagagtctattgtcaggagaaacaagaggagcgtcgggaactgcctaggatcatcacaggcccccctccagaagcggccgttgtggccttcgagtggttaaaaacttccacactcaccggactccaccctcagctcccattgtcactgccacaacctgaatgcgccctgccctacctagtcagagcattttcccgtggggactacatggggagaatccaggaagtggggtgggtgactgccggactggttatttgggctgggacatgctattacatttataaattcaccaagggtagggcacagtctgtgcggaccctggctcggaatgggtcgactgttaagatggaaacagtcgtcggagttcagtcacaaaccctggcgatcaacgaggcggaaattaagaccaagccccaggtagaaatcggcgcggagacaggagcgcggagcggtcctagggcagaggttgagaccaaagctacagccattgcaattcatcgcgcaaactcacaagctaaagccatggtgggggccgaacccgaaactcagagtgaatcaaaggttgtggcaggcacactggttatgacagaggccgtcaccttaacagaagttaaggcaaaggctagagaagtagcaatgaaggaggcagtgactcagacagacgctgaggcagggaagatcgtcaaaaaggaagccgtgacacagacaaaggctaaagcctgggcactcgtcgcaaagactgaggctaaaagagaggccatgacccagactaaagccgagacccacatcttggccgagaaggaaactgagatcaatcgcgtaatggtgacccaatccgaaaccctagccgtgcctcgcgaagttgctaaaatgggagccaccaataaaaccggaatcgtggacgagacgaagacccgggctctcgaagaaaccgtgctcattcctcgcgcgttcccatctaagaacgccagttgttag

SEQ ID NO: 40400 - DNA, 903 bp, Artificial Sequence
  Description of Artificial Sequence: Synthetic coding sequence
atgggccgggcccgggaggtgggctggatggccgccggcctgatgataggtgctggcgcgtgctactgcgtatacaagctcacgataggccgcgacgatagcgagaagctggaggaggaaggagaagaagaatgggacgatgatcaggagttggatgaggaagaacccgacatctggttcgacttcgagactatggcacggccctggactgaggacggcgattggactgagcccggggcaccaggaggtaccgaagataggccctctggtggtggtaaagccaacagagcacaccccataaagcaaagaccattcccgtacgaacacaaaaacacatggagcgcccagaattgcaaaaatggaagctgtgtgttggatcttagtaagtgtctctttatacagggaaaactactcttcgccgaacctaaggacgcggggttccctttttcccaagatataaattctcacctagccagcctatccatggctcgtaatacaagtcccacacctgatcccacagtaagagaggccctttgtgctcccgataatcttaatgccagcattgaatcgcaaggccaaatcaaaatgtatatcaacgaggtgtgtagagagactgttagcaggtgttgtaacagctttttacaacaagctgggctgaatttactaatctcaatgaccgtgatcaacaatatgctagcaaaatcagcttcggacctgaaattcccccttatttcagagggctctggttgcgccaaggtgcaagttttgaagccgttaatgggcctgagcgagaagccagtgctggcgggggagctggtgggagctcagatgctcttttcctttatgtcacttttcattcgcaacgggaatcgcgaaatccttctggagacacctgcgccatag

SEQ ID NO: 40401 - DNA, 903 bp, Artificial Sequence
  Description of Artificial Sequence: Synthetic coding sequence
atgggccgggcccgggaggtgggctggatggccgccggcctgatgatcggagccggggcatgttattgtgtatataaactgacgataggaagagatgactctgagaaacttgaagaagagggcgaggaagagtgggatgacgaccaagaacttgacgaggaggaaccagatatctggttcgattttgaaactatggcaaggccttggaccgaggatggggattggacggaaccgggagcacctgggggtaccgaggatagacccagcggagggggaaaggcaaatcgggctcaccccataaagcagcggccatttccatatgagcataaaaacacttggtctgcccaaaattgtaaaaatggatcatgtgtgctcgacctcagcaaatgccttttcattcagggaaagctgttattcgctgaacccaaagatgctgggttccctttttcccaagacatcaattcccacctcgccagcctgtccatggctcgtaacactagtccaactcccgatccaacagtgcgcgaagctttgtgcgccccagacaatctgaacgcgagcatcgagagccagggtcagatcaagatgtatattaatgaggtctgtagagagaccgtgagtaggtgctgcaattccttcctccagcaggctggtctcaacctgctcattagtatgacagtgataaacaacatgttggccaagagtgcgtcagacctcaaattccctcttatctccgagggttccggttgtgccaaggtccaggtccttaagcccctcatgggattgagcgagaagccagtgctcgcaggcgaactggtgggggctcagatgctgttcagtttcatgagcctcttcatccgcaacggaaatagagagatattgctggagacacccgcaccctag

SEQ ID NO: 40402 - DNA, 903 bp, Artificial Sequence
  Description of Artificial Sequence: Synthetic coding sequence
atgggccgggcccgggaggtgggctggatggccgccggcctgatgatcggagccggcgcctgctactgtgtctacaagttaacaatcggtcgggacgattccgagaaactggaggaggagggggaagaggagtgggacgacgatcaggagctggacgaggaggagcctgacatttggttcgacttcgaaaccatggcacgtccttggacagaagacggagattggacagagcccggagcaccaggcgggactgaggaccgaccttctgggggtggaaaagcgaaccgggcacacccaattaaacagcgccccttcccttacgagcacaagaacacatggtcggcccagaactgcaagaatggatcatgcgtcctggatctcagtaaatgcttgttcattcagggcaagctgcttttcgcggagcctaaggacgcaggattccctttttcccaggatattaactctcacctggctagcttgtccatggctcggaataccagccctacgcctgatcccacggtgcgcgaggcattatgtgcccccgacaatctcaatgctagcatcgagtcccagggtcaaattaagatgtatatcaacgaggtctgtcgggaaacagtgtcccgctgctgtaactctttcctccagcaagccggcctgaatctcctgatcagcatgacagttataaataatatgctagcaaaatcagccagcgatctgaaatttcctcttatatctgagggcagcggatgcgcgaaagtacaggtgctcaaaccactgatggggttgtctgaaaaaccagttctcgcgggtgagcttgtgggcgcccagatgctctttagttttatgagtctctttatcaggaacggcaatcgagagatcctgttagaaaccccagcgccctag

SEQ ID NO: 40403 - DNA, 1302 bp, Artificial Sequence
  Description of Artificial Sequence: Synthetic coding sequence
atgggccgggtgcagctgttcgagatcagcctgagccacggccgggtcgtttatagtcctggtgagcccctcgctggaaccgtgagggtgcggctgggcgcgcctttacctttccgcgcgatccgagtgacctgcatcggatcatgtggggtctctaataaagcgaatgacactgcctgggtggtagaggaaggatattttaactcttccctgtcactagctgacaagggcagcctccctgcaggggagcatagcttcccatttcagtttctgttgcctgccactgcaccgactagctttgagggaccctttggtaaaattgtgcaccaggtgcgagccgcaattcacactccaaggttctctaaagatcacaagtgctctcttgtgttttacatcctgagccccctcaacctcaacagtattccagacattgaacagccgaacgtggctagcgcaactaaaaagttctcttacaagctggtaaaaacagggagcgtggtcctgactgcctctacggacctgcgcggttacgtggttggtcaggcactgcaactacacgccgatgtcgaaaatcagtcgggtaaggatactagtcctgtcgttgcgtctctcctccagaaggttagttacaaagccaagaggtggatccatgatgtgaggacaatcgccgaggttgagggcgccggagtaaaagcctggaggcgagcccaatggcatgaacagattctcgtgcccgcactcccacagagcgctctgccaggatgctctctgatacacatcgattattatctccaggtgagcctaaaggccccagaggccaccgtgacccttccagtcttcattggcaatattgcagtgaatcacgcccccgtgtctccccgaccagggttgggcctgcctcctggagcccctcccctcgtggtccctagcgcgccaccacaggaggaagctgaagccgaagctgctgcaggcgggccacattttttagatccggtattcctgtctactaagagccacagtcagaggcagcccctgctagcaactcttagcagcgtgcccggggcacccgaaccctgtccccaagacggttccccagcaagtcaccctctccatcccccactatgtataagcactggggccaccgtcccttatttcgcagaggggagtgggggaccagtcccaaccacttctacattgatcctaccgcctgagtatagctcttggggatacccctatgaagccccaccatcgtacgagcagagttgtggaggagtcgaacctagtctcacaccagaatcgtag

SEQ ID NO: 40404 - DNA, 816 bp, Artificial Sequence
  Description of Artificial Sequence: Synthetic coding sequence
atgggccgggtgcagctgttcgagatcagcctgagccacggccgggtggtgtatagccccggcgaacctttagcgggaacagtgcgcgtgagactgggtgcccccctgccttttcgggctatacgggtcacttgtattggctcttgcggggttagcaataaggctaatgacacagcttgggtcgtggaggaagggtactttaatagttcattaagcttggcggataaagggtctctaccagccggggagcactcctttcctttccagttcctgctgccggccaccgcacctacttcattcgaaggcccgttcgggaagatcgtgcatcaggtgagagccgccatccacaccccgcgctttagcaaggatcacaaatgctccctagtgttttacatcctctcgcctctgaacctgaactcaattccagacatcgaagccttgcagctgcatgctgacgttgaaaaccagtccgggaaggacacaagccccgtcgtggcttctcttctgcaaaaagttagctataaggcaaaaagatggatccatgacgtacgcaccatcgctgaggtggagggagccggagtgaaagcctggcgccgtgctcagtggcatgagcagatcttggttccggcccttccccagtccgccctgccagggtgtagcttgattcacatcgattactatctccaggtatcccttaaagcacccgaggccacagtgacgctccctgtgttcattggcaacattgcagtcaaccatgcacccgttagtccccggcccggactgggtctccctccgggagctcctccgctggtttag

SEQ ID NO: 40405 - DNA, 534 bp, Artificial Sequence
  Description of Artificial Sequence: Synthetic coding sequence
atgggccgggtgcagctgttcgagatcagcctgagccacggccgggtagtgtactctcctggcgaacccttggctggtacagtcagagtgcgacttggagctcctttacctttcagggccataagagtcacctgcattggatcatgtggggtgtctaataaagcaaacgatacagcatgggtggttgaagagggttacttcaattcctccctaagccttgcggataaaggatccctccctgccggggagcatagctttccatttcaattcttactaccagcgacagctcccaccagcttcgagggaccatttggtaagatagtgcaccaggtgcgggctgctatacatacaccaagatttagcaaggatcacaagtgtagcctcgtcttctacattctcagtcctctgaacctgaactctatccctgatattgaggggtccagccttcggactcccgcaaagccccttcctggtcctccccccaaacaaccaaacgtggcatcggctaccaaaaagttcagttataaactctag

SEQ ID NO: 40406 - DNA, 1224 bp, Artificial Sequence
  Description of Artificial Sequence: Synthetic coding sequence
atggccgtgccctggctggtgctgctgctggccctgcccatcttctttctcggcgtatttgtgtgggcggtgttcgaacactttctaaccaccgacattccagcgacactgcagcacccggccaaactcaggtttttgcactgtatcttcctgtacctggtcacactaggtaacatcttcgagaagttgggcatctgcagcatgcccaagtttattagatttctacatgacagcgttagaattaagaaggaccctgagctcgtcgtcactgacctgcggtttggcactataccggttaggctctttcagcccaaggcggcctcttcccggccccgccgcggaataattttctaccacggaggcgctaccgtgtttggttcattagattgctaccacggtctctgtaattacctggccagagagacggagtctgtgcttcttatgatcgggtacaggaaactcccagatcatcatagtcccgccctcttccaggactgtatgaacgcctccattcacttcctgaaggccttagagacatacggggttgaccccagccgggtggtcgtctgtggggagtccgtgggaggagccgctgtcgccgccatcacccaggctctcgtgggccgatcagacttgccaagaattcgtgcgcaagtgctgatatatcctgtggtccaggccttctgcctgcagctgccaagcttccagcagaaccaaaatgtcccgctgttaagcagaaaattcatggtgacctccttgtgtaactatctggccatcgatctgagctggagagacgccattttaaatgggacctgcgtgccacctgacgtctggagaaagtacgaaaaatggctaagtcccgataacattcccaagaagttcaagaaccggggctatcagccctggtctccagggcctttcaacgaagcggcctacctagaggcaaagcatatgctcgacgtagagaacagccctctgattgccgatgatgaagtaatagcacagttacccgaagctttcttggtgagctgtgagaacgacattctccgagatgatagccttctctataagaagcgcttagaggaccagggtgtgagagtgacctggtatcacctatacgatgggtttcatgggtcaattatttttttcgacaagaaggctcttagctttccatgcagcctcaagatagttaacgctgttgtaagctatatcaaggggatctag

SEQ ID NO: 40407 - DNA, 8910 bp, Artificial Sequence
  Description of Artificial Sequence: Synthetic coding sequence
atggacccccggaacaccgccatgctgggcctgggcagcgacagcgagggtttcagccgcaaatccccctctgcgatttcaacgggaaccttggtcagcaagcgcgaggtagaactggagaagaatacaaaagaggaagaggacctcagaaaaagaaatagggagagaaatattgaggccgggaaggatgacggccttacggatgcgcagcagcaatttagtgttaaagaaactaattttagtgagggcaatctcaagcttaaaattgggctccaggctaaacgcactaaaaagcccccaaagaacctggaaaactacgtctgcagaccagccatcaagaccactataaaacatcctagaaaggcattgaagtctgggaaaatgacagatgagaaaaacgaacattgcccttctaagagagacccatctaaactatacaaaaaggctgacgacgtggctgcaatcgagtgccagagtgaagaagttatacgcctccacagccagggagagaataacccactctccaagaagctgtcacccgttcactccgaaatggccgactacataaacgctacgccaagtacactgctgggatcaagggaccccgacctcaaggaccgcgccttgctgaacggcgggacctccgttactgaaaagttggctcaattgattgccacatgcccccctagtaagtcctcgaaaacaaagcccaagaaactcgggacagggaccacagccggtctcgttagtaaggacctgataaggaaggccggagttggtagtgtggccggtataatacacaaagatttaattaagaaacccacaatttctaccgccgttgggctggtgacgaaagatccgggaaagaagcctgtgtttaacgctgccgtcggactcgtcaacaaagactccgtcaaaaagttgggtactggcacaaccgctgtatttattaacaaaaatctaggcaagaagccaggtacaattacaactgtcgggctcttatctaaggactccggcaaaaagctgggtattggcattgtgccaggcctcgtgcacaaggagtctggaaagaaactgggccttggaaccgtggtgggattggtcaataaagatctgggaaagaaactaggatccactgtggggcttgtcgcaaaagactgcgcaaaaaagatcgtcgcatcctccgctatgggactcgtaaataaggatatcggcaaaaagctcatgagctgcccactggccggccttatttccaaggacgctattaacctgaaggctgaagccctgttacccacccaggaacccttgaaagctagttgctctacaaacatcaacaaccaagaatcacaggagttaagtgagagcttgaaagatagcgcaacatcaaaaacctttgaaaagaatgtggtgaggcagaacaaggaaagtattctggaaaaattctctgtccggaaggaaataattaatcttgaaaaagaaatgtttaatgagggcacctgtatccaacaggacagtttcagttcaagcgagaaggggtcctatgagacctccaagcacgagaagcagccacccgtgtactgcactagccctgactttaagatggggggcgcatcggacgtaagtactgctaagtccccttttagcgcagtgggggaatctaacctcccttccccctcccccacagtctcagtgaatccgctgacgcgctctcccccagagacttcctcccagctcgcccccaatcctctcctcctgtcttctaccaccgagctgatcgaagagatctctgagtccgtgggaaagaatcagtttactagtgagagtactcacttgaacgtgggacataggagtgtggggcattcaatctcaatcgaatgcaagggcattgacaaagaggtaaatgatagtaaaaccactcacatcgatattcctagaatctccagctctctcggaaagaaacctagtctcacatcggaatctagcatccataccatcaccccatccgtagtcaactttacgagtctcttttccaacaagccgttccttaaactgggggccgtttcggcatcagataaacactgtcaggtggcagagagtctctccacctctttgcaatcgaagcccttaaaaaagcggaagggcagaaaaccccgttggaccaaagttgtcgccaggtctacctgccggtccccaaaggggctggaactagagcgctcggagctgtttaaaaacgtatcgtgtagtagtctgagcaactctaactccgaacccgccaaattcatgaagaatatcggaccaccaagctttgtcgaccacgacttcttgaaacgccggctacccaaactctcaaaatctacagcaccttccttggccttactggctgactctgaaaaaccatcccacaagtcctttgctactcataaattgtcaagcagtatgtgcgtgtccagtgaccttctgtcagacatctacaagcctaaacgggggcgcccgaagagtaaggagatgccacagctggaaggacccccaaaacggacacttaagattcccgccagcaaggtgttctcactgcagtccaaggaggagcaggagccgccaattttacagccggagatagaaataccatcgttcaaacaggggctgtcagtgtccccatttccaaagaaacgagggcggcctaaacgccagatgaggagccctgtgaaaatgaagcccccagtactgagcgtggctccattcgtagccactgaatctccatccaagttagagtccgagagtgacaaccacagatcttcctccgacttcttcgagagcgaagatcagttgcaggatcccgacgatctggatgattcccacagacccagtgtttgtagtatgagcgatctcgagatggagccggacaagaagattactaaaagaaacaacgggcagctcatgaaaactattatccgtaaaattaacaaaatgaagactttaaagaggaagaagttactcaaccaaatccttagttccagcgttgagtcctccaataagggcaaggtgcagagcaaactccacaatacggtgtcatcattagctgctacttttgggtccaagctgggacagcagattaatgtcagtaagaagggaactatttatattggcaagcgccgcggtcggaagcctaaaacagttctaaatggcattctgagtggctcccccacttctctggctgttcttgagcagactgcccagcaggctgctggatctgctctgggtcaaatactgccccctctgctcccctcttcagcaagctcatccgagatcttgccttccccaatctgttcacagtcatcaggtactagtggtggtcagtcaccggtgtcttccgatgcgggcttcgttgagccatccagcgtgccatatctccatctacattctagacagggaagcatgattcagactctcgctatgaagaaagcttctaaaggcaggcggcggctgagtcctccaactctgttgcccaattcaccctcccatctcagcgaattaacctctctcaaagaggctaccccaagtcccatatctgagagccatagcgacgagactataccaagtgactccgggatcggaaccgataataactccacttctgatagagcagagaaattctgcgggcagaagaagcgccggcactctttcgagcacgtttcactgatcccccccgagacctcaacggtgctaagttccctgaaagaaaagcacaaacacaagtgcaagcgacggaatcacgactacctgagctatgacaagatgaagcgacagaagcgcaagcgcaagaaaaaatacccccagctccggaatcggcaagaccccgacttcatcgctgagcttgaagaactgatctcaagactcagcgagatcagaattacacacagatcccaccatttcattccgcgggatcttcttcctaccatcttcagaatcaatttcaatagtttttatacccatccatctttccctctggatcctctgcattacatcagaaaacctgatttaaaaaagaagagagggaggcctccgaagatgagagaagccatggctgagatgccattcatgcattctctaagtttccctctctcctctaccggcttttacccttcttatggcatgccctatagcccgtcacctctgactgccgctcccattgggctgggatactatggtcgctatccgccaaccctttatcccccccctccttcaccttcattcacaacacctctccctcccccctcatatatgcacgctggtcacttattgttaaaccccgccaaatatcataagaagaaacacaagctgttgcgacaggaggcttttctcactacgtcccggaccccgcttcttagtatgtccacctacccttccgtgccccctgagatggcatatggctggatggtggagcacaaacatcgacaccgccacaagcatagggaacatagaagttcagagcagccacaagtctcaatggacaccggatccagccgctccgtgttggaatccctgaagcgttaccgctttggaaaggatgcagtgggcgaacggtacaagcacaaagagaaacataggtgccatatgagttgtccgcatttgagcccttcaaaaagcttgatcaaccgcgaggagcagtgggttcatcgcgaacctagtgagtccagtcccctggctcttggcctccaaacaccactgcagattgattgtagcgagtcatccccaagtttaagtttaggcggatttaccccgaattctgagcctgcaagctcagatgaacacactaacctctttaccagtgccatcggtagttgtagggtgtctaacccgaacagtagcgggagaaagaagctgaccgatagccccggtcttttctctgcacaggacacgtccctgaacagactccaccgtaaagaatctcttccctccaacgaacgtgcagtccaaaccctggcaggctctcagcccacttcagataaaccctctcaaagaccctctgaatccactaattgcagtcccactcggaaacgttctagtagcgagtctacctcttctacagttaatggtgtacctagcaggagtcctcgccttgtggcctccggagacgactctgtggactcactcctccaaagaatggtacaaaacgaggaccaagagcccatggagaaatccatcgacgcagtcatcgctactgccagcgctcctccaagctcttcccctgggaggagccattctaaggaccgaacattggggaagcccgattctctcctggttccggcagtcacctcagactcttgcaacaacagtattagcctgttgtccgagaagctgacttcttcctgtagcccacaccatattaagagatcagtcgttgaagccatgcaaaggcaggccagaaagatgtgcaactatgataagattctggctaccaaaaaaaacctcgaccacgtgaataaaatattgaaggcaaagaaactgcagcggcaggccaggaccgggaacaatttcgtgaagcggcgacctggtcgacctcggaagtgccctctacaggccgtcgtgagtatgcaagcctttcaggccgcccagtttgttaaccccgagctcaaccgcgatgaggaaggcgccgctctccacctgagccctgacaccgtcactgatgtgatagaggccgtggtccagtccgtgaatctgaaccctgagcataaaaaaggtctaaagcggaaggggtggttgctcgaggagcagactcgtaagaagcaaaaaccgttgccagaagaagaagagcaggagaacaataaatcattcaacgaggctcccgtcgagatcccgagtccatcagagacacctgccaaacctagcgaacccgaaagcaccttacaaccggtgctctcattaatccccagggaaaaaaagccaccaaggcctcctaaaaagaagtaccagaaggcaggtctgtacagcgatgtctacaaaacaaccgatccaaaatcgcgactgatccaacttaagaaggagaaactcgagtatacgcccggcgaacacgaatatggactctttcccgctcccatacatgtagtgtttttcgtgtcgggaaagtacttgagacaaaagcgcatcgacttccagcttccttacgacattctgtggcaatggaagcataatcagctctacaaaaaacctgatgtcccactgtacaagaaaatacgctccaatgtgtacgtggatgttaagcccctgtcaggctacgaggcgacaacctgtaactgcaaaaagcccgacgacgatacacgaaaaggatgtgtcgatgattgtctgaacaggatgatcttcgccgagtgtagccctaacacatgcccatgtggcgagcaatgctgcaaccaaaggatccaacgtcacgaatgggtgcaatgtctggagagattcagagctgaagaaaaagggtggggaatcagaaccaaagaacctcttaaggcggggcagtttatcatcgaatacctgggcgaggtggtgtcagaacaggagttcaggaacagaatgattgagcagtatcataatcatagcgatcactactgtttgaacctcgactccggaatggtgattgatagctaccgcatgggaaatgaagccagatttattaaccactcttgtgatcctaattgcgagatgcaaaagtggagtgttaacggggtttaccgcattggactctatgccttaaaagacatgcccgcaggtactgaactgacctatgattataacttccacagctttaacgttgagaaacagcagctgtgtaagtgtgggttcgagaagtgccggggcataataggtgggaagtcacaacgtgtaaatggtcttacctcatcaaaaaactctcagcccatggcaacccacaaaaagtcggggaggtccaaagaaaagcggaaatccaaacataaacttaagaagcggcgaggccacctgtccgaagaaccatctgaaaacatcaatacccccaccagactcactccccaactgcagatgaagccaatgagcaatcgagaacgcaattttgtcttgaagcatcacgtcttcctggtgagaaactgggaaaaaattagacagaagcaagaggaggtgaagcatactagcgacaatatacattctgccagcctgtatacccgatggaacggcatttgcagagacgatggcaacattaaaagtgatgtgttcatgacccagttttccgcattgcaaaccgcgcgaagcgtgaggactcggaggttggcggctgctgaggagaacatcgaagtggcgagggcagcccgcttggcccaaatatttaaggagatatgtgacggaatcataagctataaagacagcagtaggcaggccctggcggctcctctgctgaacctgcccccgaagaagaaaaatgccgactactacgaaaaaatctccgaccccctggatctgatcacgatagaaaaacaaatcctgacaggatattataaaaccgtggaagcctttgatgccgacatgttgaaagtgttccgcaacgccgaaaaatactacggccgcaagtctcctgtagggcgggatgtgtgtcgtttacggaaagcgtattataatgctagacacgaagcttctgctcagatcgatgaaatagtgggcgaaaccgcctctgaggccgacagtagcgagacatcagtttccgagaaggaaaacggccatgagaaagacgacgacgttataagatgcatctgcggtctgtacaaagacgagggcctgatgatccaatgtgataaatgcatggtttggcagcactgcgattgcatgggcgttaacagcgacgttgagcactacttatgtgagcagtgcgacccaaggcccgttgacagggaagtgcctatgatacctcgcccacattatgcacagccaggatgcgtctatttcatttgccttctgagggacgatctgctccttcgccaaggtgattgcgtgtatttaatgcgcgatagtcgtcgcactccagacgggcaccctgttaggcagtcctataggctgctgtcccatataaatcgggacaaactcgacatctttcgtattgaaaagttgtggaaaaacgagaaggaggaaaggttcgccttcgggcatcattacttccggccacatgagacccaccattctccaagcagaaggttttatcacaacgagctgttccgcgtcccactttacgaaatcatcccccttgaggccgtcgtcggcacatgctgtgtgctggacttatatacctattgcaagggtcgacctaagggcgtaaaggagcaggatgtgtacatatgtgattaccgcctggacaagagcgcacatttgttctacaagattcaccgcaatcgttatcccgtttgcaccaagccctacgcgttcgatcactttccaaagaagctgacccctaagaaggactttagcccccactatgtgcccgacaactacaaaagaaacggggggagatcatcttggaagtccgagcggtcgaaaccaccactgaaggaccttgggcaggaggacgacgcactccctctgatagaagaagtattggcctcacaggaacaggcagccaacgaaatcccaagtttagaagaacccgagcgggaaggtgccactgcaaatgttagcgaaggcgagaagaagaccgaggaatcctcacaggagcctcagtccacttgtacgccggaagaaagacgccacaaccaacgcgaaaggctgaaccagattcttctgaatctgctggagaagatcccaggaaaaaatgccatcgacgttacctacctactcgaagagggatccggtagaaagctgcggagacgcaccctgttcataccagaaaactcatttagaaaatag

SEQ ID NO: 40408 - DNA, 8895 bp, Artificial Sequence
  Description of Artificial Sequence: Synthetic coding sequence
atggacccccggaacaccgccatgctgggcctgggcagcgacagcgaggggttcagccgcaagagtccctctgccatatctacaggaaccctggtcagcaaacgggaggtcgagcttgagaagaatactaaggaggaagaggatcttcgaaaacggaacagggaaaggaatattgaggccgggaaggacgatggcttgaccgatgctcagcaacagtttagcgtgaaggagactaacttctctgagggcaacctcaagttgaaaattggtttgcaagccaagcgcaccaagaagcctccaaagaatctcgaaaattatgtgtgtagaccggctatcaagacaacaattaagcatccaagaaaggcattaaagtctggaaaaatgacagacgagaagaatgaacactgtccaagcaaacgggacccctccaagctctacaagaaggcagacgacgtcgctgccatcgagtgtcaatcggaagaagtgattaggcttcactctcaaggtgaaaacaacccactgtctaagaagcttagccccgttcacagcgaaatggccgactacatcaatgccaccccttctaccctcctcggctcgcgggaccccgacctcaaggaccgcgctctactcaatggcgggacctccgtcaccgagaagctggctcagttgattgcaacgtgcccccccagtaagtcctccaagacaaagcctaagaagctgggaaccgggaccacagctgggctcgtatcgaaggacttgatccggaaggcaggagtagggtctgtcgctggcatcatccataaagaccttattaagaaacctacaattagtactgccgtaggactggtgacaaaagacccagggaagaagccagtctttaatgccgcagtcgggctggtgaacaaagactctgtcaagaaattgggcactggaacaactgcggtgtttatcaacaaaaacctgggtaaaaaacctggcaccatcaccaccgtgggtctcctttcgaaggattctggcaaaaaacttggtattggcatcgtgccaggattggtacacaaagagtcaggaaagaaactggggctgggcaccgtcgtcggcctggtcaacaaggacctcggaaagaagctcggctcaacggtgggactcgtcgccaaagattgcgcaaaaaaaattgtcgcatcttcagctatgggcctggtgaacaaggatatagggaaaaagctcatgtcctgtccactggccggcctaatttctaaggacgctatcaaccttaaagctgaggccctccttcccactcaggaacccttgaaagcgagctgctctaccaacattaacaatcaagaaagccaggaattatcagaatctcttaaagactcggctactagcaaaacattcgagaagaatgtggtgaggcagaataaagagtctattttagaaaagttttccgtccgcaaggaaattattaacctcgaaaaggaaatgttcaacgaaggaacgtgtatccagcaggattcctttagtagctccgagaaaggctcctacgagacatctaaacatgaaaagcaacccccagtctattgtacaagcccagatttcaaaatgggtggagccagcgacgtttccacagctaagtcgcccttctccgccgtgggcgagagcaatctaccaagcccaagtcccaccgtgagtgtgaaccctttaactcgctctcctccagaaacatctagtcaattggccccaaatccccttctccttagctctaccaccgaattaatcgaagaaatctccgaaagcgtgggcaagaatcagttcacatcagaatcaactcatctgaacgttggccatcgaagcgttggtcattcgatcagcattgagtgtaaggggattgacaaagaggtcaacgactcaaagactacccatattgacattccccgcatcagttcctccctgggtaaaaagccttcgcttaccagcgagagctccatccataccattacaccatctgtcgtgaattttacctccttgttctcaaataagcctttccttaagctgggtgctgtgtccgcttcggacaaacactgtcaggtggccgaaagcttgtctacttccctccagtcaaaaccccttaaaaaacggaaggggaggaaaccgaggtggacaaaggtcgtcgcccgctccacttgcaggagtccaaaaggcctagaactggaacggtcagaactctttaagaacgtttcgtgttccagcctttcaaattccaattccgaaccagcaaagttcatgaaaaacataggacctccaagctttgttgatcatgattttctaaagcgaagactacccaagctctcaaagtcaacagccccctctctagcgttgctagctgatagtgaaaaacctagtcacaaatcgtttgcaacacataagctgtcttccagtatgtgcgtgtcctctgacttgctcagtgacatctacaaacccaaacgcggccggccgaaaagcaaggagatgcctcagctagagggcccaccaaaacggacactgaagattccagcaagtaaagtgtttagcctacaatcaaaagaagagcaggagcctcccatcctgcagcctgagatcgagatcccgtcgtttaagcagggattaagtgttagcccatttccaaagaaacgagggcggcccaagcgccagatgaggagccctgtcaagatgaagccccctgttcttagtgtagcccctttcgtggctaccgaatcccccagtaaactggagagcgaaagcgacaatcatagaagctcttctgattttttcgagtcagaggaccagctgcaagaccctgatgacctggatgacagccatagaccgagcgtttgttcaatgtccgatttagagatggaacccgataaaaaaatcacaaagaggaacaatgggcagctgatgaaaactataatcagaaagattaataagatgaaaactctgaaaaggaaaaagttgctcaatcagattctctctagtagtgtagagagttcaaacaaaggcaaagtgcaatccaaattacacaacaccgtgagttcactggctgccacgttcggctctaagcttggacagcagataaatgtgtccaagaaaggaacgatatacattggcaagcgccgaggtagaaagccgaaaactgttctcaacgggatcctctcaggtagcccgactagcctagccgtgctggagcagaccgcccaacaggccgccggctccgcactcgggcagatcttgcctccgctgctgccaagctctgcctccagctcggagatactcccatctcctatctgtagccagtcaagcgggactagtggtggacaatcccccgttagctctgacgcaggatttgtggagccttccagtgtgccttacctgcatctgcactcacgacagggcagtatgatccagaccttggctatgaagaaagcttccaagggccgccgacggctctccccccctaccttactgcccaactccccaagtcacttgtctgagctgacatctctgaaagaagcaaccccttcgccaatctccgaaagccattccgatgaaaccattccatcagactcaggaattggaaccgacaacaatagcacctccgatagggccgagaaattctgcggccaaaaaaagaggaggcacagctttgagcacgtttcactcattccaccagaaaccagtacggtgcttagctccctgaaagagaaacataagcataaatgcaagcgccgcaatcacgattacctatcctacgataagatgaaacggcagaagaggaagcggaagaagaaataccctcagttacggaacaggcaggatccagacttcatcgcggagcttgaagaactgatctctcggttgagtgagatacgaataacgcatcgatcccaccactttatacctagggatcttttaccaacaatttttcgtatcaatttcaattccttttacacacaccccagcttcccgttagatccccttcattacattcgaaagcccgacttgaaaaagaaacggggtaggccacccaagatgagagaagcgatggcggaaatgcccttcatgcactctctgagcttccctctatcctcaacaggcttctacccgtcatacggcatgccgtatagtccttctcccctcaccgccgctccaattggcttgggttactatgggcgctatccaccgactctatatcctccaccgcccagccccagcttcacgacccccctacctcctcctagctacatgcatgcaggacacctactattaaaccctgccaagtatcataaaaagaagcacaagttacttcggcaggaagcatttctcacaacctcccggacccctctgctaagtatgtcaacctaccctagcgtgccccctgaaatggcatatggctggatggtggagcataagcacaggcatagacacaagcaccgtgagcatcgctcctccgagcaaccccaggtgtctatggacacagggtcttcgagatccgttcttgaatccctaaaacggtatcgctttggcaaggacgcagtcggagagagatacaaacataaggagaagcatagatgccacatgtcctgtccccatctgtccccctctaaatctcttataaatagagaagagcagtgggtacatagagagccctccgagtctagccccctcgccctcggtctgcagaccccactacagatcgactgctctgaatcgtccccctctctcagcctcggcggtttcacgccgaactctgaaccagcctcttcagacgaacatactaacttatttacttccgccattggttcgtgtcgagtgtctaacccaaacagttctggcaggaaaaaactgaccgacagtccaggcctcttttcagcgcaagatacgtctctcaaccggctgcacaggaaagagagcctcccctccaacgaaagggccgttcagactcttgccggcagtcaacccactagtgataaaccatcccagaggcccagcgaaagtacaaactgctccccaacgcgcaagcggtcatcaagtgagagcacctcctctactgttaatggcgtgcctagccgctcccctcggctggtcgcctccggcgatgacagcgtcgattccctgcttcagagaatggtgcagaatgaggatcaagaacccatggagaagagcatcgacgccgtaatcgccacagcatctgctcctccctcaagtagccctggcaggtctcactcaaaagaccggacccttggaaaaccagacagcttactggtacccgccgtcacctctgatagctgcaacaattctattagcttactatctgaaaagctgaccagttcctgtagtccacaccatatcaaaaggtccgttgtggaggcaatgcagagacaggcccgaaaaatgtgtaactacgataagattctggccaccaaaaaaaacttagaccatgtgaataagatcctgaaagctaagaaactgcagcggcaggccaggacgggtaataacttcgtgaaaaggagaccaggtcggccgaggaagtgccctctgcaagccgtggtgtccatgcaggcattccaagcagcgcaattcgttaatcccgagttgaaccgagatgaagagggggctgcccttcacttgtccccagatactgtgaccgacgttattgaagcagtagtccaaagtgtgaatctgaatccagagcataagaagggtcttaagcggaaaggctggcttctcgaggagcagacccgaaaaaaacagaaacccctgcccgaggaggaggaacaggaaaacaacaagtcctttaatgaagcgcctgtggagatcccttctccatctgagacaccagctaagccctctgagccagagagcacacttcaacccgtgctgtctctgattccccgcgaaaaaaagcctccaagacctcctaagaagaaataccagaaagcggggctctactccgacgtatacaagacaacggatccaaagtctaggctcatccagctgaaaaaggaaaagctcgaatatacgccgggagaacacgaatacggcctgttcccggcacctatccatgtgggcaagtatcttcgccagaaaaggatcgatttccagctgccgtatgatatcctgtggcaatggaagcacaatcagctctacaagaaacctgatgtccccctctataaaaaaatccgctcaaatgtttatgtggatgtgaagcccctttcaggctacgaggctactacctgtaactgtaaaaagccggatgacgacacacgtaaaggctgtgtggacgattgcttaaatcggatgatttttgccgaatgctcacccaacacctgtccatgcggagagcagtgctgtaaccagcggatacagagacacgagtgggtgcagtgtctggagcgttttagggccgaagagaagggctggggaataaggacaaaggagccactgaaggcagggcaatttatcatagaatacttaggtgaggtggtgagtgagcaggaattcagaaaccgaatgatcgagcagtatcacaaccattctgaccattactgcttgaacctggattccgggatggtgattgatagttatcgaatgggcaatgaagccagattcatcaatcacagttgcgaccccaactgtgagatgcaaaagtggagcgtcaatggggtgtacaggataggtctgtacgcacttaaggatatgcccgcgggaacagaactcacctacgactacaatttccactcttttaatgtggaaaagcaacaactgtgtaaatgtggattcgagaaatgccgtgggatcatcggaggaaaaagccagagagtgaacggactgacatcgagtaaaaactcacagcccatggcgacccacaaaaagtctggtcgttccaaggaaaagcgtaagagcaaacataagttgaagaaaaggcgcgggcatctaagtgaagagccgagcgagaacattaataccccgacgcgacttacacctcagctgcaaatgaagccaatgtccaaccgggagagaaatttcgtgctcaagcaccatgtgtttctcgtcaggaactgggaaaaaatacgtcagaaacaggaggaggtcaagcatacctctgacaatatccactcagcgtccctgtatactcggtggaatggaatttgtagggacgatggtaacattaaatcagatgtctttatgacccagttttcagctctccaaaccgcccgtagtgtccggacaaggagactcgcagctgccgaagagaatattgaagtggcaagagccgctcgactggctcaaatatttaaagagatatgtgacggcattatcagttacaaggattcaagtcgccaggctctcgccgcccccctcttaaacctcccacctaagaaaaaaaatgcagattactatgagaagatatccgatcccttagatctgataaccattgagaagcagatcctgaccggttactacaagacggttgaagctttcgatgccgatatgctaaaggtgtttcggaacgcagagaagtactacgggagaaaatctcccgtgggacgtgacgtgtgccggctgaggaaagcctattacaatgctcgccatgaggcctcagcacagatcgatgagatcgtcggtgagacagcttcggaggctgactcatctgaaacctccgtgtctgagaaggaaaacggacatgagaaggacgacgatgtgatcaggtgcatatgtggcttgtacaaagacgagggtcttatgattcagtgtgacaagtgcatggtctggcagcactgcgactgtatgggcgtgaattctgacgtggaacactatttgtgcgaacagtgcgaccccagacccgtcgatagggaggtgcctatgatccctcgccctcactatgcccaaccaggttgtgtctacttcatatgtctactgcgggacgacctgctgctgcgacagggagactgcgtgtaccttatgagagatagccgccgcacacctgatggccaccctgtgagacagtcctacaggctgctgtcccacatcaacagggacaaacttgacatctttcggatcgaaaaactttggaaaaatgaaaaagaggaaaggtttgccttcggccaccattatttccgcccccacgagacccatcactccccatctagacgcttctaccacaatgagctcttcagagtgcctctgtatgaaattatccccttggaggctgttgtgggtacatgttgcgtcctcgacctctatacatactgtaaagggcggcccaaaggcgttaaagagcaggatgtctacatttgcgactaccgtcttgacaaaagcgcccacttgttttataagattcatagaaatcggtatccagtatgtacaaagccttatgccttcgaccactttccaaaaaaactgacacctaagaaagacttttcccctcactacgtccctgacaattacaagcgtaacgggggaagatcatcatggaagagcgagcgaagcaagccccccttaaaagacctggggcaggaggacgatgccctgcccttgatcgaggaggttctggctagccaagagcaggcggcgaacgaaattccgtcattagaggagcccgagagagagggcgcgactgccaatgtgtcggagggggaaaaaaaaactgaggagtcttcacaggaacctcagtctacttgtaccccggaggagagacggcacaatcagagggagcggctcaatcagatcctgctgaacttattagagaaaatccctgggaagaacgcaattgatgtgacttatctgctggaagaggggtcgggcagaaagcttagaaggcgtaccctgttcattccggagaatagttttaggaaatag

SEQ ID NO: 40409 - DNA, 864 bp, Artificial Sequence
  Description of Artificial Sequence: Synthetic coding sequence
atggccaaggacttccaggacatccagcagctgagcagcgaggagaatgaccacccttttcaccagggacccccgccagcacagccactggcccaacgcctatgctcaatggtatgtttctccctcctggcgttaagctttaatattcttctgcttgtcgttatttgcgtgaccgggtcccagtccgcacagctgcaagctgagctacggagtctgaaagaagcgtttagtaatttctccagctctacattgacagaggtgcaggcaatttctactcacggcggttccgtgggagataaaataacttctctgggcgcgaagcttgagaagcagcagcaggacctgaaagcagaccatgatgcattgctctttcatcttaaacattttccggtggatctccggttcgtggcatgccaaatggaactgttacacagcaatggttcacagagaacttgctgccccgttaattgggttgaacaccagggctcttgctattggttttcgcactcagggaaggcctgggcggaggctgagaagtactgccaattggaaaacgcgcacctagtcgtgatcaatagctgggaagagcaaaaattcatcgttcagcacactaatcctttcaacacttggatcggacttacggattccgacggtagttggaaatgggtggatggcacagattacagacataattacaagaattgggctgtgacgcagcctgacaactggcacgggcatgaacttggtggcagcgaggactgcgtggaggttcaacccgacggacgttggaacgatgacttttgtctgcaggtataccgctgggtgtgtgaaaaacgtcggaacgctacaggggaggtcgcgtag

SEQ ID NO: 40410 - DNA, 936 bp, Artificial Sequence
  Description of Artificial Sequence: Synthetic coding sequence
atggccaaggacttccaggacatccagcagctgagcagcgaggagaacgaccatccttttcaccaaggtgaggggcctggaacaagacgcctgaacccgcgtagggggaatccttttctgaaggggcccccccccgctcagcccttggcacagcggctctgtagtatggtgtgcttttccctccttgctcttagtttcaatatactgcttcttgtagtgatttgtgttacaggcagccagagtgagggccacgggggtgcacaactgcaagccgagctgcggtcgttgaaggaagcctttagcaacttcagcagcagcaccctgacagaagtgcaggctattagtacgcacggtgggtctgtgggggataaaatcacatctctgggcgccaagctcgaaaaacaacagcaggacttgaaagctgatcatgacgcactgctctttcatctgaaacattttcccgtcgatctcaggtttgtggcatgtcagatggagctgcttcacagcaatgggagccagagaacctgttgcccagtgaactgggttgaacaccagggctcttgttattggttcagccacagcggcaaagcctgggccgaggccgagaaatattgtcagctggaaaacgcacatcttgtggtgattaattcctgggaagagcagaagtttattgtgcaacataccaacccctttaatacatggattggactgaccgacagcgacgggtcttggaagtgggtcgacggcacagattataggcacaattacaagaactgggctgtgacgcaacctgataactggcatgggcatgagttaggggggtctgaagactgtgttgaagtgcaacccgacgggcgatggaacgacgacttctgcctgcaggtgtataggtgggtctgcgagaaacggcgcaatgccaccggcgaagtcgcttag

SEQ ID NO: 40411 - DNA, 936 bp, Artificial Sequence
  Description of Artificial Sequence: Synthetic coding sequence
atggccaaggacttccaggacatccagcagctgagcagcgaggagaacgatcaccctttccaccagggtgaagggccaggaacaaggaggttgaaccctcggcggggtaatcctttcctcaaaggcccaccaccagctcagcctctggctcagcgactgtgctccatggtttgttttagtctgctggccctgtctttcaacattttactgttagtagtgatatgcgtgacagggtctcagtccgaaggtcacggaggggcccagctacaggctgagctgcgcagtttgaaagaggccttctcgaacttcagttcatccactctaactgaggtgcaggccatctctacacatggggggtccgtcggggataagattacgtcccttggcgcaaagctggaaaagcagcaacaagatcttaaggctgaccacgatgctttacttttccaccttaaacactttccagtagatttacgcttcgtggcttgccagatggagttactgcacagcaatggctcacagaggacctgttgtcccgtgaactgggttgagcaccagggaagttgctattggttttcccattccgggaaggcctgggccgaagccgagaaatactgccaactcgaaaacgcccacctcgtagtgattaacagctgggaagagcagaaattcatcgtccaacatacgaatccctttaatacatggattgggctcacagactccgacgggagttggaagtgggttgatggaactgattatcgccacaattacaagaattgggctgtcactcagcctgataattggcatggacacgagctgggcggatccgaagactgtgtggaggtccagccagatggcagatggaatgatgatttctgcttacaagtctatcggtgggtttgcgagaagcgtaggaacgctacgggagaggtggcctag

SEQ ID NO: 40412 - DNA, 879 bp, Artificial Sequence
  Description of Artificial Sequence: Synthetic coding sequence
atggccaaggacttccaggacatccagcagctgagcagcgaggagaacgaccacccctttcatcagggacctccccccgcgcagccactagcccagcggctatgcagcatggtgtgcttcagcctgttggcactgtcctttaatatcctgctgctggtagtgatctgtgtcacaggatcacagtctgagggccacggaggggctcagttacaggcagaacttaggtcactcaaggaagcattctccaattttagttctagcacactaacagaggtgcaggctatatccactcatggcggctctgtgggggacaaaattacgtctctcggcgctaagctagagaagcagcagcaggacttgaaagccgatcacgatgcgctgctctttcatctgaaacactttcccgtggacctaaggttcgtggcttgccaaatggaacttctccactctaacgggagccagaggacctgctgtcccgtaaattgggtcgaacatcaaggatcctgctactggttctctcattcaggcaaggcctgggcagaagcagagaaatattgtcagcttgagaatgcccatctcgttgtcatcaactcttgggaggagcagaagtttatcgtgcagcacacaaacccattcaatacctggataggccttaccgactctgacggctcttggaagtgggtggatggaaccgactaccggcacaactacaaaaactgggctgttactcagcctgataattggcacggccatgagctgggcggctctgaggactgcgtggaagtgcagcctgatggacgctggaatgatgacttttgtcttcaagtttaccggtgggtgtgcgaaaagcggcggaacgctactggtgaggttgcgtag

SEQ ID NO: 40413 - DNA, 414 bp, Artificial Sequence
  Description of Artificial Sequence: Synthetic coding sequence
atggccaaggacttccaggacatccagcagctgagcagcgaggagaatgaccacccctttcaccaaggcccaccgccagcgcagccgctagcgcagagactgtgtagtatggtctgcttcagcctgctggccctctcttttaacattctgcttcttgtggtgatttgtgtgacaggatcacagtccgctcagctgcaggccgaactacgatctctgaaggaagccttttctaacttttcgagttctaccttgacagaagtacaggctatctctacacacggaggctccgtcggagacaaaattacttcacttggcgccaagctcgagaagcagcagcaggatctcaaggctggacagagggctagtggcgtctgtgcccatgtgagagcttgtgtgagggtgagatgcgtatag

SEQ ID NO: 40414 - DNA, 1422 bp, Artificial Sequence
  Description of Artificial Sequence: Synthetic coding sequence
atggcccagctggagggctactgcttcagcgccgccctgagctgcaccttcctcgtttcatgtttgcttttctcagcgttcagccgcgcactcagggagccctatatggacgaaatttttcacttgccacaggcccagcgttattgtgaaggtcatttctctctatcccagtgggatccaatgattaccacgttgccaggcttatatctggtgtccgtgggcgtggtgaagccagcaatctggattttcgcttggagcgagcacgtagtctgcagtataggaatgttgcggtttgtaaacctcctgttctcagttgggaatttttatctgctatacctgcttttccacaaggtgcagccgcgcaataaggcagcttcttctatccaacgggtgctgagcaccttaacgctggcagtgtttcccacactgtacttcttcaacttcctctattacacggaagccggctctatgttctttactctctttgcttacctgatgtgcttatacgggaatcataaaaccagcgcgtttttggggttttgcggttttatgttccggcaaacgaacattatttgggccgtgttttgcgctgggaacgttatagctcaaaaactgaccgaagcctggaaaaccgaacttcagaaaaaggaagatcgcttgccgccaataaaagggcctttcgcagagttcaggaagattttgcagttcctgctcgcctacagcatgtcatttaaaaatttgtcgatgttgttttgtctgacttggccttacattttactgggttttctcttctgtgcctttgttgtagtgaatggcggcatcgtcatcggcgacagatcttcacacgaggcctgtcttcacttcccccagctgttttacttcttcagtttcactttgtttttttccttcccccaccttcttagtccctcgaagatcaaaacattcttatcactcgtgtggaagcacggaatattgttcttggtggtgacattggtgtccgtgttcttggtgtggaaattcacttacgcacacaaatatctgctggccgacaaccggcactataccttttatgtgtggaagagggtcttccaacggtacgccatcctgaagtacctcctcgttccggcttacatctttgccggctggtccatcgccgatagcctgaaatccaaacccatcttttggaacctgatgttcttcatttgcctattcatcgttatcgtgccacagaagctgctcgagttccgatatttcatcttgccttacgtgatttaccggcttaatattaccctacctcccacttcaaggctcgtttgcgagctctcatgctatgccatcgtgaatttcattactttctatattttcctaaataagacattccagtggcccaattcccaggatatccagcgctttatgtggtag

SEQ ID NO: 40415 - DNA, 1173 bp, Artificial Sequence
  Description of Artificial Sequence: Synthetic coding sequence
atgttccccgcccaggccaaggagaacgccggcttcagcggctgcgggggcgacaccgagattgactggaaggcatacatggcagaagtcgaaggggtgattaacgggacttacgactacactcagttgcaaggagacaccggaccccttgtgtatcctgccgggttcgtctacattttcatgggtttgtattacgccacgagcaggggaaccgacattaggatggctcagaatatctttgctgtcctctaccttgctaccctcctcctggtcttcctgatataccaccaaacgtgcaaggttcccccgtttgtgtttttctttatgtgctgtgcgtcttaccgagtgcacagcatttttgtactccgattgtttaacgatcctgttgctatggtcctcctgttcttatctattaatctgctgctcgctcagcgatggggctggggatgctgtttcttcagcttggccgtgagtgtgaagatgaatgtcctgctgttcgctccaggccttttgtttctgctgcttactcaattcggattcaggggtgccctgccaaaactcggaatctgtgctggccttcaggtggttttgggccttccgtttctgttggagaacccctctggctatttgagtaggtccttcgacctgggtaggcagtttctattccattggacagtgaactggagattcttgcccgaggctctctttcttcaccgcgcattccacctggccctcttgacagcccacctcacactgctcctcctgttcgcgctctgtagatggcataggactggggagtccattctgtccctgctccgagacccctcaaaacggaaagtgccgccccaaccgctgactccaaatcagattgttagcaccttgttcacatcaaactttattggcatctgcttctctaggtcattacactatcagttttacgtctggtacttccacactttgccttatctcctctgggcaatgcccgcccgctggctgacacacctcctccgactgcttgttctgggtctgatcgaactgagttggaatacatacccatctaccagttgtagcagtgccgccctacacatttgtcatgcagtgatcttgctgcagttatggctcggccctcagcccttccctaaatcaacacagcattctaagaaggcccattag

SEQ ID NO: 40416 - DNA, 975 bp, Artificial Sequence
  Description of Artificial Sequence: Synthetic coding sequence
atggcccccctgctgctgcagctggccgtgctgggcgccgccctggccgccgccgctctcgtgttgatttcaattgtggctttcaccactgccactaagatgccagctctgcataggcatgaggaggagaagttctttttgaacgccaaagggcagaaggagacactgcctagtatttgggatagccccaccaagcagctgtcagtggtcgtccccagttataatgaggagaaaaggctgccagttatgatggacgaagcactttcctacctggaaaagcgtcagaagagggacccggccttcacctacgaggttatcgtagtggacgacggatccaaggaccagacaagtaaagtagctttcaaatactgccagaaatacgggtccgacaaagtgcgcgtgatcacattggtgaaaaatagaggcaagggcggagccatcagaatgggcattttttcaagcaggggcgagaagatcctgatggcagacgcagatggtgccaccaaattcccggatgtcgaaaagctcgaaaaggggttgaatgacctgcaaccctggcccaaccagatggctattgcctgcggatctagggcccatttagagaaagaaagtatcgcccagcggagttatttcaggacacttctgatgtacggatttcattttctggtgtggttcctgtgcgtgaaaggcatacgggacacacagtgtggtttcaagcttttcacccgggaggcggcctctcgcaccttctcaagcttacacgtggaacggtgggcctttgatgttgaactgttgtacattgctcagttttttaagattccaattgctgaaattgcggtcaattggaccgaaatagaaggatccaagctcgtcccgttctggtcctggctgcagatggggaaggacttgctgttcatccgcctgcgctacctcacgggcgcctggcggctggagcagaccaggaaaatgaactag

SEQ ID NO: 40417 - DNA, 693 bp, Artificial Sequence
  Description of Artificial Sequence: Synthetic coding sequence
atggcccccctgctgctgcagctggccgtgctgggcgccgccctggcagccgccgctctggtgctgatctcgattgtggccttcacgacagcaactaagatgcctgccctgcaccgtcacgaggaggaaaagtttttccttaacgccaaaggtcagaaggagactctgccctccatctgggactccccgactaagcaactgtctgtcgttgtgccaagctataatgaggagaaacggttgccagtgatgatggatgaagccctctcatacctcgagaaacgccagaagcgcgacccagcctttacttacgaagtgattgttgtggatgatggctccaaagaccaaacaagcaaagttgcattcaagtactgccagaaatacggcagcgataaagttcgagtgatcacactagtcaagaatagaggcaaggggggggcaatcaggatgggaatcttctccagtcgcggtgaaaagattctcatggcagatgccgacggtgccacaaagtttccggacgtagagaagctggagaagggactcaatgaccttcagccctggccaaatcagatggccattgcttgcggcagcagagcgcacttggaaaaggagagcatcgcgcagcataaatgttcatttggaggccttatttctcaacccgtgttcatcggcagcatcctttacggcaggcactag

SEQ ID NO: 40418 - DNA, 885 bp, Artificial Sequence
  Description of Artificial Sequence: Synthetic coding sequence
atggcccccctgctgctgcagctggccgtgctgggcgccgccctggccgcagctgctctcgtcctgatcagcattgtggccttcactacagccaccaagatgccggcacttcaccgtcatgaagaagagaaatttttcctgaatgctaaaggtcaaaaagaaactcttcctagcatctgggattcaccaactaagcagctctctgtagttgtgcccagctacaatgaagagaagcgattgcccgttatgatggacgaagccctgagttacctggagaagaggcagaagtacggttctgacaaggtgcgtgttattactttagtcaagaatcggggaaaggggggtgccatcaggatgggtattttctccagccgcggggaaaagatcctgatggcagatgcggacggagccaccaagtttcctgatgtcgagaaactcgagaagggcctcaatgatctgcaaccatggcctaatcaaatggcaatcgcctgcggatcacgggcccatctggaaaaagaaagtattgcacaacgatcatactttcgcacactgctcatgtatggttttcatttcctggtttggtttctgtgtgtgaagggcatacgggacacccagtgtggatttaaactatttacccgagaagccgcctcaagaaccttctcgtccctccatgttgagcgctgggcctttgacgtcgaattattgtacatcgcccagttttttaaaattccaatcgctgagattgctgtgaactggaccgagatcgaaggctctaagctggtgccattctggtcttggctgcagatggggaaagatcttctctttatcaggcttcggtatcttaccggagcctggaggctggaacagacacgcaaaatgaactag

SEQ ID NO: 40419 - DNA, 1173 bp, Artificial Sequence
  Description of Artificial Sequence: Synthetic coding sequence
atgaaggagggccggggcagcttcagcgtggagcggggcccccggaaggagagagagacagcgcagtccgggatgtggaaaggcaatagcccagctggcagccagggtgccgctatggaaggtaccggcggagagctggggggccaggggaattggggcccagaggacgcaccagggttactggcacgagcatccctgataatgcttccatggccactgccactagccagttctgcactcaccctgctgtttggggctctgacgtcactgtttctgtggtactgttaccgcctaggctcccaggatatgcaagctctgggggcgggcagccgggccggcggagtgcgtggcggcccagtgggctgtagtgaagccgggggtccctccccaggaggacctggcgacccaggggaaggtcctaggacggaaggactcgtcagtagaagactgcgcgcttacgccaggagatactcctgggctggcatgggacgggtccgccgagcggcacagggcggcccaggaccaggcaggggcccgggtgtccttgggattcagaggcctggtctgctctttctgcctgacttaccttccgccccgttcgtcccacgggatgcgcagaggcatgatgtggaactgctggagtcaagtttcccagccatattgagagatttcggagccgtgtcctgggacttctctgggacaaccccccctccacgcgggtggtcccctccgctagcccctggctgttaccagctcctgctttaccaggccggacgctgtcagccaagcaattgccgacgctgcccgggcgcctatagggcattaagagggttgcggtcatttatgtccgctaacacctttgggaacgctggcttctcagtactgcttcccggagccaggcttgaagggcgttgcggcccgacaaacgcacgcgttcgatgtcacttaggtctgaagattccgcctggatgcgagcttgtggtcggaggagagccccagtgctgggcagaaggtcattgcctactggtggacgacagctttctgcacactgtcgcccataacggcagcccagaagatggacctagggtggtttttattgtcgatttgtggcaccctaatgtggcaggcgctgagagacaggccctggatttcgtattcgcaccagatccatag

SEQ ID NO: 40420 - DNA, 1173 bp, Artificial Sequence
  Description of Artificial Sequence: Synthetic coding sequence
atgaaggagggccggggcagcttcagcgtggagcggggcccccggaaggaaagagagaccgcacagagcgggatgtggaaagggaattcgcctgcgggatcacagggcgccgcaatggaaggaaccggcggtgaactcgggggccaaggcaattggggtcctgaagacgcgccgggactattggctcgtgcatcactcattatgctcccctggcccctacctctggcttcatctgctctgaccctgctttttggggctctgaccagcttgttcctctggtattgttatcgtctcgggagtcaagatatgcaggccttgggtgccgggtcgcgtgctggaggcgtgagagggggacccgttggctgctcagaggccgggggaccctccccaggcggtccaggcgacccaggcgagggtccacgaacggaagggctggtctcacggagactgcgcgcctatgcgcggaggtatagctgggccggcatgggcagggtacgcagggcagcccaaggaggcccagggcctggtcggggccccggggtacttggcatccagcgccccggattactgttcctgcctgacttaccgagcgcaccgttcgttccccgtgacgcccaacggcatgacgtggagctgctggagagctcttttcctgccatcctgagagacttcggcgcagtgagctgggacttttcagggactacccctcccccacgcggatggtctcctcctttggctcccggatgctaccagcttcttctctatcaggccgggcgatgtcaacccagtaactgccgtcggtgtccaggggcatacagggcgttgaggggccttaggtcattcatgagtgccaacacatttggaaatgcaggcttctctgtacttctgcccggggcgcggctggagggacgctgtggaccaacaaacgcccgcgtaaggtgccaccttggactgaagataccacctggatgcgaactcgtggtaggtggcgagccccagtgttgggctgaaggtcattgcctgctggtggacgatagtttcttacacaccgtagctcacaatggaagcccagaagatggcccaagagtggtatttattgtagatttgtggcatcccaacgtcgccggcgctgaaagacaggcattggatttcgtcttcgccccagacccttag

SEQ ID NO: 40421 - DNA, 891 bp, Artificial Sequence
  Description of Artificial Sequence: Synthetic coding sequence
atggcccggtgcgagcggctgcggggcgccgccctgcgggacgtgctaggacgcgcacagggcgtgctgttcgattgtgacggggtcctctggaacggagaacgggccgtcccgggtgctcctgagttgcttgagcggcttgcccgcgccgggaaagcagcgctatttgtatccaacaactcccgccgggctagacccgagctggcactcagattcgccagattgggttttggcggcctccgcgctgaacagctcttcagctcagctctgtgtgcagccagactgctgagacagagactcccagggcctccagacgccccaggtgctgtatttgtactcggcggagagggactgagggctgaactgcgcgccgcaggacttcgtctggccggggacccctctgccggcgacggcgcggcaccaagggtccgcgcagtgctcgtaggatacgacgaacatttcagtttcgcaaagctccgggaggcttgtgcccacctgagggatcctgagtgcctcttggtcgctaccgatagggacccttggcacccactgtccgatggatcgcgcaccccaggcaccggctccctggctgcggccgtggagaccgctagtggtagacaggccctcgtcgtgggtaagccgtctccctacatgttcgaatgtatcacagagaatttctcaatcgaccctgctcgaacactcatggtgggagatcggcttgagacagacattctgttcggacaccgttgcgggatgacgaccgtgttgacactgaccggagtcagcagactggaggaggcacaggcttatttggctgccggtcagcatgacctcgtgccacactactacgtcgagagtatcgccgatctgacagaggggctggaagactag

SEQ ID NO: 40422 - DNA, 1506 bp, Artificial Sequence
  Description of Artificial Sequence: Synthetic coding sequence
atgcccagcgccagcgccagccggaagagccaggagaagccccgggagataatggatgccgccgaggactatgccaaggagcgttacggaatttcttctatgattcagagtcaggagaagcccgatcgagtcctggttcgggtaagggatctcaccatccagaaggccgacgaagtcgtatgggttagggccagagttcataccagtagagctaagggcaagcagtgttttctcgtgctgcggcaacagcaattcaacgttcaggccttggttgcggtcggggatcacgcatcgaaacagatggttaaatttgctgcaaatatcaacaaagaaagcatcgttgatgtcgaaggagtggtgcgcaaggtgaatcaaaaaatcgggtcatgcacacaacaggatgtggaactccatgtgcaaaagatctatgtgatatccctggccgaaccccggctccctctgcaattggacgacgctgtgcgcccagaggctgagggcgaggaggaaggtagggcaaccgtgaatcaggacacacgtcttgacaaccgggtgattgacctcagaacatcgacctcccaagccgtgtttcggctgcagtccggcatatgtcatctgttcagagaaactctcattaacaagggcttcgtcgaaatccagacacctaagatcatctccgccgcgagtgagggaggagcaaacgtgttcactgtgtcttattttaagaacaatgcctacttagctcagtctccacaactgtacaagcagatgtgtatctgcgccgatttcgagaaagtgttctccatcggcccggtgtttagagctgaggacagtaacacgcaccgacacctgaccgaatttgtgggacttgatatcgaaatggcatttaattatcactatcacgaagtcatggaagaaattgctgacactatggtgcaaatcttcaaagggctacaggagcgcttccagactgagatccaaacagtgaataaacaattcccttgcgaacccttcaaattcctcgagcctaccctcaggctcgaatactgtgaagctttagctatgctccgggaggctggcgtcgagatgggagatgaggatgatctgtccacaccaaacgagaagctcctgggccatcttgtaaaagaaaaatatgacacagacttctatatactggacaagtatccccttgccgtgcgccctttctatacaatgccagacccacgaaatcctaagcagagtaatagctacgacatgttcatgcggggagaagagatcctttctggagctcagaggattcacgatcctcagctgctgactgagagggcccttcaccatggcatcgacctggaaaagatcaaagcctacatcgactcattccgcttcggcgccccaccacatgccggaggaggaataggattggagcgtgtgacaatgctctttctgggcctgcataatgtgcgccagacaagcatgtttcctagagacccgaaacggctgacaccatag

SEQ ID NO: 40423 - DNA, 1206 bp, Artificial Sequence
  Description of Artificial Sequence: Synthetic coding sequence
atggtgaagttcgccgccaacatcaacaaggagagcatcgtggacgtggagggggttgtgaggaaggttaaccagaagattgggtcatgtacacagcaagatgtggagttgcacgtacagaagatctatgtaattagcctagccgaaccacggcttcctttgcagctggacgatgctgtaagaccagaggcggagggagaggaggaaggtagagcaacagtgaatcaggacacacgtttagataatagagtaatagatctccggacaagcacctctcaggctgtttttcgactccagagcggaatctgtcacttattcagagagactctgatcaacaaaggctttgtggagatccagactcctaagattatcagtgcagccagtgaaggaggcgccaatgtgttcactgtttcttactttaaaaataacgcatacctggcccaatcaccacagctgtataagcagatgtgcatttgtgcagatttcgagaaggttttttccataggaccagtttttcgcgctgaagatagcaatacccatagacacctgactgagtttgtgggactggatatcgagatggccttcaactatcattaccacgaggtgatggaggagatcgccgatactatggtacagattttcaaaggcctgcaggaacgatttcagaccgagatccagactgtaaacaaacagtttccatgcgagcctttcaaattcctggagcctactcttcgcctggaatactgtgaggccctggctatgctgcgcgaagccggggtcgagatgggagacgaagatgacctgagcacaccgaacgaaaagctgctggggcacctggtcaaggagaaatatgacacagatttttacattttggacaagtatcccctagcggtgcggccattctacaccatgccagaccctagaaaccccaagcagagcaatagctatgatatgttcatgcgaggcgaggagatcctaagcggcgcgcagaggatccacgatccacaattgcttacagagagggcgctccaccacggtattgatttagagaagatcaaggcctatattgacagcttcaggttcggcgcccccccacacgccgggggaggcatcggacttgagcgagtgacaatgttgtttctaggtcttcacaacgttcggcagaccagtatgttcccaagggacccaaaaagactgacgccctag

SEQ ID NO: 40424 - DNA, 564 bp, Artificial Sequence
  Description of Artificial Sequence: Synthetic coding sequence
atgaccagccgggagcaccaggtgagcctgtgcaactgcgtgcccctgttacggagactgttgtgtgacgctccatggagaaaagcgcggcccctgcacgctctttcccgctattttcggagtcgcgtctcccctagcaaaatggctgaggagccccagtccgtgctgcagctcccgactagtatagccgccggaggggagggcctgacagacgtgtctccggaaacaacaacgcccgagccgccatcatctgcggccgtctctcctggaaccgaggagccagctggtgatacaaaaaagaagatcgatatactcctgaaagccgtcggcgatacacccattatgaaaaccaagaagtgggcagtagaaaggacgcgcaccattcagggcctgattgatttcatcaagaagttcctgaaattagtcgccagcgaacaactgtttatatacgtgaatcaatcctttgctccttcccctgaccaggaagtagggaccctgtacgaatgttttggcagcgatggcaaactggtgttgcactattgcaagtcgcaggcctggggttag

SEQ ID NO: 40425 - DNA, 225 bp, Artificial Sequence
  Description of Artificial Sequence: Synthetic coding sequence
atggccgaggagccccagagcgtgctgcagctgcccaccagcatcgcagccggaggcgagggactgacagatgtctctcccgagaccaccacaccggagccaccatcatctgctgctgtgtcccctggaacggaggaacctgctggagacacaaaaaagaagatttatctgtgcgagtcagtactttgctcgttcccacgcccccggagctggaacagcctttag

SEQ ID NO: 40426 - DNA, 423 bp, Artificial Sequence
  Description of Artificial Sequence: Synthetic coding sequence
atggccgaggagccccagagcgtgctgcagctgcccaccagcatcgcggccggtggcgagggcctcaccgacgtctctcccgagaccaccaccccagaaccacccagttcagcggctgtatcccccgggacggaagagcccgccggcgacaccaaaaaaaaaatcgatatcctgttaaaggctgtaggcgatactcctataatgaagaccaagaaatgggccgtcgaacgcacccgcaccattcagggcctgatagactttatcaaaaagtttttaaagcttgtggcttcggagcagctgtttatctatgtcaatcagtccttcgcaccttctcccgatcaagaggttggaacgctgtatgagtgttttggtagcgatgggaagctggttttgcattactgcaaatcacaggcttggggatag

SEQ ID NO: 40427 - DNA, 1479 bp, Artificial Sequence
  Description of Artificial Sequence: Synthetic coding sequence
atggccagccccagcggcaagggcgcccgggccctggaggcccccggttgcgggccccggcccctggcaagagatcttgtggactcagtggatgacgccgaaggcctgtacgtggccgtggagcgctgccccttgtgcaacaccactcggagacgcctgacatgtgcaaagtgtgtgcagtcaggcgacttcgtgtatttcgacggtagagacagggaacgattcatagacaagaaggagcggctttcacgtctgaaatcaaagcaggaggaatttcagaaggaagtgctgaaggccatggaaggaaaatggattactgaccagctgcgttggaagatcatgtcctgcaagatgcgcatcgaacaactgaaacagacaatctgcaagggcaacgaagagatggaaaaaaattctgaaggcctgctcaagaccaaggagaaaaaccagaagttgtactcacgcgcccagcgacaccaggagaagaaggaaaagatacagcgccacaaccgcaaactcggcgaccttgtggagaagaagactattgatcttagatcacactacgagaggttggccaatttaagacgctctcatatcctggaattgacctcggtgatctttccgatcgaggaggtaaagactggcgtgagggatcccgccgacgtgtcatcggaatccgattccgcaatgaccagttctacagtctcaaaattggccgaagcccgccggacaacctatttaagtggcagatgggtgtgtgatgaccataatggtgacacctcaataagcattactggaccctggatcagtctgcccaacaatggagattactctgcgtactatagttgggtcgaagaaaagaagaccacacagggacccgatatggagcagtcaaaccccgcctatactatcagcgccgccctgtgttacgctacgcaactggtgaacatcctatcccacattcttgacgtgaaccttccaaaaaagctgtgtaatagcgagttttgtggtgagaatctcagtaagcaaaagttcacacgcgctgttaagaagcttaacgccaacattctctacttgtgcttctcacaacatgtgaatctcgatcagctccagccattacataccctgaggaatctgatgtaccttgtgtctccgagcagtgagcatctgggccgatctggaccctttgaggtgcgtgcagacctggaagaaagtatggaatttgtggatccaggcgtggccggcgaatctgatgaatctggcgatgagcgggtgagtgacgaggagaccgatttgggcactgactgggaaaatctcccaagtccacggttttgcgacataccctcccaatccgtggaagtgagtcaatctcagtcaacccaggcatcccctcccatcgccagttcttctgccggggggatgatttcctcagcagctgcttctgtcacttcgtggttcaaggcttacaccggacatcgatag

SEQ ID NO: 40428 - DNA, 828 bp, Artificial Sequence
  Description of Artificial Sequence: Synthetic coding sequence
atgaccgacgacaaggacgtgctgcgggacgtgtggttcggccggatccctacctgtttcactctgtaccaagacgaaatcacagagagagaggctgagccgtactacctattactcccaagagtgtcatacctgacccttgtgactgataaagtgaagaagcactttcagaaggtgatgcggcaggaggatatttctgagatctggtttgagtacgaaggtacgcctctcaagtggcactaccctatcggcctgcttttcgacttgcttgcatcctcttcggccctgccctggaatatcacggtgcactttaaatcgtttcccgagaaggaccttttgcactgtccatccaaggatgccatcgaagcccacttcatgagttgcatgaaggaggcggacgcgctcaagcacaagagccaagttatcaacgaaatgcagaagaaggatcataaacagctctggatgggcctgcagaacgacagattcgatcagttctgggccattaatagaaagttgatggagtaccctgccgaagaaaatggtttcagatatatccccttcaggatttatcagaccacaaccgagaggccattcatacagaagctttttcgccccgtggccgcagacggccagctgcacacactgggggacctcctgaaggaagtgtgtccaagtgccatcgacccggaggatggtgagaagaagaatcaggttatgatccatggaattgagcctatgctggagaccccactccagtggttatccgagcacctgagttaccccgacaactttctacacatttccatcattcctcagcccacagattag

SEQ ID NO: 40429 - DNA, 276 bp, Artificial Sequence
  Description of Artificial Sequence: Synthetic coding sequence
atgaccgacgacaaggacgtgctgcgggacgtgtggttcggccggattccaacctgttttactctgtatcaggacgaaatcacggaaagggaggctgagccatattatacagatttaacatcctttgggccttctatcggcaattcctggaatatcctgcaaaagaagatggactttgtcatatctcctctggagtacattcgtcagcgtctgaaagacctttcttttcgctcatgctttgtgttgtggctgcagatggattcctgtacccactag

SEQ ID NO: 40430 - DNA, 594 bp, Artificial Sequence
  Description of Artificial Sequence: Synthetic coding sequence
atgcactaccccatcggcctgctgttcgacctgctggccagcagcagtgccctcccttggaacatcactgtccatttcaaatcctttcccgagaaggatctgctgcactgtccttccaaggatgcgattgaagcccattttatgagctgtatgaaggaagccgatgccctcaaacacaagtcccaagtgatcaatgagatgcaaaagaaagaccacaaacagttgtggatggggctccagaacgatcgcttcgaccagttctgggccattaatagaaagttaatggaatatccagctgaagaaaacggatttagatatattccttttaggatctaccagaccacaactgagcgcccatttattcagaaactgtttcgaccggtggcagccgatggccagctgcacacccttggagacctacttaaagaggtttgccccagcgccatagaccccgaagacggagagaaaaaaaaccaagtaatgatccatggaatcgagccaatgttggagactccgctgcagtggctctcagaacacttaagctaccctgataactttctccatatctctatcatcccacaacccaccgactag

SEQ ID NO: 40431 - DNA, 828 bp, Artificial Sequence
  Description of Artificial Sequence: Synthetic coding sequence
atgaccgacgacaaggacgtgctgcgggacgtgtggttcggccggattccaacttgtttcactctgtatcaagacgagatcaccgaaagggaggccgagccatactatcttctgctaccgagagtctcttacttgactctagtgaccgacaaggtgaaaaaacacttccaaaaggtgatgagacaggaagatatcagcgaaatctggtttgagtacgagggcactccactcaagtggcattaccctattggcctgctctttgacctgctggcaagctccagcgcccttccttggaatattaccgtgcacttcaagtcattcccagaaaaagatttactccattgccctagcaaagatgcaatcgaagcacactttatgtcatgcatgaaagaggccgatgccctgaagcacaagagtcaggtcatcaacgaaatgcagaaaaaggaccataaacaactctggatgggccttcagaacgatagatttgaccagttttgggctatcaacagaaagcttatggaatatcccgcagaagagaatgggttccgctatatcccctttagaatctaccagacgacgacagagagacctttcattcagaaactcttcagacctgtcgccgctgatgggcagctgcacaccctcggtgatcttctgaaagaggtttgcccgagcgctatcgacccagaagacggcgagaaaaaaaaccaggtaatgatccacggcattgagccaatgttagagaccccacttcagtggctgtccgaacacttgagctaccccgataacttcctccatatcagtattattccccaaccgacggactag

SEQ ID NO: 40432 - DNA, 384 bp, Artificial Sequence
  Description of Artificial Sequence: Synthetic coding sequence
atgtgctgcgccgtgagcgagcagcggctgacctgcgccgaccagatgatgccctttggcaagataagccaacagctgtgtggcgtcaagaagctcccctggtcctgcgacagcagatatttctgggggtggcttaatgccgtgttcaataaggtcgactatgatcgtatccgggatgtgggtcctgatagagccgccagtgaatggctgctacgatgtggcgctatggtcagatatcatggacaggaaagatggcagaaagactacaaccacctaccaactggccccctggataaatacaaaattcaggcgattgacgctactgactcatgtattatgagtattggatttgatcatatggaaacaagcaacatttgttgctag

SEQ ID NO: 40433 - DNA, 411 bp, Artificial Sequence
  Description of Artificial Sequence: Synthetic coding sequence
atgtgctgcgccgtgagcgagcagcggctgacctgcgccgaccagatgatgccttttgggaaaatctcccagcaactttgcggggttaagaagctcccctggagttgcgattcaaggtacttctggggctggctaaatgccgtctttaacaaggtggactacgacagaatcagggacgttgggcccgaccgagctgccagcgaatggctgctgcgatgcggagccatggtacgctatcacggccaggagcggtggcaaaaggattataatcacctgcctacaggcccattagacaaatacaaaatacaggctatcgatgccactgactcctgcattatgtcaataggattcgatcacatggggaattaccccattgtgctgctaattgaaaacgctgacgacctgcaatag

SEQ ID NO: 40434 - DNA, 783 bp, Artificial Sequence
  Description of Artificial Sequence: Synthetic coding sequence
atggccgccgtggtggtggccgccgccggcggcgccggccccgccgtcctccaggtcgctgggctgtaccgcggtctttgcgctgtccgttctcgggctcttggtcttgggctagtgagccctgcccagctccgggtttttccagtgagacccggctctgggcgcccagaaggcggtgccgattcgtctggagttggagccgaggccgaactccaggccaaccctttctacgacaggtaccgtgacaagatccagctgttgcgccgcagcgaccccgctgctttcgaatcccgcctggagaaacgatccgagttcaggaaacaacccgtgggtcattctcgccagggggattttattaagtgcgtcgaacagaagactgatgccctaggaaaacaaagtgtgaatagagggttcaccaaagataaaacattatcttccattttcaatattgaaatggtgaaagagaaaacagcagaggagattaagcagatctggcagcaatattttgcagccaaggacactgtgtacgctgtgattcccgcagagaaattcgaccttatctggaaccgtgcacaatcctgccccaccaatgtggcagaagcccagtgcatcgctaaccaagtgcagctgttctatgccaccgaccggaaggagacatatggacttgtcgagaccttcaacctccgcccaaacgaatttaagtacatgtccgttatcgctgaactggagcagtcaggactgggggccgaactgaaatgtgcccagaatcagaacaaaacatag

SEQ ID NO: 40435 - DNA, 987 bp, Artificial Sequence
  Description of Artificial Sequence: Synthetic coding sequence
atggccgccgtggtggtggccgccgccggcggcgccggccccgccgtgctccaggtggcgggactgtatcggggcctgtgtgccgtgcgtagccgtgctcttggactcgggttagtttcccccgctcagctgcgggtgttccccgtccgcccaggctccggaagacccgagggaggggccgattcaagcggagttggcgcagaagctgagttacaagccaatcctttttatgatagataccgggacaaaattcagttactccggagatctgacccggccgccttcgagtctcggctcgagaaacgaagcgagtttcggaaacagccggtggggcattctagacagggggattttatcaagtgcgtggagcagaaaaccgacgctctgggtaagcagagcgtgaaccggggcttcaccaaagacaaaacactgtcaagcattttcaatatcgagatggtcaaggaaaagaccgctgaagagatcaaacaaatctggcagcagtactttgctgctaaggatacagtgtacgcagttataccagctgaaaaatttgatctaatttggaatcgagctcagagctgccccacttttctttgtgctctacccaggcgagaaggatatgagttttttgttgggcagtggactggcaccgagctgcacttcaccgctctgattaacatccagacacgcggtgaagctgcggcaagccagctgatattgtatcactatccggagcttaaagaagagaaaggcattgtccttatgactgccgagatggatagcaccttcttgaacgtggccgaagcacagtgtatcgccaatcaggtacagttgttttacgcgacagacaggaaagaaacatatgggttggtggaaacattcaacctgaggccaaatgaatttaagtacatgtcagtaatagctgaactagagcaatctggcctgggggcagaattgaagtgcgcccaaaatcagaataaaacatag

SEQ ID NO: 40436 - DNA, 723 bp, Artificial Sequence
  Description of Artificial Sequence: Synthetic coding sequence
atgagcgaccccgccgccttcgagagccggctggagaagcggagcgaatttcggaagcaaccggtgggacacagccgccagggtgattttatcaagtgcgttgagcagaaaaccgacgccttgggaaagcagagcgtgaatagggggtttacgaaggacaagactctttcatcaatcttcaacatcgagatggtgaaggagaaaacggctgaggagataaagcagatctggcaacagtatttcgcagcaaaggacacggtttacgccgttattcctgcagagaagtttgatctgatttggaatcgagcgcaatcttgtccgaccttcctctgcgcccttcctcgacgcgagggctacgagttctttgtaggacaatggaccgggaccgaacttcacttcacagctctgattaacatacagacccgcggggaagcagcggcctcccaactaattctttaccactatcccgaacttaaagaagaaaaaggtatcgtgctgatgacggctgagatggactccactttcctgaacgttgcggaggctcagtgtatagccaatcaagtgcagctgttctacgctacagatagaaaagagacctacggtttggtcgaaacgttcaacttaagaccgaacgagtttaagtatatgtccgttatcgctgagctcgagcagtctggcctgggcgccgagttaaagtgtgctcagaaccagaataaaacatag

SEQ ID NO: 40437 - DNA, 534 bp, Artificial Sequence
  Description of Artificial Sequence: Synthetic coding sequence
atggtgaaggagaagaccgccgaggagatcaagcagatctggcagcaatactttgccgcaaaagacaccgtgtatgcagtgatcccggcagagaagtttgatctgatctggaatagggctcagtcatgcccaacctttctgtgcgctttgcctcgcagggagggctacgagttcttcgtcgggcagtggacgggcactgaactccacttcacagccctaatcaatattcagactcggggagaggctgccgcatcccaacttattttataccattatcctgagcttaaggaagaaaaagggatagtgctaatgacagccgagatggacagcacattcttgaacgttgcagaagcacaatgcattgccaatcaagtccagctcttttacgctacagatagaaaagagacttatggactcgtggaaactttcaatttacgacctaatgaatttaagtacatgtcagtcattgcagagctcgagcaatcaggtttgggggctgagctaaagtgcgcacagaatcaaaacaagacctag

SEQ ID NO: 40438 - DNA, 138 bp, Artificial Sequence
  Description of Artificial Sequence: Synthetic coding sequence
atgagcgaccccgccgccttcgagagccggctggagaagcggagcgagtttagaaaacaacccgttggacactctaggcagggtgacttcatcaagtgtgtggagcaaaaagatggcgcacaaaacaagctcgtgtag

SEQ ID NO: 40439 - DNA, 783 bp, Artificial Sequence
  Description of Artificial Sequence: Synthetic coding sequence
atggccgccgtggtggtggccgccgccggcggcgccggccccgccgtccttcaggtcgccgggctgtaccgtggcctctgcgccgtgcgatccagagctctgggcctggggttagtctcccccgcccagcttcgggtgttccctgtgaggccgggctctggaagacccgagggaggggccgacagctccggagtgggcgccgaggcagaactgcaagccaacccattttacgatagatatagagataagattcagctcctgcgccgctccgaccctgccgcctttgagtcacggctggaaaagcgctccgaattcagaaagcagccagttggccacagccgccagggtgacttcattaaatgcgtggaacagaaaacagacgctctcggtaagcagtcggtgaataggggcttcactaaggataagactctctccagcatctttaatatagagatggtcaaagagaaaacagctgaagagatcaaacaaatttggcagcagtatttcgctgccaaggacacggtgtatgctgtgattcccgctgagaaatttgatctcatttggaaccgggctcagtcgtgccccaccaacgttgctgaagcccagtgcattgccaatcaggtgcagctcttctatgcgaccgaccgcaaggaaacttacggcctagttgaaacattcaacctgaggcctaatgaatttaagtacatgtctgtgatagccgaattagagcaaagcggactgggcgcagagctcaagtgtgcccaaaaccagaataagacctag

SEQ ID NO: 40440 - DNA, 207 bp, Artificial Sequence
  Description of Artificial Sequence: Synthetic coding sequence
atgccccagctgaacaccaccgtgtggcccaccatgatcacccccatgttgctgactttgtttttaataacgcagctgaaaatgctcaacacaaattatcacttgccaccttcaccaaagcctatgaagatgaagaattacaataaaccatgggaaccgaagtggaccaagatctgtagtttgcactccctacccccacaatcatag

SEQ ID NO: 40441 - DNA, 642 bp, Artificial Sequence
  Description of Artificial Sequence: Synthetic coding sequence
atggcccccgcccagcggcccctgctgcccctgctgctgctgctgctgccactgcctccaccccccttcgcgcgcgctgaagacgcagcccgcgcaaactccgacaggtacgccgtgtattggaatcgtagtaaccccaggtttcacgccggagccggcgacgacggcggcggctacaccgtcgaagtgtctatcaatgactatctggacatatattgcccacactatggggcaccactgccccccgcagaaaggatggagcattacgtactttacatggtaaatggcgaagggcacgcgagttgcgaccataggcagaggggatttaagaggtgggagtgtaataggcccgctgctcccgggggcccgttgaaattttccgaaaagtttcagcttttcactcctttttccctgggcttcgagtttcgccctggccacgagtattactacatctctgctacccccccaaatgctgtcgacaggccttgcctgaggctcaaggtttacgttcgcccaacgaacgaaaccctctacgaagcacctgagcctatcttcacatccaataacagctgtagcagccccggggggtgtaggctctttctgtcgactatacccgtgctgtggacactcttagggagctag

SEQ ID NO: 40442 - DNA, 507 bp, Artificial Sequence
  Description of Artificial Sequence: Synthetic coding sequence
atgctgcccgccgccctgctgcggcggcccggcctgggccggctggtcagacatgcaagggcctacgccgaggcagccgccgcccccgctgcagcctcaggaccaaatcagatgtcctttacctttgcttccccaacacaggtgttctttaacggtgctaacgttagacaggtcgatgtcccaactcttacaggcgcttttgggatccttgccgcacacgtcccaactctgcaagtcttacgtcccggcttggtcgttgtacacgcagaggatgggacaacttccaaatactttgtcagcagcggaagcatcgcagtaaacgcggattcatcagtccagctgctcgccgaggaagcggtgacccttgatatgcttgatctgggggccgccaaagcaaatttggaaaaagcccaggccgagctcgtggggacagcagatgaggccacacgcgccgaaattcaaatacggattgaagcgaacgaagcgcttgtgaaggctttagaatag

SEQ ID NO: 40443 - DNA, 156 bp, Artificial Sequence
  Description of Artificial Sequence: Synthetic coding sequence
atggtggcctactggcggcaggccggcctgagctacatccggtactcacagatttgtgcaaaggtggtcagagacgcactgaaaactgagttcaaagccaatgcaaaaaaaacatcaggcaattccgtgaaaatagttaaggttaagaaagagtag

SEQ ID NO: 40444 - DNA, 771 bp, Artificial Sequence
  Description of Artificial Sequence: Synthetic coding sequence
atgctgagccgggtggtgctgagcgccgccgccaccgccgcccccagtctgaagaacgccgcctttttaggaccaggcgttctccaggccactcgaacttttcacactggccagcctcatctggtgcccgtgccaccactcccggagtacggtggtaaggtgcgatacggccttattccagaggagttctttcagttcctttatccgaagactggtgttacagggccttacgtgctggggacaggactgatcctgtacgccctgagcaaggaaatttatgtaatctccgcagagacatttaccgccctgagtgtgctgggtgtcatggtttacgggattaagaagtatggacccttcgtggccgatttcgccgataagttgaacgagcagaagctcgctcagctcgaagaggccaaacaagcctccatccagcatatccagaacgctattgataccgaaaagagtcagcaggcccttgtccagaagaggcactatctgttcgacgtgcagcggaacaacatcgcgatggctctggaagtgacatatcgagagagactctatagggtgtataaagaggtcaaaaaccggctggattaccatattagtgtgcagaatatgatgcgtcgcaaagagcaggagcacatgatcaactgggtggagaagcacgtggtgcaatccattagtactcagcaggagaaagaaactatagccaagtgcatagctgacttgaagttactcgctaagaaggcacaggcccagcctgtcatgtag

SEQ ID NO: 40445 - DNA, 588 bp, Artificial Sequence
  Description of Artificial Sequence: Synthetic coding sequence
atgctgagccgggtggtgctgagcgccgccgccaccgccggcccctacgtgcttggaactggcttaatcctttacgcgctgtcaaaagagatttacgtcattagcgctgaaacttttacagctctgtccgttctcggggtgatggtgtacggtatcaagaaatatggtcctttcgtggccgatttcgcagacaagctgaatgagcagaaattggctcagcttgaggaagccaagcaggccagcatacagcatattcaaaacgcaatcgacaccgagaaaagccagcaggcgctggttcaaaagcggcactatctattcgacgtccagaggaataatattgccatggctttggaggtgacctatagagaaagattatatagagtgtacaaggaagttaaaaacaggttggattatcacatctccgttcagaacatgatgcggagaaaagagcaagagcatatgataaactgggtggaaaagcacgtcgtgcaatcgataagtacccagcaggagaaggagactattgctaagtgtattgcagaccttaagctactagctaagaaggcacaggctcagccggtgatgtag

SEQ ID NO: 40446 - DNA, 486 bp, Artificial Sequence
  Description of Artificial Sequence: Synthetic coding sequence
atggccggccggaagctggccctgaagaccatcgactgggtggccttcgccgaaatcatccctcagaaccagaaggccatcgcctctagcctgaaaagctggaacgagactctcacctcaaggcttgccgctctccccgagaatccacctgccatcgactgggcctattacaaagccaacgtggccaaggccgggctcgtcgacgatttcgaaaaaaagttcaatgctttgaaagtgcccgtacctgaagataagtacactgcccaggtggatgcggaagaaaaagaggatgtgaagtcttgcgctgaatgggtcagtctctcaaaggcccggattgtcgaatacgagaaagagatggagaaaatgaagaacttgatcccctttgaccagatgacgattgaggatctcaatgaagccttccccgagacgaaattagacaagaaaaagtatccatactggccacaccaacctatcgaaaatttatag

SEQ ID NO: 40447 - DNA, 414 bp, Artificial Sequence
  Description of Artificial Sequence: Synthetic coding sequence
atggccggccggaagctggccctgaagaccatcgactgggtggccttcgccgaaatcattcctcagaatcaaaaagcgatcgcttccagtctgaagtcatggaatgaaacactgacatcccgcctcgcagcgcttccagagaacccacccgccatcgactgggcctattataaagccaatgtggccaaggcaggactcgttgacgatttcgagaagaaagtcaaaagttgcgccgagtgggtgtccctgtccaaggcccgcattgttgaatatgagaaggaaatggagaaaatgaagaatctaatcccgtttgatcagatgaccatcgaggatcttaatgaggcattccctgagactaagttagacaaaaaaaagtacccttattggccacaccagcccatcgagaacctgtag

SEQ ID NO: 40448 - DNA, 309 bp, Artificial Sequence
  Description of Artificial Sequence: Synthetic coding sequence
atggccggccggaagctggccctgaagaccatcgactgggtggcctttgcagagatcattccgcaaaatcagaaggcaattgccagctcattaaaatcctggaacgaaaccttgacttcaagactcgctgcactgcctgaaaatccacccgccatcgattgggcttactacaaggctaatgttgcaaaagctggcctggttgatgatttcgaaaagaagttcaatgccctgaaagtgcccgttccagaagataagtatacagcacaggtcgacgccgaagaaaaagaagataagaagaagaaaaagtag

SEQ ID NO: 40449 - DNA, 285 bp, Artificial Sequence
  Description of Artificial Sequence: Synthetic coding sequence
atggccagcgtgggcgagtgccccgcccccgtgcccgtgaaggacaaaaagttgctggaagttaaactgggcgaactgccatcttggatcttaatgagagattttagcccaagtggaatattcggcgcctttcagagaggttactacagatactataataagtacataaacgttaaaaaaggctcaatctcagggatcacgatggtgttggcttgttacgtactgtttagctactcctttagctataaacacttgaagcatgagaggctgcgcaaatatcattag

SEQ ID NO: 40450 - DNA, 168 bp, Artificial Sequence
  Description of Artificial Sequence: Synthetic coding sequence
atggccagcgtgggcgagtgccccgcccccgtgcccgtgaaggacaagaaactgctcgaagtcaaacttggtgaactcccctcctggattctgatgcgcgacttttctcccagcggaatctttggcgcatttcagcgcgagcacgagcgcctgcggaaataccactag

SEQ ID NO: 40451 - DNA, 267 bp, Artificial Sequence
  Description of Artificial Sequence: Synthetic coding sequence
atggccagcgtggtgcccgtgaaggacaagaagctgctggaggtgaagctgggggagctcccaagctggatcttgatgcgagatttctcccctagtgggatcttcggtgcctttcagaggggttattaccgttactataataagtacattaacgtcaagaaggggtcaatcagcggcatcactatggtattggcatgctacgtactattcagttacagctttagttataaacacctcaagcatgaacgcctgcgaaaatatcactag

SEQ ID NO: 40452 - DNA, 150 bp, Artificial Sequence
  Description of Artificial Sequence: Synthetic coding sequence
atggccagcgtggtgcccgtgaaggacaagaagctgctggaggtgaaattgggtgagctgcccagttggatcttgatgcgggacttttcacctagtgggatttttggcgcattccaacgcgaacatgagagactgaggaaatatcactag

SEQ ID NO: 40453 - DNA, 267 bp, Artificial Sequence
  Description of Artificial Sequence: Synthetic coding sequence
atgagcagcaagctgcccgtgaaggacaagaagctgctggaggtgaagcttggggagctacccagttggattctcatgagagactttagtcctagcggaatttttggcgcattccagagggggtactaccggtactataataagtatatcaatgtgaagaaaggttccatctccggaatcactatggttctagcatgctacgtgctcttttcctacagtttcagttacaagcacctaaagcacgagcgcctgcgcaagtatcattag

SEQ ID NO: 40454 - DNA, 312 bp, Artificial Sequence
  Description of Artificial Sequence: Synthetic coding sequence
atggcccagttcgtgcggaacctggtggagaagacccccgccctggttaatgcagccgtcacatactctaaaccccgtcttgctaccttttggtactacgcgaaggtggaactggtcccccctaccccagccgagatccctcgagctattcagtctctaaagaagattgtcaatagcgcccaaaccgggagcttcaagcagctcaccgtcaaagaggccgttttgaacggcctcgtggcaactgaagtcctgatgtggttctatgtgggggagatcattggcaagcggggcatcattggctacgacgtctag

SEQ ID NO: 40455 - DNA, 303 bp, Artificial Sequence
  Description of Artificial Sequence: Synthetic coding sequence
atggcccccttcgtgcggaacctggtggagaagacccccgccctggtgaatgccgcagtgacctacctgaagcccaggttagcagctttctggtattacactactgtggagctggtgccgcctacccccgctgaaattcccagggccattcagagtctcaaaaagattgtgtcaagtgctcagaccggtagttttaaacagctcaccgtcaaggaagcattgctcaatgggctagttgctactgaggtgtctacatggttttatgtgcgggagatcaccggcaagcggggaattattggctag

SEQ ID NO: 40456 - DNA, 648 bp, Artificial Sequence
  Description of Artificial Sequence: Synthetic coding sequence
atgtgctgcgccgtgagcgagcagcggctgacctgcgccgaccagatgatgccgtttggaaagatctcacaacagctgtgtggtgttaagaaactaccgtggtcatgcgattctaggtatttttggggatggctgaatgctgtttttaataaggttgattatgatcgcattcgggatgtggggcctgatagggctgcgtctgagtggctgctgcgctgtggagctatggttcgctatcatggtcaggagagatggcagaaggattataaccacttacccacgggtccccttgataaatataaaatccaggccattgacgcgaccgacagctgtattatgagcataggctttgatcatatggaagggctggagcacgtcgaaaaaattaggctctgcaaatgccattatatcgaggatgattgtctgctacggttatctcaacttgagaatctgcagaagactatcctagagatggaaataattagttgtggcaacatcaccgataaaggcatcatcgcccttaggcatctgcgcaacctgaagtatctgcttttaagcgacctgccaggcgttagagagaaagagaacttggtgcaagcattcaagaccgccctacccagtttagaactcaaactccagcttaagtag

SEQ ID NO: 40457 - DNA, 801 bp, Artificial Sequence
  Description of Artificial Sequence: Synthetic coding sequence
atgatccggggcagcggcgccgaggcctgcagcaacgaggacggctgctctgaaaagggtatgaaaggggtcgattatgaccggatcagagacgtcggaccggatcgggccgcttctgaatggctccttcggtgcggcgcaatggtccgttaccacggccaggagcgctggcaaaaggattataaccacctacccaccgggcccttagataagtataagatccaggcgatcgacgcgaccgattcctgcataatgagcatcggctttgatcatatggaagggctggaacatgtggaaaagatacgcctgtgcaagtgccactatatcgaggacgactgtctccttcgcctgagccagctggaaaacctgcagaaaactatcctggagatggaaatcatttcgtgcgggaacatcactgacaaaggaataattgccttacgccatctacggaatctgaaataccttttgctgtcagatcttccaggcgcaggcaatcctggaccatgcgtagcatctggctcctcccggacccgcgccccactggggtttcgtgaaagagggctccaggaaactgacgtccctggagctctggttgatcgctcttacgacctttcaccaagcgcaggcatgcggatgctcgaattaaaggccaccactgctattctaaagagccggttccagttatccgtacccggcggatcactccttttcaaacaatctcccgtggggcattcatccatctctttttggccatataaggctatcctgaggcaaagcagggcaggagataatcaggagtag

SEQ ID NO: 40458 - DNA, 444 bp, Artificial Sequence
  Description of Artificial Sequence: Synthetic coding sequence
atggccggccggggcaagctgatcgccgtgatcggcgacgaggacaccgtgaccggattcttattaggtgggattggagaactgaataagaaccggcatcctaattttctggtagttgagaaggacaccacaatcaacgagattgaggacacttttagatctcttggatcccttccaggaagcgttgtcgaggctaatcccaaccagagggacccgccgctctgggacgaaatcgatagcagacagttcctgaatcgtgatgatattggcattatccttatcaatcagtatattgccgaaatggtgagacatgcactggacgcacatcagcaatccatcccagccgtcctagagatccctagcaaagaacacccctatgacgccgccaaagattcaatcctcaggcgcgccagaggcatgtttaccgcagaggacctgcgctag

SEQ ID NO: 40459 - DNA, 321 bp, Artificial Sequence
  Description of Artificial Sequence: Synthetic coding sequence
atggccgtgaccgccctggccgcccggacctggctgggcgtgtggggagtgcgcaccatgcaggccaggggctttggttctgatcagtctgagaatgtagacaggggggctgggtcaatacgcgaggctgggggtgcgttcgggaaacgcgaacaagctgaagaggaacggtattttcgagcgcagagtagagaacagctcgccgccttaaagaagcaccatgaagaggaaattgttcaccataaaaaagagatagagcgccttcagaaggaaattgagaggcacaagcaaaaaatcaagatgttgaaacacgacgactag

SEQ ID NO: 40460 - DNA, 183 bp, Artificial Sequence
  Description of Artificial Sequence: Synthetic coding sequence
atggccgtgaccgccctggccgcccggacctggctgggcgtgtggggagtgcgtacgatgcaggcccgtggcttcgggtccgatcagagtgagaatgtggaccggggggcaggcagcatacgggaggcagggggggcatttggcaagagagaacaagcagaggaagagcgttatttccgttag

SEQ ID NO: 40461 - DNA, 216 bp, Artificial Sequence
  Description of Artificial Sequence: Synthetic coding sequence
atggccgtgaccgccctggccgcccggacctggctgggcgtgtggggtgttcgaaccatgcaagccagaggattcgggagtgatcagtcagaaaatgtagatagaggggcaggatccatcagagaggccggcggtgcctttggtaagcgagagcaggcggaggaggaacgttactttcgtcactaccggctctgtttcgagatcagcctggggtag

SEQ ID NO: 40462 - DNA, 3261 bp, Artificial Sequence
  Description of Artificial Sequence: Synthetic coding sequence
atggagaagtgggaggagctgaacagccaccagcccggcgaggagtatgatcccagcaaagcaacattcgtaaaagtggtccctacaccaaataacggtagcaccgagttggttgctttacatagaaatgagggcgaggacggcctcgaggttctgagctttgagtttcaaaagataaaatatagctatgatgctctagagaagaagcagttcttgcctgtagctttccctgtaggaaacgcttttagctattatcagagcaatcggggctttcaagaggactcagagataagagccgctgagaaaaaatttggcagcaacaaggcggagatggtcgtgcctgactttagcgaactgtttaaggagcgcgctaccgctcctttctttgttttccaggttttttgcgtgggcctgtggtgcttagatgaatactggtattacagcgtgttcaccctgtccatgctcgtggcttttgaagccagcctggtgcagcagcagatgaggaacatgtctgagattcgcaagatggggaacaagccccatatgattcaagtctatcgctcacgaaaatggagacccatcgcaagtgacgaaatagtgcccggcgacattgtctccataggtaggagccctcaggaaaacctagtaccctgcgatgtcttgctcttacgcggcaggtgcattgtggatgaagctatgttgaccggcgaatccgtccctcaaatgaaggagcctattgaagacctgtccccggacagagtactggacctgcaggccgatagtaggctgcacgtgatttttggaggaactaaagttgtacagcacatcccccctcagaaggccacaacagggctgaaacctgtagactccggctgcgtcgcctatgtactgaggacgggtttcaacacctcacagggcaagctgctgcgcaccatcctgttcggcgtgaaaagagtgactgctaataatctagaaacttttatctttatactttttctcttagtctttgctatcgccgccgcagcctatgtttggatagaaggtacaaaagatccttctaggaatagatacaaattgtttttggagtgtacccttatcttgaccagcgtcgtgcccccagaattgccaattgagctgtcactcgcagtcaacacctctctgattgcgttggccaagctgtacatgtattgcactgagcctttccgcatcccttttgctgggaaagttgaggtatgttgctttgacaaaaccggaaccttgaccagcgactccctggtggtgcgcggcgtagccgggctgagagatggaaaagaggtaacacccgtgtcgagcatccccgtagagactcaccgggcgctcgcatcttgccacagtctgatgcagcttgacgatgggactctggtcggagatcccctggaaaaagctatgctcacagcagtcgattggaccctgacaaaggacgaaaaagtgtttcccaggagtattaagactcaaggactgaaaattcatcaacggttccacttcgcgagcgcacttaagaggatgtctgttctggcatcatacgagaaactgggcagtaccgacctgtgctacatagccgctgtgaaaggggcacccgagaccctccactctatgtttagtcagtgtcctcctgattaccatcacatccacacagagatctcacgcgaaggggctagagtcctggccctgggatataaagaattgggtcacctcacccaccagcaggctcgcgaggtgaaacgagaggcgctcgagtgttccctgaagtttgtagggtttattgtggttagctgcccccttaaagcggactccaaagcggtaattcgagagatccagaatgcaagccatcgggtagtgatgataacaggagataatccattaaccgcttgccatgttgctcaagagttgcactttatcgaaaaggctcatactttgatcctccaacccccttcagagaaaggaagacaatgcgaatggcggagtattgatggctccatcgtgcttcctttggcaagggggagcccaaaggcattggccttagagtacgctttgtgcctgacgggggatggtctcgcccacctgcaggcgacagacccccaacagctgctcagattaatccctcacgtgcaagtttttgctcgtgtggctccgaaacagaaggagtttgttattacgagcctgaaagagctcggctacgtgaccctgatgtgtggtgatggtacaaatgacgtaggcgctctgaaacacgcagatgtgggcgtggctctgctggccaatgcccccgaaagagtcgtggaaagacgcagacgtcctcgggattcccctacgctctcaaatagcggcatcagagccacatctaggacagccaaacagcgatccggtctcccaccttccgaggaacagccaacgtctcagcgggatagactgtcccaggtactgagagatctggaagacgaatcgactcccatagtaaaactcggggacgccagcatcgcggcacccttcacttccaaactgtcaagcatacaatgtatatgccacgtaatcaagcaaggacggtgtacgttggttacaaccctgcagatgttcaagattctggctctgaacgcactaattctggcctattctcaatccgtgttatacctggagggcgttaaattcagcgattttcaggcaacgttgcaggggctcttgctcgccgggtgcttcctcttcattagccggagcaagccattgaaaactctcagtcgcgagcggcctttacctaatatattcaatctatataccatactgaccgtaatgcttcagttttttgtccattttttaagtctggtatatctgtatcgggaagcgcaagcccgctcaccagaaaaacaagagcagtttgtggatctgtacaaagaatttgaaccaagcctcgttaattccacagtgtatattatggccatggccatgcagatggctacttttgccatcaattacaaaggtccccctttcatggagagcctgcccgaaaacaagccactggtgtggagtttggcggtcagcctgcttgcaatcataggtctgctattaggttcttccccagatttcaattctcaatttgggcttgtggacatccccgtcgaattcaaactcgtgattgcccaggtcctgctgctcgacttctgcctggcacttctggcagatcgagtactgcagtttttcctaggaacccctaagctgaaggtgccctcgtag

SEQ ID NO: 40463 - DNA, 3615 bp, Artificial Sequence
  Description of Artificial Sequence: Synthetic coding sequence
atggccgccgccgccgccgtgggcaacgccgtgccctgcggcgcccgtccgtgcggtgtccgccctgacgggcaacctaagccaggaccgcagcctcgtgcgctgttagctgcggggccagccttaatcgctaatggagacgagctggtagcagccgtgtggccctatagaaggctggcgctgcttcgccggctgaccgtgctccccttcgccggactcctgtatcctgcctggctgggagccgccgcagccggatgctgggggtggggctcttcttgggtacagatcccggaggccgcccttctcgttctggctactatatgcctcgcccatgcacttactgttctaagtggacattggtccgtccatgcccactgtgcgctgacatgcacccccgagtatgaccccagtaaagccacgttcgtcaaagttgtacctaccccaaataatggtagtaccgagctcgtggccttacatagaaatgagggggaagacggactggaagtgttaagcttcgaattccagaaaataaaatactcctacgacgcactcgaaaagaagcagtttttgcctgtcgcattcccagtgggcaacgctttcagctactatcaatccaatcgcggatttcaggaagactcggagattcgggccgccgagaaaaaattcggcagcaacaaggccgaaatggtcgttcctgactttagcgagctgttcaaagaaagagcaaccgctcctttctttgtctttcaggtgttttgtgtgggactatggtgtttggatgaatactggtattacagcgtattcacccttagcatgctggtcgcttttgaggcatcgcttgtccagcaacaaatgcggaacatgagtgagattaggaaaatggggaataaaccccatatgattcaggtgtacagaagtagaaaatggaggcccatagccagcgatgagattgttcccggcgatatcgttagtataggacgctcaccacaagaaaaccttgttccatgtgacgtgctgttgcttcgtggacggtgtatcgtcgacgaggccatgctcaccggagagagcgtgccacagatgaaggagcccattgaagatctgagtcctgaccgggtacttgacctccaagctgattccaggctccacgtgatctttggaggcactaaagtggttcagcatattcctccacagaaagcgaccacaggcctgaaaccagtggactctggatgcgtggcctacgtcctgagaaccggcttcaatacctcacagggtaagctcctgagaactatcctgtttggtgtgaaacgagtgacagccaataatctcgaaacattcatcttcatactgttcctactagtatttgcaatcgctgcagccgcatacgtctggattgaaggcactaaggatcccagcagaaatagatataaactcttcctcgagtgcacattgatccttactagtgtcgtccctccagaactccccatagaactttcacttgctgttaacacgagcctaatcgcattagctaagttgtatatgtattgtaccgagccctttaggatccccttcgccggcaaggtggaagtgtgctgctttgataagactggtacgttgacatcagactcactcgtggtaaggggagtggcaggccttcgtgatgggaaagaagtcacccctgtgtcgtctatccccgtggagacgcatcgggcattagccagctgccattccctcatgcagcttgatgatgggacgctcgtcggggatccactcgaaaaggccatgttgaccgctgtcgactggacgcttacaaaagacgagaaggtgtttcctagatcaatcaagacacaagggctgaagatccaccagcggtttcacttcgcttctgctctgaaacggatgtccgttttggcatcatacgagaaacttggcagtacggatctttgttacattgccgccgtcaagggagcccctgagactctacatagcatgttttcacaatgtccgcctgattatcatcatatacataccgagattagcagggagggcgcgcgggtcctagcactaggttacaaggagcttggccacctgactcatcagcaggcaagggaagtaaagagagaggcactggagtgctcactcaagttcgtgggctttatcgttgtttcctgccctctcaaggctgactcaaaggcagttatcagagaaatccaaaatgcatcacaccgtgtggtgatgattacgggagacaacccactcactgcctgccacgtggctcaggaactccattttatcgagaaagcccataccctgatcctgcagccaccctctgaaaaaggacggcagtgcgaatggcgatccattgacgggtcaattgtccttcccctggcccgcggctcacccaaggcgttggcactagagtacgcattgtgtcttaccggtgacggcctcgcccacttgcaagccacggacccacagcagttattacgacttattccacacgttcaggtcttcgcccgagttgcccccaaacagaaggagttcgtcatcactagcctgaaggaactcggctatgtgactttgatgtgtggagacggcacaaacgatgttggggcccttaagcacgcggatgtgggcgtcgctttgctcgccaatgcaccagagcgagtggtggagaggaggcggcgcccaagagacagcccaactttgagtaactcagggatcagagctactagtcggacagccaagcaaaggagcggcttgccaccctctgaggagcagccaacatctcaaagggacagactctcacaggtgctgcgtgaccttgaagacgaatccactccaatcgtcaagctgggtgacgcaagcatcgcggccccgtttaccagcaaactttcctctatccagtgcatttgtcatgtgatcaagcaagggcggtgcacacttgtgaccactctccagatgttcaagatcctcgcgctgaatgccctgatcttggcttactcccagtctgtactgtacctggagggggtcaagttctccgatttccaggctaccctgcagggcctgctgctggctggctgcttcctgtttatttctaggagtaaaccactaaagacacttagccgagagcggcccctgcccaatatttttaatctttatactatcctcaccgttatgcttcaattcttcgtgcacttcctgtctctcgtgtacctgtatagagaggcccaggcacgttctcccgagaagcaggaacagttcgtggatctttataaagagtttgagccaagcctggtcaacagtacagtctatatcatggccatggccatgcagatggcaaccttcgcaattaactataagggtccaccgttcatggagtcgctccccgagaacaagcctctcgtctggtctttggctgtgtcactcctcgcaatcatcggcctgctgttaggcagcagcccagactttaacagccagtttggcttggtggatattcccgtggagttcaagctggtgatagcccaggtactgctgctcgacttttgtctcgctctgctggctgatagggtgcttcagtttttcctaggaacccccaaactgaaggtgcctagttag

SEQ ID NO: 40464 - DNA, 3681 bp, Artificial Sequence
  Description of Artificial Sequence: Synthetic coding sequence
atggaccgggaggagcggaagaccatcaaccagggccaggaggacgaaatggaaatttatggatacaacctaagcaggtggaaattagcaatcgtttccctgggagtgatatgcagcggcgggtttctgctgctcctactgtattggatgcctgagtggcgcgtgaaagcgacatgtgtgcgagcagccattaaggactgtgaagttgtcctgctgcgcaccactgatgagttcaaaatgtggttttgcgccaagattagggtactgtctctggagacttaccctgtgtcctctcccaaatccatgtctaacaagctgtccaatggccatgcagtgtgcctgattgaaaacccaacagaagagaataggcatcgcatttcaaagtactctcagacagagagccagcagattagatatttcacccaccacagcgtcaaatacttctggaatgacaccattcataattttgactttttgaaaggtctggacgagggcgtcagctgtacttcaatctatgaaaaacactcagcggggctgacaaaaggcatgcatgcatatcgcaagctactgtatggagtaaacgagattgccgtgaaagttcccagtgtgttcaagcttctgatcaaagaggttttaaaccctttctacatctttcagctcttctctgtgatcttatggagcactgacgagtattactattatgccctggctatcgttgtgatgtctatcgtcagcatcgtaagcagcttgtattcgattcgcaagcaatacgttatgttgcatgatatggttgcgacacactccaccgttagagtctccgtgtgcagagtcaatgaggagatcgaagagatcttttctacagatctggtcccaggcgacgtcatggtgatccctcttaatggcaccatcatgccctgtgacgctgtcttgattaacggaacttgcattgtgaacgagtctatgctgactggagagtccgttcctgtcacgaagacaaacctgccgaacccaagcgtcgacgttaaagggattggcgatgagctgtacaacccagaaacacataagaggcatacgttattttgtggaacaaccgtaattcagacgcggttttatacaggagagctggttaaggcaattgtagtgaggacaggtttcagcaccagcaagggacagctggtgcgatccattctgtatcctaaacctacagactttaaactgtaccgggatgcatatcttttcctactttgtctcgtcgcagtggctggcatcggcttcatctacacaattattaacagcattcttaacgaggtgcaagtcggtgtgatcatcatagaaagcctcgatattataactataaccgtgcctccagccctgccagctgccatgacagcggggattgtgtatgctcagcggcggcttaaaaagattggaatattttgcatctcaccccaaaggatcaatatctgtggacagctgaatctggtgtgctttgacaagaccggaactttgactgaggatggtctggacctttgggggatacagcgcgttgagaatgctcgctttctgagtccagaggaaaacgtctgcaacgagatgctggtgaaatcccagtttgtcgcctgcatggctacctgtcacagtctgactaagattgaaggagtgttatccggtgaccccctagatttgaaaatgttcgaagcgattggatggattttggaggaagccactgaagaggagactgccctccacaaccggataatgcctaccgtggtccgaccgcctaagcagctcctgccagagtccaccccagccggcaaccaagagatggagctgtttgaattgccggccacgtacgaaattggaattgtgaggcaatttccgttctcctctgcccttcagcgtatgtctgtcgtggcccgcgtgctcggagatcgaaaaatggatgcctacatgaaaggcgctccagaggcaatcgcaggcctctgtaagccggaaacagtgccagtggattttcagaacgtgcttgaagatttcactaagcagggttttcgggtaattgcccttgctcaccggaaattggagtccaagcttacttggcacaaggtccagaatatcagtcgggacgctattgaaaataacatggattttatgggactcataattatgcagaataagctgaagcaggagacacccgccgtgcttgaggacctccataaagccaatattcggactgtgatggttacgggtgactctatgctcactgccgtttccgtcgcgagggattgcggcatgattttaccacaggacaaggtgatcatcgcagaagctctcccacctaaggatgggaaagtggctaaaatcaattggcactatgccgatagtctgacacaatgttcccacccttctgctatcgaccccgaggcaattcccgttaaacttgtccacgactctctggaggatttgcagatgacgcgctaccattttgccatgaatggaaaatccttcagtgtcattttggagcacttccaggacctggtgcccaagttaatgttacatggtacagtcttcgcgagaatggcaccggatcagaaaacacagctgatagaggcactgcagaacgtagactattttgtgggcatgtgcggtgacggggcaaacgattgtggggcactgaagagagcacatggaggaatcagtctgtctgaactggaggcatccgtggcctcgccgtttactagcaagaccccttccatttcgtgcgttccgaacttgattcgagagggaagagcagcccttatcacttcattttgcgtttttaaatttatggcactatatagtataatccagtatttcagtgtgacacttttgtattcgatcctaagcaacttgggagatttccaattcctgtttatcgatctggctatcattcttgtggtcgtctttaccatgtctcttaacccagcttggaaggaactcgtggcccagcgcccacctagcggcctgatatccggagcgctcctattttccgtgctgtcacagataattatctgcataggctttcagtccctgggcttcttttgggtgaagcagcagccttggtacgaggtgtggcatcctaagtcagatgcatgcaatacgaccggaagcggtttttggaactcatcgcacgtggacaatgagacagaactggacgagcataatatccagaattacgagaacaccacggtcttctttatctctagtttccaatatctaattgttgccatcgccttctccaagggaaaaccctttcggcaaccttgttataaaaactacttttttgtgttcagtgtcatcttcctgtacatctttatcttgtttattatgctgtacccagtcgcatccgttgaccaggtacttcagattgtttgtgtgccatatcagtggcgagtgacaatgctgatcattgtcctggtcaacgccttcgtgtccataacagtggaagaatcggtggaccgttggggaaagtgctgcttaccctgggccctgggatgtagaaagaagacacctaaggcaaaatacatgtatttagctcaggaacttctagtggatcctgagtggcctccaaaaccacagactacgactgaagccaaggcgcttgtgaaggagaacggctcttgccagattattactataacctag

SEQ ID NO: 40465 - DNA, 2151 bp, Artificial Sequence
  Description of Artificial Sequence: Synthetic coding sequence
atggtggccacccacagcaccgtgcgggtgagcgtgtgccgggtgaacgaggaaatcgaggagatcttttctaccgacctggtcccgggggacgtgatggtcattcccctcaatggcactatcatgccttgtgatgctgtacttattaacggcacttgcatagtcaatgagtccatgctcaccggagagagcgtgccagtgactaagaccaatctgccaaacccgagcgtcgatgtaaagggcatcggagatgagctatacaaccccgaaactcataaacgccatacgcttttctgcgggaccacggtgatccagaccagattctatacgggagagctggtgaaggctatagttgtgcgcaccggatttagcacatctaagggtcaattggtgcggagcatcctttatccaaagcctacagatttcaagttatacagagatgcttacctgttcctcctgtgcctggtagcagttgcaggcataggcttcatatacacaatcatcaactcaattctcaacgaggtccaagtaggggtcataattattgaatctctcgatatcataaccattacagtcccacccgcccttccagccgctatgaccgccggaatcgtctatgcccagagaagactaaagaaaatcggcatcttttgtatttccccccagaggattaatatttgcggacagctgaatctggtgtgctttgacaagactgggaccctaacagaggatgggttggacctttggggaatccagagagtcgaaaatgcaaggtttttgtcccctgaggaaaacgtctgcaatgaaatgctggtgaaatcacaatttgtggcttgcatggctacttgccacagcctaacaaaaatagaaggggttctgtccggcgatcctctcgacctgaagatgttcgaggccataggttggattctggaggaggccacagaggaagagacagctttacacaatcgtatcatgccaacggttgttagacccccaaagcaactcttacctgaaagcacccctgccggcaaccaggaaatggaactgttcgaattgccagcgacctacgaaatcggaatagtgcgtcaattccctttttcttcagctctgcagaggatgtccgtggtggctagggtgctgggagataggaaaatggacgcctacatgaagggcgcccccgaggctattgccggattatgtaagcctgaaactgtacctgtggactttcagaacgtgctcgaagacttcaccaagcagggattccgcgtaattgctctggcccacagaaagctggaatctaagctgacatggcataaggtgcagaatatttcacgtgacgctatcgaaaacaatatggattttatgggccttatcattatgcagaacaagctcaaacaggagaccccagcagtgctggaagatctgcacaaggctaacattcgaaccgtgatggtgacgggagactccatgcttaccgccgtgagcgtagctagggactgtggcatgatcctaccacaggacaaagtgatcatagcggaggctctccctcctaaggatggaaaggtggctaagataaactggcactatgccgactccctgacccagtgctcacacccctctgcaattgatccagaagccatccctgtgaagctggtgcacgattcactggaagatttgcagatgacccggtatcactttgctatgaatgggaagtcctttagtgtgatcctggagcacttccaggacttggtgcctaaattgatgctccacggcactgtcttcgccagaatggctcctgatcagaagactcagctgatcgaagcactgcagaatgtcgattactttgtgggcatgtgcggagacggtgcgaatgattgtggggccctgaagagagcccacggagggatatccctgtccgagctggaggcgtcggtcgcgagcccatttacgagtaagactcctagcataagctgcgtgccaaatctcattcgtgagggacgggcagcgcttatcacctcgttctgcgagctagccttattttcaatcgtaacctattcgttagatcactttataataagcatcctgatctccaatatgctggtcctgttcttctcggatttccataattgtgcattctattcactggtgtag

SEQ ID NO: 40466 - DNA, 3681 bp, Artificial Sequence
  Description of Artificial Sequence: Synthetic coding sequence
atggaccgggaggagcggaagaccatcaaccagggccaggaggacgaaatggagatctatggctacaatctgtctcggtggaaactggccatcgtgtcccttggcgtcatctgctccggcggtttcctcttgcttctgttgtattggatgcctgagtggagggtgaaggccacgtgcgtcagggccgctatcaaggattgtgaggtggtgttactgagaaccacagacgagtttaagatgtggttttgcgccaaaattagagtcctctccctggagacctatcccgtatcgtcccctaagtccatgtctaataaacttagcaatggtcatgccgtgtgcctgattgagaatcctactgaagaaaatcggcaccggatcagtaaatattctcaaacggagtcccagcagattcggtactttacccatcatagcgtcaaatacttttggaacgatacgatccacaattttgacttcctgaagggcttggatgaaggcgtgtcttgtacttctatatatgagaagcactccgcaggactaacgaaaggcatgcacgcttacaggaaactcctttacggggtgaatgaaatcgccgtgaaggtgcccagtgtgttcaagctgttgattaaggaagtcctgaatccattctatatattccagctgtttagcgtgatcctgtggtccaccgacgagtattactattacgccctggcgatcgtcgtgatgtcaatcgttagcatcgtatcctccctgtattccatcagaaagcagtatgtcatgcttcacgatatggtggctacccattctacagtgagagtctcggtctgtcgtgtgaatgaagaaatcgaagaaatcttcagcactgatctggtgcctggtgacgtgatggtgatccccctgaacggcaccatcatgccttgtgatgcagtgctcataaacgggacctgtatcgtgaatgagagcatgttaaccggcgaatcagttcccgtcaccaaaacaaatctccccaatccttctgttgacgtaaagggcattggtgatgaactttacaacccagagacccataaacgccataccctgttctgtggcacaaccgttattcagactcgattttacactggcgaactagtgaaggccatcgttgtgcgtacagggttctccacctccaaaggccagctggtacggtccatcctgtaccctaaaccaacggatttcaaactctatagagatgcttacctgtttctactctgcctagtcgctgtggccggtatcgggtttatctatacaatcattaactccattctgaacgaggtgcaagtcggggtgattattatagagagcctcgacattatcacaataactgtgcctccagccctccctgccgccatgacagctggcattgtctacgcccaacggcgcctcaagaagataggaatcttctgtattagcccacaacggatcaacatctgcgggcaactgaacttggtctgcttcgacaagaccggcaccctgactgaggatgggcttgacctgtggggcatccagagggtcgagaatgccagattcctgagcccagaggagaacgtgtgtaacgagatgctggtgaagtctcagtttgttgcatgcatggccacgtgtcacagcctgacaaagatcgaaggcgtgctgtcaggagatcctttagatttgaaaatgttcgaagccataggctggattctggaggaggcaaccgaggaggaaaccgccttgcataatcgtatcatgccaactgtggtcaggcccccaaaacagctgctcccggagagcactcccgcaggcaaccaggaaatggagctgtttgagctacctgcaacctacgagattggcatagtacgtcagttcccattcagctctgctctgcagaggatgtccgtcgtcgccagggtcttgggggacagaaaaatggacgcatacatgaaaggcgccccagaggctatagctgggttatgtaagcccgagacagttcctgtggacttccaaaatgtgttggaggacttcacaaaacaggggtttcgggtgattgcccttgcccatcgtaagttggaaagcaagttgacatggcataaagtgcagaatatttctcgggatgcaatcgagaataatatggattttatgggactgataatcatgcaaaataagcttaagcaggaaacccctgccgttctggaagacctgcataaagccaacattcgaacggtgatggtgaccggggacagtatgctgactgccgtttctgtggcccgcgactgtggcatgattctcccccaggacaaggttatcatcgccgaggcccttcctcctaaagatggaaaggtcgctaagatcaactggcactacgcggattccctcacccagtgctcgcatccatccgcaatagatcccgaagcgattcctgtgaagctggtacacgactctttggaggacttgcagatgactcgctatcacttcgcaatgaatggtaaatctttcagcgtcattttggaacactttcaggatctcgtgccaaagttaatgcttcatggtactgtttttgccagaatggcccctgaccagaaaacgcagctaatcgaggccctgcagaacgtcgactattttgtcggaatgtgcggcgatggcgccaacgattgcggcgcactgaagagggcacatgggggcatatccctgagcgaactggaggcctccgtcgcatccccattcacctccaagacgccctccattagctgcgtgcctaatctgatccgcgaggggagggcagctctgatcacctctttttgtgtctttaaatttatggcactctattccattattcagtatttcagcgtcacgctgctgtattcgattctgtcaaacctcggtgattttcagttcttgtttatcgatctcgccatcattttggtggtggtgtttacaatgtctctgaatcctgcctggaaagagcttgtagctcagagacctcctagcggcctaataagtggagcccttcttttctccgtgctcagccagattatcatatgcatcggctttcagtccctcggctttttttgggttaaacagcagccgtggtacgaagtatggcatcccaagagcgatgcttgtaacactacaggcagcgggttttggaattcctcccatgtggacaacgagactgaactggacgaacacaatatccagaactacgagaataccaccgtcttcttcatctcaagcttccagtatcttattgtcgctatcgcattcagcaaaggcaagcctttccgtcagccctgctacaagaactatttttttgttttttcggttatttttctgtacatcttcatactgtttattatgctttaccccgttgcatccgtagatcaggttctccaaattgtatgcgttccgtatcagtggagagtgacgatgttgattatagtcctggtcaatgcattcgtgagcataaccgtggaggaaagcgtggatcgctggggcaaatgctgtcttccctgggccctgggatgtcgcaaaaaaacacccaaggcaaagtacatgtatcttgcacaggaattgctcgtagacccagagtggccccccaagcctcagaccacaacggaagctaaggctctagtgaaggaaaatggcagctgtcagataatcactataacatag

SEQ ID NO: 40467 - DNA, 144 bp, Artificial Sequence
  Description of Artificial Sequence: Synthetic coding sequence
atggaccgggaggagcggaagaccatcaaccagggccaggaggacgaaatggagatctacggctacaaccttagccgttggaagcttgctattgtgtctttaggagttatttgttccggtggctttctgcttctcctgttgtag

SEQ ID NO: 40468 - DNA, 312 bp, Artificial Sequence
  Description of Artificial Sequence: Synthetic coding sequence
atggaccgggaggagcggaagaccatcaaccagggccaggaggacgagatggaaatctatggctacaatctcagtcggtggaaactggctatcgtttcactcggcgtcatttgctccggcgggttcttgctgctacttctgtactggatgcccgagtggcgggttaaggcaacatgcgtgcgagctgcaattaaagactgcgaggtggtgctgctgaggaccacggacgaattcaagatgtggttttgcgccaaaatacgtgtacttagcctcgagacttatcctgtctcttctccaaagagtatgtcctag

SEQ ID NO: 40469 - DNA, 1731 bp, Artificial Sequence
  Description of Artificial Sequence: Synthetic coding sequence
atgggccacttcgagaagggccagcacgccctgctgaacgagggcgaagaaaacgagatggagattttcgggtacagaacacaagggtgccgcaagtctctctgccttgccgggagtatcttctcctttgggattctccccctggttttctactggaggccagcctggcatgtgtgggcccattgcgtcccttgcagcctgcaggaagctgacacagttctcctgcgtaccaccgatgaatttcaaatatacagttggaaaaaggttatttggatttatttgtctgctttaaacagtgcgttcggactgacacccgaccatcccctcatgaccgacgaagagtacatcatcaatcgagccatccgtaagccagatcttaaggttcgatgcataaaagtgcagaaaattcgctatgtgtggaattacctggagggacagttccagaaaattgggagcctggaggactggctctctagtgccaagatacaccagaaattcggatcaggcttgacacgggaggagcaggagatcaggcggctcatttgtggaccaaacaccatcgatgtggaagtgacacccatctggaaattgctaattaaagaggttctcaaccctttctacatctttcaactgtttagcgtgtgcctctggttttccgaggattacaaagaatatgcctttgccattataattatgagtattattagcatctcccttacagtctacgacttgcgagaacagtccgttaagctacaccatttggtggaatctcacaactccattaccgttagcgtgtgtggtcgtaaggccggtgttcaggagcttgaatctcgcgtgcttgtccctggagatttgctgattctgactggcaacaaagtcttgatgccttgcgacgcagtcctgattgaggggtcatgcgttgtggacgaaggtatgttaaccggagagagcattcccgtgacgaaaactcccctgccaaaaatggattcttcagtgccttggaaaactcagtccgaagccgattataagagacacgtcttattttgtgggacagaggtgatccaggcgaaggcagcctgttccgggacagtcagggcagtagtactgcagactgggtttaataccgctaaaggggacttggtgcgatccatcctgtatccgaagccagtaaacttccagctgtatcgggacgccattcgttttctgttgtgcctcgtggggacggctaccatcggaatgatctacaccttgtgcgtctacgtcctcagcggcgaaccccctgaggaggtcgtcaggaaggcgctggacgtcataactattgcggtcccacccgccctgcccgctgcgcttaccaccggaatcatatacgcgcagcgtcggcttaaaaagcgggggattttctgtattagcccccaaaggattaacgtttgcgggcagttgaacctagtgtgcttcgacaaaactggcacactcacgcgcgatggtctagatctgtggggggtagttagttgtgatcgcaatggctttcaggaggtccactctttcgcttccggacaggctttaccttggggacccctctgcgccgcgatggccagctgccattccctcatcctgcttgacggcaccatccagggggaccccctggatctgaagatgttcgaagctaccacctgggtctctctctgtagcagtgagaatttgaggtccttttttaacgcccgcgccacgtag

SEQ ID NO: 40470 - DNA, 3591 bp, Artificial Sequence
  Description of Artificial Sequence: Synthetic coding sequence
atgggccacttcgagaagggccagcacgccctgctgaacgagggcgaggaaaatgaaatggagatcttcggatacagaacccagggctgtagaaagtcattgtgcctcgctgggtccatattttccttcgggatccttcctctggttttctactggcggcctgcatggcatgtctgggcccactgcgtgccctgctccctacaagaggcggatacagtgctgctacgcactacagatgaatttcagatctactcctggaagaaagtgatctggatctacctttctgctctgaattccgcctttggtctcacacccgaccatccactcatgacggatgaggagtatatcattaatcgggccattcgcaaacccgatcttaaagtgagatgtattaaagtccagaaaataagatacgtctggaactatctcgaaggccagtttcagaaaattggatcactggaggactggctgtccagtgccaaaattcaccagaaattcggttccggcctgacaagagaagaacaagagatccggaggcttatttgtggtcccaataccattgatgtagaggttacacctatctggaagctgctcataaaagaggtcttgaacccattttacatcttccagctcttttcagtgtgcctgtggttttctgaagattataaagaatatgctttcgccatcataataatgagcatcattagcatctccctgacagtttacgatctgagggaacagagcgtgaagcttcaccatcttgtggagtcccataattccatcaccgtgtccgtttgtggtaggaaagcaggggtccaggagctggagagcagagtattggtgcccggtgatctgctcattttgacaggtaacaaggtcctgatgccctgcgacgctgtcctgatagagggctcctgtgtggtggatgaagggatgctcactggagaatcgatcccagttaccaagactcccttacctaagatggactcttcagtaccatggaagacgcagtcagaggccgattataagcgacacgtcctgttctgtggaacagaagttatccaggccaaagccgcttgttctggcactgtccgggctgtggtgcttcagaccggctttaatactgccaagggcgaccttgtgcggtcaattctttaccccaagcctgtcaatttccaactctaccgggacgctattcgcttccttttgtgtttggttggcacagctacgatcgggatgatttacaccctatgcgtttatgtcctgtccggcgagcccccagaggaagtagttcgcaaggctttggacgttataacaattgccgtgccgccagctttgccagccgcactgacaacaggaataatttacgcgcagcggaggctcaaaaaacgggggatcttttgcatctcccctcagcggattaatgtctgtggtcaactgaacctggtatgtttcgacaaaaccgggacactcactcgcgatggactcgacctatggggagtggtctcatgtgaccgtaacggattccaggaggtgcatagcttcgcttcagggcaggccttgccctggggtcccctttgcgcagcgatggcctcatgtcatagcctcattctgctcgacggcaccatccagggcgatcccctggacctgaagatgttcgaagccaccacttgggagatggccttttccggtgatgacttccatatcaagggtgtgccagcccacgccatggtggtcaagccatgtaggaccgcatcacaggtcccggtggaggggattgccattctccatcaattcccattcagttcagccctgcaaaggatgaccgtcatcgtgcaggagatggggggagatagactcgcgttcatgaaaggtgctcctgaacgggtggccagcttttgtcagccggaaactgtccccacttcctttgtttccgaacttcagatctacaccacccagggcttccgagtgattgccctcgcttacaaaaagctggagaatgaccaccacgccacgacccttacacgggaaaccgtggaaagtgatctcatctttctgggcctgctgatcctggaaaatcggttaaaggaagagaccaagccggttctggaggagctgatcagcgcgcgcatccgtaccgtgatgatcacaggagacaatctacagacagccatcaccgtggctagaaaaagcggaatggtcagtgagtctcagaaggtgattctgattgaagctaacgaaaccacaggctcgagtagtgcgtcaattagctggacactggtagaagaaaaaaagcacatcatgtatggtaaccaggataattacattaacattagggacgaggtcagcgataagggcagggaaggtagttatcacttcgcactgacaggcaagagttttcacgtgatttctcagcactttagttcccttctcccaaagatcttaatcaatgggacgatttttgcccgcatgagcccagggcagaaaagcagcctggtagaggaattccagaagctggattactttgtgggcatgtgcggagatggagccaatgattgcggagccttgaaaatggcacatgtcggaatcagtctgagtgaacaggaagcatctgtcgcctctccgttcaccagtaaaaccccgaatatcgagtgtgtcccccatctcattaaggagggtcgggcagctttggttacctcattttgcatgttcaagtacatggcactgtatagcatgattcagtatgtgggcgtgctacttttgtattgggagacaaattccctgtcaaactatcagttcctcttccaggacttggccataaccacgcttatcggtgtaactatgaatctgaatggggcctatcccaaactagtgccattccgacctgcgggtcgcttaatttccccgcctctgttgctgagtgtgatcttcaacatcttactgagtctcgctatgcacatcgcaggcttcattctggtgcagcgacagccttggtactcggtagagatacacagcgcttgtacggtccagaatgagtcaattagcgagctgaccatgtctccgactgcccctgaaaagatggaatctaacagcaccttcaccagcttcgaaaataccactgtgtggtttctgggtactattaactgcatcactgtggccctggtgttcagcaaaggcaaacccttccgacagcccacttataccaattacatcttcgtactagtcctaataattcaactgggagtctgtctgtttattctttttgccgatatccccgagctctatagacgcctcgaccttctctgcacacccgtgctgtggcgtgcttccatagtgatcatgctgagcctgaactttattgtgagtctggtggctgaagaggcagtgattgagaacagggccctctggatgatgatcaagagatgctttgggtatcaatctaaatcgcaataccgcatatggcaacgcgacctcgccaacgacccttcgtggccaccattaaaccagacgtcacactctgatatgccagaatgcgggagaggggtgagctactccaaccctgtgtttgagtcaaacgaggagcagttgtag

SEQ ID NO: 40471 - DNA, 639 bp, Artificial Sequence
  Description of Artificial Sequence: Synthetic coding sequence
atgcacatcgccggcttcatcctggtgcagcggcagccctggtacagcgtggaaatacacagcgcatgtacagttcagaatgaatctattagcgagttgacaatgtcgccaactgctcctgaaaaaatggaatccaattcgacttttacgtcatttgagaatactacggtgtggttcctgggtaccattaactgcattaccgtggcactcgttttctctaaaggtaagccctttcggcaacccacatatacaaactacatcttcgtgctggtactcattattcagctgggggtatgtctgtttatcctgtttgcagacatacccgagctgtacagacggctcgacctcctatgtacacccgtcttatggagggcatccatagtgatcatgctgagcctgaacttcatcgttagcctggtggctgaagaagctgttatcgagaaccgagccttgtggatgatgatcaaacggtgctttggctatcaatccaaatctcagtatcgcatttggcagagagatctggccaacgacccttcatggccccctttgaatcagacgagccactccgacatgcctgagtgtggaaggggggtaagctacagcaaccctgtgttcgaatctaacgaagaacagctttag

SEQ ID NO: 40472 - DNA, 3657 bp, Artificial Sequence
  Description of Artificial Sequence: Synthetic coding sequence
atggaggagaacagcaagaaggaccaccgggccctgctgaaccagggagaggaagatgagctagaggtgttcggatatcgtgaccacaatgtgagaaaggccttctgtctagtggcttctgtcctaacctgcggcggccttttgctcgtgttctattggcgaccccagtggagggtgtgggcaaattgtatcccctgtccactgcaggaggcagataccgttttattacggactaccgacgagttccaaagatacatgcgcaagaaggtattttgcctgtacctctccaccctgaaattccctgtttctaaaaaatgggaggaatctctggtcgcggaccgccatagtgtgattaaccaggccctgatcaagcctgagcttaaattgcggtgtatggaggtacagaagatacgatacgtgtggaacgatcttgagaagaggtttcaaaaggtggggttactcgaggacagtaatagctgtagtgatattcatcaaactttcggactaggcctgactagcgaagagcaggaagtccgtcggttggtgtgtggccctaacgcaatcgaggtcgagattcagccaatctggaagctgttagtcaaacaggtcctgaatcccttttatgtctttcaggccttcactctgaccctatggctcagccagggctacatcgagtacagtgtcgccataatcatcctgactgtgatctctatcgtcctgtccgtctacgatctccgccagcagtctgtcaaactgcacaacctggttgaggaccacaacaaggtgcaagtaactatcatcgtaaaagataagggcctggaggagctggaaagcaggcttcttgtcccaggcgatatccttattttgcccggcaagttcagcctaccctgcgacgctgtgctgatcgacggtagttgcgtcgtcaatgagggaatgctgaccggtgaatccatccccgtaacgaaaacacccctgccacagatggaaaatactatgccttggaaatgtcattcactggaggattaccgtaagcacgtgcttttctgtggaactgaggtcattcaggtgaaacccagtggacaaggacctgtacgggccgtagtgttgcaaactggttataacaccgctaaaggggatctagtgcggtctattctgtacccccggcccctaaactttaaattgtactctgatgctttcaagttcattgtgttcctcgcatgtctcggggttatgggtttcttttatgctcttggagtatacatgtatcacggcgtgcccccaaaggacaccgtgacaatggcactaatattgctgaccgtgacagtgcctcctgtactgcccgcagctctgacgatcggaaacgtctacgctcagaagcgcttgaagaagaaaaaaatattctgtatttccccccagcgcattaacatgtgtggtcagataaacctggtgtgtttcgataagactggaaccctgacagaggatggacttgacctctggggcaccgtgcctactgccgataactgttttcaggaggctcacagctttgcaagtgggcaagctgtaccatggtcccctctttgtgccgctatggcttcatgtcacagtctcattctgctgaatggcacaattcagggcgacccgctggacctcaaaatgttcgagggcaccgcctggaaaatggaggactgcatagtcgactcctgcaagtttgggaccagcgtgtctaacataatcaagccagggcctaaagcctccaaaagccctgtggaggctatcatcacgctctgccagttccctttttcgtcctcgcttcagcggatgagcgtgatcgcgcagctggcaggtgagaaccatttccatgtctacatgaagggagcacccgaaatggttgccaggttctgtaggagcgaaacagtcccaaaaaactttccccaggaactgcgctcctatacggttcagggttttcgcgtaattgctctggcccataaaacactgaaaatgggcaacctctcggaggtcgagcacctcgcaagggagaaggttgagtcggagctgacattcctgggattgctgatcatggaaaatagacttaaaaaggagacaaaattagtgctgaaggaattgtcagaggcccgcattagaacagtcatgatcacaggcgacaacctccagaccgccatcaccgtggccaagaactctgagatgatcccccccgggagccaggtgataattgtggaggccgacgagcccgaggagttcgtcccggcctcggttacgtggcaactggtggaaaaccaagagacaggacctggaaagaaggaaatctacatgcatacgggcaactcctcaactccccgaggcgagggcggctcttgctaccactttgcgatgagtggaaaatcctatcaagtcatttttcagcatttcaattctctgcttcccaagatcctcgtgaatggaactgtgtttgctagaatgagccccggccaaaaatctagtctcatcgaagaatttcagaagctaaattactatgtgggcatgtgcggagatggcgccaacgattgtggggctctcaaagcggctcacgccgggattagcctaagcgagcaggaagcctctgtggcttccccatttacatccaaaaccacaaacattcagtgcgttccccacctgatccgcgagggaagagcagcactggtcagttcattcggagtatttaaatatctgaccatgtacgggattattcagttcattagcgcattactcttgtactggcagctgcagctgttcgggaattatcagtatctcatgcaggacgtggctatcactttgatggtttgcctaacgatgagctcaactcatgcttaccctaagcttgcaccatacagaccggccggccagctgctcagtccacccctgttgctgagtattttcctcaattcgtgcttcagttgcatagtgcagatttctgcatttctgtatgtgaaacagcagccgtggtattgcgaggtttaccagtacagtgaatgtttccttgccaatcagagtaacttttctactaatgtaagcctcgagagaaactggaccggcaacgctactctaattccaggctctatattgtcatttgaaacaaccaccctttggcctataacaacaattaattatattactgtcgcctttatcttctccaaggggaagccctttcgtaaacctatctacaccaattatatcttctccttccttcttttggccgcccttggacttaccattttcatcctttttagtgatttccaagtcatatataggggcatggagctgatcccaactataacatcatggcgggtgctgattcttgtggtggcactgacccagttttgtgtagcttttttcgtggaagatagcatcttgcagaaccatgagctctggctgctgataaaacgggagtttggcttttacagtaagtctcagtataggacatggcagaagaagcttgccgaagatagtacttggccaccgatcaataggactgattactcaggggacggcaaaaatggtttttacattaacggcgggtatgagtcacacgaacagattcctaaacgcaaattgaaacttggcggccaaccaaccgaacagcatttttgggcaaggctgtag

SEQ ID NO: 40473 - DNA, 3450 bp, Artificial Sequence
  Description of Artificial Sequence: Synthetic coding sequence
atgcccaccatgcggcggaccgtgagcgagatccggagccgggccgagggctacgaaaagacagacgacgtttccgaaaagacctcactcgctgaccaggaggaggtcagaaccatcttcataaatcaaccacaacttactaagttttgtaataatcacgtctcgaccgcgaaatataatatcatcacattcctgccccgctttttgtacagccagtttcgtagagccgcaaacagcttcttcctgtttattgccttactgcaacagattccagatgtctctcccacagggcgctacacaaccctcgtgccactccttttcatccttgccgttgcagcaatcaaagagattattgaagacatcaaacggcacaaggcagacaacgccgtgaacaaaaaacagacacaggtgctgagaaatggagcgtgggaaattgtgcattgggaaaaagttaacgtgggggatatcgtcattattaaggggaaagaatatatccctgctgataccgtgctcctctccagctcggagcctcaagcaatgtgttatatcgagacctcaaacctcgatggcgaaacaaacctcaagattagacaggggttgcccgccacctctgacattaaagatgttgattccttgatgagaataagcggccgtattgagtgtgagtctcccaaccgccacctgtatgacttcgtgggtaatatccgcctggacggtcacgggactgtccccctgggagctgaccagatccttctgcgtggggcccagttgcggaatacccagtgggtgcacggaatcgtggtgtacacagggcatgacaccaagctaatgcagaattcaacgtctccgcctctgaagttaagcaacgtcgagaggataaccaatgtgcagatcctgatcctgttttgcatcctcattgctatgagcctagtgtgctctgtgggctctgcaatttggaatagacgccatagcggaaaggattggtacctgaacctgaattatggaggcgcaagtaatttcgggttaaattttctgacattcattatcttgttcaacaacctgatccccataagcttacttgtgactctggaggtggttaaattcacccaggcatactttatcaattgggatctggacatgcactatgagccaacagatactgccgccatggctcggacttcaaacttgaatgaggagctcggccaggtgaagtacatcttctctgataagaccggaaccctcacgtgcaatgtgatgcaatttaaaaagtgtacgatagccggagttgcctacgggcagaacagtcaattcggagacgagaaaacctttagtgatagctctttactggagaacttacagaacaatcatcctacagcacccatcatttgtgaatttttaacaatgatggcagtttgccatactgctgtgcctgagagggaaggggacaagatcatataccaagccgctagtccagacgaaggcgcccttgtccgtgctgcaaaacagctcaactttgtgttcactgggcgaacgccagactccgtcattattgacagcttgggacaggaagaacgctatgagctgttgaacgtgctggaatttaccagtgcccggaagcgcatgtcggtgatcgtgcgcaccccctccggaaagttgcggttgtactgtaaaggggctgatactgttatctacgatcgcctggctgagacatccaaatacaaggagatcacactgaagcatctggaacaatttgccacagagggcttacgcacactctgcttcgccgtggcagaaatcagtgaatctgactttcaggagtggcgcgcagtctatcagcgagctagcacatcagtgcagaatcgcctgctcaagctcgaagagtcctatgagcttatcgagaaaaacctccagctactgggtgccacagccatagaagataaacttcaggatcaggttccagaaacgattgagacgctcatgaaagcagatatcaagatctggatcctgaccggggacaaacaggaaaccgccattaatataggtcatagctgcaaactcttaaagaaaaatatgggcatgatcgtgatcaacgagggatccttagacggcactcgggagaccctgtctcgccattgcacaacgctaggggatgccttgcggaaagagaatgatttcgctctgatcatcgacggcaagacactcaagtacgctctgaccttcggagtccggcagtattttttagacctggcactgagctgcaaggcagtgatctgctgcagagtgtcacccctgcagaagtccgaggtggtggagatggttaagaaacaagtcaaggtggtcacattggcgatcggggatggggcaaacgacgtatctatgatccagaccgctcacgtgggcgtcgggatttctggcaatgagggcttacaagcagctaactcttccgattatagtattgcacagttcaaatatctaaagaacctgcttatgattcatggagcttggaattacaaccgggtctccaaatgcatcctgtattgcttttacaagaacatagtcttatatatcattgaaatttggtttgcattcgtcaacgggttctccggacagatcctattcgagcggtggtgcataggtctgtacaacgtgatgttcactgctatgcccccacttacactgggtatctttgagagatcttgtcggaaggaaaatatgctgaagtaccctgagctgtataaaacctcgcaaaatgcattggactttaacactaaagtcttctgggtgcattgtctgaacgggcttttccattccgtgatcctgttttggtttcctctgaaggctctccagtatggcaccgctttcggcaatggcaagacatccgactacctactcctgggtaattttgtttatacctttgtagtaattacagtgtgcctgaaagccggattagagaccagttactggacttggttttctcatatcgctatctgggggagcattgctctttgggtggtgttttttggcatatatagctccttgtggcccgccataccgatggccccagacatgagtggagaggccgccatgctctttagttctggagtgttttggatggggcttcttttcatccccgtggcgtccctgctcttggacgtcgtttataaagtgattaagaggacagcgttcaagacactggttgatgaggttcaggaactggaggccaagtcccaggacccaggggcggtagtgctgggcaaaagccttaccgagcgggcccaactcttgaaaaatgtttttaaaaagaaccatgtgaacctgtacagaagtgagtctctgcagcagaacctgctacacggctatgcttttagtcaggatgagaacggaattgtgtcccagagtgaggttatcagggcctatgatacaaccaaacagcggccggatgaatggtag

SEQ ID NO: 40474 - DNA, 3495 bp, Artificial Sequence
  Description of Artificial Sequence: Synthetic coding sequence
atgcccaccatgcggcggaccgtgagcgagatccggagccgggccgaggggtacgagaagaccgatgacgtatcagaaaaaacctccctagccgaccaagaagaagtccgcaccatctttattaatcagccccagcttacaaaattctgtaacaaccacgtatctaccgccaaatacaatataatcaccttcctccctaggttcctgtactctcagttccgccgagcggctaacagtttcttcctatttatcgccctgctccagcagattccggatgtctcacctacggggcgttacactacgctggtaccactactcttcattttagctgtcgctgccatcaaagaaattatagaagacatcaaaaggcacaaagcagacaatgcggtcaataaaaaacagacacaggtgctgcggaatggagcgtgggaaattgtgcattgggaaaaggtggccgtcggcgagatcgttaaagtgactaacggcgaacacctcccagcagatcttattagcttgtccagctctgaaccacaggctatgtgttacatcgagacctcaaatttagacggagaaactaacctgaagatacgacagggcctgcccgccacctcagacatcaaggacgtcgactcactgatgcgcatttctggccggatcgaatgcgagtccccaaaccgacacctctacgatttcgtgggcaacattagactagatgggcacgggacggtccctctcggtgccgaccagattctgctcaggggcgctcagctgagaaacacccaatgggtgcacggaatagtggtttatacaggtcacgacacaaaattgatgcagaacagcactagccccccactgaaactaagcaatgtggagaggatcacaaacgttcagatccttattctgttttgtatccttatagccatgagcctggtctgctcagttggcagtgcaatttggaataggaggcattcaggtaaggactggtatctgaatctcaattatggaggtgcttctaacttcggccttaatttcttgaccttcatcattctgttcaataacctaatccctatatccctcctggtgacactggaagtagtgaaattcacccaggcgtatttcatcaattgggatttggatatgcactacgaacccacagacacggctgctatggcaagaacctccaacttaaatgaggagctgggacaggttaaatatatatttagtgacaagacggggacgctgacctgcaacgtgatgcaatttaaaaaatgtaccatcgcaggcgtggcatatggccacgtacctgagcctgaggactatggctgttctcctgatgaatggcagaacagccagtttggcgacgagaagacattcagtgatagctctcttctagaaaacctgcagaataatcaccctacggctcccatcatctgcgaattcctgaccatgatggccgtttgccacaccgctgtgccagaacgagagggggacaaaattatctaccaggccgcatctccagacgaaggagctttggttcgggccgcaaaacaattaaactttgttttcactggacgcacacccgactccgtcattatcgactctctgggtcaggaggaaagatacgagctcctgaacgttctcgagttcacttcagccagaaagcgcatgtcagtcatcgtccggacaccttcgggcaagctgcgactttactgtaagggggcagataccgtgatctatgaccgactggccgaaacatcaaaatataaagagataaccctaaagcatcttgagcagttcgccaccgagggcttgagaacattatgctttgccgtggctgaaatttccgagtccgattttcaggagtggcgtgccgtgtaccaaagggcatccacctcagtgcagaatcggctgctcaagcttgaggaatcatatgagttaatcgaaaaaaacttacagttactgggagcgaccgccattgaagacaaacttcaggaccaagtgcccgagacaatcgagaccctcatgaaagctgacatcaagatctggattctgaccggcgacaaacaggaaacggccataaatatcgggcacagttgcaaattactcaaaaagaacatgggaatgatcgtgatcaacgaagggagcctcgatgggactcgcgagacactatctcggcattgtaccacactcggtgacgctttgcggaaggaaaacgacttcgccctcatcatcgatggcaagacacttaagtacgccctgacattcggggtgcgacagtattttctggacctggcattaagttgtaaggccgtcatctgttgtcgagtatcgcctctgcaaaagtccgaggtggtggagatggtgaagaaacaggtcaaggttgtcaccctggctataggcgatggcgctaatgatgtttcaatgatccaaacggctcacgtgggggttggaatttctggaaacgaagggctacaggcagcaaattccagcgactacagcatcgcccagtttaagtatctgaagaacttgttgatgatccacggagcctggaattacaatagggtgtctaaatgtatcttgtactgtttttacaaaaatatcgtgctgtacatcattgaaatctggttcgccttcgttaatggtttctccggccagattctcttcgagaggtggtgtatcggcctttacaacgttatgtttaccgctatgccccctcttacactcgggatatttgagcggtcctgccggaaagagaatatgctcaagtatcctgagttatacaagacttcacagaatgcgctagactttaacactaaagtgttctgggtgcattgcctgaacggcctgtttcactctgtcatcctgttttggttcccattgaaagccctacagtatggcacagcctttggcaatggcaaaacttcagattatctgctccttggaaatttcgtgtacactttcgtcgtcataaccgtctgcttgaaggcgggactcgagactagctattggacctggttctcacacatagctatctggggctcaattgcgctgtgggtagtcttcttcggcatctactcaagcctctggcctgccattccaatggcacctgatatgtctggggaggcggctatgctgttttcttctggcgttttctggatgggcctgttgtttattcccgtagcatccttactgctggacgtggtgtacaaagtaatcaaaaggacagcctttaaaacactcgtcgatgaggtccaggagctggaggccaagtcgcaggaccccggcgcggtagtgttgggcaaatctctgacagagagggctcagctgctgaaaaatgtgtttaagaaaaaccacgtcaacctttatcgaagcgagtcactccagcagaatctgctgcacggctacgccttcagccaggacgaaaacgggatagtgtcacagagtgaggtcatacgggcctacgatactacaaagcaacggcctgatgaatggtag

SEQ ID NO: 40475 - DNA, 3579 bp, Artificial Sequence
  Description of Artificial Sequence: Synthetic coding sequence
atgttctgcagcgagaagaagctgcgggaggtggagcggatcgtgaaggctaatgatagagagtacaatgaaaaatttcagtacgccgataataggattcacacatctaagtataacatcctcacattcctgccgattaatttgtttgagcagtttcagcgagtcgccaatgcctacttcctctgcctcctcattctgcaactgataccagaaatcagcagccttacgtggttcaccaccatcgttccccttgtgttagtaattacaatgaccgccgtgaaagatgccacggacgactattttcggcataagtctgacaatcaggtcaacaacagacagtctgaggtcctgatcaactccaagctccagaatgagaagtggatgaatgtgaaggtgggggacattatcaaattagaaaacaaccaatttgttgccgctgacctgctactcttgagcagctccgaacctcatggcctttgttatgttgagaccgcggagctggatggggaaaccaatctgaaagtgagacatgccctgtctgtcacatcagaactgggagccgacatcagtcggttggcaggatttgatgggatcgtggtctgtgaggtccccaacaacaagctcgacaaatttatgggtattctgagttggaaagacagcaagcacagcctcaataatgagaaaatcatcctgaggggctgcattctgaggaacaccagctggtgtttcgggatggtgatctttgcaggaccagacaccaaattgatgcagaactctgggaagaccaagtttaaacggacctctattgacagacttatgaatacacttgtgctctggatctttggcttcctgatttgcctcggcatcatcttagccataggcaatagtatttgggagagtcaaacaggtgatcagttcagaaccttcttgttctggaatgaaggcgaaaagtctagcgtgttcagcggttttttgactttttggtcttacatcataatccttaacactgtggtacctatcagtctgtatgtgtccgtggaagtaatccgcctgggtcactcatacttcataaactgggacaggaagatgtactactcacggaaagccattcccgctgtggccagaactacaactctgaatgaagagctcgggcaaatcgagtacatattttcagataagaccggcacactgactcagaacatcatgacatttaagagatgctcgattaacgggcgcatctatggtgaggtccatgatgatctcgaccaaaagaccgagattacacaagagaaggagccagtggattttagcgtcaaaagtcaggctgaccgggaattccagtttttcgatcaccacctgatggaatctatcaagatgggcgaccccaaagtgcatgaattcctccgcctcttagccctgtgtcatactgtcatgagcgaggagaactcagccggtgagttgatttatcaggtgcagtcaccagatgaaggtgctctagtaactgctgctcgcaacttcggattcattttcaagtctaggacaccagagaccatcactatcgaagaactgggaacactggtgacctatcagctgctagcgttcctggactttaacaatacaagaaagagaatgtccgtcatagtcagaaaccccgagggccagatcaagctctactcaaagggtgcagatactattctgtttgagaaacttcatcctagcaacgaagtgttactatccctgacctcagatcatctgagcgaatttgccggcgagggattacggacactggcaattgcatatagagacctagatgataagtacttcaaggaatggcacaagatgttggaggatgcaaatgcagcaacagaagagcgcgacgagcgcattgctgggctgtatgaagagatagaacgggatttgatgctcttaggagcgaccgccgtggaggacaagcttcaggagggcgtgatcgagaccgtaacctctttaagcctcgcaaacatcaagatctgggtgctcactggtgacaagcaggagacggctattaacatcggttatgcatgtaatatgttaacggacgatatgaatgacgttttcgtgatagctggcaataacgccgttgaggttagagaggagctgagaaaggctaagcagaacctgtttggccagaatcgtaacttctccaacggtcacgtggtctgtgaaaagaaacagcagcttgaactcgattccatagtggaggagactatcaccggagattatgcgctgattatcaatgggcacagcttagcccatgccctggaaagcgatgttaaaaatgacctgttggaactagcctgtatgtgtaaaacagttatatgctgccgggtcacaccactgcagaaagcccaagttgtggaactcgtgaagaagtacagaaatgccgtgacccttgccatcggggacggcgcgaatgacgtgagcatgataaaaagcgcccacatcggcgttggaatctccggacaagaaggcctccaggcggtactggctagtgattattcattcgcccagtttaggtacctgcagagattgctgctcgttcacgggcgatggagctattttagaatgtgtaaatttctgtgttactttttctacaaaaactttgccttcacccttgtgcacttctggttcggcttcttctgtggatttagcgcccaaactgtctacgatcagtggtttataactttgttcaatatcgtttacacgtcacttccggtgctggccatgggtatcttcgatcaggatgtgagcgaccagaactcagtggattgcccacagctttataagccagggcagctgaatcttctgttcaataagcggaagttttttatctgcgtgttacacgggatctacactagtttggtcctgttttttattccatacggggcattttataatgtggccggcgaggacggtcagcatatagccgattatcaatctttcgcagttactatggcaacatcgctagtgatcgtggtgagtgtccaaattgctctcgacacatcttactggacgttcattaatcacgtgtttatctggggtagcatcgccatttactttagtattctgtttaccatgcatagtaacggcatatttgggatttttcccaaccagtttccgtttgtggggaacgcaaggcatagcctgacccagaagtgcatttggctcgtaatactactcactacagtggcaagcgtcatgccagttgtcgcttttcgctttctgaaggtggacctatatcccactctatcagatcagatccgtaggtggcagaaagctcagaagaaggctcggcccccttcttcccgtcgccccagaacccggcggtcatcctccagacgctctgggtacgccttcgcgcaccaggagggttatggggagctaattacatctggaaaaaacatgcgcgcaaaaaatcccccaccaacatcagggctagaaaagactcattataattccaccagctggatcgaaaacttgtgcaaaaaaaccaccgacaccgtaagttcattctcccaggacaagaccgtgaagttgtag

SEQ ID NO: 40476 - DNA, 162 bp, Artificial Sequence
  Description of Artificial Sequence: Synthetic coding sequence
atgttctgcagcgagaagaagctgcgggaggtggagcggatcgtgaaagccaatgaccgcgagtataacgaaaaattccaatatgctgataaccgcatacacacaagcaagtataatatcctaacctttctgcctattaacttgttcgagcagtttcagtag

SEQ ID NO: 40477 - DNA, 3579 bp, Artificial Sequence
  Description of Artificial Sequence: Synthetic coding sequence
atgttctgcagcgagaagaagctgcgggaggtggagcggatcgtgaaagccaatgatagagaatataacgagaaattccaatacgccgataatcgcatccacacaagcaaatataacattctgacttttcttcctatcaatctgttcgagcagtttcaaagggtggctaacgcctattttctgtgcttgttgatcctccagttgattcccgaaatttcctccctgacatggttcacgacaatagtgcctttggtgctggtcattacaatgactgcagtgaaagacgctacagatgactatttcagacataagtcggataatcaggtcaataatcgacagtccgaagttctaatcaatagtaagctgcaaaacgagaagtggatgaatgtcaaagtgggagacatcatcaagctcgaaaataaccagtttgttgctgccgaccttctcctgctgtcttcttcagagccacatgggttatgttacgtggagaccgccgaacttgacggagaaaccaatctgaaggtgcgccacgctctttctgtgacatctgagctgggagctgatatctccagactcgccggttttgatgggatagtggtgtgcgaggttccgaataacaagctggataagttcatgggaattttaagctggaaggatagtaaacacagcttgaataacgagaaaattatcctgcgggggtgtatcctgaggaataccagctggtgtttcgggatggtgattttcgcaggccctgatacaaagctcatgcagaatagcggcaagacaaagttcaagaggacttctatagacaggcttatgaacacccttgttttgtggattttcggcttcctgatctgtcttggcataatactggctataggaaatagtatctgggaatcccagactggggaccaatttaggaccttcctgttctggaatgaaggtgagaaaagctcagtgtttagtggctttctgaccttctggtcttatataattatcttgaataccgtggtgccaatctcactgtatgtttctgtggaggtgataagacttgggcactcttacttcatcaattgggatcgcaagatgtattactcacgcaaggccattcctgcagtagcccggacaacaactttaaatgaggaactgggccagattgaatacatctttagtgataaaacagggacactaacccagaacataatgactttcaagagatgctccatcaatgggcgaatttacggcgaggtccacgatgatctagaccaaaaaactgagatcacccaggaaaaggagcctgtggatttcagtgttaagtcccaggctgatagagagtttcagttcttcgatcaccatctcatggaatctatcaagatgggggatcccaaggtccacgagtttctgaggctgctcgccctgtgccacacagtgatgagcgaggagaattccgccggcgagctgatataccaagtgcaaagtccggatgagggagcactcgtgacagctgctcgcaacttcggcttcattttcaagagccggactccagagacaatcactatcgaagagcttggcactctggtgacctaccaattattagctttcctcgactttaacaacacgcgcaagcgcatgtctgtaatcgtgcgcaatccagagggccaaataaaactttatagcaagggtgcggacactatactgttcgagaaactccatcccagcaacgaggtgctactcagtcttacctctgatcatctgagtgaattcgcaggcgagggactcagaacactggccatagcctatcgagatctggacgataaatatttcaaggaatggcacaaaatgctggaggatgccaacgcggccaccgaggagcgtgacgaacggattgccggattatacgaagaaattgaacgggaccttatgttgctgggggcgactgctgtggaagataagctgcaggagggggttatagagactgttacaagtctgagcctggccaatataaagatctgggtgctcaccggtgataagcaggagaccgcaattaacatcggatatgcttgtaacatgctgacagatgacatgaacgatgtatttgtcatcgcaggaaacaatgccgttgaggttagagaggaactgagaaaagcaaaacagaatctcttcggacagaacaggaacttttctaacgggcatgttgtctgcgagaaaaagcaacagcttgagctggacagcatcgtcgaggaaaccatcacaggggactacgcacttatcatcaatggccactcactggcacacgccctagagagcgacgtcaagaacgacttgctggagctggcgtgcatgtgcaagacagtgatatgttgcagggtgacacccctgcagaaagcccaggtggtggagctggtcaagaagtacaggaacgccgtgaccctggctatcggggatggcgccaatgatgtttccatgattaagtccgcacacattggcgtagggattagcggccaagaaggtctgcaagccgttcttgcctcagattactccttcgcccaatttaggtatctccagcggttgctactggtccatgggcggtggtcttacttcagaatgtgtaaatttctgtgctactttttttataaaaattttgcctttactctggtgcacttctggttcgggtttttctgtggattttctgcccaaacagtatacgatcagtggttcattacgctctttaacatcgtctatacatccctgccagtgctggcgatgggaatcttcgaccaggatgtgagtgatcagaactctgtagattgccctcagctgtacaaacccggccagctgaacctactcttcaataagcgcaagttttttatttgtgtgttgcatggcatttatacctctctggtcctgtttttcattccctacggagccttctacaacgtggcaggcgaggatggacagcacattgcagactatcagtctttcgccgtcaccatggccactagtctcgttatagtagtgagcgtgcagatcgctcttgatacctcatactggactttcattaaccacgtcttcatatggggttcaatcgcaatctacttcagcatactttttacgatgcacagcaacggcatttttggaatcttccccaaccagttccccttcgttgggaacgcaaggcactctctcacccaaaagtgcatttggctcgttatcctgcttaccactgtcgcatccgtgatgcccgtagttgcgttcaggttcctgaaagtcgacctatatcccacattgtctgatcagattaggcggtggcagaaggctcaaaagaaggcccggcctccgagcagtcgaagacctagaacgaggcgctcaagctcaagacgctctgggtacgcattcgcgcaccaggaaggctatggggagctgatcacatccgggaaaaacatgagagcgaagaaccctccccctacaagtgggttggagaagacccattacaactccaccagttggatcgagaatctgtgcaagaaaacgacagacactgttagttccttttcacaagacaaaactgttaagttgtag

SEQ ID NO: 40478 - DNA, 2736 bp, Artificial Sequence
  Description of Artificial Sequence: Synthetic coding sequence
atggacagccggccccgggccggctgctgcgagtggctgcggtgctgtgggggcggtgaagctaggccaagaactgtgtggttaggacatccagagaagcgagaccagaggtatccccggaacgttatcaacaatcagaagtataatttctttacatttctgcctggggttctgttcaatcagtttaagtatttcttcaacttgtatttcctcctgctggcttgttctcagttcgtgcctgaaatgagactgggtgcactgtacacatactgggtccctcttggctttgttctggccgtaacggtgataagggaagcagtggaggagataaggtgttacgtaagagacaaggaagtcaattctcaggtatatagcaggctcactgcaaggggcacagtggttggtgtggtcctctacaccggccgcgagctgagaagtgtgatgaatacttcaaaccctcgcagcaaaatcggtctgttcgacctggaagtgaattgcctgactaagattcttttcggagctctcgtcgtggtatctttggtaatggtggctctgcagcattttgctggcagatggtaccttcagattatacggttcctcctgctgttctctaatatcatccccatctcactccgcgtgaatcttgatatgggcaagattgtatactcctgggttattaggcgggatagcaagatccccggcaccgtagtcagaagttctaccattcccgagcagttaggacgcataagctacttactgactgataaaaccggtacccttactcaaaacgaaatgatctttaagcgcctgcatctgggcactgtcgcgtatggtttggacagtatggacgaggtgcaaagccatatttttagcatctacactcagcaaagccaggacccccccgctcaaaaagggcccactcttactactaaagtgagacgaaccatgtccagcagggtgcacgaggctgttaaggccattgctctgtgccacaacgttactccagtttacgagtccaacggcgtgactgaccaggccgaggccgagaagcaatatgaagactcatgtcgagtgtaccaagctagcagtcctgatgaagtagcactggtacagtggaccgagtccgtcggcctcacacttgtgggccgcgatcaaagttccatgcaattgcggacacctggcgatcaaattctcaatttcaccattctccagatttttcccttcacttatgagtccaagcggatgggaatcatcgtaagagatgaatccaccggtgagattactttctatatgaaaggcgctgacgtcgttatggcggggatagtgcagtacaacgattggctcgaggaagagtgcgggaacatggccagggaaggcttgcgagttctggttgtggctaagaaatccctcgccgaggaacagtaccaggacttcgaggcccgttacgtccaggcaaagctgtccgtgcacgatagatccttgaaggtcgctacagtgatagagtctttggagatggaaatggagctactctgccttaccggagtggaggaccagttgcaggctgatgtcaggcccacattggaaacgctccgtaatgccggcatcaaggtgtggatgctgaccggagataaattagagaccgccacttgtaccgccaaaaatgctcacctcgtgacccggaaccaagacatccatgtttttagactggtcacaaatcggggcgaagcacacctagaattaaatgcctttcggaggaaacatgactgcgccctggttatttccggcgactcgctggaggtttgcctgaaatattacgaatacgagtttatggaactggcttgtcagtgtcccgccgtggtgtgttgtcggtgcgcaccgacccaaaaggcccagatcgtccggctgctccaggaaagaacgggaaagctgacatgtgcggttggagacggaggtaacgacgtaagtatgattcaggagagtgactgcggagttggggtggaggggaaagagggaaagcaagctagtcttgcggcagacttttccatcacacagtttaagcacctcggtcgactgctaatggtgcacggcagaaactcctacaaaaggtccgctgctctctcccagtttgtgatccaccgatcgttatgcatctctactatgcaggcagtgttctctagtgtcttttattttgcctcagttccactgtatcagggatttcttattattggttactcgaccatctataccatgtttccagtctttagcttggtactggacaaagatgtcaaaagcgaggtggccatgctgtacccagagctctacaaagacttgttgaaaggccggcccctctcttataagacattcctgatctgggtcctgatatcaatctatcagggttccactatcatgtacggcgcattgttactgtttgaaagcgagttcgtgcacatcgtggctatctcattcacctctctgatactcaccgaactcctgatggtagctctcaccatccagacctggcattggttaatgaccgttgctgagctccttagtcttgcatgttatattgccagcctggtattcctgcacgaatttatagacgtgtacttcatcgcgactctgagcttcctgtggaaggtgagcgtcattactttagtgtcttgcctcccattatatgtgttgaaatacttacggcgccggttctccccaccctcttactcaaagctgaccagctag

SEQ ID NO: 40479 - DNA, 3144 bp, Artificial Sequence
  Description of Artificial Sequence: Synthetic coding sequence
atgaccgacaacatccccctgcagcccgtgcggcagaagaagcggatggactcgcggcctagagccggctgttgcgaatggctgagatgttgcgggggcggggaagctcgccctcgaactgtctggctcggacatcctgaaaagcgcgatcagaggtatccccggaatgtcatcaacaatcagaagtataactttttcacattcttgcccggagtactgttcaaccagttcaaatacttcttcaacctctattttcttttgctggcctgttcccagttcgtaccagagatgagactgggggctctgtatacatactgggtgccgctgggatttgtcttagcagtcaccgtgatcagagaggcagtagaggaaattaggtgctacgtgcgcgataaagaggtcaactcccaggtgtacagcaggcttacggcccgcggaacggtcaaagttaagtcctcgaacattcaggtaggagacctgataatcgtagagaagaaccaacgggtccccgccgacatgatctttctccgcacaagcgaaaaaaatggcagctgctttctcagaacagatcagttagatggcgagacagattggaagctgagattgcctgtggcttgcacccagcgcctgcccacggctgcagatctactgcagattaggtcatacgtttatgctgaagagcctaacattgatattcacaacttcgtcgggacatttacacgcgaagacagcgatccaccaatcagtgagtccctttctattgagaatacattgtgggccggcacagtcgtagcttccggtactgtcgtcggcgtggttctgtacaccggcagagagttgcgttctgtgatgaatactagcaaccctcggtccaagatcggcctgtttgatcttgaagtgaactgtctgactaagattcttttcggggcattagtcgtggtgtccctagttatggtggccctccaacattttgccggcaggtggtatctgcagattatccgttttctgcttctgtttagcaacatcattccaatttcactgagagtcaatctggacatgggtaagatagtctattcttgggttatcaggcgcgactctaagatccctgggactgtcgtaaggtcttctactattccagaacagctagggaggatttcttacctgctaacagataaaacaggtaccctgacacagaacgaaatgatattcaagaggttgcacttgggtactgtcgcctacggcctcgatagcatggatgaggtccaatctcacatttttagcatctacacacagcagtctcaggatccgcctgcacaaaaaggccccacactcacaacaaaagtgcgcaggacgatgagttcacgggttcacgaagccgtgaaggctatagctttatgtcacaatgtgacgcctgtgtatgaatcaaatggagtgaccgaccaggcagaggcagaaaagcaatatgaagattcatgtcgggtgtaccaggcatctagcccagatgaggtagcgttggtacagtggactgagagcgtgggattaaccctcgtcggcagagatcagtcctcaatgcagttacgcaccccaggcgatcagatcctgaattttaccatcttacagatttttcctttcacttatgaaagtaagcggatgggaatcattgtgcgggacgagtctaccggcgagatcaccttttacatgaagggagccgacgtcgttatggcaggcattgtgcagtataatgactggctcgaggaggagtgcggcaacatggccagggaaggcctgcgcgtactagttgtcgccaagaagagtctcgccgaagagcagtaccaggactttgaggcccgctatgtgcaggctaaactgagcgtgcacgataggagcctgaaagtggccaccgttatcgagtctttagagatggagatggaacttctttgtctgaccggtgtggaagatcaattgcaggctgatgtgaggcctacactcgagaccttacggaacgccggaataaaagtatggatgctgacaggggacaaactggaaaccgctacctgcaccgctaagaacgcccacttggtgactagaaaccaggatatccacgtgttcaggttggttactaacagaggcgaggctcacttggagcttaacgcttttcgccgtaagcatgactgcgccctcgttataagcggggacagcctagaggtgtgcctgaaatactacgagtatgaattcatggagttggcctgccaatgtcccgccgttgtatgctgccgctgcgcccctacacagaaagcacaaatcgtccgacttctgcaggagcgtacaggtaagctcacgtgcgcagtcggagatggcggaaacgacgtgagtatgattcaggagagtgactgtggcgtgggcgtggagggtaaagaaggaaagcaggcctccctggcggcagatttcagtataacccagttcaagcatcttggtaggctcttgatggtgcatggtagaaacagctacaaaaggtcagccgcactgtcccagtttgtgatccaccgaagcctctgtataagtaccatgcaggccgtattctcatcagtcttctacttcgcgtcagttcccctctaccagggattcctgattattggatacagtaccatctatacgatgtttcccgtcttctctctggttttagacaaggacgtgaaaagtgaagtggccatgctctatcctgagctttacaaagatctgctcaagggccggccactatcttataagaccttccttatatgggtcctgatttccatatatcaaggcagcacaataatgtatggtgcgctcctgttgttcgagagcgagtttgtccatattgtggctatttccttcacaagccttattctgaccgagcttctgatggttgctcttactattcagacatggcactggcttatgaccgttgcggagttgctgtctcttgcttgttacatcgcttccctggttttcttgcacgaattcatcgatgtctatttcatcgccaccctctccttcctctggaaagtgagcgtgattacgctggtgagctgtttgcccctctacgttctaaaatatctgcgccggcgattctccccccccagctactccaagctgacttcatag

SEQ ID NO: 40480 - DNA, 2781 bp, Artificial Sequence
  Description of Artificial Sequence: Synthetic coding sequence
atgaccgacaacatccccctgcagcccgtgcggcagaagaagcggatggattcacgccccagggctggatgttgcgagtggctgcgctgctgcggaggcggcgaagcgcggccaaggacagtttggctgggtcatccagaaaaaagagaccaacggtaccctcggaatgtgattaacaaccagaagtataatttcttcacatttctccctggtgtgctgttcaaccaatttaaatatttctttaacctgtattttctactcctggcttgctctcagttcgtccctgagatgcgactgggggccttgtacacgtattgggtgcccctgggcttcgtgctggccgttactgtgattcgggaagcagttgaagagattagatgctacgtgcgggataaggaggttaattcccaagtttatagtagacttactgcaagaggcacggtggtgggagtggtattgtacacaggcagagagttgcgatcggtgatgaacacctctaatccgaggagtaagatcggattattcgacctggaggtgaattgcctgaccaaaatattattcggggccttagtggtggtgtccctggtcatggtcgccctgcagcacttcgccggccggtggtatctgcagatcattcggttcctgctgctcttcagcaacatcattccaatcagtctccgcgtgaacctggatatgggcaaaatcgtttacagctgggtgatccgacgggacagcaaaattcctggtaccgttgttagatcttccacaattccggagcaactgggcagaatcagttacctgttgaccgacaaaactggaaccctcacccagaacgagatgatctttaagagactgcacttaggaaccgttgcctatggtttggattcgatggatgaagtccaatctcacatattttcaatctatacccagcagtcacaggatccaccggcgcagaaaggccccactcttaccacgaaagtcagacggacaatgagttcccgggtgcacgaagccgtgaaagctatcgcgctgtgtcataacgtgacccccgtctatgagagcaacggagtgacggatcaggcagaagcagaaaagcagtacgaggattcttgcagggtgtatcaggcctcctcccccgacgaggtcgccttggtgcagtggactgaatcagtgggcctgacactggtgggacgtgatcagtcatcaatgcagctgaggactccaggtgatcaaatcctcaatttcacaatactccagatcttcccctttacatacgagagtaagcgcatggggatcattgtgagggacgaatctaccggcgagatcaccttctatatgaaaggggcggacgtagttatggctggtatcgtacagtacaatgattggctcgaagaagaatgcggaaatatggccagggagggacttcgggtgcttgttgtcgctaaaaaatctctcgccgaagagcagtatcaggacttcgaagcacgctatgtacaggcgaaactgagtgtccacgacaggtcactcaaagtggccaccgtaattgaatcattagagatggaaatggaattgctgtgtttgacaggggtagaggaccagctccaggcagacgtgcggcccacgctggaaaccctgagaaatgctgggataaaggtgtggatgctcaccggagacaaattagagaccgcaacgtgtacagccaagaacgcccacttagtgactcgaaaccaggacatccacgtattccggctcgtcacaaatagaggcgaagcccacctggagctgaacgcattccgacggaagcatgattgcgccctggtgataagcggcgacagcctcgaggtctgcctgaaatactacgaatacgagtttatggagcttgcctgtcaatgcccagccgtggtttgctgtcgttgcgccccaacgcaaaaagcccagatcgtgcggcttttgcaagagagaactgggaagttgacatgcgctgtcggcgatggaggcaatgatgtgtctatgatccaggaatctgattgcggtgtaggagtagagggcaaggagggaaaacaggcgtctctcgctgctgatttttcaatcacacagtttaaacatttgggtcgcttgctcatggttcatggaaggaattcctataaaagaagtgccgcactatctcagttcgtgatccatcgttcgctgtgcatctccaccatgcaggcagtattctcttcggtcttctactttgcctctgtcccactctatcagggattcttgataatcggatactctactatatataccatgttccccgtgtttagtctggtgctggacaaggatgtgaaaagcgaagtcgctatgttgtatccagagttatataaggacttattgaagggtaggcctctttcatataagacattcctcatctgggtactgatttccatctaccagggctccaccattatgtatggggcactgcttctgttcgaatcagaatttgtccacatcgtggctatttcgtttacttctctgatactgactgagctgctgatggtggcactgacaatccagacatggcattggctcatgaccgtagcagaactgctctcccttgcatgctatatcgcatccctcgttttcctacatgagttcatcgatgtttattttatcgcaactctgtcctttctgtggaaagtgagcgtgattactttggtgtcttgtttgccactgtacgtcctcaagtatctgcgtcggaggttttccccacccagttactccaaacttactagctag

SEQ ID NO: 40481 - DNA, 4386 bp, Artificial Sequence
  Description of Artificial Sequence: Synthetic coding sequence
atggccctgagcgtggacagcagctggcaccggtggcagtggcgggtccgcgacggtttccctcattgtcctagcgaaactacccccttgctgtctccagaaaaagggcgtcaatcttataacttaactcagcagagggtggtttttcctaacaacagtatctttcaccaagattgggaagaggtcagccggaggtatcctgggaatagaacatgtactactaaatataccttgtttacgtttcttccaaggaatctgtttgaacagtttcaccgttgggccaatctgtattttctgtttctcgtgatcttaaattggatgccatccatggaggtttttcatcgcgaaataacgatgctgccgctggcaatcgtgctcttcgtgatcatgattaaagacgggatggaagactttaagcgacacagatttgataaggccattaactgctcgaacatccggatctatgagcgtaaggagcaaacttatgtgcaaaagtgctggaaggacgtaagagtgggtgacttcatccagatgaagtgcaatgagatcgtgcctgcagacatcctgttattgttctcctcagaccctaacggtatttgccacctggaaactgctagcttggatggagaaaccaatctgaagcagcggtgcgtggtcaagggcttctcacaacaggaagtgcaattcgaaccagaactgttccacaataccatcgtgtgtgaaaaacctaacaatcatctgaataagtttaaaggttatatggaacaccccgatcagacacggacagggtttggctgcgagtctcttcttctaaggggttgtacaatccgcaacactgagatggctgttgggatagtgatttacgccggacatgagaccaaggcaatgttaaacaattcaggacccagatataagcggagtaaaattgaacggaggatgaacattgacatttttttttgcattgggattctgattcttatgtgcctgattggcgctgtggggcatagtatctggaacggcacctttgaggagcatccgccattcgatgtgcccgacgccaatggttcttttttgccttcggccttgggcggattctacatgtttctgactatgatcatactgctccaggtgctcatccccatcagcctctacgtgagcatcgaactggtgaaactcgggcaggttttttttctcagcaacgatttggatctttacgacgaggaaacagatttgtcaattcagtgtcgggctttgaacatcgcggaagacctgggacagattcagtacatctttagtgataaaactggcaccctgaccgagaacaagatggttttcagaaggtgtaccattatgggcagtgaatattcacaccaagagaatgccaagcgccttgaaactccaaaagagctcgattccgacggtgaagagtggacacagtatcaatgtctcagtttttcagctcgttgggcccaagaccccgctacaatgagatctcagaagggtgcacaacccttgcggagatcccagtccgctcgggtccccattcagggccattatcgtcagaggtcaatgggccaccgagagagctcacagcctccagttgccttttccagctctatcgaaaaggatgtcaccccagataaaaacctgcttacgaaggtgcgtgatgccgctctctggttggaaactctgtcagatagcaggcctgccaaggcctctctgtccaccacaagctccatcgcagattttttcctggcgctcaccatttgcaacagtgtcatggtttccaccaccacagagccgcggcagcgggtgacgatcaaaccttccagtaaggccttgggcacaagccttgagaaaattcagcagctgttccagaagctcaaacttttgtccctgagccaaagcttttcttctactgccccctccgacactgacttaggcgagtctctgggagcaaacgtggcaacaaccgacagcgacgagagggatgatgcctccgtgtgttccgggggtgattcaacagatgatggggggtatcgatcttctatgtgggatcaaggggatatcctcgagtctggatcgggaacttcactggaggaggcgctcgaggcccctgccactgatcttgccagacccgagttttgctatgaagctgaatcacccgatgaagcagccctcgtacatgctgcacatgcatacagcttcaccttggtatcccgtaccccagagcaagtcacggtgcgcctaccacaagggacttgtttgaccttttccttactgtgtacattgggtttcgattctgttagaaagagaatgtctgtcgtggtccgacacccactgacaggtgaaatcgtggtttacacaaaaggcgcggacagtgtcataatggacctcctcgaggacccggcctgcgtaccagacatcaacatggagaaaaagctgaggaagatacgtgctcggacacagaagcacttagacctgtacgctcgggatggattaaggacattatgcatcgctaagaaagtggtgtctgaggaggattttcgtaggtgggccagtttccgacgtgaagctgaggcgtcattggataaccgcgatgagcttctgatggaaacagcccagcatctggaaaatcaactcacactgctcggggctactgggattgaggacagacttcaagaaggcgttcccgacacaatcgcaacactgcgcgaagccggcatccagctatgggtcctgactggcgataagcaggagaccgccgtgaatattgcgcactcttgccgcctgctgaaccagaccgacactgtgtatacaatcaacacggaaaaccaagagacttgcgagtcgatccttaattgcgccctggaagagctcaaacagttcagagagctacagaagccagacaggaagttgttcggcttcagactaccttccaagactccgagtattacctccgaggccgtcgtgccagaggccggcctggtcatagacgggaagacactaaacgctatctttcagggtaaactagaaaaaaagtttttagaacttacacagtattgtcgaagcgtactgtgctgtcggtcgacacctctccagaagtcaatgattgtgaagctcgtgagggataagctgagagtcatgactctgtccatcggagatggagccaacgacgttagtatgatccaagccgcagatataggtatcggcattagcggccaggagggtatgcaggcggttatgtcatccgattttgctattaccagatttaagcaccttaaaaagctactgttagtgcacgggcactggtgctacagcagactcgcaagaatggtcgtgtactacctgtacaagaacgtctgctacgtgaacctgttgttttggtaccagttcttttgcggcttctcttcctccactatgattgactattggcaaatgattttctttaatttgttttttacaagcctacctcctctcgtctttggcgtactagataaagatatttccgctgaaactctcttagcattgcccgaactgtacaagtctggacagaattcagaatgctacaatctcagtacattttggatttcaatggtggatgccttctaccagtcacttatctgcttctttatcccttacctcgcctacaaaggatccgacatcgatgtttttacctttggaactccaattaataccatcagtcttaccacaatactactgcatcaggccatggagatgaagacttggaccatcttccacggcgtggttctccttggaagctttctcatgtatttcttggtgagcttgctgtataatgccacatgtgttatttgcaactcgccaactaacccttactgggtgatggagggacagttatctaatcctacgttttatttggtgtgctttctgactcccgtcgtcgcacttcttccgaggtacttcttcctcagtctgcaggggacttgcggaaagagtctgatctcaaaagcacagaagatcgacaagctgccaccagataaacggaacttagaaatccaatcatggcggtcccggcagcggcctgccccagtccccgaggtggcccgtcctactcatcaccctgtttcttccatcacaggacaagatttctcagcgagtacacctaagtcctccaatccccccaaacgtaagcacgtggaagagtcagtactccacgaacagagatgcggcaccgaatgtatgagggatgattcctgcagtggcgatagcagtgctcagctttcttctggtgagcatttgcttggcccaaatcgcatcatggcgtactcccggggccagaccgatatgtgtcgctgtagcaagcggtcttcgcatcggcgctcacaatcttctctgactatctag

SEQ ID NO: 40482 - DNA, 4281 bp, Artificial Sequence
  Description of Artificial Sequence: Synthetic coding sequence
atgaccgaggccctgcagtgggcccggtaccactggcggcggctgatccggggagctacccgagacgacgacagtgggccctacaattattcctcactcctggcctgtgggaggaaatcatcccagacaccaaagctgtccggccgacaccgcatcgttgttccacacatccagccatttaaagacgaatatgagaagttttctggcgcgtatgtcaacaacaggattcgcactaccaaatacaccctgctcaactttgttcccagaaacctgttcgagcagttccaccgcgccgcaaatctgtactttttgtttctggtcgtgctcaactgggttccgcttgtggaggcttttcagaaagaaatcaccatgttgcctctggttgtcgtgctgactatcatcgcaatcaaggacggactggaagactataggaaatacaaaattgataagcagataaataatctgattaccaaggtttactcaagaaaagagaaaaagtacatagacaggtgttggaaggatgtgaccgtgggagactttatccggttgtcctgtaatgaggtgattccagctgacatggtgctgttgttttcaacagatcctgatgggatttgtcacatagaaacatccgggctagatggggaatcaaatctcaagcagcgccaggttgtgaggggctacgctgaacaggattctgaagtagatcctgaaaagttttccagcaggatagagtgcgaatcaccgaataacgatctgtcacggtttcgtggctttctggaacactcaaataaagaacgagtcgggctttctaaggagaatctcctgctacgagggtgcaccataaggaacaccgaagcagtggtcggcattgtagtgtacgccggacacgagacgaaggcaatgctcaataatagcgggccacgatacaagcggtctaagctggaaaggagggccaacacagatgtgctgtggtgcgtgatgcttctggtgattatgtgtctgacaggggccgtgggacatgggatatggctctctcgttatgagaagatgcacttctttaatgttcctgaacctgacggccatatcatctcacccctgttagccggattttacatgttctggaccatgattatacttctgcaggtcctgatcccaatatctctgtacgtgtctatcgaaatcgtgaagctcggccagatctattttatacagagtgacgtcgacttttataacgaaaaaatggacagcatcgtgcagtgcagggctctaaatatcgctgaagatctggggcagattcaatacttgttctccgataaaaccggcaccctcaccgagaataaaatggtgttcaggcggtgcagtgttgcagggtttgattattgtcacgaagaaaacgctagaagactggaatcctatcaagaggctgtgagtgaggacgaggacttcatcgacaccgtgagtggatccctttcaaacatggctaaacccagagccccttcctgccgcaccgtgcacaatggaccgctaggaaacaagccctctaaccatcttgcaggcagtagctttactttgggaagcggtgagggtgcctccgaggtccctcactcccgccaggccgccttcagcagtccaattgaaaccgatgtcgtgccggacacaaggttgctcgacaagtttagtcagatcactccaagactgttcatgccgttggacgaaactatccagaatcctcctatggagacactgtacatcatagactttttcattgccctggccatctgcaatacagttgtagtgagcgcacccaaccagccaagacaaaagatcagacacccaagtctcggaggcttaccgattaaatcgctggaggaaattaaatctctcttccaacgatggagtgtcagaagatcctcctcaccttcgttgaactctggcaaggaacccagctccggcgtccctaacgcattcgtcagccggctccctctgttctcccgcatgaaacctgcatcccccgtcgaggaagaagtgtcccaggtctgtgaatcaccccagtgtagttcttccagtgcctgttgcaccgagaccgaaaaacagcacggagatgccggattactgaacggcaaagccgagtctctcccaggccagccactagcctgtaacttgtgctatgaagccgaaagtcctgatgaggcagcgttggtgtacgcagcccgggcctaccagtgcacactgagatctaggacacctgaacaggtgatggtcgacttcgcagcgctgggacccctgaccttccaactcctacatatcctgccttttgacagcgtcagaaagagaatgtcagtggttgttcggcatccactgtcaaatcaagtcgttgtctatactaagggagctgacagcgtcattatggagctgctgagcgtggctagccccgacggggcaagtctcgagaaacagcagatgatcgttcgggaaaagacccagaaacatttagatgattatgccaagcagggtttgcgtacgctgtgtattgctaagaaagtgatgagcgatacggagtacgccgaatggctccgtaatcatttcctggcagagacctcaattgataaccgcgaggaactcctgctcgaaagtgcaatgaggttggagaataaactaaccctacttggcgctacggggattgaggacaggctccaagagggcgtccccgaatcaatcgaggcactccacaaagcgggtattaagatttggatgttgacaggagataaacaggagaccgcagtgaatattgcctacgcgtgtaaactcctcgagccagacgataaattattcattctgaatacgcagtccaaagacgcctgtggcatgctgatgtctactatcctcaaagaactgcagaagaagacccaggctttaccagaacaggtttctttatcagaggacctcctgcaacctcctgttcctcgcgacagcgggcttcgcgccggactcattataacaggaaaaacgctggaatttgccctgcaagaatccctccaaaaacagtttctagagctcacctcctggtgtcaagcagtcgtttgctgtagagcgacgccacttcagaagtccgaggtggtgaagctcgtgaggtcccacttacaggttatgacactggccatcggtgacggggccaacgatgtatctatgatccaagtagcagacatcggaattggagtgagcggccaggagggtatgcaggctgtgatggcttcagattttgccgtttctcagtttaagcacctctcaaaactcctactggtgcacggccactggtgctatactcggctctccaacatgatcctctacttcttctacaagaatgtcgcctacgtgaatctgctcttttggtatcagttcttctgtggtttctctggtacatccatgactgactattgggtgctcatcttctttaatctcctttttaccagtgcgccccccgtcatttatggagtcttggagaaggacgtatccgccgaaaccctaatgcagctccccgagctctatcgtagcggccaaaaaagtgaagcttacctgcctcacacgttctggatcacccttcttgatgctttttatcagtcactcgtctgtttcttcgtaccatacttcacctatcagggatccgacacggacatatttgcgttcgggaatccccttaatactgccgcgctcttcatcgtactattgcacctagtgatcgagagtaagtcacttacctggatacatctcctcgtgataattggctctatcctctcctatttcctcttcgccattgtgttcggggccatgtgcgtgacatgtaaccccccctccaacccttactggattatgcaggagcacatgcttgacccagttttttacttggtctgcatcctcactacttccatagcattgctacctcgttttgtgtaccgagtgttacagggcagcctgttcccttcacccattcttcgagctaaacatttcgaccgtctgacccccgaagagcggactaaggctctgaaaaagtggcgcggggccgggaaaatgaaccaggtcacttctaaatacgctaaccagtcagccgggaaatcaggccgacgaccgatgcctggtccctcagcagtgttcgcaatgaaaagcgccagtagttgtgccatcgagcaggggaatttgtcactgtgtgaaactgctctagaccagggctactcagaaacaaaagcttttgagatggccgggccatctaaaggaaaagagtcatag

SEQ ID NO: 40483 - DNA, 1608 bp, Artificial Sequence
  Description of Artificial Sequence: Synthetic coding sequence
atgaccgaggccctgcagtgggcccggtaccactggcggcggctgatcaggggagccacaagagatgatgatagcggcccatacaattactcctcattactcgcttgcggacgcaaatcctcccagacaccgaagctgtcaggcagacatcggatagtggtcccacatatccaaccgtttaaagacgagtatgaaaaattctcgggcgcatacgtcaataaccgtattcgaaccaccaagtataccctgcttaacttcgtgcctcgtaatctgttcgagcaatttcaccgggctgcaaatctttatttcctttttttagtcgtgttaaactgggtgcctctggtagaagcatttcaaaaagagatcacaatgctgccattggtggtggtgttgacaattatcgccataaaggacggactggaagactaccggaagtacaaaattgataagcaaattaacaatctcatcacaaaggtgtatagccgaaaggagaaaaagtatattgatcgctgctggaaggatgtcacagtcggagactttatccgtctatcttgtaatgaagttataccagccgacatggtgctcctattttctaccgaccccgatgggatctgccacattgagacatctggccttgacggcgaaagcaaccttaaacagcggcaagtggtacggggatatgccgagcaagacagcgaagtggatcctgaaaaatttagttcccggatcgaatgcgagtctccaaacaatgacctcagccggttcaggggcttcttggagcactcaaacaaggagagggtgggtctgtcgaaagaaaatctcctgctgcgtggctgcacaatcaggaacactgaggccgttgtaggaatcgtggtttacgccgggcatgaaaccaaagctatgttgaacaactccggcccgaggtacaaacgatcaaaactggagagaagggccaacacggacgtgctatggtgtgtgatgctcctcgtcatcatgtgcttgacgggggcggtcgggcatggcatttggctgtcacgatacgaaaagatgcacttcttcaacgtgcccgagccggatggccacatcatcagcccactgctggccgggttttacatgttctggactatgatcatcttgctgcaactgggccagatctattttatccagagtgacgtagatttttataacgaaaagatggattccattgtgcagtgcagagcgctcaatatcgccgaagacctgggccagattcagtacctattttccgataaaaccggaaccttgacggaaaacaagatggtgtttcggagatgcagcgttgccggatttgactactgtcatgaggagaatgcacggcggttagagtcttatcaagaggccgtaagtgaggatgaggacttcattgacaccgtatccggttcactttcaaatatggcaaagccccgtgctccgagctgcaggacggtgcacaatggcccgttgggcaacaagccttctaatcatttagctgggagctctttcaccctaggcagtggagaaggggcaagtgaagtgccccacagcaggcaggccgcattcagttcccccatcgtctctatgaacgcctag

SEQ ID NO: 40484 - DNA, 3399 bp, Artificial Sequence
  Description of Artificial Sequence: Synthetic coding sequence
atgcagatggtgcccagcctgccccccgccagcgagtgcgccggcgaggaaaaacgcgtgggcacgcgcaccgtgttcgtcggaaaccaccctgtcagcgagactgaggcatacattgcgcagcggttctgcgacaaccgtatcgtgtctagcaaatacacgttgtggaacttcctaccgaagaacctgttcgaacaattcaggagaattgcaaacttttattttctgatcatattcttggtccaagtgaccgtggatactcccacgtcccctgtaacctccggcctgccattgttttttgtaattactgtgactgcaattaagcagggatacgaggattgcctgcgacatcgagccgacaacgaagtgaataagagtacagtgtatattattgaaaacgcgaagagagtgagaaaagagtctgaaaaaatcaaggtcggggacgtggtagaggtgcaggctgatgagacgttcccatgcgacttaatcctcctgtcctcgtgtactacagacggcacatgctatgtgaccacagccagcctcgacggggaatctaactgtaaaactcactatgccgtacgggataccatagctctttgcacagccgaatcaatcgacactctgcgggcagctattgagtgcgaacagccccaacctgatttgtataaatttgttggtcgcatcaatatctattcaaattccctcgaggcggtcgccagatccttgggtcccgagaatctgctgctgaagggggcaaccctgaaaaacaccgaaaagatttatggggtagctgtgtacaccggaatggaaaccaagatggcactgaattatcagggaaagagccaaaaacgcagtgccgttgagaaaagcataaatgctttccttattgtgtatctgttcattctactcactaaagcagctgtgtgtaccacactgaagtacgtctggcagtctaccccttacaatgatgagccttggtacaatcagaaaacgcagaaggaacgggagacacttaaggtactgaagatgttcaccgatttcctctccttcatggttcttttcaattttatcatccccgtcagtatgtacgtaaccgttgaaatgcaaaagttcttgggttctttctttatcagctgggacaaggatttctatgacgaagagatcaacgaaggggccctcgtcaatacctcggatctcaacgaggagctggggcaggtcgattacgttttcacagataagactggtacactgacggagaattcgatggaattcatagagtgctgcattgacgggcataagtataagggggtcacacaggaggtggacggtctctctcagacagatggtaccctgacctatttcgacaaggtggataagaaccgggaggagctgtttctaagagccctgtgcctgtgtcacaccgtggagatcaagactaacgacgccgtcgacggggctaccgagtccgcagaactgacgtacatttcttcgagccctgacgagatagccctggtcaagggggcaaaacgatacggtttcacttttcttgggaatagaaacgggtatatgcgcgtggagaatcagcgcaaggagatagaggagtacgagttgctccatactctgaacttcgatgcagtgcgtcgaaggatgtcagttatcgtgaagactcaggaaggggacattctgctgttttgcaagggcgcggactctgctgttttcccccgggtgcagaaccatgaaatagaactgaccaaagtgcatgtcgagcgaaacgccatggatggttacaggactctgtgtgtggctttcaaggagatagctcccgatgactatgagaggattaaccgtcaactaatcgaggcaaagatggcgttgcaggacagggaggagaaaatggagaaggtttttgacgatatcgaaactaacatgaatctgatcggggcaactgctgttgaggacaaacttcaggaccaggccgctgagaccatcgaggctttacacgccgccggattaaaggtgtgggtcctgactggtgacaagatggaaacagcaaagtctacatgctacgcttgccggctctttcaaacaaacactgaactgcttgaactgaccacaaaaaccattgaagaaagcgagcgaaaagaggatagattgcatgagcttctcatcgaatatcgcaagaaattgctgcatgagttcccaaagtctacacgctctttcaagaaggcctggactgaacaccaagaatacggcctgattattgatggttcaactttatccctcatcctaaatagttctcaagatagctccagcaataattataagtctatcttcttgcaaatctgtatgaaatgcacagctgtactgtgttgtcggatggcacccttacaaaaggcccagatagtcagaatggtaaaaaacctcaagggcagcccaatcacacttagcatcggtgacggtgcaaatgatgtaagtatgatcctggaatctcacgtgggcattggaatcaaggggaaggagggccgacaagctgctagaaactctgattatagcgtcccaaagtttaaacacctgaagaagttgctgctggcgcacggtcatctctactatgtgagaatagcacacctggtccagtacttcttctataagaacctgtgtttcattttgcctcagttcttgtaccagtttttttgtggcttttctcagcagccactctacgatgccgcatatctgactatgtacaatatttgctttaccagcttaccaattttggcctatagtttgttagagcagcatataaatattgacactctgacttcagacccccggctctacatgaagatctccgggaatgcaatgctccaactcggacctttcttatattggacattcctcgccgcattcgaggggacagtcttctttttcggcacctactttctcttccaaaccgcgtctctcgaggaaaacggcaaagtttatgggaactggacgtttggaacaatcgtctttacggtacttgtattcactgtcacacttaagctcgcactggacacccgtttttggacttggattaatcattttgtgatctgggggtcgctggccttctacgtcttcttctccttcttctggggaggcatcatatggccgtttcttaagcaacaaaggatgtacttcgtgttcgcacagatgctgagcagcgtcagtacctggctcgcaataatcctgctcatcttcataagcctgtttccggagatcctactgatcgttctgaaaaacgtgcggaggcggagtgcccgtagaaatctttcctgtagacgcgcatcagattcgctgtctgcaaggccttctgttagacccctcctcctgcgcaccttttcagatgaaagtaatgtcctctag

SEQ ID NO: 40485 - DNA, 3327 bp, Artificial Sequence
  Description of Artificial Sequence: Synthetic coding sequence
atgcagatggtgcccagcctgccccccgccagcgagtgcgccggcgaggagaaacgggtggggactagaacggtgttcgtgggcaaccatccggttagcgaaaccgaagcttatatcgcccaaagattctgtgataatcgcatcgtctcgtctaagtacactctttggaacttcctcccaaagaatctcttcgagcagttccgcaggatcgcaaatttctacttcctgatcatctttcttgttcaggtcactgtagacactccgacgagccctgtcactagcggactgccgttgttctttgttatcactgtaaccgccattaaacagggttatgaagattgcctgcgccacagagccgacaacgaggtgaataaatccacagtgtatatcatcgaaaatgcaaaaagggtgagaaaagagtcggagaaaattaaagtgggggatgtggtcgaggtgcaggccgacgagacattcccttgcgacctgatcttattgtcgtcatgtaccactgatggaacatgttacgtgacaacggcctctctcgacggcgaatcaaattgtaaaacacactatgcagtcagggacaccatcgcgctgtgcaccgccgaatctatcgacacattgagggccgcgatcgaatgtgaacagccgcaaccagacctctacaaattcgtgggccgtattaatatatatagtaattctctggaggcagtggccaggtctctgggacctgagaatctcctactgaagggggccacactcaaaaacaccgaaaaaatttatggcgttgccgtctacaccgggatggagaccaaaatggctctaaattatcaagggaaatcacagaagaggtccgcggtggaaaaatccatcaacgcctttttaattgtgtacctgttcatccttttgaccaaagccgctgtttgtaccacactgaagtatgtctggcagtcaacgccctacaacgatgagccttggtataaccaaaagacacagaaggaacgggaaactcttaaggtgttgaagatgtttaccgatttcctctcattcatggtgctctttaacttcatcatacctgtgagtatgtacgtgacggtggagatgcagaaatttctcggctctttctttatatcgtgggataaggacttctacgacgaggaaatcaacgagggggctctcgtgaatacaagcgacctaaacgaggagcttggccaggttgactatgtctttacagacaaaactggtactctcaccgagaactctatggaattcattgagtgctgtattgacggtcacaagtataagggagtcacccaggaggtagatgggctgagtcagacggacgggacattgacctactttgataaggtcgacaaaaatagagaggagctgttcctgcgagccctctgtctctgccacacagtagaaattaagacaaatgatgctgtagatggagcaacagaatcagccgaattaacatacatcagttcctctcccgatgagattgccctcgtgaagggagccaagcgttatggattcacttttttgggaaaccgcaacggctatatgcgtgtggaaaaccagagaaaggaaatagaagaatatgaactgttacacacactgaactttgacgcagtccgaagacgaatgtccgtcattgtgaaaactcaggagggcgatatcctcctgttctgtaagggggccgattcagcagtttttccccgagtgcagaatcatgaaatcgagctgactaaggtgcatgtggagagaaatgcgatggatggttataggacactatgcgtcgcgttcaaggagatcgcacccgatgactatgagaggatcaaccggcagctcattgaagctaagatggcactccaggatcgagaggaaaagatggagaaggtctttgatgatatcgagacgaatatgaatctaatcggggcgaccgccgtagaagataaactccaagaccaagccgcagagactattgaggcgctgcacgccgccggactgaaggtctgggttttgaccggcgataaaatggagaccgccaagtccacctgctacgcctgccggttgtttcagacgaacacagaactgttggagctgaccaccaaaactatcgaagagtccgaaaggaaggaggacagactccatgaactcttgatcgagtatcggaaaaaacttctgcatgaattcccgaaaagcaccagaagctttaagaaagcctggactgaacatcaggagtacgggcttattatagatggcagcacattgtctctgattctgaactcgagtcaggattcaagctcgaacaactacaaatccatattcctgcagatttgtatgaagtgtactgccgtgttgtgttgcagaatggcccctctgcagaaagcgcaaatagttaggatggtaaagaatctcaagggatctccgattacactaagcatcggcgacggtgccaacgatgtgagcatgattttagaaagccacgtgggaatagggattaaaggcaaggagggaagacaggccgcccggaattcagactatagcgttccaaagtttaagcacctgaagaaactcctgctcgcccacggccacctctactacgttcggattgcccatttggtccaatatttcttctataaaaacctgtgtttcatcctaccacagtttttgtaccagttcttctgtggcttcagccagcagcccctttacgacgcagcttaccttaccatgtacaatatctgtttcacatccttgcctatcctagcctattctctgctggagcagcatatcaacatcgacacactcacaagcgatcccaggctgtacatgaagattagtgggaacgctatgctgcagctcggcccctttctttactggacctttctggcggcattcgagggcaccgtgtttttttttggcacatactttctatttcagacagcctccctggaagagaatggaaaagtatatggtaattggacatttggtaccattgttttcacggtactggtgtttacagtcaccctcaagttggcattggacaccaggttctggacgtggatcaatcacttcgtaatttggggaagcttggcattctatgtgttcttttcatttttttggggaggaatcatctggccttttctgaagcagcagcggatgtattttgtatttgcccagatgctgtcatcagtgtcaacttggctagcaatcatcctacttatattcatcagcctgttccccgaaatcctcctgatagttttaaaaaacgtgagacggcgatcggcccgagttcatcatctgattagctcctcggcctag

SEQ ID NO: 40486 - DNA, 3360 bp, Artificial Sequence
  Description of Artificial Sequence: Synthetic coding sequence
atgcagatggtgcccagcctgccccccgccagcgagtgcgccggcgaggaaaagagggtgggcacaagaacagtgtttgtgggaaatcacccagtttccgagacggaagcgtacatcgcacagcgcttctgcgataatagaattgtgtcgtctaagtacacactatggaatttcctccctaagaacttgttcgaacaattccgtcggattgccaacttctactttttaataatcttcttggtgcaagtgaccgtggatacacctacttcccccgtaacaagtggtctcccactgttctttgtgatcacagtaacagccattaagcagggctatgaggattgtttgagacatagggcagacaacgaggtgaacaagtctaccgtgtacatcatagaaaacgcaaaacgtgtgcgtaaagagtccgagaaaatcaaggtaggcgatgtggtggaggttcaggccgacgagacgttcccgtgtgatttgatcttgctgagtagctgcaccactgacgggacatgctatgtgaccactgcatcactggatggggagagtaactgcaaaactcactatgccgtgcgagatacaatagcactctgcaccgcggaatcgatcgacaccctaagggctgcaatcgagtgtgaacagccacagcccgacctttataaatttgtggggagaattaatatatattcaaatagtctggaggctgttgcacgatctctgggacccgaaaatctcttgttgaagggcgctacactgaagaatacagagaagatctacggagtcgccgtgtacactggtatggaaactaagatggctttgaattatcagggcaagagccagaagaggtccgctgtggagaagagtatcaatgctttcctaattgtttatctgtttattctcctgactaaggccgccgtgtgcacaacgctgaagtacgtgtggcagtccacaccttacaatgatgaaccctggtataatcagaaaactcagaaggagagggaaaccctcaaggtgttgaaaatgtttaccgatttcctctctttcatggtgctatttaatttcataatcccggtttctatgtatgtcactgtggagatgcagaagtttctcgggtcattctttatctcatgggacaaagacttttacgatgaggaaattaatgaaggtgctctggttaacacaagtgacctcaacgaggaactgggccaggtggactacgtttttaccgacaagacaggtactcttacagagaacagtatggagttcattgagtgctgcattgacggccacaagtataagggggtgactcaggaagtcgacgggctgtcccagaccgacggaactttgacctacttcgacaaggtggataaaaatagggaggagctgttcctgcgagccctctgtctttgtcatacagttgagataaagactaacgatgcagtggatggagcaactgagtctgcagaactgacatatatttcctcaagccctgacgaaatcgcacttgtcaaaggcgctaagaggtatggctttaccttcctgggtaatcggaacgggtatatgcgcgtcgaaaatcaacggaaggagatcgaggagtacgaactgctgcacacgcttaacttcgatgcagtaaggcggcgcatgagcgtgattgtcaagacgcaggagggggatattttgctgttttgtaaaggcgctgattccgccgtgtttcccagagttcagaaccacgaaattgagcttaccaaggtccacgtggagcgcaacgctatggacgggtatagaactctgtgtgtggcattcaaggaaattgccccagatgattatgaacgcatcaaccgtcagctgatcgaggctaaaatggcgctccaggaccgtgaggagaagatggagaaagtgttcgacgatattgagaccaatatgaatttgatcggcgccacagccgttgaggacaaattacaggaccaggccgccgagaccatcgaggccctgcacgctgctgggctgaaagtgtgggtcctgaccggggataagatggagaccgccaagtcaacatgctacgcctgccgcctgtttcaaactaataccgagcttctggagctgacgacaaaaacaatagaggaatccgaacgtaaagaagacagattgcacgagttgctgatcgaataccgcaagaaactgttacacgagttcccgaagtcaactaggtcctttaaaaaggcctggactgagcatcaagaatacggactgataatcgacggctctaccctctcccttattctgaacagctcacaagactcctctagcaacaattataaaagcattttcctacagatttgcatgaagtgtaccgcagtcctgtgttgccggatggcaccactgcaaaaggcacaaatcgttcgaatggtaaaaaatctgaaaggttctcccattactctgtcaatcggcgacggcgccaatgacgtttcaatgatcctagagagccatgtggggatcggcatcaaggggaaagaaggcaggcaggctgctcgcaattccgattacagtgtacccaagttcaagcacttgaagaaacttctgctggcccatggacatctgtattatgtacgaatcgcccatctcgtgcagtactttttctacaaaaacctctgttttattctcccacagttcctctaccagttcttttgtggctttagccagcagcccctgtacgatgctgcgtacctcaccatgtacaatatctgttttacatcactgcccatcctggcctactccttgcttgagcagcacatcaacatcgatacacttacatcagaccctcgtctgtatatgaaaatctccggcaacgcaatgctgcagttggggccctttctgtattggaccttcctggctgccttcgaggggacggtctttttcttcggaacctatttcttgttccagacagcgagcctggaggaaaatggcaaagtctatgggaattggacatttggcacaattgttttcacggtgttggtgttcaccgtcacattgaaactggcgcttgacacacggttttggacctggatcaatcactttgtgatttggggttctcttgcgttttatgtttttttctcattcttctggggcggcatcatctggccattcttgaagcagcagcgcatgtacttcgtgttcgcccagatgctttcaagtgtgtcaacatggctcgcaatcattttactcatttttatttctttgttcccagaaatcctgctgattgtgcttaaaaatgtcagacgccgcagcgcccggaacccaaacctcgaactacctatgttgttatcgtacaaacataccgatagcggttacagctag

SEQ ID NO: 40487 - DNA, 3387 bp, Artificial Sequence
  Description of Artificial Sequence: Synthetic coding sequence
atgcagatggtgcccagcctgccccccgccagcgagtgcgccggcgaagaaaaaagggttgggacccggacagtgttcgtgggcaatcatcccgtctcggagacagaagcgtacatagcccagcgattctgcgataacaggattgtctctagcaagtataccctgtggaactttctccccaagaatctgtttgagcagttcaggcgtatcgctaacttttactttctgatcatttttctcgtgcaggtgacagtcgatacacccacaagccctgttacgagtgggctgcccctgtttttcgtgattaccgtgacagccatcaaacagggctacgaggactgcttaagacaccgagcagataatgaggtgaataagagtactgtttacatcatcgaaaacgccaagcgcgtgaggaaggagtcggaaaagattaaggtcggggatgtagttgaggtacaggctgacgagacctttccatgtgatctcattcttttgtcctcatgcacgactgatggcacatgttatgtgactaccgcatccttagatggcgagtccaattgtaagacacactatgcagtcagagacaccatcgctttgtgcaccgccgaaagcatcgacacactgagggctgccatcgagtgtgaacagccacagccggacttatataagttcgtcggccgtattaacatctactccaactcactcgaagccgtcgcacgtagcctggggccagagaatctgctgctgaagggagccaccctgaagaacacggagaagatttatggcgtggctgtttacacaggaatggagacaaagatggcgctgaactaccaggggaagagtcaaaaacgcagcgccgtggagaaatcaatcaatgcctttttgattgtttacttgtttatcctccttactaaggccgccgtttgtaccacactgaaatatgtttggcaaagcactccttacaacgatgaaccctggtataatcagaagacccaaaaggagcgggagactctgaaggtgctgaaaatgtttacagatttcctgtcatttatggtgctgttcaatttcatcattccggtctcaatgtacgtgacagttgagatgcagaaattccttggtagtttttttatcagctgggataaggacttctatgacgaagaaattaatgaaggagctctcgtcaacacctctgatcttaacgaagaattgggacaggtggactatgtgttcaccgataaaacagggactcttaccgaaaattctatggagttcattgagtgttgcatagatgggcacaagtacaaaggagtcacacaagaggttgatggcctgagccagacggacggaacattaacctattttgacaaggtggacaaaaacagagaggagttgtttttgcgcgccctctgtctgtgccataccgtggaaattaagaccaacgacgccgtagacggggccactgagtcagctgagctcacttatatcagtagttcccctgatgaaatcgcccttgtgaagggggctaagaggtacggttttacttttctgggcaacaggaacggctacatgcgtgtagagaatcagagaaaggagatagaagaatacgagctgttgcataccctgaattttgatgctgtgcgtcggaggatgtcggttatcgtcaagacccaggagggcgacattctcctgttttgcaagggcgctgactccgccgtatttccacgagtgcagaaccatgagattgaactgacaaaagtccatgtggaacgaaatgccatggatggctaccgaacactgtgcgtcgccttcaaggaaattgcaccagatgactacgaacgcatcaatagacagctcatcgaggcgaagatggctctgcaggatcgcgaggaaaagatggaaaaggtgttcgacgacatcgaaacaaatatgaacctcatcggagccactgcggtcgaagacaagttgcaggatcaggccgccgaaactatcgaggctctgcacgcggcaggcctgaaggtgtgggtgctaacgggcgacaaaatggagacggcaaagtcgacatgttatgcgtgtcggctcttccagacgaacacagagctgctcgaactgactaccaaaaccatcgaagagtctgaaaggaaagaagatcgtcttcacgagcttcttatcgagtatagaaaaaagctgctgcacgaatttcctaaatctacccggtcttttaagaaagcttggactgaacatcaggagtacgggctgataatcgatggctcaacgctatcactgatactgaacagctcacaagattcatcaagtaataattataaatctatatttctgcagatttgcatgaaatgcactgctgtcttgtgctgcagaatggctcctctgcagaaggctcagatcgtacggatggttaagaacctaaagggcagccctattacattgagtatcggcgatggggctaatgacgtgtcgatgatactcgaatcccatgtgggaataggtattaaaggcaaggagggccgccaggccgctcgtaattccgattacagcgtacctaagtttaagcacttgaagaaactccttctggctcacgggcatctttactatgttcggatcgcacatctggtccagtatttcttttacaaaaacctgtgcttcatattgccccagttcctatatcagttcttctgcgggttttcgcagcagcccctgtacgacgccgcatatctcacgatgtataacatttgctttacaagcctccctattctggcctatagtctattagaacagcatatcaacatcgataccctgacttctgatcctaggctctatatgaagatttccgggaatgcaatgctgcaattgggaccatttctctattggacattcctggccgcgttcgagggcactgttttcttttttggcacatatttcttgttccagaccgccagcctcgaggaaaatggcaaagtctacggcaactggacctttggaacgatcgtctttaccgtcctcgtctttaccgtaacactcaaattggcacttgatactagattttggacatggatcaaccattttgtcatctggggtagccttgcattctacgtgttcttctcgttcttttggggaggcatcatttggcccttcctcaaacagcagagaatgtactttgtattcgcccagatgctttctagcgttagtacatggctcgcaatcattttgttaatctttatttccttgttcccagagatcctgctcatcgtgctgaagaacgtgcggcggaggtccgcaagagttacgaagagactcccttcaagtggtactagtgccatttttatgctgtcccaaactagcagcaaccatagttttagctggagcgaatag

SEQ ID NO: 40488 - DNA, 3342 bp, Artificial Sequence
  Description of Artificial Sequence: Synthetic coding sequence
atgttccggcggagcctgaaccggttctgcgccggcgaggagaagcgagtgggtactaggacagtgtttgtgggcaatcaccctgtgtctgagaccgaggcctacatcgcccagcgtttctgcgataaccgtattgtgtcatctaaatacacactctggaactttttaccaaagaacctgtttgaacaattccgtcgcatcgctaatttctatttccttataatattcctcgtgcaggtgaccgtggacacccctacgagtcctgtcacttcaggcttgcccctattcttcgtgatcactgtgaccgccattaaacagggatacgaggactgccttcgacatcgtgcggacaacgaagtgaataagtccaccgtttatatcattgaaaacgctaagagagtgaggaaggagtcagagaaaataaaggttggagatgtggtggaggtccaagctgacgagaccttcccttgcgatctgatcctactgtcgtcatgcaccaccgacgggacttgctacgtgaccacggcaagcttagatggtgagtccaattgcaagacccattatgcggtcagagacacgatcgctctgtgtactgccgaatcaatcgatacccttcgggccgcaattgaatgtgaacagcctcagccagacctgtacaaattcgttggccggataaacatttatagtaactctttagaggctgttgctcggtctctcgggcccgaaaacctgttattgaagggggccacacttaaaaacactgagaaaatttacggagtggccgtgtatacagggatggaaacaaagatggctctaaattaccaggggaaaagccagaaaaggtccgccgtggagaaatccatcaacgcctttctcatcgtctatctatttatacttctgaccaaagccgctgtttgcaccacacttaaatacgtgtggcagtctaccccctataacgacgagccatggtacaaccagaaaacccagaaggagagagagactctgaaggtgctcaagatgtttactgactttctgagcttcatggtgctgtttaatttcattattccggtgagtatgtacgtgaccgtagagatgcagaagtttctgggatctttctttattagctgggacaaagatttttacgacgaggaaatcaacgagggagcattggtgaatactagtgacctgaatgaagagttggggcaggtggattatgtgttcacagacaaaacgggaactttaaccgaaaactctatggagtttattgaatgctgcatcgatggtcataaatacaagggagttacacaggaagtcgatggcctgtcacagacggatggtacactgacctactttgacaaagtggacaaaaatcgtgaagaactgttcctgcgggccctgtgcctctgtcacacagttgagatcaagacgaacgacgccgtcgacggcgccactgagtcggctgagcttacgtacatttcatcatccccggacgagattgctttagttaaaggtgccaagcgctacggattcaccttccttgggaatagaaatgggtacatgagagttgaaaaccaacgcaaagaaatagaggagtacgaactgttacacaccctgaactttgatgcggtaaggagaagaatgagtgtcattgtaaagacccaggaaggagatatacttcttttctgcaaaggagcagacagcgccgtgtttcctagggtgcaaaaccatgagatcgagctgaccaaggtgcatgtggaaaggaatgccatggacgggtacaggacactgtgtgttgccttcaaggagatcgccccagacgattatgagagaatcaaccggcaactgattgaagccaagatggccttacaggacagggaggaaaagatggagaaggtgtttgacgatatcgaaactaacatgaacctgatcggggctaccgccgtggaagataaattgcaagatcaggctgctgaaacaatcgaagccctgcacgcagcgggtttaaaagtgtgggtcctcaccggcgacaaaatggagactgcaaaatccacctgctacgcatgtagactgttccagacaaataccgaactgctggaactcacgactaagaccatcgaagaaagtgagaggaaggaagataggctacacgaactgctgatcgagtaccgcaagaagcttctgcacgagttccctaagtctaccagatcatttaagaaggcttggactgaacatcaggaatacggcctcataatagacgggagcaccctttcattgattctcaattccagccaggattcttccagcaacaattataagagtatcttcctgcagatttgcatgaaatgcaccgcagtgctgtgctgtagaatggctcccctgcagaaagcgcagatagtgaggatggtgaagaatctcaaagggtctcccatcacactgagcatcggggatggcgcaaacgacgtcagcatgattctggaaagccacgttgggatcggaaaggaggggcgacaagcagcaagaaactcagactattctgtgcctaagttcaaacatctgaagaagctgctgctggcacacggccatttatattacgtcaggattgcccatttagtccaatactttttctataaaaacctctgctttattttaccgcaatttttgtaccagtttttttgcgggttctcccagcaacctctctatgacgccgcgtatctgactatgtataatatttgcttcacctcccttcctatcctggcttacagcctgttagaacaacatattaacatcgatacactgacttccgatccccggttgtacatgaaaatctccggtaatgcaatgctgcagttaggaccgtttctctactggacttttcttgccgccttcgaggggacagtgttctttttcggaacatatttcctgttccaaaccgccagtctcgaggagaacggtaaggtgtacggtaattggacttttgggaccatagtgtttactgtcctagtgtttacagtgacacttaaactggcactcgatacaagattctggacttggatcaatcatttcgtaatttgggggtctttagctttttacgtgttttttagcttcttctggggggggattatctggcctttcctaaagcagcaacggatgtatttcgttttcgctcaaatgctgagttctgtttccacttggctcgccattatactgctgatcttcattagtctgttcccggagatattgctgatcgtgctgaaaaatgtccgcagacgcagcgcccgcaatccaaatctagaacttcctatgctgttgtcttacaagcacacagattccggctattcatag

SEQ ID NO: 40489 - DNA, 609 bp, Artificial Sequence
  Description of Artificial Sequence: Synthetic coding sequence
tgagagtgctgcatcgacggccacaagtacaagggcgtgacccaggaagtcgatggcctgtcacaaacagacggaaccctaacttacttcgacaaagtggataagaatagggaagagctgtttctacgcgccctttgtttgtgtcacactgtagagatcaaaaccaacgatgctgtggatggcgctactgagtctgccgaacttacctacatatcctctagtcctgatgagatcgcactggtgaaaggagccaagcggtacgagttactgcacactttaaactttgacgcggtccggaggagaatgagtgttatcgtaaagacacaggaaggggatatattgctgttctgcaaaggtgccgactctgccgtgtttcccagggtacagaaccacgagatcgagctgacaaaagttcacgtggagcggaatgctatggatggctaccggacattgtgcgttgcctttaaagagatcgctccagacgactacgagcggatcaacagacagctgatagaggcaaagatggctttgcaagacagggaggagaagatggagaaggtcttcgatgacattgagacaaacatgaatttaatcggagccacagcatag

SEQ ID NO: 40490 - DNA, 498 bp, Artificial Sequence
  Description of Artificial Sequence: Synthetic coding sequence
tgagagggcaccgtgttcttcttcggcacctacttcctgttccagaccgcctccctcgaagagaatggaaaagtgtacgggaattggacatttggcaccatcgtgttcacagtgttggtttttactgtcactctcaagttagcgctggataccagattttggacctggataaatcattttgtgatatggggatctttggctttctacgtgtttttttcctttttctggggcggcatcatctggcccttcttgaagcagcaacggatgtattttgtgtttgctcagatgctcagctctgtaagtacttggctggcaatcatcctgttgatctttatttcactctttcccgagatcctcctgatagtcctcaagaacgtgcgccggcgaagtgcccggcgaaacctctcatgtcggcgtgcttcagattcgctcagcgcacgtccatcagtgagacccctgttgcttcgaactttttccgatgagtctaatgtcttgtag

SEQ ID NO: 40491 - DNA, 519 bp, Artificial Sequence
  Description of Artificial Sequence: Synthetic coding sequence
accctgaccagcgacccccggctgtacatgaagatcagcggcaacgccatgctgcaactcggcccattcctgtactggactttcctggctgctttcgagggcacagtatttttcttcggtacctatttcttgtttcagaccgcaagcctggaggaaaacggcaaggtgtatggtaattggacctttgggacaatagtgttcaccgtgttggtgtttacagtcacattgaaactcgccttagacactaggttttggacgtggattaaccacttcgtgatatggggttctctggccttctatgtctttttttctttcttctggggaggcatcatatggccatttctgaagcagcaacggatgtacttcgtctttgctcagatgctcagtagcgtcagtacatggctcgctattattctgctgatcttcatcagtcttttcccagagatactgcttatcgtgctgaaaaacgtccggcgtagatctgcacgagttcaccatcttatcagtagtagcgcttag

SEQ ID NO: 40492 - DNA, 357 bp, Artificial Sequence
  Description of Artificial Sequence: Synthetic coding sequence
atgaccagccagagccagggcatccaccagctgctgcaggccgagaagcgagctaaggataagctagaggaggcaaagaagagaaaaggaaaaagacttaagcaggctaaggaggaagccatggtagagattgatcagtacaggatgcagcgggataaggaattccggctaaagcagtccaagataatgggctcccagaataacctcagcgacgagattgaggagcagacgttaggcaaaattcaggaattgaacggccactacaataagtacatggagagcgtcatgaatcaactgctgagcatggtgtgcgacatgaaacccgagatccacgtcaactatcgggctactaattag

SEQ ID NO: 40493 - DNA, 180 bp, Artificial Sequence
  Description of Artificial Sequence: Synthetic coding sequence
atgaccagccagagccagggcatccaccagctgctgcaggccgagaaaagggctaaggataagttggaggaagccaaaaaaattctccacctcctttttcttaagagacgagactgggactgtttttggaaaaggaaagcgatagaggcttcgcagggcggctcaaatgggcgcaattag

SEQ ID NO: 40494 - DNA, 375 bp, Artificial Sequence
  Description of Artificial Sequence: Synthetic coding sequence
atgaccagccagagccagggcatccaccagctgctgcaggccgagaaacgggccaaagacaagctggaggaggctaagaagaaaactggcacagcttctggaaaggggaagaggctgaagcaggcaaaggaggaagcaatggttgaaatcgatcagtacagaatgcagagggataaagagtttcgtctcaagcagagtaaaattatggggagtcagaacaatctttcagacgagatcgaggagcagacattaggcaaaatccaagagctgaacggccattacaataaatacatggaaagcgtcatgaatcagctactctctatggtctgcgacatgaaacctgagattcacgtcaattatcgggccaccaattag

SEQ ID NO: 40495 - DNA, 357 bp, Artificial Sequence
  Description of Artificial Sequence: Synthetic coding sequence
atgaccagccagagccagggcatccaccagctgctgcaggccgagaaacgagccaaagataagctcgaggaagctaagaaaaggaaagggaaacggttgaagcaggcaaaagaggaagcaatggtggaaatagaccaataccgaatgcagcgagataaagagtttagactgaagcagtccaagattatgggctcccagaataatctgtccgatgagatcgaggagcagactctgggaaagattcaggagttgaacggtcactacaataagtacatggaaagcgtgatgaatcaactgctgagcatggtttgcgatatgaagccagagatccatgttaactatcgtgccactaattag

SEQ ID NO: 40496 - DNA, 375 bp, Artificial Sequence
  Description of Artificial Sequence: Synthetic coding sequence
atgaccagccagagccagggcatccaccagctgctgcaggccgagaaaagagccaaggacaaactggaagaagctaaaaaaaagactggcaccgcatctgggaaggggaagcggctgaagcaggcaaaagaggaggccatggtggaaatagatcagtaccgtatgcagagagataaggaattccgcctgaaacagtccaaaatcatgggctctcagaacaatctaagcgacgagattgaggagcaaacccttggcaagattcaggagttgaatgggcactataataagtacatggaaagcgtcatgaatcagttactgagtatggtctgcgacatgaaacctgaaatacacgtgaactacagagctaccaactag

SEQ ID NO: 40497 - DNA, 360 bp, Artificial Sequence
  Description of Artificial Sequence: Synthetic coding sequence
atggccggccggggcaagctgatcgccgtgatcggcgacgaggacacagttacaggattccttttggggggcattggcgagctcaataagaatcgtcaccctaattttttagtggtggagaaggatactactattaacgagatcgaagatacatttcggcagttcctgaacagagatgacatcggaatcatcctgataaaccaatatatcgctgaaatggtgcgccacgccttggacgcccaccaacagtctatcccagcggtactcgaaatacccagtaaggaacatccctatgatgcagcgaaagattctattctgaggcgcgctcgcggaatgttcaccgccgaggatcttcggtag

SEQ ID NO: 40498 - DNA, 681 bp, Artificial Sequence
  Description of Artificial Sequence: Synthetic coding sequence
atggccctgagcgacgtggacgtgaagaagcagatcaagcacatgatggcgtttattgagcaagaggctaatgagaaggctgaggaaattgacgcaaaagcagaggaagaatttaacattgagaaaggtaggttggttcagacccagagactgaaaataatggagtactatgaaaagaaggaaaagcagatcgagcagcagaagaaaatcttaatgtctacaatgaggaatcaagcccgtctgaaggtcctcagagcccgaaatgatttgatctcagacctgctgtctgaggcaaagcttcgcctatcacgcatagtggaggatccagaagtttatcagggactgttagataaactggtgctgcaagggctgttgaggctgctcgaacccgtgatgattgtgcggtgtagaccacaggatttgttgctggtggaggccgccgttcagaaagcaattcccgaatacatgaccatatcgcagaagcatgtcgaagtgcagattgacaaagaagcttacttagcagtaaatgcagccggcggcgtggaagtgtactccggaaaccaaaggattaaggtgtctaatacactggagtcccgcttggacctgagtgccaaacagaagatgcccgagatacgaatggccctgttcggtgccaataccaatcgcaaattttttatatag

SEQ ID NO: 40499 - DNA, 681 bp, Artificial Sequence
  Description of Artificial Sequence: Synthetic coding sequence
atggccctgagcgacgtggacgtgaagaagcagatcaagcacatgatggcctttattgaacaagaggccaacgaaaaagcggaagagatcgacgcaaaagcagaagaggaattcaacatagagaagggacgacttgtgcagacccaaagactgaagattatggaatattacgaaaagaaagagaagcagattgagcaacagaaaaagattctgatgtccactatgcgtaatcaagctcggctgaaggttctgcgggctcgcaacgatctgatcagtgatctccttagcgaagcaaaactccggctgtcacggattgtagaagatccagaggtctaccagggcctcctagataagctggtactccaggggctgctgaggctgcttgaaccagtgatgatagtgaggtgtaggccgcaagaccttctcttagtcgaggccgccgtgcagaaggccattcccgagtatatgaccatttcgcagaagcatgtggaagtgcaaatcgataaagaggcctatttggcagtcaacgcagcaggcggggttgaggtgtactcaggcaaccagaggattaaggtgagtaacaccctcgagtcccgacttgatctgtctgcaaagcaaaaaatgcccgagattcgaatggctttgttcggagcaaataccaaccgaaagtttttcatttag

SEQ ID NO: 40500 - DNA, 999 bp, Artificial Sequence
  Description of Artificial Sequence: Synthetic coding sequence
atggccgccgtgttcctggtgaccctgtacgagtacagccccctgttttatattgctgtcgtctttacgtgctttatcgtcaccacaggcctggtgctgggctggtttggatgggatgttcccgtgattctcagaaattctgaagaaactcagttttcaaccagggtgtttaaaaagcaaatgcgccaggtcaagaaccccttcgggcttgagatcacgaacccttcatctgcctcaattaccacggggatcacactaaccaccgactgtttagaagacagtctcctcacctgctactggggctgttctgttcagaagttgtacgaggctttgcagaagcacgtgtattgcttcagaatctccaccccccaggccctagaagacgctctttattcagaatatttgtatcaggaacaatacttcattaagaaggattccaaggaagaaatttattgtcaactgcccagagatactaagattgaggacttcggaaccgtgcctcgttctcgttacccactggtggctctgctcacgttggcggatgaagatgaccgcgagatctatgacatcatatccatggtgtctgttatccatattcctgaccgaacctataaactgagctgccggattctgtatcaatacctgctgctggctcagggccaatttcatgatctgaaacagctcttcatgtccgctaataataacttcaccccatccaacaatagtagctccgaagaaaaaaataccgacagatcactactggaaaaggtggggctgagtgagagtgaagtagaacccagcgaagaaaacagtaaggactgtgtggtgtgtcaaaatggtacagtaaactgggttttgttgccttgccggcatacttgtttgtgcgacggatgcgtgaagtattttcaacagtgccctatgtgtcggcagtttgtgcaagaatcattcgccttgtgttcacaaaaggagcaggacaaggataagccgaagaccttgtag

SEQ ID NO: 40501 - DNA, 744 bp, Artificial Sequence
  Description of Artificial Sequence: Synthetic coding sequence
atgagcggcaaggaccggatcgagatcttccccagccggatggcccagacaatcatgaaagcacgactcaagggcgcacagaccggtaggaatctgttgaaaaaaaagagcgacgctctgacgttgcgttttcgccagattctgaaaaaaatcattgagaccaagatgctgatgggggaggtgatgcgggaagccgcctttagcttggccgaggctaagtttacagcaggcgacttctctacaacagtcattcaaaacgtaaataaagctcaggtgaagatcagagctaaaaaggacaacgttgccggggtaacgctccctgtgtttgaacactatcacgaggggaccgactcctatgagcttactgggcttgctaggggtggagagcagttggctaagctgaagagaaactacgctaaggctgtcgaactactggtcgagctggcctccctgcagactagttttgttactctagatgaggccatcaagattaccaatcgacgcgttaacgctatagagcacgtcatcatcccgaggatcgagcgtaccttggcctatatcatcaccgagctggacgagagagagcgggaggagttctatagactcaaaaagatccaagaaaaaaaaaagatactgaaggaaaagtctgaaaaggacctggaacagcggagggccgctggagaggtactggagccagcaaacctgttagctgaagaaaaggacgaggacctcctgttcgaatag

SEQ ID NO: 40502 - DNA, 219 bp, Artificial Sequence
  Description of Artificial Sequence: Synthetic coding sequence
atgagcggcaaggaccggatcgagatcttccccagccggatggcccagacaatcatgaaggctcgactgaaaggtgctcaaactgggaggaacctcctgaaaaagaagtccgatgccctgacacttagattccggcagatcctcaagaagattatagagaccaagatgcttatgggcgaagtgatgagggaggcagcctttagcctcgccgaagcgtag

SEQ ID NO: 40503 - DNA, 1053 bp, Artificial Sequence
  Description of Artificial Sequence: Synthetic coding sequence
atgctggagggcgccgagctgtacttcaacgtggaccacggctacctagaaggcctggttcgggggtgtaaggctagtctgcttactcagcaagactacataaacctggtgcagtgcgagacgctggaggaccttaagatccatttacagactactgactatggtaactttctagcaaaccacaccaacccattgaccgtctccaagatcgacactgagatgcggaaacgcctgtgtggtgaatttgagtattttaggaatcactcactcgaaccactttctaccttcctaacgtacatgacatgttcctacatgattgataacgttatcctgttaatgaatggggccctgcaaaagaaatcagtaaaggagattcttggaaaatgccaccccctgggccggttcactgaaatggaggcagtcaatattgcggaaacccccagcgacctattcaatgccatcctgatcgaaacaccccttgcgccattttttcaggactgcatgtctgaaaatgccctcgatgaactcaacatcgagcttttgagaaacaaattgtacaagtcttacctcgaggctttctacaagttctgcaagaaccatggtgatgtgacggccgaggtgatgtgccccattctggaattcgaggctgaccgcagagctttcatcatcacgctcaactcgtttggaaccgagctgagcaaagaagatagggagaccctgtatcccacattcggcaagctgtatcctgaaggcttgcgtctgctggctcaggccgaagatttcgaccagatgaaaaacgtagcggaccactatggtgtctacaagccactcttcgaagcggtgggtggctccggaggaaaaaccctggaggacgttttctacgaacgcgaggtgcagatgaacgttctagcattcaaccgtcagtttcattacggtgtcttctacgcatatgtgaagctgaaagaacaggagattcggaatattgtgtggattgccgaatgtatctctcagagacatcgtacgaagattaattcctatatacctatcttgtag

SEQ ID NO: 40504 - DNA, 111 bp, Artificial Sequence
  Description of Artificial Sequence: Synthetic coding sequence
atgctggagggcgccgagctgtacttcaacgtggaccacggctacctggaaggccttgtgaggggttgtaaggcatcgcttctgacacagcaggactatatcaatctatag

SEQ ID NO: 40505 - DNA, 132 bp, Artificial Sequence
  Description of Artificial Sequence: Synthetic coding sequence
atgctggagggcgccgagctgtacttcaacgtggaccacggctacctagagggtctcgtgagaggatgcaaggcctccctacttacacagcaggactacatcaacttagtgcagtgtgagacgcttgagtag

SEQ ID NO: 40506 - DNA, 1284 bp, Artificial Sequence
  Description of Artificial Sequence: Synthetic coding sequence
atgagcgagttctggctgatcagcgcccccggcgacaaggagaacctgcaggctctggagagaatgaacactgtcacatcaaaaagtaacttgtcttataataccaagtttgcaatacctgacttcaaggtgggcacactggacagtttggtcggactgtctgacgaactgggcaaactagacacgttcgccgaatctctaattcggagaatggcccagagcgtagtggaggtgatggaagactctaaaggcaaggtgcaggagcatttgctggcgaatggcgtcgacctcactagctttgtcacccacttcgaatgggacatggctaaatatcccgtgaagcagcctctagtgtctgtggtggatacgattgcaaagcagctagcacagatcgagatggatttaaaatccaggactgcagcgtacaatactctgaagaccaacctcgagaacctggagaagaagagcatgggcaacctcttcactcgaacgctatctgacatcgtctccaaagaagatttcgtgctggatagcgaatatctggtgaccttgctcgtcatcgtcccaaaaccaaactattcgcagtggcagaagacctacgaatcactatcagatatggttgtcccccgaagtaccaaattgattactgaagacaaggagggagggttatttaccgtgacactgtttcggaaggttattgaggatttcaaaaccaaggcaaaggagaacaaattcacggtccgcgaattctattacgacgaaaaggaaatcgaacgagagagggaggagatggctcggctgctgtccgacaagaagcagcaataccaaactagctgcgtggcactgaagaaaggctcctctactttccccgaccacaaagtgaaggttaccccattgggtaatcctgacaggccggccgctggacagaccgaccgggaacgtgagtcagaaggagagggtgaagggccacttttacgatggctaaaggtgaacttttcagaagcattcatcgcctggatacacatcaaagcccttcgggtattcgttgaatcagtgctccgctatggtttacctgtgaatttccaagcggttcttctacaacctcataagaagtccagcaccaagcggttgagggaggtgttgaatagtgtgtttcgacacctcgatgaagtggccgccacatccatcctcgacgcctcagttgaaatccccgggttacagttgaacaatcaggattattttccgtatgtatactttcatatcgacctgtccttgctagactag

SEQ ID NO: 40507 - DNA, 1146 bp, Artificial Sequence
  Description of Artificial Sequence: Synthetic coding sequence
atgagcgagttctggctgatcagcgcccccggcgacaaggagaacctgcaggccttggagaggatgaacactgtgacaagcaagtccaacctgtcatacaacaccaaatttgctatccccgacttcaaggtgggcacactggattcgctggtgggtttgtcagatgagctgggcaagctcgacactttcgctgaaagcctcatacgccggatggcccagtcagttgtagaagtgatggaagacagcaaggggaaagtgcaggaacaccttctcgctaatggagtcgatcttacgtctttcgtcactcatttcgagtgggatatggccaaatatccggttaaacaaccactggtttctgtggtcgataccatagctaagcagcttgctcagattgagatggatctgaagtccagaacagccgcctacaatacactaaaaaccaatctggagaacctggaaaagaaatctatgggaaacctgttcactaggaccctttctgatattgtcagcaaggaagactttgtgctagactcggaatatctggtaaccctactagtgatcgtgcctaagcccaattattctcagtggcagaagacttacgagtccctcagtgatatggtggtcccacgcagtaccaaactgatcacagaggacaaggagggtggattattcaccgttaccctatttagaaaggtgatcgaggacttcaaaactaaggcaaaagaaaacaagttcactgtacgggagttctactacgatgagaaggagatcgagcgggagcgcgaggaaatggctcggctcctttccgataaaaaacaacagtatgggccattgttgagatggctgaaggtaaacttttctgaggcttttatcgcctggatccatatcaaggccctgcgtgtcttcgtcgagtccgtactccgctatggactacccgtgaattttcaggctgttctgctacaaccgcacaagaagtcatccaccaagagactcagagaggtgcttaacagtgttttccgtcacttagacgaggtagcagcaacaagcatcctggacgctagcgtggagatccccggcttgcagttgaataaccaggactatttcccctacgtatactttcatatcgatctctccttgctggattag

SEQ ID NO: 40508 - DNA, 1398 bp, Artificial Sequence
  Description of Artificial Sequence: Synthetic coding sequence
atgaccaagatggacatccggggcgccgtggacgccgccgtgcccaccaacatcattgccgcaaaggccgctgaagttcgagcgaataaagtgaattggcagtcttatttgcagggccaaatgatttccgccgaggattgcgaattcatccagcgtttcgaaatgaagcgatcacccgaggagaagcaagagatgttacaaaccgaaggctcacagtgcgccaagacattcatcaatctcatgacccatatctgtaaggaacaaactgtgcagtatatcctgaccatggttgacgatatgctgcaagaaaaccaccagagggtttccatattcttcgattatgcacgctgtagcaagaacacggcctggccatactttctgccaatgctgaatcgtcaggaccctttcacggtccacatggccgctagaatcattgccaaactcgcagcctggggaaaggagctgatggaaggaagcgacctgaattattatttcaattggattaaaactcaattgtccagccagtccagtcaatacgtccagtgcgtggccgggtgcctacagctgatgctaagggtaaacgagtaccgcttcgcttgggtagaagcggatggggtcaactgcatcatgggcgtgttatctaacaagtgtgggttccagctgcagtatcagatgattttttccatctggttgttggctttcagcccacagatgtgtgagcacctacgtaggtataatatcatccctgtcttgagcgacattctgcaggaaagcgtcaaggagaaggtgactcgtattatcctggcagcattccggaacttcctcgagaaatccacagaacgggaaaccaggcaggaatacgcccttgctatgattcagtgcaaggttttgaagcagttagagaacctggagcagcaaaagtatgacgatgaggacattagtgaggacatcaagtttctactcgagaagctcggagagagcgtgcaggacctgtcttctttcgatgagtactccagtgaattgaaatcaggacgactcgaatggagccccgtgcataagagcgagaagttttggcgtgaaaatgcggtgaggttgaatgaaaaaaactacgaactgctcaagattttgacaaagctgctagaagtgtccgacgacccacaggtgttagcagttgctgcacacgacgtgggcgagtatgtgaggcattacccacgtggcaaacgcgtgatagagcagcttggagggaagcagctcgttatgaaccacatgcaccacgaagatcagcaggttcgctacaacgccctgttggcagtccagaagctgatggtgcataactgggaataccttgggaagcagttgcagagcgagcagccacagacggccgcagcccgctcgtag

SEQ ID NO: 40509 - DNA, 1452 bp, Artificial Sequence
  Description of Artificial Sequence: Synthetic coding sequence
atgaccaagatggacatccggggcgccgtggacgccgccgtgcccacaaatataattgccgcaaaggccgcagaggtccgcgctaataaggtgaactggcaatcatacttgcagggccaaatgatctccgcagaggactgtgaattcatacagcgttttgagatgaagcggagccctgaggaaaaacaggagatgcttcagacagagggaagtcaatgcgccaaaacttttatcaatctcatgacccacatttgtaaggagcagactgtgcagtatatcctgacaatggtagacgacatgctacaggaaaaccaccagcgtgtgtctatatttttcgactacgctagatgttcaaagaatacggcatggccctatttcctgcctatgctcaatcgccaggatccattcactgtacacatggctgcccggatcattgccaaactggcagcgtggggaaaggagctcatggaaggatcagatctgaactactatttcaattggattaaaacacagctgtctagccagaaacttcgtggtagtggagtggccgtcgaaactggaaccgtttcttcctccgattcgtctcaatatgtacaatgcgtggcaggctgtttgcagctgatgctgagggtcaatgagtatcgctttgcctgggtggaggccgacggggtgaactgtatcatgggggttctcagcaataagtgtgggttccagctgcagtaccagatgattttcagcatttggctgctggccttctcaccacagatgtgcgagcatctccgcagatataacatcataccagtcctcagcgacatccttcaggaatcagtgaaggagaaggtgacacgcataatcttggctgcctttcgcaacttcttggagaagagcacagagcgcgaaaccaggcaggaatacgcactcgccatgattcagtgtaaggttctgaaacagctagagaacctcgagcagcaaaagtacgatgatgaggacatctccgaggacattaagttcctgctggagaaattgggcgagtcagtccaagacctctcgtccttcgatgagtactcctccgaattgaagagcggtcgtttagaatggtctcccgttcacaaatccgagaaattctggagagagaatgcagtgaggctgaatgagaaaaattatgagctgcttaaaatactgacaaagctgctcgaagtgtccgacgaccctcaggtgcttgctgtggctgcacacgatgtgggcgagtatgttaggcactatcccagaggaaagcgtgtaattgaacagctgggcggaaaacagcttgtcatgaaccacatgcaccacgaggatcagcaggtgcgatataatgctctgcttgccgtacagaaactaatggtgcataactgggaatatctgggaaagcagctccagtcagaacagccgcagaccgctgcggccaggtcgtag

SEQ ID NO: 40510 - DNA, 1452 bp, Artificial Sequence
  Description of Artificial Sequence: Synthetic coding sequence
atgaccaagatggacatccggggcgccgtggacgccgccgtgcccacaaacattattgctgcaaaagccgcagaagttagagctaacaaggtgaattggcagtcctatctgcagggacagatgatatcagccgaggattgcgagtttattcagcggtttgaaatgaagcggtccccagaagaaaagcaagagatgctgcagactgagggcagtcagtgcgctaagactttcattaatctgatgactcacatctgcaaggagcagaccgtacagtacatcttaaccatggttgacgatatgctgcaggaaaaccatcagagagtgtccatctttttcgactacgcccgctgttcaaagaacacggcttggccatatttcctgcctatgctcaacaggcaggacccttttactgttcacatggcagccaggattattgccaagctcgctgcttggggtaaagagctaatggagggatctgacctgaattactatttcaactggattaaaacacagctgagcagtcagaaactacgcggatctggggtagcagttgaaactgggaccgttagctccagcgatagctcacaatacgtccagtgtgtggcggggtgcctgcagctgatgctgcgtgttaatgagtatcggtttgcctgggtagaagccgatggtgtaaactgtatcatgggcgtactctcaaataaatgcggttttcagctgcaataccagatgatcttctctatctggctgctggccttttcgccccagatgtgcgagcatttaagaagatacaacataatacccgttctgagtgacatcctacaagagtctgtaaaggagaaggtgacgaggatcatccttgccgcttttaggaattttctggaaaagtctactgagagagagacgcgtcaagaatacgcgctagctatgatacaatgcaaggtgctcaagcagctcgagaacctggaacaacagaagtatgatgatgaggacatatccgaagatattaaattcctgctggagaaattaggcgaatctgtgcaggacctgtcttcattcgacgaatattcctctgagctcaaatctggccggctggagtggagtcccgtacacaaaagtgaaaaattttggagggagaacgcggtgcgcctcaatgagaaaaattacgagctgctgaagattttaacgaaattgttggaggtgagtgatgatccacaggtgctggcagtggccgcgcacgatgtaggagaatatgttaggcactaccccaggggcaagagagtcatcgagcagctggggggaaagcagcttgtcatgaaccatatgcaccatgaggatcagcaagtgcggtacaacgcattgctggccgtgcagaagctaatggtccataactgggagtaccttggaaagcagctccagtcggagcagcctcaaaccgccgcagcccgatcatag

SEQ ID NO: 40511 - DNA, 309 bp, Artificial Sequence
  Description of Artificial Sequence: Synthetic coding sequence
atgaccaagatggacatccggggcgccgtggacgccgccgtgcccacaaacatcatagccgccaaagccgctgaggttcgggcgaataaggtcaattggcaaagctatctgcaggggcagatgatcagcgctgaggactgtgaattcattcaaagattcgagatgaagcgcagcccagaagaaaaacaggaaatgcttcagacggagggctctcagtgcgctaagacatttataaacctgatgactcacatctgcaaagaacagaccgtgcagtatatcttgaccatggttgatgatatgctccagtag

SEQ ID NO: 40512 - DNA, 306 bp, Artificial Sequence
  Description of Artificial Sequence: Synthetic coding sequence
atgaccaagatggacatccggggcgccgtggacgccgccgtgcccaccaatatcattgccgctaaggcagccgaggtgagagcaaataaggttaattggcagtcatacctacagggacagatgatttctgcggaggactgcgagttcatacagcgctttgagatgaaacgctcccctgaggaaaagcaggagatgctgcaaacagaggggtcacaatgtgctaagaccttcatcaaccttatgacccacatttgtaaagagcagaccgtacagtatattctcacgatggtggacgacatgctgtag

SEQ ID NO: 40513 - DNA, 873 bp, Artificial Sequence
  Description of Artificial Sequence: Synthetic coding sequence
atgggcgacggcggcgccgagcgggaccggggccccgcccggcgggctgaatcgggaggcggcggtggacgctgtggcgaccgcagcggtgctggggacctccgcgctgatggcggcggccactcacctacggaggtagcaggaactagcgcaagtagccccgcagggtcgcgcgagtccggagccgattctgatgggcaacccggacccggcgaggccgatcactgcaggcgcatactggtgagggatgctaagggcacaatacgggagattgttcttccgaaaggtctggaccttgataggccaaagcgcactcgtaccagcttcactgctgagcagctatatcgactggaaatggaattccagagatgtcagtatgtggtaggcagggaacgtacagagcttgcgagacagctgaatctatctgaaacccaggtgaaagtctggtttcagaaccggagaaccaagcagaagaaagaccaatcgcgagacctcgagaagcgggcgagctcaagtgcttccgaagcctttgccacgtcaaacattctgcgtctccttgaacagggtagactgcttagcgtgcctcgcgcacccagcctccttgccttgacaccaagcctcccaggactccccgcaagccacaggggcacaagcctaggagatcctagaaattctagtcctaggctgaatccgctgtctagtgcctcggccagccctcctctgcctccccccttgcctgccgtctgtttttcatctgccccgctgcttgatctacctgccggctatgagttgggaagctccgctttcgagccttactcctggctggaaagaaaagtcggtagcgcttccagttgcaagaaggccaacacctag

SEQ ID NO: 40514 - DNA, 1491 bp, Artificial Sequence
  Description of Artificial Sequence: Synthetic coding sequence
atggccatggagatcgacagccggcccggcggcctgcccggcagctcctgtaatctgggcgcagcaagagagcacatgcaagcagtgacacgaaactacataacacatcccagggttacataccgcactgtttgcagtgtcaatggtcctctggtcgtgctcgatcgcgtgaagtttgcccagtacgccgagatagtgcacttcacgctgcctgacggcactcagcggagcggtcaggttctggaagttgctggtaccaaggccatcgtgcaggtgtttgaaggcacctccggcatcgatgcccggaagacaacttgcgagttcactggggacatcctgcggacgccagtcagtgaggatatgctgggcagagtcttcaacggttcaggaaagccaatcgataagggaccagtcgttatggcagaagactttctggatattaacgggcaacctattaatccacacagcaggatatatcctgaggagatgatccagaccgggatctcccccatagacgttatgaactccattgctcgcggtcagaagattcccatctttagtgctgccgggctgccgcacaacgagattgctgcacagatctgccgccaagctggcctggtgaagaagtcgaaagcagtcctggattaccacgatgataatttcgccattgtgttcgcagccatgggagtgaatatggagacagcacggttttttaaatccgacttcgaacagaacgggaccatgggcaatgtgtgtttgttcctcaatcttgctaacgatccaacaattgagaggatcattacacctaggctggccttaaccactgcggagttcctcgcataccagtgcgagaagcatgttcttgtgatcttgacagacatgtcctcctatgcagaagcgctacgggaagtgtccgccgctcgtgaggaggttccaggtcggagggggtttccaggttatatgtataccgatcttgccacaatatacgagcgggctggccgggtggaagacatcactcatccaatacctgacctgaccgggttcatcacagagggccagatttacgtcgacagacagctacataatagacagatatatcctcccatcaacgtgctcccctccctgtcacgcctcatgaagtctgccatcggggaaggtatgacaagaaaagatcatggagacgtgtcaaatcagctgtatgcctgttacgccataggcaaagacgtccaggccatgaaagctgtggtcggtgaagaggcattgacgagcgaggatctgctctacctggaattcttacagaagtttgaaaaaaactttatcaaccaaggaccctacgagaacaggtctgtcttcgaatccctggacctcgggtggaaactcctgcgaatatttccaaaggaaatgctgaagagaataccacaggcagtcattgatgagttttacagcagggagggtgctctgcaggaccttgccccggatacagccctgtag

SEQ ID NO: 40515 - DNA, 1467 bp, Artificial Sequence
  Description of Artificial Sequence: Synthetic coding sequence
atgcaggccgtgacccggaactacatcacccacccccgggtgacctatagaacagtgtgctcagtgaatggcccactcgtggtgctcgatagggttaaattcgcccagtatgccgagattgttcactttacattaccagatggaactcagcgctcaggccaggtcttagaggtcgcaggcacaaaagctattgtccaggttttcgagggtacatcgggcatagacgcccgcaaaacgacctgtgagttcaccggggatatcctgcgaaccccagtcagcgaggatatgctggggcgtgttttcaacggttctggcaaaccgattgataagggacccgttgttatggctgaagattttctggacattaatggccagcccattaacccccacagcaggatctaccccgaggagatgatccagaccggcattagtccgatcgatgttatgaattccattgcacgaggccagaaaatcccgatatttagcgctgcaggcctgccccacaatgaaatagctgcccagatctgcagacaggctgggttagtgaaaaaaagtaaagccgtgctcgactatcatgatgataattttgcaatagtgttcgcggccatgggtgttaatatggagaccgctaggttttttaaatcggacttcgagcagaatggcaccatgggaaacgtctgtcttttcttaaacctggcgaacgatcctacgattgaacgcatcatcacaccgcggttggccctgacaaccgccgagttcttggcgtaccagtgcgaaaagcatgtgcttgtaattttaaccgacatgtcaagttatgccgaagctctgagggaagtgagcgctgctagagaggaggtgccaggcagacgaggatttccggggtacatgtataccgaccttgccacaatctatgaacgagcaggaagagtggagggccgcggaggctccattactcaaatccctattcttacgatgccaaacgatgacataacacaccctattcccgacctgacggggtttatcaccgagggccagatttacgttgaccgccagctgcacaacaggcagatctatccccccattaacgttctcccttccctgtcaaggttaatgaaaagcgcgattggggaaggcatgacccgaaaggaccatggtgacgtttccaatcagctgtatgcgtgttacgccatagggaaagacgtccaggccatgaaggcagtggtcggtgaggaggcattgacttcagaagacttgctttaccttgaatttctgcagaagttcgagaagaatttcatcaaccagggtccctatgagaaccgttcagtgttcgagtctctggacctgggatggaaactactgcgtatcttcccaaaggaaatgctcaaaaggatcccacaagccgttatcgacgagttctactccagagagggcgcgttgcaagatttagcacccgatacggcactttag

SEQ ID NO: 40516 - DNA, 1536 bp, Artificial Sequence
  Description of Artificial Sequence: Synthetic coding sequence
atggccctgcgggccatgcggggcatcgtgaacggcgccgcccccgaactgcctgtgccaacaggaggaccagctgtgggagcccgcgagcaagctttggctgtgtctcggaattacctaagccagccacgattgacatacaaaaccgtgagtggggtcaatggaccactcgtcatcctggatcacgtgaagttccctcgatacgcagagattgtacacctcacattgcccgacggcaccaaaaggagtggtcaagtcctggaggtctcagggtccaaggcagtagtgcaagtgttcgaaggcaccagcggtatcgatgctaaaaaaacttcctgtgaattcactggggatatcctgagaactccggtgtcagaggatatgctgggcagagttttcaatgggtctggtaaacccattgaccggggccccgtagtcctcgccgaggacttcctagatattatgggacagcctatcaatccccagtgtcgaatctacccagaagaaatgattcagaccggaattagcgcgattgatggcatgaacagtatagcccgtggacagaaaattccaatcttcagtgccgccggtctgccacacaacgagattgccgcccaaatttgtcggcaggctggcctggtgaagaagtccaaagatgtcgttgattatagtgaggaaaacttcgccatcgtatttgccgcaatgggcgtaaacatggagactgcccgcttcttcaagtctgactttgaggagaacggcagcatggacaacgtatgcttgttcttgaacctggccaacgatcccaccatcgaaaggatcatcaccccacgacttgctttaactacggctgagttcctggcctatcagtgcgagaaacacgtcttagtcatcctcacggacatgtcgtcatatgccgaagcactccgagaagtttcggcggcaagggaggaagtgcctggtcgtagaggcttcccaggctatatgtatactgaccttgccaccatatacgaacgcgccggtcgggtcgagggtaggaatggtagcatcacgcagataccgatattaacaatgcccaacgacgacattacccatcctattccagatttaaccggatacatcacggaggggcagatatacgttgaccgccagctgcataatcggcagatctaccctcccattaacgtgttaccctcactctccaggttgatgaaatccgctatcggtgaaggtatgacacgcaaggatcatgcagacgtgagcaaccaattgtacgcctgctacgctattgggaaggacgtgcaagctatgaaggcagtcgtgggggaagaggccttaacaagtgacgatctcctgtacctggagtttcttcagaaattcgaacgtaatttcatcgcacaggggccatatgagaatcgaacagtttttgagaccctggacataggatggcagctgcttaggatttttccaaaagagatgcttaagcgcattcctcagtccactctgtccgagttctatccgcgggactcagctaagcactag

SEQ ID NO: 40517 - DNA, 1158 bp, Artificial Sequence
  Description of Artificial Sequence: Synthetic coding sequence
atgctgggccgggtgttcaacggcagcggcaagcccatcgaccggggccctgtcgttctggccgaagacttcttagatattatggggcagcctattaatccgcagtgccgcatctatccggaggagatgatccagacaggaatctctgccattgacgggatgaacagtattgccagaggacagaaaataccgatttttagcgcggccgggctcccgcacaacgagatcgccgctcaaatctgtaggcaggcgggccttgtgaagaagtctaaggacgttgtggactattctgaggaaaactttgcgattgtcttcgccgccatgggggtgaacatggagaccgcccgttttttcaagtctgattttgaggagaatggtagtatggacaatgtgtgtctatttctgaatcttgccaacgaccccaccattgaaaggatcatcactcccagactcgcactgacgactgccgaattcctcgcataccaatgcgagaagcacgtactggtgatcctcaccgatatgtcctcttatgctgaggcgctaagagaggtttccgccgccagggaagaggtccccggtcgtagaggttttccgggctacatgtatactgacctggcgaccatctatgaaagagcagggagggttgagggccggaacggcagcattacgcagatcccgatcctgacaatgccaaacgatgatatcacgcatcccattccagatctcaccggatatatcacagagggccagatctacgtagaccgacagctacacaataggcagatctatcctccaataaacgttctgccttctctctctcggctcatgaagtccgccattggggaaggtatgacacggaaggaccacgccgatgtttccaatcagttgtacgcttgttacgctatcggaaaagacgttcaggctatgaaggcagtagtcggagaagaagctctgacgtctgatgacttgctgtacctcgagtttctgcagaaattcgagagaaacttcatcgcacagggtccgtatgagaaccggacagtgtttgagacccttgacatcggctggcagctgttgagaatctttcccaaggagatgctcaagagaattccacaaagcactctgagtgaattctacccccgggactccgcaaagcattag

SEQ ID NO: 40518 - DNA, 1854 bp, Artificial Sequence
  Description of Artificial Sequence: Synthetic coding sequence
atggacttcagcaagctgcccaagatcctggacgaggacaaggagagtacgttcgggtatgtacatggagtatctggaccggttgtaacagcatgtgacatggccggagccgctatgtacgagcttgtgagggtgggccactccgagttggtgggcgaaatcattcggctggaaggtgacatggccaccatccaggtatacgaagaaacctctggggtcagtgtgggcgaccccgtgctccgcactggtaagccgctgagtgtggaactagggcccggcataatgggggccatttttgacggtattcagaggccactgtcagacatttcctctcagactcagtccatatacatccctcggggtgtgaatgtatctgccctttcccgcgatataaaatgggactttactccatgcaagaatctcagggtgggctcacacatcactggtggagatatatatggaatcgtgtctgaaaacagtttgatcaaacacaaaattatgttgccaccaaggaataggggcactgttacatacattgcaccccctgggaattatgacactagcgacgttgttctagaattggagttcgagggagtgaaagaaaagtttacaatggtccaggtctggcctgtgaggcaagtcaggcctgttacagaaaaactccctgctaaccatcctctgctgacgggacaacgagtgctcgacgccttatttccctgcgtacaagggggcactaccgctattccgggtgccttcggctgcggcaaaactgtcatcagtcagtcattgtctaagtattccaacagcgatgtaatcatttacgtcgggtgtggggagagggggaacgagatgtcagaggtgctgcgggattttcctgagctgacaatggaagttgacggaaaggtggagagtatcatgaaacgaacagcgttggtggctaacacgagcaatatgcccgtcgcggccagagaggccagcatttacacgggaataaccttgtccgagtacttcagggatatgggatatcacgtgagcatgatggccgacagcactagcaggtgggcagaagccctgcgagaaatctctggtcgactggcagaaatgcctgccgattcaggttaccctgcgtatcttggggctagactcgcctcgttttacgagcgcgctggtcgggttaagtgcctcggaaacccagagcgtgagggaagtgtgtcaattgttggcgcggtctctcctcccgggggagacttctctgatcccgtgaccagcgccacgctcggaatcgttcaggtcttctggggcttagacaagaagctggcccaacgcaaacacttcccctccgtgaattggcttatctcctattctaaatacatgcgcgccctcgacgaatactacgacaagcatttcaccgagttcgtccccctcaggactaaggcgaaggagatcctgcaagaggaagaagacctggctgagatcgttcagctcgtggggaaggccagcctggctgagacagacaagatcactctcgaagtggccaagctgattaaggatgacttcctgcagcagaacgggtacaccccatatgaccggttttgtccattctacaaaacagtaggcatgcttagcaacatgattgcattctatgatatggctcgccgggccgtggagaccaccgctcaaagtgataacaagatcacatggtcgattattcgggagcacatgggggatatcttgtataagctgtcctcaatgaagttcaaagatcctctgaaagacggcgaagcgaagataaagtccgactacgcccagctcctggaggacatgcagaacgctttccggagcctggaggattag

SEQ ID NO: 40519 - DNA, 666 bp, Artificial Sequence
  Description of Artificial Sequence: Synthetic coding sequence
atggacttcagcaagctgcccaagatcctggacgaggacaaggagtctacgtttggctacgtgcacggcgtgtctggtccagtcgtcaccgcatgtgatatggctggggccgccatgtatgagctggttcgagtaggacatagcgagcttgtcggggagataatccgtctggaaggcgatatggcaacaatccaggtttacgaagaaacatctggggtatccgttggggatcctgtactgaggacaggaaagcctctctccgtggaactggggccaggaattatgggggcgatctttgatggaattcagcgaccactgtccgacataagtagccagacccagtctatttatattcctcgaggcgtgaatgtctctgctctaagcagggacataaaatgggacttcaccccatgcaaaaacctgagagtcggctcacatattaccggcggagacatctatggaatagtatccgagaatagtctgatcaaacataaaatcatgctgccacccaggaatagagggaccgtgacgtacattgcaccccccggcaattacgatacgtccgatgttgtactggaactcgaattcgagggagtcaaggagaaatttacgatggtgcaggtgtggcccgtgaggcaggttaggcccgtcactgaaaagctgtag

SEQ ID NO: 40520 - DNA, 1755 bp, Artificial Sequence
  Description of Artificial Sequence: Synthetic coding sequence
atggccggcgccgccatgtacgagctggtgcgggtgggccacagcgagctggtaggagaaattatcaggctggaaggggacatggctacgatccaggtctacgaagagacttccggagtgagcgttggagaccctgtactccggaccggtaagccactgtccgtcgaactgggcccagggatcatgggggccatcttcgacggtatccagcgaccactcagcgacatcagcagtcagacccagagcatctacatccctcggggagtcaatgtgtccgcgctctcccgggatattaagtgggacttcactccttgcaagaacttgcgggtgggatcacacattacaggaggagatatctacggtatcgtctcggagaatagtctgatcaagcataagataatgctccctccgcggaacagggggaccgtcacctacatcgcaccccccggcaactacgacacgagcgatgttgtgctggaactcgaatttgagggagtcaaagagaaatttaccatggtacaggtgtggccagttcgccaggttcgacccgtaaccgagaaacttcctgctaatcatcccctgttgactgggcagcgcgttttggatgctttgttcccttgtgtgcagggaggaaccacagcgattcctggtgcctttggatgcggtaagactgttatctcgcagtccctcagtaagtactccaactccgacgtgatcatttatgtgggctgtggagagaggggtaatgaaatgagcgaggttctgcgagactttcccgagctcactatggaggtcgacggaaaagtcgaatccatcatgaagaggaccgcgctcgtggctaatacttctaacatgcctgtggccgcgagagaagctagcatttatactggtatcaccctgtctgagtacttccgcgacatgggataccacgtcagcatgatggccgacagcacctcacgatgggccgaagctttgcgtgagatttctgggagactggcagagatgcccgccgattctggttaccccgcttatctgggtgcccgcttggcctccttttacgaacgggctggtagggtaaaatgtctcggcaatcccgagcgcgaaggctccgtatcaattgtaggcgcagtcagccctccaggtggcgacttttcagaccccgtcactagcgctaccttgggtatcgtgcaagtcttctgggggctggacaaaaagcttgcgcagcgcaaacatttcccgtccgttaactggctcatttcctatagtaaatatatgcgagccctggatgaatactacgacaaacactttaccgagttcgtgccccttagaacaaaggcaaaggagatcctgcaggaggaggaggacctcgctgagattgtacagttagtgggcaaggcctccttggcagagaccgacaagatcacactagaagttgccaagcttatcaaggacgatttcttacaacagaacggatatacaccatatgatcgtttctgtcccttctataaaacagtaggcatgttgtccaacatgattgccttctatgacatggcacggcgggcggttgagaccaccgcccagtcagataacaaaattacatggtcaattatacgagaacacatgggagacatattgtataaactgtctagcatgaagttcaaggaccccctgaaagacggcgaagctaaaatcaaatcagactacgcgcaactcctggaagacatgcagaatgccttccgcagcctcgaggactag

SEQ ID NO: 40521 - DNA, 1005 bp, Artificial Sequence
  Description of Artificial Sequence: Synthetic coding sequence
atgagcgaggtgctgcgggacttccccgagctgaccatggaggtggacggtaaggtagaaagtatcatgaagcggaccgcactggtggccaacacctctaacatgcccgtggccgctcgcgaggcaagtatatatacaggaatcaccctctctgaatatttcagagacatgggataccatgtgagcatgatggcagactctacatcccgatgggccgaggctctgagggaaatctcggggcgcctggcggaaatgcccgcagactcaggttatcctgcatacttgggagcgcgattggcgagcttttatgagagggcagggcgcgtgaagtgcctgggcaatcccgaacgagaagggagtgttagcatcgtcggggcagtctcgcctcctggcggggatttcagcgaccccgtgacaagtgctactctagggattgtgcaggtcttttggggactagataaaaaactggcccagcgcaagcactttccaagcgtcaattggctcatttcatattcaaaatatatgcgagccctggatgagtattacgacaagcacttcactgagtttgtccctctgcgcactaaggctaaagagattctacaggaggaggaggatctggcggagattgtccagttggtgggtaaagcttctttggccgaaaccgataaaattaccttggaggttgctaaactgatcaaagacgattttttgcagcagaacgggtatacaccttatgaccgattttgccccttctataagaccgtggggatgttgagtaatatgattgccttttacgacatggcgaggcgagcggtagagaccaccgcgcagtccgacaacaagatcacctggagtatcattagggagcacatgggcgacatactctataaactctccagtatgaaattcaaagatccacttaaggatggggaggccaaaataaaatcagactatgcccagcttctggaggacatgcaaaacgcatttagaagtctggaggattag

SEQ ID NO: 40522 - DNA, 246 bp, Artificial Sequence
  Description of Artificial Sequence: Synthetic coding sequence
atggcctaccacggcctgaccgtgcccctgatcgtgatgagcgtgttctgggggtttgtgggttttctagtcccatggttcatccctaagggaccaaatcgtggcgttattataacaatgctggtcacctgctccgtctgctgttacctcttttggctcatcgcaatcctggcccaactgaaccctttattcggaccgcagctgaagaatgagacgatatggtatctaaagtaccattggccttag

SEQ ID NO: 40523 - DNA, 246 bp, Artificial Sequence
  Description of Artificial Sequence: Synthetic coding sequence
atggcctaccacggcctgaccgtgcccctgatcgtgatgagcgtgttctggggattcgtgggttttttagtgccttggttcattccaaaaggaccaaatcggggagtgatcattactatgctcgtcacgtgcagtgtttgctgttacttattctggttgatagcaattctggctcaattgaacccactgtttggtccccagctgaaaaatgagacaatctggtacctaaagtaccactggccatag

SEQ ID NO: 40524 - DNA, 1413 bp, Artificial Sequence
  Description of Artificial Sequence: Synthetic coding sequence
atgatggccgccatggccaccgcccgggtgcggatgggcccccggtgtgctcaggccctctggcggatgccttggctgcctgtcttcttgtcactcgccgccgcggccgctgctgccgccgccgaacagcaggtccccctcgtgctatggtcctctgatcgagatttgtgggcacctgccgcagacactcatgagggccatatcacctccgatttacaactaagtacatacctagaccctgcgttagaactggggccccgaaatgttcttctgttcctgcaagacaagctgagtattgaggattttacggcctacggcggcgtattcggcaataagcaggacagcgctttctctaacctggagaacgccctcgatctggctccctccagtctggtgctgcccgccgtcgactggtacgccgttagcactctgaccacttacttacaggaaaagctcggggcttcccctttgcacgtcgacttagccacactgagagagctcaaattgaacgcttctcttcccgccctgttactcatccgtctaccctatacagcaagctctggtctcatggccccccgcgaagtgctgactggaaatgatgaagtgataggccaggtcctctccactctgaagtctgaggatgtgccctatacagcggcactgactgcagtgcgcccctcccgagtggcccgcgatgtggctgtggtggccgggggcctcggaaggcagctgttacagaaacagccagtctcccccgtgatccatccacccgttagttacaatgatactgcgcccaggatcctgttttgggcacagaatttcagcgtggcctacaaagaccaatgggaggatctcactccactgacattcggagtgcaggaactcaatctgactggtagcttttggaacgactcatttgcccgcctttctcttacctacgagaggctgtttgggactaccgtgacctttaagtttatacttgccaaccggctgtatccagtgtcagcccgccattggtttacgatggagagactggaggtgcatagtaacggaagtgtggcatattttaatgcctcccaggtaaccggtccatcaatatacagctttcactgcgagtacgtgagcagtctctcaaaaaaaggatctttgttggtggcaagaactcagcccagcccctggcagatgatgcttcaggatttccagattcaggcttttaatgtgatgggtgagcaattcagttatgcaagcgactgcgcgtcctttttttctcctggcatttggatgggactgctcacttccctcttcatgctgtttatcttcacttacggccttcatatgattctgtccttgaagacaatggaccggtttgacgaccacaagggacccaccatatcattgacccagatagtttag

SEQ ID NO: 40525 - DNA, 822 bp, Artificial Sequence
  Description of Artificial Sequence: Synthetic coding sequence
atgatggccgccatggccaccgcccgggtgcggatgggcccccggtgcgctcaggccctctggcgcatgccctggttacctgtctttctatccttggccgcagctgctgccgccgcggccgcagaacaacaagtgcctcttgttctgtggagctcagacagggacctatgggcgcctgccgctgatacccatgaaggacacatcacctcagacttgcaattgagcacttaccttgatcctgcactcgagcttggtccaaggaatgtcctgctgttcctgcaggataaactttctatagaagacttcacggcatatggcggggtgtttggaaacaagcaggatagcgcctttagcaaccttgaaaatgccctggatcttgcgccaagttcacttgtgttgcctgccgttgattggtacgcagttagcaccctcacaacttaccttcaggagaagctgggcgcatctccgctgcatgtggcccgcgatgtcgcagtggttgctggcggactgggtcgacaactactgcagaaacagcctgtctctcccgtcattcaccccccagtctcctacaatgacacagcgccccgcattcttttttgggctcagaacttctctgtggcctataaggatcaatgggaagacttgacaccgctgacgtttggggtccaggagctcaatttgacaggcagcttctggaatgactcctttgctcggttcatcctcgcgaatcgtctctatcctgtctccgcgaggcactggttcactatggagcgcctggaggtccacagcaatgggtcggtggcctactttaatgcgtcatag

SEQ ID NO: 40526 - DNA, 885 bp, Artificial Sequence
  Description of Artificial Sequence: Synthetic coding sequence
atgaaggccaccagccccgccacctgcagcagcggcctgatggccccaagggaggtgctgacaggcaatgatgaggtgattggacaggtgctttctactctaaaatcagaggacgtgccatataccgccgcactgaccgccgtgcgaccgagtagggttgcaagagatgtggctgtcgtggctggcggtctgggtcgccagcttctgcagaagcaaccagtgtcccctgtgatccacccccccgtcagctacaatgacactgcaccccggatactgttttgggctcagaacttttccgtcgcttacaaagaccagtgggaggatctgacacctctgacctttggcgtccaagaactgaatctgaccgggagcttctggaatgatagcttcgcgaggttaagtctcacatacgagcgcctgtttggcactaccgtgacatttaagtttatcctggccaaccgtctttacccggtgagcgccagacactggttcacgatggagagactagaagtgcattcaaacggatcggtcgcctactttaatgcttctcaggtgaccggccctagtatctacagcttccactgcgagtacgtttctagtcttagcaaaaaaggcagtctactggtcgcccggacccagccgagcccatggcaaatgatgctgcaggattttcaaatacaagcatttaacgtcatgggggagcaattttcctacgctagtgactgcgcctcgttcttctcacctggaatctggatggggctgcttacatctttgtttatgctatttatatttacgtacggcttacacatgatcctgtccctgaagaccatggacagatttgacgaccataagggtccgaccatcagtctaacacagatcgtctag

SEQ ID NO: 40527 - DNA, 693 bp, Artificial Sequence
  Description of Artificial Sequence: Synthetic coding sequence
atgatggccgccatggccaccgcccgggtgcggatgggcccccggtgcgcacaggctttgtggcgcatgccatggctccctgtgtttctctcattggctgctgcagccgcggccgctgctgctgagcagcaagtcccactggtgctgtggagttcagaccgggatctgtgggcacccgccgctgacactcacgagggtcacatcacaagtgatctacaactgtcaacctaccttgaccccgctctcgagttgggtcccaggaatgtcctcttgttccttcaggataagctcagcatcgaggattttactgcatatggtggggtgtttgggaataagcaggacagcgccttctctaatcttgagaacgcactggacctggcacccagcagcctagttctgccggctgttgactggtatgcagtgtcaaccctgactacatacttgcaagagaaactgggggcttcacccctccatgtggatctcgcgactctcagagaactcaagcttaacgcctctctgcctgccttattactaatcaggctcccatacactgcgtcatcaggactgatggccccacgtgaggtgctgactgacgaggtcatcgggcaagtgctaagtaccctgaaaagcgaggacgtcccgtacactgcagcactgactgccgtgagaccaagtcgggtggctcgggattag

SEQ ID NO: 40528 - DNA, 675 bp, Artificial Sequence
  Description of Artificial Sequence: Synthetic coding sequence
atgcggctgtggaaggcccgggtgctgaagctggtgctgaagaccgccaaagatagtagactggggctcaattctaaatggctttctctgaaattaggggacgccggcaacccacgatctctcgcaattcgcttcatcctgactaactacaacaaactttcgatccaatcttggttcagcttgagacgagtggagattattagcaacaacagcattcaggcggtatttaatcccacaggtgtgtacgccccaagtggatattcctatcgctgccaacgtgtcggcagtttacagcaggatcaggccctgctgttgccctcagacaccgatgatgggagcagcctctgggaagtgactttcatcgacttccagatccagggttttgcaatcaagggcggcaggttcaccaaagcccaggattgtgcctcttccttcagccctgcattcctgataggcctggccatgagcctgatcttgttgctggtactggcatatgctctgcatatgctgatctacttgcgctacctggatcagcagtacgacctgattgcctcacccgcccactttagtcagctgaaagctagagataccgcagaagaaaaagagctgctcagaagtcaaggtgcagaatgttacaaacttcgctcacaacagatatccaagatctatgtttag

SEQ ID NO: 40529 - DNA, 675 bp, Artificial Sequence
  Description of Artificial Sequence: Synthetic coding sequence
atgcggctgtggaaggcccgggtgctgaagctggtgctgaagaccgccaaagatagtcgtctgggccttaatagtaaatggctttcactgaagcttggggacgcaggcaatcctaggagcctggctatccggttcattctgaccaattacaataagctttcaattcagagttggttttcattgagacgggtagagataattagcaataactctattcaggccgtgttcaaccccactggtgtgtacgccccctctggctatagttacagatgccagcgcgtggggagtctgcagcaggaccaagctctcctcctgcctagcgacacagacgatggctctagcctttgggaggtcacctttatcgatttccaaatccaaggttttgccattaagggcggacggtttacgaaggcacaggattgcgcttcatcatttagtccggccttcctgataggtttagccatgtctctaatccttctgctggttctggcatatgccctccatatgttaatttatctgcggtatcttgatcagcagtacgacttgattgcttcgccagcccacttctcacagctgaaagcccgtgacactgcagaggaaaaagagcttctgcggtcccagggcgcagaatgctacaagcttagatcccagcaaataagtaagatatatgtttag

SEQ ID NO: 40530 - DNA, 3327 bp, Artificial Sequence
  Description of Artificial Sequence: Synthetic coding sequence
atgttcctgggcctgggccggttcagccggctggtgctgtggttcgccgctttcagaaaactcctgggtcatcatggtctggctagcgcaaagttcctgtggtgtctctgcctgttatccgttatgtcactgcctcaacaggtgtggactctgccctacaaaattggggtcgtcggtccatgggcctgcgacagtctgttctccaaggccctgcctgaggtggcagctaggctagcaatcgaaagaataaatcgtgatccttccttcgatttgtcttacagcttcgagtacgtgatcttaaacgaagattgccaaacgagtcgcgcgctctcatcctttatcagccaccatcaaatggcaagcggattcattggcccgactaatcccggctactgcgaggcggcatctctgttgggcaactcctgggataaaggaatctttagctgggcatgcgtgaactacgaactggacaataaaattagttacccgaccttcagtcgcacgctgcccagcccaattagagtgctggttactgtaatgaaatattttcagtgggctcatgccggcgtgatttcctccgatgaggacatatgggtccataccgcaaaccgcgtggcttctgccctccgctcccatggactccctgtgggtgtcgtgctcaccacggggcaggatagtcagtctatgcgaaaggcgctgcagcggattcatcaagcggataggatacgaatcatcatcatgtgcatgcacagcgctctcatcggtggcgaaactcagatgcacctcctggaatgcgctcatgatttgaaaatgacggatgggacatacgtgttcgtcccctacgacgccctactgtacagtctgccatataagcataccccctatcgcgtcctcagaaacaatcctaaactcagggaagcctatgacgctgtcctgaccattaccgtcgagagtcaggaaaagacgttttaccaggctttcacagaagcggccgccagaggagagattccagagaagttagagtttgaccaggtgtccccactgttcggcaccatctacaattctatttacttcatcgcccaagctatgaacaacgccatgaaggaaaacggtcaggcgggcgctgcctctcttgtgcaacattcccggaatatgcagttccatggctttaatcaactgatgcggactgactccaacggtaatgggatctctgagtacgtgatactggacacaaatctcaaagaatgggagcttcattccacctacacggtcgacatggaaatggaattactgcgcttcggaggaacccctatacattttcccggtggacgccctcctagagccgacgccaagtgttggtttgccgaaggaaaaatttgtcacgggggcattgatccagccttcgctatgatggtgtgcctaacattactgattgcccttctctctatcaatggatttgcttacttcattaggagacgtattaataaaattcagctgataaagggccctaatcggattcttctgaccctggaagacgttaccttcatcaacccacactttggatccaagagagggtcccgcgcttccgtgagcttccagatcactagtgaggttcagtcaggccgttctccgcgtctttccttcagctctggctcgcttactcccgccacctacgaaaatagcaatattgccatttacgaaggggattgggtgtggttgaaaaagttcagtctgggcgactttggagaccttaagtcaattaagagtcgggcaagcgatgtcttcgaaatgatgaaggacctgcggcacgagaatatcaacccactgctaggatttttctacgacagcggtatgtttgccatcgttactgagttttgcagtcggggatcattggaagatatactcactaaccaggacgtcaagctggactggatgttcaaatcctctcttctcctggatctcatcaaaggtatgaagtacttgcatcacagggaattcgttcatgggagactcaaatctagaaattgcgtcgtggacggcagattcgtcctaaaggtgacggattacggatttaatgatatcttggaaatgctgaggttgtccgaggaggagtcaagtatggaggagttattgtggaccgcacctgaactgttgcgcgcaccccgaggctctcggttgggatcattcgctggggacgtgtactcatttgccataatcatgcaagaggtcatggtaagagggacgcccttttgcatgatggatctgccagcacaggagatcattaatcggctgaagaaacctccaccagtgtatagacccgtggtgcctcccgaacacgcaccaccggaatgcctgcaactgatgaagcagtgttgggcagaagcggccgagcagaggccaacgtttgatgagatctttaatcagttcaagacctttaacaaaggaaaaaaaactaacatcatcgattctatgttgcggatgcttgaacagtactcctctaatttggaggacctaattagggaacggaccgaagaactggagatcgagaagcagaaaacggaaaagttgttaactcagatgctgcccccctccgtcgctgaaagcctgaagaagggatgtactgttgagccggaggggttcgacctggttaccctttacttctctgacatcgtgggctttaccactatcagcgccatgagtgagcccattgaggtggtggatctcctcaacgacttgtatacgctctttgatgcaattatcggatctcatgatgtgtacaaggtcgagactatcggagatgcctatatggtcgcttcaggcctcccaaaacggaacgggtctagacacgcagctgaaattgccaacatgagtcttgacatcctctcttcggtggggacatttaaaatgcggcacatgcccgaggtgccggtgcggatcaggatcgggctccattccggcccagttgtagccggagtcgtcggcctgaccatgccccggtactgcctttttggcgacacagtgaacaccgccagcagaatggagtcgacgggcctgccctacagaatacacgtctccctatctactgttactatcctgcagaatctaagcgagggctacgaggtggaactgcgggggcgaacagagcttaaaggaaagggaactgaggaaaccttctggctgattggaaaaaaggggtttatgaagcctctgccagtaccgccccctgttgacaaagatggacaggtgggccacgggctccaaccggtggaaatagcagctttccagcgcaggaaagctgagcgacagttggtaaggaataaaccatag

SEQ ID NO: 40531 - DNA, 1062 bp, Artificial Sequence
  Description of Artificial Sequence: Synthetic coding sequence
atgcggcggcagctgcggagccggcgggcccccagcttcccctactcataccgctaccgccttgacgaccccgatgaggcgaatcagaactacttggccgacgaagaggaagaggcggaggaagaagcccgggtcaccgtcgtgcctaaatcagaggaggaggaggaagaggaggagaaagaagaagaggaagaggaagaaaaagaggaagaggagggccaggggcaacccaccgggaacgcatggtggcagaagttgcagataatgtccgaatatctgtgggacccagagcggcgtatgttcctggctcggaccggcttgattctgctcatatatttcttcttttacgccagcctggccgcagtgataaccctctgcatgtataccctgttccttaccatctcaccgtacattccgacattcaccgaacgcgtgaaaccacccggggttatgatccgtccattcgcccactcactgaactttaatttcaacgtgagtgaaccagatacctggcaacattatgtcatttccctgaatggctttctgcagggctataatgattccttacaggaagagatgaatgtcgactgtcctcctgggcaatacttcatacaggacgggaacgaagatgaagacaagaaggcatgccagttcaaacgttctttcctaaagaattgtagcggactcgaggatcccacgtttggttatagcactggtcagccatgcatactgctcaaaatgaatcgcatcgtcggcttcaggcccgaattaggggatccagtcaaggtttcctgtaaggtccagaggggagatgagaacgatataagatcaatcagctactaccctgagagtgcctccttcgatctgcgctactatccttactacggtaagctgacacatgtaaattataccagtccactcgtcgcaatgcacttcactgacgtggtcaaaaatcaggccgttccagtccagtgtcagctgaaaggaaaaggggttattaatgacgtgattaatgaccgctttgtcggccgagtaatcttcaccctgaatatagagacttag

SEQ ID NO: 40532 - DNA, 945 bp, Artificial Sequence
  Description of Artificial Sequence: Synthetic coding sequence
atgcggcggcagctgcggagccggcgggcccccagcttcccctactcatatagatatagactcgacgaccccgacgaagccaaccagaattacctggcagacgaggaggaggaagctgaggaggaagctcgcgtgactgtggtccccaagtctgaagaggaggaggaagaggaagaaaaagaagaggaagaagaagaagagaaggaagaggaagaaggacagggacagccaactggcaacgcctggtggcaaaagcttcaaattatgtcagagtacctgtgggaccccgagcgcaggatgttcctagctaggactgggcaatcttggagagttatgattcgcccttttgctcatagtctcaactttaatttcaacgtctcggagcccgacacgtggcagcattacgtgatctcactgaacggatttcttcaggggtacaatgactctctacaagaggagatgaatgtagattgccctcctggccagtacttcatccaggatggcaatgaagatgaggacaaaaaggcatgtcagttcaaacgctctttcttgaaaaattgtagtggcctggaggatccgacctttggttattcaactggtcagccctgcattctgctcaaaatgaaccgcatagtgggctttcgtccagagctcggggacccagtcaaagtgtcatgcaaggtgcagcggggagacgagaatgacatcaggtctatctcctactatccagaatctgctagttttgacctgaggtattatccttactatggcaaactgacccacgttaactacacgagccctctggttgctatgcactttacagacgtggttaagaatcaagcagtaccggttcagtgtcagctgaaggggaagggagtaattaacgacgtaattaacgaccgctttgtgggacgcgtcatattcaccctcaatatcgaaacttag

SEQ ID NO: 40533 - DNA, 381 bp, Artificial Sequence
  Description of Artificial Sequence: Synthetic coding sequence
atggtggacgagaacgacatccgggccctgaacgtgcggcactaccgggaccatatcggtgttgtgtcccaggagcccgtgctattcggaactactatctctaataacataaaatacggccgcgacgatgtaacggacgaagaaatggaaagagccgctagggaggccaacgcatacgattttatcatggagttcccgaacaagttcaataccctggttggagagaagggcgctcagatgtcaggcggccagaagcagcgtatcgctatcgctagggctctggtgagaaatccaaaaattctgattctagacgaggccacatctgctctcgacagtgaaagtaaaagtgccgttcaggccgctctagaaaagaagaaatag

SEQ ID NO: 40534 - DNA, 2439 bp, Artificial Sequence
  Description of Artificial Sequence: Synthetic coding sequence
atggtggacgagaacgacatccgggccctgaacgtgcggcactacagagaccatatcggagttgtgagccaggagcctgttctgttcggtaccacaatctctaataacattaagtacgggagagatgacgtgacagacgaggaaatggaacgtgcggctagggaagctaacgcttacgatttcattatggagtttcctaacaagttcaataccttagtaggcgaaaaaggagctcaaatgtcgggtgggcaaaaacaaaggattgcaatcgccagggccctcgtgcggaatccgaagattctcatattggatgaagcgacatccgctttggatagcgaatccaagagtgccgtgcaggctgcactagagaaagcttcaaaaggtaggacaaccattgtggtggcccaccgactatccactatccgtagcgcggacctcatcgtgaccctgaaagatggaatgctagcggagaaaggtgcgcacgcagagctgatggcgaaacgtggtctctattactcacttgtcatgagccaggacataaagaaggccgatgaacaaatggaatctatgacatattcgaccgaaagaaagacaaatagccttccgctgcacagcgtgaaatctattaagtctgacttcattgataaagccgaggaatctacgcagagcaaagagatctcactccccgaggtgtcactgcttaagattttgaagctgaacaagccagaatggccatttgttgtgcttggaactctcgcctcagtgctgaatggaactgtccatccagtgttttctatcattttcgcaaaaataatcacaatgtttggcaataacgacaagacaactctaaaacacgacgccgagatttacagcatgatctttgtcatcctgggcgtcatttgcttcgtttcatatttcatgcaggggttgttctacggacgcgccggcgagattctgaccatgaggctcagacaccttgcgttcaaggcaatgctctatcaggacatagcatggtttgacgaaaaagaaaactccactgggggattgaccaccatcttggccatagatattgcccagatccagggtgcaacaggttcacgaataggcgtgctgactcagaacgctactaacatgggtctgtctgtgattatcagcttcatctatggctgggaaatgacctttttaatcctctctattgcgccagttctggcagttaccggaatgattgagaccgctgccatgactgggttcgccaacaaggataagcaggagttgaagcacgccgggaaaattgcgactgaggcccttgaaaacatccggacaattgtctccttaacacgggagaaggcattcgaacagatgtacgaagaaatgctgcaaactcagcaccgtaatacatctaagaaggcccagatcatagggagctgctacgccttctcccacgcgtttatctactttgcctatgccgctgggtttaggttcggcgcttacttaatccaggccggccgaatgacgcccgagggtatgttcatagtgttcaccgctatcgcatatggcgctatggccatcggggagaccctcgttcttgctcccgagtactcaaaggcgaaaagcggtgctgcccacctgtttgcattgttggaaaagaaacccaatattgattcgcgctcccaagaagggaaaaaaccagacacctgcgagggtaatctggagtttcgagaagtgagttttttttatccttgcagacccgacgtatttattttacggggactaagtcttagcatagaaagggggaagacagtggcatttgtgggcagcagcgggtgcgggaagtctacatcagtccagcttctccagcgcctgtacgatcccgtacagggacaagttctttttgatggcgtggacgccaaggagctgaacgttcagtggcttcgcagccagattgctatcgtgccacaggaaccagtgctcttcaactgtagtatagcagagaacattgcatatggtgataacagccgagttgtgccactcgacgagataaaagaggcagccaatgcagccaatattcattcctttatagaaggccttcctgagaaatataacacgcaggtggggctaaaaggcgctcaattgtctgggggccagaagcagcggctggccatcgctcgggccttactgcagaagccgaagatcctcctgctggacgaggctacttctgctctcgacaatgactcggagaaagtggtccaacatgcactggacaaggccaggaccgggcgcacctgtctggtcgtaactcatagattgagcgctatccagaacgccgacttgatcgtggtccttcacaatggaaaaatcaaggagcaggggactcatcaagagctgcttcggaatcgcgacatctactttaagctggtgaatgctcagagtgttcagtag

SEQ ID NO: 40535 - DNA, 3774 bp, Artificial Sequence
  Description of Artificial Sequence: Synthetic coding sequence
atggagaacagcgagcgggccgaggagatgcaggagaactaccagcggaacgggacagctgaggagcaacctaagctgcggaaagaagcagtgggaagtattgaaatattccgttttgcagatggcttggatatcactctgatgatcctggggatcctcgcttcccttgtcaatggcgcttgccttccactgatgccactcgtattgggtgaaatgtccgataacctcatttccggttgcctggtgcagacgaatactaccaactatcagaactgtacacagtcacaagagaaactgaacgaggacatgaccttactgacactctattacgtcgggattggcgtcgcagccctgattttcggctatatacagatatccctctggatcataaccgccgccagacagaccaagagaattcgaaagcaatttttccacagcgtcctggctcaggatattgggtggtttgacagctgtgatatcggggaattgaacacacgcatgacggatgacatcgacaagatcagcgacggtattggagataaaatcgcacttctgtttcagaatatgagcaccttttccataggtctcgcagttgggctcgttaagggctggaaattgaccctcgtaaccttaagtacctcccccttgatcatggctagcgcagccgcttgttctaggatggtgatttctcttacgagtaaggaactgtccgcgtacagcaaggccggagccgtggctgaagaagtgctgtcctccatacggacagtcattgcgttcagagcccaggaaaaggaattgcaaaggtacacacagaacctgaaagacgcgaaagatttcgggataaaacggacaattgcatccaaggtctcacttggggctgtgtacttctttatgaatggcacatacgggttggcattctggtatggcactagcttaattctgaacggcgaacctggatacactataggcaccgtgttggctgtgtttttctcggttatccactcaagctattgcattggagctgcggtgccccattttgagacttttgcaattgcccggggggcagcttttcacattttccaggtgattgacaaaaagccgtctatagataatttctcaactgcagggtacaagcctgagtcaattgagggtactgttgaatttaaaaatgttagcttcaattacccgtcacgaccaagcattaagattcttaaaggcctgaatcttcgcatcaaatcgggggaaactgtggcactggttggcttaaacgggagcggtaaatccactgtcgtacagctattacagagattatacgaccccgatgacggctttattatggtggatgagaatgatatccgggcccttaacgtccgacattaccgggaccacatcggcgttgtgtctcaggagccagtactttttggaaccaccataagtaacaacatcaagtatggccgggacgatgttactgacgaggaaatggagagggccgcccgggaggccaatgcctatgactttatcatggagttccctaacaagtttaataccctggtgggtgagaagggagcccagatgtcagggggacagaagcaaagaatagccatcgccagagccctcgtcagaaaccctaaaatattaattcttgatgaggccacctctgctctggactccgaatccaagtcagcagttcaggctgccctcgaaaaggcgagcaagggccggacgaccatagtggtggcgcaccgactttctactataaggagtgcggaccttatagtgactctgaaagacggtatgctcgccgagaagggggctcatgctgagcttatggcgaaacgtggtctctattatagccttgtgatgagccaagatatcaaaaaggccgatgaacagatggaatcgatgacgtattcaaccgaaagaaaaaccaacagtctaccactccatagtgtgaaaagcattaagtctgacttcatagacaaggctgaggagagtactcagagtaaagaaatctcactccccgaagtcagcttgttaaaaatcctgaaactgaacaaacctgaatggccatttgtggtgctgggcacacttgcctctgtgcttaatggtactgtgcacccagtgtttagtattatatttgccaaaattataactatgttcgggaacaacgataagacaacacttaagcacgacgccgaaatctactctatgatctttgtcatcttgggggtgatctgttttgtgtcgtacttcatgcagggactgttctatggacgggctggcgagatccttacgatgcggctgcgacacctggccttcaaggcgatgctgtatcaggacatcgcctggttcgatgagaaggagaatagtacaggagggttgaccacaatcctggcaatcgacattgcccagatccagggggcaaccggcagcagaattggtgtgctcacacaaaatgctactaatatgggtctgtccgtcataatctcctttatctacggctgggagatgacgttcctgatcctttctatagctccagtgctggctgtaaccggaatgatcgaaacggcagccatgaccggattcgcgaacaaggataagcaggaattaaagcacgcaggtaagattgcaacggaggctctcgagaacattaggacaattgtttccctaactcgagaaaaggccttcgagcagatgtacgaggagatgcttcaaacacagcaccggaacacatccaagaaggcccagatcatcggatcctgctacgctttctctcacgcttttatctattttgcctatgccgccggttttagatttggtgcgtatctgattcaggctggccggatgacccccgaaggaatgttcatcgtcttcactgctattgcgtacggcgctatggcaatcggtgagactctcgtgctggcccccgaatattctaaggccaagtccggggccgctcacctgtttgccttgctcgagaaaaagcctaacatcgattcccggagtcaggaagggaagaaaccggatacatgtgagggaaacttggagttccgtgaagtgtcgtttttttacccctgcaggccggacgtattcatccttagggggctttccttgtctatcgaacgaggcaagaccgtggccttcgtgggctcctcgggctgcgggaagtcaaccagcgtgcagcttctgcagcgcctctatgatccggtccagggccaggtcctcttcgacggcgttgacgctaaagaacttaacgtgcagtggttaaggtctcaaatcgccatcgttccccaggagcctgtgcttttcaattgctcaattgccgaaaatattgcttatggcgacaacagcagggttgtgccgctggatgaaatcaaggaagctgctaacgccgctaatatccattcgtttattgaagggctgcccgaaaagtacaatacacaagtgggactcaagggagcgcagctgagcgggggacaaaaacaacggcttgcaattgcccgcgccttattacagaagcccaaaatcctgttgctcgatgaggctacctcagccttagacaatgactcagaaaaagtggtacagcatgcgctggacaaggcccggacagggaggacctgtttggtggtgacacataggctatccgcaattcagaatgccgacctgattgtggtgctacacaatggtaagatcaaagaacaaggcactcaccaggaactgctccgcaaccgggatatatactttaaacttgtcaacgcccaaagtgtgcagtag

SEQ ID NO: 40536 - DNA, 396 bp, Artificial Sequence
  Description of Artificial Sequence: Synthetic coding sequence
atggtggacgagaacgacatccgggccctgaacgtgcggcactaccgagatcatatcggcgtggtgagccaagagcccgtactgttcggtactaccatctccaataacatcaagtatgggcgagacgatgtgaccgacgaggagatggagagagcagctagggaggccaacgcctacgactttatcatggaatttcccaacaagtttaatacgctggtcggtgagaaaggggcccagatgtctggcggacaaaagcagcggattgcgatcgccagagccctggtgcgcaaccccaaaattctaattttggacgaagctacaagcgctctcgactcagagtctaagagtgccgtgcaggcagccttggaaaaagacacacctaggtattccttctag

SEQ ID NO: 40537 - DNA, 4749 bp, Artificial Sequence
  Description of Artificial Sequence: Synthetic coding sequence
atgcccctggccttctgcggcagcgagaaccacagcgccgcctaccgggttgatcagggggtgctaaataatgggtgtttcgtagatgctctgaatgtcgtcccacacgtctttttgctatttattacatttcctatcctgttcattgggtggggctcacagagctctaaagtgcatatccaccactctacatggttgcacttccctggtcacaacctgcgctggatattaactttcatgctcctttttgtgctggtgtgcgaaattgctgaggggattttgagtgatggcgtcaccgaatctcatcaccttcacctgtacatgcctgccgggatggcctttatggccgccgttacttccgtagtgtattatcacaatattgaaacatctaattttcctaagctgctgatcgccttgcttgtgtattggaccttggcatttattaccaagaccataaagttcgttaagtttctggaccacgccatcgggttctctcaactgaggttttgtctgactggactgctcgtgatcctgtacggcatgcttctcctggtggaggtgaacgttattcgggtgcgccgttatatcttcttcaagacccctagagaggtgaagccgcccgaggatttacaggacttgggtgtacggtttctccagcccttcgttaatctcttgagcaaaggcacttactggtggatgaacgctttcatcaaaacggcccacaagaaaccgatcgatctccgggctataggaaaactgccaattgccatgagagccttgactaactatcagcgcttatgcgaggcattcgacgcccaggtgcgaaaggacatccaaggcacacagggcgccagagccatttggcaggccctctcccatgcttttggacgaaggctggtgctctcttccaccttcagaatactggcagacctgctgggcttcgcgggacccttgtgcatcttcgggattgtcgaccacctgggtaaagaaaatgacgttttccagccaaagactcagttcctgggggtttatttcgtgtcttcccaggagttcctggcaaatgcttatgttcttgcagtacttctgttcttggccttgcttctccaacgcacatttctccaagcaagctattacgtggcaatcgaaacggggatcaatctgcgtggggccattcagacaaagatctacaataagatcatgcatctgtcaacgagcaacctgagcatgggcgagatgacagcaggacagatttgcaacctggtcgccatcgacaccaaccaacttatgtggtttttcttcttgtgccctaacctctgggcgatgcccgtccagattatcgttggtgtgatcctgctttactatattctcggcgttagtgctctgattggggccgccgtgataatactgctcgcccccgtccagtattttgtcgcaacgaaactctcccaggcacaacgcagcactctggagtactccaacgagcgattaaagcagacgaacgagatgctgcgcgggatcaaattgctcaagctgtacgcatgggagaacatttttaggactcgggtggaaaccacacggcgaaaagaaatgacatcacttagagcattcgccatttatacaagtatttcgatctttatgaatactgccatcccgatagcagcggtgctcattacctttgttgggcatgtaagtttttttaaggaagcggacttttccccatccgtggccttcgcaagtctgtcgctgtttcacatcctggtcacacctcttttcctcctctccagtgtcgtccggagcacagtcaaggcactcgtgtctgtacagaagttgagcgagtttctctccagcgctgagattagggaggagcagtgtgcacctcatgagccaacgccacagggcccggccagtaagtaccaggccgtcccactcagagtagtgaatcggaagcgccctgccagagaggactgcagggggctgaccgggccgctgcaaagccttgttccatcggcagatggcgatgccgataattgttgtgtgcagataatgggcgggtatttcacatggaccccagatggcatccccacactttcaaatatcaccattcgcatcccccggggtcagctgaccatgatcgtgggccaggtgggatgcggcaagtcttctcttctgctcgctgctttaggggaaatgcagaaggtatctggagctgttttttggtcatcatccctcccggatagcgagattggcgaagaccctagccctgagcgggagaccgcgactgacctggacattcgtaagagaggtccggtagcttatgcgtcccaaaaaccgtggctcctcaacgccaccgtcgaggagaatattatattcgagtctcccttcaacaagcagcgatataaaatggtgattgaggcctgttccctccagccggacatcgacattctgcctcacggagatcagacccaaattggcgagagggggatcaacttaagcggtggccaaaggcagcggatctccgttgctagagctctctatcaacatgccaatgtcgtttttctggacgatcccttctcggctctggacattcacctcagtgaccacttgatgcaagctgggattctggagctccttcgagatgataaaaggaccgttgtgctggtgactcataaacttcagtacttgccgcatgccgattggataatagctatgaaggatggaacaatccaacgggagggcacgctcaaagacttccagcggtctgagtgtcaactgtttgagcactggaagacgctcatgaatcgacaggaccaagagttagagaaagagaccgtgaccgaaagaaaagccaccgaacccccacagggcctgtctcgcgctatgtcctctcgcgacggcctgcttcaagatgaagaggaagaagaggaagaggcagcagaaagcgaggaggacgacaatctttcatctatgctgcaccaaagggcagagatcccgtggagagcttgtgccaagtatctgtctagtgcaggaatcttacttctgagcttactggttttcagccagttgctcaaacacatggtgctggtggccatcgactattggctggctaagtggacagacagcgccctgacattaactcccgctgcaaggaattgctcgctgagccaggaatgtactctagaccagaccgtatacgccatggtgtttacagttctgtgcagcctgggcatcgtgctgtgtttagtgactagcgtgaccgtagagtggacaggactgaaagtggcaaaaagactccaccgttcattgctgaaccgaatcattctggcccctatgaggttcttcgaaacgactcctctaggttccatccttaatcgtttttcttcagattgtaataccattgatcagcacatcccatcaacattagaatgcctcagtcgatcaacgctgctctgcgtaagtgccctcgctgttatctcatacgtgacccccgtgttcctcgtagctctgctgccactagcgattgtgtgttattttatccaaaagtactttcgggttgcaagtagggacctccagcaactggatgataccactcaactcccactgttgtctcactttgcggaaacggtcgagggactgacaacgatccgggcctttcgttacgaagccagattccagcagaaactgctggaatacactgattcaaacaatatcgcctcactgtttctcacagcggcgaacagatggctggaggtccggatggagtacattggcgcctgcgtcgtgctaattgctgcagtgacttctattagcaatagcttgcaccgagagctgtccgccggacttgtgggtcttggtctgacttatgccttaatggtcagcaattacttgaattggatggtccgcaatttggccgatatggagctccagctgggcgccgtcaagaggatccatggcctactcaaaactgaagccgaatcctacgagggcctcctggccccgagcttgattccgaaaaactggcctgaccaggggaagatccaaattcagaatctgtctgtgagatatgattccagcctgaaacctgtgttgaaacatgtgaacgcccttatcgctccgggccaaaaaattggcatttgtggaagaaccggatcaggtaagtcaagcttttcattagctttttttcgcatggttgacactttcgagggtcacattataatcgatggaattgacatcgcgaaactccccctacatacactgcggagtcggctgtctataatcttgcaggaccctgtattattcagcggaacaatacgctttaacctcgatcctgaacgcaaatgctctgacagtaccctgtgggaggctctagagattgctcagctcaagttagtcgtgaaagccctgcctggagggctggacgctatcatcacagaagggggtgagaatttttcccagggccagcgccaactattttgtttggcgagagctttcgttcgcaaaactagcatttttataatggatgaggcgactgcaagcattgatatggccaccgaaaatatactgcagaaggttgtaatgacagccttcgcagacagaaccgtggtgaccatcgcacacagggtacatactatcctgtctgcggacctggttattgtcctaaagaggggcgctattctcgaattcgacaagccagaaaagctcctaagccgtaaggacagtgtattcgctagcttcgtgagagcagataagtag

SEQ ID NO: 40538 - DNA, 3036 bp, Artificial Sequence
  Description of Artificial Sequence: Synthetic coding sequence
cggagccagctgagccccagccccgcccgggcccgggccgccatgcctctggcgttttgcgggagtgaaaaccattcagcggcatatcgcgtggatcagggggtgctgaacaatggttgctttgtggatgccctaaacgtagtccctcatgtgtttctactgtttatcacctttcctattctttttatcgggtggggctcgcagtcctccaaggtgcatatacaccattcgacttggctccactttccgggacacaatctgaggtggattctgaccttcatgctgctgttcgtgctcgtgtgtgaaatcgcggagggtatcctctcagacggcgtcactgaatcccaccatctgcacctgtatatgcccgccggtatggccttcatggccgcagtcacctccgttgtgtattatcataatattgaaaccagcaactttcccaagctgctgattgctctcctggtatattggaccctggccttcatcactaaaacgattaagtttgtaaaatttcttgaccacgcgataggctttagccagctgcgattctgtctgacagggctgctcgtgattttgtatgggatgctcctgcttgtggaggtgaacgttatccgggtgcgtcgctatatcttctttaagacacccagggaggtaaaacctcctgaggatcttcaagaccttggggtcaggttcctccagcctttcgtaaatctgctcagcaagggcacttactggtggatgaatgccttcatcaagaccgcccataagaaaccgatcgacttgcgggcaattgggaagctgccaattgcaatgcgagccctcacgaattaccagcggctttgcgaagccttcgacgctcaggtgcgcaaggatattcagggtacccaaggggccagagccatttggcaggctctgtctcatgcctttggacgccggctggtgctctcctctacctttaggatcttagcggatcttctcggttttgccggacctttatgcatcttcgggatagtggatcatctggggaaagagaacgacgtttttcagcccaagacgcagtttctcggagtttactttgtgagctcccaagaatttcttgccaacgcttacgttctggcagtccttctattcctagcactactgctccaacgaaccttccttcaggcctcttattatgtcgcgatcgaaacgggcataaacctcagaggtgctatccagactaagatctacaataaaataatgcacctgagcacctccaatctgtcaatgggggaaatgaccgcagggcaaatatgcaatttggtagcaattgataccaatcagctgatgtggttcttctttctgtgcccgaacctctgggccatgcctgtgcagatcatcgttggcgtgatcctgctttactatatcctgggtgtttcggcattgattggcgccgccgtgatcattctgctcgctccagtccagtatttcgttgcaactaagctaagccaggctcagagatccactctggagtacagtaacgaaagattaaagcaaactaacgaaatgttacgcggaattaaacttttgaagttatatgcttgggaaaacatctttaggacccgagtggagactaccagaagaaaggaaatgacttctctgcgagctttcgcaatttatacatccatctcgatctttatgaacacggctattcccatagctgcggtcctgatcactttcgtgggccacgtgagttttttcaaagaggccgatttttctccgtctgtggcttttgcgagtctgtccctcttccacatactggttactcctctttttctgctctcttcagtagtgagaagtacggttaaagctctggttagcgccgaaattagagaggagcagtgcgcgcctcacgaacccacgccacagggcccagcctccaaataccaggctgtccccctgcgtgtggtgaaccggaaaaggccagccagggaagattgcaggggactaaccgggcccctgcagtcactggtgccttcagctgatggcgatgccgataattgttgtgtccaaattatgggagggtattttacgtggactcctgatggaatcccgacgttgagtaatatcactattcggatccccaggggacaactgacaatgatcgtgggccaggttggatgtggcaagtcaagcttgttacttgccgcgttgggcgagatgcagaaggttagtggagcagtcttttggagctcacttcccgactccgaaatcggtgaagatccctccccggagagggagactgccacagatctggacattcgtaaacgcggaccagtagcatacgcttcccagaagccatggctattgaacgcaaccgtcgaggagaatattatctttgagagcccattcaataagcagagatataaaatggtgattgaggcctgtagcctgcaaccagacatcgacatcctgccccatggcgaccaaacccagattggcgagaggggtatcaatctgagtggggggcaacgccagcgcattagtgttgctcgggccctctatcagcacgcaaacgttgtgttcctggacgaccccttcagcgccttggatattcatctatctgaccatctgatgcaagccgggatcctggagttactccgggatgacaaacgcaccgtggtgctggtgacccataagttgcagtacctcccccacgcagactggatcatcgctatgaaagatggaaccatccagcgggaaggtacattgaaggacttccagcgttctgagtgccaactgttcgagcattggaagacgctgatgaaccgacaggatcaagagctcgaaaagaggcggcagctcagagcgcgcaggatgaccacctgtaggccctgctgtacaagtgtgctaaggagccacggggagccagctccatcaacctgcccaccccctgcttcatgtagctgtagatgctggtcatctcattcatgtagcagcacgtggtcctggtggccctcgacgacggggtggccatcaggaccaaccgccccctag

SEQ ID NO: 40539 - DNA, 4746 bp, Artificial Sequence
  Description of Artificial Sequence: Synthetic coding sequence
atgcccctggccttctgcggcagcgagaaccacagcgccgcctacagagttgatcagggtgtactaaataatggctgcttcgtggacgccctgaacgtagtgcctcatgtttttttgctgttcattacatttccaattttatttatcggctggggttctcaaagtagcaaggtccatatacaccacagcacctggcttcactttccagggcataatctgcgctggatcttgacatttatgctcctgtttgtgcttgtgtgtgagattgctgaaggaattctgtcggatggtgtcacggagtcccaccacctgcatctatacatgcccgcaggcatggcctttatggccgctgtaactagtgtggtctattatcacaacattgagacatctaactttccaaagctgttgattgcactgcttgtgtactggaccttagcatttataacgaagactataaaatttgtcaaattcttggatcacgctatagggtttagccagctgaggttctgtttaacggggctgcttgtaatactgtacgggatgttgctcctggtggaagtgaatgtgatccgggtcaggcgctacatcttttttaaaacaccaagggaagttaaaccccccgaagatctccaagacttgggtgtgcggttcctgcagccctttgtgaacctcctgagcaaaggcacctattggtggatgaacgcattcataaagactgctcataaaaagcctattgatctgagggcaatcgggaaactgccaatcgccatgagggcgttaaccaactatcagaggctgtgtgaggcttttgacgcacaggtgcggaaggacattcaggggacccagggggcccgggcaatatggcaggctttgtcccatgccttcgggcggcgcctggtcttatcctcaacgttcaggattttagccgatctgcttggatttgccgggcccctgtgcatttttggcattgtcgaccacctgggcaaagagaacgacgtattccagccaaagactcagtttttaggcgtgtatttcgttagcagccaggaattcctggctaacgcatacgtgctggcagttttgctgttcctagcactgttgttacagcggaccttccttcaggcttcctactatgtggcgatcgagacaggcattaacctcagaggcgccatacagactaagatatacaataaaatcatgcaccttagtacatccaatctgtcaatgggcgaaatgacggctggtcaaatatgcaatctggttgcaatcgataccaaccagcttatgtggtttttcttcctctgcccaaacctgtgggctatgcccgtgcagatcatcgtgggcgtgatcctattatactatattctcggagtatcggccctcatcggcgccgccgtgatcattctgctggccccggtgcagtactttgtcgcaaccaagctatcacaagcccagcgcagcacgctggaatacagcaatgaaaggctgaagcagaccaatgagatgctaaggggtatcaaattgctgaagctgtacgcatgggagaatatcttccggacaagggtcgaaacaacacgccgaaaagaaatgacatccttgcgcgctttcgccatctacacttccatctccatatttatgaataccgctatccccatcgccgccgtgttgatcacattcgtgggacatgtgtccttctttaaggaggctgatttctcaccatcagttgcgttcgcatctctatccctattccacattctggtcacacccctgtttctcctatcttccgtggttcgatccactgtaaaggccctagtatccgtgcagaaactctcagagtttctcagctctgctgagatccgagaggagcaatgcgcgcctcacgagccaacccctcaagggccggccagcaagtaccaggctgttcctttaagggtagtgaatagaaaacgtcctgcccgcgaggattgtagagggctgaccggtcctctccagagcctggtgccatcagcggacggtgacgccgataactgctgcgtgcagatcatgggcggctactttacctggacacctgacggcattccaaccttgagtaacatcaccatcagaattcctcggggacagctgaccatgattgttggccaggtcggatgcggaaagtcctccctactgctggccgcgttaggggaaatgcagaaagtcagcggggccgtgttttggtctagcctacccgattctgagatcggcgaggatcccagcccagaaagggaaactgcaactgacctggacattcgcaagcgagggccagtggcctacgcttctcagaaaccatggctgttgaacgctaccgtggaggaaaatatcattttcgaatcaccctttaacaaacaaagatacaagatggtcatcgaagcatgctctctgcagccggacattgatattctgccccacggggaccagactcagattggcgaacgtggaattaacctaagcggcggccagaggcagcggatctctgtcgcaagagcactctatcagcatgctaatgtggtttttttggatgatccattttcagcgctggatatccacttatccgatcacttgatgcaagcaggcatcctcgaattgctgcgagatgacaagcgtactgtagtgctggtgacccataagttgcagtatctaccccacgccgactggattatcgccatgaaagatggcaccattcagcgcgagggcactctcaaggactttcaaaggtctgaatgccaactctttgaacattggaaaaccctgatgaatcggcaggaccaggaactggaaaaggagaccgtcaccgagaggaaggctacagagccaccccagggacttagtagggctatgtcgtctagagacgggcttctgcaggacgaggaagaagaggaagaggaggccgcagagagcgaggaagacgacaatctttcttctatgctccaccagagagctgagattccgtggcgagcgtgtgccaagtatctgtccagtgcggggatccttttattgagcttgctggttttcagtcaactgctcaagcacatggttttggtggccatcgactattggctggcaaagtggacagactctgctttgacactgacaccagcagccagaaattgttctctgtcccaggagtgcacccttgaccagaccgtgtatgccatggtgttcacagtcctgtgctcattaggtatcgtcctgtgtttggtgaccagcgtgacagtggagtggacaggcttgaaggtcgctaagaggctgcatcgatcccttttgaataggataattctcgcgcccatgcgttttttcgagaccactccgctggggtctatcttgaacaggttcagctctgactgcaataccatcgaccaacatattccatccacactagaatgtctgagccgatcaacactgttgtgtgtcagtgctcttgctgtgatatcctacgtgactccagtcttcttggtcgctttgctgccactggctatagtgtgctactttattcagaagtacttccgagtagccagtcgggatctgcagcagttagacgacacaacgcagctgccgctattgagtcatttcgctgagactgttgaaggactgacaactatccgggcttttaggtatgaagcacggtttcagcaaaaactgctcgagtataccgattcaaataatatagcttcactctttctcactgccgcgaatcgctggttggaggtgcgaatggaatacatcggggcatgcgtggtgctaatagccgccgttacttctatatctaacagtcttcaccgtgagctgtcagctgggcttgtgggcttagggctgacgtacgcactaatggtgagcaactatctgaattggatggtgcgcaacctggcagatatggagctgcaactcggcgccgtcaaaaggatccatgggctgctgaaaacggaggccgagtcctacgaaggcctgctggcaccctcacttatccccaagaactggcctgatcaaggaaaaattcagatacaaaatctcagcgtacgctatgactcctcactgaaacccgttttaaagcatgttaatgcgctcattgccccaggccagaaaattggtatctgcggaagaacaggctccggtaagtccagcttctccctcgccttctttcgcatggtcgatactttcgaggggcatattattatagatgggattgacatagcgaaactaccactgcacacgttgcggtcgaggctgtccattattctgcaggaccccgtcctcttttcgggaaccattcggttcaatcttgatccggagcgtaagtgcagcgactccaccctgtgggaggccctcgagatcgctcagctgaaactagtggttaaggcactgcctggaggcctggacgccatcattaccgaaggtggggagaacttctcacaggggcagaggcagctcttttgcctagccagggcattcgtgaggaagacaagtatttttattatggacgaggccacagcatccatcgacatggccacagaaaacatcctgcagaaggtggtcatgactgcctttgccgatcggacggttgtgactatcgcccaccgtgtgcacaccatcctaagcgcagacctcgtcatcgtactgaagaggggggccattctcgagttcgataaacctgaaaaattgctgtcaaggaaggatagcgtgtttgccagttttgtcagggccgataagtag

SEQ ID NO: 40540 - DNA, 2994 bp, Artificial Sequence
  Description of Artificial Sequence: Synthetic coding sequence
atgcccctggccttctgcggcagcgagaaccacagcgccgcctacagagttgaccagggcgtcctgaataacggctgctttgtggacgctttgaatgtggtaccccacgttttcctgctctttattacattccccatccttttcatcggatggggatcacagtccagcaaggttcacatccatcactccacatggctgcacttccctggccataaccttaggtggattctgacctttatgctcttgtttgtccttgtttgtgaaattgctgaggggatcctgagtgacggagtaaccgaatctcatcatctccatctttatatgcccgcagggatggccttcatggctgcggttacatccgtggtgtattatcataacatagagacctccaacttccccaagctgctgatagctctgctcgtctattggacgctcgcttttatcaccaagaccatcaagtttgtcaaattcctggatcatgcaatcggctttagccagctgcgattctgcctgacagggctgctggttattctgtacggaatgctgctgttagtagaggtcaatgtgatcagggtgaggagatatattttctttaagaccccccgcgaggtgaagccaccagaggacctacaagacctcggcgtgaggttcctgcagccattcgttaatctactaagtaagggtacttactggtggatgaatgccttcattaaaaccgcccacaaaaaaccaatagatttgcgcgcgatcggaaaactgccgatcgccatgcgagctcttacaaattaccagcggttgtgcgaggctttcgatgcacaagtacggaaagacattcaggggacacaaggggcccgtgccatatggcaggccttgtcccatgcatttggtcgccgcctggttcttagctctacctttaggatactggctgatctgttggggttcgcggggcccctttgcatttttggcatcgtcgaccaccttggtaaggagaatgatgtctttcagccgaagacacaattcttgggcgtgtattttgttagctcccaggagtttctcgccaatgcgtatgtcttagccgtcctcttgtttctcgccctcttgctccagcggaccttccttcaggccagttattatgtggccattgaaacaggtataaacttgcggggcgccattcagaccaaaatatataacaagatcatgcatctcagtaccagcaatctgagcatgggggagatgaccgccggccagatctgtaacctggtggcaatcgatacgaaccagctgatgtggttttttttcctttgtcccaacttatgggcaatgccggttcaaatcatcgttggagtgattttgctgtactatatcctcggtgtctcagcactgattggcgccgctgtgatcattcttctcgccccagtccagtattttgttgcaacaaagctatcacaggcacagaggtcaaccttagaatatagcaacgagcgactgaaacagacaaatgagatgctgcgcggaattaagttgctgaaactgtacgcctgggagaatatcttcaggacaagagtggaaaccacaaggcgtaaagagatgaccagcctgagagcctttgccatctacacttctatctctatctttatgaacaccgccattcccattgctgccgttttgataacgtttgtgggacacgtatccttcttcaaagaagccgacttttccccaagtgtcgctttcgcttcactgtccttatttcatatcctggtcacacccttatttctactgagctccgtcgtgcggagcacagttaaggcattggtgagtgccgaaattcgggaagagcagtgtgcgccccacgaaccgacaccccagggaccagcctctaagtaccaggccgtgccgctccgagttgtgaatcgaaaacgccctgcaagagaagactgccgcggactgaccggcccgttgcagagccttgttccaagtgcagacggcgatgcagataattgctgcgtgcagataatgggggggtactttacatggacccccgacgggataccaacattgtccaacatcaccatccgaattccaagggggcaactgaccatgattgtgggccaggttgggtgtggaaaaagctccctgctgctggccgcattaggtgaaatgcaaaaggtgagtggcgcagtcttttggtcgtccctccccgatagcgagattggagaagatcccagcccagagcgcgaaaccgccaccgatttggacatacgcaaacgtggccctgttgcttacgcatcccaaaagccatggcttctaaacgcaacggtcgaagaaaacataattttcgagtcccctttcaataaacagagatacaagatggtaatcgaggcctgctctctgcagcctgacatcgacatccttccccacggtgatcagacacagatcggcgagagaggaattaacctttccggggggcagcgtcagaggatctctgtcgctcgtgctctgtaccagcatgctaatgtggtgttccttgacgacccattcagcgccttggacatacatctgagtgatcatctgatgcaagccgggattctggagctgctgcgggatgacaagaggactgtggtgctcgtgacacataagctacagtatctaccacatgccgactggattatcgcgatgaaggacggcaccattcagcgggaaggcacactcaaggatttccagaggtctgagtgccagctctttgagcactggaaaaccctcatgaaccgccaggaccaggagcttgagaagcgacgacagctcagggcacgccgaatgactacgtgccgcccttgttgcacttctgtgctgcgaagccacggcgagccagcacctagtacttgcccaccaccagcctcttgctcatgcaggtgttggagttcccatagttgttcctcaacatggtcatggtggcccagtacgaccggatggccttccggacccactgccccctag

SEQ ID NO: 40541 - DNA, 792 bp, Artificial Sequence
  Description of Artificial Sequence: Synthetic coding sequence
atgagcttcgccgtgttcctgatccacaccaagcggaagaagggcgtgcagtctagcggcgtcctattcggatactggctgctatgcttcgtgcttccagctacaaatgccgctcaacaagcctccggtgcagggtttcagtcggatccagtccgccacttgagtacatatctttgtcttagcctagtggtcgcccagtttgtgctctcgtgtcttgctgaccaacctcccttcttccccgaggatccgcagcagagcaacccttgtcctgagacaggggctgctttcccctctaaggcgacgttctggtgggtgtccgggctggtgtggaggggctatcgacgcccccttcgccctaaggatctttggtctctcggccgagaaaacagttccgaggagctggtcagcaggctggagaaagaatggatgcggaacaggtccgccgctcgaggacacaacaaggccattgctttcaaaagaaagggcgggagtggcatggaggctcctgagactgagccgttcttacgacaggaaggctcacagtggcggcccctgcttaaggcgatttggcaggttttccatagtacctttctgctgggcaccctcagcctggtcattagcgacgtgtttcgtttcactgtcccaaagctgcttagcctcttcttagagttcatcggggaccccaaaccgccagcatggaagggctacttgctcgctgtcctgatgttcctttctgcatgtctacagacactgtttgagcagcaaaatatgtacaggttaaaggtgctatag

SEQ ID NO: 40542 - DNA, 600 bp, Artificial Sequence
  Description of Artificial Sequence: Synthetic coding sequence
atgctgctgggccggctgaccagccagctgctgcgggccgtgccctgggcaggcggccgccccccctggccagttagcggcgttctgggatcccgcgtctgtggaccactctatagtacatctccagccggacccggaagggccgcgtcactccctcgcaagggagcccagttagagctggaagaaatgcttgtcccgaggaagatgtcagtttctcctctggaatcctggctgactgcacgctgcttcttacccagactggacactggtactgcaggaaccgtcgctcctccacagagctaccagtgccctcctagtcagatcggagaaggagccgagcaaggggacgagggtgtagccgacgcaccccagatccaatgcaagaatgtgctcaagatcaggaggcggaaaatgaatcatcacaagtatagaaagctcgtgaaaaagactaggttcctgaggcggaaagtgcaagaggggagactgagaaggaaacagattaaatttgagaaggacctcaggcgaatctggctgaaggccggcctaaaagaagctccagagggatggcagacacccaaaatttatctgcggggcaaatag

SEQ ID NO: 40543 - DNA, 600 bp, Artificial Sequence
  Description of Artificial Sequence: Synthetic coding sequence
atgctgctgggccggctgaccagccagctgctgcgggccgtgccctgggccggcggcagacctccctggcccgtgagcggggtcttgggttcccgggtgtgtggccccctctactctacgtccccagcggggcccggcagggcagcttctctgccccgcaaaggagctcagctggagctggaagaaatgcttgttcctcggaagatgagcgtcagccccttggagagctggcttactgctcgttgctttctccccaggctcgacacgggcaccgccggcacggtggccccgccacaatcctatcagtgtcccccgtctcagattggggaaggcgccgagcaaggcgacgagggcgtggccgatgcaccccagattcagtgtaaaaacgtgctcaagattagaaggcggaaaatgaaccatcacaaataccgtaagctagtgaagaagacacgctttttaagaagaaaagtgcaagagggacgcctgaggaggaaacagataaagttcgagaaggaccttaggaggatttggctcaaggccgggcttaaggaggcacccgaaggatggcagactccaaagatctaccttcggggtaagtag

SEQ ID NO: 40544 - DNA, 600 bp, Artificial Sequence
  Description of Artificial Sequence: Synthetic coding sequence
atgctgctgggccggctgaccagccagctgctgcgggccgtgccctgggccggcggcagacctccatggcctgtgtcaggtgtactgggaagtcgcgtgtgtgggcccctttatagcacaagtccagccggaccaggacgggccgcttctctcccccgtaagggcgctcagctggaactagaagaaatgctggttccccgcaaaatgtcagtgtcccctcttgagtcatggctgacagcacggtgttttttgccaagattggataccggaaccgccggtacggttgcacccccccagtcttaccaatgccccccctcccagattggcgaaggggctgagcagggtgatgagggagtcgccgacgccccccagattcagtgtaagaacgtgctgaagatacgccggagaaagatgaaccaccataagtaccgcaaacttgttaaaaagacacgattccttaggcgcaaggtgcaagaaggtcgcctgaggaggaagcaaatcaagttcgagaaggatcttcgacggatctggctgaaagccggactgaaagaggctccagaggggtggcagacgccaaagatctatctgcgtggtaagtag

SEQ ID NO: 40545 - DNA, 600 bp, Artificial Sequence
  Description of Artificial Sequence: Synthetic coding sequence
atgctgctgggccggctgaccagccagctgctgcgggccgtgccctgggcaggtggaaggcccccctggcctgtgtctggggtgctgggctcaagggtttgcggaccgttatacagcaccagcccggctgggccaggcagagctgcctccctcccacggaagggagcccagttagaactcgaagaaatgctggtccctcgaaaaatgtctgtttctcctctcgaaagctggctgaccgccagatgctttctgccacggttggacaccggaacagccggaacagttgctccacctcagagctatcagtgtcccccctctcagattggggaaggcgctgagcagggggacgagggagtcgcagacgcaccgcagatccagtgtaagaacgtccttaaaattagacgccggaagatgaatcaccataagtatcgcaaactcgtcaagaagacgaggttcctgcgacggaaggttcaggagggccggctcaggaggaagcagattaaatttgagaaggacctccgccgcatttggctgaaggcaggcctgaaggaggctccagagggatggcagacaccaaagatctatctcagaggcaaatag

SEQ ID NO: 40546 - DNA, 870 bp, Artificial Sequence
  Description of Artificial Sequence: Synthetic coding sequence
atgaagaccctgcccgccatgctgggcaccggcaagctgttctgggtattcttcctgattccttacctagatatttggaacattcacggcaaagaaagctgtgatgtgcaactgtatatcaagcgtcaaagcgagcactctattttggcaggcgacccctttgagctggaatgcccggtgaagtactgcgctaaccggcctcatgtgacctggtgtaagttgaacgggaccacttgcgtgaaactggaggacaggcaaacatcatggaaagaagagaagaacatctccttcttcatactccatttcgagcccgtgcttccaaacgacaatggtagctatcgctgctctgcgaatttccagtctaacctaattgagtcacacagcacgactctatatgtgaccgatgtcaaatccgcatctgaacggccttcaaaggacgagatggcatccaggccttggttattataccggctgttgccccttggcgggctgcccctgctgatcacaacctgtttctgcttgttctgctgcctgaggaggcatcagggaaagcagaacgagctgagtgacactgctggcagagagataaacctggttgatgcacacttgaaaagcgaacagacggaagcctctacccgccagaactctcaagtccttctgtccgagaccggcatttacgataatgacccagacctctgctttaggatgcaggaaggctctgaggtatacagcaacccctgcctcgaagaaaacaaacccggcatagtgtacgctagtctgaaccatagcgtgataggcccgaacagtcggcttgcaagaaacgtgaaggaggcccctacagaatacgcctccatttgtgtgcggtcatag

SEQ ID NO: 40547 - DNA, 726 bp, Artificial Sequence
  Description of Artificial Sequence: Synthetic coding sequence
atgaagaccctgcccgccatgctgggcaccggcaagctgttctgggtcttcttcctgatcccctatctggacatttggaatatccacggtaaagaatcttgcgacgtccagctgtacatcaagcgacaaagtgagcacagtatcctcgcaggggatcctttcgagctggagtgcccagtgaaatattgcgcgaatagacctcacgtcacctggtgcaaactgaacggcaccacttgcgtaaaattagaggaccgccaaaccagctggaaggaggagaagaacattagctttttcatcctgcacttcgagcctgttctgcccaatgacaacggctcgtacagatgttccgcaaattttcagtccaacctgatagaatcccattcgacgacactctacgtgacaggcaagcaaaacgagcttagcgatactgcaggccgggaaatcaacctcgtagatgctcacctgaagagtgagcaaaccgaagcaagtactagacagaatagtcaggttctgctgagcgagacgggtatctacgataacgacccggacctgtgttttcgaatgcaggaagggtctgaggtctattcaaatccatgtcttgaggagaacaaacctggaatagtatacgcgtctctgaaccacagcgtcattggacccaactctcgcctggccaggaacgtaaaggaggctccaacggagtacgctagtatttgcgtacggtcctag

SEQ ID NO: 40548 - DNA, 1365 bp, Artificial Sequence
  Description of Artificial Sequence: Synthetic coding sequence
atgacctggcgggccgccgccagcacctgcgccgccctgctgatcctgctgtgggctctgacaaccgagggggatctgaaggtggaaatgatggcgggcggcacccagatcacccctctgaatgataacgtaactattttctgcaacatattttatagccagcccctgaacatcacctcaatgggcatcacatggttctggaaatctcttacgttcgataaagaagtgaaggtttttgaattctttggtgaccaccaagaagcattcaggccaggcgctattgtgagtccatggcgcctgaagagtggagatgccagtttgcgcctccctggcattcagctcgaggaagctggcgaatatcggtgcgaggtcgttgtgaccccactgaaggcacagggaactgttcagctagaggtcgtcgcctctccggcatccaggctgctcctcgatcaagttggcatgaaggagaacgaggacaagtacatgtgcgaatcttctgggttttatcctgaggccataaatataacctgggagaagcaaacacagaaatttccgcacccgattgaaatcagcgaggacgtaatcacagggcctacaatcaaaaacatggatggtacatttaacgtgacaagttgtctcaaactaaatagctctcaggaagatcccggcacagtgtaccagtgcgtcgttcggcacgccagcctgcacactcccctgcgctctaattttactctgaccgctgctagacactcactttctgaaaccgagaagaccgacaactttagtatccactggtggccgatttcgtttatcggagttggtcttgtgctgctcattgttctcataccatggaagaaaatatgcaataagagttcatctgcttacactccactcaagtgcatccttaagcattggaacagcttcgatacccaaacactgaagaaagaacatctaatctttttctgtaccagagcttggcccagttaccagctccaggacggcgaggcctggcctcccgagggcagtgtaaacattaacacaatccagcagttagatgtcttttgtcgacaggagggtaagtggagcgaggtgccctatgtgcaggcctttttcgccctgagagataacccggatctttgccagtgctgcaggatcgatccagcactcttgaccgtgacttcaggaaagtccattgacgacaatagcactaagtccgagaagcagaccccacgagagcatagtgatgccgtgcctgatgctccaatcctgccagtctccccgatatgggaacccccccccgcaaccacctctaccactcctgtgctgagctcccagcctccaactctgctgctgccactgcaatag

SEQ ID NO: 40549 - DNA, 1365 bp, Artificial Sequence
  Description of Artificial Sequence: Synthetic coding sequence
atgacctggcgggccgccgccagcacctgcgccgccctgctgatccttctgtgggctctgaccaccgaaggtgacttaaaggtagaaatgatggccggaggtacgcagataacccccctgaatgacaacgtgaccatattctgcaacattttctatagccagccactaaatatcacctcaatggggatcacctggttctggaaatctctgacatttgataaggaggtgaaggtgtttgagttttttggcgaccatcaagaggccttcagacctggcgccatcgtctctccttggagactcaagagcggagatgccagcttgcgacttccaggtatccagttagaggaggctggcgaatacaggtgcgaagtggtggtgacaccacttaaggcacaagggacggtgcagcttgaagtggtcgcctctccagctagtcggctactgctggatcaagtgggtatgaaggagaacgaggataaatacatgtgtgaatcaagcggattctatccagaggcaattaacataacatgggaaaagcagacccagaaatttccccatcccatagaaatcagtgaagacgttatcactgggcccactattaagaatatggacggaacgttcaacgttaccagctgtttaaagctgaactcaagccaggaggaccccggtactgtctatcaatgcgtagtgagacacgcatctctacacacccctttgcgttccaactttactctgactgcagcacgccatagcctctcggaaactgaaaaaaccgacaatttcagcatccactggtggcctatcagtttcatcggcgtcggactggtgctgctcatcgtgcttattccttggaaaaagatttgtaataaatccagctccgcatacacaccactgaagtgcatacttaagcactggaattctttcgatacacagacgctcaagaaagaacacctaatattcttctgcactcgagcctggcccagctatcaacttcaggacggagaagcctggccgccagaggggtcagtgaatatcaacacaatccagcagctggacgttttctgtcgtcaggaggggaagtggagcgaagtgccatatgttcaagcattctttgcactgagagacaacccagatctttgtcagtgttgccgaatagaccctgcgctcctcaccgtcacaagcggcaaatcaatcgatgataacagcacgaaaagcgaaaaacagacccctcgcgaacattccgatgctgtaccggacgctcccattcttccagtttcacccatttgggaaccaccaccagccaccacctcaaccacaccagttttatcttctcagccacccaccctgttattgccacttcagtag

SEQ ID NO: 40550 - DNA, 660 bp, Artificial Sequence
  Description of Artificial Sequence: Synthetic coding sequence
atggcccccgagatggaccagttctaccggagcaccatggccatctacaaatcaattatggaacagttcaaccccgcacttgaaaacctggtgtacctaggcaacaactaccttagggcctttcacgccctcagtgaagccgccgaagtctactttagcgccatccagaagatcggggagagggctcttcagagccccacatcacagatcctgggggaaatcctggtgcaaatgtcagacacccagaggcacctgaactctgatttagaggtcgtggtgcagacttttcacggagggctgcttcaacatatggaaaagaatacgaagctggacatgcagttcattaaagactccaggcagcattatgagctcgagtatagacaccgggcggccaacctggagaagtgcatgtccgaactgtggaggatggagaggaagagagataaaaatgtgcgtgagatgaaggagtctgtcaatcggttgcacgcccagatgcaagcctttgtgtctgagagtcaaagagccgcggagctcgaggagaagcggcgatataggttcctcgcagagaaacacttgcttctgtctaacacctttttgcagttctttggacgcatgctagcggacggaagactggttgtctccactttgtggctgagctag

SEQ ID NO: 40551 - DNA, 1590 bp, Artificial Sequence
  Description of Artificial Sequence: Synthetic coding sequence
atggcccccgagatggaccagttctaccggagcaccatggccatctataagtcaatcatggagcaatttaacccagccctggagaacctggtgtatttaggcaataactatctccgggcgtttcacgccctgtccgaggctgcggaggtgtatttcagcgccattcagaagattggtgagagggccctgcagtcccccacttctcagatactcggcgagattctggtccagatgagcgatacacaaaggcatttgaattccgacctggaagtagttgtccagacatttcatggcggactcctgcagcacatggagaagaatacgaagctcgacatgcaattcatcaaggactcacgccagcactatgaactggagtacagacatcgggctgcaaacctggagaagtgtatgagtgagctttggcgcatggagagaaagcgcgacaaaaacgtccgggagatgaaagagagcgtcaatagactccatgcacaaatgcaggcctttgtgtccgaaagccagcgcgctgccgagctggaggagaaacgacgctaccgctttctagccgaaaagcatctcttgttgagcaacacattcctgcaattcttcggcagggcacgcgggatgctgcagaatagggttctgctctggaaagagcaaagcgaggcgtcccgttcaccctcacgtgcccattctccgggtctgcttggcccggctctcggcccaccttacccaagcggacggctcacacctacttgccttgacatgcctccgcggcctttaggagaattctcgagccctaggagccgccacggatccggctcctacgggactgagccagacgccagacctgctagccagctggaacccgaccgccgctccctgccccggactcctagtgcaagttccttatattctggaagcgcgcagtcatcacgttcaaattcctttggagaacgacccggcggtgggggcggggccagacgcgtgcgcgcactggtcagccattcagaaggtgctaatcatactctcttaaggttcagcgccggagacgtggtagaggttctggtgcctgaggcccagaatggctggctgtacggaaagcttgaggggtccagtgcctcaggatggtttccagaggcgtacgtgaaagcgctcgaggaggggccggttaatcctatgaccccagtaacacccatgacgagtatgacttctatgtcaccaatgacacccatgaacccaggtaacgaactgccctctaggtcatacccgctgagggggagccacagcctggacgacctactagaccgaccaggcaatagtatagcccctagcgagtactgggatggtcagagccggtctcgaaccccatctagagttcccagccgagccccatccccggcccctccgccattaccatcttcaaggaggagctcaatggggagcacagcagtggccaccgatgttaaaaaactgatgtcaagtgaacagtatccaccacaagaactattcccccgaggaaccaatcctttcgcgaccgtgaagttgagaccaaccattacaaacgatagatctgctcccctgatcagatag

SEQ ID NO: 40552 - DNA, 1548 bp, Artificial Sequence
  Description of Artificial Sequence: Synthetic coding sequence
atggcccccgagatggaccagttctaccggagcaccatggccatctacaaatccatcatggaacaatttaaccccgcgctggagaatcttgtgtacttaggcaacaattacctcagagcatttcacgcactatctgaagcagccgaggtatatttctccgccatccaaaagatcggtgaacgggcacttcaaagcccaacatcgcaaatcttaggcgagatcctggttcagatgtctgacacccaaagacacctaaacagcgatcttgaggtagtggtgcagacgttccatggcggcttgttgcagcatatggaaaaaaatactaagctggacatgcagttcataaaggatagtagacagcactatgagctcgagtacaggcaccgcgctgcaaacctggagaaatgcatgtcagaactgtggcgcatggagagaaagcgagacaagaacgtccgggagatgaaagaaagcgtaaataggctgcatgcccagatgcaggcttttgtgagtgaatcacaaagagcagctgagctggaagagaagcggagatatcgcttcctggccgaaaagcacctgctgctgagcaacacttttctgcaattctttggccgggctaggggcatgttgcagaatcgggtcctgctctggaaagagcagtctgaagcctctcggtccccatctagggctcatagcccaggactcctgggtcctgctctcggaccgccttacccaagcggacgactcactcccacatgtctggacatgccccctagacccctgggggagttctctagccccagaagccgtcatggtagtggatcgtatggtacggagcccgatgcacgaccagcaagccagctggagcccgaccgacggagcttgccaaggacccccagcgcctcttcactctactctggaagtgcccaatcttccagaagcaattcctttggcgaaagacctggtggcggcggcggagcacgaagggtgagggccctggtttctcacagtgagggagctaatcataccttgctacggtttagcgccggcgatgttgttgaagtccttgttcccgaggcgcagaacggatggctgtacggtaaattggagggcagttctgctagcggctggttcccagaggcgtatgttaaagctctggaagagggtcctgtaaatccgatgactcccgtgacacctatgaccagcatgacttccatgtcccccatgacccccatgaaccccggtaacgaacttccttcacgcagctaccctcttagagggtcccactcactggatgatttattggataggccaggcaacagtacaccttcacgggtaccctcccgggcccccagccctgcccctcccccattacccagcagtagacgttcttccatgggctcaactgccgtggccacagacgtaaagaagctcatgagtagcgagcagtacccccctcaggagttattccctcgcggcaccaacccgtttgctactgttaaactccggcctactattaccaacgacagaagtgcgccgctaatccgttag

SEQ ID NO: 40553 - DNA, 726 bp, Artificial Sequence
  Description of Artificial Sequence: Synthetic coding sequence
atgaccctgcagtgggccgccgtggccaccttcctgtacgccgagatcggtctcatactgattttctgcttgcctttcattcccccccagcgctggcagaaaatcttctcattcaatgtgtggggaaagatagccactttctggaacaaagcatttctgactattatcatcctcttgattgtgttgtttctagacgccgtgagggaagtgagaaagtactcttcagttcacactattgaaaaatcttccacctcccggccggatgcctacgaacatacacagatgaagttgtttcgttcgcaaagaaatctctacatcagtggattctcactgtttttctggctggtgcttcgcaggctggtgacactgatcactcagttagctaaagagctgagcaataagggggtcctcaagactcaggcagaaaataccaataaggcagccaaaaaatttatggaggaaaacgaaaagttaaaaagaattctgaagagccatgggaaggacgaggagtgcgtgctggaggccgagaacaagaaactggtcgaagaccaagagaagctgaagacggagctgagaaagactagcgacgccctgtctaaagcacagaacgacgtgatggagatgaaaatgcaatcggagcgcctgtccaaagagtacgaccagctgctgaaggaacacagcgagctgcaagaccggctggagcgcggcaacaaaaaaaggctctag

SEQ ID NO: 40554 - DNA, 726 bp, Artificial Sequence
  Description of Artificial Sequence: Synthetic coding sequence
atgaccctgcagtgggccgccgtggccaccttcctgtacgccgagataggcctgattttgattttttgcctgccattcatccccccccagaggtggcagaagatcttttcgttcaatgtatgggggaagatagctacattttggaataaagccttccttaccattataatccttttgattgtgctgttcctcgacgctgttcgcgaggttcgcaagtactcgtcggtgcataccatcgaaaagagctctacctcccgacccgatgcatacgaacacactcagatgaagctgttcagaagccaaaggaacctgtatatctcaggtttcagtctgtttttttggctcgtgcttcggaggcttgtgacactaattactcagctcgccaaggaactgagcaacaaaggagtgttaaaaacccaagcggagaataccaataaggcagccaagaagtttatggaggagaacgagaagctcaaacgaatcctgaaatcccatggcaaggatgaagagtgtgtgttagaggcggagaataaaaaattagtcgaagaccaagagaagctaaagacagagcttcgaaaaacgtcagacgccctctccaaggctcaaaacgatgtaatggagatgaaaatgcagagcgaacgcctctcgaaggaatacgaccaattgctgaaggagcacagtgagttacaggacagactcgagcgagggaacaagaagaggttatag

SEQ ID NO: 40555 - DNA, 1047 bp, Artificial Sequence
  Description of Artificial Sequence: Synthetic coding sequence
atgaccctgcagtgggccgccgtggccaccttcctgtacgccgagattgggctcatcctgatattctgtctgccctttatccctccacagcggtggcagaagattttttcttttaacgtctggggtaagatcgcgacattctggaataaggctttcctcacaatcatcattttgctgatagtccttttccttgacgccgtgcgtgaggtgcgcaagtactcttctgtccataccattgagaaaagttccacgtcccggccagacgcatacgaacacacccagatgaaactcttccgctcacagcggaatctttatatttccgggttctctctgtttttttggttggtgttaaggagacttgtaaccctcataacgcagttggctaaggaactgtccaataagggggtcttgaaaacccaggccgaaaacacaaataaggctgccaaaaaattcatggaagagaatgaaaaattaaaacgaattctgaaaagccatggtaaggacgaagaatgcgtgttggaggcagaaaacaagaaacttgtcgaggaccaggaaaagctcaaaactgaattgaggaaaacaagcgatgcgctgtccaaggcccagaatgacgtgatggagatgaagatgcagtccgagcggctgagcaaagagtatgatcaactgctgaaggaacactcggagctgcaacatagtagcttcggggaatttctgtccaaaaggagccataagaatggcagtataggcaaacagaccggctccagaaagggctcattcaggaagcggcaacaggaaaagaccgtgaattttataaaggatacttgcaatatcctttgccagaatgacaactttgtgatgttggcctctcggaaatttaaatttaggaagatgcactacgacaggttcgtgatttttctgatgccacacatcggctgcatcgtcatggctctcagcaaatatctgatgatgttccagatctattgcaaggtgtgcatcccagcacttaaaaagaacatttccatgctaaatactatttttacttattag

SEQ ID NO: 40556 - DNA, 468 bp, Artificial Sequence
  Description of Artificial Sequence: Synthetic coding sequence
atgaagctgttccggagccagcggaacctgtacatcagcggcttctctcttttcttttggctggtcctccggcgactggtgacactgatcacccagcttgcaaaggagttatctaataagggggtgcttaagacacaggctgagaacacaaataaggccgcaaagaaattcatggaagagaacgaaaagctgaaaagaattctgaaaagccacggaaaagacgaagagtgcgttctagaagctgagaacaaaaagctcgtggaggaccaggagaagctaaagacagagttgagaaaaacctccgacgccctgagtaaggcccaaaacgatgtgatggaaatgaaaatgcagtctgaacggctgtctaaagaatacgatcagctcctgaaagaacactctgagctgcagaaaagccactcacagcctggggctgcagctttccttgttaaggaggtagagagcttctag

SEQ ID NO: 40557 - DNA, 402 bp, Artificial Sequence
  Description of Artificial Sequence: Synthetic coding sequence
atgaccctgcagtgggccgccgtggccaccttcctgtacgccgagatagggctaattctcatcttctgcctgccttttatcccaccccagaggtggcagaaaattttctcatttaacgtgtggggaaaaatcgcaacattctggaacaaagcatttctcacgatcattatcctcttaattgtgctgttcctagatgcagtacgggaagtccggaaatactcctcagttcatacaattgaaaaaagctctacttcaaggcccgatgcgtatgagcacacccagatgaagttgttcagatcacagcgcaacctgtacatttccggattttctctgttcttctggctggtgctgaggcgattggtgacccttatcacccagctggccaaagagctctctaactag

SEQ ID NO: 40558 - DNA, 492 bp, Artificial Sequence
  Description of Artificial Sequence: Synthetic coding sequence
tgagacgcctacgagcacacccagatgaagctgttccggagccagagaaacctctatatcagcggatttagcctcttcttttggctggtcttgagacggttggtgacgctgataacacagctggcaaaggaactcagcaataaaggggttctcaagactcaggccgaaaatacaaacaaggctgcaaagaagttcatggaggagaacgagaagctcaagcgcattctgaagagccacggcaaggacgaggaatgcgttctggaagccgaaaataagaaactcgttgaggaccaggagaagctcaaaacggagttacgtaaaacctcagatgctctgagcaaggcccagaacgatgtgatggagatgaaaatgcagagcgagaggttgtctaaagaatatgatcaactgctgaaggagcatagcgaactccagaagagccacagccagcccggggccgcagcctttctggtgaaggaagttgaatcgttctag

SEQ ID NO: 40559 - DNA, 1047 bp, Artificial Sequence
  Description of Artificial Sequence: Synthetic coding sequence
atgaccctgcagtgggccgccgtggccaccttcctgtacgccgagattgggctgatcttaattttctgtctccctttcatcccgcctcagcgttggcagaagatctttagttttaatgtgtggggcaagatcgctactttctggaataaagcctttctgaccataatcatcctcttgatcgtgctcttcctggacgccgtgcgggaagtccgaaagtattcttcagttcacactatcgagaaatcttccacaagcaggcccgatgcatatgaacacacccaaatgaagctttttagaagtcaacgaaacttgtatatctctggattttcacttttcttttggctggtcctccgacgcctcgtaacactcatcacccaattagcgaaagagctttcgaataaaggtgtgttgaagacacaggccgagaataccaacaaggccgctaagaagtttatggaagaaaacgagaagctgaaacgcattttaaagtcacacggtaaagacgaagaatgtgtcctggaggccgaaaacaaaaagcttgtggaagaccaggaaaagctaaaaaccgagctcaggaagaccagcgatgctctcagtaaggctcagaacgacgtcatggagatgaagatgcagtctgaacgcttgtccaaagagtacgaccagcttctgaaagagcactctgaactccagcacagctctttcggtgagttcctctctaaacgatctcacaaaaacggtagcattgggaaacagaccggaagcaggaaaggctccttccggaaaaggcagcaggagaaaaccgtcaactttatcaaggatacctgcaatatcctgtgccagaacgacaattttgtaatgctggcctcccgaaagttcaaatttcgcaaaatgcattatgaccggttcgtgatctttctcatgccccatatcggttgcattgtgatggcattgagcaaatacttaatgatgttccagatctattgcaaggtgtgcataccagctcttaagaaaaatatttccatgctgaacacaattttcacatactag

SEQ ID NO: 40560 - DNA, 693 bp, Artificial Sequence
  Description of Artificial Sequence: Synthetic coding sequence
atgaccctgcagtgggccgccgtggccaccttcctgtacgccgagatcggcctgattttgatcttctgtcttccatttattcctccacagcgttggcagaagattttctcatttaacgtgtggggcaagatcgccactttctggaacaaggcgtttttaaccatcatcatactgctgattgttctctttctcgatgcagttagggaagtgcgtaagtactcgtctgtgcacaccatcgaaaagtccagcaccagtcgccctgatgcttacgagcacacccagatgaagttgtttaggtctcaacgcaatctctatattagtggatttagcctcttcttctggttggtgctccggagattggtaaccttaattactcagttagccaaagagttatcaaacaagggtgtcctcaagacccaggcagaaaataccaacaaagctgccaagaaatttatggaagagaacgaaaagctcaaacgtatcctgaagagtcacggcaaggacgaggagtgtgtgctcgaggccgagaataaaaaattggttgaggaccaggagaaactgaagaccgaactgagaaagacgtctgatgcactcagcaaggctcaaaatgatgtgatggagatgaagatgcagtccgagaggctgagcaaggagtatgatcagctgctcaaggaacattcagaactgcaatag

SEQ ID NO: 40561 - DNA, 444 bp, Artificial Sequence
  Description of Artificial Sequence: Synthetic coding sequence
atgaagctgttccggagccagcggaacctgtacatcagcggcttctcactgtttttctggctggtgctcaggcgactcgttacacttattactcagctggccaaagaactcagcaataaaggggtgttgaagacacaggcagaaaacactaacaaggctgcgaaaaaatttatggaggagaatgagaagctgaaaagaattttgaaaagccacgggaaggacgaggaatgtgtcttagaggctgagaacaagaagctggtagaggatcaggagaaactgaagacagagctccgcaagaccagcgatgccttatcaaaagcgcagaatgatgtgatggagatgaagatgcagtcagaacgactatctaaggagtatgatcagctgctcaaggagcactcggagttgcaggacagactggagcgtggcaataaaaagagactttag

SEQ ID NO: 40562 - DNA, 195 bp, Artificial Sequence
  Description of Artificial Sequence: Synthetic coding sequence
atgaccctgcagtgggccgccgtggccaccttcctgtacgccgagatcggactaattctcattttttgcctgccttttataccaccccagcgttggcaaaagatcttttctttcaacgtgtggggaaagatcgcgactttctggaataaggcttttctcacaattatcatattgctcattgtgctcttcctctag

SEQ ID NO: 40563 - DNA, 591 bp, Artificial Sequence
  Description of Artificial Sequence: Synthetic coding sequence
atgaccctgcagtgggccgccgtggccaccttcctgtacgccgagatagggctcattctaattttctgcctgcctttcatcccaccacagagatggcagaaaattttttctttcaacgtgtggggcaagatagccaccttttggaataaggcatttttgacaatcatcatcctcctgatagtcctgtttctggatgctgtcagggaagtccggaagtactcatccgtgcacaccatagagaagtcctctacatctaggcccgacgcctacgaacatacgcagatgaagctgttccggtcgcaaagaaatttgtatatcagcggattttcattgtttttttggctggtgctgcgtcgacttgtaaccctgataactcagctggcaaaggagcttagcaataagggcgtgctgaagactcaagcagagaacacgaataaagcagctaagaagttcatggaggagaatgagaaactcaaaaggatactcaagagtcacggaaaagatgaggagtgcgtgctcgaggccgagaacaaaaagctggtggaggaccaggagaaattgaagaccgaattgcgcaagacaagcgattag

SEQ ID NO: 40564 - DNA, 741 bp, Artificial Sequence
  Description of Artificial Sequence: Synthetic coding sequence
atgagcctgcagtggaccgccgtggccaccttcctgtacgccgaggtgttcgtggtcctgctcctctgcatcccctttatctcgcctaaacgctggcagaaaatatttaaaagtaggctggtggaactgctggtgagctacggtaacacattcttcgtggtcctgatcgtcatattggtgctcctggtgatcgatgccgtcagagaaattaggaagtacgatgatgtcacagaaaaggtcaacctccagaacaatcccggggctatggagcattttcacatgaagctatttcgggcccaaagaaatctttacatcgcagggttttccctgctgttgagcttccttctgcgtaggctcgtcaccttgatttcacagcaggcaaccctgctggcttctaatgaagcattcaaaaaacaggctgagtctgcgtctgaagctgccaagaagtatatggaggagaacgatcaactgaaaaagggggccgccgtggacggcgggaagttagacgtcggaaacgccgaagtgaaactcgaggaggaaaacagatcgctgaaagcagatcttcaaaaactcaaggacgagcttgcatcaaccaaacaaaaactggaaaaagctgagaaccaagtccttgccatgagaaaacaatccgaggggctgaccaaggaatacgatcgcctactggaggaacatgccaaacttcaggctgccgtagacggcccaatggataagaaggaggagtag

SEQ ID NO: 40565 - DNA, 549 bp, Artificial Sequence
  Description of Artificial Sequence: Synthetic coding sequence
atgagcctgcagtggaccgccgtggccaccttcctgtacgccgaggtgttcgtggtcctgctattgtgtatacctttcatctccccgaagcgatggcagaaaatcttcaaatcccggctagtagagctgctggtgtcttacggaaacactttcttcgtcgtacttatcgtgatccttgttctgctcgtcattgacgctgttcgggagattcgcaagtatgacgacgtgaccgagaaggtgaatctccagaacaatcccggggcaatggaacattttcatatgaagctgtttagggcacagaggaacctatatattgctggcttcagcctgttgcttagttttctgctacgccggctggttacattaatctcacaacaggctacgctgttggcctccaatgaagcctttaagaagcaggccgaatccgccagcgaggctgccaaaaaatacatggaagaaaatgatcaactgaagaaaggagctgctgtggatggcggaaaactagatgtgggcaacgctgaagtgaagttggaggaagagaatcgatag

SEQ ID NO: 40566 - DNA, 537 bp, Artificial Sequence
  Description of Artificial Sequence: Synthetic coding sequence
atgagcctgcagtggaccgccgtggccaccttcctgtacgccgaggtctttgtcgtgcttctgctctgcattccatttatttcgccaaagaggtggcagaagatattcaaaagccgcttggtggagcttctcgtgtcttacggcaacacatttttcgttgtattaatcgtcatcctcgtgttgctggttattgacgctgtgagggaaatccgcaagtacgatgatgtgaccgagaaggtaaacctgcagaacaaccccggcgctatggagcacttccacatgaaactgttccgagcccagcgcaacttgtacattgcagggttttcactgttactgtcatttctgctgagacgcctcgtcacacttatctctcaacaggccacactgctggcatcaaatgaggcttttaagaagcaggctgagtcggcttccgaggccgcgaaaaaatatatggaggagaatgaccaactcaagaagggagccgctgtggatggtggaaagctggacgtgggaaatgccgaggtgaaactcgaatag

SEQ ID NO: 40567 - DNA, 942 bp, Artificial Sequence
  Description of Artificial Sequence: Synthetic coding sequence
atgggcgccgaggccagcagcagctggtgccccggcaccgccctgccagaggagaggttgtcagtgaaacgcgccagtgaaatctcgggctttttaggccaggggtcgtccggggaagccgcactggacgtacttacccacgtccttgagggagccggcaacaagctgaccagcagttgtggtaaaccttcaagcaaccgcatgagcctccagtggacagccgtggccacctttctatacgcggaggtgttcgtggttttactgctgtgcatcccctttatttcacctaaacgctggcaaaaaattttcaagtctcggctcgtggaactactcgtgagttacggtaatactttttttgtggtattgatcgtaattctagtccttctagtgatcgacgcggtgcgtgagattcgtaagtacgacgatgtcaccgagaaagtgaatctgcagaataatccaggtgccatggagcacttccacatgaaactgttccgggcccaaagaaatctgtatatagccgggttcagtctcctgctgtcttttctgcttagaaggttggttacactcatctctcaacaggccacgttgctcgcatctaatgaagctttcaagaagcaggccgaatcggcgtcggaggcggctaagaagtacatggaagagaatgaccagctgaagaaaggcgctgccgtcgacggtggaaagctggacgtgggcaacgctgaagtgaagctcgaagaagaaaatcgcagtcttaaagccgatctgcaaaagctgaaggatgagcttgcctcaacgaagcagaagttggagaaagccgagaatcaggtgttggcgatgcgtaagcagagtgagggcctcaccaaggaatacgaccggctgctggaagagcacgccaaattgcaggcggccgtggatggccccatggacaaaaaggaggaatag

SEQ ID NO: 40568 - DNA, 564 bp, Artificial Sequence
  Description of Artificial Sequence: Synthetic coding sequence
atgagcctgcagtggaccgccgtggccaccttcctgtacgccgaggtcttcgtggtgctgctgttatgtatcccttttattagcccaaaacggtggcaaaaaatattcaagtctcgactggtggagttactcgtgtcatatgggaatacattcttcgttgtcctgatcgtaattctagttctccttgttatagatgctgtgcgggaaatcaggaagtatgacgatgtaaccgaaaaggttaatctgcaaaataatcccggcgcaatggagcacttccacatgaagctgttcagagctcagagaaatctgtacattgctggcttttcattgttgctctccttcttgctccgcagattagttaccctgatcagccagcaagccacactgctggctagtaatgaagctttcaaaaaacaagccgaatctgcgtcggaggctgcaaagaagtatatggaggagaacgatcaactcaaaaaaggggcggccgtggacggaggcaaactagacgtgggaaacgccgaggtcaagctggaggaggagaaccgctcactgaaagcagattag

SEQ ID NO: 40569 - DNA, 417 bp, Artificial Sequence
  Description of Artificial Sequence: Synthetic coding sequence
atgagcctgcagtggaccgccgtggccaccttcctgtacgccgaggtgttcgtcgtgctgttgctttgcatcccattcatcagccccaagagatggcaaaagatctttaaatcccgtctcgtagaattgctggtttcttatgggaacacattcttcgtagtcctaatcgtaattctggtgctcctggttatcgatgctgtcagggagattcggaaatacgatgacgtgaccgagaaggtgaatcttcagaataacccaggcgccatggagcatttccatatgaagctcttccgcgctcaacgaaatctgtatatagctggattttctcttttactgagcttcctgctgcggcggctggtgaccctcattagtcaacaggcaacactcctagcaagtaacgaagcctttaagaaatag

SEQ ID NO: 40570 - DNA, 741 bp, Artificial Sequence
  Description of Artificial Sequence: Synthetic coding sequence
atgagcctgcagtggaccgccgtggccaccttcctgtacgccgaggtgttcgtagttttgctgctgtgcatccccttcattagtccaaagcggtggcagaaaatctttaagtcacgcttagtggagctccttgtgtcttatggtaacacttttttcgtggtacttatcgtcatcctcgtcctccttgtgattgatgctgtacgcgaaattagaaagtatgacgacgtaacggagaaggtcaaccttcaaaacaacccaggagccatggagcactttcacatgaaattgtttcgagcccaacggaatctttacatcgccgggttcagcctcctgctgtcattcttgctccggcgtctcgtgacactcatcagtcagcaggccactctccttgctagcaacgaagcatttaaaaagcaagcagaaagcgcgtcagaagccgcaaaaaaatatatggaagaaaatgaccaactcaaaaagggcgctgccgttgacggcggaaaactcgacgtgggaaatgccgaggtgaaactggaagaggagaataggagccttaaagccgatttgcagaagctcaaagatgagctggcttccaccaaacagaaactggagaaagccgaaaaccaggtcttggccatgcgcaaacaaagtgaggggcttacaaaagaatatgataggttactggaggaacatgccaagctccaggcagctgttgacggcccaatggacaaaaaagaagaatag

SEQ ID NO: 40571 - DNA, 567 bp, Artificial Sequence
  Description of Artificial Sequence: Synthetic coding sequence
atgagcctgcagtggaccgccgtggccaccttcctgtacgccgaggtctttgtagtgctgctgttgtgtatcccttttatctctccaaaacgctggcagaaaatctttaaatctcgcctggtggaactacttgtatcttacggaaatacattttttgtggtcctgatcgtgattcttgtgcttctcgtcatcgacgcagtgcgcgagattcggaaatacgacgacgtcaccgaaaaggtgaatttgcagaataacccaggagcaatggagcacttccacatgaaactgtttcgggcacagaggaacttgtacattgctgggttcagcctgctcctgagctttctcctacgccgccttgttactttgatcagtcagcaggctaccctacttgcctcaaatgaagcattcaagaaacaggccgaaagcgccagcgaggctgccaagaagtatatggaagaaaacgaccagcttaaaaaaggggcagctgttgatggcggtaaactcgatgtgggaaacgccgaggtgaagttggaggaagagaaccggtcgctgaaagccgatctctag

SEQ ID NO: 40572 - DNA, 942 bp, Artificial Sequence
  Description of Artificial Sequence: Synthetic coding sequence
atgggcgccgaggccagcagcagctggtgccccggcaccgccctgcctgaagagcgattatcggtgaaacgggctagtgagatcagcggctttttgggacagggaagcagcggcgaagccgcattggacgtcctgacccacgtgctggagggagccggcaacaagcttacttcttcatgcggaaaaccaagttcaaatcgcatgtccctgcagtggacagcagttgccacttttctgtacgccgaggtgttcgtggttttactgctttgcatccctttcatcagccccaagagatggcagaaaatctttaaaagtcggctggtcgagcttctggtgtcatacggcaacaccttcttcgtcgtcctcattgtaattcttgttcttctggtgatcgatgctgtgagggaaatacggaagtacgatgacgtgactgagaaggtcaacctgcagaacaatcctggcgctatggaacacttccatatgaaactgttccgggctcaaaggaacctgtacattgcgggtttttctctgctgctgtcatttctgctgcgcagactcgtcacccttatttcgcagcaggcgactttgctggcgagcaatgaagcattcaaaaaacaggctgagagcgccagcgaggctgccaaaaagtacatggaggagaacgaccagttaaaaaagggcgccgcggtagacggtgggaagcttgacgtcggtaatgccgaggttaagctggaagaggagaatcgaagcctgaaagctgatctccagaagctgaaggatgaacttgcttccactaagcagaaacttgagaaggccgagaatcaagtcctggctatgcgcaaacagagtgagggtctgacaaaagaatatgatagattgctcgaagagcatgccaagctgcaggcagctgtcgacgggccaatggataagaaggaagagtag

SEQ ID NO: 40573 - DNA, 798 bp, Artificial Sequence
  Description of Artificial Sequence: Synthetic coding sequence
atgtacgtgggctacgtgctggacaaggacagccccgtgtaccccggccctgctcgacccgcttcactcggcctgggacctcaggcatacgggcctcccgcacccccacctgctcctccacagtatcctgatttctcttcatattcccacgtggagcctgctcccgcccctcctaccgcgtggggagcacccttcccagcgccaaaggacgactgggccgctgcctacggcccaggcccagccgcccccgcagccagccctgcttcactcgccttcgggccccctcccgatttctcccccgttcccgctcctccaggtcctggacccggactgctggcacagccactcggcggtcccggcacacctagcagtcccggcgctcagcggcccacgccgtacgagtggatgcgccggtcagtagctgctggagggggcggcggctctgggaagacccgaacaaaagacaagtatagagtggtatacactgatcaccagaggctcgagcttgagaaggaattccattacagtcgatatatcacaatccggcgcaagagcgaactggccgccaatctcggactgaccgagaggcaggtgaaaatttggttccagaaccgacgtgcaaaagagcgcaaggtgaacaaaaaaaagcaacaacagcagcagcccccgcagccaccaatggctcacgacatcactgctacgcctgccggcccaagtctgggcggcctgtgcccaagtaacacttctctgctggcgacttcatcaccaatgcctgtcaaggaagaatttctcccctag

SEQ ID NO: 40574 - DNA, 687 bp, Artificial Sequence
  Description of Artificial Sequence: Synthetic coding sequence
atggccgccccccaggacgtgcacgtgcggatctgcaaccaggagatagtgaagttcgacctcgaagtgaaagctcttattcaggatattagggattgttctggacccctctcggccctcacagagctgaataccaaggttaaagaaaagtttcagcagttgaggcataggatacaggaccttgagcagctggcaaaggaacaggacaaagaatcagaaaagcagttactgctgcaggaggtagaaaaccataagaagcagatgctttctaaccaggcttcgtggagaaaggctaacctgacttgtaaaattgccatcgataaccttgaaaaagcagagctgcttcagggtggcgatctgctgaggcagaggaaaaccaccaaagaatcgctggcccagacttcaagcactatcacagagtctttgatgggcatctccaggatgatggcccagcaagttcagcagtccgaggaggccatgcaatcccttgtgaccagttcccggacgattcttgatgcaaacgaagaatttaaatctatgtctggcaccatccagttggggagaaagctcatcacgaagtacaaccggagggaattaactgataaactgctgatttttctggcactggccctcttcctagccactgtgctgtatatcgttaagaaaaggctatttccatttctttag

SEQ ID NO: 40575 - DNA, 714 bp, Artificial Sequence
  Description of Artificial Sequence: Synthetic coding sequence
atggccgccccccaggacgtgcacgtgcggatctgcaaccaggagatcgttaaatttgacctcgaagtaaaggccttgatccaggatatccgcgactgctcgggccccctgtccgcgctgaccgagttgaacacgaaggtgaaggaaaagttccagcagctgaggcaccggattcagcctgttctgtatcaacgcgccttcatctggacggcaagcaccttcttcttcaaactgacttactctttaactgatttttcatctacccagcatgactttaattcaccaactacacctgtgaccttcagcgatctcgagcagttggccaaagaacaagacaaggagtcggaaaagcagctcctgctacaagaagtcgagaaccacaagaagcaaatgctgcggaagaccacgaaagaatcactcgcccagactagttccacaattactgaatctcttatgggcatcagcaggatgatggcccagcaggtccagcagtctgaagaagccatgcagagcctggtcacatctagtagaaccattttggacgccaacgaggagtttaagtccatgtcagggaccatacagctgggcaggaagctgattacgaaatacaatcgtcgggagttaacagataaacttcttatctttctcgctttggccctctttctagctacagtactgtatatcgtgaagaagaggctgtttccctttctctag

SEQ ID NO: 40576 - DNA, 585 bp, Artificial Sequence
  Description of Artificial Sequence: Synthetic coding sequence
atggccgccccccaggacgtgcacgtgcggatctgcaaccaggagattgtaaaattcgacctggaagttaaggcactgatccaggatattagagactgcagtggaccactgtctgccttgacggagcttaatacgaaggtcaaagagaaattccagcagctgcggcatcgcattcaggacctagagcagctcgcaaaagagcaggataaggaaagtgagaagcaactgctgttacaagaagtggagaaccataagaagcagatgctgcggaaaaccaccaaggagtcgctcgcacagacctcctcaaccattacagagagcctgatggggatttctagaatgatggcacagcaggtgcagcaatctgaggaggccatgcagagcctcgtaacaagttctaggaccatcctcgacgccaacgaggaatttaaaagtatgtctgggactatccagctgggacggaagttgatcactaaatataatcggagggagttaacggataaactcctgatctttctggcattggctttattccttgctacagtgttatacatagtgaaaaagcggctgtttccttttctatag

SEQ ID NO: 40577 - DNA, 1458 bp, Artificial Sequence
  Description of Artificial Sequence: Synthetic coding sequence
atggccagcagcagcaccgtgcccctgggcttccactacgagaccaaatacgtcgtcctgagttatttgggcttgttgtcacaggagaaactgcaggagcaacacctcagctcacctcagggtgtgcagctggatatcgccagccagtccctcgaccaagaaatcttgttgaaggttaaaaccgagatcgaggaggagctaaaatctcttgataaggagatctctgaagcttttacatctactggcttcgatcgacacacgtcccccgtcttcagccctgcaaatccagaatcaagtatggaagactgcctggctcacctgggcgaaaaggtgtcccaggagctgaaggagccattgcataaagctctccaaatgctgttgagtcagccggtcacctaccaagctttcagagaatgcacactggagacaacagtacacgccagcggttggaacaaaattctggtacccctggtgctgctgcgccagatgttgcttgagctcacaagaagggggcaagagccacttagcgcccttctgcagtttggagtcacctatctcgaggactactccgccgagtatataatacaacaaggtgggtggggtacagtttttagcctcgaaagtgaggaggaggagtaccccggaattaccgctgaagactccaacgatatctatattctccccagcgataactcaggccaagtttccccgcctgagagtccaactgtgactacatcttggcagtctgagtccctgcccgtgtctctgtccgcatcccagagctggcacaccgaatctctgccggtctctctggggccagagtcttggcagcaaatcgccatggaccccgaggaggtgaagtctctcgactccaacggggccggtgaaaaatcagaaaacaactcctctaacagtgacatcgttcacgtagagaaagaggaggtgcctgagggcatggaggaggctgccgttgcttcggtggtgcttcctgcacgcgaactgcaggaagccctgccggaggctcctgcccctctcctgccacacattaccgcaactagcttgttgggtacccgagaacctgacaccgaggtgattactgtggagaagtcatcaccagctacaagtctgttcgtggagctggacgaggaggaggtaaaagccgcaactactgagcctactgaggtagaggaagttgtccccgccctggagcccaccgaaacccttctgtccgagaaggagattaacgctcgcgaagaatctctggttgaggaactatctcctgcttcggagaagaagcccgtgccaccatctgaggggaagagccgtttgtcccccgcgggtgagatgaaaccaatgcctctctccgaggggaaatccatccttttgtttggtggggccgccgcagtggctatcctggcagttgccataggtgtcgcactcgcattaagaaaaaaatag

SEQ ID NO: 40578 - DNA, 972 bp, Artificial Sequence
  Description of Artificial Sequence: Synthetic coding sequence
atgctgctggagctgacccggcggggccaggagcccctgagcgccttactgcaattcggagttacgtatctcgaggactactctgcagaatacatcattcagcaagggggatggggaaccgtgttctccttggaatctgaagaagaagaatacccgggaatcactgccgaagatagcaacgacatttatatattgccctccgataacagcgggcaagtctcccccccagaatctcctaccgtgaccacatcctggcaaagcgaaagccttccagtctccctgtcagcctcccagtcttggcatactgagagtcttcccgtcagcctagggcccgagagctggcagcagattgctatggaccccgaggaggttaagtccttggacagcaacggtgccggtgaaaagtcagagaacaatagttccaacagtgatatagtgcacgtggaaaaggaggaagtgcccgaaggcatggaagaggctgccgttgcctcagtcgtgctgcccgcccgcgaacttcaagaagctttaccagaagcccccgccccgctcctgcctcacattacagccacatcattgctgggcacccgtgagcccgacacggaagtgatcaccgtggaaaagtccagccccgctacctcactttttgtggagctagacgaggaagaggttaaagctgctaccacagagccaaccgaggtcgaggaggtggtgccagcactggagccaaccgagactctgctatccgagaaagaaattaacgcacgcgaagaaagcctggttgaggaactctcccccgcttcggagaagaaaccagtccctcccagtgaggggaagtcacgtctttctccggccggggaaatgaagcccatgcccctcagtgaggggaagtcaattctgctgtttggtggagccgcagcagtggctattctagccgtggcgataggagtagctctggctttgagaaagaagtag

SEQ ID NO: 40579 - DNA, 606 bp, Artificial Sequence
  Description of Artificial Sequence: Synthetic coding sequence
atggccagcagcagcaccgtgcccctgggcttccactacgagaccaagtacgtcgtcttgtcttaccttgggctgctgtcacaagaaaagttacaggagcagcatctgtcatctcctcaaggggtgcagctggatatcgcctctcagagcctggaccaggaaatcttgttgaaagtgaaaactgagatcgaagaagagctcaaatcactcgacaaagagattagcgaggctttcacttctaccgggtttgatagacacacatccccagttttcagcccagcaaatcccgagagcagtatggaggattgccttgcccaccttggtgagaaagtaagtcaagagctgaaggagccgctgcacaaagccctgcaaatgttgttgagccagcccgtcacctaccaagcattcagggaatgtactctggaaacaaccgtccatgcttctgggtggaacaaaatcctggtgccgctggtcctgctgcggcaaatgctcctggaactgacaaggagaggccaggagccactatcggctctgctccaattcggggttacctacttggaggattacagtgccgaatatatcatccaacaggggggttgggtttag

SEQ ID NO: 40580 - DNA, 315 bp, Artificial Sequence
  Description of Artificial Sequence: Synthetic coding sequence
atggccagcagcagcaccgtgcccctgggcttccactacgagaccaaatacgtggtgttgtcatatctcggtctactttcccaggaaaaactccaggagcagcaccttagtagccctcagggcgtgcagctggatatagctagccagtctctagaccaagagattttactgaaggttaagacggaaattgaagaggagcttaaaagtttggataaggaaatttctgaaggatggagcgccgtagcccctagcagacctactactacttcaataagccaggtacagatgatcctccttagccagccccctgagtag

SEQ ID NO: 40581 - DNA, 606 bp, Artificial Sequence
  Description of Artificial Sequence: Synthetic coding sequence
atggccagcagcagcaccgtgcccctgggcttccactacgagaccaagtacgtggtgctcagttaccttgggctgctctcgcaggagaaactgcaagaacaacatctctcgagtccgcaaggggtgcagttagatatcgcctctcaaagcttggaccaagaaatcttgctgaaagttaaaaccgaaatcgaagaggagcttaagagtctagataaggagatttcagaggcatttacgtcaactggcttcgatcgccacacctccccagtgttctctcccgctaatcccgagtcctctatggaggactgcttggcccacctgggtgaaaaggtgagtcaggagctgaaggaacccctccataaagctctccagatgctcctctcgcaaccagtgacttatcaggcattcagagaatgtactctggagaccaccgttcatgcaagtggatggaataagatcctggtgccgctggtgcttctgcgtcaaatgcttctcgaacttacaaggcggggccaggaacctctctctgccttgctccagtttggggtcacttacttggaggactactccgccgagtatatcatacagcaagggggctgggtttag

SEQ ID NO: 40582 - DNA, 1086 bp, Artificial Sequence
  Description of Artificial Sequence: Synthetic coding sequence
atgaagcagagcatgctgttcagcgccacctgggacagcagcctgaagcggtcttgtaagtcaaatattttcccccacccgaagatactcgttcccctggttctgctgcggcaaatgcttctggagttgacccgtcggggacaggagcccctatctgccctgttacaattcggagttacataccttgaggactacagtgccgaatatatcatccaacagggtggttggggaacagtattctctctggaatctgaggaggaggagtatcccggcatcaccgctgaggacagcaacgatatttatattcttccatcagacaatagtggtcaagtgtccccccccgaaagccccaccgtcacaacttcttggcagtcagagtccctgcccgtttccctgagtgcttcacaatcttggcatacggagagcttgcctgtgtctctgggtccagaatcttggcagcagatcgccatggaccctgaggaggtgaagtcactggactcaaatggcgctggagaaaagtccgagaacaactctagcaattctgacattgtgcatgtagagaaagaagaggtgcccgaagggatggaagaggctgctgtagcttccgtggtccttccagccagagagcttcaagaagctcttccagaggctccggctcccctcttaccccatattaccgccacaagccttttgggcactcgcgaacccgatacggaagtgatcacggtggaaaagtcaagcccggcgacgtctctcttcgtcgagttggatgaggaggaggtgaaagccgctactactgagccgaccgaggttgaggaagtggtgcctgctctcgagcccaccgagacccttctctccgaaaaagaaatcaacgcacgcgaagaatctctcgttgaggaattatctcctgcctctgaaaagaagccagtgcctccctctgaaggtaaaagtcggctctcccctgcaggtgagatgaagcccatgcccctgtccgagggtaagtctatcctgttgtttggtggcgcagctgctgtagcaatcctggccgtagcgatcggggtagcgctagcgctgaggaagaaatag

SEQ ID NO: 40583 - DNA, 972 bp, Artificial Sequence
  Description of Artificial Sequence: Synthetic coding sequence
atgctgctggagctgacccggcggggccaggagcccctgagcgccctcctgcaatttggagttacatatttggaggactatagtgcagaatacattatacagcaagggggttggggaaccgtgttctccttggagagcgaagaggaagagtatccgggcatcacggcagaggatagcaacgacatctacattctgccgtcagataactccggtcaggtgtctccccctgagagccccactgtgaccacttcctggcagtcagagagcctacctgtttccctatccgccagtcagtcctggcacacagaatctctgccagtgagtctgggtccagagagttggcagcagattgcaatggaccccgaggaggtgaagtccctggactctaatggcgcaggcgagaagtctgagaataattctagcaactcagacattgttcacgtggagaaggaggaggtgcctgaggggatggaagaagcggccgtggcgtccgtggttctgccggcccgcgagctccaggaggccttgccggaagcacccgccccccttctgccacacatcaccgccacgagccttcttggaaccagggagcccgacaccgaagtgatcacagtcgaaaaatccagtcccgcgaccagtctgtttgtcgagctcgatgaagaggaggtcaaggccgccaccaccgagcccacagaggtcgaggaagtcgtgcctgctctcgaaccgactgaaacgttgctgagcgagaaggaaattaatgcaagagaagaaagcctggtagaggaactgtcacccgcctctgagaagaagcctgttccaccttcggaggggaaatctcgcttaagcccagccggggaaatgaaacccatgcccttgagcgaaggcaagtcaatccttctgttcggcggcgccgccgccgtggcgattctcgctgtggccattggtgtcgctctagctttgagaaagaaatag

SEQ ID NO: 40584 - DNA, 516 bp, Artificial Sequence
  Description of Artificial Sequence: Synthetic coding sequence
atggccagcagcagcaccgtgcccctgggcttccactacgagaccaagtacgtggtgttgtcatacctcggcctgcttagccaggaaaaactgcaggagcagcatctctcctctcctcaaggagtacagctcgacattgccagtcaaagcctcgaccaagaaatcttgctgaaagtgaaaactgagattgaggaggagcttaagtccctcgacaaggagatcagtgaggcattcacatctaccggattcgatcggcatacgtccccagtgttcagtcccgcaaacccagaaagttctatggaggactgccttgctcatctcggagagaaagtatctcaggagcttaaagaaccactgcacaaagctcttcagatgctgctgtcccaggccctatgcctagtgctgagccaacgcaggagaaataccttggaatctctacagaagatcgcgatgaccttcacctcctgtcctgcaaccacccttgacaaaagcgttccccagtctctccagctgtag

SEQ ID NO: 40585 - DNA, 402 bp, Artificial Sequence
  Description of Artificial Sequence: Synthetic coding sequence
atggacaagtacatcctggacaacggcaaggtgcacctgggcagcgggatctgggtggatgaagagaagtggcaccagctccaggtcactcaaggagattccaaatacaccaagaatctcgctgttatgatctgggggaccgacgtacttaaaaaccggtctgtgaccggagttgccacaaaaaagaaaaaggacgccgtgcctaagccccctctgtcaccgcataaactgtccattgtgagagagtgcttgtatgaccgcatcgcccaggaaacggtggacgaaacagagatcgcacagaggctctctaaagtcaacaagtatatctgcgagaagattatggatattaataagagctgcaagaacgaggagaggagggaagccaagtacaaccttcaatag

SEQ ID NO: 40586 - DNA, 1266 bp, Artificial Sequence
  Description of Artificial Sequence: Synthetic coding sequence
atgtacgccttcgtgcggttcctggaggacaacgtgtgctacgccctaccggtgtcctgtgtcagagatttttctccacgtagtcgcctcgacttcgataatcagaaagtgtatgcagtctatcgaggacctgaagagctgggtgccggccctgaatcaccaccaagagccccaagagattggggagctctgttgctgcacaaggctcagattctggctctggctgaggacaaatcagacctggagaatagcgttatgcagaaaaagatcaaaattcctaaactttctctgaaccatgtggaggaggatggtgaggtcaaggactacggggaggaagatctccagctccggcacatcaagcggcctgaggggagaaaaccctcagaggtggcacacaagagcattgaagctgtcgtggctcgactggagaagcagaatggactgagtttgggacactcaacctgccctgaggaggtgttcgtggaggcctcacctgggacagaggacatggactcattggaagatgctgtggtgccacgggcgctatatgaagaactcctgaggaattatcagcagcagcaggaggagatgaggcatctacaacaggaactcgagaggaccaggagacaactggtgcagcaggcaaaaaagctgaaggagtacggggccctcgtgagcgagatgaaagagttaagagatctgaacagaaggttacaggatgttcttttactgagattaggatcaggccctgctatcgatctcgagaaagtgaagtccgagtgtctggagcccgaaccggaactaaggtctacctttagtgaggaagccaacacaagctcctattacccagcccctgcacccgtgatggataagtacatcttagataacgggaaagtacaccttggctcgggcatctgggtggacgaggaaaaatggcaccagctccaggttacgcaaggcgattctaaatacacaaagaatctggccgtgatgatttggggaacggacgttttaaaaaacaggagtgttaccggcgtcgcaacaaagaaaaagaaggatgcagtgcccaagcctcccctgtccccccataagctgtctattgtccgtgaatgcctgtacgatcgcatcgcgcaagagaccgtggatgagacagagattgctcaacggcttagcaaagttaacaaatacatctgcgaaaaaatcatggacatcaacaaatcatgtaaaaacgaggaacggcgggaggccaaatacaatcttcagtag

SEQ ID NO: 40587 - DNA, 399 bp, Artificial Sequence
  Description of Artificial Sequence: Synthetic coding sequence
atggccgaggagggcatcgccgccggcggcgtgatggacgtgaacaccgccctccaagaggttctgaagaccgcccttatccatgatggcttggcgcgcggcataagagaggccgccaaggcgctggacaagcggcaagctcacctgtgtgtcttggctagtaactgtgacgagcccatgtacgtcaagctcgtggaagctctgtgtgccgagcatcagattaacctgattaaggtagatgataataaaaagctgggggagtgggtagggctatgtaagattgaccgtgaggggaagccgagaaaggtggtagggtgttcatgtgtggtggtgaaagactatgggaaggagagtcaggccaaggatgtgattgaagaatattttaagtgcaagaagtag

SEQ ID NO: 40588 - DNA, 996 bp, Artificial Sequence
  Description of Artificial Sequence: Synthetic coding sequence
atggccagcgccctgtggaccgtgctgcccagccggatgagcctgaggagtctgaagtggtctctgcttctgctcagtttactgtcattcttcgtcatgtggtacttgtcccttccccactataatgttatcgaacgcgtcaactggatgtacttctatgaatatgaacctatttacaggcaggattttcacttcacccttcgggagcactctaactgctcacatcagaatccctttctggtcattctggtcacaagccacccttcagacgtgaaggctcgacaggctatccgcgtcacttggggcgagaaaaaatcctggtggggatatgaggtgctcaccttcttcttgctgggccaggaagccgagaaggaggacaagatgctcgcgctctctctcgaggatgaacatttgctctatggagacattatccgacaggacttcctagatacttataataacctcacactaaaaaccatcatggcttttcgttgggtcaccgaattttgccccaacgccaagtacgtgatgaagaccgacaccgatgttttcatcaacacaggcaacctcgttaagtacctcctcaacttgaaccacagcgaaaagttcttcaccggttatcccctcattgataattattcttacaggggcttttatcaaaaaacacacatcagctaccaggagtacccattcaaagtctttcctccctattgctcaggattgggatacatcatgtcccgcgatctggttcctagaatatatgagatgatggggcatgtcaaaccaatcaagtttgaggatgtgtacgtagggatctgcctgaacctcttaaaagtcaacatccacatacccgaagacacgaatttattctttctgtatcgaatacacctcgacgtgtgtcagctgcgcagagtaatcgctgcacacggcttcagctccaaggaaatcatcactttttggcaggtgatgctgcgcaacactacatgccactattag

SEQ ID NO: 40589 - DNA, 996 bp, Artificial Sequence
  Description of Artificial Sequence: Synthetic coding sequence
atggccagcgccctgtggaccgtgctgcccagccggatgagcctgcgttcactaaagtggtcgttgctgctgctgtccctgctgtccttttttgtgatgtggtacctgtccttaccgcactataacgtgattgagcgggttaattggatgtatttttatgaatacgagccgatatatcgccaggattttcatttcacgctgagagagcatagtaactgcagccaccagaatcccttcctggtcatcttggtcacaagtcacccgagcgacgtgaaagcacggcaggccattagagtgacctggggggagaaaaagtcctggtggggttatgaagtgctgacatttttcttgctcgggcaggaagcagagaaagaggataagatgctggcactgtcattggaagacgagcacctgctctacggcgatattatccgccaagatttcctggatacatataacaatctcaccctgaaaacaattatggcttttagatgggtgaccgaattctgccccaacgcaaagtacgttatgaagaccgataccgacgtcttcatcaatacaggaaatttagtcaaatacctacttaatctgaaccactctgaaaagtttttcacgggctatcccttaatcgacaactatagctacagagggttctatcagaaaactcatatttcttatcaggagtatccttttaaagtttttcctccatactgttctggtctcgggtacatcatgtcacgggatctggtgccacggatttacgaaatgatgggacatgtgaaacccatcaaatttgaggatgtgtatgttggcatctgcttgaatctgctgaaagtgaacatccacattccagaggatacaaacctttttttcttataccgcatccatctcgacgtctgccaactgaggcgagtgattgctgcacatggattttcctccaaggaaattataaccttttggcaagtgatgctgaggaataccacatgccactattag

SEQ ID NO: 40590 - DNA, 996 bp, Artificial Sequence
  Description of Artificial Sequence: Synthetic coding sequence
atggccagcgccctgtggaccgtgctgcccagccggatgagcctgcggtccctcaagtggtccctcttgttgttatccctcctttcatttttcgttatgtggtacctttctctgccccactataacgtgatagaacgagttaactggatgtacttctatgaatacgaacctatctatcgccaagattttcacttcaccctgagggaacacagtaattgcagtcaccaaaacccatttctggtgattctagtgacaagccaccccagtgacgttaaggccaggcaggccatcagagtgacgtggggggagaagaagagttggtggggttacgaagtgctaaccttcttcttgcttggccaggaggccgaaaaagaggataagatgctggctttgtccctggaggatgagcatttgctgtatggagatatcatacggcaagacttcttggacacgtataataatttgacccttaagaccataatggccttccggtgggtgacagaattttgtccaaacgcaaagtacgtgatgaaaaccgatacagatgtgttcattaataccggaaacttggtgaaatatctccttaacctgaaccactctgaaaagttctttaccgggtaccctctgatcgataattattcctacagaggattttatcaaaagacccacatcagctatcaggaatatccattcaaagtattccccccttactgtagtggcctcgggtatataatgtctcgcgatctggtgcctcgcatttacgaaatgatgggccatgtcaaacccattaagttcgaggacgtttacgtggggatttgccttaatctgctgaaagtgaatattcatatccccgaagacacgaacctttttttcctgtatcgcatccaccttgacgtgtgtcaattgagacgcgtaatcgctgctcacggattcagcagtaaagagatcataacattctggcaggtcatgctgcgaaacactacgtgccattactag

SEQ ID NO: 40591 - DNA, 996 bp, Artificial Sequence
  Description of Artificial Sequence: Synthetic coding sequence
atggccagcgccctgtggaccgtgctgcccagccggatgagcctgagaagcctgaaatggtctctactgctgctgagcctcctcagcttcttcgtcatgtggtatttaagcctcccacattataatgtgatagagcgggtgaactggatgtacttctacgaatacgagccaatataccgccaagattttcatttcaccctaagagagcatagcaactgctcccaccagaatcccttcttagtgattctggtcacatctcaccccagcgacgtcaaagcaagacaggctattagagtgacatggggggaaaaaaaatcatggtggggctacgaagtcttgacgttcttcttgctaggtcaggaagctgaaaaggaagacaagatgctcgcactgtcacttgaggacgaacatctcctatacggcgatattatacgccaggacttcctggacacatataacaacctaacacttaaaacgattatggcttttagatgggtcacagagttctgccctaacgctaaatacgtgatgaagactgacacagatgtttttatcaatacgggcaaccttgtgaaatatcttcttaatttgaatcactctgaaaaattctttacagggtaccccctcatcgataactattcatacagagggttttatcaaaaaacccatataagttaccaggaataccctttcaaagttttcccaccttattgcagcggcctgggatatatcatgtcgagagacctggtcccaagaatttacgagatgatgggtcatgtaaagcccatcaagttcgaggatgtgtacgtgggaatatgtctgaatttactgaaggtcaatatccatatcccagaagatacaaacttgttttttctgtacagaatccacttggatgtgtgccagctgagaagagtaattgctgcgcacggattttcttcaaaggaaatcatcaccttctggcaggttatgctccgaaacaccacttgtcactactag

SEQ ID NO: 40592 - DNA, 276 bp, Artificial Sequence
  Description of Artificial Sequence: Synthetic coding sequence
atggccagcgccctgtggaccgtgctgcccagccggatgagcctgcgcagtcttaagtggagcttactgcttctcagcctgttatccttcttcgtgatgtggtatctgtccctaccccactataatgttattgagcgggttaactggatgtacttctatgaaattcatctggacgtgtgtcaattacggcgggtgatcgccgcacatggttttagttcgaaggaaattattaccttttggcaagtgatgctgcgaaacaccacatgtcattattag

SEQ ID NO: 40593 - DNA, 336 bp, Artificial Sequence
  Description of Artificial Sequence: Synthetic coding sequence
atggccagcgccctgtggaccgtgctgcccagccggatgagcctgcggagtctgaaatggtccctactgctgctctcacttctcagctttttcgtcatgtggtatttgtcactaccacactacaatgtgatcgaacgcgttaattggatgtacttctatgaatacgagccaatatatcgtcaggacttccatttcacgttaagagagcactcgaactgttcacatcagaacccctttctcgttatcctcgtgacctcccatccctccgatgtgaaagccagacaagcgattcgagtaacttggggcgaaaaaaaatcgtggtgggggtacgagtag

SEQ ID NO: 40594 - DNA, 177 bp, Artificial Sequence
  Description of Artificial Sequence: Synthetic coding sequence
atggccagcgccctgtggaccgtgctgcccagccggatgagcctgaggtcactgaagtggagtctactccttttatcactgctgagttttttcgtgatgtggtatttgtctctcccacattataacgtcatcgaacgggtcaattggatgtacttctacgaatacgagcccatttag

SEQ ID NO: 40595 - DNA, 996 bp, Artificial Sequence
  Description of Artificial Sequence: Synthetic coding sequence
atggccagcgccctgtggaccgtgctgcccagccggatgagcctgagatcattgaagtggagcctcttacttttgagcctcttatctttcttcgttatgtggtatctgtctttacctcattataacgtgatcgagagagtgaattggatgtatttctatgagtatgagcctatctatcgacaggattttcattttaccttaagagaacactccaactgttcacaccagaacccattcctagtcatcctcgtgacctctcatccgtctgacgtgaaggctcggcaagccatccgggtcacatggggtgagaagaaatcctggtggggatatgaagttctgactttttttctgctgggacaggaggctgaaaaagaggacaagatgctcgcactgagtctggaagatgagcatcttctgtatggcgatatcatcagacaggattttttggatacatacaataatttaaccctgaagaccatcatggccttccgctgggtcaccgaattttgtccaaatgccaaatatgtgatgaaaacagatacggacgtctttatcaacactgggaatctggttaagtacttgctcaatttgaatcactccgaaaagttcttcactgggtaccctcttattgacaactacagctatcgcgggttttatcagaagactcacatctcatatcaagagtatccttttaaggtatttcccccatactgctcaggcctgggctacattatgtcaagagatctcgtgcctcgaatttatgaaatgatggggcacgtgaaacccatcaagtttgaggatgtgtatgtcggtatttgcctgaacttgctaaaagtcaacatccacatacctgaggatacgaacctgttctttttatacaggatccatttagatgtttgtcagttgcgacgcgttattgccgcacacggctttagcagcaaagaaatcatcactttctggcaggtgatgctgcggaacacgacttgccattactag

SEQ ID NO: 40596 - DNA, 126 bp, Artificial Sequence
  Description of Artificial Sequence: Synthetic coding sequence
atggccagcgccctgtggaccgtgctgcccagccggatgagcctgcggtctctgaagtggagcttactgcttctgtcacttctatcattttttgtaatgtggtacctctcactcccgcattattag

SEQ ID NO: 40597 - DNA, 996 bp, Artificial Sequence
  Description of Artificial Sequence: Synthetic coding sequence
atggccagcgccctgtggaccgtgctgcccagccggatgagcctgaggtcattgaaatggtccttgctgctactgtcccttctgtcatttttcgtgatgtggtatctctccctacctcattacaacgtcatcgaacgtgtgaactggatgtatttctacgaatacgaacccatttaccggcaagacttccactttacattgcgcgagcattctaactgcagccaccagaatcctttcctggttatattggtgacatcgcatccgtccgatgttaaggcacgacaagcaatcagggtgacctggggagagaagaaaagttggtggggatatgaagtgctgacattttttctactaggtcaggaggctgagaaagaagataagatgctcgccctgtcactggaagacgaacatctcctctatggcgacatcatacgacaagactttcttgatacctacaacaatctaacactcaaaaccattatggctttccgctgggtaaccgaattttgcccaaatgccaaatatgtcatgaagaccgataccgatgtgttcattaacacgggtaatctcgttaagtacctcctgaacctgaatcacagcgagaagtttttcaccggctatcccttgattgataactattcctatcggggattttaccagaagacacatataagctaccaggagtatccattcaaggtgttccccccgtactgttccggtttagggtacatcatgagtagagacctggtccctagaatatacgagatgatgggtcacgtgaagcccattaaatttgaagacgtctacgtcggtatctgtctcaacttgcttaaggttaacatacatatccccgaggatacaaacctcttcttcctgtatagaattcatttagatgtttgccagctcagacgtgttatcgccgcacacggcttcagctctaaggagatcatcacattctggcaggtaatgctgagaaacaccacatgtcactattag

SEQ ID NO: 40598 - DNA, 198 bp, Artificial Sequence
  Description of Artificial Sequence: Synthetic coding sequence
atggccagcgccctgtggaccgtgctgcccagccggatgagcctgcgtagtttgaagtggtctctccttttactgagtctgttaagctttttcgtgatgtggtacctgagcctgccacattataacgtcattgaacgcgttaattggatgtacttttacgaatacgaacctatctatcggcaggatttccacttctag

SEQ ID NO: 40599 - DNA, 90 bp, Artificial Sequence
  Description of Artificial Sequence: Synthetic coding sequence
atggccagcgccctgtggaccgtgctgcccagccggatgagcctgaggtctctgaaatggagtttactgctcctcagcctgctttcgtag

SEQ ID NO: 40600 - DNA, 165 bp, Artificial Sequence
  Description of Artificial Sequence: Synthetic coding sequence
atggccagcgccctgtggaccgtgctgcccagccggatgagcctgaggtctctgaaatggtcactcctgctcttgtcgctgctatcattttttgtgatgtggtatctgtccctcccccattacaacgtgatcgaaagagttaattggatgtacttctacgaatag

SEQ ID NO: 40601 - DNA, 981 bp, Artificial Sequence
  Description of Artificial Sequence: Synthetic coding sequence
atgcggaactggctggtgctgctgtgcccctgcgtgctgggcgccgccctgcacttgtggttacgcctgaggtctccacctccagcatgtgcttcaggggctggtcccgccggaggagttagtctgctcctcccccggctggagtgcaatggagcggtgtccgcacaccctaacctccatctcccaggctcaagggacagccctgcatctgcatcacaggttgccggcataacggaccagctcgcactgttcccccagtggaagtcgactcactacgatgtggtagtgggcgtgctcagcgcgcgcaacaatcacgagttacggaacgtgatacggtccacctggatgcggcatctcctgcagcacccgacccttagccagagggtgctggtgaagttcattatcggtgctcacggctgtgaggtgcccgttgaggacagagaagatccctattcctgcaagctgctaaatatcaccaatcctgtgctcaatcaggagattgaggctttctctttatccgaggatacaagcagcggactgcccgaggatcgtgtggtttccgtgagcttccgcgtcctgtacccgatcgtaattacctcccttggggtgttctacgatgctaacgacgtcggcttccagcggaatattaccgtaaagctgtatcaggctgagcaggaagaagctctgtttatcgcacgcttttctccaccctcctgtggcgtgcaggttaataagttgtggtacaagcctgtcgagcagtttattctgcccgagtcttttgaaggcacaatcgtatgggagtctcaggaccttcacggtctggtgtccagaaacctccacaaggttacagtgaacgatggcggcggagttctccgcgtgattactgcaggagagggcgctttgccgcatgagtttctcgaaggtgtcgaaggcgtggcaggcggctttatctacaccattcaaggcaaattcgcgagctag

SEQ ID NO: 40602 - DNA, 966 bp, Artificial Sequence
  Description of Artificial Sequence: Synthetic coding sequence
atgcggaactggctggtgctgctgtgcccctgcgtgctgggcgccgcgctgcatctgtggttgcgcttgagaagtccccctcccgcctgcgccagcggagcgggccctgccggaggcgtttctctgctgctgccacggctcgaatgtaacggcgccgtgtccgctcatccaaatctacacctacctggctcgcgtgactcaccggcctctgcttcacaagtggctggaattactgatcaactcgctcttttccctcagtggaaatccacacactacgatgtagttgtaggcgtgctctctgcacggaataaccacgaattaaggaatgtgatacgttctacttggatgagacacctgcttcagcatcccactttgtctcaaagagtgctggttaagtttatcattggcgctcatggttgcgaggtcccagtggaagaccgcgaggacccctacagctgcaagttattgaacatcacaaatccagtgctaaatcaggagatcgaagccttttcacttagtgaggacacctcctccggtctgcccgaagacagggttgttagcgtgtctttccgggtgctgtatcctattgtaattacaagtctcggcgtcttttatgatgctaacgacgtggggttccagagaaatatcacggtcaagttatatcaggcagagcaagaggaagctttattcatcgccagattctctcctccctcatgcggtgtccaggtgaacaagttatggtacaagccagttgagcaatttatcctgcctgagagcttcgagggcaccattgtgtgggaaagtcaagacttacacggcctggtatcaagaaacctacacaaagtaactgtgaacgatggaggcggcgtgctgcgtgtcattaccgctggggaaggggctctacctcatgagttcctcgaaggtgtggagggggtcgccggaggattcatatacacaatccagtag

SEQ ID NO: 40603 - DNA, 1503 bp, Artificial Sequence
  Description of Artificial Sequence: Synthetic coding sequence
atgcggaactggctggtgctgctgtgcccctgcgtgctgggcgccgcactgcatttatggcttcgcctgcgcagtcctcccccggcatgtgcgagcggagcgggtcccgctgaccagctggcactcttccctcagtggaagtctacgcactacgatgtcgtagtcggcgtgctgtctgctaggaacaaccacgaattgcgtaatgtcattaggtcaacatggatgaggcatcttctccagcatcctactctgtcgcagagagtgttagtgaagtttataatcggtgcacacggctgcgaagtacccgtcgaagacagggaagacccatacagttgcaaactgctgaatatcacaaacccagtactgaaccaggagatagaggcattcagcctttcggaagacacgtctagtgggttacccgaagaccgggtcgtctccgttagcttccgggtgctgtaccctatcgtgattacctcgctcggagtgttttacgatgccaatgacgtcggattccagagaaatataacggttaagttgtatcaggcagaacaggaggaagccctgtttatcgctcggttttctccgccaagttgtggcgttcaagtcaacaaactgtggtacaaaccagtcgaacagttcatactcccagagtcgttcgaaggtacaatcgtgtgggagtcccaagaccttcacgggctagttagtcggaaccttcataaagttacggtaaacgacgggggcggggtgttacgcgtcataacagcaggtgagggcgcactcccgcatgagttcctggagggggtcgagggggtcgccggcggctttatatacacaattcaagaaggagacgccttacttcataacctgcactctagaccgcagcggctaattgaccatatccgcaatttgcatgaggaagatgctttactgaaggaggagtcttctatttacgatgacatcgtcttcgtggacgtggtggacacctataggaacgtgcccgcaaaattactcaacttttaccgctggacggtggaaacaaccagcttcaatctactattgaaaacagacgatgattgttatatcgacttggaggcggtgttcaatcggatcgtgcagaagaacctcgatggacccaatttctggtggggaaacttccgactcaattgggccgtggacagaaccgggaagtggcaggaattggagtacccatctccagcctacccagctttcgcatgtgggagcggttatgtcatcagcaaagacatcgttaaatggttagcttctaattccggtaggctcaaaacttaccaaggtgaggacgtatccatgggcatttggatggctgcaataggaccaaaaagatatcaggattctctgtggctctgcgagaagacctgtgagaccgggatgctctcgtccccgcaatactcaccatgggaactgacagagctctggaagttaaaggagagatgcggtgatccttgcagatgccaggcgagatag

SEQ ID NO: 40604 - DNA, 1602 bp, Artificial Sequence
  Description of Artificial Sequence: Synthetic coding sequence
atgtggctgggccggcgggccctgtgcgccctggtgctgctgctggcatgcgcttccctcggactgctctatgcctcaactcgcgacgcgcccggcctgagattacccctggctccttgggctccacctcagagcccccgaagacctgaactgcccgacctggccccggagccaaggtacgcccatattccagtccgcatcaaggagcaagtagtggggttgctcgcttggaataattgttcttgcgagagctcaggcggcggattgcctttgccctttcagaaacaggtgcgcgcaattgaccttacaaaagccttcgatccagccgagttgcgcgctgccagcgcaacccgggagcaggagtttcaggccttcctcagtagaagccagtcacctgccgaccaactcctcatcgcacctgccaattcaccactgcagtaccctctccaaggagtcgaggtgcaaccgctgcggtccatcttggtgcccgggctcagcctgcaggccgcaagcgggcaggaagtgtaccaggtaaacctgacagcctccctaggcacatgggacgtagctggcgaagtgacaggcgtcacattaactggtgaaggccaagctgatctgaccctagtgagcccggggcttgaccaactcaaccgtcagttgcagctggttacatattcaagccggtcataccagaccaacaccgccgatacagtaaggttctcaacagaaggccatgaggcagcattcaccattcggattagacaccctcccaacccacggctctaccctcccgggtctctccctcagggagctcagtacaacatttccgcgctcgtgaccattgcaaccaagacctttcttcgttacgataggctgcgggccctgattactagcatacggaggttttaccctactgtgaccgtggtgatcgctgacgattcagacaaaccagaacgcgtatccggcccttacgtggagcactatctgatgccgttcggcaaggggtggttcgcaggcaggaacctcgcggtgtcacaagttacgacaaagtacgtcctttgggtagacgatgacttcgtgtttacagcacggacccgccttgaaagactggtagacgtcctggaaagaactcccttagacctggtcggtggcgccgttcgcgaaatctctggcttcgctacaacctatagacagttattatccgtggagcctggcgcacccggactgggaaactgtttaaggcagaggagggggttccaccacgagctcgtcggctttcccgggtgtgtggtgactgatggtgtggtaaattttttcttagcgcgtactgacaaagtacgtgaggttgggttcgacccacgcctatcgcgcgtcgcccacctagaatttttcctcgacggcctagggtccctgagagtaggatcctgcagcgatgtggtcgtagatcatgcatccaagcttaaactcccatggacatcacgggacgccggcgcagagacctatgctcgttatagatatcctggcagtttggatgaaagccagatggccaagcacagactattgttctttaagcaccgcctgcaatgcatgactagccagtag

SEQ ID NO: 40605 - DNA, 714 bp, Artificial Sequence
  Description of Artificial Sequence: Synthetic coding sequence
atgtggctgggccggcgggccctgtgcgccctggtgctgctgctggcatgtgcatcactaggcttactgtatgcgtccaccagggacgcacctggattacggctgcccctggctccttgggcccccccacagtctccacgcaggccggaattgcccgacctggcccctgagccaaggtacgcccatatcccagtccgaataaaggagcaggtagtgggcttactcgcttggaacaactgtagctgcgaaagttcgggaggaggactgcccctcccatttcagaaacaggtcagagccattgacctgaccaaggcgttcgatcctgctgaattgcgggccgccagcgccactcgggaacaggagttccaagcttttttgtctcgatcccaaagcccggctgaccaattgctgatcgcacccgctaatagcccactgcagtaccctttgcaaggcgttgaggtccagcctttgcggtccatcctggtgcctggattatcactgcaggcagcctctggccaggaggtctaccaagtgaacctgacagcctccctgggtacctgggacgtggccggtgaggtgaccggcgttactttgactggagaggggcaggcagatctcaccctcgtgagtcctggattagaccagcttaacaggcagcttcagctcgtaacctattcttctagaagctaccaaactaatacagccgacacatag

SEQ ID NO: 40606 - DNA, 363 bp, Artificial Sequence
  Description of Artificial Sequence: Synthetic coding sequence
atgtggctgggccggcgggccctgtgcgccctggtgctgctgctggcatgtgcctcactcggattactgtacgcttccacacgagacgcccctggtctgagattgccactcgccccctgggccccacctcaatctcccaggcgacctgaactccccgacctagctcccgaacctaggtacgcccacatccccgtgaggatcaaggaacaggttgtgggcctcttggcgtggaataattgctcttgtgaatcctcaggtggcggactgccactcccttttcagaaacaagtcagggccatcgatctgacaaaggctttcgatccagctgaactccgggcggcttcggcaacgagggagcagtag

SEQ ID NO: 40607 - DNA, 1701 bp, Artificial Sequence
  Description of Artificial Sequence: Synthetic coding sequence
atgggcagcgccggcttcagcgtgggcaagttccacgtggaggtggcctcgcgaggacgggaatgtgttagtggcactccagaatgcggcaaccggttagggagcgccggattcggcgcgctttgtctggagctgagaggagctgatcctgcctgggggccgtttgccgcacatgggcgatcccggcgccagggttctcggttcttgtggctgttaaaaatccttgtcattatcctggtcctcggtatcgtcgggttcatgttcggatcaatgtttctacaagcagtatttagcagccctaagccagaacttcctagcccagctccaggggtgcaaaaactgaagttactgcccgaggaacgcttacggaatctcttttcatacgatgggatctggctctttcctaaaaaccagtgcaagtgcgaggccaacaaggagcagggcggctataattttcaggacgcctatggccaatccgatttaccagcagtgaaggcgcggagacaggcggagtttgagcatttccagcggcgcgaagggctccctaggccgctgccactgctcgtccagccaaacctgccctttggatatcctgtccacggtgtcgaagttatgcctcttcacactgtgcccatccctgggttgcagttcgagggccctgatgcccccgtgtacgaggtgactctgacagctagcctgggaaccttaaacacgctggcagacgtccccgacagcgtggtgcaaggcaggggccaaaagcagctcatcatctccacatctgatcgcaagctgttgaagtttatcctccaacacgtgacatacacatctacgggttatcagcaccagaaagtggatatcgtgagcctggaatctcgttcatccgttgctaagtttccagtgaccattcgccatcccgtcatccccaaactgtacgatcccggacctgagcgtaagctgcggaatctggtgaccattgccaccaagacttttctgcgcccacacaaactgatgattatgcttaggtctattcgagaatactacccagatctcacagtgattgtggcagacgattcacagaaaccgttagaaattaaagacaatcacgtggaatactacaccatgccatttggcaagggctggtttgccggaagaaatctcgcaatttcccaggttacaacaaaatacgtactgtgggtggacgacgactttctgttcaatgaggagactaaaatagaagttcttgtggacgttctggaaaaaaccgaactcgatgtggtgggcgggagcgtgctgggtaacgtgttccaattcaaactactcttggagcagtccgaaaatggcgcttgcctgcacaaacgaatgggtttctttcagccacttgatggctttcccagctgcgtggtgacctccggcgtggtgaatttcttcttggcgcacaccgagaggctgcagcgcgtgggcttcgatcctagactccagagggtcgctcattcagaatttttcatcgatgggctgggcacgcttctagtcggttcttgcccggaggtgattattggacaccaatctaggtcacctgtggtagacagcgagttggccgcgctggagaaaacgtacaacacctacaggtctaacacccttaccagagtgcaatttaaactggcattacactactttaagaaccacctgcaatgcgctgcttag

SEQ ID NO: 40608 - DNA, 1521 bp, Artificial Sequence
  Description of Artificial Sequence: Synthetic coding sequence
atgaccagcggcggcagccggttcctgtggctgctgaagatcctggtgatcatcctggtactaggtattgtgggctttatgtttggcagcatgttcctccaagctgtcttctcctcccctaaacccgaactcccaagcccagctcccggagtccaaaagctgaaattactgcccgaggagcggctgagaaacctgttcagttacgatggtatctggcttttccctaaaaaccagtgcaaatgcgaggcaaacaaggaacagggaggctacaacttccaggacgcttatggccagtctgatttgcccgcagttaaggcccggcgtcaggccgagttcgagcactttcagagacgggaagggttgccccgacccctgcctcttctagtccagcccaatctgccattcgggtacccagtgcacggggtggaggtgatgcccctccacaccgtcccaattccgggcttgcagttcgagggaccagacgcccccgtttacgaagtcacccttacggcctccttagggaccctcaataccttagcagatgttcccgactccgtagtgcagggcagaggacaaaagcagctgatcatttccacctctgatagaaagttgctgaagtttattctgcagcatgtgacttacacttcaacaggatatcaacaccagaaagtcgatatcgtatcacttgaaagccgctccagtgtcgctaagtttcccgtgactatccggcatcctgtcatccccaagttgtatgatccaggtcccgagcgcaaattacggaacttggtcacaatcgctacaaagacctttttgcgcccccacaagctgatgatcatgctgagaagcattagagagtactaccctgacttaaccgtgattgtggctgacgatagtcagaagccgctggagatcaaagataatcacgttgagtattataccatgcctttcggtaagggctggttcgccggccgcaatttggcaattagccaggtaaccacaaagtacgtactgtgggttgatgacgacttcctctttaatgaggagaccaaaatcgaagtgttggttgacgtgttggagaaaaccgagctcgatgtggtcggtgggtctgtcttgggaaatgtcttccagttcaagctcctgctggagcaatcagaaaacggcgcatgcctgcacaaacgaatgggctttttccagccgctcgatggcttcccttcctgtgtggtaacatctggcgttgttaactttttcctggcccatactgaacgcctgcaacgggttggttttgaccctcgcctgcagagggtcgcccattctgaatttttcatagatggactgggcactctccttgtcggatcgtgtcccgaggtgatcattggacatcaatcgagatcaccagttgtcgattcagaactggccgcactggagaagacatataacacatatagatctaacactctcacgagagtgcagtttaaactggctctacattatttcaagaaccacttacaatgtgcggcgtag

SEQ ID NO: 40609 - DNA, 1443 bp, Artificial Sequence
  Description of Artificial Sequence: Synthetic coding sequence
atgttcggcagcatgttcctgcaggccgtgttcagcagccccaagcctgagttgccctcgcctgcccctggagtacagaagctgaagctgcttcccgaggagcgcctgaggaacttattctcttatgacggcatctggctgttccccaagaaccaatgcaagtgtgaggcaaacaaggagcagggcgggtacaacttccaggacgcgtacggtcagtcagacctcccagcagtgaaagctcggcgccaggctgaattcgagcactttcaaagacgcgaagggttaccccgacccctgcctcttttggtccagccaaatctgccatttggctacccagtgcatggcgtggaggtgatgccgttacataccgtcccaatccccggacttcaattcgagggtccggacgcccccgtatacgaagtgaccctgactgcctctttgggtaccctgaatacgttggccgacgtaccagattcagtggttcagggcagaggccaaaaacagctcattatcagcacgtccgaccggaaactgctgaagtttatactccagcacgtgacttatacatcgactggatatcaacatcagaaagtggacattgtatcactggaatccagatcatctgttgccaaattccctgtgactatacggcatcctgttatacctaaactttacgacccggggccagaacgcaagcttcgcaatttagtgaccattgccacaaaaacctttctccgtccacacaaactcatgatcatgctgagatccatcagagagtactaccccgatctcactgtcatcgtcgctgatgacagccagaaacctctcgagataaaagacaatcatgtggagtactatactatgccattcggaaaaggttggttcgcaggcagaaatctggccatcagccaggtgaccaccaaatatgtcctgtgggttgatgatgatttcctgtttaacgaagaaaccaagatcgaggtgctggtcgatgtgcttgagaagacagagttagacgtggttggcgggtccgtcctaggcaacgtctttcagttcaagcttctccttgagcaatcagagaatggagcatgcctgcataagcgaatgggctttttccagccattagacggcttcccctcgtgtgtagtaaccagtggcgttgtcaatttcttcctagcacacaccgagcggctgcagcgcgtgggattcgacccgaggctccaacgagtcgcccattctgaattttttatagatggtctgggcacactcctcgttgggtcgtgccccgaggttattattggtcatcagtcacggtcaccagtcgtggattccgaattggctgctctcgagaagacatataacacctaccgttccaacactctgactcgagtccagttcaagctcgctctgcactatttcaagaaccacttgcaatgtgcagcttag

SEQ ID NO: 40610 - DNA, 3120 bp, Artificial Sequence
  Description of Artificial Sequence: Synthetic coding sequence
atgccccggctgcccgtgaagaagatccggaagcagatgaagctgctccttttgctgctgctgctctcatgcgccgcctggctaacatacgttcatctcggtttagtcaggcagggccgggcgctgcggcagcgcctgggctacggacgtgacggcgagaaattaacgtctgagacagatggcagaggagtccatgcggctccaagcacccaacgtgcggaggactcatcagagagtcgggaggaggaacaggctcccgaaggccgggatctggacatgctgttcccagggggcgcgggcagactacccctcaactttacccatcagacccctccatggagagaggagtataagggacaagtcaatttacacgtcttcgaggattggtgtgggggggctgtcggacacctgaggaggaatctgcactttccactcttcccccacacccgaaccaccgttaagaagttagccgtctcaccgaagtggaaaaattatgggctgagaatttttggtttcattcatcctgctagagatggcgatgtacaattctctgtggcgagcgatgacaactctgagttttggctgagtctggacgaatctcccgcagcagcccaacttgtggcgtttgttggtaaaacagggagcgagtggactgcccccggcgagttcactaaattttcgtcccaggtatccaaaccaagaaggcttatggcgtcaagacgatactacttcgaattgttgcacaagcaggacgacagagggtcagatcatgtggaagtgggttggagagccttcctacctgggctgaagtttgaggtcatcagtagtgcccacatcagtctctacaccgacgagtcagccctgaagatggaccatgtggcgcacgtccctcagagtcccgcctcccacgtgggggggcgccctccacaagaggagactagcgccgatatgctgcgaccagaccccagggacaccttcttcctaacccccagaatggagtctagtagcttggagaacgtgttagagccttgcgcctatgccccgacgtatgtggttaaggatttccccattgcacgataccaggggctccagtttgtctacttgtccttcgtttaccccaacgactacactcgtctcacacatatggagacagacaacaaatgcttctaccgtgaaagccccctttacttagagaggtttggcttctataagtatatgaagatggataaggaggagggagatgaagatgaggaagatgaagtccagcgcagagccttcctatttctcaatccagacgatttcctcgacgacgaagatgagggagaactcctcgacagtctcgagccgacagaggctgctcctccgagatccggtcctcagtccccagctccagcagcccctgcgcagcccggagccaccctggctccgcccacacccccgcgcccaagggacggcggaaccccacggcatagccgagctttgagctgggctgcacgcgctgcacgtccccttccactgttcctgggtcgtgccccgccacctcgcccagctgtggaacagccccctcctaaggtgtatgtcactcgcgtccgccccgggcagcgggcatcgcctcgggccccagctccacgggccccatggccaccttttcccggagtgtttcttcatccacgaccccttccgagagtccagctcagggccccccctagaccacctcgccctcatggccgaaggacaggcgggccacaagccacccaaccccgacccccagcccgggcccaagcgacacaggggggcagggaaggccaagcgcgcaccctgggcccggccgctccaacagtggactccaacctgtcctcagaagcgcggcctgtaactagttttctcagtctgagccaggtctcagggcctcaattgcctggcgaaggtgaagaagaggaggagggggaagatgatggggctccaggggacgaggccgcctccgaagactccgaggaggcagcagggcctgccttgggtcggtggagagaggacgccatcgactggcagcgaacgttctctgttggggcagtggacttcgagctgctgcgatcagattggaacgatcttcgttgcaacgtctctgggaacctgcagctaccggaggccgaggctgtcgacgttactgcacagtatatggagaggcttaatgctagacatggcggtcgatttgcactccttagaattgtaaacgtggagaaaaggcgggactcagcacgaggctctcgattcctgctggaactcgaattacaagaacgcggcggcggccgtctcaggctcagcgagtacgtgtttttgagactgccaggagccagagtgggggacgcggacggagagtcgccagaacccgctcctgccgcttcagtcagaccagacggcaggcctgagctgtgccgtccgcttcggctggcatggagacaggatgttatggtgcactttatcgtccccgtgaagaatcaggccagatgggtagctcagtttctggcggacatggctgcactgcacgcccgaaccggcgactccaggttctcagttgtgctcgtagatttcgaaagcgaagatatggacgtcgagagggctctgcgcgcggcaagactgccacggtaccagtacctgcgtagaacgggaaactttgagagaagcgctggacttcaggcaggcgttgatgccgtggaagatgcctctagcatcgtattcctgtgtgacttacatatccacttccctcccaatatcctggatggcatccgcaaacactgtgtggaaggccgactggctttcgctcccgtggtgatgcggctgtcgtgtgggagttcaccacgagacccccatgggtattgggaggttaacggatttggactgtttggcatttacaagagtgactttgatagagtcggtggtatgaatacggaggaattcagagatcagtggggaggcgaggattgggagctccttgatagggttctgcaagccggcctcgaggttgaaagactccgactccgcaatttctaccaccattaccattcgaaacgcggcatgtggagtgtacgcagtagaaaaggcagtagaacaggcgcaagttag

SEQ ID NO: 40611 - DNA, 708 bp, Artificial Sequence
  Description of Artificial Sequence: Synthetic coding sequence
atggaccccgcccggcccctgggcctgagcatcctgctgctgttcctgacagaggctgcacttggcgatgctgcccaggagccgaccggcaacaatgccgaaatttgcctcctcccactggactatggcccctgcagggcactcctactgcgatactactacgaccgatacacacagagctgccggcagtttctgtacggaggctgtgaaggtaatgcaaataacttttacacctgggaggcatgcgacgacgcctgttggcgcatcgaaaaagtgcccaaagtctgtcgactccaggtcagtgtggatgaccagtgcgaagggtctacagaaaaatacttttttaatctgtcttcaatgacttgcgagaagtttttctctggaggatgtcaccgcaacaggatcgaaaatcggttccctgacgaagccacatgtatgggattctgtgcgcccaagaagatccccagtttttgttactctcctaaagacgagggcctctgctctgcgaatgtgacacgatattacttcaaccctagatacaggacctgtgacgctttcacatatactgggtgtggcggcaatgataacaacttcgtaagccgggaagattgcaagcgtgcctgcgctaaggccctcaagaagaagaagaaaatgcctaagctgcgcttcgccagccgcatccgaaagatcaggaaaaagcagttctag

SEQ ID NO: 40612 - DNA, 309 bp, Artificial Sequence
  Description of Artificial Sequence: Synthetic coding sequence
atggccgactgggcccgggcccagagccccggcgccgtggaggagatcttagacagagagaataaacgcatggctgattccctggccagcaaggttaccagacttaaatccctagccttagatattgatcgtgatgccgaagaccagaaccgctatctggacggcatggtccgggcccacggagtgagagtcagtgtcccctgtcctagcaccacgtgctgtcgggcttgttccgtaagcttcagcactggagcaggcggatggtccaaccatcatttttgcgttatactactagggttcctgccttag

SEQ ID NO: 40613 - DNA, 336 bp, Artificial Sequence
  Description of Artificial Sequence: Synthetic coding sequence
atggccgactgggcccgggcccagagccccggcgccgtggaggagattttagaccgggagaataagagaatggcagattcgttagcgagtaaagtgacacgacttaagagccttgcactcgacattgaccgggacgctgaggaccagaatcgttatctagatgggatggactctgactttacgtctatgaccagcctcttaacaggcagtgtgaaacggttctccaccatggcccggagtggccaggataacaggaaattgttgtgcggtatggccgtgggactgatcgtcgcctttttcatcctgtcatattttctgagtagggcaaggacctag

SEQ ID NO: 40614 - DNA, 3348 bp, Artificial Sequence
  Description of Artificial Sequence: Synthetic coding sequence
atgctgcggggcaccatgaccgcctggcggggcatgcggcccgaggtgaccctagcttgccttttgctggccaccgctgggtgttttgctgatctgaacgaggttccgcaggtgaccgtccagccagccagtacggtgcaaaagcctggcggcaccgtgatcctgggctgtgtagtggaacccccccgaatgaacgtgacatggcgcctgaatggaaaggagctcaacgggtccgacgacgctttgggcgtgctgatcacccacgggaccttggtgattacagcgctaaacaatcacaccgtgggaaggtaccagtgcgtcgctaggatgcctgccggggccgtggcctcagtgcctgctactgtgacactggctaacctgcaggactttaaattggatgtgcagcacgtcatagaggtggatgagggtaatacagcggttattgcgtgccacctgcccgagtctcaccccaaggctcaggtcaggtactccgtgaagcaggagtggctggaggcctcacgaggaaactacttaatcatgccctctggaaatctgcagattgtcaatgcgtcccaggaggacgagggcatgtacaaatgcgctgcatataacccagtgacccaagaagtgaaaactagcggtagttcggaccggctgcgtgtccgacgcagcaccgccgaagccgctcgcattatttaccccccagaggcacagacaatcatcgtgacaaagggccagtccctgatcctggaatgcgttgcctcaggtatccccccacctagagttacctgggccaaagatggttccagtgtcaccggatacaacaagacaagattcctgctgagcaatttgctcatcgacaccacatccgaggaggattccggcacgtataggtgtatggccgacaacggcgtcggacagcccggtgcagccgttattctctataacgtgcaggtatttgagccccccgaggtcacaatggaattgagccagctggttattccgtgggggcagtctgcaaagctgacgtgcgaagtacgggggaaccctcccccttcggtcctctggctccgcaacgcagtgcccctgatctcctcacagaggttaaggctgtcgcgtcgcgcgctcagagttctgagtatgggcccagaggatgaaggcgtgtaccagtgcatggccgagaacgaggtcggttccgctcacgcggtggtgcagctgaggacctcaagacccagtatcacacctcgactgtggcaggatgcggaacttgccaccgggaccccccctgtcagtccgtctaagctcggcaacccagagcaaatgctcagaggacaacccgcactgccaaggcctcctacctcggtgggccctgcaagcccacagtgcccgggagaaaagggccagggcgcgcctgctgaggcaccgattatcctttctagcccacgcacaagtaagacagatagttacgagctggtttggcgaccaagacacgagggctcggggagggcccccatcctgtattatgtggtcaagcaccgaaagcaagtgacaaacagttcagatgactggaccatctccggcatccccgccaaccagcaccgcctcacactgacccgcctggaccctggttctctctatgaggtcgaaatggctgcctacaattgtgccggcgagggacaaactgccatggttaccttccggaccggaagacgcccgaaaccagaaatcatggcatccaaggaacagcagatccagcgggacgacccaggtgcctccccccagtccagctcacagcccgaccacgggagactcagtcctcccgaagctcctgaccgccctactatctcgaccgcgagcgagacgagtgtttacgtaacgtggatcccacgtggaaacggcggcttccctatccaatcatttagggtggagtacaagaaacttaaaaaggtaggggattggatacttgccacctcggccattccgcctagtaggttgtccgtggaaattaccggtctcgaaaagggaacctcatataaatttagagtgcgggccctaaatatgcttggcgaatccgaaccatccgcaccgtccaggccctatgtggtgagcggctacagtgggcgcgtctatgaaaggcctgttgctggcccttacattacttttacggacgcagtgaacgagactacaattatgttgaagtggatgtatatccctgcatctaacaacaacaccccaatccatggattctatatctactatagacctaccgattccgataatgatagcgattacaagaaagatatggtggaaggggataagtactggcattccatttctcacctccagccagaaacaagctacgatatcaaaatgcagtgctttaatgagggaggtgaatccgagttctcaaacgtcatgatctgcgagactaaggctagaaaatctagcggacagccaggacgactgccacccccaacattggcccccccacagcctcccctgcccgaaaccatcgagcggccagttgggactggcgccatggtggcccgatcatctgaccttccttaccttatcgttggtgtggtgttaggcagcatcgttctgataatcgttacattcatcccattttgcctctggcgcgcctggagtaaacagaaacacaccactgatctgggatttcctcgtagtgctctgcccccctcttgtccatatactatggtccccctggggggtctgcccggtcatcaggcaagcggacagccatatctttcgggcatatccgggcgcgcctgtgcgaacgggattcatatgaatcgagggtgcccctctgctgccgtaggctatcccggcatgaagcctcagcaacattgcccaggggaactgcagcagcagtctgatacttcctccctgctgaggcagacacatctcggcaacggctacgacccccagagccatcagatcacacgtggccccaagagcagcccagacgagggcagctttctttatactctcccggatgacagcacccaccagttgttacagcctcatcatgactgttgccagaggcaggaacaaccagctgcagtgggccagtctggtgttcggcgcgcacctgactctcctgtgcttgaggcagtgtgggatcccccctttcattcaggaccgccctgttgcctaggcctggtgccagttgaggaggtggatagccccgattcatgccaggtgtcgggtggagattggtgtccacagcatcctgtgggagcttacgtcggacaggagcctgggatgcagctgtcacccgggcctttagtacgggtgtcattcgaaacccccccactgacaatctag

SEQ ID NO: 40615 - DNA, 3345 bp, Artificial Sequence
  Description of Artificial Sequence: Synthetic coding sequence
atgctgcggggcaccatgaccgcctggcggggcatgcggcccgaggtcacgctggcttgcctgcttctggccacagcaggctgcttcgcggacttaaacgaagtaccgcaagtgactgtccagcccgcgtcgacggtgcaaaagcccggcggcaccgtgatacttgggtgcgtggtggaacccccccgaatgaatgtgacctggagactcaacggaaaggagttgaacggtagcgacgacgctctgggagtcctcattacccatggaacacttgttattacagcgctcaataatcataccgtcggtcgttaccagtgtgtcgcgcgcatgccagcaggggccgtagcatccgtgcccgccaccgtgacactggctaatcttcaagactttaagctcgacgtccaacatgtgatagaagtcgatgaaggaaacaccgctgtcatcgcctgccacctacctgagtcacaccccaaggcccaggtgcggtactccgtgaagcaggaatggttggaagcatctagagggaattacctgatcatgccaagcggcaatctccaaatagtcaacgcgtcacaagaggacgaaggtatgtacaagtgcgctgcctacaacccggtaacccaggaggtcaagacttcaggctccagcgaccgactgcgagtgcgccgatcaactgctgaagctgcccgaattatttatccccctgaagctcagactattatcgtgactaaaggacagagcctgattctcgaatgtgtggcatcaggtatcccaccacctcgtgtcacctgggccaaggacggctcttctgtaacagggtacaataagacgcgattcctccttagcaacttgctcatcgacacaacatctgaggaagattccggaacctaccgttgtatggcggataacggcgttggccaacctggcgcggctgtaatcttgtataatgtccaagtttttgaacccccagaagtgaccatggaattgagccagctggtcatcccctggggacagtccgccaaactgacatgcgaggtgcgaggaaatcctcctcctagcgttctgtggttgaggaacgcggtgccactgatttcctcacagaggctgaggctgtctagaagagccctgcgtgtgctcagcatggggcctgaagacgaaggtgtctaccagtgtatggctgaaaacgaggtcggaagcgcccacgcggtcgtgcaactgcgtacatcacgtccttcaatcacccctcggctctggcaagacgctgagctggccaccgggaccccacccgtgtctccatccaagctcgggaaccctgagcagatgttgcggggacagcctgcgttgccaaggcctcctaccagcgtcggaccagcttcaccacagtgccccggagagaaaggacagggtgcccctgctgaggcgccaatcattctctcttctcccaggacttcaaagacggacagctacgagctggtgtggcgcccacggcacgaaggcagcggtcgggccccaatcctctactacgtcgtaaaacaccgtaaagtgaccaacagctctgacgactggactattagcggaatcccagctaaccaacatcgcctgactctcactcgcttagacccaggcagcttatatgaggtggagatggctgcttacaattgtgctggcgaaggacagacagccatggtcacattccgcaccggtcggcgacccaagccggaaattatggcctcgaaggagcagcaaattcagcgcgatgaccctggagcctctccccagtctagcagccaacctgaccatgggcgtctcagcccacccgaagctcccgacagaccgaccatttctaccgcatctgaaaccagtgtgtacgtgacatggatcccacggggtaacggggggttccccatccagtctttccgggtggagtacaaaaagctcaaaaaagtcggtgactggatcctggccacctctgcaattccaccgagccggctcagcgtggagattaccgggctggaaaagggtactagctataagtttagagtccgggccctcaacatgctgggagagtccgagccaagcgctccatcccggccttacgtggtcagcgggtattcaggcagggtttacgaacggccagttgcaggaccatatatcacctttactgacgccgtgaacgagaccactattatgctgaaatggatgtatatccccgccagcaacaataatacacccattcatggtttctacatctactataggcccacagattctgataatgactccgactacaagaaggacatggtggagggcgataaatactggcattccatttcacacttacagccagaaacctcctatgatatcaagatgcagtgttttaacgagggcggagagagtgagttttctaacgtgatgatatgtgagacaaaggctagaaagtccagcgggcagccaggaagactgcccccccctacactcgcaccgcctcagcctccccttccagaaacaatcgagcggccagtaggcactggcgctatggtcgccagaagctccgatttgccttacttaatcgtgggcgtggtgctcgggtccattgtgctgatcatcgtaacgtttataccattttgtttgtggcgggcgtggtccaagcaaaaacatactactgacctaggatttcctcggtccgccttaccaccatcgtgcccgtataccatggttccccttggcggtctacccgggcaccaggcgtctggccagccctacctgtccggcatttctggcagggcctgtgccaacgggatccacatgaacagaggctgtccaagtgccgctgtcggttatccgggcatgaagcctcaacagcactgccctggggagctgcagcagcagagcgatacaagttcgttgctgcgtcagacccatttgggtaatggttatgatccacaatcccatcagatcacgagggggcccaagagtagccctgacgaggggtcctttttatataccctcccagacgactccactcaccagctgctgcagccccaccatgattgttgtcagcggcaggagcagccagccgcagtgggacagtccggcgtgagacgcgcaccggattcccctgtcctcgaggctgtttgggacccaccctttcattcaggacctccatgctgtctggggcttgtgcctgtggaagaggtggacagtccagatagctgccaggtatcaggcggggactggtgcccccaacatcctgttggcgcctatgtggggcaagaacccggtatgcaactgtcccccgggcctcttgtgagggtctcattcgagacacccccactcacgatttag

SEQ ID NO: 40616 - DNA, 69 bp, Artificial Sequence
  Description of Artificial Sequence: Synthetic coding sequence
atgctgcggggcaccatgaccgcctggcggggcatgcggcccgaggtcactctggcgtgcctcctatag

SEQ ID NO: 40617 - DNA, 258 bp, Artificial Sequence
  Description of Artificial Sequence: Synthetic coding sequence
atgctgcggggcaccatgaccgcctggcggggcatgcggcccgaggtaacattggcttgcctgcttctggctacggccggatgcttcgccgacctgaatgaagtcccccaggtgacagtgcagcccgccagcacagtgcaaaagcccgggggaaccgttatcttggggtgtgtggtggagcctccccgcatgaacgtgacatggagactcaatgggaaggagctaaatggatccgacgatgctcttggcgtgttgtag

SEQ ID NO: 40618 - DNA, 474 bp, Artificial Sequence
  Description of Artificial Sequence: Synthetic coding sequence
atgctgcggggcaccatgaccgcctggcggggcatgcggcccgaggtcacactggcatgcctgctgctcgctaccgcaggctgttttgcggatctgaacgaagtgccacaggtgacagtgcagcccgcctccactgtccagaagcctgggggcacagtgatcctcggatgtgttgttgagccgccccgcatgaatgtcacctggaggcttaacggaaaagagctgaatggttcagatgacgcgctcggcgtgttaatcacgcatgggacgctggtgatcactgccctcaacaatcacaccgtgggcaggtatcagtgcgtagcccgaatgccagctggcgctgtagccagcgtcccagccactgtgacccttgccagcgagtccgcccccctgcccccttgtcacggcgcagtgcctcctcacctgtctcatcccgaagcccccaccattcacgctgctagctgttactcttag

SEQ ID NO: 40619 - DNA, 474 bp, Artificial Sequence
  Description of Artificial Sequence: Synthetic coding sequence
atgctgcggggcaccatgaccgcctggcggggcatgcggcccgaggtgaccttagcatgcctcctgctcgccaccgccggctgcttcgctgatctaaatgaggtgccacaggtgacagttcagccggcaagcaccgtacaaaagccaggaggcactgtaattcttggctgtgtggtggagccaccgaggatgaatgttacctggcgattgaacggaaaggaactaaatggttcagatgatgcgctgggcgtgctaatcacccatgggacgctggtgatcaccgccttgaacaatcataccgtggggagataccagtgcgttgcccgtatgccagctggagccgttgcctcggtcccagccaccgttacgctggcttccgaaagcgcaccgctgcctccatgccatggagccgtgccaccacacctctcacaccccgaggctcctaccatccatgctgctagctgctactcatag

SEQ ID NO: 40620 - DNA, 99 bp, Artificial Sequence
  Description of Artificial Sequence: Synthetic coding sequence
atgctgcggggcaccatgaccgcctggcggggcatgcggcccgaggtgacacttgcgtgtctgttgcttgctacagcaggatgctttgcagacttgtag

SEQ ID NO: 40621 - DNA, 3345 bp, Artificial Sequence
  Description of Artificial Sequence: Synthetic coding sequence
atgctgcggggcaccatgaccgcctggcggggcatgcggcccgaggtgacccttgcctgcctgctgctcgcaaccgcaggttgctttgccgacctgaatgaggtgccccaggtcaccgtgcagcccgcctctaccgtgcagaaacccggtggtacagtgatcctcggctgtgtcgtcgaaccaccacgcatgaacgtgacttggagactgaacggtaaggaactaaacggcagcgacgatgcactgggagtcttgatcacgcacggaacattggtgatcaccgctctgaacaaccatacagtaggccggtaccaatgtgtggcaaggatgccggccggagctgtggcttcagtgccagccacggtgactctagcaaacttacaggatttcaaactagatgtgcagcacgtcatcgaggtggacgagggcaatacagccgttatagcatgtcacctgcctgaatcgcatccgaaagcacaagtgcggtattccgtcaaacaggagtggttggaggcatctaggggtaattacctgatcatgccctcgggaaatttacagattgtcaacgcttctcaggaggatgaaggcatgtacaagtgtgcagcctataatcctgtgacgcaggaagtcaaaacatcaggcagctcagaccgcctaagagtgcgccggtcaacagccgaggccgctcgaatcatctatcctcctgaagcgcagactatcatcgtgaccaagggccagagcttaattttggagtgcgtggcatccggcatccctcccccccgggttacatgggccaaagatggctcatctgtaaccggttacaacaagactagattcctgctctccaatctgctcatcgataccacctccgaggaggactccgggacataccgttgcatggcagataacggggtcggtcaaccgggtgccgctgtcatcctatataatgtacaggtgtttgaaccacctgaggtgaccatggaactgagccagcttgtgattccatggggacagagtgccaagctaacttgtgaggtgagaggcaatccacctcccagtgtcctgtggctccgtaatgccgtgcctttgattagcagtcagagactgcggctctctcgccgtgccttacgcgtgttgagtatgggccctgaagatgaaggcgtgtaccagtgcatggctgagaatgaagtggggagtgctcatgccgttgtacagctcaggaccagtcggcccagcatcacacctagattgtggcaggacgcggaactggcgaccggcaccccacccgtatccccatctaagctcggaaaccccgagcaaatgttacggggacaacccgctctgcctcgccctcctaccagcgttgggccggcgtcacctcagtgccccggcgagaaggggcagggagctccagctgaagctcccattatccttagtagccctaggacatctaagaccgactcctacgagcttgtttggcggcctcgccatgagggatccggacgtgcacctattttgtattacgtggtcaagcaccgcaaggtgactaattcgtcagatgattggacgatctccgggatccctgccaatcagcaccggcttaccctgacccggttggaccctggaagcctctacgaagtagagatggcagcatataactgcgcaggtgaaggacagacagccatggtgactttccgcactggacgtcgaccaaaaccggaaataatggcgtcaaaagaacagcagatccaacgggatgaccctggtgcttctcctcagagttccagtcagcccgatcatggaagattgtcaccacccgaggcccctgatcggcccaccattagtactgctagtgaaacttctgtgtatgtgacttggattccaaggggcaatggcggctttcctatccagagttttagagtggagtacaagaagctgaagaaagtgggggattggattctcgcgacctcagcaattccacctagcaggctgtctgtggagataacgggcctagaaaaggggacatcctataagtttcgtgttcgtgccctaaatatgctgggcgaatccgagccatctgcacctagccgcccctatgttgtttccggttatagtggccgggtgtatgagagacccgtcgccggaccgtacattacctttactgatgcagtgaatgagaccacgatcatgctaaaatggatgtatattcccgcaagtaacaataatacccctatccacgggttctatatatactatagacccactgatagcgataatgacagcgactacaaaaaggacatggtcgagggggacaaatactggcactcaatcagccacctgcagccggaaacctcgtacgatataaagatgcagtgttttaatgaaggaggagagagcgaattttctaacgttatgatctgtgaaacaaaggccagaaaatcatccgggcagccagggcgtctgcctccccccaccctggcgcccccccagccaccgttgccggagactatagaacggcctgttggcaccggcgccatggtagcccggtcttctgatctgccatacctcatcgtgggagtagtcctaggaagcattgtattgattatcgtgaccttcatccctttttgcctttggcgagcgtggagtaaacagaagcacaccacagatctcgggttccccaggagtgcactaccccctagttgtccctacactatggtaccactggggggactgcccggtcaccaggcgtccggccagccttacttatccgggatttcgggaagagcctgtgctaatggcattcacatgaacagggggtgcccatcggccgcggtggggtatcctggcatgaagccccagcagcattgtcccggggaactgcaacagcagagtgacacatcaagtctgcttcggcaaacacatctgggaaatggatatgatccacagtcacatcagattactcggggccccaagagcagccctgatgaggggtctttcctgtatacactcccagacgactctacgcatcagttgcttcagccacaccatgactgttgccagcgccaggagcagcccgcagccgtaggacagtccggagtccgccgcgcaccagattcacctgtgctagaagccgtgtgggatccacctttccactctgggccaccatgctgcctagggttggtgcccgtcgaggaggtggattcacccgatagctgtcaggtgagcggcggtgactggtgccctcagcatcccgtgggggcgtacgtcggccaggaaccaggcatgcagctgagccccggccccctagttcgcgtgtcattcgagactccccccttaaccatctag

SEQ ID NO: 40622 - DNA, 627 bp, Artificial Sequence
  Description of Artificial Sequence: Synthetic coding sequence
atgcggtacgcctgcagcagcagcgaggactggcccccccccctggatatctcctctgatggcgacgttgacgccactgtcctgagggagctgtacccagactcccctccgggcgtgtccctgagccgcctcagatggagcgctatgatgtacaccggctcattcacttattgggttaggagcatgctctcccgacacaagttggatgccattctcggtcggcttggctatacagcaacccttgagtcggagtttagcctggtgcaggccatctcaaaagagaacgtgaaacagatggtttttaaaattttcttagtccgtgttagttgcgaggcggtgttgcgcacagccggaacaagaatgctggagcctggcacggagaaattagctcgaacgcactctagacacagttctgaaaagagactggtgaaaccctgttcctgtctggaaggtgtgcagcctggccctggaagcggtggaccacaacagggtccgtctgagggggtagggtcagaaactgccctggctgaaggcacggcaggccagcggtctctgccgatggctttgtccccgtcagaggtgagcaccgcacccaactcactgccaagcgggagcccggtgctgtag

SEQ ID NO: 40623 - DNA, 753 bp, Artificial Sequence
  Description of Artificial Sequence: Synthetic coding sequence
gcccggtacaaccggaccagctacttctaccccaccttcagcgagtcaagcgaacatagccatcttcttgtgtcccctgtcttggtcgcaagtgctgttatcggcgtggtaataattttatcctgtatcaccataatagttgggtccattagaagagaccgacaggcccgattgcaacggcaccgccacaggcaccaccgtcaccaccatcatcatcaccatcataggcgacgtcgccatagggagtatgaacacgggtacgtctccgacgagcatacatacagtcgctcatcgcgacgaatgcgctacgcctgtagctccagcgaagattggcctccaccactcgacatcagcagcgacggcgatgtggatgcgaccgttttaagggaactgtatcccgacagcccaccaggctacgaggagtgcgtggggccaggcgctacacagctatacgtaccaactgacgctcccccaccatattcattaaccgatagctgccccactctagacggaaccagcgattctgggagtggacacagccctggccgacaccagcaagagcagagaaccccagcacaggggggcttacataccgtgtccatggacaccctccctccgtatgaggctgtgtgcggagctggccctccctcaggtctcttacctctcccagggccagaccccggtcccaggggctcccaaggcagcccaacacccacgagagctccagcttctgggcccgaacgaatcgtgtag

SEQ ID NO: 40624 - DNA, 780 bp, Artificial Sequence
  Description of Artificial Sequence: Synthetic coding sequence
atgagcttcaagcggccctgccccctggcccggtacaaccggacctcctacttctaccccaccttttcagagtcaagcgagcattcccatcttttagtttcccctgttcttgtggctagtgcagtgataggtgtggttatcattctgagctgtatcacaattatcgtgggctctatccgcagagaccgacaggctcgtctccaacgccataggcacaggcaccaccggcaccaccaccatcaccaccatcaccgcaggcgaagacacagggagtatgagcacgggtatgtctcggacgaacacacctactcaaggtctagccgccgaatgcgctacgcttgctccagctcagaggactggcctccccctctcgatatctcttctgatggtgacgttgatgcgactgtgctgcgagaactctatccagacagtccacccggatatgaagagtgcgtagggccaggggctacacagctttatgtccctacagacgccccaccaccatattctcttaccgactcttgccccactttagatggcacatcagactccggcagcggtcacagtccaggaaggcaccaacaggaacagaggacacccgctcagggaggtctccatacggtaagcatggatactctgccaccatacgaagccgtgtgcggcgcaggtccacctagcggcttactccccctgcccggtccggatcccgggcccaggggaagccagggctctcctactccaactagagcgcccgcctctgggcccgaaagaattgtgtag

SEQ ID NO: 40625 - DNA, 384 bp, Artificial Sequence
  Description of Artificial Sequence: Synthetic coding sequence
atgagcgccgccggcgcccggggcctgcgggccacctaccaccggctcctcgataaggtagaacttatgttgccagaaaaactgaggccactctacaatcatccagccggcccaaggaccgtgtttttttgggctccaattatgaaatgggggctagtatgcgcggggctggctgacatggctagaccggcagaaaagctgagtactgcccagtcagcagtgctcatggccactggtttcatctggtcccgatatagcttggttataattccaaaaaattggagtttgttcgcagtgaatttttttgtaggcgcagccggtgcttcacaactgttcagaatctggcgttataatcaggaactcaaggccaaggcccataagtag

SEQ ID NO: 40626 - DNA, 384 bp, Artificial Sequence
  Description of Artificial Sequence: Synthetic coding sequence
atgagcgccgccggcgcccggggcctgcgggccacctaccaccggttgttagataaggtagagctcatgcttccggagaagctccggcctctgtacaatcatccagctgggcctcgcacagtgttcttttgggcgccgattatgaagtggggcctggtctgcgcaggccttgctgacatggcgaggccagcggagaaactctcgacggcccagagcgcagtgttaatggccaccggctttatttggagccgttattctttggttatcattccaaagaactggtctcttttcgctgttaatttcttcgtcggtgctgccggtgcttcgcagctctttcgaatatggagatacaaccaggagctgaaggccaaagcccataagtag

SEQ ID NO: 40627 - DNA, 318 bp, Artificial Sequence
  Description of Artificial Sequence: Synthetic coding sequence
atgagcgccgccggcgcccggggcctgcgggccacctaccaccggctgttggacaaggtagagctgatgctgccagaaaaactgcggcctttgtacaatcatcccgcgggacctagaacggtttttttttgggcaccgattatgaaatggggcctcgtgtgtgcaggcctcgcagacatggctcggcctgctgagaagctgtctaccgctcaaagcgccgttttgatggcaaccgggtttatctggagcagatacagtctggtgatcattcccaaaaactggagtctctttgcggtgaatttcttcgtgggtgcatag

SEQ ID NO: 40628 - DNA, 330 bp, Artificial Sequence
  Description of Artificial Sequence: Synthetic coding sequence
atggccggcgccctggtgcggaaggccgccgactacgtgcggagcaaggattttagggactatttgatgtctaagcatttttggggcccagtagccaactggggacttcccatcgccgctatcaacgacatgaagaagtcccccgaaattatatccggtaggatgacatttgcactgtgctgctacagcctcactttcatgcgtttcgcttataaggtccagcctagaaactggctcctattcgcctgtcacgccacgaatgaggtcgcccagctgattcaaggaggccgtctgattaaacacgaaatgactaagacagccagcgcgtag

SEQ ID NO: 40629 - DNA, 330 bp, Artificial Sequence
  Description of Artificial Sequence: Synthetic coding sequence
atggccggcgccctggtgcggaaggccgccgactacgtgcggagcaaagacttccgggactacctgatgtcaactcacttctgggggcctgtggccaattgggggctcccaattgcagcaattaatgacatgaaaaagtcccctgaaatcatctccgggaggatgacatttgctctgtgttgctacagtttgaccttcatgagatttgcatacaaggttcagcctaggaactggttgctcttcgcatgtcatgccacgaacgaggtggcccagttgattcaagggggcaggctcattaagcacgaaatgactaagaccgcatcggcctag

SEQ ID NO: 40630 - DNA, 201 bp, Artificial Sequence
  Description of Artificial Sequence: Synthetic coding sequence
atgaagaagagccccgagatcatcagcggccggatgaccttcgccttgtgttgctattctttgacctttatgcgctttgcttacaaggtgcagccaaggaattggctcctgtttgcttgtcatgccacaaacgaggtggctcagctaatccagggaggccgcctcatcaagcacgagatgacaaagacagccagcgcttag

SEQ ID NO: 40631 - DNA, 642 bp, Artificial Sequence
  Description of Artificial Sequence: Synthetic coding sequence
atgcccgacgagaacatcttcctgttcgtgcccaacctgatcggctacgccagaattgtattcgccattatttctttttatttcatgccgtgttgtccgctgacggccagttccttctacttactaagtggactgctggacgcctttgacggtcacgccgcccgggcgttgaatcagggcactcggtttggggctatgttagatatgcttaccgaccggtgctccaccatgtgcttattagtgaatctggccctgctgtatcccggtgcgactttattcttccagatttccatgtctctggatgtggcgagtcactggcttcatttacatagcagcgtggtccgaggatctgaatcacacaaaatgatcgacctgtcagggaatcctgtgctgagaatttactatacgtctaggcctgccttatttacactgtgtgctggcaacgagctcttctattgtctcctttacctcttccattttagcgagggccccttagtgggaagtgtgggcctcttcagaatgggcctttgggtgaccgctcctatagcgctgctgaaatcactgatcagcgtgatccatcttattactgccgctagaaatatggctgcactggacgcagccgatagggccaaaaagaaatag

SEQ ID NO: 40632 - DNA, 1008 bp, Artificial Sequence
  Description of Artificial Sequence: Synthetic coding sequence
atgatcctggccagcgtgctgcggagcggccccggcggcggcctgcctttgcggccactgctgggacctgccctggcactacgcgcaagatcaacctccgcaacagatacacatcatgtcgaaatggccagagagcgaagtaagacggtgaccagcttttacaatcagagcgcaatcgatgccgcagctgaaaagccatctgtgagactcactccaactatgatgctgtacgccggccggtcccaggatggatcgcacctgctgaagagcgcaaggtatcttcaacaagagcttcccgtccgaattgctcaccggatcaaaggcttcaggtgtctcccctttatcatcggttgtaacccgacaattttacacgtccatgagctgtacatacgcgcattccagaaattgacagatttcccaccaatcaaagatcaggcggatgaggctcagtattgccagttggtcagacagctcctggacgatcacaaggacgttgtgacattgttggccgaaggactgcgcgagtcacggaaacacatagaggacgagaaactggtccgctacttcctagataaaactctgactagccggcttggcattcgcatgctggccacgcaccatctggccctgcatgaagacaagccagactttgtgggaatcatttgtacaagactgtcaccgaagaaaatcatcgaaaaatgggtagactttgcgcgacgactgtgcgaacataagtacggcaacgctccaagggttcggatcaacggccatgtggccgcacgctttcctttcatccctatgccattggattacatcttgcccgagctgctgaaaaacgcgatgcggatatccgatagagggggcgggatagctcataaagacctagatcgtgtaatggactatcatttcactacagctgaagcctccacacaggatccacggatatccccactattcggacatttggatatgcactccggtgcacaatccggtccaatgcacggatag

SEQ ID NO: 40633 - DNA, 1098 bp, Artificial Sequence
  Description of Artificial Sequence: Synthetic coding sequence
atgatcctggccagcgtgctgcggagcggccccggcggcggcctgcccctgcgtcctctcctcgggcccgcattggctttgagggcgcgatcaactagcgccaccgatactcaccatgtggagatggcaagggaacggagcaagaccgtgacctcattttacaatcaaagtgctattgatgcagcggctgaaaaaccaagcgtgaggctaacaccgactatgatgctgtacgctggccgatcccaggacggctcccatctcctgaaaagcgcccggtacttgcagcaagagctgcctgtgagaatcgctcatcggattaaggggttcagatgtctacctttcatcatcggctgtaaccccactattctccacgtgcatgagctgtacatccgtgcattccagaaactgaccgacttcccaccaatcaaagatcaagccgacgaagctcaatattgccagctcgtgagacaactcctggacgatcataaggacgttgtgaccctgctggcagagggattacgagaatcaagaaagcacattgaggacgagaaactggttaggtacttcctggataagaccctgaccagccggctgggcattcggatgttagccactcaccatctcgcacttcatgaggacaaaccagactttgtgggcatcatatgcacccgcctgtctccaaaaaagataatcgagaagtgggtggactttgccagacgactctgcgaacataaatacgggaatgccccccgtgtgcgtattaatgggcacgtggctgcccgttttccatttatcccaatgcctttagattacatattacccgagctcctcaagaacgcgatgcgggctacgatggaaagccatcttgacacgccttacaatgtgcctgatgtagtcatcacaattgctaataacgatgtagacctaatcatccggatcagcgacagaggtggtgggatcgcgcacaaagatttggaccgcgttatggattaccacttcaccaccgccgaagcaagcacccaagatcccagaatctctccccttttcgggcacctggacatgcactcaggagcacaatctggccctatgcacggctag

SEQ ID NO: 40634 - DNA, 1239 bp, Artificial Sequence
  Description of Artificial Sequence: Synthetic coding sequence
atgatcctggccagcgtgctgcggagcggccccggcggcggcctgccactccgccctctgttaggcccagcgcttgccctccgggctaggagcacatccgctactgatacccaccacgttgagatggccagggagcggtccaaaaccgttacttctttctacaatcagtcagccatcgatgctgccgcagaaaagccctctgtaagactgactcctaccatgatgctgtacgcagggaggtcccaggatggaagtcacctgctcaagtctgcgagatatctgcagcaggagctgcccgtccgaatcgcccaccggataaagggcttccgctgcttaccttttataattggctgtaatcctacgatactccatgtgcatgagctatacataagggcattccagaaactcacagacttccccccaataaaggaccaggctgacgaggctcaatattgtcagctggtgcgacagctccttgatgaccacaaggacgtcgttaccctgctggctgaggggctgcgtgaatcccggaagcacattgaggatgaaaagttagtacggtactttttagacaagacccttacctccagactcgggatcaggatgttggccacccatcacctggccctgcacgaggacaagcccgattttgtcggaatcatctgcacccggctatcccccaagaagatcatagaaaaatgggtggacttcgcacggcgactctgcgagcacaaatacgggaacgccccgcgtgtgagaatcaacggacatgtcgcagcccgcttcccatttatcccaatgcctcttgattacatccttccagaactcttgaaaaatgccatgcgcgctaccatggaatcacacctggacacaccttataacgtgcctgacgtcgtgattactattgcaaacaatgatgtcgatttgatcatccgtatatcagaccgggggggcggcatcgcccataaagatctcgatcgcgtgatggattatcatttcaccaccgccgaagcaagcacacaggatccgcgtatcagcccactcttcgggcaccttgacatgcacagcggtgctcagtccggccctatgcacggatttggtttcggccttcccacaagccgagcctacgccgaatatctgggagggagtctccagttacaatcgctgcaagggattgggaccgacgtttatctgcggcttaggcatattgatggtcgagaggaatcctttaggatatag

SEQ ID NO: 40635 - DNA, 756 bp, Artificial Sequence
  Description of Artificial Sequence: Synthetic coding sequence
atgggcgcccgggccagcggcggccccctggcccgggccggcctgctgctgttgctcctactgctgctactcctcggtctgctggcccccggtgcccaaggggcccgcgggagagggggagccgagaaaaactcctaccgcagaactgttaatacgttctctcagagcgtgtcgtccttgttcggggaggataacgtgcgagcggcccagaagtttctagcccgactcaccgagcggttcgttctcggcgtggatatgttcgtggaaaccctgtggaaggtgtggactgaactgctggacgtacttggcctggatgtctccaatctgagtcaatatttctctccagcctctgtctcatcttcgccggcacgcgcattactgctggtgggagtagttctgttagcgtactggttcctctccctgaccctgggcttcactttcagcgttctgcacgttgtgttcgggcgatttttctggatcgtgcgcgtggtcctgttttccatgtcatgtgtgtatattctccataaatacgagggagaacctgagaatgctgtcctgcctctgtgctttgtcgtcgctgtgtattttatgaccgggcctatgggcttttactggagatccagcccatcaggaccttctaacccaagtaaccccagcgttgaagagaagctggagcacctggaaaagcaagtgaggctgttgaatatcaggcttaacagggtgctggaatccctagacaggtccaaagacaagtag

SEQ ID NO: 40636 - DNA, 1236 bp, Artificial Sequence
  Description of Artificial Sequence: Synthetic coding sequence
atgacccactggttccaccggaaccccctgaaggccaccgcccccgtgtcctttaactactatggagttgttaccgggcctagtgcttcaaaaatatgtaacgatctccggtcaagccgtgcacgactgctcgagctcttcacagacctgagttgcaacccggagatgatgaagaacgcagctgattcttacttctcgcttctgcaaggcttcatcaactcgctcgatgagtcaactcaggagagcaagttgagatatattcagaacttcaagtggacggataccctgcagggacaggtacccagcgcacagcaagacgcggtttttgagctgataagcatggggttcaacgtcgccctatggtacacaaaatatgcctctagactggcaggtaaggaaaacattacggaggatgaagcgaaagaggtgcatagaagcctaaaaattgcggccgggatctttaagcatctgaaggagagccacctgccaaaactgattacgccggccgaaaaaggccgtgaccttgagagtcgcctaatagaagcctatgtgattcagtgtcaggcagaagcccaggaagttactatcgcccgcgcaattgaactcaagcatgcccctgggctaatagccgcactggcttatgaaacagcgaacttctatcaaaaggccgaccacacactgtcaagcctcgagccagcttattctgccaagtggaggaaatatctccatctgaagatgtgtttttatacagcttacgcctactgttaccacggcgaaacgctgctggcctccgataaatgcggagaggccatcagaagcctccaggaggccgaaaaactttatgctaaggctgaagccctgtgcaaagaatatggagagaccaaaggccccggccctactgttaagccgagcggacatctgttctttagaaagctgggcaatctggttaagaatacccttgagaaatgtcagcgcgaaaacggcttcatatatttccagaagatacccactgaggcaccccaactggaactaaaagctaattacggcctggtcgagcccatcccatttgaatttcctcccacttccgtacagtggaccccagagactttagctgccttcgatctcactaagcgacccaaggacgacagcacaaaaccgaaaccagaagaggaggtaaagcctgtgaaggagcccgacatcaagccccagaaggataccggttgttacatcagctag

SEQ ID NO: 40637 - DNA, 648 bp, Artificial Sequence
  Description of Artificial Sequence: Synthetic coding sequence
atgacccactggttccaccggaaccccctgaaggccaccgcccccgtaagttttaactattatggggtggtgacagggccctccgctagtaagatctgtaatgacctaaggagctcccgagccaggctcctagaactgttcactgacctgtcatgtaatccagagatgatgaagaatgccgcggatagctacttctcacttctccagggtttcatcaacagtttagacgagtcaacccaggagtcaaagctgcggtatattcagaatttcaagtggactgacacccttcagggccaggtccccagcgcccagcaggacgccgtgtttgaactgatctccatggggtttaacgtcgcattgtggtacactaagtatgcctcacgactcgcggggaaggagaatattactgaagacgaggccaaggaagtccaccgctctcttaaaatcgcggcaggcattttcaagcatctgaaggagtctcacctgcccaagcttattacaccagcggaaaaagggcgggatttagagtctaggctcattgaggcctatgtcatccagtgtcaagctgaagcccaggaggtaactatcgctcgagccatcgaactcaagcatgcccctggtttgatcgcagctttggcctacgaatag

SEQ ID NO: 40638 - DNA, 1017 bp, Artificial Sequence
  Description of Artificial Sequence: Synthetic coding sequence
atgacccactggttccaccggaaccccctgaaggccaccgcccccgtgagctttaattactatggcgtggtcaccgggccatccgccagtaaaatctgtaacgatctgcggtcgtccagagctcgtctactcgaattgttcacagacctgtcatgcaaccccgaaatgatgaaaaacgccgccgattcctacttcagcctcctccagggctttatcaacagtctggatgaatccacacaggagtctaaactccggtacatccagaacttcaagtggacagatacgctgcaaggacaagtgccctccgctcagcaagacgctgtgttcgagctcattagcatgggtttcaacgtagcgctgtggtatacaaagtacgcatcccggctggctggcaaggaaaatatcacggaagacgaggccaaggaggtgcaccgctcgctgaaaatcgccgcggggatcttcaagcacctaaaggagtcacatcttccaaagttgatcacccccgccgaaaagggtcgtgacttggagtctagactaatagaggcttatgttattcagtgccaggctgaggcgcaagaggtaacgatcgctagggctattgagctgaagcacgctcctggcctcatcgccgctctggcgtacgagactgcaaacttctaccagaaagccgaccacacgctgagttcactggagcccgcctacagcgctaagtggcgcaaatacctgcatttaaaaatgtgcttttatactgcttatgcttactgctaccacggtgagaccctgctggcgtccgacaagtgtggggaagcgatccgcagcctacaggaggccgaaaaactgtacgcaaaggcggaggccctgtgcaaggaatacggcgaaacgaagggtcctggccctactgtaaagccctctggtcatctgttctttaggaagctgggaaatctcgttaaaaatacgctcgaaaagtgccagagagaaaacggatttatcctcaaccctaaccagaagaaaaagtag

SEQ ID NO: 40639 - DNA, 1140 bp, Artificial Sequence
  Description of Artificial Sequence: Synthetic coding sequence
atgacccactggttccaccggaaccccctgaaggccaccgcccccgtttcattcaactattatggtgtggttacaggaccctccgccagcaaaatctgtaatgacttgagatcttcacgcgcccgattgttggaactttttacagacttgtcctgcaatccagaaatgatgaaaaacgcggccgactcctattttagtttacttcagggatttattaactcgttagatgagagcacgcaggagagcaaactgcggtacatccagaatttcaaatggacagacacgctgcaagggcaggtacctagcattacagaggacgaggctaaggaagtgcacaggagccttaagatagcggcaggaatatttaagcatttaaaggagtctcatctccctaaacttatcactcccgcggaaaaggggagagacctggagtccaggctgatcgaagcctatgtgattcaatgtcaagcagaagctcaggaagtgacaatagcccgcgccattgaacttaagcacgctccagggcttatagctgccctggcctatgaaaccgccaacttttatcagaaggcggaccataccctcagttcactcgaaccggcctactccgcaaaatggaggaagtatctgcacctaaaaatgtgtttctacactgcttacgcatactgctatcacggcgagaccctcctcgcgtctgataaatgcggcgaagccattaggtccctgcaggaagctgaaaagctgtatgcaaaggctgaagccttatgtaaagagtacggggagactaagggccccggtccaaccgtgaagccctccgggcatctgtttttccgcaagctggggaacttggttaagaatactctggagaaatgtcaaagagaaaatggcttcatctactttcagaagattcctacagaggctcctcagctggaactaaaggccaattatgggcttgttgaacccattcctttcgagtttccgcccacctccgtgcagtggacgcccgaaaccctggcagcattcgatctgacaaaaagaccaaaagacgactcaaccaaacccaaaccagaagaagaggtgaagcctgttaaggagcctgatatcaagccacagaaagataccggatgctatatttcatag

SEQ ID NO: 40640 - DNA, 309 bp, Artificial Sequence
  Description of Artificial Sequence: Synthetic coding sequence
atgagcagcccccccgagggcaagctggagaccaaggccggccacccccctgccgtcaaggctggtgggatgcggattgtacaaaagcaccctcacacgggtgatacaaaggaagagaaagataaagatgaccaggagtgggagtcgccctcccccccaaagcctaccgtgttcatttctggtgtaattgctaggggcgacaaggactttcctccagcagcagcacaggtcgcgcaccagaaacctcacgcctcgatggataagcaccccagtccccgcactcagcacattcagcaacctcggaagtag

SEQ ID NO: 40641 - DNA, 2274 bp, Artificial Sequence
  Description of Artificial Sequence: Synthetic coding sequence
ctggccaagaagatcaccctgaagaagaagctggaggaggaggaggcagaagtcaagcggaaggcaacagatgctgcttaccaggcgcgacaggccgtcaagacacctccacgaagacttccaactgtcatggttagaagcccgattgatagcgccagtccggggggtgattaccccttgggggatctgacccccaccactatggaagaggcgacctctggggttactcctggtaccctaccatccacaccagtcaccagtttccccgggatacctgatactctgccaccaggttcagccccactcgaggcgccgatgacccccgtgaccgatgatagcccccagaagaaaatgttgggacagaaggccactcccccccccagccctctgctctctgagctattaaagaaggggtcactgttgcctacaagcccaagattggtcaacgagtccgaaatggccgttgctagtgggcatctaaattcgaccggtgtccttctggaggtcgggggagtactgcccatgattcacggcggtgaaatccagcagacaccaaacaccgtcgcagccagcccagcggcgtcggaatctgtgtcgcaagccacaatcgtgatgatgcctgcactgcctgccccttcttcagcccccgcagtgtcaactaccgagtctgtggcacccgtgtctcagcctgacaattgcgtgcctatggaggccgtgggagacccccatacagtcaccgtgagcatggactcttccgagatcagtatgataatcaacagtatcaaggaagagtgctttaggtctggggttgccgaggcccccgtgggctccaaagcccccagtatcgacggtaaggaggagttggatttggctgagaaaatggatattgcagtgtcatatacaggggaggagcttgacttcgagacggtaggtgatataattgccatcatcgaggataaggtggatgaccaccccgaggtcctggatgtggcggccgtggaagcagccctgtctttttgcgaggagaatgatgaccctcagagcctgccggggccttgggaacatcccatccaacaagagcgtgataagcctgtccccctcccagcaccagagatgactgtaaaacaggagcggctcgattttgaggaaacggaaaataagggaatccacgaacttgtggatattcgcgagccctcagctgagatcaaggtcgagcccgccgagccagagcccgtaatatcgggggcagaaatcgtcgctggcgtcgtacctgcaaccagcatggagcctccagagctccggtcacaggacttagatgaggagcttgggagcacggccgcgggagaaatcgtggaggccgatgtggctatcggaaaaggcgatgagacccccctgactaatgtcaaaacggaagcctctccagagtcaatgctgtcgccatcgcatggatccaacccgattgaggatcctctggaggcagagactcaacataagttcgaaatgagcgactccttgaaagaagagtcagggaccatctttggttcacagatcaaagatgcacctggagaagacgaggaagaagacggcgtttcagaagccgctagcttggaagagcctaaagaggaagaccaaggcgagggttacctgtcggagatggataatgagccacctgtctcagagagcgacgatgggtttagtatccacaacgccaccctgcagagtcacaccctcgctgactctataccctcaagtcctgctagtagccagttctctgtgtgcagcgaagaccaggaagccattcaggcccagaaaatctggaagaaggccatcatgttggtatggagagctgcggccaatcacagatatgcgaatgtgttcctgcagccagtcactgacgatatcgctcctggatatcactcaattgtgcagagaccgatggacctgtctactatcaaaaagaatattgagaacggcctgatccgcagcaccgccgagttccagcgggatataatgctcatgttccagaacgccgtgatgtataactcatcagaccatgatgtctatcatatggcagtcgagatgcagagagacgtgctggaacaaattcagcagtttctggccacccagcttattatgcagacctcagaatcaggcatctccgcaaagagtctcaggggtagggactcaacaagaaaacaggatgcatccgaaaaagacggaggaacacgggggagacgctgcgccattgaggcggacatgaaaatgaaaaagtag

SEQ ID NO: 40642 - DNA, 3708 bp, Artificial Sequence
  Description of Artificial Sequence: Synthetic coding sequence
atggccaccggcaccggcaagcacaagctgctgagcaccggccccaccgaaccatggtcaatccgggagaagctctgccttgcaagctccgtaatgagaagtggcgatcaaaattgggtgagcgtctctagagccattaaaccattcgccgagcctggaaggcccccagactggttttcacagaaacactgcgccagtcagtactcggagctcctagaaaccactgagacgcccaagcgaaagaggggcgagaaaggcgaagtggtagaaactgtggaggatgtgatagtcaggaagctcacagccgagcgtgtggaggaactgaagaaggtcataaaggagacacaggaaaggtaccggcgtctgaaaagagacgctgagcttattcaagcggggcacatggactcccggctggacgagctctgcaatgatatcgccaccaaaaagaagctcgaagaggaggaggcggaagtaaaacgtaaggccacagacgccgcctatcaggccaggcaggctgtgaaaaccccccctcgtcgactgccaactgttatggttagatctcctattgatagtgctagcccggggggagattaccccctgggagacctgactcccaccaccatggaggaggcaacttccggcgtcaacgaaagcgagatggcagtggctagtggtcatttaaacagtaccggagtgctgctggaggttggaggagtgctcccaatgattcatggaggcgagatccagcagacacctaacacagttgctgcttcgccggccgcttctggagctccgaccctgtccagattgctagaagccggccccacacagttcaccacaccattagcttctttcactaccgtggcatcagaaccacccgtgaagctggtccccccccctgtggagagcgtctctcaagcaacaatcgtgatgatgcctgctctgcccgcgccctcctctgctcctgccgtgtcaaccaccgagtcggtggccccagtctctcagcccgataactgtgttcccatggaggctgtgggcgatccgcacaccgtgacagtatccatggactcatccgaaatttccatgattataaacagtattaaagaggagtgtttccgcagcggcgtagctgaagcccctgtgggcagcaaagcaccaagtatcgatggtaaagaggagctcgatctggcggagaaaatggacattgcagtcagctatacaggtgaagaattggatttcgagactgtgggcgacattatcgccatcatcgaggataaagtagacgaccaccccgaggtccttgatgtcgccgccgtggaggcagcgctgtccttctgtgaagaaaatgatgatccccaatcattacctggaccttgggaacatccaatccagcaggaaagggataagcctgtccctctgccggcccctgaaatgacagtgaagcaggaaagactcgattttgaggaaacagaaaacaaagggatccacgaactcgtagacattcgtgaaccttccgccgagataaaagtggagcctgccgagccagaaccagtgattagcggtgccgagatagtcgccggagtagtgccggcgacctccatggaaccacccgaactgcgatcacaggacttggacgaagaactaggctccacagccgccggcgagatagtggaagccgacgttgccattggaaagggagatgaaacacccctgactaatgtcaaaacggaagccagccccgagtccatgttgagtcccagtcacgggagtaatccgatcgaagacccccttgaagcggaaacgcagcacaagttcgagatgagtgactcacttaaggaagaaagtgggaccatcttcggctctcagatcaaagatgcccctggtgaagacgaggaagaggatggtgtcagcgaagccgccagcctggaagaaccaaaggaggaggaccagggagaaggctatttgagtgagatggacaacgaaccacccgtgagcgaatcagacgacggcttttcgattcacaatgccactctgcagtcccataccctggccgattcaattccatcctcaccggcttcaagccagttctctgtttgctctgaagatcaggaggcgatccaagctcagaaaatttggaaaaaagctatcatgctggtgtggagagcagcagccaaccataggtacgcaaatgtgttcttacagccggtaaccgatgacatcgcacccgggtaccactcgattgtacagcggcccatggatctgtccaccattaaaaagaacattgaaaatgggctcatacgtagcacggcggagtttcagcgtgatatcatgctgatgtttcagaacgctgtcatgtataattctagcgaccacgatgtttatcacatggccgtggagatgcagcgagacgtcttggagcagatccagcagttcctcgccactcagctgatcatgcagactagcgagtcgggtatttccgccaagtccctacgtgggagagatagtacgcgcaaacaggatgcatccgagaaggactctgttccgatgggctcacccgccttcctgctgtcgctcttcatggggcacgaatgggtatggctagacagtgaacaggatcatccgaatgacagcgaactaagcaacgattgtcggtccttattttcttcatgggattccagtctcgatctggacgttgggaattggagggagaccgaagatcccgaagccgaggaactggaggaatcatcccccgaaagggaacccagcgaattgctggtgggcgatggcggctctgaagagagccaagaagcagcacggaaagcaagtcaccagaatctcctgcacttcctctctgaggttgcctacctcatggaacccctatgtatctcatcaaatgagtcttcagagggttgttgccctccctcgggaacaagacaggagggtagagaaatcaaggcttctgaaggcgagagggagttgtgtagggaaacggaagaactctccgctaaaggcgacccactggtcgctgagaaacctctgggcgaaaacgggaaacctgaggtagcatccgcccccagtgttatctgcacagttcagggcctgctcactgaaagtgaagaaggggaagcgcagcaggagtcaaaaggtgaagatcagggagaagtgtatgtgtctgaaatggaggatcagcccccaagcggggagtgtgatgatgcctttaatatcaaggagactcccttggtggataccttattcagccatgcaacctcctctaagctgaccgatctgagccaggacgaccccgtgcaggaccatctgctcttcaagaaaactctgctacctgtctggaagatgatcgccagccacaggttcagtagcccatttctgaaacctgtctctgaacgacaggcccctggttataaagatgtcgtgaagcggcctatggatctgactagcctcaaaaggaacctgagcaaggggagaataaggaccatggctcagttcctgagagaccttatgctcatgtttcaaaatgccgtgatgtacaacgatagcgatcatcacgtgtatcacatggccgtggaaatgaggcaggaggtattagagcagatccaggtcctgaatatttggttagataagcgcaaggggagcagttcattagaaggagagccagcaaatccggtggacgacgggaagccagtgttctag

SEQ ID NO: 40643 - DNA, 2601 bp, Artificial Sequence
  Description of Artificial Sequence: Synthetic coding sequence
atggccaccggcaccggcaagcacaagctgctgagcaccggccccaccgagccttggagcatcagggagaaactgtgcttggcatcctcagttatgcgctcaggagaccagaactgggtttctgtctcgagagccattaagcctttcgcagagccaggccgccctcccgactggttcagtcagaaacactgcgcgtcccaatacagtgagctgctggagacaacggagaccccaaagcggaagcggggggagaagggagaagtggtagagacggtggaggatgtcatcgtgagaaagctgactgctgaacgagtagaggagctaaagaaggttatcaaggagactcaggagcgttatcggcgcctgaagcgggatgccgagctaattcaagcaggacacatggattcaaggttggacgagttatgcaatgacattgccacgaaaaaaaaactggaggaggaagaagccgaggtgaagagaaaagctaccgatgccgcataccaggctcggcaggccgtaaagacccccccgcgccggcttcccactgtgatggtccgatcgcctatcgactccgcttcgcccggcggtgactacccgctaggagatctaaccccaacaacgatggaggaggctacctctggagtgacccctgggacactgcctagtacacccgtcacctcatttcccggaattccagacactcttccacccggaagtgcacccctcgaagctcccatgaccccagttaccgatgactcaccccagaaaaaaatgctcggtcaaaaggccacaccacctcctagccccctcttgtccgagttattaaagaaggggagcttattacctacttctcctcgtcttgtgaatgagtccgaaatggctgtggcctctggtcatcttaattctactggtgtgctgctggaggtggggggcgtgctgccaatgatacacggtggagagatccagcaaacacccaacacggtggcggcgtcccctgctgcttcagtctcccagccagataattgtgtgcccatggaggctgtcggcgacccacatactgtgacagtgtccatggacagctcagagatcagcatgataattaattctatcaaagaggagtgttttcgctctggagtcgccgaagctcccgtggggagcaaagcgccctccatcgacggcaaagaggagttggacctggcagaaaagatggacattgcagtgagttacacgggcgaagaacttgacttcgaaactgtgggcgatatcatcgccattatcgaggacaaagtggatgaccatcctgaagtgctcgatgtggccgccgttgaagctgctttgtcattttgtgaggaaaatgatgaccctcagagcctcccagggccctgggagcatccaatccagcaggagagggacaagccggtgccattgccggccccagaaatgaccgtcaaacaggaacgactggattttgaagaaactgagaacaaaggaatccacgaattagtagatatcagagaaccttcggcggagataaaagtggaaccggcagagcctgagcccgtgatcagcggcgccgagatcgtggcaggcgtggtgccagcgacttcaatggaaccacctgaactgcgtagccaagacttggacgaggagctagggagcacagcagccggcgagatcgttgaggcggacgtggctatcgggaagggggatgaaaccccccttacaaatgtgaaaacagaagctagtcccgagtccatgctttcgccaagccatggatccaaccctatcgaggacccacttgaggccgagacgcagcataaatttgagatgagcgacagtttgaaggaggagagtgggactatcttcgggagccagataaaggatgcgcccggcgaggatgaggaggaggacggagtatcagaagcagcatctctggaggagccgaaggaggaagaccagggtgaaggctacctttccgagatggataacgaacccccagtgagcgagtcagatgatggttttagcattcataacgcaaccctccagtctcacactctggccgactcgatcccttccagcccagcttcttctcagttctcagtgtgctccgaagatcaggaggcaattcaggcacagaagatctggaagaaggccatcatgctggtctggagggctgccgcgaatcaccggtacgccaacgtgtttctccagcccgtcacagacgacattgcaccaggttatcactcgatcgtacagcggcctatggatctatctacaatcaagaagaatattgaaaatggactgatacgaagcactgctgaattccaaagagacattatgctgatgttccagaatgcggttatgtataactcttccgatcatgatgtgtaccatatggccgtcgagatgcagcgggatgtgctggagcagatccagcagtttcttgccactcagctcatcatgcagacttccgagtccggcatttcagccaaatcactcagaggacgcgatagcactcggaaacaggatgcctctgagaaggacggcggaactcggggccggcgctgtgcaattgaagccgatatgaaaatgaagaagtag

SEQ ID NO: 40644 - DNA, 2586 bp, Artificial Sequence
  Description of Artificial Sequence: Synthetic coding sequence
ggcaagcacaagctgctgagcaccggccccaccgagccctggagcatacgggaaaagctgtgcttagccagttccgttatgagatctggcgatcagaactgggtgagcgtgagccgcgcgattaaaccatttgccgaaccgggtagaccaccggattggttctctcagaagcactgtgccagtcagtactctgagctcctggaaactacagagactccgaagcgcaagaggggcgagaagggagaggttgtggaaacagtcgaagacgtgattgtgaggaaattaaccgccgagagggtggaggaactcaaaaaggtgattaaggagacccaggagaggtaccggcgcctgaagagagatgccgagctcatccaggcaggtcacatggattctaggctcgacgagctctgcaacgatattgcaactaaaaagaaactagaggaggaagaagccgaggtcaaacgcaaagccaccgatgcagcctatcaggctagacaggccgttaagactcctccacgacgccttccgacagtgatggttagatcaccaatcgactccgcatctcctggtggcgactaccccctaggcgatcttacgccaacaactatggaggaggccaccagtggagtgaccccagggacccttcccagtacgcctgtgacatccttccctggaattcccgatacactgccacctgggagtgcgcccctggaagccccgatgacgcctgtaacagatgactctccccagaagaagatgctgggccagaaggccacccctcctccttcccctttgctcagcgagctgctgaagaagggcagcttgctgccaacttctccccggttggttaacgaatccgagatggctgtggctagtgggcacctgaactccacgggcgtgctcttggaggtagggggggtgctacccatgatacatggaggggaaatacagcagacccccaataccgtggccgccagccctgcagcatctgtatcccagcctgacaactgtgtgcccatggaagccgtgggggaccctcacacagtgactgtctcaatggattcgagcgaaattagtatgattatcaatagtataaaggaagagtgttttcgcagtggagtagccgaagcacctgtagggagtaaggcgccaagcatcgacggtaaagaggagctcgaccttgccgagaagatggacattgccgtttcatatactggcgaggagctggacttcgaaaccgtgggtgacataattgccatcatcgaagacaaagtggacgatcatcccgaggtcttagatgttgcagctgtggaggctgccttgtcgttctgtgaagagaatgacgacccccagtctctgccaggaccctgggaacaccccatccaacaagaaagggacaaaccagtacctctcccagctcccgagatgactgttaagcaagagcgcctcgatttcgaggaaacggagaataagggcatacacgagttggtcgacatccgggagccctctgcagagattaaagtcgaacccgccgagcccgaaccagtgatctctggagcggaaattgtggccggggtggtccctgctacctcaatggagccccctgaactaaggagccaggacttagacgaggagcttggtagcacagcggctggagaaatcgtcgaagccgatgtggccattggaaagggcgacgagactccactgacgaatgtcaagacagaggccagccccgaatctatgttgagcccctcccacggctcaaaccctatcgaagaccctcttgaggccgagacacagcacaaatttgaaatgagcgattctttgaaagaagaaagcgggacgatctttggttcgcagatcaaggatgcacccggcgaagatgaagaggaagatggcgttagtgaagccgccagccttgaggaacccaaagaggaagaccagggggaaggttatctaagcgagatggataacgaacccccggtcagtgagagcgatgacgggttctccatccataatgcaaccctgcaatctcacacattggctgactcgatcccatcctcacccgcatcatctcagttctctgtgtgttcagaggatcaggaagcaatccaggcacagaaaatttggaaaaaagccatcatgttggtgtggcgggccgcagcaaatcaccgctacgccaacgttttcctgcaaccggtgaccgatgacatcgccccggggtaccattcaatcgttcagaggccgatggaccttagcaccattaaaaaaaacattgagaatggacttatccgcagcaccgcggaattccaaagagacattatgcttatgttccagaacgcggtgatgtataacagttccgaccatgacgtgtaccatatggccgtggagatgcagcgagacgttcttgaacagattcagcaatttctggctacccagttgatcatgcagacaagcgaatctggtattagcgcaaagagtctaagaggccgcgactctacaagaaagcaggacgccagcgaaaaggacggcggtacccgaggccggcggtgtgccatcgaagccgatatgaagatgaaaaagtag

SEQ ID NO: 40645 - DNA, 2679 bp, Artificial Sequence
  Description of Artificial Sequence: Synthetic coding sequence
ggcaagcacaagctgctgagcaccggccccaccgagccctggagcatcagggagaagttgtgcctcgcttccagcgtcatgcggtcaggcgatcagaattgggtgagcgtttcgcgtgcgatcaagccatttgccgaacccgggagaccacccgactggttctcgcagaagcactgcgcctcacagtattccgagctgctggagaccactgagacaccgaagaggaagcggggtgaaaaaggcgaggtggtggaaacagtggaagacgttatcgttcggaagctcaccgctgaacgcgtggaagaattgaagaaggttatcaaagagacacaagaaaggtaccgtcgactaaagcgagatgccgaactcatccaggccggccacatggactccagactggacgagctgtgtaatgatattgccaccaagaaaaaacttgaagaggaagaggccgaggtgaagcggaaagccaccgacgcagcatatcaggccaggcaggctgtgaaaacccctcctaggcggcttcctactgtaatggtgcgtagcccaatagacagcgcctctccagggggcgattacccgcttggggacctgacaccaactaccatggaagaagcaacatccggcgttacccctggaaccctccctagcacaccagtaacgtccttccctgggattcctgataccttgcctccgggttccgccccccttgaggcaccgatgaccccagtgacagatgactctccccagaagaaaatgctggggcaaaaggcaactcctccaccgtccccacttctgagcgaattgctgaaaaaaggctcactgttacccacatcccccagattggttaatgaatcagaaatggccgtagcttctgggcacctcaattccaccggtgttttgctcgaagtggggggcgtactgcccatgatccatgggggggaaatccagcagacgccaaacacagtggccgccagccccgccgcaagcgagtctgtctctcaggctaccatagtgatgatgcctgctcttccagctccttcctctgctcccgccgtatcaacgacagaatctgtggctccagtgtcccagccagataactgcgttcccatggaggcagtcggcgatcctcataccgtaactgtaagtatggactcaagtgaaatcagcatgataatcaacagcattaaggaggaatgctttaggtctggcgtggctgaggctcccgtaggttccaaggctcccagtatcgatggtaaggaagagctggatctggccgagaaaatggacatcgcagtgtcttacacaggtgaggagttagacttcgagacggtaggagatataattgctataatcgaggacaaagtcgacgaccaccccgaggtgctggacgtggccgctgtggaggcagcgcttagcttttgcgaagagaatgacgacccccagagtctcccgggaccctgggaacatccaatccagcaggagcgggataagcccgtgcccttgccagctcctgagatgaccgtgaaacaagagcggctggactttgaggagacagaaaacaagggcattcacgaactggtggacattagagaaccatcagccgagataaaagttgaacccgcggagcccgagcctgtaatcagcggtgccgagatcgtggcaggagttgtccctgctaccagcatggagccgccggagctacggtctcaagatctggacgaagagctcggtagcacagcagccggggagatcgtggaggctgacgttgcaataggcaagggagacgagactcccctgactaatgtcaagaccgaagcgagtcctgagtccatgcttagcccgtcccatgggagcaacccaatcgaagatccgctggaagccgaaactcagcacaaattcgaaatgtcagattcactgaaggaagagtccgggacgattttcggctcccaaatcaaggatgcaccaggggaagacgaggaagaggatggggttagcgaggcagcttctttggaagagccaaaagaggaggaccaaggggagggctatttgagtgagatggataacgaaccccctgtaagcgagtccgacgacggcttctccattcataatgctaccctccagtctcacaccttggcagacagcatcccttcatccccagcctcctctcaattttccgtgtgctcagaggaccaggaggccatacaagcccagaagatctggaaaaaggcaatcatgcttgtatggcgagctgccgctaatcatcgctatgcaaacgtgttccttcagcctgtcacagatgatatcgcaccaggctatcacagcatagtccagcggcccatggacctttccacaattaagaagaatattgagaacggcttgattcgcagtaccgccgagtttcagcgggatataatgcttatgttccaaaacgctgtcatgtacaactcctctgatcatgatgtgtaccacatggcggtggagatgcagagagacgtactcgagcaaatccagcagttcctggccacacagctgattatgcagacaagcgagagcggtatatcagcaaagtctttgcgtggtcgagactccactcgtaaacaagacgcctcggaaaaggacgggggcacccgcggaaggcgctgcgctattgaggctgacatgaagatgaagaaatag

SEQ ID NO: 40646 - DNA, 2514 bp, Artificial Sequence
  Description of Artificial Sequence: Synthetic coding sequence
atggtgcacccccgggaggccatgttcagcatcttctgccacgagaagtggaggtctaagttgcactgtgcaagccagtatagtgagctcctggagacaactgagacaccaaaaaggaagcggggcgagaagggcgaagtggtcgagactgttgaggatgttatcgtgcgcaaactgaccgccgaacgggtggaggaactgaaaaaggtaatcaaggagacacaggaacggtacaggcgcttgaagagagacgctgagcttatccaggccggccatatggacagtagactggatgagttgtgtaatgatatcgccacaaagaagaagctggaagaagaggaggccgaagtgaaacgcaaagcaaccgacgcagcataccaggcaaggcaggcagttaagacacctcccagaagactaccgactgtgatggtgagaagcccaattgattctgcgagtcctggcggggactaccctctgggggatctgactcctactacaatggaagaagctacatccggggttaatgaatccgagatggctgtggcctccggccacctaaattccaccggcgttctgttggaggttggtggcgtcctcccgatgatccacggtggggagattcagcagactcccaacacggttgcagcgtcacctgcagcttccggggcaccaacgctgagtcggctgctcgaagctgggcccactcaatttacgacacctctagctagctttaccacagttgctagcgaacctccggtgaagctggtacccccgcccgtggagtccgtgagtcaagccactattgttatgatgccagccctgccggcaccaagcagcgcgcccgccgtaagcaccactgaatcggtggcccccgtgagtcagcctgacaattgtgtgccaatggaggcggttggagatccacacaccgtcaccgtgtccatggattcatctgaaatcagtatgataataaattctatcaaggaagagtgttttcggagcggagtcgccgaggcccccgtagggagcaaggccccatccatcgacgggaaggaggaattggatctggccgagaaaatggacatcgctgtcagctacaccggtgaagagctggatttcgaaacagttggtgatattatcgcaataattgaagacaaggtcgatgatcaccccgaggtgctcgatgtagcggccgtggaagccgctctctcattttgcgaagaaaacgatgacccacaatcgctcccaggcccatgggagcacccgatacaacaggagcgagataaacccgtccccctccctgcccctgaaatgacagtgaaacaggagaggttggactttgaggaaactgagaataagggcatacatgagctggtggacattagggagccaagtgccgaaatcaaggtcgaacccgcggagcccgagcctgtgatttcgggtgctgagatagtggcaggagtggtgcctgccaccagtatggagccgcccgaactcagatctcaggatctggatgaggagctaggctccactgccgctggtgaaatagttgaggcagatgtggcgatcggcaagggagacgaaacacctctcaccaacgtcaagacagaagccagcccggagagcatgctgtcaccaagccacgggtcaaatcctatcgaggacccactcgaggcggagactcagcataagttcgaaatgagcgactctctgaaagaggagtccggaaccattttcggcagccagatcaaagacgcaccaggcgaggatgaagaggaagacggcgtatcagaagcagcaagtctggaggagccaaaggaggaagaccagggagaaggctatctgagcgagatggacaatgagccgccagtaagtgagtccgatgatggctttagtattcacaatgcaaccttacagtcccacaccttggccgattcaataccatcctctcctgcttcttcccaattctcagtatgttctgaggaccaggaagccatccaagcccagaagatctggaagaaagctatcatgctggtgtggcgcgctgctgctaatcataggtacgcaaatgtattcttgcaaccagtaactgatgacatagctcccggatatcactctattgtccagcgccccatggacctcagcactatcaaaaaaaatatcgaaaacggcctgatcaggtctacggcagaattccagcgtgatatcatgctgatgttccagaatgcagttatgtataactcttctgatcacgacgtgtaccatatggccgtggaaatgcagcgcgatgtgttggagcaaattcaacagtttttagccacccagctcattatgcagacttcggaatccggcattagtgctaaatcgcttcgcggcagagattccactcgcaagcaagacgcctccgaaaaggattctgtacccatgggaagtcccgccttcctgctgtccctgttcgatggagggacccgaggaaggcgttgtgcaatagaagcagatatgaaaatgaaaaagtag

SEQ ID NO: 40647 - DNA, 3315 bp, Artificial Sequence
  Description of Artificial Sequence: Synthetic coding sequence
atggcccggcggggcaagaagcccgtggtgcggaccctggaggaccttactctcgacagcggctatggcggagcagcagattccgtgcgaagctctaacctgtctctttgctgcagcgacagccaccccgccagtccatacggtgggtcttgttggccacctttggctgatagcatgcatagcaggcacaactcgttcgataccgtgaacactgcccttgtggaggacagcgaaggcttggactgcgcagggcagcactgttcaagattactccccgatttagacgaggtcccctggacactgcaggaactcgaagcgctcttgttgcggtcccgcgatccgcgcgctgggcccgccgtaccgggcggactccctaaagacgccctggctaaactttcaaccctcgtgagcagagcactggtgagaattgcgaaagaagcgcaaagactatcactgcgatttgccaaatgtacaaaatatgagatccagagcgccatggaaatcgttctgtcctggggcctggccgcccactgcacggctgcagctctcgcagctctgtcattatacaacatgagttcagccggaggggatcgcctgggccgtggtaagtcggctagatgcggcctcaccttttccgtaggcagagtatacagatggatggtcgactcgagggtagctcttcgcattcacgagcacgctgctatttatcttactgcctgcatggagtctttgttccgggatatttactcaagagtggtggccagtggtgtgcctaggagttgctctggtcctggcagcgggagcggcagcggacctggtccaagttccgggcctggtgctgcacccgccgcggacaaggagcgggaagcacccggagggggagccgccagcgggggcgcatgctccgcggcctcgagcgcatccggcggctcaagttgctgtgccccgcctgcagctgcggccgcagctgtgccaccagcagctgcggccaaccatcatcatcatcaccatcacgcactgcacgaagccccaaagttcaccgtggagacccttgaacacaccgtgaataacgattcggagatctggggattgctgcagccttatcaacatctgatctgtggaaagaacgctagcggcgtgttgtgtttgcctgatagccttaatctacaccgcgatccgcagcggtccaataagccaggagagctccccatgtttagccagtccgaattgaggacgattgagcagtcccttctggctaccagagtgggcagtattgctgagctgtcagacctcgttagccgcgccatgcatcatctgcagcctctcaatgccaagcaccacggtaacgggacaccactgcatcataagcagggcgctctgtattgggagcccgaagcgctgtacaccctgtgttatttcatgcattgtccacagatggagtgggaaaatcctaacgtggagccgagcaaggtcaacctccaggtggagcggccattcctggtcctgccaccattaatggaatggatacgtgttgctgtagctcacgctggacaccgaaggagctttagcatggattccgatgatgtgagacaagccgctcgcctgctgctgccaggcgtggactgcgagcctcgacagctgcgggctgacgattgcttctgcgctagccgaaaattggacgccgtggccattgaggctaagtttaaacaggacctcggtttccgaatgctcaactgcggtcgcaccgatctcgtgaagcaggccgtgtctctacttggacccgatggcataaacacaatgtctgagcaaggcatgacccccctcatgtacgcctgtgtacggggggacgaagccatggtgcagatgctcctggacgctggagccgatcttaatgttgaagttgtatcaaccccacacaagtatccatccgtgcaccctgagaccaggcactggactgcactgacctttgctgtgttgcacggacacatacccgtggttcagttactcctcgacgccggagctaaggtggaaggtagcgtggagcacggcgaggaaaactactccgagactcccctgcagcttgctgccgctgtcgggaactttgagctggtcagcctgctgctggagcggggcgccgatcccttgatcgggactatgtatcggaacggaatttcgaccacaccgcagggcgatatgaattccttttcccaggcggccgcacatgggcacagaaatgtctttcgaaaactcttagcgcagccggaaaaggagaaaagtgatattctctctctggaagagattctcgctgaaggcactgacctggcggaaactgccccgccccccctgtgtgcctcgcggaatagcaaggccaaactacgagcgttacgcgaagctatgtaccactcggccgaacacgggtacgtcgacgtgacaatcgacattcgcagtatcggcgtcccttggaccctccatacatggttagagagtctgaggattgcgtttcagcagcaccggaggccactgattcaatgtctgctgaaggagttcaagacaattcaagaggaagaatacaccgaggagttagtgacacaagggttacctttgatgttcgagatcctgaaagcatccaagaacgaggtgatcagccagcagctgtgtgtgatttttacccactgctacgggccttaccccattcctaagctgacggaaattaagcgaaagcaaacatctcggctggaccctcattttctgaacaataaggagatgagtgatgtgacatttttggttgaggggcgccccttttatgcacacaaagtactgctgttcaccgcttcacctaggtttaaagcattacttagtagcaagccgaccaatgatggcacttgcattgagatcggttacgtgaagtactctatcttccaactcgtgatgcagtatttgtactacgggggtccggagtccctcctcattaagaataacgagatcatggagctactgtccgccgctaaatttttccagttagaggcactacaaagacattgcgaaatcatctgcgcaaagtcaattaatactgacaactgcgtcgacatctacaatcatgctaaattcctcggagtgaccgaactgtccgcgtactgtgagggatattttttgaaaaacatgatggtcttaatagagaacgaggcatttaagcagctgctctacgacaaaaacggcgagggtaccggtcaagacgtgcttcaggatttacagaggacactcgccattaggattcagtctatccatttgtctagcagcaagggctccgtcgtgtag

SEQ ID NO: 40648 - DNA, 1926 bp, Artificial Sequence
  Description of Artificial Sequence: Synthetic coding sequence
atgcggaagctgcggcccaaggacagccgggagcccgcccccggctctcccgtgcgctccggttgcttgcagcgtctcagccactattcaggcatccagcggccattcctggtgttgcccccactcatggagtggatccgtgttgccgtagcccatgctggccacaggaggtccttctccatggactctgacgacgtccgacaggccgcccggctgctccttcccggcgtagattgtgagccacgccaactccgggccgatgactgtttctgcgcatcacgcaaactcgatgcggtggctattgaagctaaattcaagcaagacctaggcttccggatgctgaattgcggacggactgatttagtgaaacaggccgtgagcctgctggggcctgacggtattaacaccatgagcgaacaaggcatgaccccgcttatgtatgcttgtgtgcgaggagacgaggccatggtgcagatgctgctggatgctggagccgacctgaacgttgaggtcgtttctaccccccacaagtacccctccgtacaccccgagacccgtcactggaccgcgttgacctttgccgtactccacggtcatatcccagtggtgcagttgcttttagacgctggcgctaaagtggaaggaagtgtggagcacggtgaggaaaactactccgagactcctctgcaactagccgcagccgtgggaaatttcgagcttgtcagcctgctcctggagcgcggcgccgatccccttattggcacaatgtatcgaaacgggatttccacaactccccagggtgatatgaatagtttcagtcaggccgctgcccatgggcacagaaatgtgttccgcaaactactcgcccagccagagaaagaaaaaagcgacatccttagcttagaagagatcctggctgaaggaacagacctcgccgagaccgctccgcctccgttgtgcgcatcacgaaattcaaaggcgaaattgcgggccctcagggaagccatgtaccatagtgcagaacacggctacgtggatgtgactatagacattaggtcgatcggcgtcccttggacactgcatacttggctggagagcctccgcattgccttccaacagcatagacgcccccttatccagtgtctgctaaaggagtttaaaacaattcaagaagaggagtatacagaggagttggtgacccagggtttgcccctgatgtttgaaatcttgaaggcctccaagaatgaagtcatttcccagcaactgtgtgtcatcttcacgcactgttatgggccttaccctatacccaagctgaccgagatcaaaaggaaacagacatcccgactcgacccccattttcttaataacaaggagatgtcagacgtcaccttccttgtggagggccggccattctatgcacacaaggtactgctcttcacagcttctccgaggtttaaggcactactgtcttccaaacctacaaatgacggaacttgtatcgaaattgggtatgtcaaatacagcatcttccaactggttatgcagtacctctattacggaggaccagaatctctgttgattaagaataacgaaattatggagttactgtctgcagcgaagtttttccagctggaagctctgcagaggcactgcgagattatatgcgccaaatctatcaatacagataactgcgtggacatatacaaccacgccaagttcctgggtgtgaccgagcttagcgcctattgcgaggggtacttcctgaaaaacatgatggtgttgatcgagaacgaagcctttaagcagctactctacgacaagaatggagagggaacgggccaggatgttctgcaggacctacaaaggactctggcaattaggattcaatccatacacctaagcagtagtaaagggagcgtggtgtag

SEQ ID NO: 40649 - DNA, 2958 bp, Artificial Sequence
  Description of Artificial Sequence: Synthetic coding sequence
atggcccggcggggcaagaagcccgtggtgcggaccctggaggacttaacgttggatagcgggtatggcggggccgccgactctgttcggtcatcaaacctatccctgtgctgttcagattctcacccagccagcccctatggaggcagctgttggccaccccttgctgacagcatgcactcccgccataacagctttgacacagtgaataccgcactcgtggaggacagtgaaggacttgactgtgccggtcagcattgttcaagactgctgcccgacttggatgaggtcccctggactctccaggaacttgaggcattacttcttcgttctcgcgacccacgcgctggcccggccgtaccaggaggcttgcccaaagatgcactggcaaagttatcaacattagtcagtcgtgcactggtgcgcatcgccaaggaggcacaacgtctgtcgcttagatttgccaagtgtaccaagtatgagattcagtcagcaatggagattgtgctttcttggggactggccgcccattgcactgcagccgcccttgcagccctctcattgtacaatatgagttcggcgggtggcgatagactggggaggggaaagagtgcccgatgcgggcttacgttctctgtggggcgggtgtaccgatggatggtggattctcgggtggcactcagaatacacgaacacgcagccatttatttaaccgcctgtatggagagcctgtttagagacatatatagccgggttgtcgcaagcggcgtgccgaggagttgctccgggccagggtctggctccggttcgggacctggaccatcatctgggccaggcgccgcgcccgccgccgacaaggagcgggaagccccaggcgggggtgcggcaagcggcggggcctgtagtgcggcctcctccgcaagtggtgggtctagctgctgtgccccaccagccgctgctgcggctgctgtgccccccgccgctgcggcaaaccatcaccaccaccaccatcacgctctgcacgaggctccaaaattcacagtagagacccttgagcacaccgttaacaacgattccgaaatatggggactcctgcaaccgtaccagcatcttatttgtggtaaaaatgcgagtggagttctatgcctacccgatagcctgaacttgcaccgggatccccagaggtctaacaaaccaggagaactgcctatgttctctcaatccgagctgaggacgattgaacagtctctcctggccactagagtcggctctatcgctgagctcagcgatctggtgtctcgggccatgcatcaccttcagccgcttaacgcaaagcaccatgggaatgggactcctctgcatcacaaacagggagccctgtattgggaacctgaggccctgtatacactctgctatttcatgcactgcccacagatggagtgggaaaatcctaacgtggagccatctaaagtgaatctgcaggtggagcgtcctttcctcgttctgcccccactgatggaatggattagggtggccgttgctcacgcaggtcacaggcgctcattttcaatggattctgacgatgtgcgccaagccgcccgcctcctgctacccggtgtggactgtgagccccggcagctgcgagctgatgattgcttttgtgcgagtcggaagctcgacgctgttgccatcgaggccaaatttaaacaggacctgggcttcaggatgctcaattgtgggcgaaccgacctagtgaagcaggcagttagtctgcttgggcctgatggtataaatacaatgtctgagcagggcatgacacccctgatgtatgcatgcgtgcgcggggatgaggccatggtccaaatgttgttagatgcaggggccgacctcaatgtcgaagtcgtaagtactccacataagtaccccagcgtacatcccgagacgaggcattggacagccctgacatttgcggtgctgcacggccacatccctgtggtgcagctgcttctggatgctggtgctaaagttgaggggagcgtggagcacggcgaggagaactattctgaaacccccctgcagctggccgccgcggtgggggttccttggactctccatacttggctggaaagtcttcgcatcgctttccaacagcatcggcgcccgctgattcagtgtcttcttaaggaattcaagaccatccaggaggaggagtataccgaagagttagttacacagggcctgccattaatgtttgaaattctgaaggctagtaaaaacgaagtgatcagccaacagctctgtgtgatatttacccactgctacggaccttaccctatccctaaattaacggaaataaagcggaagcagacatccaggctggacccccacttcctcaataataaggaaatgagcgacgttactttccttgtggaggggaggccattctacgcacacaaggtgttattgttcactgcctccccgagatttaaggctttactaagctcaaagcccaccaatgatggaacctgcattgagataggctatgtgaaatactcgatcttccagctggtgatgcagtacctgtactacgggggtccggagtccctcctgataaaaaataatgaaatcatggagctgttgagcgccgcgaagttcttccaattggaagcactgcagcgccactgtgagattatctgcgctaagagtattaacaccgataactgcgtcgatatttacaatcacgccaagttcctgggcgttacggagctgtccgcttactgtgaaggatattttctcaaaaacatgatggtgctgattgagaacgaggcgtttaagcagcttctgtacgataagaacggtgaaggtactggacaggatgtcttgcaggacctgcagagaacccttgccatcagaatacagtccatccatctctccagtagcaaaggttccgtcgtctag

SEQ ID NO: 40650 - DNA, 3024 bp, Artificial Sequence
  Description of Artificial Sequence: Synthetic coding sequence
atggcccggcggggcaagaagcccgtggtgcggaccctggaggacttaactctcgattccggatatggtggggccgctgattccgtacggtcaagtaatttatccctgtgttgtagcgacagtcaccccgcatccccttacggcggtagttgctggcccccactggcggattccatgcactcccggcataattcatttgacacagtaaatactgccttagtcgaggactccgagggacttgactgtgctgggcagcattgtagtcgcctcctgcccgacttggacgaggtcccctggactttgcaggaattagaggcactgctcctgagaagtcgtgaccctcgagctggtcccgcagtgcccggcgggcttcctaaagatgcactggcaaagctgagcacccttgtctcccgcgcgcttgtgagaattgctaaagaagcccagaggttgtctctgcgattcgccaagtgtactaaatacgagatacaatccgcaatggaaatcgtacttagctggggtcttgccgcccactgcaccgccgccgcattggcagctctctccctatataacatgtccagcgccggaggcgataggctgggtagggggaaaagtgcccgatgcgggctcactttctctgtgggtagggtgtaccgctggatggtagactcccgcgtagcactgaggatccacgagcatgctgcgatttacttgactgcttgcatggaaagtctgttcagggacatttacagtcgcgtcgtcgcgagcggagtcccacgcagctgtagcggacccgggagtgggagcgggagcggtcctggtccttcttccggacccggggccgcgcccgctgcagataaggaaagggaggcaccgggcgggggtgctgcctctggaggggcatgttcagccgcgtctagtgcgtcaggcgggtctagttgctgcgccccgcctgccgcggccgcagcagccgtccctccagcggccgctgcaaatcaccaccaccatcaccaccacgcgctgcacgaagctccgaaatttaccgtggagacactggagcacaccgtgaataatgattctgagatttggggccttttacaaccttaccaacacctcatctgcggaaaaaatgcgtccggagtgctatgtctccctgactctttgaatctgcatagagatccccagaggtcaaataagcctggggaactgccaatgttttcacagagcgagctgcggaccatagagcaaagtctcctggctaccagagtgggttcaatcgcagaactcagtgatttagtctcacgcgctatgcaccatctgcaaccattaaatgctaagcaccatgggaacggtacccctttgcaccataagcaaggtgccctttactgggagcccgaggccctgtatactttgtgttactttatgcactgcccacagatggaatgggagaatccgaacgtggagccctcgaaagtgaatcttcaggtggagcggccttttctagtgctgcctccactaatggagtggatccgggtcgccgtggcccatgcgggacacagacggtcgttttctatggattctgatgatgtccgacaggcggcccgcttactgttacctggagtagactgcgaaccgaggcagctccgggcagacgattgcttctgcgccagcagaaagctcgatgcagtcgcaatcgaggcaaaatttaagcaggatctcgggttcagaatgttgaactgcgggcgtaccgatttggtgaaacaggcggtttccctcctaggcccagatggaattaatacaatgtccgaacaggggatgaccccactcatgtatgcttgtgtccggggcgatgaggcaatggtgcagatgctccttgatgcaggcgcagatctaaatgttgaggtggtcagcacaccgcataagtatcccagtgtgcacccagagacccggcactggaccgccctcaccttcgccgtgttgcatggccacatacccgtcgttcagctgctgctcgatgctggcgctaaagtggaggggtcggtggaacacggggaagagaactactcagaaactcctctgcagctcgcagccgccgtggggaatttcgagcttgttagcctcctcctggagcgcggggccgaccccttgatcgggacaatgtatagaaatggcataagtaccactccgcaaggcgacatgaacagtttctctcaggcggcagcccatggccaccggaatgtttttcgtaaactgttagcccaacccgagaaggagaaatccgacatcctgagtctcgaagagattctggccgagggaactgatctggcggaaacggctcccccacccctgtgtgcctctagaaactctaaagctaagctcagggcccttcgggaggctatgtaccactccgctgaacacggctatgtggacgtcacaatcgacatccgctcgataggcgtcccgtggacactgcacacttggctggagtcattgcggatcgcctttcagcaacaccgaaggcctctgatccagtgcttactcaaggagttcaagaccattcaggaggaggaatatacggaggaactcgtgacccagggcctacctctgatgtttgagatcctcaaagcttcaaagaacgaagttatctcccagcagctttgtgttatctttacccattgctacggaccttatccgatccccaaacttacagagatcaaacggaagcagaccagtagacttgacccgcatttcctcaacaataaagaaatgtccgacgtgacgttcttagtggaggggaggcctttttacgcccacaaagtgcttctgttcacagccagtccacggttcaaggcactgctctccagcaaacccactaacgacggcacttgcattgagatcggatacgttaaatactcaatatttcaactagtgatgcagtacctttactacggcggccctgagagtttactgattaaaaacaatgagatcatggaggttcgcgaccccctctggtgctggctttcatag

SEQ ID NO: 40651 - DNA, 552 bp, Artificial Sequence
  Description of Artificial Sequence: Synthetic coding sequence
atgagcgacgtgaccttcctggtggagggccggcccttctacgcccacaaggtcctcctcttcactgcgagcccgcgcttcaaagccttactgagttccaagccaaccaacgacggcacctgcatcgagatcggctacgtgaaatattccatcttccagctggtgatgcagtacctgtactatggtggccccgagtccttgctcatcaagaacaatgagatcatggaattgctgtctgccgctaagtttttccaattggaggcactccagaggcactgcgagataatttgtgcaaagtccattaatacagacaactgcgtggatatctataaccacgccaagtttctcggggtcaccgaactgtccgcatactgcgagggctactttctgaagaatatgatggtgttaatagaaaatgaggcatttaagcagctgttgtacgacaagaatggcgagggcaccggtcaggacgttctgcaggacctgcagagaaccctggctattaggatacagtccattcacttgtctagtagtaaaggctccgtggtctag

SEQ ID NO: 40652 - DNA, 987 bp, Artificial Sequence
  Description of Artificial Sequence: Synthetic coding sequence
atgtgccaccagcagctggtgatcagctggttcagcctggtgttcctagcttcccctctggtggccatttgggagctgaagaaggatgtgtatgtggttgagctagattggtatcccgacgctccaggcgagatggtggtgctcacgtgtgacacccctgaggaggatggtatcacctggactctagatcagtcctctgaagttctcggatctggaaagacgctgacaattcaggttaaagaattcggcgatgctggccaatatacctgccataagggcggcgaagtgttgtcgcattccttgctgctgctacacaaaaaagaggatggtatttggtccacagatattttaaaggaccagaaggagcccaaaaataaaacatttttacggtgtgaggctaaaaactatagcggcagattcacatgttggtggcttacaactatttctacggatttgactttctcagtgaagagctcgcgaggttcctctgatccccagggcgtcacctgcggcgcagcaacgctcagcgccgagagagttcgaggggataacaaggagtatgagtattctgtcgagtgccaggaagacagcgcctgcccagcagccgaagagagtctgcccatcgaagtaatggtcgacgctgttcataagctcaaatatgagaactacacctcctcattttttattagggatatcattaagcccgatccacccaagaacttgcagctcaagcctctgaaaaacagcaggcaggttgaggtttcctgggaatacccagacacatggtccacaccacacagctacttttctctaaccttttgtgtccaggttcaaggcaagagtaaaagggagaaaaaagacagggtattcacagataagacatcggcgaccgtaatctgtcgaaagaacgctagcatctccgtccgagcacaagaccgctattattctagctcatggagcgaatgggcatcagtaccttgcagctag

SEQ ID NO: 40653 - DNA, 1503 bp, Artificial Sequence
  Description of Artificial Sequence: Synthetic coding sequence
atggccctgatgctgagcctggtgctgagcctgctgaagctgggcagtggccagtggcaagttttcgggccggacaagcctgtgcaagccctagtcggcgaggatgccgcattctcttgcttcttatctccaaagaccaatgccgaagccatggaggttcgatttttcagaggccaattttcgtctgtcgtgcacctgtatcgggatggtaaagaccagcccttcatgcagatgccacaataccagggcagaacaaagctggtcaaggattcaatagccgagggcagaatcagtctaagactagagaatatcaccgttctcgacgccgggctctatgggtgccgcataagttcacaatcctactatcaaaaagcaatttgggaactgcaggtttccgctttgggcagtgtgccactgatctctatcaccggctatgtggaccgtgatatacagctgctgtgccagagtagcggatggttccctagaccaactgcaaagtggaaggggcctcagggccaggacttgtcaaccgacagtaggacaaaccgcgatatgcatgggctgttcgacgtagagatttccctgacggtacaagagaatgccgggtctatctcatgctccatgcggcatgctcacttgtcccgggaggtggagtcccgagtgcaaatcggcgataccttcttcgagccgatctcctggcacttggcaactaaagtattggggatactttgctgcggattgtttttcggcatcgtagggttaaaaattttcttttctaagttccagtggaaaatccaagccgaactcgattggcggaggaagcacggacaggccgagctgagagacgcgcggaaacacgctgtggaagtaaccctcgatcccgaaacagcccatcctaagctctgtgtgtcggatctgaagactgtgacccacaggaaggctcctcaggaggtgccacatagcgagaaaagattcacacggaagtctgtcgtggcctctcagtcatttcaggcaggtaaacattattgggaagtagacggcggtcataacaagaggtggcgtgtcggagtgtgccgggacgatgtagatagacggaaggaatacgtgaccctttcgcccgaccatggatattgggtccttcgactgaacggcgagcatctttacttcaccctcaacccccggtttatcagcgtcttcccaaggaccccccctaccaagatcggagtgttcctcgactacgagtgcggaactatctccttcttcaacattaacgatcagagcctgatctacactcttacttgtagattcgaggggctgcttcggccgtatattgaatacccatcctacaacgaacagaatggtacacccattgtgatctgccccgtaacccaggagtccgagaaggaagcttcctggcagagagcctctgccattcctgagacaagcaactccgaaagctcatcacaagcaactactccatttttgcccagaggagaaatgtag

SEQ ID NO: 40654 - DNA, 951 bp, Artificial Sequence
  Description of Artificial Sequence: Synthetic coding sequence
atgcacggcctgttcgacgtggagatcagcctgaccgtgcaggagaacgctggaagtatcagctgcagcatgcgccatgcacacctgagtagggaggtggagtctcgcgtgcagatcggcgataccttctttgaacctatcagttggcatcttgccactaaggtgctcggtatcctatgctgcggcctattcttcggcatcgtgggactgaaaatctttttttctaagtttcagtggaaaatacaggccgaacttgattggcgccggaagcacggacaggctgagctcagggatgcccgtaaacatgccgtcgaggtgactctagaccccgaaactgctcaccctaaattgtgcgtgagtgacttgaagacagtgacccatcgaaaagcaccccaagaagtgccgcactcagagaagcgattcactagaaagagcgtggttgcatcacaaagctttcaggccggcaaacactattgggaggtggacgggggtcacaataagcgatggcgggtgggcgtgtgtcgagacgacgtggaccggagaaaagagtatgtgacccttagccccgaccacgggtactgggtgctgagactgaatggcgaacatctctattttaccctgaacccccgcttcatctcagtttttccacgcactcccccgactaagatcggcgtctttctggactatgaatgcggtactatatccttttttaatattaacgatcagtcacttatttatacactgacatgtcggtttgaaggactccttaggccgtatattgagtatcccagctacaacgagcagaacggcacccccatagttatttgcccggtcacacaggagagcgaaaaggaagcctcgtggcagagagcatcagccatccctgaaacatcgaactcggagtcttcgtcccaggccactacccccttccttccacggggcgaaatgtag

SEQ ID NO: 40655 - DNA, 1128 bp, Artificial Sequence
  Description of Artificial Sequence: Synthetic coding sequence
atgtggacctggttcgtgaagagcctgggcagcgtgcccctgatctctatcacagggtatgtggatcgtgacattcagctgttatgccagtcaagcggctggttcccccgacccacggccaagtggaaaggaccccaaggtcaagacctgtctactgactctaggactaacagagatatgcacggactcttcgatgtggaaataagtctcacagtacaggagaacgccggaagcatcagttgttctatgagacatgcccatctctccagagaagtggagagcagggtacagattggagatactttttttgagccaatttcttggcacctcgctactaaggtgctgggcatcttgtgttgcggcctgttcttcgggatagtgggcctgaagatctttttttccaaattccagtggaagatccaggctgaactggattggaggagaaagcacggtcaggcagaactgcgagatgcaagaaaacacgccgttgaagtgacactggatcctgagaccgcccaccccaaactgtgtgtgagtgatttaaagactgttacgcatcggaaggccccccaggaggtcccccatagcgagaagcgatttacaaggaagtccgtggtggcttcccagtcctttcaggccgggaaacactactgggaagtcgacggcggtcataacaagagatggcgtgtaggggtgtgtagggatgacgtggaccgcagaaaggagtacgtgacactcagcccagatcatggctattgggtgctgcgtctcaacggggagcacctgtattttacgctgaaccctaggttcattagcgtgtttccccgcacccccccaacaaagatcggagtgtttctggactatgagtgcgggacaattagcttctttaacattaacgaccagagcttgatatacaccctaacctgtcgtttcgagggcctgctgcgcccttatatcgaatatccctcctataatgagcaaaatggaacacctatcgtgatttgtcccgttacccaggagagcgagaaagaagcctcctggcagagagcctcggcgatccctgagacctcaaattctgaaagctcgtctcaagcaaccacaccatttttaccccgaggtgagatgtag

SEQ ID NO: 40656 - DNA, 1023 bp, Artificial Sequence
  Description of Artificial Sequence: Synthetic coding sequence
atggccctgatgctgagcctggtgctgagcctgctgaagctgggctccgggcagtggcaggtgtttggccctgacaaaccagtgcaggctttagtgggggaggatgcagcctttagctgcttcctgtcgcctaaaacaaacgcagaagcgatggaggtccggttttttagaggacagttttcttctgtggtgcatctctatagggacgggaaggaccagcccttcatgcagatgccgcagtatcaggggcgaactaagcttgtgaaggactccattgcagaggggcgcataagcctccgcctggaaaacatcacagtgctggacgcggggctgtacgggtgtcgcatctctagtcagtcttactaccagaaggctatatgggagttgcaagtcagtgctctagggagtgtgccactgatatccattactggttacgtcgatcgggatattcagttgctttgccagtcttctggatggttccctagacccactgccaaatggaaaggaccacagggccaagacctctcaacagattccaggactaatagagacatgcatgggctgttcgacgttgaaattagtctaaccgttcaggagaacgcgggctctatctcttgtagcatgaggcatgctcacttgagccgcgaagtggagtctcgggtccagatcggcgatacgttttttgagcccatatcctggcatctggctactaaggtcctcggaatcctgtgctgcggtctattttttgggattgtgggcctcaagattttcttcagtaagtttcagtgtaagcgcgaacgcgaggcctgggctggcgccctgttcatggtccctgccggcactggaagcgaaatgttgccccaccctgcagctagtctgctgcttgtactcgcctcccgaggacctggtcccaagaaactggaaaagaaggctcgcacaggcagaatagagcggagacctgagacacgttctggcggcgatagtgggagccgcgacggatctcccgaagcactccgtttctag

SEQ ID NO: 40657 - DNA, 1155 bp, Artificial Sequence
  Description of Artificial Sequence: Synthetic coding sequence
atggccctgatgctgagcctggtgctgagcctgctgaagctgggcagcgccttgggctcagttccattaatcagcatcaccggctacgtggaccgcgatatccaactgctatgtcagtcttcagggtggttccctaggccaactgccaagtggaaggggcctcagggccaggacttatcaacggattccagaacgaatcgggacatgcatggcttgtttgatgtggagatttctctgaccgtgcaggagaacgccggatccattagctgctctatgaggcatgcccacctctctagagaggtagagagtcgtgtgcagattggtgatacgtttttcgaaccaattagctggcatttggccaccaaagttttaggtattctgtgctgcggactgttctttgggatcgtgggcctcaagatttttttctcaaaattccaatggaaaatccaggccgagcttgactggcgacggaagcatggccaagcagaactaagggatgcgagaaaacatgctgtcgaggttaccttagaccctgagacagctcaccctaagctctgtgtgtccgatctgaagactgtgacacatagaaaggctccccaagaggtgcctcattccgaaaagcgcttcacccggaaatctgttgtggcgagccagagttttcaggctgggaagcactattgggaggttgatgggggacacaacaaacggtggcgcgtgggcgtgtgtcgtgacgatgtggaccgaagaaaggagtacgtgacactttcacctgaccatggctactgggtcctgaggctgaacggagaacacctttattttacgttaaaccctcgtttcattagtgtgttcccacggacaccacccaccaaaatcggcgtatttctggactacgaatgtgggactatcagtttttttaatatcaatgatcagtcactcatttacaccctgacgtgcaggttcgaagggctcttgcgaccttatattgagtacccctcttataacgaacagaatggcacccccattgtcatctgtcctgtgacccaggagtcagaaaaggaggctagctggcagcgggcctctgccatcccggagacatccaactccgagtcttcgtcccaggccactactccatttttaccacggggcgagatgtag

SEQ ID NO: 40658 - DNA, 1608 bp, Artificial Sequence
  Description of Artificial Sequence: Synthetic coding sequence
atggtggacctgagcgtgagccccgacagcctgaagcccgtgagcctcaccagctctctcgtcttccttatgcacctcctgctgctgcagcccggggaaccatcatcagaagtgaaggtcttaggtcccgaatatcctattttggctctggtgggtgaagaagttgagttcccttgccatctgtggccacagctcgacgctcagcagatggagatccgatggttccgctcgcagaccttcaatgttgttcacctttaccaagagcagcaagaactgcccggaaggcagatgccagcttttagaaacagaaccaaattggtcaaagacgacattgcctacggaagtgtggttctgcagcttcactccatcatcccatccgacaaagggacctatggatgccgatttcattcggataattttagtggtgaagccctttgggaactggaggtggccggcctggggtctgaccctcacctgtcccttgaggggtttaaagaggggggaatccaactccggctgcgcagttccgggtggtatccaaaaccaaaggtgcagtggagagaccatcagggacagtgtctgccccctgagttcgaagctattgtgtgggatgcccaggatctgttctctctggagacatcagtcgttgtgcgtgctggtgctctctccaacgtctcagtcagtatccaaaacctcctccttagtcaaaagaaggagctcgtggtacagatagctgacgtgttcgtgcccggagcaagtgcctggaaaagtgctttcgtggcaactttgcccctgctcctggtgctggctgctctggctctcggcgttctgaggaagcagagacgtagtcgagagaagctaagaaagcaggcagagaagcgtcaggagaaactcacagcggaactggaaaaactgcagacagagctggattggcgacgagctgagggccaggctgagtggcgagcagcccagaaatacgctgtcgatgtaactctggacccagcctcagctcacccttctctggaggtctctgaagatggaaagtctgtatcatcgcgtggagcacccccaggaccggctcccggacatccacagaggttcagcgaacagacatgcgctctgtcgttggaacgctttagtgccgggcgccactattgggaagtgcatgtgggtagacggagcaggtggtttttgggagcctgcctggctgctgtccccagggccgggcctgcgaggctatctcccgcagcaggctattgggtgctcggtctgtggaacggatgtgaatattttgtacttgccccccatcgggttgcactgaccttgcgcgtgccacctaggagactgggcgtcttcttggactacgaagcaggagaactgtccttttttaacgtgagcgatggctcacacatatttacatttcacgacacattctcgggcgccctctgtgcttatttcaggcctcgagcccacgacggtggtgaacatcctgatccactcaccatctgccctttgcctgtcaggggtacgggtgtacctgaggagaatgattctgacacgtggctgcaaccttacgaacctgctgatcccgcactcgattggtggtag

SEQ ID NO: 40659 - DNA, 1035 bp, Artificial Sequence
  Description of Artificial Sequence: Synthetic coding sequence
atggtggacctgagcgtgagccccgacagcctgaagcccgtgagcctcacaagtagcctcgtgttcctgatgcacttgttgctcctgcagcctggcgaacccagctcagaagtgaaagtgttaggaccagagtatccaatcctggctctggtgggggaagaagttgagttcccatgtcacctgtggccacagctggacgcccagcagatggaaatacggtggtttcggtcacagacctttaacgttgtacatctataccaggaacagcaggagctcccggggaggcagatgccagcgttcagaaatagaaccaagctggtaaaagatgatatcgcgtacggtagtgttgtcttgcaacttcacagcataattccctctgataaggggacatacgggtgccggttccatagcgacaacttttccggggaggcactatgggagctcgaggttgcgggcctgggaagtgaccctcacctgagtctcgaagggttcaaggaaggcgggatccagctccgcctaagatcatccggctggtatccaaagccaaaggttcagtggagggatcatcagggacagtgcctgccccccgagtttgaagctattgtgtgggatgcccaagacctgttttccctggaaacctcagttgtggtgcgggcgggggctctcagtaatgtaagcgtgtctatacagaatctcctcctgtcccagaaaaaggaactcgtggtacagattgcggacgtcttcgtacccggagcttccgcatggaaatccgcctttgttgccaccctgcctctgctcctggtgctcgccgcgcttgccctgggcgtcctgcgtaaacagcggcggagccgcgagaaactaaggaagcaggccgagaaacgacaggaaaagctgactgcggagctggagaagctgcagaccgaactggactggcggcgagccgagggacaggctgagtgttttgttcttgccagccaccctcccggggaaggaatacaggctgccagtaatagtactaccactttgaatgcttag

SEQ ID NO: 40660 - DNA, 1611 bp, Artificial Sequence
  Description of Artificial Sequence: Synthetic coding sequence
atggtggacctgagcgtgagccccgacagcctgaagcccgtgagccttacctcgagcctggtttttctgatgcatctgctgctcctgcagccaggagagccatcctcggaggtgaaggtcctgggaccggagtatccaatcctggctcttgtgggcgaagaggtggagttcccatgccacctttggcctcaactggacgcgcagcaaatggaaatacggtggtttagatctcaaactttcaatgtcgttcatctttatcaggagcagcaggaactgcctgggcgccagatgccggcattccggaataggactaagctggtaaaagatgacattgcatacggatctgtggtgcttcagttacattctatcatcccttctgataagggcacatacggctgcagattccattcagacaatttttcgggagaggcactttgggaactcgaggtggcgggcttaggaagcgacccccacctctcattggagggatttaaggagggcggcatccagctcaggctgcggagcagtgggtggtatccgaagcctaaggtgcagtggagagatcaccagggacagtgtttgccacccgaattcgaggccatcgtctgggacgcccaggacctgtttagtcttgagacaagcgttgtggtgcgtgcgggtgcactcagtaacgtgtctgttagcattcagaatctgctgttgtcccagaaaaaggagcttgtggtacagatcgcagacgtcttcgtgccaggcgcctctgcttggaagtccgcatttgttgctacacttccactgcttctagtgttagcagcgttggccttgggggtgcttagaaaacagcgaagaagcagagagaaactgcgcaaacaggccgagaagcgccagggaacggaaaaaacagcccaactaccaccaaaccaggttgccagcgattggagaagagcggagggccaagccgagtggcgagcagcgcagaagtatgcagtggatgtcacgctggaccccgctagtgcccatccaagcctggaggtgagtgaagacgggaaatcggtcagctcccggggagcgcctcctgggcccgcccccggacacccccagaggttcagtgagcaaacctgtgccctgtctctggagagatttagcgccggacgccattactgggaagtacacgtgggtcggcgctcacgatggttcttaggtgcctgtttagcagctgttcctagagccggccccgcaagactctctcctgcagccggctactgggttttggggctttggaacgggtgtgaatattttgtcctggcacctcacagagtcgctttgacacttagggtacctcctaggaggcttggggtttttttggactatgaggcaggcgaactgtctttcttcaatgtgagcgacggcagtcatatttttacatttcatgatactttctctggagcactctgcgcatacttcaggcctcgtgctcacgatggtggagagcaccccgacccacttaccatatgccctcttcctgtgaggggcactggcgtgcctgaagaaaacgattctgatacctggctgcagccttatgagccagctgacccagcacttgattggtggtag

SEQ ID NO: 40661 - DNA, 1035 bp, Artificial Sequence
  Description of Artificial Sequence: Synthetic coding sequence
atggtggacctgagcgtgagccccgacagcctgaagcccgtgagcctaacgtcctcgctagtttttctgatgcatctgttactgctgcagccaggcgaaccctcgtcagaagtgaaggtacttggaccggaataccctattctagcacttgtgggtgaggaggtagaatttccatgccatctctggcctcagcttgacgctcagcagatggagattagatggtttcgctcacagacctttaatgtggtgcatttataccaggaacagcaggagcttccaggaaggcaaatgcccgctttccgtaaccgcactaagcttgtcaaagatgacatcgcgtatggatccgtggttcttcagctgcatagtattatcccttctgacaagggcacatatggctgtcggtttcactctgataattttagcggcgaggcattgtgggagctggaagtcgccgggttggggtctgacccacacctgtccttagaagggttcaaagaaggtggaatccagctgcgtctgagaagctccggatggtaccctaagccaaaggtccagtggagggaccaccagggtcagtgtctgcccccagaatttgaagcaatcgtctgggatgctcaggacctgttttctctggaaaccagcgtcgtagtgcgtgccggtgccttgtctaacgtttctgtgagtatacagaacctgctcctctcacagaagaaggaattagtggtgcagatcgcagacgtgttcgtgccaggggcctccgcttggaaatcggcctttgtggcaaccctccccttactattggtactggctgcattggccctgggagtcttgagaaagcaacgcagaagccgggagaagctgcgtaaacaggcagagaagcgacaagccagatatgatgcacaagcaggaccacttctcgtcgctagtgactggaggagggcggagggtcaagccgaatgtttcgtgctcgcctcccatccaccgggtgaaggtatccaggctgcctccaactctactacaactctcaatgcttag

SEQ ID NO: 40662 - DNA, 3672 bp, Artificial Sequence
  Description of Artificial Sequence: Synthetic coding sequence
atgcggcggctggccgccgaggagctgggcgtggtgaccatgcagcgtatcttcaattctttcgtatataccgaaaagatctccaatggcgaatctgaagtccagcagctagccaaaaaaattcgcgaaaagtttaacaggtatctggacgttgtcaacaggaacaagcaggtggtagaagctagctacactgcacaccttactagccccttgaccgccattcaggattgttgcactataccccccagtatgatggagttcgacggcaattttaacaccaatgtctcacgtacaatatcttgtgatcgactaagtaccacagttaactcacgcgcttttaaccccggacgtgatttgaactccgtgctggccgacaaccttaagagtaaccctggcattaagtggcaatactttagctcagaggagggcattttcaccgtatttcctgcacacaagttccgctgcaagggcagctatgagcaccgctcccgccctatctacgtaagcacagtaagaccccagtccaagcatatagtcgtaatcctggatcacggcgcttccgtgactgacacacaattgcagattgccaaggacgctgcccaggtgatcttaagcgccatagatgagcatgataaaatttcagttcttactgtcgctgacactgtgaggacttgttctctggatcagtgctacaagacgttcctatcccccgcaacctcagaaacgaaacgtaagatgtcaacctttgtctccagcgtcaagtcgtctgatagtccaacccaacacgcggtgggcttccagaaggctttccagttgatccgaagcactaataataacactaaatttcaggcaaatactgacatggtgataatctatctctcagccggcattacgtccaaagacagctctgaagaggacaaaaaagcgaccctgcaggtgattaatgaggaaaactcttttctgaacaatagcgtcatgatactgacttacgcactgatgaatgacggagtgaccggactgaaagagttagcttttctgcgggacctagctgagcaaaactccggcaagtatggggtgccagaccgaatggcactccccgtcatcaaggggtcaatgatggtccttaaccagctctcgaacttggaaaccaccgtcggtagattttacaccaacctgccaaaccgaatgatagacgaggcagttttctctcttcctttttctgacgaaatgggtgatgggcttattatgactgtatctaagccttgctactttggcaacctgttgcttggcatcgttggggtcgatgtgaacttagcttatatattggaagacgtgacttactaccaggatagcctcgccagctatacgttccttattgatgataaggggtatactctgatgcatccttctctgactaggccttatcttttgagcgagcccccattgcacacagacattattcattacgaaaacatcccaaagttcgaactcgtgagacagaacattctgagtcttccacttgggagtcagataattgccgtccctgtgaactcctctctcagctggcatattaataagttaagggagacaggtaaagaagcatataatgtctcatacgcctggaaaatggtgcaggatacgagttttattctctgcattgtcgtgatccagccagagattcccgtgaagcaactaaaaaatctaaacaccgtgccaagcagtaaacttctgtaccataggcttgacctgcttgggcaaccctctgcttgtctgcacttcaaacagctggcgaccctcgagtctcccacaatcatgctgagtgctggctctttttccagcccctatgagcacctgagccagccagagacaaaaagaatggtggaacattacacagcatatctcagtgacaacacaagacttattgcgaatcctggcctcaaattttctgtcagaaacgaggtgatggccaccagtcatgtcacggacgaatggatgacacagatggagatgtcttcgctgaacacctatattgtccggaggtatattgcgactcctaacggcgtattgaggatctatccaggtagcctgatggataaggccttcgatcccacccgccggcagtggtatctgcatgcagtcgctaatcccggtctcattagcttaacagggccctatctggatgttggtggcgccggatatgttgtgacgatcagccatactatccacagcagctctacgcaactgtcttctggacataccgtggctgtcatggggattgatttcacccttcggtacttctacaaggtccttatggatctgctcccggtgtgcaaccaggatggcggtaacaagatccggtgcttcatcatggaagacagaggctatctggttgctcaccccactctgatcgatccaaagggtcacgcacctgtcgaacaacagcacataactcacaaggaacctctggtcgctaacgatatactgaatcatcccaactttgtgaaaaagaacttatgtaactcatttagcgacagaaccgtgcagcggttctataaatttaacacaagtctggcgggtgacttgacaaatttagtgcacgggagccactgttccaaataccggctcgccaggataccaggaacaaacgctttcgtgggcatcgtcaatgagacatgcgattccctcgcgttttgcgcctgttccatggtcgatcggctgtgcctgaattgccacagaatggaacagaatgagtgtgaatgtccctgtgaatgtccgctggaggtgaacgaatgtacaggaaatctgaccaatgccgagaacaggaaccccagctgtgaggtacaccaggagcctgtgacgtacacagctattgatccgggcttgcaggatgcactccaccagtgcgtgaatagtagatgtagccagaggttggaatccggcgattgtttcggcgtcctcgattgcgaatggtgcatggtggattctgacggtaagacccatctggacaaaccttactgtgctcctcaaaaggagtgcttcgggggtatcgtaggtgcaaaatcaccctatgtggacgacatgggtgcgataggagacgaagttataaccctaaatatgatcaagtccgcacccgttggacctgttgccgggggtatcatgggctgcattatggtgctggtactcgctgtctacgcttatagacatcagattcaccggagatcccaccaacatatgtcgcctctcgctgcacaggagatgtctgtgcggatgagcaatctggagaacgaccgggacgaacgggacgacgattcccatgaggatcggggaattatctctaacacacggtttattgccgctgtgatcgaaagacacgctcattcccccgagcgccgcaggcggtattggggtcgctccggtaccgagagcgatcacggctactcaacgatgagcccccaggaagactccgagaaccccccgtgtaacaatgacccactgtctgccggggtggacgttggaaatcacgacgaagacctcgaccttgacacacctccgcagactgcggcacttctgtcccataaattccatcattatagatcgcaccatccaacactacaccactcccatcatctgcaagccgcggtaaccgtacatacagtagacgccgagtgttag

SEQ ID NO: 40663 - DNA, 3825 bp, Artificial Sequence
  Description of Artificial Sequence: Synthetic coding sequence
atggcccggcagcccgaggaggaggagaccgccgtggcccgggccagaagaccgccgctgtggctgctgtgcctggttgcttgttggcttctgggagcaggcgcagaagccgacttctcaatacttgacgaggcgcaagtcctggcaagtcagatgaggaggctagctgccgaagaactgggcgtcgtgactatgcaaaggatctttaactcattcgtgtataccgaaaaaatctctaacggcgaatcagaggtccagcagttggccaagaaaatccgggaaaaattcaataggtatctagacgttgtgaatcgaaacaaacaggtggttgaagcctcctataccgcgcacctgacaagtccgctcaccgccattcaggactgttgcaccatccccccctcaatgatggagttcgacggaaacttcaatacaaacgtgagtagaaccatttcttgcgatcggctgtctaccacagttaattcccgggccttcaaccctggccgggacctcaactctgtgctcgccgataatctaaagtcgaaccccggcatcaagtggcagtactttagcagtgaggaggggatcttcaccgtgttcccagcccataaattccggtgtaagggatcttatgaacataggagccgaccaatatacgtgagcacagtgcggccacagagcaaacacattgtggtgatcctggaccacggagcttcagtaaccgatacgcagctccagattgccaaggacgctgcccaagtaatattaagcgccattgacgagcacgataagatatccgtccttactgtagctgacacggttaggacatgttcgctggaccaatgttacaagacctttctgtccccagcaactagcgagacaaaacgcaaaatgagcactttcgtaagttcagttaagtccagcgactctcccacacagcacgcagtgggctttcagaaggctttccaacttattcggtctacgaacaacaacacaaagtttcaagccaacaccgacatggtgatcatctacttatctgccgggatcacctcgaaggactcctcagaagaggataagaaagcgacactgcaggttattaatgaagagaactcttttcttaacaactcggtgatgattctgacgtacgctctaatgaacgatggcgtcaccggtctgaaggaactcgcttttcttcgcgatctggccgagcagaatagtggcaagtacggcgttccggaccgcatggcccttcccgtgatcaaagggagcatgatggtgctcaaccagttgagtaatctagagactaccgtgggcagattttacaccaatctgcctaatcgaatgatcgatgaagctgtgttttctctgccgttttctgatgagatgggggacggcctgataatgactgtgagcaagccatgctacttcggaaatcttctcctggggattgtgggggtagacgttaacctagcatacatccttgaggatgtgacatactatcaggacagcttggccagttataccttcctgattgacgacaaaggctacacactcatgcacccatccctaacaagaccgtatcttctcagcgaaccccctctgcacaccgatataattcattacgaaaacattccaaagtttgaactcgtgcgccagaatattctgagcctcccactcggtagccaaatcatcgccgtgccagtcaattcttccttgtcttggcacatcaacaagctacgggaaacaggcaaggaagcctataatgtcagttatgcatggaaaatggtgcaagacacaagctttatcttatgtattgtggtgatccagcctgagatccccgtaaagcagctgaagaatctaaacacagttccgtcatcaaagttgctttatcatagactggatctcctcggccagcctagtgcttgccttcacttcaaacagctcgcaacactggagagcccaacaattatgctgagcgctggttccttcagttccccgtatgagcatctgtcccagccagaaactaagaggatggttgagcattacaccgcttatctgagtgataataccagactgattgcaaatcctggacttaaattctctgtgcgcaacgaggtgatggcaacctcccatgtgaccgacgaatggatgacgcagatggaaatgtcttccctcaatacctacatcgttagacgatacattgccactccaaatggagtgctgcggatctaccctggtagtttgatggataaagccttcgacccaacacgaaggcagtggtatctgcacgctgtcgccaacccaggcctgatctctctgacaggcccttacctggacgtaggaggagcaggatatgtcgtgaccattagccatacaattcatagctcttctacccagctgtccagtggacataccgtggccgtgatgggaattgactttacattaaggtatttctacaaggttctgatggatttgctgcccgtttgcaatcaggatggggggaacaagattagatgctttattatggaggataggggttatttagtagcccacccaactctgattgatcccaaaggacacgcgcctgtggagcagcagcacatcacccataaggagccgctagtggccaatgatatactgaatcaccccaacttcgtgaagaagaatctatgtaattctttttctgaccgcacagtgcagaggttctataagtttaatacttcactcgccggggatctgaccaatcttgttcatggttctcactgttccaagtatcggctggctagaatacccggtacgaacgccttcgtgggaattgtcaacgaaacgtgcgacagtctggcattctgtgcctgtagtatggttgatcgactttgcctcaactgccaccgtatggagcagaatgagtgtgaatgtccatgcgaatgtccgctggaggtgaatgagtgcacaggaaacctgaccaatgctgagaatcgcaatccgtcgtgcgaagtccaccaagagccggttacttacactgcaattgacccggggctgcaggacgccctgcatcagtgcgtgaattctagatgcagtcagaggctagagtctggggactgcttcggtgtattagactgcgagtggtgtatggtggacagtgacggcaagacacatctggataagccttactgcgcaccgcagaaagaatgttttgggggcattgtcggcgccaagtctccctatgtcgacgacatgggggccattggagacgaggtcattacactgaacatgataaagtcggctccagtgggtccagtggctgggggaatcatgggatgtatcatggtgctggtgctggctgtgtatgcctaccggcatcagattcaccgcagatcccatcaacatatgtcccccctggccgcccaggagatgtcggtacgcatgtccaatctagagaatgaccgtgacgaacgggacgacgatagtcatgaagaccggggcatcatctctaatacgcgatttatcgccgcagtgatcgaacggcacgcacacagccccgagcgtaggcgcaggtattggggaagaagtgggactgaatcggatcatggctattcaaccatgagtccccaggaggactctgaaaaccctccttgtaacaacgatcccctgagcgcaggagtggatgtcgggaaccatgatgaggacctggacttagatacccccccccagaccgccgcactgttaagccacaaatttcatcactatcgtagtcaccatccgaccctgcatcacagtcaccatctgcaggccgccgtgacagtgcatacagtggatgccgagtgttag

SEQ ID NO: 40664 - DNA, 2460 bp, Artificial Sequence
  Description of Artificial Sequence: Synthetic coding sequence
atgtggggcctggtgcggctgctgctggcctggctgggcggctgggggtgcatgggccgccttgctgcccccgctcgtgcatgggctgggagtagagagcatccaggtcccgccctgctgcgaactcgcaggtcatgggtgtggaatcagttcttcgttatcgaggaatatgcggggcccgaaccagtcctcatcgggaagcttcactcagacgtcgataggggagagggaagaaccaaatacctgttaaccggggaaggagctggaaccgtttttgtgatcgacgaggccacaggcaatatccacgttacaaaatccttggacagggaggagaaagctcagtacgtactgctagctcaggccgttgaccgggcctcaaaccggcccttggaacctcctagtgagttcatcattaaggttcaagacataaatgataatccccccatctttccccttggtccctaccacgccaccgtccccgaaatgagcaatgtgggcacaagcgtgatacaggtaactgctcatgacgcggacgacccaagctacggaaactctgccaaacttgtgtataccgtcttggacgggttacctttcttttccgtggaccctcagaccggcgttgtacgaactgccatccccaatatggatagggagacgcaggaagagttcctcgtagttatccaggcgaaggacatgggagggcacatggggggcttgtctggtagcacgacggtcaccgttacgttgtctgacgtgaacgacaatccacctaagttcccccaaagtctctatcagttttctgtggtggaaaccgccggtcccggcaccctcgttggccgactgcgggcacaggatccggaccttggcgacaatgccctgatggcttacagcattctggacggcgagggcagtgaggcctttagtataagtacagacttgcagggtagagatggcctgctgaccgtacggaaaccgctagactttgagtctcagagatcttatagcttccgcgtagaagccaccaacaccctgatcgaccctgcttatttacggcggggacccttcaaagacgtagcttcagtaagagtagcagtgcaggatgccccagaaccgcctgcgttcacacaggcagcttaccatctgaccgtgcccgaaaataaagctccagggacgttggtgggccagatctcggccgctgacctcgacagtcccgcgagcccaatccggtattccattctgccccactctgacccagagagatgttttagtattcagcctgaagaagggacgatccacacagcagctccactcgacagagaggcacgagcatggcataacttgactgtgctggccacggaactaggatggagttggggacctgagcggggatgggtacccttgctggtggctgagtggtcagcgccagctgctccaccccaacgatcaccagttggcagtgcggttgggataccccaagattccagtgctcaggcctcacgtgttcaggtggcgatccagacactggatgagaatgataatgccccccagttagccgagccttatgatacatttgtgtgcgactcagcagctcccgggcagctgattcaagtgatcagagcactggatcgggatgaggtgggcaactcgtcacatgtcagcttccaagggcctctcggaccagacgccaactttactgttcaggacaaccgagatggtagcgctagtctgctgctccctagtcgcccagcgcctcctcggcatgccccctacctggtgccaattgaattatgggactggggtcaacctgcactgtcaagtacagcaaccgtgactgtcagcgtttgccggtgccagcctgacggcagcgttgcctcctgttggcctgaagctcacctcagcgctgccggactttccaccggagcactcttggcgataatcacatgcgttggagctctgttggccctggtagtgctatttgtggccctgcggcggcagaaacaagaggcactaatggtgttggaggaggaggacgtgcgcgagaacataatcacttatgatgatgaaggtgggggagaggaagatacagaagctttcgatattaccgcgcttcagaaccccgacggagctgcacctcccgctccagggccccccgcaagaagggatgtccttcccagggcaagagtgagccgccagccacgtccccctggccccgccgacgtggcccagttgctcgctctgcggctgagagaagccgatgaagaccccggggtgccgccctacgacagtgtgcaggtgtatggttatgagggccgcggtagttcatgtgggtctttgagttctctgggaagcggctctgaggctggtggcgcccctggacccgcagagcccctcgacgactggggacctctgttccggaccctagccgaactctacggggctaaggaaccccctgcgccctag

SEQ ID NO: 40665 - DNA, 2460 bp, Artificial Sequence
  Description of Artificial Sequence: Synthetic coding sequence
atgtggggcctggtgcggctgctgctggcctggctgggcggctggggctgcatggggagactggccgccccggcacgcgcgtgggccgggagccgggagcacccagggcccgccctgctgcgtacaaggcgttcttgggtgtggaatcagtttttcgtcatcgaggagtacgccggacccgaacctgtactaatcggtaaactgcactccgatgtcgacaggggagaaggacggaccaaatacctgctgacaggcgaaggagcggggaccgtattcgtaattgacgaagctaccgggaatatacacgtcactaaaagcctggaccgggaggagaaggcacaatacgtcctgctggcacaggcagttgatagggcctcgaacaggccattagagcctccttcagaattcatcattaaggtgcaggatataaatgacaatcctcctatttttccactgggaccgtaccacgcgaccgtacccgaaatgtcaaatgtgggaacctctgtgattcaggtaacagctcatgatgccgacgaccctagctacggcaactctgccaaactggtatatacagtattggacggactgccttttttcagcgtggaccctcaaaccggagtagtgaggacagcgatacccaacatggatcgagagacccaggaagaatttcttgtggtgatccaggccaaggatatggggggacacatgggcggcctgtcgggatcaaccacagtcaccgtcactctctctgatgtgaacgataatcctcctaagttcccacaatccctgtatcagtttagcgtagtcgagactgccgggccaggtacgttagtcggacggctgagagcccaggaccccgacctgggcgacaacgcactcatggcctactctatcttggacggggagggatctgaagccttttctatctcaaccgaccttcaagggcgagacgggcttctgaccgtcaggaaaccactggacttcgaaagtcagcggtcgtatagctttcgggtcgaggccacgaacacactgattgatccggcctacttgcgccgcggcccttttaaggacgtggcaagtgtgcgggtggccgttcaagatgcccccgagcctccagcttttacgcaggccgcttaccacctgacggtcccagaaaataaggcgccaggcactctggtcgggcagattagcgccgcagatttagacagcccagcgtcacccatccggtacagcattttacctcatagcgaccctgaaagatgtttcagcatacagcctgaggaggggaccattcacacagccgctcccctggaccgtgaagcaagagcttggcataacctgactgtgctggcaactgaactgggatggtcatggggacctgaaaggggatgggttcctttgctcgtggcagaatggtcagccccagctgccccaccacagaggtcccctgtcggttcagctgtaggaattccgcaagatagcagtgcccaggcttctcgagtacaggtagccatccagacactcgacgagaatgacaacgctccccagctggctgagccgtacgacacttttgtgtgtgactcagcagctcctgggcagctgatacaggtgattcgcgctttggatagggatgaggtgggaaattcttcgcacgtgtcgttccaaggacccttggggcctgatgcaaacttcacagtacaagataatcgcgatggttctgcgtcgttactcctcccatccagaccagcacctccccggcacgcgccctacctcgtgcctatcgaactttgggactggggacagcccgccctgtctagcaccgccaccgtgacggtcagtgtgtgtaggtgccagcctgacggctccgtcgcctcttgttggcccgaagctcatctgagcgctgctggtttgtccaccggcgcccttctggcgatcataacttgtgtgggagctttgctggccctagtcgtgctgtttgtggctctgcggagacagaagcaggaggcactcatggtgctagaggaggaagacgtcagggaaaatattataacatacgatgacgaaggcggaggggaagaggatacggaagctttcgatattaccgcactacagaatcccgacggagccgcacctccggctcctggaccgcctgctcggcgagacgttctgcccagagcccgagtaagccggcaacctaggcctcccggcccggcagacgttgcccaactgctcgctctgcggctccgggaagccgacgaggatccaggagtcccaccctacgacagcgtgcaggtctacggatatgaaggacggggatccagctgcggctctctctcatcgttaggatccggaagcgaagccggaggtgctcccggccccgccgaacccctcgacgattggggccccctgttccggacattggctgaactgtacggcgctaaagagcctcctgctccatag

SEQ ID NO: 40666 - DNA, 945 bp, Artificial Sequence
  Description of Artificial Sequence: Synthetic coding sequence
atgtggggcctggtgcggctgctgctggcctggctgggcggctgggggtgtatgggtagattggcagcacctgccagggcttgggccggatcacgtgagcaccccgggcctgcactcctgcggactcgcaggtcctgggtgtggaatcagttctttgtgattgaagagtacgcagggcccgagccagtgctcattggtaagttgcattcagacgtggatagaggcgaaggccggaccaaatacctcctgacaggggagggggccggcaccgtgttcgtgatagatgaagcaaccggaaatattcatgtgaccaagagcttggatagggaggagaaagcgcagtacgttctgcttgcgcaggctgtggaccgcgcctcaaaccggcctctggaacccccaagcgagttcataattaagatcatcacctgcgttggtgctttactggccctagtcgtgctgtttgttgctttgaggcgccaaaagcaggaggcgctgatggtgcttgaggaggaggacgttcgggagaacattatcacttacgatgacgaggggggaggggaggaggataccgaggcttttgacatcacagcactgcagaacccagatggagccgccccgcccgctccagggccccccgcccgccgcgacgtcctgccacgagcccgggtgagtagacaaccccgaccaccgggcccggccgacgtcgcccaactcctggcgctgcggttgcgggaggcggatgaagacccaggggttcccccttacgacagcgtgcaggtgtacggctacgaaggacgagggagcagctgtggctcattatcctcactgggatctggaagcgaggcaggaggcgccccaggcccagctgaacccctcgatgattggggtcccctgtttagaacattggctgagctgtatggcgccaaggagccacccgcaccgtag

SEQ ID NO: 40667 - DNA, 2346 bp, Artificial Sequence
  Description of Artificial Sequence: Synthetic coding sequence
atgtggggcctggtgcggctgctgctggcctggctgggcggctggggatgcatgggcagactggccgccccagccagggcatgggcagggtctagagagcaccccgggcctgccctgctacgaacaagacgctcgtgggtgtggaatcaattttttgtaattgaggaatacgccggtcctgaacccgtgttaatcggcaaactccattccgacgtagaccggggcgagggccggactaagtatctgctcactggggagggggcagggacagttttcgtgattgatgaggccaccggaaacattcacgttactaagtcattagaccgggaggagaaggcccagtacgtcctgctggcgcaggccgtggacagagctagcaaccgccctctggagccaccttcagagttcattatcaaagtgcaggacatcaatgataatcctcctatctttccactaggcccctaccatgctaccgtgccagagatgtccaatgtcggtacgagcgtgattcaggttactgcccacgatgccgatgacccttcgtacgggaactcagccaagctcgtgtacaccgtgctggatggcctgcctttttttagcgtggatccacaaacgggcgtggtacggacggctattcctaatatggatcgcgagacccaggaggagttcttggtggtcattcaggcaaaagatatgggcggccacatgggggggctttctggctccaccactgtaaccgttactttatctgacgtcaatgacaacccacctaaattccctcaaagtttgtaccaattctcggtggtggagaccgctggtccaggcaccctggtgggccgacttcgggctcaagatcccgacttgggcgataatgccttgatggcctacagcatactcgatggcgagggatcagaggctttcagcatctcaaccgatctgcagggtcgtgatggcttgctcaccgtccggaagccgctggatttcgagtcccagcggagctatagtttcagagtggaggccactaacacactcatagatccagcatatctaagacggggaccattcaaagatgtggcctccgtgagggtggccgttcaggatgctccggagccaccagcctttacccaagctgcataccatctgactgtgcctgagaataaggcccccgggactctggtgggtcagatttccgctgcggacctagattctcccgcctcccccatacggtatagcatattgccacatagcgaccccgaaaggtgcttttctatccagccagaagaggggacaatacacactgccgcacctctagacagggaagcacgcgcttggcataacctgacggttctagccaccgagcttgactccagtgcccaggcatcccgcgtgcaagtcgcgatacagaccctcgacgaaaatgacaatgctccacagctggccgagccttacgatacatttgtgtgcgactccgcagcgcccggccagctgattcaggtgatccgggctttagacagagacgaggtcggaaactcttctcatgtgtctttccagggacccctcggaccagatgccaactttaccgtgcaggataaccgcgacgggagcgcttctctgctgcttccttcacggcccgcaccgcctaggcatgccccctacttggtaccaatagagctgtgggattggggtcaacctgcccttagctctacagcgaccgtgactgtgtctgtgtgtagatgccagccagacggctccgtcgcttcctgctggccggaggcgcacctttccgctgcaggcttgtctaccggcgcgctcctcgcgattattacatgcgtgggtgccctgctggccctggtcgtgctgtttgtggctctgcgcagacagaagcaagaggctctgatggtgcttgaagaggaggacgtgagggagaatatcatcacttacgatgatgaagggggtggggaggaggacactgaggcctttgatattaccgcgctgcagaacccagatggcgccgccccacctgcccccggtcctcctgccaggcgggacgtgctaccgagagctcgagtctctagacagccaagacctcctggcccggccgacgtcgcgcagctcctcgccctccggctgagagaagctgacgaggaccccggggtgcccccatacgactcagtgcaggtgtacggctatgaagggagaggctccagctgcggttcattgtcctccctgggatctggctccgaggcaggcggcgcaccagggcctgctgagcctctggacgactggggccctctcttcagaacactggctgagctgtacggagctaaagagccccctgctccctag

SEQ ID NO: 40668 - DNA, 2346 bp, Artificial Sequence
  Description of Artificial Sequence: Synthetic coding sequence
atgtggggcctggtgcggctgctgctggcctggctgggcggctggggttgcatgggtagacttgccgcacccgcgagggcttgggcaggaagtcgcgagcatccaggacccgcactgctccgcactaggaggagctgggtgtggaaccagttcttcgttatagaggagtacgcgggacctgagcctgttctgataggaaaactgcactcagatgtggataggggcgagggtcgcaccaagtacttgttgactggcgaaggcgccggcacagtcttcgtgattgacgaagccactggcaacattcacgtgactaagagtttggaccgcgaggagaaggcgcagtacgttctgctggctcaggctgtggacagggcctccaatagaccactggagcctccttctgaattcatcataaaggtgcaggatatcaatgacaaccctcccatctttcctctcgggccatatcatgctaccgtgccagagatgagtaatgtagggactagcgttatccaagttacggctcacgatgctgatgatccgtcatatggcaactcagctaagctggtatatacagtcctggatgggctacctttcttcagcgttgaccctcagaccggagtggttagaacagccatccccaatatggatcgggagacccaggaggagttcctagtggtaattcaggccaaggacatgggaggccatatgggtggactgtctggctccaccactgtcacagtgacactgtcagatgtcaacgataatcctcccaaattcccccaatccctgtaccagttcagcgtggtagaaaccgctggacccggaacactggtgggcaggttaagggcgcaggacccggatctgggagataatgcactcatggcttattcaatcttggatggggaggggtcagaggctttcagcatctctactgatttacagggccgcgatgggctgctaaccgtgagaaaaccactggacttcgaaagccaacgctcttactcatttcgcgtggaggccacaaacaccctaatagatcccgcctacctgcggcgcggaccatttaaggatgtcgctagcgtgcgtgtagctgtccaagatgcaccagagcctccagctttcactcaggcggcctatcacttgacagtccctgagaacaaagccccaggtacattagtaggccaaatttccgccgcagacctcgattcgcccgcatcccccattcgctacagcatccttcctcacagcgatcccgaacgctgtttcagcattcagcctgaagagggcacaatccatacagctgcccctctggaccgggaggcgcgggcgtggcacaacttgacagtgctggcgactgagctggattcttctgcccaggcaagtcgcgtgcaagtcgcaattcagacacttgatgagaatgacaatgcaccacagcttgctgaaccttacgatacctttgtgtgtgatagcgcagcccctggccaacttatacaggtcatcagggctctggatcgtgacgaagtgggcaattcaagccatgtgtcattccagggaccgctcggaccggacgcaaatttcaccgttcaggataatcgggacggttcggcgtcacttctgcttccaagccgcccagctcccccaaggcacgccccctacctggtgcccattgagctatgggactgggggcagccagcgctgagttccaccgccacagtcacagtgagcgtatgcagatgccagccagacgggagcgtagctagttgttggcctgaagctcatctcagcgccgccggactttccacaggcgctctgttggccatcatcacatgtgtcggggcactgctggctttagtagtcctgtttgttgctctgcgtagacagaagcaggaggctctgatggtgttggaggaagaagacgtgagggagaacatcattacatacgatgatgaaggcgggggcgaggaggatactgaagcattcgatattaccgcactgcagaacccggatggcgcggccccacccgcgccagggccaccggcacgccgggacgtgcttcccagagcccgcgtgtcccgacaaccccgcccccctggtcccgcagatgtggcccagctgctagccctacggttaagagaggctgacgaggatcctggcgttcctccgtacgacagtgtgcaggtttacggatacgagggtcgggggagttcttgcggcagcctcagttctctgggctcaggatctgaggcaggcggtgccccagggccagcagagcctttggacgattgggggccgcttttccgtaccctggccgaactgtatggtgccaaggaacccccagccccgtag

SEQ ID NO: 40669 - DNA, 2559 bp, Artificial Sequence
  Description of Artificial Sequence: Synthetic coding sequence
atggccatgcggagcggccggcaccccagcctgctgctgctgctggtgctccttctttggctcttacaggtgtccataattgattccgtccagcaggagaccgatgacctgactaagcagaccaaggagaagatctatcagcctctgaggagatctaaacgaaggtgggtcattaccaccttggagctcgaagaggaggatcctgggccattccccaaacttatcggtgaactgttcaacaatatgagttacaacatgagcctaatgtatctgatctccggcccaggcgtcgacgagtaccccgagatcggactgttttcgctagaagaccacgaaaatggccgcatctacgtccatcgtccagttgatagagagatgacgccttcttttacagtgtacttcgacgtggttgagcgatcaacagggaaaatcgtcgacacctccttgatattcaatataaggatcagcgacgtaaatgaccatgcccctcagtttcccgagaaagagtttaatatcacagtacaggaaaaccagtctgccggacaacctatctttcaaatgctggccgtggatctggacgaggagaacacacccaattcgcaggtgctgtacttcctgatttctcaaactccattgctaaaagagagtgggttccgggtggaccgactgagtggggaaatccggctcagcggttgccttgattacgagaccgctccccaatttaccctgctgattcgggcccgtgattgcggggagcccagtctctcctccaccaccaccgtgcacgtggatgtacaggaagggaataaccatagacccgccttcacccaggagaactacaaggtccaaatccccgaaggccgtgccagtcagggcgtcctccggcttctagtgcaagatcgcgatagcccattcacgagtgcgtggagggccaagttcaacatcctacacgggaacgaggaagggcattttgacatcagcacagaccccgagaccaacgaggggatcctcaacgtgattaagcccctggactatgagacgcgacctgctcagagtctgatcatcgtggtcgaaaacgaggaacggcttgtattttgtgagcgcggcaaactgcagcccccccggaaagctgcggcttctgccaccgtgtctgtgcaggtgacagacgccaacgatcccccggccttccacccccagtcttttatcgtcaacaaggaggagggggccagaccgggcaccctgctggggacctttaacgccatggatccggactctcaaatccgctatgaactggtgcatgacccggcgaattgggtgtcagtcgacaaaaacagcggagtcgtgataaccgtcgaacctattgatcgcgagagtccacatgttaacaattccttctatgttatcattatccatgccgtggatgatggattccctcctcagaccgccacggggaccctgatgctcttcctctccgatataaatgataatgtgccaaccttaaggcctaggagcagatatatggaggtgtgcgagtccgccgttcacgaacctctccacatagaggctgaggaccctgacctagagccattcagcgatcctttcacattcgagcttgacaacacctggggcaatgctgaggacacctggaagttgggacgtaactgggggcagagcgtcgaactgttgaccctgagatccttacctcgcggcaattacttagttccgttattcattggggacaaacagggcctgagtcagaaacagacggtccacgtgcggatttgtccatgtgcatccggccttacatgtgtagagcttgccgacgccgaggtgggactgcatgtcggagcccttttcccggtatgcgcggcctttgttgctctggccgtggccctcctgtttctgctgcgatgctacttcgtgctcgagccaaaacgccatgggtgctcggtgagcaatgatgagggccatcaaactcttgtcatgtacaacgccgagtccaaagggacatcagcacagacttggagtgacgtagagggtcagcggcccgcactccttatttgcacggcagccgccggcccaacacaaggcgtcaaagcttaccctgacgctaccatgcaccgtcagctccttgcccccgtggaaggaagaatggctgaaacactcaatcagagtaaagagagaaataggttcagtttgtcaaggggatgtatcattccacaggggcgtgcaacagctggccggggccttccccaagacatctataaagagatgatgcccagaagactgacgcaaaccggtaaaaggaagcacggagccctcgccagaaccccaagtttcaaaaaggtcgtatacgaccataaggaggacgaggaaaacaaagctgggagaaagcagcgttcccacctttttaaagtcatgcaacttaggaacgaacaaggcggagtgcgggtacagagtgcacatagtcctagcccactcaacaagaaagcctgcttccccggggactatcggggcgagagtgctgggggtcacaattgccgtgctgtgagcggatag

SEQ ID NO: 40670 - DNA, 375 bp, Artificial Sequence
  Description of Artificial Sequence: Synthetic coding sequence
atgaagcccctgatctggacctggagcgacgtggagggccagcggcctgcgctcctgatctgtaccgcagccgcaggacctacacagggagtgaaagcctacccagatgcaacaatgcacagacagcttctggctcccgtggagggaaggatggcagagacccttaaccagaaattgcacgtagcaaacgtgttggaggacgacccaggatacctgccacatgtttatagcgaagagggagaatgcggcggcgcgccaagcctttccagcctggcctctctcgaacaggagcttcagccagacctgctcgattctctgggctccaaggcgacgccctttgaggagatctattcagagagcggcgtgcctagttag

SEQ ID NO: 40671 - DNA, 2499 bp, Artificial Sequence
  Description of Artificial Sequence: Synthetic coding sequence
atggccatgcggagcggccggcaccccagcctgctgctgctgctggtgttgctcctgtggcttctccaagtttccattatagacagtgtgcagcaggaaactgatgatcttaccaaacagacgaaggaaaaaatatatcagcctctcaggcgcagcaaacgacggtgggtgatcactacgctggagctggaagaagaggatcctggaccattccctaagctgattggtgaactcttcaataatatgtcgtacaacatgtcactcatgtacctgatctccggccccggcgtagacgagtacccggagatcggtctgttttccctggaggaccacgaaaacggaagaatctacgtccaccgaccggttgacagggaaatgacccctagcttcacagtttacttcgatgtggtcgagcgatccacaggaaagattgtagatacctctctgatcttcaatatcaggatcagcgacgtgaatgatcacgcccctcagtttcctgagaaagagtttaacattaccgtgcaggagaaccagtctgcaggccagcctattttccagatgctggctgttgacttggatgaggaaaatacccccaactcacaagttctgtattttctgataagtcagacgcctctactcaaggagagcggtttccgggtcgacagactctccggggaaattcggttatcaggatgtctggattacgagacagccccccagttcacacttctcattagagccagagactgcggtgaaccgtctttaagcagtaccacgactgtgcatgtcgacgtgcaagaaggcaacaatcacagacctgcctttacacaggagaattataaggttcagatccctgagggccgggccagccaaggggtgcttagactgctggtacaggacagagatagccccttcaccagcgcatggcgggctaaattcaatattcttcacgggaatgaagaaggtcactttgatatcagcacagacccagagacgaatgagggaattcttaatgtgatcaagcccctagactatgaaaccagacccgcccagagtcttatcattgtcgttgagaacgaggaacggctcgtcttctgcgagagggggaagctgcaaccacctagaaaggccgccgcatccgcaaccgtgtcagtccaagtaactgacgcaaacgacccacccgcattccatccgcagagtttcatcgtgaataaggaggagggagcccgacctggaactctgctgggcacattcaatgcgatggatcccgactctcagatccggtacgagctggtacacgatccagcaaactgggtgtccgtcgacaagaattccggtgtcgttatcactgttgagccgatcgaccgggaatctccacatgttaacaactccttctatgtgatcataatccacgccgttgacgacggtttcccacctcagactgcaaccggtacccttatgctgtttctctctgacataaatgataatgtgcctactttaagacctaggtcaagatacatggaggtgtgcgagagcgctgtgcatgagcccctgcatatcgaggctgaagatcctgatctcgagccattctctgatccatttactttcgagctggataatacatggggaaatgctgaggatacatggaaactgggaaggaactggggtcaatcagttgagctcttgaccctgagatccctgccccgcggtaactatttggtcccacttttcattggggataagcaggggttgagccagaagcagaccgtccacgtgagaatttgcccatgcgcgtccggcctcacttgcgtggagctagccgatgctgaagttggcctgcatgtcggcgccttatttccagtatgcgcagcttttgtggcactggctgtggctctactgttcctcttgaggtgctacttcgtactcgaaccgaaacggcacggctgcagcgtcagcaatgacgaagggcatcagacgctggtgatgtataacgctgaaagcaagggcacaagcgcccagacctggagcgatgtggaaggacagagacccgccttactcatatgcacagccgcagccggccctacacagggtgtgaaagacctcgaagaggttccgccaagcgctgcttcgcaatcagctcaggcacgctgtgcattgggcagttggggatatggcaagcctttcgaaccccgtagcgtgaagaacatacactcaaccccggcctatccagatgccacaatgcatcgccagctcttagctccagtcgagggtcgaatggctgagacgctcaaccagaaactccacgtcgccaacgtcttggaagatgaccccggctacctgccccatgtgtactcagaagagggggagtgcgggggagccccctcactgagttccctcgcctcgcttgagcaggagttgcagccggacctcttggattctcttgggtcgaaggctacgccgttcgaagaaatctatagtgagtctggcgtgccttcctag

SEQ ID NO: 40672 - DNA, 498 bp, Artificial Sequence
  Description of Artificial Sequence: Synthetic coding sequence
atgaagcccctgatctggacctggagcgacgtggagggccagcggccggccctgctgatttgcacagccgctgccggtcccacgcagggggtgaaggatttagaggaggtacccccatcagccgcctcccagagcgcccaggctcggtgcgcactgggtagctggggttatggaaagcccttcgaaccaagaagcgtgaaaaatatacattcaactcctgcttaccctgacgccaccatgcataggcagttgttggctccagtagaaggcagaatggccgaaaccctgaaccagaagctgcacgttgccaacgtgttggaggacgaccccggttacctcccccatgtgtatagcgaagaaggagaatgcggcggcgctcccagcctgtccagccttgcctccttggagcaggaactacagccagatcttctggactcactgggatctaaggccaccccatttgaggagatctatagcgaaagtggcgtcccgtcttag

SEQ ID NO: 40673 - DNA, 1335 bp, Artificial Sequence
  Description of Artificial Sequence: Synthetic coding sequence
tgacggcccggcaccctgctgggcaccttcaacgccatggaccccgactctcagattagatacgaactggtccatgacccggcgaattgggtgtccgtggataaaaattctggtgtggtgatcacagtggagcctattgaccgcgagtctccccatgtcaataactccttttatgtgatcattatccacgcagttgacgacggcttccctccacaaacagcaacaggaacattaatgctttttctgtccgacattaatgataacgtcccaacacttagaccacgaagccggtatatggaggtctgtgaaagtgctgtccacgaaccgttacatattgaggccgaggatcccgacttggagccctttagcgacccatttacttttgaactggacaatacatggggcaatgccgaggacacttggaagcttgggcggaactgggggcagtcagtggagctcctcacactgagatcgctgcctcgagggaattacctcgtccccctatttatcggggataagcagggattgtctcagaaacagacggtgcacgtacgtatctgtccctgtgcttctggactcacatgtgtggaactggccgacgccgaagttggcttgcacgttggggctctgtttcccgtgtgcgccgcctttgtggcgctcgctgtggccctgctcttcttactccgatgctacttcgttctcgaacctaagaggcatgggtgttctgtatctaacgacgagggacatcagacacttgtaatgtataatgccgaatccaagggaacctcagctcagacgtggagtgacgtggagggccagcggccagcccttctcatatgcactgccgcagcgggacctacacaaggcgtgaaagcctaccccgatgcgactatgcaccgtcagctgctggctccagtcgagggaaggatggctgagacattgaaccagagtaaagagcggaacaggttctctctgtccagggggtgcattattcctcagggccgcgcaacagccggcaggggtctcccacaagacatatataaagagatgatgccccgcagactgacacagacaggcaaaagaaagcatggggctctggcccgcactccctccttcaagaaggtcgtttatgatcataaggaggacgaagagaacaaggctggaagaaaacagagaagccacctcttcaaagtaatgcagcttaggaatgaacagggcggggttcgagtgcagagcgcgcactccccgtcgccactgaataaaaaggcctgctttcccggcgattaccgaggcgaaagtgctgggggtcacaattgtcgggctgtaagcggctag

SEQ ID NO: 40674 - DNA, 3933 bp, Artificial Sequence
  Description of Artificial Sequence: Synthetic coding sequence
atggcccagctgtggctgagctgcttcctgctgcccgccctggtggtctctgtggcagccaacgtagccccgaagtttctggctaatatgacatctgtgatactgcctgaagatctgccagtgggcgcccaggcgttctggctcgttgccgaggatcaggataatgatccgctcacatacggaatgtcagggcctaacgcctactttttcgcggttacccccaaaaccggagaggttaaactggcctcagccctcgactatgagaccctgtatacatttaaagtgacgataagcgtgtcagacccatatatacaggtacagcgggagatgctggtgatcgtggaagacagaaatgataatgccccagtgttccagaataccgccttctctaccagcatcaacgagacgttacccgttggttccgtcgtcttttcggtcctggctgtcgataaagatatgggctccgccggaatggtagtatacagcattgagaaggtcattccgtctacgggtgacagtgagcatctttttcgaattttagctaacgggagcatcgtcctgaacggctccttatcttataataataagtccgcattttatcagctggagttaaaggcctgtgacttgggtgggatgtaccataacacgtttaccatccagtgttcccttcccgtgtttttgtccatcagcgttgtggaccagccagatttagacccacagtttgtccgcgaattctattcagcgagtgtagcagaggatgcagcaaagggcacaagtgtacttaccgtggaagccgtcgatggtgataaagggatcaacgaccccgtcatctatagcatatcctatagtaccagacctggctggtttgacattggtgccgatggcgtgattcgagtgaacggaagcctggacagggaacagctgttggaggcagatgaggaggtccaactgcaggtcacagctactgagacgcatctgaacatctacggccaggaggccaaggtgagtatctgggtgactgtgcgggtgatggatgtcaatgaccacaagccagagttctataattgctcactgcctgcttgtactttcactccagaagaagcccaagtgaactttacaggatatgttgatgaacacgcatcaccccgaattccaatcgatgacctcacgatggttgtgtatgatcctgataaaggttcgaatggcacattcctgttatcattgggaggaccagatgctgaagccttttcagtgagccccgaaagagctgtgggttctgcttccgtgcaggtgttggtccgggtcagcgccttggtcgattacgagcggcaaactgccatggctgtccaggtggtagccaccgatagcgtttcgcaaaacttctctgtggctatggttacgattcacctgagagatatcaatgatcatcggcccacatttccacagagtctgtacgtgctaacagtgccagagcactcagccaccgggtccgtggtaactgacagcattcatgcaactgaccccgatacgggggcctggggccagattacttactctctgctcccggggaacggagcagatcttttccaagtggatcctgtgtccggcaccgtgactgtgcgaaacggtgagctactagacagagaatcccaggccgtctattatctcacacttcaggcaacagatggaggcaacctcagcagctctactacactccagattcatctgcttgacatcaatgacaatgccccagtcgtctccggcagctacaatatcttcgtgcaggaggaggagggcaacgtatccgtaacaatccaggcccacgataatgacgaaccgggcaccaataatagccgcttgcttttcaacctccttcctggtccgtattcccacaatttctcacttgaccctgatactggcctacttcgtaacctcggtccgttggatagggaagccatcgacccagccttggagggcaggatcgttctcaccgtcctggtgagtgactgcggtgaacccgtgcttggaacaaaagtgaacgtgacaatcactgttgaagacattaatgataatctgcccatctttaaccagtctagctacaacttcaccgtaaaggaggaagaccccggcgtgctcgtgggcgtggtgaaagcctgggacgccgaccaaaccgaggccaataatcgcatctcctttagtttgtcaggatctggcgctaactatttcatgattcgaggattagtactcggcgcgggatgggctgagggatacctccgcctaccaccagacgttagtctagactatgagacgcagcctgtgtttaacttaacggtcagcgcggagaacccggatcctcagggcggtgagacgatcgtcgacgtgtgtgttaacgtcaaagacgttaacgataacccgccgaccctagacgtggcatctctgcggggaatcagggtggcagagaacgggagccaacacggccaggttgccgtcgtggtcgccagcgatgtggacacctcggctcagttagagatccaacttgtgaacatcctgtgcaccaaggccggtgtagacgttggcagtctatgttggggttggttcagcgtagcagcaaacggatccgtctacattaaccaaagcaaggccattgattatgaggcatgcgatctggttaccttggtggttcgggcatgtgatctcgccactgatccgggctttcaggcgtacagcaacaatggctccctccttatcacaatcgaagacgtgaacgataatgccccgtactttctgcctgagaacaaaaccttcgttatcattcctgaacttgtcctccctaaccgggaggtggcctccgtcagggctagggatgatgacagcgggaacaatggcgtcatcttgttcagtatccttcgcgtggattttattagcaaggacggcgcaacaatcccctttcagggagttttctctatttttacttcttcggaagcagacgtgttcgccgggtccatccagcccgtgacttccctcgattccacgctgcaaggtacgtatcaagtaacagtccaggcccgtgacagaccctctctgggcccgtttctcgaagccaccacaactttaaatctgtttactgtggaccaatcgtatcgcagccggttacagtttagcactccaaaagaagaggtgggtgcaaatagacaggcgatcaacgctgcactcactcaggccaccagaaccactgtgtacatcgtagatatacaggacattgactctgctgcaagggccaggccacatagttatttggatgcatatttcgtgttccccaatggttctgcactcactctagatgagctaagtgtcatgattcgtaatgatcaggattcactcacccagttgctgcagctcggcctggttgtgctggggtcacaggagagccaggagtctgatctctccaaacagctgattagcgtcatcatcggccttggagtcgcattgctactggtgcttgtgattatgactatggcgttcgtatgtgtgcgcaagtcctacaacagaaaactgcaggcaatgaaagctgctaaggaagcgcgcaaaacagccgcaggcgtcatgccaagcgcgcctgccatcccgggcacaaacatgtataataccgaaagagcgaaccccatgttgaacctcccgaataaagatctaggcctcgagtatttgtccccctcgaatgatctggactccgtaagcgtgaactccctagacgacaatagtgtggatgtggacaaaaacagccaggaaattaaggagcatcggcctccacatacacctccagagcccgatcctgagcccctgtctgttgtgctgctggggagacaagctggagcaagtggacagctagaaggcccttcatacacaaatgccggattggataccactgacctgtag

SEQ ID NO: 40675 - DNA, 3933 bp, Artificial Sequence
  Description of Artificial Sequence: Synthetic coding sequence
atggcccagctgtggctgagctgcttcctgctgcccgccctggtggtcagcgttgccgctaacgtcgccccaaagttcctggccaacatgacatccgtgatcctgcccgaagatttgcctgtaggcgcccaggcattctggctggtcgccgaggaccaggacaacgaccccctcacttacggaatgtccggccccaatgcctacttttttgctgtaacccctaaaaccggagaggtgaagctggcttccgctctagattacgagactctgtataccttcaaggtgaccatttctgtgagcgacccctatattcaggtgcagagggaaatgctcgtgatagtcgaagatcggaatgataacgcccctgtgttccagaacacagcgttctccactagtattaatgaaacccttccagtggggtccgtggtgtttagcgtactggccgtggataaggatatgggaagcgccgggatggtggtgtactctatagagaaagtgattccttccaccggggacagtgaacatctatttagaatccttgcgaatggctctatcgtgctcaatgggagtctttcatataataataagtccgccttctaccagttggagttgaaagcttgcgatctgggcggaatgtaccacaacactttcaccattcagtgcagcttacctgtttttctgtctatttcagttgtggaccagcccgacctggacccacagtttgtgcgggagttttactctgcctctgtggctgaagatgcagccaaaggcaccagtgtactgaccgtcgaagcggtggatggggataagggtatcaatgaccccgtcatctacagtatctcttacagcacacgtccgggttggttcgatattggggctgatggggtaattcgggtgaacggttcgcttgaccgcgagcagctgttagaggccgacgaagaggtacagctccaggtgacagcaacagaaactcacttgaatatatatggccaggaggcgaaggtttctatctgggtaaccgtgagagttatggacgtgaacgatcacaaacctgagttttacaactgtagcttacctgcttgcactttcaccccagaggaggcccaggtaaacttcacgggttatgttgatgagcatgcgagcccgagaatccctatagacgacctgacaatggtggtgtatgatccagataaggggtcgaatggcactttcctgctgtccctgggagggcccgatgcagaggcatttagtgtgtcgcctgagcgggctgtgggatcggcctctgtacaggtgctagtgcgggtgtccgctctggttgattacgaacggcagacagccatggcagtccaagtcgttgccactgatagcgtgtctcagaacttctctgtggccatggttacaattcacctgcgagatataaacgaccataggcctacatttccgcaaagcctctacgttctgactgtaccagaacatagcgctaccggctctgtggtgacggacagcattcacgctacagatcctgacactggagcatggggacagattacttactcactgcttcccggaaatggcgccgatttatttcaggtcgaccccgtgtctggcaccgtgactgtgcgaaatggcgagctcctcgatagagaaagccaggctgtgtactacctcacgctccaagccaccgatggcggtaacctgtcgtcgagcaccacgctgcagatccatctgctagatattaatgacaacgccccagttgtctcagggtcctacaatattttcgtacaagaagaggaagggaatgtgtcggtcactattcaggcacacgataatgacgagcctggcaccaataactctcgcctgttgtttaatctcctgccaggtccctattctcacaatttttctctcgacccagacacaggccttctgcgaaacctcggacctctggatagagaggctatcgatcctgccttggagggacgcatcgtgttgaccgtgctggtctcagattgtggagaacccgttctaggaacgaaagtgaacgtaacaatcacggtggaggacattaatgacaaccttccaatttttaaccagtcgagctacaacttcactgttaaagaagaggaccctggagtcctggtcggggtcgttaaggcttgggacgccgatcagactgaggccaataatcggatatcatttagtttgtccggatccggagctaactatttcatgataagaggcctggtactcggggctggctgggctgaaggctatctacgcctcccccctgatgtctcactcgattacgagactcagccagtgttcaatctgaccgtgagcgcagaaaaccccgaccctcagggcggcgagactattgtagacgtttgcgttaatgtgaaagatgtgaacgacaatcccccgacgctcgacgtggccagcctccgcggaattagggtggcagagaatgggtcccagcacggacaggtcgcggttgtggttgcttctgacgttgatacttcagcacagctggaaatccaactggttaacatcctgtgcacaaaagccggggttgatgtcgggagcttgtgttggggatggttttccgtcgccgctaatgggtccgtgtacatcaaccaatcaaaagccatcgactacgaagcttgcgatttggtcacactggtggttagagcttgcgacttggctactgatcctggcttccaggcttactcaaataacgggtccctgcttattacaatcgaggacgttaatgataatgcaccctactttctgcctgagaataagacttttgttatcatccctgagctggtgctgcctaacagagaagtcgctagcgtgagagcaagggatgatgatagtggcaataatggcgtcattctcttcagtattctgagagtcgacttcatttctaaagacggcgccaccatcccatttcaaggtgtgttcagtattttcacatcctccgaagcggatgtttttgcaggcagcattcagccagtcacttctcttgactctaccctgcaagggacctaccaggtgactgtgcaggccagagatcgaccaagcctgggtccgttcctggaagccactacaaccctgaacctgtttactgttgatcagtcttaccgatccagactgcagttctccaccccgaaggaagaggtcggagcgaatagacaggctatcaatgccgcactcacgcaggcaacacggacgacagtttatattgtggatattcaggatatagacagtgctgcccgggccagaccacattcttatttggacgcatactttgtctttcccaatggctcagccctcacactggatgaactttctgtcatgattaggaacgaccaggatagcctcacccagttactccagctgggtctggtggtcctgggatcccaggaaagccaggagtccgacctctctaagcaattaatttccgttatcatcggcctaggcgtagctcttctgctcgtgctggtgataatgacaatggcattcgtttgcgtgaggaagagttataaccgaaaattacaggctatgaaggccgcaaaggaagcgcggaagacagcagcgggggtgatgccctcagcccccgctatcccaggaacaaacatgtataatactgaacgggccaatcccatgctgaaccttccgaacaaagatctgggcctggagtacctgtccccatccaatgacctagatagcgtgtctgtgaatagcctggatgacaattctgtggacgttgacaaaaattcacaagagattaaggaacacaggcctccccacactcctcccgagcctgatcctgaacccttgagtgtggtccttctgggtagacaagcgggcgcatccgggcagctggagggtccttcttatactaacgccgggctggataccacagacctctag

SEQ ID NO: 40676 - DNA, 3933 bp, Artificial Sequence
  Description of Artificial Sequence: Synthetic coding sequence
atggcccagctgtggctgagctgcttcctgctgcccgccctggtggttagcgttgcagctaatgtggcaccaaagtttctcgcaaacatgacctccgtgatcctgccagaagaccttcccgtgggagcccaggcgttttggctggtagctgaagaccaggataacgatccactgacttacggtatgagtggaccaaatgcgtatttcttcgcggtaaccccaaagactggagaggtaaaactcgcgtccgccctggactatgagaccctttatactttcaaagtgacaatttccgtttccgacccctatatccaagtgcagagagaaatgctggtcatagtcgaagaccgaaacgacaacgcccccgtgtttcagaacactgctttctccacctctattaatgagaccctgccagtgggttctgttgtcttctctgtcctggcagtagacaaagatatggggagcgcaggcatggtggtctactcaatcgagaaagtgattccttcgacaggggatagcgaacacctttttaggatactggcgaatggctccattgtgctgaacggatccctgtcctataataacaagtcagctttttatcagcttgaattgaaggcatgcgacctgggaggcatgtaccacaacacctttaccattcaatgctcactaccagtgttcctttcaatatccgttgtcgatcaacccgatttagacccacagtttgtgcgtgagttctattctgccagcgtcgctgaggatgcagcgaaggggacatccgtgttgactgttgaagccgtggatggcgataaagggataaatgacccagtaatttactcaattagttacagcacaaggccaggatggtttgatatcggcgcagatggagtcattcgtgtgaatggctctctagaccgggaacagctgctcgaagccgatgaagaagtgcagttgcaggtgactgctacagaaactcaccttaacatctacggccaagaggccaaggtgtctatttgggtgactgtaagagtgatggacgtcaatgaccacaaacctgaattttacaactgtagtctgcccgcatgtactttcaccccggaggaggcccaggttaatttcacaggatatgtcgacgagcatgcatcccccagaatacccatcgatgacttaaccatggtggtatacgaccccgataaggggagtaatgggacatttctgttatcgttaggtgggcccgatgccgaggcattctctgtatccccagaacgagctgtagggagcgcatcggttcaggttttggttcgagtgagtgcactggtggattacgaacgacagacggccatggctgtgcaagtggtcgcaaccgattctgttagtcagaactttagcgtggctatggtcacgatccacctgcgagacatcaacgatcaccgccctacatttccccagtcactgtacgtcttgacggtgcccgaacattccgctaccggctcagtcgtgaccgactccattcacgcgaccgaccccgatacgggcgcatgggggcagatcacctactcccttcttccgggtaatggagcagacctatttcaagtggatcctgtcagtggcaccgtgacggtcagaaatggtgagctcctggaccgcgagtctcaagccgtgtattacctgacccttcaggctacagatggtggaaacctgtcttctagtactacactgcaaatacacctcctggatatcaacgacaatgcacctgtggtgtctggctcttataatatttttgtgcaagaggaggagggtaacgtgtcagtgactattcaagcccacgacaacgacgagccaggaaccaacaattctcgcctgctctttaacctactcccgggtccatactcgcataatttcagtttggacccggacactggtctcctcaggaacctgggccccctagatcgagaggccattgatcctgccttagagggccgaatagtactgacagtgcttgtgagtgactgcggcgagcccgttctgggtacaaaagtcaacgttaccatcacagtcgaggatattaacgataacctgcccattttcaatcaaagcagttataacttcaccgttaaggaagaagacccaggcgtcctagtgggtgtagtcaaggcgtgggacgcggaccaaacagaagctaacaatcggatttcattcagccttagtggtagtggggccaactattttatgattagaggactggtgcttggagccggctgggccgagggctacctgaggctcccgcctgatgtgagcttggactacgagactcagccagtattcaacttaacagtgtcggctgagaacccagatccacaggggggcgagacaattgtggacgtctgtgtcaatgtcaaggatgtgaatgacaaccctccaacgcttgacgtggcctcgctccgcggcataagggtggcagagaacgggagtcagcacggccaggttgctgtggtagtggcttctgacgtggacacgtctgcgcaactcgaaatccagctcgttaatattctctgtacgaaggcaggggtagacgtaggatcactgtgctgggggtggttcagcgtggcagccaatggttctgtctatataaaccagagtaaagctatcgactatgaggcgtgcgacctggtcaccctggtggttcgtgcttgtgatctggccacagaccccggtttccaggcttactctaacaatggtagcctcttgatcaccatcgaggatgtgaacgacaatgccccctactttctgcccgagaataagacattcgtgattattcccgagctcgtgctccccaatcgtgaggtggctagcgtccgggcgcgggatgacgatagcgggaataacggggttattctattcagcatcctccgggtggacttcattagcaaggacggggcgacaatcccatttcagggcgtcttcagcatctttacaagcagcgaagcggacgttttcgcaggcagcatccagccggtgacctctctcgactctacattgcagggtacatatcaggtaacagtgcaggctcgggaccggccaagccttggaccatttctagaggctacaaccacgttaaacctgttcaccgtagaccaatcgtataggagccgcctccagttttcaacccccaaggaagaggtgggggccaaccggcaagctatcaatgcagcattgactcaggcaacaaggaccaccgtgtacattgtagacatccaggatatcgacagtgccgctcgagcacgcccccattcttatctggacgcatactttgtctttccaaacggatccgctctgacactggacgagctatccgtgatgatcaggaacgatcaagatagtttaactcagctgctccagctgggcctggtagtactggggagccaggagtcccaggagtcagacctctccaaacagttgatctcagtcataattggactcggtgtcgctctgctcctagtgctggttatcatgaccatggcgttcgtctgtgtgagaaaaagctataaccgcaagctacaggccatgaaagccgctaaggaagcaagaaagacagctgctggcgtaatgcccagcgcaccggccattccgggtactaacatgtacaacaccgagagggcaaaccccatgctgaaccttcccaataaggatctaggactggaatacctcagccccagcaatgacctggactcagtgtccgtgaattccttagacgataactctgtggacgttgataaaaacagtcaggagatcaaagagcatcggccccctcatactccaccagagccagatcccgagcccctttctgtcgtgctgttggggagacaagccggagccagtgggcaactggagggccctagctacacaaacgctggcctggataccactgatctttag

SEQ ID NO: 40677 - DNA, 2658 bp, Artificial Sequence
  Description of Artificial Sequence: Synthetic coding sequence
atgcaggaggccatcatcctgctggccctgctgggcgccatgagcggaggtgaggccctgcatctcatcctgctgccggccacagggaacgtggctgagaattctccacctggaacgtctgtgcacaagttttccgtgaaactttcagcctccttgtccccggtaatccccgggtttccccagattgtcaattcaaatccactaacagaagcctttcgcgtcaattggctgtcaggaacctacttcgaggtggtgacgaccggtatggagcagctggacttcgagacgggcccaaatatttttgatctgcagatctatgttaaagacgaggttggagtgactgatctgcaggtcttaactgttcaagtgacggacgtcaatgaacctccacagtttcagggaaacctcgctgaagggttgcacctgtacattgttgaacgcgccaacccaggtttcatctaccaggtggaagccttcgaccctgaggacacaagccgcaacatcccacttagctatttcttgatttcaccaccaaaaagtttcagaatgtctgctaacggcactctgttctctactacggaactggatttcgaagccggacacagatcttttcatttaattgtggaagtgagagactccggcggcctgaaagcctctacggaactgcaggtcaacatcgttaacctaaatgacgaggtcccaagattcacgtcaccaacccgcgtctacaccgtgctcgaggagctgagcccaggcaccatcgtggctaatatcacagccgaggatcccgatgacgaaggtttcccctcccacctgctgtactccatcaccaccgtgagtaaatatttcatgatcaatcagcttacaggtacaatccaggtcgctcagcgcattgatcgggacgcaggagagctgcggcagaatccaactatctccctggaggttcttgtgaaagatcgcccctatggtgggcaggaaaacaggattcagatcacctttattgtcgaagatgtgaacgataacccagccacatgccagaaattcacattttccatcatggtgccggagcgcaccgcaaaagggaccctcttgctggatctcaataaattctgcttcgatgacgactccgaggctcctaataataggtttaacttcacgatgccaagcggggtgggctccggcagtcgctttttacaggacccagctggcagcggaaaaattgtgttgattggagatctcgattacgagaatccctccaacctcgctgccggcaacaaatacaccgtgataatacaggtgcaggacgtggctcccccatactacaagaataatgtgtacgtgtacatcctgacctctccggaaaatgaattccccctcatcttcgataggccatcctacgtattcgatgtgtcagaacggcggcccgctcggacccgggtaggtcaggttcgcgcaactgacaaggatctgccacagagttctctgctgtacagtatcagcaccggcggcgcaagcctgcaatatcctaacgtcttttggatcaacccaaagacaggtgaactccagctcgtgacaaaagtggattgcgagactactcccatctacatcctccgcatacaggcaacaaacaacgaagatactagcagcgtaactgttaccgtgaacatcctcgaagagaacgatgagaagccaatatgcactcctaacagctactttttggcattgcctgtagacctgaaagtgggcaccaatatacagaatttcaagttgacttgtaccgacctggattcctctcctcgatctttccgatacagcataggacccggtaatgtgaacaaccactttacattcagcccaaatgccgggtccaatgtgacacgtcttctgctgactagcagattcgattacgctggagggtttgacaaaatctgggattacaagcttctggtgtatgtgacagacgataatctaatgagcgatagaaaaaaggctgaagccctggtcgagacaggtaccgtgactctttctatcaaggtcattccccatcctactacgatcattacgaccactccacgaccaagagtaacttaccaggtgctccgcaagaatgtctacagtccctccgcctggtatgtgccttttgtgatcacactggggagtattctcttgctcggcctgctggtgtacctggtggtgctcctggccaaggccatccaccgtcattgtccttgtaagaccggaaaaaacaaggaaccactgaccaaaaaaggagaaaccaagaccgccgagcgcgacgtcgtcgtagaaactatccagatgaacacaatatttgacggcgaagccattgaccccgttactggtgagacgtatgaattcaatagtaaaacaggggccaggaaatggaaggaccctctgacccagatgcccaagtggaaggaaagtagtcaccagggcgccgcaccccgtagagtcacagctggagagggcatgggttccttgaggtcagctaactgggaagaggatgagctgtccggtaaggcttgggccgaagatgcgggtttaggatcccgcaacgagggggggaagttgggcaatccgaaaaacagaaacccagccttcatgaatagggcgtatcctaagccgcacccgggtaagtag

SEQ ID NO: 40678 - DNA, 600 bp, Artificial Sequence
  Description of Artificial Sequence: Synthetic coding sequence
atggtgctgctgcggctgctggtgttcctgttcgcccccgtggtgagtgacctttgctcgctcccctgcttcataaatgtgtctgagagccagggccccggaactgttctgcaatttctctcttttaactgttcttcgtacacccccacaccaaccctggagctcctgaatgttcagcctcccacaactttttttaaccccccaagcctggcccgatggcagggtacctatgtcgggaagctgaccctatccagctctgcacaactggatgcactcatggtcaaccattacaaagtgcagctcaaatttacctgcggcaaccacgtcatggaaggctcgctgtccgtcgatgtgcagagggacttgtcccatatccagtgcgctggtcaattcgcgagccccggggaagcaagggggtccaggcagggcggcggccgccatggattgagtcgatcctcactgactagcacacttgcaagttggggcaacgacagcggcgccagggactctcacacatgggggtctgccgtccattcggctcctccaagacccagaacacctcgaagcgcagggaagccaaggacatgggacggaggctag

SEQ ID NO: 40679 - DNA, 2367 bp, Artificial Sequence
  Description of Artificial Sequence: Synthetic coding sequence
atggtgctgctgcggctgctggtgttcctgttcgcccccgtggtgtccgacttgtgttccttaccttgctttattaatgtgagtgaatcccaaggacccggaacagtgcttcagtttctttcattcaattgctccagctacaccccaaccccaaccctagaacttctgaacgtgcaaccacctactacattcttcaacccaccgtcgcttgctaggtggcaggggacatacgtggggaagttgaccctgagtagctcagctcaattggatgcgttgatggtgaaccactacaaagtgcagcttaaattcacatgtggtaaccacgtcatggagggttccctcagtgtcgacgtgcagcgggacctcagtcatattcaatgtgcaggccaatttgcttccccggccggcgaaatgatacaggtcccagagacagtgactccgggtgctagactgtacacactgttattgccaggtctggagctgcacggggctcagatgtcaataataagcgcacaagatctgccccacttccctggaccctttagcatcaacgaacagggctggttacaggccccctctcaagggctgcttggtcaggctcagaaagtgtttcagctgcagatcagtgtctctttcgggcagaggcagtcatgtcagggcatggtgattgtgaaagtgcttccagtgccaagttcacaggtgagttttctggagcaggcccaaaatataacaattcctgagaacttagcaccgggttccgaagtcgtacaggtgcaggccagaggagtggatctcaggtatgagattcttagtccagtaccgtcacccttgtttagcatcgggagggcggatggggttgtccggactacaacccccctcgaactcgctcgtacttcaggcacggcggtttctcgactacaagtgaaagcatttgagcaaggacaattgtgggcgtcagctaaattgaatcttaccatgaacgtccagttggtgaacctgtggcctccaaggtgtctgcccgccctactagtgagccaaattcccgaaaccgcccctgtaggcacagttctcaacacactgacgtgtgaggatcccgattccgtcggggctaccctggactacaagctttggttccgatctagctctaatcccgcctcactttgcctctacgatcgtgtgctggaggtgaacgcgacattggactgcgatacacctggagcttgtttccaacacgccgcctctatcctcgtgctagatggcgggcaaccccaaatgaccacagaggtgcccgtattggtgatggtcactcccattaatgagttctcacccgcgtgtgcgcccagaactttccgtgtgcaggaagatgcagcacctcacaccctactaggatctgtggtcgggactgatatggactacccccatgacaatatcgagtattatacatctggcggcccgactacattcgcagtcgaccgtttaagcggcgaggtgcaccttctgggcccactagactacgagcagcaaagactgtaccgtttgacggtgttagtaatcgaccacgggcaggaccaaaaccccaaccaccacttgagtgggtcctgcactatcaccatcgaggttgaagatgtaaatgaccatgctccggaatgtgaaccaccttttcaggagctgaccatttatgctcccctaggcaggtccgtggaagtgaccaaaatgtcttgccagatcccgcaggagccacagcggctaatctattcttacagcattgtcggcgggaattcccaaaatagattcatactgcaaggcgcaattctggtccattccgacttggtcttgggcccattttggcccgaacagcccagaacttatgagctgctaatttgcgtggccgatgccggaccaagtactccacatctcagcacaacagctaccatcatcgtgcacctggttccgcgcagagcctcgactgtggccacatctacacaccgcaccactgtgccttcaactatgactcctatgctggtgaccgacacagaagcgttctggcagccccagccgtggtttgtcgttgtactcactgccactggcgccctcctactgctcgcactcggctggctgctgggccggctgcttcagggcttggcccagctgctacaggcccccagcaagccagcgcaggctctgctactgaactccatacagggcaccgagggttcaatagaaggctttttggaggctcccaaaatggaaatgagtcaggcgccctcttcggtaatgtctcttcatttcgacggcagagcacaagacagcagaacaggtagagattatctcttcaacacccacactggagcccggagatggctctag

SEQ ID NO: 40680 - DNA, 684 bp, Artificial Sequence
  Description of Artificial Sequence: Synthetic coding sequence
atgggcaactgcgtgaagtaccccctgcggaacctgagccggaagatgtgtcaagaggaacaaacgagctacatggttgtccaaacctctgaggaagggctggctgctgacgccgaacttccgggccctctcctgatgttggcgcaaaattgcgctgtgatgcataatttgctgggccctgcctgtatattcttgcgcaaaggctttgctgagaacaggcagcccgacagaagcctcaggcccgaggagatcgaggaattgcgcgaagctttccgcgagttcgacaaagacaaggacggatacattaactgccgtgatttgggcaactgcatgaggactatgggatatatgcccacagaaatggagttgatagagctgtcacagcaaatcaatatgaacctcgggggccatgtggactttgacgacttcgtggaacttatgggaccaaagttactggctgaaacagccgatatgattggagtgaaagagcttcgagatgcctttcgggaattcgatacaaatggcgacggagagatctccacctccgagctccgggaggcgatgcgcaaacttctgggacaccaagtcggccatagagatatcgaggagatcattcgagatgtggatttgaacggagacggacgagttgatttcgaagaatttgtgcgaatgatgtcgaggtag

SEQ ID NO: 40681 - DNA, 1113 bp, Artificial Sequence
  Description of Artificial Sequence: Synthetic coding sequence
atgggcggcggcgacggcgccgccttcaagcggcccggcgacggcgctcggctgcagagagttctgggactcgggagtagacgcgagccgagaagcttacccgccggaggaccagctcccaggcgcactgcccctccccctcccgggcatgcctccgccggcccagccgctatgagctcccatatcgctaaatctgaatctaaaacctccctcctgaaagccgcagcagccgcagctagcggtggcagccgggcccctagacatggccccgctagagacccagggctcccgagtcggcggctcccgggaagctgcccagctacacctcagagtagcggggatccttctagcagaaggcccctgtgtcgcccagctcccagggaggagggcgccaggggctctcagagggttctcccacaagctcattgcagacctagagaggccctgcctgccgccgcttcacgcccgagtccgtcgtccccactgccgcccgccagaggtagagacggggaagagcgcggtctatcccctgctctaggcttgagaggctctctgagggctcgcggtcgcggcgactccgtacccgccgccgcctccgaggcagacccttttctacaccgccttcgtcccatgctgtccagcgctttcggccaggataggtctctcagaccggaggagatagaggagttgcgagaagcgttcagggaattcgataaagacaaggatggctacattaactgcagagatctgggcaactgcatgagaacaatgggatatatgcccacggaaatggaactgatagagctgtcgcagcaaattaatatgaatctcggagggcacgttgacttcgacgattttgtagagctgatgggccctaagctgctggccgagacagccgacatgattggagtaaaggagttgagggacgcgtttagagaattcgacacaaatggcgatggagagatttctacatcagagctaagggaggctatgaggaagctcttaggccatcaagtgggccatcgggacattgaagaaattattagagatgttgatttgaatggagacggacgggtcgactttgaggaattcgtcagaatgatgtcacgctag

SEQ ID NO: 40682 - DNA, 504 bp, Artificial Sequence
  Description of Artificial Sequence: Synthetic coding sequence
atgggcaactgcgtgaagtaccccctgcggaacctgagccggaaggatagatctctccgccccgaagaaatagaagaactgcgggaggcttttagagagttcgacaaagacaaggacggttacatcaactgtagggatctcgggaattgtatgcggacgatggggtacatgccgaccgaaatggagctcattgagcttagccagcagatcaatatgaacctgggtggacatgtggactttgacgacttcgtggagctgatgggacctaagttgctagcagagacggccgacatgataggggtaaaggagctgcgcgatgccttccgggagtttgacacgaacggcgacggggaaatcagcaccagcgaactcagggaagctatgagaaagctgctcggacaccaggtagggcatcgtgatattgaagaaatcatcagggatgtcgacctgaacggggacggcagggtggatttcgaggagttcgttaggatgatgagccggtag

SEQ ID NO: 40683 - DNA, 1266 bp, Artificial Sequence
  Description of Artificial Sequence: Synthetic coding sequence
atggtggagatgctgcccaccgccatcctgctggtgctggccgtgtcagtggtggctaaagataacgccacgtgtgatggcccatgcggcttgcgattcagacagaatccacaaggcggtgtacggattgtgggtggaaaagcggctcagcacggggcctggccatggatggtctcgctccaaattttcacctacaatagtcacagataccacacttgtggtggctccctcctgaatagcaggtgggttctcacagcggcgcattgttttgtaggtaaaaacaatgtccacgattggaggctggtgttcggagccaaggaaattacttatggaaataataagcctgttaaggcgcctctccaggaacgatacgtggagaagataatcatacatgaaaaatataatagcgcgaccgaggggaatgacatcgccctggtggagatcacgcctccaatcagctgtggtcgattcatcgggcccggctgcctgcctcatttcaaagcgggactcccacgtgggagccagtcctgttgggtagcgggatgggggtacattgaggagaaggccccccgacccagctctattcttatggaggcaagagtggacttgattgacctggatctgtgcaattcgactcaatggtataatggacgggtgcagcccacaaatgtgtgtgcagggtatcctgttggtaaaatcgatacgtgtcagggagacagcgggggcccactgatgtgcaaagactccaaagagagtgcttatgtcgtggtgggaatcacatcttggggggtgggttgcgccagagccaaacggcccggcatctacacggccacttggccgtatcttaattggatcgcttccaagatcggctctaacgctctgcggatgattcagtccgctacacctccgccacccacgacccgaccgcctccaattaggccaccgttctcccatccaatctctgcacacctgccatggtattttcagcccccaccaaggccattgcctcctaggccacccgcggcccagccaagacctccaccttctccgccaccgccacctcccccacccgcgtctccactgcccccccccccccctccacctcctcccacacctagctccacaaccaagctcccccaaggactcagtttcgccaagcgactgcagcagctgatcgaagtcctgaagggaaagacctactccgatggcaagaaccactacgacatggaaacaacagaactacccgagctcactagtacaagctag

SEQ ID NO: 40684 - DNA, 3333 bp, Artificial Sequence
  Description of Artificial Sequence: Synthetic coding sequence
atggccgccggctgcctgctggccctgaccctgaccctgttccagtctctcctgattggcccctcttcagaggagccattcccaagcgccgtgacaatcaagagctgggtcgataagatgcaagaagacctggtgaccttggcaaaaacagcgagcggagttaaccaactggtggatatatacgagaagtaccaagacttgtatacagtcgagcccaataacgctagacagctggtggagattgctgcacgggatatcgagaaacttctgtcgaatcgctccaaagccctggtacggctggccttggaggccgaaaaagtccaagccgctcaccagtggcgcgaagattttgcctctaacgaggtagtgtactacaacgctaaggatgacctcgatcctgagaagaatgatagcgaaccaggttctcagcgcataaagcccgtctttatcgaggacgctaatttcggacggcagatctcataccagcatgctgcagtccacatcccaactgacatctacgagggctcaacaattgtgctgaacgagctgaactggacatcagccttggatgaggtgtttaagaaaaatagagaggaggatccaagtcttctgtggcaggtattcggctctgctacaggacttgctcgatactatccagccagtccttgggttgataatagccgtacaccaaacaagattgatctttatgacgttaggagaagaccctggtatattcagggggcagcatctcccaaagatatgctgatattggtggatgtatccggatccgtgagtggactcacgcttaaactcattcggacctccgtgtcggagatgctggagaccctgtccgacgatgacttcgtgaacgtagcttccttcaatagcaacgcccaggacgtgtcatgttttcagcacctcgtgcaggccaatgtgcgcaataagaaagtgctcaaagatgccgtcaataatataaccgccaaaggaattacagattataaaaagggtttttcattcgcatttgaacagcttctcaactacaacgtgagccgcgctaactgcaataagatcatcatgctgtttactgacggcggtgaagagcgggcccaggagatcttcaacaagtacaacaaagacaagaaggtccgggtatttaccttctccgtgggccagcataactatgatagggggccaattcaatggatggcatgcgagaacaagggatactactacgagattccatctatcggcgccatccgcatcaatacacaggaatacctggatgtgctcggaagaccaatggtgttggccggggacaaagcgaagcaggttcaatggactaatgtatacctcgacgcactcgagctcggcttggttatcactggcactctcccagtgttcaatatcaccggtcaattcgagaataaaacaaacctcaagaatcagctcatcttgggcgtgatgggcgtcgacgtcagtctcgaggacatcaaacgcctgacacctcggtttactctgtgcccgaacggatattactttgcaatagacccaaatggctacgtgctcctgcatcccaacctgcaacccaagccaattggagtggggatccctaccatcaacctgagaaagaggcgcccaaacattcaaaatcccaaatctcaagagccagtcaccctggattttcttgacgctgagctggaaaatgacattaaggtggagatacgtaacaagatgattgatggtgagtctggggagaaaacgtttagaaccctggtgaagagccaggatgagcggtacatcgacaaggggaacagaacctatacttggacaccggtgaacggtaccgactactccctcgctcttgtgctgccaacctattctttctactacatcaaggcaaaactggaggagaccatcactcaagctaggtgtaaatattgtgagaggtcagactccgagacgctgaaacctgataatttcgaggagagcggctatacatttatcgcccccagagattattgcaacgatctgaaaatttcagacaacaacaccgagtttttactgaacttcaacgagttcattgatcgcaagaccccaaataatcccagctgcaacgccgacttaattaaccgagtgttgctcgatgcaggcttcacaaatgagctagttcagaattattggtccaagcaaaaaaatatcaagggtgttaaggcacgcttcgttgtgacagacggcggtatcacgagggtctatccaaaggaggccggtgaaaattggcaagagaaccctgaaacatatgaggatagcttctataagcgctctctggacaacgataactacgtcttcactgcgccatatttcaataaatctggaccaggggcatatgagtccggcattatggtgagcaaagctgtggagatttacatccaggggaagttactcaagcctgctgtagtgggtattaaaatcgacgttaacagctggatagaaaacttcactaaaacttcaatccgagacccatgtgcgggaccagtctgcgactgtaaacggaactcagacgtcatggactgcgttattttagatgatgggggtttcttgctgatggcgaaccacgatgattacacaaatcaaattgggcgtttctttggcgaaatcgaccccagtctgatgcgtcatctcgtcaacatctccgtgtacgcttttaataagagttacgattaccagagcgtatgtgaacctggagccgcacccaaacagggcgctggccacagaagtgcctacgtgccaagtgtagcagatattctgcagataggctggtgggccaccgcggcagcgtggagcatcctccaacagttcctcctgagccttacctttccaaggctgcttgaggccgtggaaatggaggacgatgattttactgcttcgctcagcaagcagtcttgtattactgaacagacacaatacttttttgacaatgatagcaagtccttctcgggtgtgcttgactgcgggaattgcagccgcatttttcatggggagaagctgatgaacacaaatctcatctttatcatggtggaatctaagggaacatgcccctgcgatacaaggctgctaattcaggctgaacaaaccagtgatggtcccaatccatgtgacatggttaagcagcctcggtatcgaaaaggacctgacgtgtgtttcgataacaatgtcctcgaggattatacggattgtggaggcgtctccggattgaatccctctctttggtatattatcggaatacagtttctattactgtggcttgttagcggatccacccacaggctcctgtag

SEQ ID NO: 40685 - DNA, 3312 bp, Artificial Sequence
  Description of Artificial Sequence: Synthetic coding sequence
atggccgccggctgcctgctggccctgaccctgaccctgttccagtccctgcttataggtccgagctcggaggagccattcccttcggccgtcacaatcaaatcttgggtggataagatgcaagaggatttggttactctggcaaaaactgcttccggcgttaatcaacttgtagacatttatgaaaaataccaagacctgtatacagtcgaacccaataacgccaggcagttggtggagatcgcggcgcgggacatcgaaaaactactttcaaataggagcaaagctcttgtgcggctggcactcgaggccgaaaaagttcaagctgctcaccaatggagggaagactttgcctccaacgaggtggtttactacaacgcaaaggacgacctggaccccgagaaaaatgattccgagcctgggagccaaagaataaagcccgtgttcattgaagacgcaaatttcggccggcaaatttcgtatcagcatgctgccgtgcatatcccaacggatatttatgaaggaagcaccattgttttaaatgagttgaactggacctccgccctggacgaagtattcaagaaaaaccgcgaagaagatccatcactgctatggcaagtatttgggtccgctaccgggttggcccgctattatccggccagcccttgggtcgacaattcccggactcctaataaaatcgatctatacgacgtacggcgacgcccatggtacatccaaggagctgcctccccaaaggatatgcttattctggtcgacgtttcaggatccgtctccggactcaccttgaaattgatcaggacttcggtttcagaaatgctggaaactctgtctgatgatgactttgttaacgttgcatcctttaacagtaatgcacaggacgtgtcttgtttccaacacctcgtccaggccaatgtacgcaataaaaaggtgctgaaagatgcagttaacaatatcacagccaaaggcatcaccgactacaaaaagggattttcatttgcctttgagcaactcctgaattacaatgtctcccgtgctaactgcaacaagatcattatgttgttcactgacggcggcgaagagcgagctcaagaaattttcaataaatacaataaagataagaaggtgcgagtgttcactttctccgtgggccaacataactacgaccggggacctattcagtggatggcctgcgagaataaggggtattattatgaaattccttctattggcgctattcgaatcaacacccaagaatatcttgatgtgctggggagaccaatggtcctggcaggggacaaggcaaaacaggtccagtggacaaacgtttatttggacgcgctggagcttggtctggtcatcaccgggaccctcccagtctttaatattaccggacagtttgaaaataagaccaatttaaagaatcagctgatcctgggggtcatgggggtcgacgtatcccttgaagacattaagcgacttactccaagatttacgctgtgtccaaacgggtactactttgcaattgacccgaatgggtatgtcttactgcaccctaatctgcagccaaagccaattggagtggggattccaaccattaacctccgcaaaagacgaccaaacatacagaatcctaaaagtcaagaaccagtcaccttggatttcctggacgccgaactggagaacgatatcaaggtcgagatcagaaacaaaatgatcgacggcgaatctggtgaaaagacattccgcacactggttaagtcccaggatgagcgatacatcgacaagggcaatagaacttatacgtggacgcccgtgaacggtactgactacagcctggccctggttctgccgacgtatagcttctactacattaaggcaaagttggaggagacaattacgcaggccagatatagcgagacactcaagcccgataatttcgaagaatccgggtacacctttatcgcgcctcgggactattgtaacgatctgaaaatctcagataataacacggagttcctgcttaacttcaacgagttcattgacaggaagaccccaaacaacccttcctgtaatgcagacctcattaatcgggttcttttagacgccggttttaccaatgagctggtccagaattactggagtaagcagaaaaatatcaagggagtgaaagcacgctttgtcgtcaccgacggtgggatcacaagggtataccccaaagaagcaggggaaaactggcaggagaaccctgaaacttatgaagattcattttacaagagaagtcttgacaacgataattacgtgttcaccgccccctactttaacaaatccggaccaggagcgtatgagtccggcatcatggtgtcgaaggccgtggagatttacatccagggcaagctcctcaaacccgccgtcgtgggaatcaaaattgacgtcaattcctggattgaaaactttacaaaaacatctatccgcgatccctgcgcagggcccgtgtgtgattgtaagcgaaacagtgatgttatggactgtgtgatcctggacgatggaggattccttttaatggccaatcacgacgactacaccaaccagatcggaagattctttggagaaatcgacccatcactgatgaggcatttggtaaacatctccgtgtatgctttcaataagtcctacgattaccagagcgtatgtgagcccggcgctgctccgaagcagggagccggtcatagaagcgcttacgtgccatccgtggcagatatccttcagatcggatggtgggctacagctgctgcatggagcatcttgcaacagttccttctgtctctcaccttcccgaggttgctggaggccgtggagatggaggatgatgatttcactgccagcctgagcaagcagagctgtattaccgaacagacacagtacttttttgataacgattctaaatcctttagtggggtgctcgactgcggaaactgctcacgaatttttcatggagaaaagctcatgaacaccaacctgatttttattatggttgagtctaagggtacatgcccatgtgatacccgacttctgattcaggcagagcaaacctccgatggcccgaatccctgcgacatggtcaagcagcccagatacagaaaggggccagatgtatgttttgacaataacgtgttggaggattacactgactgtggcggggtatcaggcctgaatccttcattgtggtatatcatcggaatacagttcctgttactgtggctcgtctccgggtccacacaccgcctgctgtag

SEQ ID NO: 40686 - DNA, 3276 bp, Artificial Sequence
  Description of Artificial Sequence: Synthetic coding sequence
atggccgccggctgcctgctggccctgaccctgaccctgttccagtccctgctgattggaccgagttctgaggagcctttcccttccgcggtgaccataaagtcctgggtcgataaaatgcaggaagatctggtgacattggccaagacagcctccggcgtgaaccagttggttgacatctatgaaaaataccaggacctctatactgtggagcctaataacgctaggcaattagtggaaatcgcagcccgggacattgagaagctgttatcaaaccgctcaaaagcccttgttagactcgctttggaggccgagaaagtgcaggccgcccatcagtggagagaggacttcgcctctaatgaagtggtttactacaacgctaaagacgacctcgaccccgaaaagaacgactcagaacccgggagccagcgcatcaaacccgtttttatcgaagacgcaaattttggaaggcagattagttaccagcacgccgcggtgcacattcctacagatatctatgaaggatctactatcgtgctcaatgagcttaactggacatctgcgctagacgaagtgtttaaaaagaatagagaggaagaccccagtcttttgtggcaggtcttcggctcggctactggacttgcccgatattatccagcttctccttgggtggataattcccgcacaccaaacaaaatcgacttgtatgacgtgagacgtcgaccttggtatatacagggcgcggcctcaccgaaagacatgttaatactggtcgatgtctctggtagcgtctcagggctgactctgaaactgatcagaacttccgtcagcgagatgctggaaacactctccgacgatgatttcgttaacgttgcgagttttaattccaacgcacaggacgtctcgtgttttcagcacctagtccaggcaaatgttcgcaataaaaaggtgctgaaagatgctgttaacaatatcaccgcgaaggggatcactgactataagaagggcttttcctttgcattcgagcagctcttgaattacaatgtctcgagggctaattgcaataagataataatgctctttactgatggcggtgaggagagagcccaggagatcttcaataagtacaacaaggacaaaaaagtcagggtctttaccttctcggtcggacaacataattacgatagaggcccgatccaatggatggcctgcgagaacaaaggctactactacgagattcccagcattggcgcaattaggattaacacccaggagtacctcgacgtgctcggaaggcccatggttcttgctggagataaggccaaacaggtccagtggactaacgtttacctggatgctctggaactgggcctggtgattactggcactcttcccgtgttcaacataacaggtcagtttgagaacaagacaaacctcaaaaatcagctcatcctgggtgtgatgggtgttgatgtgagtctagaggatattaagagactcacgccaagatttactctatgccccaacggatattacttcgcaatcgatcctaatgggtacgttttactgcaccctaacctacagcccaagaatcctaaaagtcaagagccggtcacacttgacttcctggacgcggaactcgaaaatgacatcaaggtggaaatcagaaacaagatgattgacggcgagtctggggagaagactttcaggactctggtgaagtcccaggacgaaaggtacatcgacaaaggcaacaggacgtacacttggactcctgtgaatggtaccgattactcactcgccctcgtcctacctacctacagcttctactacattaaagctaagctggaggagacgatcactcaggcccgtagcaagaagggcaagatgaaagacagcgaaaccctgaaacctgataatttcgaggagagtggatatacatttattgcacccagggactattgcaatgacctcaaaatttccgataacaacacagagttcctgctgaattttaacgagtttattgataggaaaacaccgaataatcctagctgcaacgctgacctgataaatagagtcctgctggacgccgggtttaccaatgaattggtccagaactattggtcgaagcagaaaaacatcaaaggagtgaaagcccggttcgtggtcactgatggcggcatcaccagagtgtatcctaaggaggctggggaaaattggcaggaaaaccctgaaacctatgaagattcattctataaaaggtcgctggacaacgacaactacgtcttcaccgccccatacttcaataaaagtggaccgggtgcctacgagtccgggatcatggtgtccaaggccgtcgagatctatatccaggggaaacttttgaagcccgccgtagttgggataaagatcgatgtaaactcatggattgagaactttactaagacctccatccgcgatccttgcgcgggaccggtttgcgattgcaagcgaaatagcgatgtcatggattgtgtaatcttggacgatggggggttcctgctaatggccaaccacgatgactacacaaatcagataggtcgcttcttcggcgaaatcgatcctagtctgatgcggcacttggtgaacatctccgtatatgcgttcaacaagtcatatgactaccagtccgtgtgcgagcctggggcagccccaaagcagggagcggggcataggtccgcctatgtgccctccgtggcagatattctccagatcgggtggtgggccacagctgctgcctggtctattctgcaacagttcctgttatctctgacgttccctaggctgctggaagccgttgagatggaagatgacgacttcaccgccagcctgagcaaacagtcttgcattacggagcaaacccagtactttttcgacaatgactccaaaagcttctcgggtgtgctggactgtggaaattgctcgcggatcttccatggtgagaagctgatgaacacaaatttgatatttatcatggtggaatccaaagggacttgtccatgtgatacaagactcttgattcaagctgagcagacctctgatggaccaaacccttgcgacatggtgaaacagcctcgataccggaaaggtccagatgtctgtttcgacaataatgtgctggaggactataccgactgtggaggagtcagcggattaaatcccagcctttggtacatcatcgggattcagtttctgctcctgtggcttgtgtctggatcaactcataggttactgtag

SEQ ID NO: 40687 - DNA, 912 bp, Artificial Sequence
  Description of Artificial Sequence: Synthetic coding sequence
atggtgggcctgcccgagttcatccccaagatcgtgggcatcaagatagacgttaactcttggatcgaaaacttcacgaaaacatccattcgggacccatgcgccgggccggtctgcgactgcaagcgtaactccgatgtgatggattgtgtaatcctcgatgacggtggcttcctgctgatggctaatcatgacgattacacgaatcagatcggacgctttttcggcgagatagacccgtctctcatgagacatctggtcaacataagcgtatatgcatttaataaatcttatgactatcagtctgtttgtgaaccaggcgctgcccccaaacagggcgctggacatcgatccgcttacgtcccctccgtcgcagacattctgcagataggctggtgggcgactgcagccgcctggtccatactacaacagttccttctgtcactgacttttccacggctgttagaggcggtagaaatggaggacgacgattttactgcctccctcagcaagcagagctgtatcactgaacagacacagtactttttcgacaacgactccaagagcttcagcggcgtgcttgattgcggaaactgttccaggatctttcacggtgaaaaactcatgaatactaacttgatcttcataatggtggaatccaaaggcacctgtccatgcgacacccgactacttattcaagccgaacagacatccgatggaccaaacccatgtgacatggtgaaacagccaagatatcgtaaagggcccgacgtgtgttttgataataatgtgctcgaggactacaccgactgcggcggggttagtggtctgaacccaagtctgtggtacattatcggcatccaattcctgcttctctggcttgtaagcggatcaacccatcgcctgctctag

SEQ ID NO: 40688 - DNA, 984 bp, Artificial Sequence
  Description of Artificial Sequence: Synthetic coding sequence
atggtgcggtgcgaccggggcctgcagatgctgctgaccaccgccggcgccttcgccgccttttcactcatggccatcgcgatcggaaccgattactggctttacagttctgcccatatatgtaatggcacaaatctgacaatggacgacggccctccgccccgtcgggctcgcggagatttgacacatagcgggctgtggagagtctgttgcattgaaggaatatataagggtcactgttttaggatcaaccacttcccggaggacaatgattacgatcacgattctagcgaatacctcctgcgaatcgtgagggcctcttctgtctttcccatcctctctaccatccttctactgctggggggactatgcattggggctggaagaatttatagcaggaagaacaatatcgtcctatccgccgggattctctttgtggccgcggggttgtctaatatcattggaataatcgtgtatataagttctaataccggagatccgagtgataagagggatgaggataagaaaaatcattacaattatggttggtccttctattttggggcgttgtccttcatagtcgccgaaactgtgggcgtcctggccgtgaacatatatatcgagaaaaacaaagagctgcgcttcaaaaccaaacgcgaatttttaaaggcctctagttcttcaccctacgctcggatgccttcctataggtaccgcagacgacggtcccgttccagctctcggtcaactgaagcatccccctcacgagacgtgtcgcccatgggactgaagatcaccggggccatcccgatgggcgagctgtccatgtataccctgagtcgcgagccgcttaaggtaactactgcagctagctacagtccagatcaagaagcaagtttcctgcaggtccacgacttttttcagcaagatctgaaggagggtttccacgtgagcatgctgaacaggcgaaccacacctgtgtag

SEQ ID NO: 40689 - DNA, 6120 bp, Artificial Sequence
  Description of Artificial Sequence: Synthetic coding sequence
gagcgggtggagtacctgttcctgatcatcttcaccgtggaggcctttctgaaggtcatcgcctacggcctgctttttcacccaaacgcctacctccgcaatggttggaatcttctcgatttcatcatagtcgtggttggtcttttctcagctattctcgaacaggctaccaaagcagacggggctaacgcccttgggggcaaaggtgcgggctttgacgtcaaagcactcagggccttccgtgttcttcggcctctacggctggtctccggcgttccctccctgcaagtggtcctgaacagcatcattaaggcgatggtgcccttattgcacattgccctgctggtactgtttgtaattatcatatacgctattatcgggctggaactctttatgggcaaaatgcataagacatgctataatcaagaggggattgctgatgttccagcagaggacgatccgagcccttgcgcgcttgagactggccacggcagacaatgccagaatggcactgtgtgtaagcccgggtgggatgggcccaagcatgggattactaactttgataatttcgcttttgcaatgctcacggtgttccaatgcatcaccatggaagggtggacagacgttctttactggatgcaggatgcaatggggtacgagctgccctgggtctactttgtgagcttagtaatttttggttcttttttcgtgcttaacctggttctgggagtactctccggggaattctccaaggaacgtgagaaagcaaaagcacggggcgactttcagaaactgcgggaaaaacaacagcttgaggaagacctgaagggatacttggattggattacccaggcggaggacatcgatccagagaacgaagacgaagggatggacgaagaaaaacccaggaatatgtccatgccaacaagcgaaaccgagagtgtgaacacagagaatgtcgctggcggagatatagagggtgaaaactgcggggcaagactggcacacaggatttcaaaatcaaagttctctcggtattggaggcggtggaaccgtttctgccggcgtaaatgtcgtgctgccgttaagagtaacgtgttctactggctggtaatatttttagtgtttctgaacaccctcaccatcgccagtgaacactataatcagccaaattggttaaccgaggtgcaggacacagctaataaagcccttctggccttattcactgctgaaatgctgctgaagatgtactctctcggtctccaggcctatttcgtgagtttgtttaatcggttcgactgttttgtcgtttgcggggggatactggaaactatcctggtggaaaccaagatcatgtcgccccttgggatatccgtcttgagatgcgtccgcctgttacgtattttcaagatcacgaggtactggaattcattgtctaacctggtggccagcttactgaacagtgtgagatctatcgccagcctcctgctgctcttatttctttttattataatctttagcctgttaggcatgcagctttttggcggcaaatttaacttcgacgaaatgcaaacccgtcgttcaacttttgacaatttccctcaatctctgctgactgtgttccagattctcaccggagaggattggaacagcgtgatgtacgacggtattatggcatatgggggaccgagcttccccggcatgctggtgtgtatttattttataatcctatttatctgtggaaactatattttattgaacgtgtttttggctattgctgtggacaatcttgccgatgccgagagtctaacatctgcacagaaggaagaagaggaggagaaagagcgtaaaaaacttgcccggaccgcgtctccggaaaaaaaacaggaacttgttgaaaagccggcggtcggcgaatccaaagaggaaaaaatcgagctcaagagtattactgcagacggtgaaagcccaccagcaacgaaaattaatatggacgacctgcagccaaatgaaaatgaggacaagagtccctacccaaatccagaaacaactggagaagaggatgaggaggagcctgagatgcccgttggaccccggccacggccactgagcgagctgcatctaaaggagaaagctgtccccatgccggaggcatctgccttttttatcttcagcagcaataaccggtttaggctgcagtgtcaccgcatcgttaacgacacaatattcaccaatttgatcctgttttttatcctactgtcttcaatcagcctcgcagccgaagatcccgtgcagcatacctcattccggaaccacatcttgttttactttgacattgttttcacaacaatattcaccatcgagattgcacttaagatgacagcctatggcgcctttctgcataagggctccttctgccggaattactttaacatcctggacctgttggtggtgtccgtgtccttgatctcgttcgggattcagtcttccgcgatcaacgtggtcaaaatcctgcgagtactgcgcgtcttacgacctcttcgggccatcaacagagctaaaggattaaagcacgtggttcagtgcgtcttcgttgccatccggaccattgggaatatagtgattgttacgacccttctccagtttatgtttgcgtgtatcggtgtgcagcttttcaagggcaagctttatacttgctccgatagcagcaagcagacagaagcagaatgtaagggaaattatatcacttacaaggacggagaggttgaccatccaataatacaacccagatcttgggaaaattccaagttcgatttcgataacgtgctggcggcgatgatggcactgttcacggtgagcacatttgagggctggccggagctgctttatagatccatcgacagtcacacagaagacaagggcccaatttacaactaccgcgtcgagatttctatcttctttatcatctatatcattattatcgctttttttatgatgaatatttttgtggggttcgtgatagtgacttttcaggaacagggcgagcaggaatataaaaactgcgaactggataaaaaccaacgtcagtgcgtggaatatgcgctgaaagctcgccctcttcggcggtatatccctaaaaaccagcaccaatacaaggtatggtatgtagtgaactccacctatttcgaatatctgatgtttgtgctgattctcttaaatactatctgtctagctatgcagcattatgggcagtcttgtcttttcaagatcgctatgaacatcctcaacatgctcttcacagggttattcacggtggagatgattctcaagcttatagctttcaaaccaaaacactacttttgcgatgcctggaatacttttgacgcactgatcgtagtaggcagcatcgtagacatagccatcacagaagttaataacgcagaggaaaattcaaggatcagcatcaccttcttcaggctgttcagagtgatgcggctggtaaaattgctgagccggggagagggtataaggacccttctctggacatttattaaaagttttcaagccctgccctatgtggctttactgatcgtgatgctcttttttatttatgcagtgatcggtatgcaggtgtttggaaagatagcgttgaatgatactacagagattaacaggaataataactttcaaacttttcctcaggcggtccttctgctgtttcgctgtgcgacaggagaagcttggcaggacatcatgctggcctgcatgcctggcaagaaatgcgcgcctgagtctgagccctcaaatagcacggagggggaaaccccatgtggatccagctttgccgtcttttactttatttccttctatatgctgtgtgccttcctcattattaatcttttcgtcgcggtaattatggataactttgattatctgactcgggattggtcgattctcggaccacaccatctggacgaatttaagcggatatgggccgagtacgatcccgaagcgaaaggacgaataaagcatcttgatgtcgtgactctgctcagaaggattcaacctccgctcggcttcggcaagctgtgcccacatagagtggcatgcaagcgcttggtttctatgaacatgccactgaatagtgatggaacagtaatgttcaacgctaccctcttcgctctggtgcgcaccgcattgaggatcaagaccgaagggaacctggaacaggctaatgaggaactcagggccatcattaagaagatctggaaaaggacatccatgaagctactcgaccaggtcgtcccccctgccggtgacgacgaggtgacagtgggcaagttctacgcaacattcctgatccaagagtattttaggaagtttaaaaagaggaaggaacaaggattagtcggaaagccgagccagcggaacgcgctgtctctgcaggccggccttcgtactctgcatgacatcggccccgaaatccgaagagccatttccggcgatctgacagcagaagaagaacttgataaggcgatgaaggaggcagtgtctgctgcctccgaggacgatatttttaggcgtgcaggggggctgtttggcaaccacgtgagctattaccagagtgacggaaggagcgcttttcctcaaaccttcaccacccagaggccactgcacataaacaaggctgggtcttcccagggggacaccgaatcccccagtcatgagaagctggtggattcgacattcactccatcatcatattcatcaacgggctcaaatgcgaatattaataatgctaacaatactgccctgggcaggctgccccggccagccgggtacccgtccacagttagtacagtggaaggtcacgggcctccactgtcacctgccattagagttcaagaagtggcatggaagttatcatcaaaccgcatgcactgctgtgacatgttggacggcgggaccttcccacctgccctgggcccacgccgggcacctccatgtttacaccaacaactgcaagggtccctggcaggcctgagggaagatactccatgcatagttccaggccacgcctcgctgtgttgttcctcgcgggtgggcgagtggctcccagcaggatgtacggctccgcagcacgcccgctgccatagcagggagagtcaagccgccatggctggacaggaggaaacctcgcaagacgagacctacgaggtaaagatgaatcacgacacagaagcttgctctgaacctagcttgcttagtaccgagatgctgtcataccaggatgatgaaaaccggcagctcacactgcctgaggaggacaagcgcgacattcggcaatcgccaaaacgcggattccttaggagcgctagtctgggacgcagggcctctttccacctggagtgcctcaagcgccagaaagacagaggaggagatatcagccaaaaaacagtgctgcccctgcatctggtgcatcaccaggctcttgccgtggcaggactgtcccctcttctgcagcggtcgcattccccagcttcattcccccggccctttgcaacccccccagccacaccaggcagtcgcggctggcccccacagccagtcccgacactgagacttgagggggtcgaatcatccgagaaactgaactcctcatttccttctatccactgtggctcttgggccgaaactacgccagggggcgggggttcctcagcagcgcgtcgggtgcggcctgtgtcattgatggtgccttcacaagcaggtgccccagggcggcagttccatggcagcgcaagctcactggtggaggccgtgctgatctcagagggtctggggcagttcgcccaggatcctaagtttatagaagtcacaacccaggaactagccgatgcctgcgatatgacaatagaagaaatggagtccgctgcagacaacatcctttcaggcggggcaccccagagccctaatggtgcactccttccttttgtgaactgccgtgacgctggacaggaccgcgctggtggtgaggaggatgctggctgcgttagggcaagagggcggcccagtgaagaagagctacaggatagcagggtgtacgtctcttcactgtag

SEQ ID NO: 40690 - DNA, 6522 bp, Artificial Sequence
  Description of Artificial Sequence: Synthetic coding sequence
atggtgaacgagaacacccggatgtacatccccgaggagaaccaccagggcagcaactacgggagcccgcggccggcccacgctaatatgaatgcaaatgcagcagctggtctggcaccggagcatatcccaacccccggcgctgcccttagctggcaggccgccattgatgcagcccggcaagcaaagctgatgggatccgccggcaacgccacaatttccacggtgtcctctacccagagaaagaggcagcagtatggcaaaccgaagaaacagggttctacaaccgctacacgaccacctagagctctcctctgcctgacactgaaaaatcctattagacgagcatgtataagtatcgtagagtggaaaccttttgagattatcatactgctgactatttttgcaaattgtgtggcgttggcaatctacatccctttccccgaggacgattccaatgccaccaacagtaacctcgaaagagtggagtaccttttcctgatcatttttacagtcgaggccttcttaaaggttattgcctatgggctgctgttccaccctaatgcctatctgcgaaatggatggaatctgctggactttatcattgtcgtggtaggcttattctcagccattctagaacaggccaccaaggctgacggcgccaatgcactcggcggaaaaggagcaggattcgatgtcaaggccttgcgcgccttccgcgtgttgaggcccctgcgcctagtttcaggagttcccagtcttcaggtggtgctgaactccatcataaaggccatggtgccgctgctgcatatcgcactcttagtgctgttcgtgatcattatttacgccatcatcggcctggagctcttcatggggaagatgcataagacttgttacaaccaggaaggaattgccgatgtcccagcagaagacgatccctctccatgcgcgctcgagacaggccatgggcgacaatgccagaatggaaccgtctgcaaaccaggttgggacggtcctaaacacggaataactaatttcgataactttgccttcgccatgctgactgtttttcagtgtataacaatggaggggtggacagacgtgctttattgggtcaatgatgccgtaggaagggactggccatggatctatttcgttacacttattatcattggttcatttttcgtgttaaacctggtgctgggtgtgctcagcggcgaatttagtaaggagcgcgaaaaggcaaaggctaggggcgactttcagaaactgcgcgagaagcagcaattggaagaggacctgaagggctacctggactggataacacaggcagaagacattgaccccgagaacgaagacgaggggatggatgaagagaaacctcgcaacatgtccatgcccacgtctgagaccgaatctgttaataccgagaacgtcgcaggtggcgatatcgaaggcgagaattgtggtgcgcgactggcccaccgcattagcaaaagcaagtttagtaggtattggaggcggtggaaccgattttgtcgccgcaaatgtcgagcagcagttaagagcaatgtgttttactggcttgtcatcttcctggtgttcctcaacaccttgacgattgcctccgagcactataaccagccgaactggcttaccgaggtgcaggataccgccaacaaggctctgttggccctgtttacggccgagatgcttctgaagatgtacagtctgggactccaggcctacttcgtctccctgtttaaccgcttcgactgctttgtggtgtgtggaggcatcctggagaccatccttgtggaaactaaaatcatgagcccactgggaatttctgtgctgcggtgcgtgcgtctcctgagaatattcaaaataacgcgctattggaattccctcagtaacctggttgccagcctcctgaacagtgtgagatctatcgcctcactgctcttgctcctgttcttgtttatcatcatatttagtttgctgggaatgcaactgttcggcggtaagtttaatttcgacgagatgcagacaaggaggtccacctttgataactttccccagagcctgctgactgttttccagatacttactggggaggactggaactctgtgatgtacgatggcatcatggcttacggcgggccatcatttcccggcatgctggtctgcatttacttcattattttgttcatctgcggcaattacatcttgctcaatgtcttccttgccattgccgtagataatctggctgacgccgaaagcctgacctccgcccagaaggaggaggaagaagagaaggagcggaagaagctggcccgaaccgcatctccggagaaaaagcaggagcttgttgagaagccagcggttggagaaagcaaggaagagaaaatcgagcttaaaagcatcaccgcagacggcgaatcccctccggcaaccaagatcaatatggacgatttacagcctaatgagaatgaggacaagagcccctatccgaacccagagacaactggtgaggaggatgaagaagagcctgaaatgccagtcggccctcgccccaggccattatccgagctgcaccttaaagaaaaagccgtcccaatgccggaggcatctgctttctttatttttagttcaaacaatagatttcgacttcagtgccacagaattgtgaacgacactatcttcactaacctgatcctgttttttatcttgcttagtagcattagtttggctgccgaggacccagtacagcacactagctttagaaaccacatcctcggcaatgcggactacgtcttcacttctattttcactttagaaattattttaaagatgacagcctacggagcgtttctgcacaagggatccttctgcaggaattacttcaatattctggacctattggtggtgtctgtatcactaatcagctttggcatccagtcgtcagccatcaatgtggtcaaaatcctccgtgtgctccgggtccttcggcctcttcgggctattaatcgcgcaaagggcttgaagcacgtggttcagtgcgtgttcgttgcaatcagaactattgggaatatagtgattgtgacgaccttactgcagtttatgttcgcctgtatcggtgtgcagttatttaaagggaagctctacacctgttccgatagttctaaacagaccgaagctgaatgcaaaggaaattatattacatacaaagacggcgaggttgaccacccaatcatccagccaagatcttgggagaacagcaaatttgatttcgataacgtgttagctgccatgatggccctgtttacagtttccacttttgaaggatggcccgaactgctctatagatctattgactcccatactgaggacaaaggacctatttataactatagggttgagatatcgatcttctttataatttacatcatcattattgcctttttcatgatgaatatcttcgtgggatttgtaattgtgacgtttcaagaacagggagagcaggaatataagaactgtgaactcgataagaatcagcgccagtgtgtagagtacgcactcaaagcgcggcccctgcggcgatacatacctaaaaaccaacatcagtataaggtgtggtacgtagtgaactcaacatactttgagtatctgatgtttgttctgatcctgctgaacactatatgcttggccatgcagcactatggacagtcctgtctgtttaaaatagcgatgaatatactgaatatgctatttaccggactctttaccgtggagatgattctgaaactcatcgcattcaagcctaaacactacttttgtgacgcttggaacacttttgacgcattgatcgtggtcgggtctatagtcgacatcgcgataactgaggtgaaccccgctgaacatacccagtgtagtccttctatgaatgccgaagagaacagcagaatcagcatcacgttttttaggctctttcgcgtgatgcgcctggtaaagctgcttagccgtggtgaagggatccgtaccctactttggactttcattaagtcattccaggcgctcccttatgtcgccctgttgatcgtgatgttattctttatttatgccgtgatcgggatgcaagtcttcgggaagatcgcactgaacgacacaaccgagatcaatcgcaataacaatttccaaacattccctcaggctgtgttattgctgtttcggtgcgctactggggaggcgtggcaggacataatgttggcttgtatgcctggcaagaaatgtgcccctgagtctgagccaagcaacagtacagaaggtgagaccccttgtgggagttctttcgccgttttttattttatttcattttatatgctgtgcgccttcttgatcatcaaccttttcgttgcagtgatcatggataatttcgattatctgactcgggattggtccattcttggccctcaccatctagacgagttcaaaaggatttgggctgaatacgatcctgaggctaaagggcgtattaaacacctcgatgttgttactttgctgcgccgcatacagcccccactcggatttgggaaactgtgccctcaccgcgtggcgtgcaagaggcttgtgtctatgaatatgccgctcaactctgatggcaccgttatgttcaatgccactctattcgcactggtccggactgccctccgtattaagaccgagggtaatctggagcaggccaatgaagagttgagagctataatcaaaaaaatctggaaacgcacaagcatgaagctcctggatcaggtggttcccccagcaggggatgacgaagtcaccgtagggaagttttatgccacctttctgattcaggagtatttccggaaattcaagaaaaggaaagaacaaggcttagtggggaaaccttcacagcggaatgctctttcccttcaggctgggttgcggacattacatgacattggacccgaaattcgtcgagcaataagcggtgacttgactgctgaggaggaactggacaaggccatgaaagaggcagtctccgccgcatcagaggatgatatcttcaggcgcgctgggggactatttgggaatcatgtgagctattaccagagcgatggtagatcagctttccctcagacttttaccacacagagaccccttcacataaacaaggctgggtccagccagggggatactgagtccccttcccacgagaagctcgttgatagcacatttactccttcgagctactcgagcactgggtccaatgccaacataaacaatgccaataacacagctctgggtaggcttccacgccctgcaggctatccaagcacagtgtcaacggtcgagggacacggacccccactctctcccgctatccgtgtacaggaggtggcctggaagctgtcttccaacagagaacgccacgtccctatgtgtgaagatctggaactgaggcgggattcaggtagcgcaggaacccaagcccactgccttctgttgcgcaaggctaatccctctcggtgccactcccgggagtctcaggccgcaatggcgggccaagaggaaacctcacaggacgagacctacgaggtaaaaatgaaccacgataccgaggcttgctctgaaccgtccctgctctcaactgaaatgcttagctaccaggacgacgaaaatcgccagcttacattacccgaggaagataagcgcgatatccgccagagtcccaaacgcggattcctcaggtctgcctcactgggacgccgtgcgagttttcacctcgagtgtctcaagaggcagaaggaccgcggaggcgacatctcccagaagactgttctgccactgcatcttgtgcaccaccaagccttggctgtggctggcctcagtccactcttgcagaggtcacactcaccggcctcattccctcgccctttcgcaacacctccagcaacccctggcagtcgtggttggcctccacagcctgtgcctactctacgtctcgagggggtggaatcttccgagaagttaaactcctcatttccatctatccactgcggctcatgggctgaaacgacaccaggggggggtgggtctagcgccgctcgaagggtccgccctgtctctctcatggtccccagtcaagcaggggcacctgggagacagtttcatggaagcgcctcgtccctggtggaggccgtgttgatctctgagggcctcggtcagtttgctcaagatccaaagtttatcgaggtgactacccaggagttggcagatgcctgtgacatgacaattgaggagatggaatctgccgccgacaacatcctcagcggcggagctccacagtcccccaacggcgcgctgttaccctttgtgaactgtagagacgccggccaggatcgcgcgggcggcgaggaagatgcaggctgtgtgcgggccaggggacgaccaagtgaggaggagctgcaggactcccgcgtctatgtctcttccctgtag

SEQ ID NO: 40691 - DNA, 6492 bp, Artificial Sequence
  Description of Artificial Sequence: Synthetic coding sequence
atggtgaacgagaacacccggatgtacatccccgaggagaaccaccagggaagcaattacggttccccccggcccgcccatgctaatatgaatgcgaatgccgctgcgggtctcgcccccgagcatattccaacccctggagcggctctgagctggcaggccgcgattgacgcagctcggcaagctaagctgatgggatctgccggcaatgccaccatctctacagtctctagcacccagcgcaaaagacaacagtacggaaagcccaagaaacagggttctaccaccgcaactagacctccccgagccctgctatgtctgaccctgaaaaaccccatcagacgtgcatgcatctctattgtagagtggaaacctttcgagataatcattttactgacaatatttgcaaactgcgtggccctcgccatctacatccctttccctgaagacgactcaaacgccacgaactccaacctggagcgcgttgagtatttgtttttaataatttttactgtggaggccttcctcaaggtgatcgcgtatggtctgctcttccaccctaacgcctatttgcgaaatggttggaacttacttgactttatcatagtagtcgtgggccttttcagcgccatcctagaacaagcgacgaaggccgacggcgctaacgccctcggtggaaaaggcgcaggtttcgatgtgaaagcactgcgagcttttagagtgctgaggccgctgagactggtgagcggcgtaccatctctccaggtagtgctgaatagtatcattaaggcgatggtccccttactgcacattgccctgttggtgcttttcgttattatcatctacgctatcatcgggctggagctgtttatgggaaagatgcacaaaacttgttacaaccaggagggcatcgccgatgtgccagccgaagacgatccatctccatgtgctcttgagacaggccatggcagacagtgtcagaatggaactgtgtgcaaacccggttgggacggtcctaagcacggcataaccaattttgataattttgcatttgccatgttgacggtcttccagtgtataactatggaaggctggacagacgtgctctactgggtgaatgatgcagtcggtagagattggccatggatttattttgtgacccttattatcatcggtagcttttttgtcctgaaccttgtcctcggggtactctccggcgaatttagtaaagaacgcgagaaagccaaggctagaggcgattttcaaaagttacgcgagaaacaacaactggaggaggacctgaaggggtacctggattggattactcaggcagaagacatcgaccctgagaatgaagacgagggcatggatgaagaaaagcctaggaatagaggaactcctgccggtatgctcgaccagaagaaggggaagttcgcatggtttagtcacagtaccgagactcatgtgtccatgccaacctctgaaacagaaagtgtaaacactgagaatgtggcaggcggcgacattgaaggcgagaattgcggtgcaaggctggcccacagaatctcgaaaagtaaattcagtcgttattggaggcggtggaatcggttttgtcgtcgaaaatgtagggccgcagtaaaaagcaacgtattctactggttggtcatctttctggtgtttctgaacaccctcacaatagctagcgagcattacaatcagcctaattggcttacggaagttcaggacaccgccaataaagcactacttgccctctttactgccgagatgttattgaaaatgtactcgttaggactgcaggcttatttcgttagcctgtttaaccggttcgattgctttgtcgtgtgtggcggaatcctcgagacgattctcgttgagactaagataatgagtcccctagggattagtgtactcaggtgcgtgaggctcttgcgaatcttcaaaatcactagatactggaactcgctcagcaatctggtggcttcactcctgaacagtgtacgaagtatcgccagcctgttgctcttactgtttctgttcataattattttttctctgttgggcatgcagctgtttggcgggaaatttaattttgatgaaatgcagaccaggagaagtacctttgacaacttcccacagagtctcctgaccgtcttccagattcttacaggagaagattggaattccgtcatgtacgacggtatcatggcatacggaggcccatcatttcctggcatgcttgtatgcatatatttcatcatcctttttatctgtggaaactatatcctgttaaatgtattcctggccatcgcggtagacaacctcgccgacgccgagtccctgacaagcgcacaaaaggaggaggaagaggaaaaagaacgaaaaaaactagctcgtactgcctcgccagagaaaaagcaggagctggtggagaagcccgccgtcggggaaagcaaagaggaaaagattgagcttaagtctatcacagctgatggcgaatccccccccgctaccaaaatcaacatggatgacttgcagcctaatgagaacgaggacaagtctccctatccaaaccctgaaacaaccggagaggaggacgaggaagagcctgaaatgcctgtcgggcccagacccaggccactgtccgagctgcatctgaaagaaaaagcagtacccatgcccgaggcctctgcgttctttatcttcagttctaataataggttccgactccaatgtcaccggattgtaaacgatacaatctttacaaatctcatcctattctttattttgttgtccagcatcagtttggccgcggaagatcctgtgcaacataccagctttaggaaccatatcctcttttatttcgacattgtgttcacaacaatttttacaattgagatcgctctgaaaatgacagcttacggagcatttctccataagggatccttttgccggaactattttaacattctcgatttgctggtggtgtcagtgtccctgataagctttgggatccagtccagcgcaattaatgtcgtgaagatattgagagtgctacgtgtcctccgacccctcagggctattaaccgggcaaagggtttgaagcacgttgtccagtgtgtgttcgtggctattcggactatcggaaacattgtgatcgtgacaactctgttacagtttatgtttgcctgtatcggagttcagttgttcaaagggaaactttacacctgttcagactcgtctaagcagactgaggcagaatgcaaaggcaattatattacatataaggacggagaagtcgaccatccaatcattcagccacgatcttgggaaaacagcaaatttgatttcgacaacgtgctggccgcaatgatggctctgttcacagtatcgaccttcgaaggttggcctgagctcctgtataggtccatagattcacacacagaggataaaggccctatctacaactacagggttgaaatcagcatttttttcatcatttatatcatcattatagccttcttcatgatgaacatctttgtcggatttgtgatagtgacctttcaggagcagggagagcaagaatacaaaaactgcgagctcgataagaatcaaagacagtgtgtggagtatgcccttaaggccaggccactgcggcggtatatcccaaaaaatcagcaccagtataaagtctggtacgtggtcaactctacttattttgagtacctgatgttcgtcctaatcctgcttaacacaatctgtctggccatgcagcactatggtcagtcttgcttgtttaagattgctatgaatattttaaacatgttatttaccggactgttcaccgtcgagatgatcttgaagctgatagcatttaaaccaaaacactacttttgcgatgcctggaacaccttcgatgctctgattgtggtggggagtatagtggatattgctatcaccgaagtgaatcctgccgagcacacacagtgctctccgagtatgaacgctgaggagaattcacgcatcagtatcactttcttcagactgtttcgagtgatgaggctggtgaagttgctctctaggggagaagggattcgcacactgctgtggaccttcatcaagtcttttcaggccctcccttatgtcgccctccttatcgtgatgcttttttttatctatgctgtgatcgggatgcaggttttcggtaaaatagcactcaacgacaccacagaaataaacagaaataacaatttccagacctttccccaagccgtactactcctcttcaggtgtgcaacgggtgaggcttggcaggacataatgttggcttgtatgccaggaaagaaatgtgcccccgagtccgagccttctaactctacagagggggagacgccttgcggttcgtcatttgcggtattctattttataagtttttatatgctctgcgctttcctcattattaacctgttcgtggccgtgatcatggataactttgactatttaaccagagactggagtatccttgggccgcaccatctggatgaatttaaacggatttgggcagagtacgatccagaagccaagggcaggatcaagcatttggacgtggttactctcttgcggcgaatacaacctcctcttggttttggcaagctgtgtccccacagagtcgcctgtaaaaggctcgtatccatgaatatgccacttaactccgacggaactgtgatgttcaatgcgacattgtttgctctggtgcgcacagccctgcggattaaaactgaggggaatctggaacaggctaacgaagagctccgggcaatcatcaagaagatttggaagaggacatcaatgaaactgctggatcaggtcgtgccccctgctggcgacgatgaggtgacagtcgggaaattctatgccaccttcctgattcaggaatacttccggaagtttaagaaacgaaaggagcaaggtctggtaggtaagccttcacaacgaaatgccttgtctcttcaagccgggctccggacactgcacgacattggacctgagattcggcgcgccatatccggagatctgacagccgaggaggaactggacaaggctatgaaggaagccgtgtcagctgcttcagaggatgacatcttcagaagggccggaggcctctttggcaaccatgtcagttactaccagtctgatgggcgctccgctttcccacagacatttacgacgcagaggccactgcacatcaacaaagctggaagcagtcagggagacactgaatcacctagtcacgagaagctcgtggatagcacttttaccccctcttcttactcaagtactgggtcaaacgcgaatattaacaacgcgaacaacacagctctcggaaggctgccacggcctgccggttatccctcaacggtctctacggtggaagggcacggcccacccctttctccggcaattcgcgttcaggaagttgcgtggaaactgagttccaaccgatgtcacagtcgcgagagtcaagcagcaatggctggtcaggaggagacttcacaggatgaaacctatgaggttaagatgaaccacgataccgaagcgtgtagcgagccctcactgctgagcacagaaatgctgagctatcaagacgatgagaataggcagcttacgttgccagaagaggacaaaagggacattcgacagagtccaaaacgcgggttcctaaggagcgcatcactggggcgccgggctagcttccacctcgaatgcctgaaaagacagaaggacagaggaggagatatctcccagaaaacagtgctgcctctccacctggtgcatcatcaagccctggcggtggcaggcttgtcacccttgctgcaaagatcacacagtccagcttcatttccgcggcccttcgctactccacctgccacacctggctctcgcggatggccgccacagcctgtgccaacactgagactcgaaggcgttgagtcctccgaaaagctcaatagctctttcccctcaattcactgcggctcctgggcagaaaccactcctggcggcggaggcagctccgccgcccgtcgtgttaggccagtgtctctcatggtccctagtcaagcaggagccccggggagacaattccatggaagcgcatcaagcctcgtcgaagctgtcttaatcagcgaagggctcggtcagtttgcccaggatcccaaatttatcgaggtcactacccaggaactggctgacgcgtgtgacatgaccatcgaggaaatggagtcagccgccgataacattctctccggtggggccccacagagcccaaatggagctctgctgccctttgtgaactgtcgcgacgcaggccaggatcgagccgggggagaggaggatgccggctgtgtgcgggcgcgtggcagaccatctgaggaagaactgcaggactctcgagtctatgtttcatctctatag

SEQ ID NO: 40692 - DNA, 6753 bp, Artificial Sequence
  Description of Artificial Sequence: Synthetic coding sequence
atggacgaggaggaggacggcgccggcgccgaggagagcggccagccgagatcgttcatgagactcaatgacctttctggggcggggggtcgacccggcccaggtagcgccgagaaggatcccgggtccgcagattcagaagctgaagggctgccataccccgctctcgctcccgtagtttttttctacttgagccaggacagtagacctcggagctggtgcctgcgaaccgtctgcaacccttggtttgagcggatttccatgttggtgatactgttaaactgcgtaacattggggatgtttaggccgtgtgaagacattgcctgcgacagtcagcggtgtcggatcctgcaggcctttgacgacttcatattcgcattcttcgccgtagagatggtggtcaagatggtcgcccttggcatcttcggcaaaaagtgctacctgggagatacctggaacagactggacttcttcatcgtaattgccggaatgctggagtacagcctggacctgcagaatgtttccttttcagctgtccgcactgtgcgagtcctgaggcccctgcgcgctattaatcgagtcccttccatgcggatattggttactctgcttttggataccctgcccatgttaggaaatgtgttgctgctgtgcttcttcgtcttcttcatctttggaatcgtaggcgtacagctgtgggcgggacttctgcgcaaccgatgtttcctgcctgaaaacttctccctccctttatctgtggacctggaacgctactatcaaaccgagaacgaggacgagtccccctttatctgtagtcagccacgcgagaacgggatgaggtcttgcagaagcgtaccaacgcttagaggggacggaggggggggacctccttgcggtctggactacgaagcatataactcatccagtaataccacatgtgttaattggaatcaatattacaccaattgctctgccggtgagcataatccattcaaaggcgcgatcaattttgacaatatcggctacgcttggattgccatcttccaggtgatcaccctggagggatgggtcgacatcatgtacttcgtaatggacgcacacagcttctataatttcatctactttatactgctcatcattgtgggcagcttctttatgatcaacctctgtctcgtcgtcattgcgacccagttcagtgaaaccaaacaacgagaatcccagctgatgcgggaacaaagagttcggtttctctctaacgcatccacgttggcttccttcagcgagccaggctcatgctacgaagaacttctgaaatacctggtgtacatattgagaaaagccgctcgcagattagcacaggtctctcgtgcagctggagtgagggtgggactgctgagcagtcctgcgccattggggggacaggagacccaaccaagtagcagctgcagccgctctcaccgtaggctgtccgtgcaccacctagtgcatcatcatcaccatcatcaccatcactaccatctcggcaatgggactctgcgtgcgccccgcgcgagtcccgagatccaggacagagatgccaacggatctagacgattgatgctccctccaccttcgacgcctgcattgtccggcgctcctcccggaggagctgaatctgtgcattctttttatcacgccgattgtcacttagaacccgtccgttgccaagcaccccccccaaggagtccttccgaggccagtgggaggaccgtcggatccggcaaagtgtaccccaccgtgcatacatccccaccaccagagactctgaaggagaaggctctggtcgaggtagctgccagctccggtcctcctaccctgaccagtctcaatatcccaccaggcccatattcttccatgcataaattgctcgagacccaatcgaccggagcctgtcagtcatcgtgtaaaattagcagcccgtgcctcaaggccgactcgggcgcatgcggcccagatagctgcccctattgtgccagagccggcgcaggcgaggttgaactagcggacagggaaatgcccgacagtgacagcgaggctgtctatgaattcactcaggacgcacagcattctgacctgagggatccccattccagaaggcagcgatctctcggccctgacgctgagccaagcagcgtccttgccttttggcggcttatttgcgacaccttcagaaagattgtggattccaagtattttgggcgaggaattatgatcgcaatactcgtgaatacccttagcatgggtatcgaataccacgaacagcccgaggaactaaccaacgctctggagattagtaatatcgtattcacttccctgtttgccctcgagatgcttctgaaactgctggtgtacgggccttttgggtacataaagaacccctacaatatctttgacggcgtcatcgtggtcatctcagtgtgggagattgtgggacagcaaggcggaggactgtctgttcttaggacatttcgcctgatgcgcgtgcttaagctggtcagattccttcccgccctccagcggcagcttgtggttctgatgaaaaccatggacaatgtggccactttctgcatgctgctaatgctgtttattttcatcttctccattctgggtatgcatttgtttggttgtaagtttgccagcgaacgcgacggggacacactacctgataggaaaaattttgactcactattgtgggctatcgtgacagtctttcaaatcctaacgcaggaggattggaataaagtcttgtacaacggtatggcctcaacaagcagctgggccgccttgtatttcattgcgctcatgacatttgggaattacgtgcttttcaacctcctcgtagcgattctcgtggaaggttttcaggctgagggggacgcgaacaaaagcgagagcgaacctgactttttttcaccatcgcttgacggagacggcgatagaaagaagtgtttagctttagtgagcctcggtgaacatcctgagctacggaagtctcttctgccaccactcattatacacactgccgccaccccaatgtcactcccaaagtctacctctaccggtctgggtgaagcactgggaccagcgagtcgaagaacgagctcttcaggctccgccgaaccaggagctgctcatgaaatgaaatcgccacccagcgctcggtcaagccctcactccccgtggagtgcagcgagctcatggacaagcaggaggtcaagccgcaattcactaggccgggccccctctctgaagcgacgaagcccttcgggagagagaaggagtctgctctctggcgaggggcaggaatcacaggacgaggaggaaagcagtgaggaagagcgagccagccccgccggctccgaccataggcatcggggttcccttgagagggaggcgaaaagcagctttgatctgcctgataccctgcaagtgcctgggctgcacagaactgctagtggtcggggcagtgcttccgagcaccaagactgcaacggcaaaagcgcttccggtagactggcacgcgccctgcggcctgacgacccgccactcgacggcgacgacgcagacgacgaagggaacctctcaaagggagagagggtgcgagcctggattcgggctagattaccagcatgttgtctggaaagagactcttggtccgcatatatttttccacctcagagccgtttccgcctgctgtgtcaccggatcatcacacacaagatgtttgatcacgtggtgcttgtaatcatatttctaaactgcatcaccatcgcaatggaacggcccaagattgatccgcattccgctgagaggattttcctcaccctttccaactatatctttactgcagttttcctcgctgaaatgacagttaaggtcgtggcactaggatggtgcttcggagagcaggcctacctacggtcctcgtggaacgttctcgatggcctgctcgttcttatcagtgttatagatatcctcgtgtctatggtgtccgattctggaaccaaaattttgggtatgctgagagtcctcaggctcctaagaacactgcggccacttagggttatctcaagggctcagggactgaaactggttgtagagactttgatgtccagcttaaagcccatcggaaacatcgtggtgatctgctgtgctttttttatcatcttcggaatcctcggcgtgcagctttttaagggcaaattctttgtgtgccagggggaggacactagaaacatcactaacaaatctgattgtgctgaggcttcatacagatgggtgcgccacaagtacaattttgataatttgggacaggctctgatgtcactgttcgtgctagcctctaaggacgggtgggtcgatattatgtacgacggtctggatgccgtgggcgtagaccagcaaccaatcatgaaccacaacccatggatgcttctgtactttatttccttcctgcttatcgttgctttcttcgtgctgaatatgtttgtgggggtggtcgtggagaattttcacaaatgtagacagcaccaggaagaagaggaggcccgccggagagaagagaagaggttgcgcaggctggagaaaaaacgccggtcaaaggagaaacagatggctgaagcccagtgtaagccctattattccgattattcacggtttcgccttctggtccaccatctgtgcacatcccattacctggatttgtttatcaccggagtaatcggtctgaatgtggtgaccatggctatggaacattatcaacagccccagatactagatgaggcgctgaagatttgtaactatatcttcacagtgattttcgtgctcgagtctgtctttaaactggtggcattcggcttccgtagattctttcaggatagatggaaccagctcgacctcgccatagtcctactgtccattatgggaataacattggaagagattgaagtgaacgccagtctgcctatcaacccaacaatcatccggatcatgcgcgtgctccgaattgcacgggtcctcaaactcctaaagatggcggtcggtatgagagccctcctggacactgtgatgcaggctctgccacaggttgggaatttggggcttttgtttatgttgttgttcttcatattcgcagccctgggcgttgagctatttggtgacctggaatgtgacgagacccatccctgtgagggtctgggccgccatgcgacttttaggaactttggaatggcctttcttaccctgttccgggtgagtacgggagataattggaacggtattatgaaggataccctgagagactgcgaccaagaatcaacctgctacaatacggtaattagccccatctatttcgttagcttcgtgttgaccgctcagtttgtgcttgtaaatgtggtcatcgcagtgctgatgaaacacctggaggagtccaacaaggaagctaaggaagaggcggaattggaggccgaactcgagctcgagatgaaaacattgagcccccagcctcattctccactgggatcccccttcctctggccgggggtggaaggccctgattccccagactcacctaagcctggcgcactgcatccagcagcgcacgcacgatccgcttcacacttctcgctagagcatccaaccatgcagcctcaccctaccgagcttcccggcccggatctgctaaccgtgagaaaatcaggcgtttctcgtactcacagcttaccgaatgacagctacatgtgcagacacgggtctaccgccgagggcccccttgggcaccggggttggggactaccaaaggctcagagtgggagtgtgctcagcgtacacagccagccagcagacaccagttatatcctgcagcttcccaaggacgccccgcatctcctgcagccgcatagcgccccaacatgggggactattcctaagttacccccaccagggaggagcccactcgcacaaaggcctcttcgccggcaagccgctatcaggacagactcgcttgacgtccagggtctgggctcccgcgaggatctgctggctgaggtctctggcccttccccgccgctagccagagcttactccttctgggggcagtcttccacgcaggcccagcagcactctaggagtcatagcaagatcagcaagcacatgacgccccctgcaccatgtccggggcctgagcctaactggggcaaaggtccgcctgagaccaggtcctcgttggaactggatacagaactgtcatggataagcggagacctgttgcccccggggggacaagaagagccaccctcccctcgcgacttgaagaagtgttactcagtcgaagctcagtcctgtcagagacgccccaccagctggctggacgagcagcgaagacactcgatcgcagtgtcgtgcctggacagcggcagccagcctcacctcggaacggacccttcgaacttgggtggtcagccccttggggggcctggctccagaccaaagaaaaagctgtccccacctagcattaccatcgaccctccagagtcccagggcccacggactccgccatcacccggcatctgtctccgcagacgcgcgccttcttccgactcaaaagacccccttgcctccggccctcctgacagcatggctgcctcgcctagcccaaaaaaagacgtgttatccctctcaggcctctcaagcgatccagccgacttagacccttag

SEQ ID NO: 40693 - DNA, 7032 bp, Artificial Sequence
  Description of Artificial Sequence: Synthetic coding sequence
atggacgaggaggaggacggcgccggcgccgaggagagcggccagccccgcagtttcatgcgcttgaatgacctcagcggcgccgggggccgtcctggccccggctctgccgagaaggaccctggctccgccgattcagaagcagagggactcccctatcctgcactggctcccgtcgtgtttttctatttgagccaggacagtagaccccgaagctggtgtctaaggactgtgtgcaacccctggtttgagcgcattagcatgctcgttattttactgaactgcgtcaccctgggtatgttccgcccctgcgaggacatagcctgtgactcgcagcgatgccgaatcctccaggcgtttgacgattttatctttgccttttttgccgtcgagatggtggtgaaaatggtggctctggggattttcggcaaaaagtgctaccttggagacacatggaatcgactggatttctttattgtcattgccggaatgctggagtactccctggatctgcagaatgtgtctttcagcgccgtaaggacagttagagtgctgaggccgttacgcgccatcaatagagttcctagcatgcggattttggttacactgctcctggacactctgcccatgctcggcaatgtgctgctgttatgtttttttgtgtttttcatattcggaatagtgggggtgcagctatgggcaggacttctgcgcaaccgctgcttccttcccgaaaacttctcactcccactttcggtggatctcgagcggtattaccagacagagaatgaggatgagtccccattcatatgctcgcagcccagagagaatggcatgcgcagttgccgaagtgtccctaccctgaggggagatgggggcggcggaccaccttgcggcctggactacgaggcatataactcctcgtccaatacaacgtgcgtgaattggaaccagtactacaccaactgtagcgctggcgagcataacccttttaagggcgctatcaattttgataacattggctatgcatggattgcgatcttccaggtcatcactctcgaaggctgggtcgatattatgtatttcgtcatggacgctcattccttctataacttcatctactttattctcctcataatcgttggttccttcttcatgattaatttgtgcctggtcgtaatagctacccagtttagcgaaacaaagcagcgggaatctcagctcatgagggagcagagagttcgctttctctcaaacgccagcacgctggcatcattctctgagccgggttcatgttatgaagaactgctgaaatatcttgtctacatcttgcgtaaggccgccaggcggctggcccaggtctcaagagctgctggggttagggttgggctgctctcgtcccccgccccgcttggtggtcaggaaacccagccttcttcatcctgttctagatctcaccgcagactgtccgttcatcacctggtgcaccatcatcatcatcaccaccaccactaccacctcgggaatggtactctgagagcacctagggccagtccagaaattcaagaccgggacgccaacggcagtaggcgactcatgctgcctccaccaagcacgccagctctttcaggggctccccctggcggcgccgagagtgtgcactcattctaccacgccgactgccacctagagcccgtcaggtgtcaggccccccctcctcgaagtcctagcgaagcttccggcagaaccgtaggttctggtaaggtgtatccaactgtacatacttcccctccaccagagactctaaaggagaaggcactggtggaggtggccgcgagtagcggtccccctactctgacctctctcaacatcccccctggtccttattcctctatgcataaactgctggagacccagtctacaggagcatgccagtctagctgtaagatctcgtccccctgccttaaggcagactccggtgcttgcggcccagacagctgcccctactgcgccagggccggtgctggtgaggtagaactggccgacagggaaatgccggacagcgactctgaggcagtgtacgaatttacacaggatgcccaacacagcgatctgagggacccacattcccgcaggcaacgctccctggggccggatgccgaaccgagttctgtgctggctttctggcggctcatctgcgacaccttccggaaaatagttgacagtaaatacttcggccgtggcatcatgattgcaattctcgtcaacacacttagcatggggatcgagtatcacgagcaacctgaggagctgactaacgctctggagatcagcaacattgttttcacatccctctttgccctggagatgcttctgaagctgctcgtgtacggcccttttgggtacattaagaacccgtataacatttttgatggagtcatcgttgtgatctctgtgtgggagatcgtgggccagcagggcggagggttgtctgttctgcgcacctttaggcttatgcgggtcctcaagcttgttcgatttctcccagcactgcagagacagctcgtagtgcttatgaaaacgatggataatgtggcaacattctgcatgctgctgatgctgttcatatttatctttagcatcttaggtatgcatctttttggctgcaaattcgcctcagagagggatggcgatacactgccagacagaaagaactttgattccttgctgtgggctattgtgactgtgtttcagattttaacacaggaagactggaataaggtcctgtataatggcatggctagcactagcagctgggccgcactttacttcatcgctcttatgacgtttggcaactacgtgctctttaacctgttggttgctatcttagtcgaaggttttcaagccgagggggacgctaacaagtccgagagcgaacctgactttttctccccttcattggatggggatggggaccggaaaaaatgcctcgctctcgtgtccttgggagaacacccagaactgcgcaaaagcctgctgcctcccctaattatacacaccgctgccacacctatgagtctacctaaatcgacttccaccggattgggcgaggctttgggacctgcgtccagacgaacatcctcttccggctctgcggaacctggcgccgcccatgagatgaaatcacctccatcggctaggtcatcaccccactctccttggagcgccgcgagttcctggaccagtaggcgaagcagccgtaactccttaggccgcgccccctccttaaagcgccgatcaccgtcaggggaacgacgctccctgttgtcgggcgagggacaagagtcccaggacgaagaggagtccagcgaggaggagcgagcctcccccgccggaagtgaccacagacataggggctctttggagcgggaggcgaaaagctcatttgacctgccagatactctgcaggtgcctggtctgcatcgaacagcctccggacggggaagtgcttctgagcatcaggattgtaacgggaagagcgctagcggacggctcgcgcgcgctctgagaccagatgatcccccactcgatggtgatgatgcagacgatgagggcaatctcagtaaaggagagagagtgcgggcctggattcgggctcgacttccagcctgctgtctggagagggattcttggtccgcctacatcttccctccccaatcgcgcttccgcctcctttgtcacaggatcatcactcacaaaatgtttgatcacgtggtgctcgttatcatctttttgaactgcattacgattgccatggagcggcctaagatcgatcctcattctgccgagcgcattttcctcacactgtcgaattacattttcaccgcagtctttctggccgaaatgacagtaaaagtagtagccttaggatggtgcttcggagagcaggcatatctgagaagtagttggaatgttcttgacggtctcctggtgttgatctccgtgatcgatatcctggtctccatggtttcggattcaggcaccaagatcctcgggatgttgagagtactacgcctgctgcgaacccttaggcccttaagggtgatcagccgtgcacagggtctcaaactggtggtggaaactttgatgtcttccctcaaacccatcggcaacatcgtggtcatctgttgcgctttcttcattatttttggaatcttgggcgtgcagctatttaagggtaagttttttgtgtgccagggggaggatacacgcaacatcaccaacaaatcagactgcgccgaggctagctatcgttgggtgcgccacaagtacaactttgataatcttggtcaagccttaatgagtttatttgttcttgcatccaaagacgggtgggtcgacataatgtacgacggcctggacgccgtgggcgtggatcagcaacccatcatgaatcacaacccctggatgttgctctacttcatctcctttcttctcatcgtggcctttttcgttctaaacatgttcgtcggtgtggttgtggaaaattttcacaaatgtcggcaacatcaggaagaggaggaggcccggcggcgcgaggaaaaacgactgcggaggctggaaaaaaaacggagatcgaaggagaaacagatggcagaagcgcagtgcaagccatactacagcgattacagccggtttcgtttgttggtgcatcacctatgtacatcgcattacctcgacctctttatcaccggagtgattgggctgaatgtagtaacaatggctatggaacattatcagcagccacaaatcttagacgaggcgctgaagatatgcaattatatctttacggtaatctttgttctcgagtccgtgtttaagttagtggcattcggattccgacgctttttccaggatcgctggaatcagctcgatctcgcaattgtacttctgagcatcatgggcattacactggaagaaattgaagttaatgcaagtcttccaatcaaccctaccattattaggattatgcgggtcctcaggatagctagagtcttaaagctgcttaaaatggccgtgggtatgcgcgccctgctggacactgtcatgcaggccctgcctcaggtcgggaatctgggactactattcatgctcttattctttatctttgctgccctgggcgtcgagctgttcggcgacctggagtgcgacgagacccatccatgcgaaggactgggacggcacgcgacgttcaggaatttcggtatggcattcctgaccttgtttagagttagcactggggataactggaatggaattatgaaagatacactgcgggactgtgatcaggaatccacctgctataacaccgttatatcgcctatttactttgtttccttcgtcctaaccgctcagtttgtgctggtgaacgtggtgatcgcagttttgatgaaacacttagaggagagtaacaaggaggcgaaggaagaagcggaattggaagccgagctagagttggagatgaaaacgttgtcgccgcagccccactcacccctgggctctccgtttctctggccaggagtggaaggtccagacagccctgacagccccaagccaggcgcgctgcacccggccgctcatgctaggtctgcgtcgcacttctccttagagcaccctaccgatcgccagctcttcgacacaattagtcttctgatacaaggcagtctagaatgggagcttaagctgatggatgagctggcaggaccaggcggccagccctctgcctttccctcagcaccaagcctaggagggagtgacccgcagatccccctggctgagatggaagcactttctttgacatctgaaattgtttctgagccctcatgttccttagcccttacagatgattccctgccagacgacatgcatacgctgctcctaagcgcactcgagagcaacatgcagccacaccccactgagctcccaggtcctgatttacttactgttaggaaatcgggtgtgtcgaggacccatagtctgcccaatgacagctacatgtgtcggcatggcagtactgccgaaggaccacttggacatcgcggatgggggctgcccaaagcccagagtggaagtgttctgtcggttcactcccagcccgctgacacaagctacatcctgcagcttcctaaggacgctccacatctcttgcagccgcattccgcccctacatgggggaccatccccaagttaccccctcccggtagatctccactggctcagcgaccattgcgtcgacaggctgccattagaaccgatagtctcgacgttcagggacttggatccagagaggatttgctggctgaagtatccggtccctcaccaccacttgctagagcatattccttctggggccagtcctcaacccaggcccagcagcacagccggagccattcaaaaattagtaaacatatgacccctccagccccatgcccaggtccagagcccaattggggcaagggcccacccgagaccagaagctcacttgagttggacacagagctttcatggatttctggagatctgctaccacctggtgggcaggaggagccccccagcccacgggatctaaaaaaatgttactcagtggaagcccagagttgtcaaaggcggcctacatcctggctggatgaacagcggagacattccattgctgtttcatgtctcgacagcggtagccaacctcacctgggcacagacccgagcaatctggggggacagcccctgggtggacctggctctcgccccaaaaagaagctgagcccacctagtattaccattgatccaccagagagccaagggcctagaacccccccttcccctgggatttgcttgcgacgccgcgctccttcttcagatagtaaggatcccttggcttctggcccaccagacagtatggcggccagccccagccctaaaaaggacgtgttgagtctgtcgggcctgagctccgaccctgccgaccttgatccgtag

SEQ ID NO: 40694 - DNA, 6516 bp, Artificial Sequence
  Description of Artificial Sequence: Synthetic coding sequence
atggacgaggaggaggacggcgccggcgccgaggagagcggccagccccgctccttcatgcgccttaacgatctttccggggcaggtgggcggccgggacccggatcagcagaaaaagacccgggcagtgctgactctgaggctgagggcctcccttatccggcactcgctccagtagtattcttctacctgagtcaggattctcggccccgctcttggtgcctccgcaccgtgtgtaatccatggtttgagcggatctccatgctggtgatcctgcttaactgcgttaccctgggtatgttcaggccatgcgaagatatcgcatgtgactctcaaagatgtaggattctgcaagccttcgatgacttcatctttgcatttttcgctgtggagatggttgtaaaaatggtagccctgggtattttcggaaaaaaatgctacctcggagatacatggaatcgcctggacttttttatcgtcattgccggaatgctggagtattcacttgatctccagaacgttagctttagtgctgtgcgaacagttagggtgctgcgacctctgagagccatcaatcgggtgccgtcaatgagaatcctggtgactcttcttctggacaccttgcctatgctcggaaacgtgctgttactctgctttttcgtcttctttatatttgggattgtgggagtccagctgtgggctggccttctaaggaaccgatgtttcctgcctgagaatttctcactccctcttagtgttgatctggagaggtattaccagacggaaaatgaggatgagtctcctttcatctgttcacagccacgggagaacggtatgcggagctgcaggagcgtgccaacccttcgaggggatggtgggggaggacccccttgcgggctcgactatgaggcctacaacagtagcagcaatactacttgcgtcaactggaaccagtactatactaattgttcggccggtgagcacaacccgttcaagggcgccattaattttgacaacatcggctatgcttggatagcaatattccaggtaataacactggagggctgggtagacatcatgtacttcgtcatggacgcccatagcttttataatttcatttactttatacttctgatcatcgtgggctccttttttatgattaatctctgtctcgtcgtcatcgcaacacagttttcagagacaaagcagcgggagagtcagttaatgagagagcagagagtccggtttcttagcaatgcctctactttggccagcttttccgaacccgggagttgctacgaagagctgttaaaatatttggtatacatcctccgcaaagcggctagaaggctggcacaggtgtctcgcgctgcgggggttcgggtcggcctcctatcctcaccagctcccctggggggccaagaaacacaaccttccagttcctgtagtagatcacaccggagattaagcgtgcatcatttggtacaccaccaccatcaccaccaccaccactatcacttaggtaatggcactttgagagccccaagagccagtcctgagatccaagaccgagacgccaatggatcccgtagactgatgctgcccccgccttcaacccctgcactgtccggcgccccgcccggaggagcagaaagcgtgcacagtttttatcatgccgactgtcatctcgaacctgtgcgctgccaagcacctccaccaagatctcccagcgaggccagtggtaggaccgtgggttctggaaaagtgtacccaacagtgcacacttctccaccacccgagaccctgaaagagaaggcgctggtcgaggttgccgcaagctcaggccctcccactcttacaagccttaatattcctcctggcccctactctagcatgcacaaacttctggagactcaaagtacaggggcctgtcagtcttcctgtaagatcagctcgccctgcttgaaagccgattccggggcctgcggtcctgacagttgtccatactgtgcccgggccggggcaggtgaggtcgaactcgctgacagggagatgcccgattcagacagcgaagctgtgtacgaattcacccaggatgcccagcattctgacctccgggatcctcactcccggcgtcagcggtcattgggccctgacgctgagcctagctctgttctggccttttggcgcctcatctgcgacactttccgtaagatcgtggacagcaagtactttggaagaggtataatgatagctattcttgttaacactctgtccatggggatcgagtatcacgagcagcccgaggagttgaccaacgctctcgagatttccaacatcgtttttacctcactgttcgccctcgaaatgctcttgaaactgctcgtttatgggcctttcgggtatatcaagaacccctacaacatctttgacggggtgatcgtggtgatctccgtttgggaaattgttggacagcaagggggtggattaagtgtgctgcggaccttccgcctcatgcgggtgctaaagcttgtccggtttctgccagcacttcagagacaattagtcgtgctgatgaaaaccatggataatgtggccacattctgcatgctgctgatgttatttatatttatattcagcatcttgggcatgcacctctttggatgcaaattcgcaagcgagcgggatggagacactctccccgatcgtaagaactttgatagtctgttgtgggccattgtgactgtgtttcaaattctgactcaagaggactggaacaaggtgttgtacaatggtatggcatcaacatcttcctgggccgctttatacttcattgcattgatgacttttggcaactacgtgctgttcaatttgcttgttgccatccttgtggaaggattccaagctgagggggatgcgaataaatctgagagcgaacccgatttctttagcccttccctagacggcgacggggatagaaaaaaatgcctcgcactcgttagcttgggcgagcacccagaactgaggaagtccctcctgccacctttaattatccacactgccgcaacacccatgagcctaccgaaaagcacatctacgggcctgggggaagcacttggaccagcgtcacgacggacgagtagtagcgggtcagccgaaccgggggctgctcacgaaatgaagtcgccgcctagcgcaaggagcagcccacacagtccctggtcggctgcttctagctggacttcacggcggtccagtcgaaattcactcggccgagctccttctctcaagaggcgcagcccatccggcgagaggcgtagcttactttccggcgagggacaagaaagccaggacgaagaagagtccagtgaggaggagagagcctcacccgccggatccgaccacaggcaccgcggctccttagaacgcgaggccaagagttccttcgacttgccagacacccttcaggtccctggccttcatcgcactgcttccggtagaggctccgctagcgagcatcaagactgcaacggtaaaagtgcatccggtcgtctggcccgcgcccttcgcccagatgaccccccactcgacggagacgacgcagatgatgaaggaaatctgagcaaaggtgaacgagtgcgggcttggatcagagcacgactacccgcctgttgcctggagagggattcttggagtgcttacatcttcccgcctcagagccggttcagactactttgccaccgcattataacccacaagatgttcgatcacgtagttctagtcattattttcttgaactgtatcactattgcaatggagcgcccaaagatcgacccacactcagccgagaggatctttttaaccctcagtaactacatatttactgctgtatttctcgctgaaatgactgtgaaggtggtcgcactgggctggtgcttcggggagcaggcttatctaagatccagttggaacgtgctcgacggtctgctggttctcatctcagtcattgacattctggtgagtatggtcagtgactcgggaacaaaaatcctggggatgttaagagtgttaaggctactcagaaccttgcggcccctgcgagtcatcagcagagcacagggtctgaaactagttgtggagaccctcatgtcttctctgaaacccatcggtaacatcgtagtgatttgctgcgctttcttcattatatttggaatcctgggcgtccagctctttaaaggtaagttcttcgtatgccagggggaagacacaaggaatatcacaaataagagtgattgcgccgaggccagctacaggtgggtaaggcataagtataacttcgataatctcggccaggcacttatgtcacttttcgttctcgcatcaaaggatggttgggtggacatcatgtatgatggtttggatgccgtgggggtcgaccagcagccaatcatgaatcataatccctggatgctcctttactttatctcttttctgctgatagtagctttcttcgtcctgaatatgttcgtgggcgtggtggtcgaaaactttcataagtgtcgccagcaccaggaagaggaagaggctaggaggcgagaggagaaaaggcttagacggttagagaagaagcggcgctcaaaggagaagcagatggcagaggcccaatgcaagccttattactccgactatagccgctttagactgcttgtgcatcatctttgtacatcccattatctggacctgtttatcaccggagtaattggattaaatgtggtaactatggccatggagcattaccagcagcctcagatccttgacgaggccctaaaaatatgtaactacatttttactgtcatttttgtgctggaatcagtttttaagctggtggcctttgggtttagaagattcttccaagatcggtggaatcagttggatttagcaatcgtgttgttgtctattatggggatcaccttggaagaaattgaggtcaacgcctcactcccaataaaccctacaattattcgcatcatgagagtactccgcatcgcaagagtcctgaagttattgaagatggcagtcggcatgagagcactgctggacactgttatgcaagcgctgccacaggttggtaatctaggattactgttcatgttactattcttcatctttgctgcactaggcgtcgagctgttcggagatctggagtgtgatgaaacacatccttgcgagggccttggacggcacgctacattcaggaactttgggatggcgttcttaacactgtttcgggtaagcaccggcgataattggaatggcataatgaaagacacacttcgggactgtgatcaagaaagtacttgttacaacaccgtgatctccccgatttatttcgtaagtttcgtgctcacggcccagtttgtcttggtgaacgtggtgatagcggttctgatgaagcacctggaggagtcgaacaaagaggccaaggaagaggccgagctggaggctgagttggaattggagatgaagaccctcagcccccagccgcattctccgctcggcagtccatttttgtggcctggcgtagaggggcccgattcgcccgattcacctaaacccggggcattacatccagctgcacatgcccggagtgcttcacactttagcctggagcacccaacaatgcaaccacatcctactgagctgcccggtcctgatctgctgacagtacggaagtcaggggtttcccggactcattcactacccaacgattcctatatgtgccgacatggcagcaccgcagaaggacccctcgggcatagaggatggggcctgccaaaggcccagtccggcagcgtgttgtcagtccactcacagccagctgatacatcttacatcctccagctgcctaaagatgcccctcatctgctacagcctcacagcgcccccacatggggaacaatccctaagttgcctccccccggccggtcacccctggcacagcgcccactgcggagacaggccgcaattcgcactgactcactggacgttcaggggttgggtagtcgggaggatctactggctgaagaggagcccccttccccacgggatctgaagaaatgctacagtgtcgaggcccagtcctgtcagcgtcgtcccactagctggctggatgaacaacgcagacactccatcgcagtaagctgcctagatagcgggtcacagccacacttgggaactgatccgagcaacctaggcggccaaccattgggaggccctggctccaggcctaagaaaaagctgtctccccctagtatcaccatcgatccccccgaaagccaaggtccccgcacacctcccagcccaggaatttgtctacgtcgtcgcgcccccagttcagattctaaagacccgcttgcgtccggccctcccgatagcatggctgcctcgcccagccctaagaaggacgtcctgagtctctccgggctcagctcagacccagcagacctggatccctag

SEQ ID NO: 40695 - DNA, 7134 bp, Artificial Sequence
  Description of Artificial Sequence: Synthetic coding sequence
atggacgaggaggaggacggcgccggcgccgaggagagcggccagcccagaagtttcatgagactgaacgatctttccggggccggtggaagaccgggtccggggagcgctgagaaggatcccggcagcgcagactcagaggccgagggcctgccatacccggctctcgctcccgtcgtgtttttttacctttctcaggattcccgcccccgatcatggtgtctgcgcaccgtgtgtaacccatggttcgagcgaatttccatgcttgtgattctgctcaattgcgtgacgctggggatgtttaggccttgtgaagatatcgcatgtgactcccagcgttgtcggatcctgcaggcattcgatgattttatttttgctttttttgcagtcgaaatggttgttaaaatggtggccttagggatatttggaaagaaatgctacttaggggatacgtggaatcgcctggacttcttcatcgtgattgcagggatgctggagtacagtttggatctccagaacgtgtcgttcagcgccgtccggactgtcagagtgctccggccattgcgtgccatcaacagagtgccaagtatgaggatcctggtcactctgctcttagacacgctgcctatgttggggaatgtgttacttctgtgctttttcgtgtttttcatattcgggatagttggcgtccaactctgggcaggattgctcagaaaccgatgctttctccccgagaacttttccttgcccttatccgtggatctggaaaggtactaccagactgagaatgaggacgagtccccgtttatatgcagccagcccagagaaaatggcatgagatcctgtcgatctgttccaaccctgaggggtgatggtggcggaggccctccctgtggcttagattacgaggcctataactcttcatctaatacgacctgcgtgaactggaaccaatactacacaaactgtagcgctggagagcataaccccttcaagggcgcgattaattttgataatattggctacgcgtggattgcaatcttccaggtgattactcttgaggggtgggttgatatcatgtactttgtcatggacgcacattcgttctacaacttcatctactttattctcctcatcattgtgggatctttttttatgattaatctgtgtctcgtagtgatcgctacacagttttctgaaaccaagcagagagaatcccagctcatgagggaacaacgggtaaggttcttatccaatgcaagtaccctggcctccttcagtgagcctggaagctgttacgaagagttactgaaatatcttgtgtatatcctgcgaaaggcggcacgcagactggcacaggtgagtcgggctgccggagtaagggtgggtttactgagcagccctgccccactaggcggacaagaaacacagccatccagctcctgctcacggagtcatcgcaggctttctgtccatcacctggtgcatcaccaccatcatcaccatcatcactaccaccttggcaatggaaccctgcgcgctcccagagcctcgccagagatccaagatcgcgacgcaaatggaagccgacgattgatgctgccccccccgagtacaccagcattaagcggagccccccccgggggagctgaaagcgttcattcgttttaccacgccgactgtcacctggagcctgtgaggtgccaggctccccccccgcgctcaccaagcgaggccagcggcaggacagtgggaagcggaaaggtgtaccctactgtacacactagtcccccacctgaaacactgaaagagaaggctctggtcgaggtcgccgcctcctcgggacctcctaccctaacctctttgaatataccacccggaccatactcgagcatgcacaaactgctggagactcagtcaaccggcgcctgtcagagctcatgtaagatctcatccccttgcctcaaagccgacagcggcgcctgcggtccagactcctgcccctattgcgcgcgcgcaggggcgggggaagttgagctggcagatagagaaatgccggactccgacagtgaagccgtgtacgagttcacccaggatgcgcaacattccgatctgcgtgatccgcattcgcgtcgacagagaagcttgggccccgacgcggaaccaagctcagtgctggccttttggagactgatttgcgacacattccgaaaaatcgtcgacagcaaatacttcggacggggcattatgatcgccattctcgtcaacaccctgagtatggggatcgagtatcatgagcagcccgaagaactcaccaacgcgctggagataagcaacattgttttcacctcactcttcgctttggaaatgctgctaaagctgctggtttacggcccctttggttatattaaaaatccatataacatttttgatggtgtcatcgtggttatatccgtttgggaaatcgtcgggcagcaggggggaggactgtctgtcctgcgcacttttaggctaatgagagttctgaagctggtcagatttctgcctgccctgcagcgacaattggttgtactgatgaagacgatggataatgttgccacgttctgtatgctgctgatgctcttcatctttattttttctatcctagggatgcatctgttcggctgtaaatttgcctcagaacgagacggagatacactcccagatcggaagaatttcgactcactgctatgggcaatcgttactgtcttccaaattctcacgcaggaggattggaataaggtgctctataacggcatggcgagcacgtcctcctgggcagcgttgtattttattgcactgatgacgtttggtaactatgtgctgttcaacctgctcgtggcaattctggtagaggggttccaagccgaggaaatcagtaaacgggaagatgcatccgggcagctgtcctgtatccaacttccggttgattcacagggcggtgacgcaaacaagagtgagtccgagcccgactttttttctcccagtctcgacggcgatggcgaccgaaagaaatgcctagcccttgtgagcctgggcgaacatcccgagctgcgaaagagcctcctgcctcccctgattatccatacagctgcaacccctatgtctttgccaaaatccacttctactggactgggcgaagccctggggcctgccagccgacgcacttcttcctccggctctgctgaacctggcgccgcccatgagatgaaaagcccaccttcggctagatccagcccacattcaccctggtccgctgcgtcgagctggacctctcggcgtagctcaaggaattcactgggtcgcgctcccagcctgaagagaaggtctccatctggtgaaagacgctcactcctttccggggaaggacaggagtcacaagatgaggaagagtccagcgaggaggagcgcgcttcccccgccggctcagatcaccggcaccgaggatccctggaacgagaggccaaaagcagttttgatttgcccgacaccctgcaggtgcctggtcttcacaggacagcctccggcagaggcagtgccagcgaacatcaagactgcaacggaaagtccgcttccggcagacttgccagagctcttcgccccgacgacccccccttggacggcgacgatgcagacgacgaaggcaatctctcgaagggtgaaagagttcgggcctggattagggcccgactgcccgcttgttgcctagagcgcgatagctggagtgcatacatctttccccctcagagcaggtttcgcctgctgtgtcatcgaatcatcacccacaagatgttcgaccacgtcgtgctggtgattatcttcctgaattgcatcactatcgctatggagaggcctaaaattgacccccacagcgcagagcggatattcctgacgctttctaattacattttcaccgcggttttcctagctgaaatgaccgtaaaagttgtcgctctcggttggtgctttggcgagcaggcgtacttgaggtcttcctggaacgtcttagatggcctgctggtgctcatttcggtgatcgacatcctggttagtatggtatccgattcaggcactaagatattgggcatgctacgggtgcttagactgttgcggacactaagaccgcttcgggtcataagcagagctcagggcctgaagctagtggttgaaaccttaatgagcagcttgaaacctatcgggaacatcgtggtcatctgctgtgcgttcttcatcattttcgggatcctcggcgtacaactttttaaaggaaaattttttgtctgccagggtgaggacactcgcaacatcactaacaagtcagactgcgccgaggccagctatagatgggttaggcacaaatacaacttcgataacctgggtcaggccctgatgagtctattcgtgttagcatcaaaagatggatgggtggacatcatgtacgacggcctggatgctgtgggcgtggaccagcagcccatcatgaatcacaatccatggatgttgctttatttcatttcgtttcttctgattgtggcattctttgtgctaaacatgttcgtcggggtggtggtagaaaattttcataagtgcagacagcatcaggaggaggaggaggcccgcaggcgggaggagaagagacttcgccggttggaaaagaaacgtaggaacctgatgctggacgatgtcatcgcaagtggctcttctgccagcgcagcttcagaggctcagtgtaagccctattactctgattatagtaggtttagactgctagtgcatcacctgtgtacttcccactacttagatttgtttattactggcgtcattggactgaacgttgtgaccatggctatggagcactaccagcagcctcagattctcgacgaagctttgaaaatctgcaattatatcttcactgtgatctttgtcctcgagtccgtgtttaagctggttgcattcggcttccgacggttcttccaggacaggtggaaccagctcgacctcgcaatcgttctactgtccattatgggtatcaccctagaggaaattgaggttaatgcttcgttacccatcaacccaaccattatccgaatcatgcgcgttctcaggatcgcacgagtactaaagctgctgaagatggcggtggggatgagggctctgctggatacagtcatgcaggcactgccccaggtggggaatctgggcctgctgtttatgcttttgttcttcatctttgcggctctgggagtcgagctgtttggtgatcttgaatgtgacgagacacatccgtgcgaggggctggggcggcacgccactttccgaaattttgggatggccttcctcaccctttttagagtgtctacaggtgataattggaatggcattatgaaggatactctcagagactgtgaccaagaatccacatgctataataccgttatttcccccatctattttgtgagcttcgtcctcacggctcagtttgtgctggtcaacgtggtgatcgccgttctgatgaagcatctggaagaaagcaataaggaggcaaaggaggaagccgagctggaggccgagctggagcttgaaatgaagaccctgtcaccccagccccacagcccactcggttctccatttctatggcccggcgtcgaggggcctgacagccctgattctcccaagcccggcgcactccaccccgcagcacatgcaagatccgccagtcatttctctcttgaacaccctacagaccgacagcttttcgatacaattagtcttctcattcagggatcactcgagtgggagctgaagctgatggatgagctggcaggtcccggtggccagcccagcgcttttcccagtgcccccagcctcggcgggagcgacccccagatccccctggccgagatggaagccctatccttgacaagcgaaatcgtctccgaaccctcttgttctctggctctgaccgatgatagcttaccagatgacatgcacactctgctgctgtctgccctggaaagtaacatgcagccccatccaaccgaattacccgggcctgatctcctgaccgtcaggaaatcgggtgtgtcacgcacacacagcttgccaaatgactcatatatgtgtaggcacggttcgacagctgaaggcccactgggccacaggggctggggcctccccaaagcccaatccggctccgttctcagtgtccactctcaacccgcggataccagttacatcctccaactcccgaaagatgctcctcacctgctccagccgcactccgccccaacatggggaaccattcctaagctgccaccccccggaagaagccctctggcacagcgccctctgaggcggcaggctgccattcgaactgactccttagacgttcagggactgggaagccgcgaggacttactcgctgaggtcagtggccccagtcccccccttgctagggcttactcattctgggggcagagctctacccaagcacaacagcatagtaggtcgcacagcaagatttcaaaacacatgaccccccctgctccgtgtcctggacctgagcccaattggggaaagggccccccagaaacacgctctagtctggaactggacacagaactatcatggatctccggtgacctgctgccccccgggggtcaggaggagccgccatccccccgcgacctgaaaaagtgctactccgtggaggcccagagttgccagaggcgccctacttcttggctagatgagcagagacgtcattcaatcgcagtttcttgcttagactccgggtcacagcctcacctcggtacagatccttcgaacctaggaggccagcccttgggcgggcctggctcacgtccaaagaagaaattatcccctccgtctattacaatagaccctccagaatctcagggccctaggacaccaccttctcccggaatctgtcttcgtaggcgagcaccaagctccgactcaaaggatcctctcgcctctggacctccagattcaatggccgcttctccctccccgaagaaagatgtactgtccctgtcaggattgagcagcgatcctgccgatctagacccctag

SEQ ID NO: 40696 - DNA, 6786 bp, Artificial Sequence
  Description of Artificial Sequence: Synthetic coding sequence
atggacgaggaggaggacggcgccggcgccgaggagagcggccagccccgttcctttatgcggcttaatgacttatcgggtgctggtggcaggccaggtccggggtccgctgaaaaggaccccggctccgccgactccgaggcggagggcctcccttaccccgcactcgctccagtcgtgtttttttacctgtctcaggacagtcgaccccggtcctggtgtcttagaacggtatgcaatccttggtttgagagaatttcaatgttggtgatccttttaaattgcgttacattgggcatgtttagaccgtgcgaagatatagcttgcgactcacaaagatgtaggatactgcaggcatttgacgacttcatcttcgctttcttcgccgtcgagatggtcgtgaagatggtggccctgggcatcttcggcaaaaagtgttacttgggtgatacttggaaccggctcgatttttttatcgtgatagctggcatgcttgagtacagcctggacctccagaacgtgagcttctcagccgttcgcaccgtcagagtgctacgacccctgcgagccatcaatcgggtcccgagcatgcgaatattagtcacgctgttacttgacacgctacccatgttgggcaatgtgttgcttctctgcttttttgtattctttatattcggcattgtgggcgtccagctttgggccggactactacggaatcgctgctttcttcctgagaatttctcgttgccactttctgttgatctggagagatattatcagactgagaatgaggatgaatcacctttcatctgctcgcagccgcgggagaacggcatgagatcttgtcgctctgtccctaccctgcggggcgacggtggaggtggacccccatgtggcttggactacgaggcttataacagctcgagtaataccacttgtgtaaattggaatcagtattacacgaactgcagcgcaggcgagcataacccctttaagggggctataaattttgacaacatcggatacgcctggattgccatattccaggtgattaccttggagggctgggtcgatattatgtacttcgtgatggacgcccatagtttctacaactttatttactttatactgctgattatcgtggggtcctttttcatgatcaacctgtgtctggtcgtgattgccacacagtttagcgagaccaagcagcgtgagtcccagctaatgcgcgagcagagagtgcgtttcctttccaatgcttctaccctggccagcttcagcgaaccaggctcgtgctacgaagagctactcaagtacctggtgtatatcttgcgaaaggccgctaggcggctcgctcaagtctcaagagcagcaggtgttagagttgggttgctatccagtccagcgcctctgggcggtcaagagacgcagcccagctcctcgtgtagcaggtcacatcggagactgtcagtgcaccatctggttcatcatcatcaccatcatcatcaccattatcatctgggcaatggcacactgagggccccgagagcttcccctgagatacaagaccgggacgcaaatggatcaaggagactgatgctgccaccgcccagtacgccggcccttagcggagcccctcccggcggcgccgagtcagtgcacagcttctaccatgcagactgtcatctggaaccagtgagatgccaggccccacctccccgctcaccgtccgaggctagcgggagaacggttggaagcggtaaagtctatcccaccgtccatacaagccccccgccagaaactctaaaggaaaaggcccttgtggaagtcgctgcttcttccggcccgcctactctgacctcactgaacatacctccgggaccctattcctctatgcacaagttgctcgaaactcagagtacaggggcctgtcagtcctcttgcaagataagctctccttgtctgaaggctgacagcggggcatgcggccccgatagttgcccttattgcgcccgcgccggggctggggaggtcgagctcgcggacagagagatgcccgactccgactccgaggccgtttacgaattcacccaggatgctcagcacagtgatcttagggacccccactcacgtcgccagagatccttaggccccgatgccgaacccagttccgtccttgcgttctggcgtctgatatgcgatactttcaggaaaatcgttgatagcaaatacttcggccgaggaatcatgatcgcaattctcgtaaatacattgtctatgggcatcgagtaccacgaacagccagaagagttgaccaacgccctggaaattagcaacatcgtgtttacaagtctgtttgccttggaaatgctcctgaaactcctcgtttatgggccgtttggatacatcaagaacccctacaatatcttcgacggggtgattgtagtcatttcagtgtgggagatcgttgggcagcagggtgggggccttagtgtactgaggaccttccgactcatgagggtcctcaagctggtgcggttcctgcccgccttgcaacggcagctggtcgtgctgatgaagactatggacaatgtcgcaacattctgtatgttgctgatgctgtttatcttcatcttctctatcctgggcatgcatttgttcggttgcaaattcgcatctgaacgggacggagacactttgccagaccgtaaaaattttgactcattgctgtgggcaatcgttacagtgtttcagattcttacccaggaggactggaataaggtactctacaatggaatggccagtacctctagctgggctgccctttattttattgccctcatgacctttggcaattacgtgctcttcaacttgctggtcgcaattctggttgagggcttccaggccgagggcgacgccaacaagagtgaatccgagcccgattttttctcgccctccttggatggggatggcgacaggaagaagtgcctggcgctcgtgagtcttggggaacatcccgagctgagaaagtctcttctgcctccgctgatcatccacaccgcagcaactcctatgagccttcctaagagtacctctactggtcttggtgaggctttgggaccagcgtcgcggcgaacctcttccagcggaagcgctgaacccggagctgcacacgaaatgaagagcccccccagcgcacggtctagccctcacagtccatggtcggcggcctcatcttggacatctagaagatcatcccgaaactccttgggtagagcccccagtttgaagaggagaagcccatcaggggagaggagatccctgctgtccggtgagggacaggaaagtcaagacgaggaggagagctctgaggaggaacgtgcatcgcccgctggaagtgatcacaggcatcgcgggtctctggagagagaagccaaaagctcttttgatctcccagatactctgcaggtcccaggccttcaccggactgcaagtgggcggggttccgcatcagaacatcaggactgcaacggaaagagcgcgagcggccggctcgcgagagctctgcggccagacgatcctccccttgatggtgacgacgcagatgatgaaggaaacctttccaaaggtgagagggtacgcgcatggattagggctcggttgcctgcatgttgcctggaacgggattcctggagtgcctacattttccctccacagtctcgctttcggctactctgccacagaatcattacacacaagatgttcgatcatgtagtgctcgtgatcatattcctgaactgtattaccatagctatggagcggccaaaaattgacccccatagcgcagagcgcatctttctgaccttgagcaattacatatttaccgcagtgtttcttgctgagatgactgtaaaagtggtcgccctgggatggtgttttggagaacaggcttacctcaggagttcttggaatgttctggacggcctgctcgtgctgatcagtgtgatagacattctagtgagtatggtgtccgacagtggtaccaagatccttggtatgttgagagtgctgaggctgctcagaaccctccgccccctgagggtgatttcacgtgcacagggtctgaagctcgtcgtagagacactgatgagcagcctaaaacctattggcaatattgtggtaatctgctgtgccttcttcattatctttggcatccttggtgtgcagctgtttaaggggaaatttttcgtgtgccagggagaggatacccgcaatatcaccaataagtcagactgcgcagaagcctcctaccgatgggtccgacacaaatataatttcgataacctcgggcaggccttaatgagtctctttgtgcttgcatctaaagatggctgggtcgacatcatgtacgatggtctggacgccgtgggcgttgatcagcagcctattatgaaccataatccatggatgttgctgtattttatcagcttcctgcttatcgtggccttctttgttttgaacatgtttgtgggtgtggtggtagagaattttcacaaatgtagacaacaccaggaggaggaagaggcccggcggcgagaggaaaagagactgcgtcgactggagaagaagcggcgcaatttgatgctagatgacgtgatagcatcagggtcctccgcgtccgcagcctctgaggcgcagtgcaagccctattactctgactacagcaggttccggctcctggtgcaccatctctgtacctcccactacttggatcttttcattacaggcgttatcggcctcaatgtcgtgacaatggcaatggaacactatcagcagccccaaatcttggacgaagcacttaagatttgcaattacatttttactgtgatctttgtgctcgaatctgtgtttaaactcgtcgctttcggtttccgccgcttctttcaggatcgctggaatcaactagatttggctatcgtgctgctttctatcatgggtatcaccttagaagagatcgaggtgaacgcgtccctaccgatcaaccccacgattataaggatcatgagagttctacgaatcgctagggtgctgaagctcctgaaaatggcagtcggcatgcgagctttattggacacagtcatgcaggccctgccccaggtgggcaacctggggctgctttttatgttattatttttcatctttgccgcccttggggtggagctgttcggcgacttggagtgtgacgagacccatccttgcgagggactgggaaggcacgctacgtttcggaactttggaatggcctttttgacactttttagagtaagcaccggggacaattggaacggaatcatgaaggatactttacgagactgtgatcaggaaagtacgtgttacaatacagtgatcagccccatctactttgtcagctttgtgctgacggcccagtttgtgctcgttaacgtcgttattgccgttctcatgaaacatctcgaagagagcaataaggaggccaaggaggaggcggagctggaagccgaattagaactggagatgaagacactaagccctcagccccacagccccctgggctccccttttctttggccgggcgtggagggccctgacagccctgattctcctaagcccggcgccctgcaccctgccgcccatgcgcgcagcgcaagccatttttctctggagcatccgaccatgcagccacatcctacagaactgcccggacccgatctcctgacggttcggaaatcgggagtgtcaaggacccatagtctccccaacgacagctacatgtgcaggcacggctccaccgctgagggacccttgggccaccggggatgggggctgcctaaagcccagagcggttcggttttgtctgtccactctcagccagcggataccagttatatattgcagctgccgaaggacgccccccacttacttcaacctcatagtgcgcctacgtggggcactatccccaaactcccgcctcctggccgtagccccctggcacagcggcccctgcggaggcaggcagcaattcgcactgactcactggatgttcagggtcttgggtctcgcgaggatttattggccgaggtgtccggtccttcccctccacttgccagagcctattcgttttgggggcagagctccacccaggcacaacagcacagtcggtcacactctaaaattagcaagcacatgacacccccagccccctgtcccggaccagaacctaattgggggaaaggcccccccgaaacacgtagtagtctggagctggatacagagcttagctggattagtggggaccttttgcctccaggggggcaggaggaacccccatcccccagagatctgaagaagtgttacagtgtcgaagcacaaagctgtcagcgccgccccactagttggttggacgaacagcggcgacacagtatcgccgtgtcctgccttgattcgggctctcagccacacctgggcacagatccatctaatttagggggccagccgctgggaggcccaggcagtagaccaaaaaaaaagctctctcccccttcaattactatcgacccaccagagtcccagggaccacgcacacccccctcaccaggaatctgcctaaggcgtcgtgcccctagctcggattccaaggaccctctggcgtcaggaccgccggactcaatggcagctagtccgtcgccgaagaaagacgtcttgtctctatccggcctctcatcagatcccgccgatttggacccctag

SEQ ID NO: 40697 - DNA, 4668 bp, Artificial Sequence
  Description of Artificial Sequence: Synthetic coding sequence
atggacgaggaggaggacggcgccggcgccgaggagagcggccagcctaggtccttcatgcggctgaatgatctttctggagcaggcggccggcccggccctgggtccgcagagaaggaccctggatccgccgattcagaggccgaggggctgccctaccctgctctggccccagtcgtgttcttctacctgtcacaggactctaggccccggagctggtgcctccgtactgtctgtaacccctggttcgagcgcatcagtatgttggttatattgcttaactgcgtcacactgggtatgtttcggccgtgcgaagacattgcctgcgacagtcagcgttgccgaatactgcaggcattcgacgactttatcttcgccttttttgctgtggagatggtggtgaagatggttgctcttggcatcttcgggaaaaaatgctacctgggggatacctggaacagactcgatttcttcatcgtaattgctggcatgctggaatatagtctcgacctacagaatgtctccttctctgccgtgcgaactgtgcgtgtactgcggcctctgagagccattaatcgcgtaccatcaatgagaatcctggtaactctcttactggacactctccctatgctcgggaacgtcctgcttctttgttttttcgttttctttatttttggaattgtcggcgtccaactgtgggctggcctgctgcgcaatcggtgtttcctgccggaaaattttagcctccctttatcagtggacctcgagagatattaccagacagagaacgaagatgaatctccattcatttgcagccaaccaagggaaaacggtatgcgcagctgtcgaagcgtccctactcttagaggggacggtggtggcggccccccctgtgggctggactatgaagcttacaattcatcaagtaacacaacgtgcgtgaattggaaccaatactatactaactgttccgccggagaacacaatccctttaagggagctattaatttcgataatatcgggtatgcttggattgccatctttcaggtgataacactggaagggtgggtggacattatgtattttgtgatggacgctcatagcttttataactttatctattttatcttacttatcatcgtggggtcctttttcatgattaacctctgcttggtggttatagccacccagttttccgagacaaagcagagagagagccagctgatgagagaacaacgggtgagatttcttagtaacgcgagtacactggccagcttcagtgagcctggttcctgctacgaggagctgttaaaatacctcgtttacattttacggaaggcagccagacgactggcccaggtcagtcgcgccgcgggagtccgcgtggggcttctcagctctccggctccgctggggggacaggaaacccaaccctcgtctagctgttcccgcagtcatcggcgtctgtcagttcatcacttggttcaccaccatcaccatcatcaccaccactatcatctggggaatgggacgctccgcgccccacgagcaagccctgagatccaggacagagatgctaatggcagtagacgtttgatgttgccaccaccatctacccctgcattgagtggtgcaccacccgggggggcagagtctgttcacagcttctaccacgccgattgccatctcgagccagtgcgatgccaggctccccctccacggtctccgagtgaggcatcagggcgcaccgtaggaagtgggaaggtgtatcccacagtgcatacatcccctccccccgagactctgaaagaaaaagctctcgtggaagtcgccgcttcctccggcccccctaccttaacgtctctcaatatcccgccaggtccctactcttctatgcacaagctcttagaaacccagagtaccggtgcttgccaatccagttgcaagatcagttctccctgcctgaaagcagattcaggcgcctgcggaccagacagctgtccctattgcgccagggcaggagccggtgaagtggagctagccgatcgggaaatgcccgatagcgattcagaggccgtctatgagttcacacaagatgcccagcacagcgatcttcgcgatccccactcccgtagacagagaagcctaggtcctgacgctgagccatcttcagtgctggccttctggcgcctgatctgcgacaccttcagaaagatcgtggatagcaagtactttggtagggggatcatgatcgctattcttgtgaatactctgagcatgggcatcgagtaccacgagcaacctgaggaattaactaatgcgttggagataagcaatattgtatttactagcctattcgcccttgagatgcttttaaagttattggtctatggccctttcggctatattaagaacccttacaatatttttgacggagtgattgtggtgatcagtgtttgggagattgtgggtcaacagggaggcgggttaagcgtccttaggaccttcagactaatgcgcgtattgaagctagtgcgcttcctcccagcccttcagagacagctggtggttctgatgaaaaccatggataacgtagccacattttgcatgttgcttatgttatttatatttatcttttctatcctgggtatgcatctgtttggctgcaaattcgcatccgaacgtgatggagacacattgcccgacagaaagaatttcgacagtctgctgtgggccattgtgactgtgtttcagatcctgactcaggaagattggaacaaagtgctgtacaacggcatggcatctacatctagctgggcagcactgtattttattgccctcatgacatttgggaattacgtcctcttcaatctgctcgtcgctattcttgtggaaggtttccaggctgaagagatttccaagcgggaggacgcatctggtcagttaagttgtatccagctgcccgtcgactctcagggtggagatgcgaacaagagcgagagtgagcctgacttctttagcccatcgctggacggtgatggcgatagaaaaaagtgcctcgcgttggtgagccttggcgaacaccccgaactgagaaaaagtttactacctccactcatcatccataccgccgctaccccgatgtcccttcctaaatccacctccacaggtctgggcgaggccctaggacccgcctctcgccgaacgtcctcgagcggatctgctgagccgggcgcagcccacgagatgaaaagtccgccaagcgccagatcctcacctcactctccttggagcgcagcatctagctggacctctaggcgctctagccgaaactcactggggcgcgctcccagcctgaaaagacgctctccttcaggcgagaggagaagcctgctcagcggggaaggacaggagtcccaagatgaggaagagtccagcgaagaagagcgggcttcgccagccggctcagaccaccgacacaggggtagtttagagagggaagcaaaatcttctttcgacctgccagacaccctccaggtgcccggcctccatagaacagctagcggccggggttctgcatccgaacatcaggactgcaacgggaaaagcgctagcggaagactagcgagggcactcaggccggacgatcctcctttggacggtgatgatgcagacgacgagggcaatctttcaaaaggcgaaagggtcagagcctggattcgggcccggctgcctgcatgctgtctggaaagagactcgtggtctgcctacatctttcctcctcaaagccggtttcggttgctgtgtcacagaataatcacacacaagatgttcgatcatgtcgtgctggttataatttttctgaattgtatcaccatcgcgatggagagacctaagatagaccctcactccgccgagcggattttcttaaccttgtctaactatatttttacagcggttttcctggcggagatgacagtgaaggtcgtcgcactgggctggtgcttcggcgagcaggcgtatctccgtagctcatggaacgtactcgatggactgttggtcctgatctccgtgatcgacatcctcgtctccatggtgagtgactcaggtacaaagatactggggatgctgcgggtgcttcggctattgcgtacgctcaggcctcttcgtgttattagccgagcccagggcctgaagctggtggttgagactctcatgtcttctctcaagcccattgggaacatcgtagtgatctgttgcgccttttttatcatcttcggtatacttggtgtgcagctgttcaaaggcaagttttttgtgtgtcaaggagaagacacaaggaacatcaccaacaagagcgactgcgctgaggccagctatagatgggttcgacacaagtataacttcgacaatctcgggcaagtctctcctcggcttcggggcggcgctgtggtgaaggaggcaggcggcgggaccggaccctgcctcgtgatccctgcagacagcggtggtggtgggctccatgaggagatctctccgagtcatcctttgttaagtaaccaccaacatgtggcaaagccctctccttcacactccgctcctaagtccggtcctatgggatccctagccgttttgaaggatgaagagacagaggcacaaaggggatag

SEQ ID NO: 40698 - DNA, 6801 bp, Artificial Sequence
  Description of Artificial Sequence: Synthetic coding sequence
atggacgaggaggaggacggcgccggcgccgaggagagcggccagcctaggagcttcatgcggctgaatgatttgagtggtgccgggggcaggccaggccctggatctgccgaaaaagaccccggttctgcggactccgaggcggaaggcctgccctaccccgcattagcaccagtggtattcttctatctaagtcaagattctcggccccgatcttggtgcctgagaaccgtgtgtaatccctggtttgaaagaatctcgatgctggtgattctcctgaactgtgtgaccctgggcatgtttaggccctgcgaagacatcgcctgcgatagccagagatgcagaattctgcaggcttttgatgactttatattcgccttctttgcggtggagatggtggtgaagatggtagcattgggcatcttcggcaagaaatgttacctgggagacacatggaacaggctggacttcttcatcgtcatagctggcatgcttgaatactctttagacttgcagaacgtgtctttttcagcagtgcgcacagtgcgagtcctccgcccactgcgtgccattaatagggttcccagcatgcgcatcttggtaacactcctgttagacactctgcctatgctgggaaatgtgctgttattatgctttttcgtgttcttcattttcggtattgtgggcgtgcagctgtgggcaggactacttagaaaccgttgctttctgccagaaaatttcagcctgccgctctcagtcgatctcgagagatattaccagactgagaatgaggacgagagcccttttatatgcagccagccacgggaaaatgggatgcgatcttgtcggagcgtccctacactccgcggcgacggtggtggcggcccaccatgcggccttgattatgaagcctacaactctagttctaacaccacatgtgtcaactggaatcagtattacacgaattgtagcgcaggggagcacaatccctttaagggtgctatcaatttcgacaacataggatacgcctggatagcaattttccaggtaattacccttgaaggatgggtggatatcatgtacttcgttatggatgcccactctttctacaatttcatttacttcatccttctgatcattgtgggttcctttttcatgattaacttgtgcttggtagtaattgccactcagttctctgagactaagcagcgcgagtcacagcttatgcgagaacaaagggttcgttttctttctaacgccagcaccctggcctctttttccgagcctgggtcctgttacgaggagctgctcaagtaccttgtatacattttgaggaaagccgccagacgactggcccaggtgagcagagctgccggtgtgcgagtcgggctcttaagcagccccgcacccctgggaggacaggagacacagcctagctcctcgtgtagtaggtcccacaggcgcctgtctgtgcatcacctggtacaccaccatcaccaccatcaccatcactatcacctgggcaacggaacgttgagagcccctcgagcatctcccgagatccaagaccgagacgccaacggttctaggcgcctgatgctaccaccgccatcaacacctgctctgagcggcgccccacccggtggagcagagtccgtccacagtttttatcacgccgactgccatctggagcctgtgcggtgtcaggctcccccaccacgcagcccaagtgaagcatcagggaggacggtgggcagcggtaaagtgtatcctacagtacacacatcaccacccccagaaactcttaaggagaaagcgctggtggaggtggcagcttctagcggaccacctactctgaccagccttaacatccctccaggtccctactccagtatgcataaattactcgagacccagagcactggcgcatgccagtcctcttgtaaaatctcttcgccctgtctgaaggcagactccggtgcttgcggcccagacagctgcccatactgtgcacgcgctggcgccggcgaagttgaactcgccgatcgcgagatgcccgattccgattctgaagcggtttacgagttcacccaagacgcccagcatagtgacctgagagatccccattctaggaggcagcgcagcttgggcccagatgcggagccgtcctccgttctagctttttggcgcctgatctgcgacaccttccgtaaaatcgttgattccaagtatttcggaagaggtatcatgatcgctattctggtgaacacgctgagtatgggcattgagtatcatgaacagcctgaggagcttacaaatgccctggaaatttccaatatcgtctttacctccttatttgccctggaaatgctcctcaagctgctcgtgtacggtcccttcggatacataaaaaatccttataatattttcgatggcgttattgtggttatttcagtgtgggaaatcgttggccagcagggcggtggactgagtgtgcttcggacatttcggctcatgcgggtactgaagctggttagattcttgcctgcccttcagcgccaacttgttgtgttgatgaaaactatggacaatgtggcgacattctgtatgctattgatgctgttcatctttattttctcaatcctgggcatgcacctgtttgggtgcaaattcgcaagtgaaagggatggagataccctgcctgaccgtaaaaactttgatagtctcctctgggctatcgtgaccgttttccagattcttacccaggaagattggaacaaggtcctgtataacggaatggcaagtacttcttcatgggccgctctgtacttcatagctctcatgacctttgggaattatgtgttgtttaacctgctcgtcgccatcctggtggaaggatttcaggcagaggagatcagcaagcgtgaggatgcctcaggccaattgtcctgtatccagctgcctgtggactcacaggggggtgatgctaataaaagcgaaagcgagccagattttttctcaccctctctcgacggagacggcgacagaaaaaagtgcctggccctggtatctctgggggaacaccctgagctccggaagagccttctgcctcccttgataatacacaccgccgccacaccgatgtcattgcctaaaagcacaagtaccgggttgggtgaggcactcggtcccgcgagcagacgaacaagctctagcgggtccgccgagcccggcgccgcccatgaaatgaagtccccgccatctgccagaagttccccccattccccctggagcgcagcgtctagttggactagccgccggagctcccgaaacagtcttggccgcgcaccatcattgaagcgcaggtcaccctcaggagaacgacggagccttctgagtggggagggacaggagagccaggacgaggaagagagcagtgaggaagagagagctagccccgctggaagcgatcatcgccaccgcggcagtttagagcgtgaagccaaaagctcttttgacctgcctgatactctgcaagtacccggattacacagaacggcttcaggcagggggtccgccagcgagcatcaggactgcaatggaaaatccgcgtccggaagattggctagggctttaagacccgacgaccccccactcgatggggatgacgctgatgatgaaggaaatctgtctaaaggtgaacgggtgagagcctggatccgtgcccggctgcctgcttgttgcctggaacgggacagctggagcgcctacatattccctcctcagtcgcgattcaggttgctgtgccatagaatcattacgcataagatgtttgatcatgtggtgctcgttatcatcttcctgaactgcattacaattgctatggaacgaccaaagatagaccctcacagcgctgaacgcattttcttgaccctctctaattatatatttactgccgtcttcctggcagagatgactgtcaaggtagtggctctagggtggtgtttcggggagcaggcctaccttcgctcctcttggaacgtcctggatgggctcctggtgcttatcagtgtgattgatattctggtgagtatggtgagtgattccggaacaaagattctaggaatgcttcgagttctgagactgctgcggaccctgaggcccctacgtgtgatatcacgggcccagggccttaagctggtcgtggagacactcatgagctcactcaagcccatagggaacattgtcgttatctgctgcgcgttcttcattattttcggaatactgggcgtgcagttgtttaagggcaagttttttgtgtgtcagggggaggatactaggaacatcaccaacaaatccgactgtgccgaagcctcttacagatgggttagacataaatacaatttcgacaatctcggtcaggctctcatgagtctgttcgtcttggccagtaaagacggctgggtggatatcatgtatgacggactagacgctgtcggcgttgatcaacagccaataatgaaccataatccttggatgctactatattttatttccttcttgctgatcgtagccttcttcgtcctcaacatgttcgtgggagtggtcgtggagaactttcataaatgtagacagcatcaggaggaagaggaggcgagaagacgtgaagagaaacggttgagacgtctggagaaaaagcgacgcaaggcacagtgcaagccatactatagcgattacagtagattcagactgctggtgcatcacttgtgtacaagccactacctggatctgtttatcactggggtgatcggcctgaatgtggttacaatggctatggagcactaccagcagccccaaattcttgacgaggccctgaagatttgtaactacatcttcaccgtaatattcgtcttggagagcgtatttaaattggtggctttcggtttcaggcgcttttttcaggatcgatggaatcagctggacctggcaattgtcctcctgtccattatgggaattacactagaggagattgaggtgaacgcctcactgccaatcaatccgacaataatccgcatcatgagagtgctgcgaatcgcccgtgttctcaaattgctgaaaatggctgtgggtatgagggctctcctggataccgttatgcaggctcttcctcaggtgggcaatctgggccttctctttatgttgcttttttttatttttgccgccctgggagtcgaactgtttggagacctggaatgtgacgagacacatccctgcgaagggctgggcagacacgctacctttcggaactttggtatggccttcctcaccctgtttcgggtcagtactggcgacaactggaatgggatcatgaaggataccttacgagattgtgatcaggagtctacttgttataacacagtcatttctcccatctattttgtgagcttcgtgttaacagcgcagttcgtcctcgtaaatgtggtaattgctgtattgatgaagcatctggaggagtcgaacaaggaggctaaggaggaagcggagctcgaggctgagctggaactggagatgaaaaccttgtcgcctcaaccccattcccccttaggaagccccttcctgtggcccggagttgaagggcccgatagcccagattccccaaaacccggagccctgcatcccgccgcccatgcaaggtcagccagtcacttttctctggagcaccctacgatgcagccgcatcccacagagctcccagggcccgatctgctcactgtccggaaatccggtgtaagcagaacccactcactgcccaacgattcatacatgtgtcgtcatggcagtaccgcggaaggcccattgggacatagggggtgggggctgcctaaagctcaatccggcagcgtgcttagcgtacattcccagcccgcggacacttcttatatcctacagctccctaaagacgctccgcatcttcttcagccccatagcgcccctacatggggcacaattcctaagcttccgccgcctgggagatcacctctggcccagcgtcctctccgccgacaggccgcgatacgcacagacagtctcgacgtgcagggactggggtcaagggaagaccttcttgccgaggtgtcggggccgtctccccctctcgccagagcctacagcttctggggacagagttccacacaggcacagcagcactcgcgttcccactctaaaatcagcaaacatatgaccccgcccgcaccttgtccagggccagaacctaattgggggaagggaccgccggagacacggagcagcctcgagttggatacagagctgtcttggatctcgggggacctcctgccacctggcggccaggaagagcctccatccccgcgtgatctcaagaaatgttatagtgtggaggcgcagtcttgtcaaagacgtccaacatcctggctggatgaacaacgtagacattctatcgccgtttcctgcctggactccggctcgcagccccacctgggcaccgaccccagcaacctgggaggccagcctttgggcggacccgggagcagacccaagaagaagctgtcaccccccagcatcacaatcgatccccctgagtcccaaggaccaagaactcctccgtccccgggcatatgcctccgccgccgagcaccgtcgtcagacagcaaggaccctctcgcaagtggccctcccgattcaatggccgctagcccgtccccaaagaaggacgtgctctccctgtctggcttgagttccgaccccgccgacctcgatccatag

SEQ ID NO: 40699 - DNA, 6732 bp, Artificial Sequence
  Description of Artificial Sequence: Synthetic coding sequence
atggacgaggaggaggacggcgccggcgccgaggagagcggccagcctagatcatttatgagactcaacgacttgtctggcgccggtggtcgtccaggaccaggttctgccgagaaggaccctgggagcgccgactcagaggcagaagggctgccgtatcccgcactggcccccgttgtctttttctacctgtcgcaggactcccgcccaaggtcttggtgccttcgcaccgtctgcaacccctggttcgagaggattagcatgcttgtcatcttattaaattgcgtgactctggggatgtttaggccctgcgaagacattgcatgcgacagccagaggtgtcgcatactgcaggcattcgacgattttatcttcgcattttttgctgtggaaatggtagtgaaaatggtcgcactgggtatctttggcaaaaaatgctatctgggcgacacgtggaacaggttggacttctttatcgtaatcgccggaatgcttgagtactccttggacctacagaatgtgagcttctctgctgtacgcaccgtccgtgtgctaaggcccttgcgggcaatcaaccgcgtcccatccatgagaattctcgtcacgctcctgctcgatacacttcccatgttgggcaacgtgcttctcctgtgcttctttgtcttctttattttcgggattgtcggcgtacagttgtgggcgggtctactacgcaatcgctgcttcctgccagaaaactttagtttgcccctgtccgtggacctcgagcgttattaccaaacagaaaatgaagatgagtccccgttcatatgttcccagccgagggagaatggcatgcgctcctgtagaagcgttcccactctgaggggagacggaggcgggggccctccatgcgggctggactacgaagcctacaactcaagttctaacacaacatgcgtaaattggaatcagtattataccaattgctcagctggggaacataaccccttcaagggtgccatcaacttcgacaatatcgggtacgcttggattgcaatctttcaggttattactctggagggctgggtggacatcatgtacttcgtgatggatgcccactcattctataatttcatttattttatcttattgattatcgtcgggagtttcttcatgatcaacttgtgtctggttgtaatagctacacagttctccgaaacgaagcaaagggaaagccagctaatgcgggagcaaagagtccgatttctgtctaatgcctccacgctggcaagcttttctgaaccgggcagttgctacgaagaactgctaaagtacctcgtctatatcctcaggaaagctgctagacgtctggcccaggtcagcagggccgctggcgtgagggtgggcctgctcagctctccagccccactcggcggtcaggagacccagcctagctcttcttgctcaaggtctcatagacgcctgtcagtacaccaccttgttcaccatcaccaccatcaccaccaccattatcatctaggcaacggcactttgagagcccctagggcctctccagaaattcaggacagggacgctaatgggtctaggagactgatgctgcctcccccgtccacacctgcgctctctggcgctcccccagggggcgctgagtcggttcattctttctatcacgccgactgccacctggagcctgtccggtgccaggcaccacctccgcggtctccttctgaggcttccggccgcacggtgggaagtgggaaggtgtacccgaccgtgcacacttcccctcctccggaaactctgaaagagaaagccctggtcgaggtcgctgcttcatctggcccccccacactaaccagcttaaatatccctcccggaccttattctagcatgcataagctcctcgagactcaatcaaccggtgcctgccagagctcttgcaaaatatcatcaccatgtctcaaggcggacagtggtgcttgcggcccagattcttgtccatactgtgctcgggccggtgctggggaggtggagcttgccgacagagagatgcctgactctgacagcgaggccgtgtatgagtttacccaggacgctcaacattctgacttgcgagatccccatagtcggaggcagcgatctcttggaccagacgccgagccgagttccgtgctcgccttctggagactgatttgtgacactttcagaaaaatcgtcgacagtaagtatttcggacgtgggataatgattgccatcctcgttaataccctctcaatgggcatcgagtaccatgaacagccagaggagttgaccaatgccctggaaatatctaacatcgtttttaccagcctgttcgccctcgagatgcttcttaaactgctggtgtacggtccctttggttacattaaaaatccctataatattttcgatggggtgatcgtggtgatatcggtgtgggagattgtcgggcagcaaggaggtggtctctcagtgctgcgtacttttaggctgatgagagtgctcaagctagtgagattcctgcccgccctgcagcgccagctagtggtgttgatgaagaccatggataacgtcgcgacgttctgcatgttacttatgttatttatttttatctttagcatcctggggatgcatctcttcggctgtaaatttgcgagcgaaagagacggagacaccctgcccgacaggaaaaacttcgactctcttttatgggcaatcgtgaccgtattccagatattgacacaggaggattggaataaggttctctacaatggcatggcaagcacttcgtcatgggccgccttgtactttatcgcactgatgacgtttggcaattatgtgctgttcaacctcttagtagccatcctggttgagggtttccaagccgagggagatgctaacaaaagcgaaagcgagcccgatttcttttccccgtcactggatggagacggcgacaggaagaaatgtctggcgctggtgagcctgggggagcaccctgagctccggaaatccctactgccccctctgatcatccacacagcagccacacctatgtctctgcctaagtctacatcaactggattaggagaggctttgggacccgcgtcacgacgcaccagctcaagcggctccgcagaacctggcgccgcccatgagatgaagtctcccccttctgccagatcctccccgcattctccatggagcgctgcgtcaagctggacttcccgccgttcttctcgaaattccttaggtcgcgctcccagtcttaagaggcgttctccgtcgggcgaacggcggtccctactatctggggaggggcaggagtcgcaggacgaggaggaatcttccgaggaagagcgagcctcacccgctggatcagaccaccgacacaggggttccctggagcgtgaagcgaagtcgtcctttgaccttccagatactcttcaggtcccaggcctccaccgaaccgcttccggacggggatctgcatcagagcatcaagactgtaacggcaaatctgcctctggccggctggcccgggctctgcgtcccgatgatcctcccttggacggagacgatgccgacgacgaggggaatctcagcaagggcgagcgcgtgcgcgcttggattagggcgcgcctgcctgcttgctgcctcgaacgagattcttggtctgcctacatcttccctccccagtctcggtttcggctattgtgtcacaggatcatcactcataagatgttcgatcatgtggtactggtcatcatctttttgaattgcattacaattgctatggaacgccccaagattgacccacactctgccgaacgcattttcctgacgctctcaaattacatctttaccgctgtcttcctggctgaaatgaccgtgaaggtcgtggcattaggctggtgttttggcgagcaggcctatctccgcagcagctggaacgttcttgacggcctcctggtattgatctcagttatagatattttggtctccatggtgtccgactctggcaccaaaattctggggatgctcagagtcctccgtctgttgagaactttacgccctttgcgtgtgatttcaagagcacaagggcttaagctggtggtggagacactcatgtccagcttgaaacccataggtaatattgtggtgatctgctgtgcattttttatcatctttggcattcttggcgttcagcttttcaaggggaagttttttgtgtgtcagggcgaggatacaaggaacatcacaaacaagagtgactgcgctgaggcgtcatatagatgggtgagacataaatacaactttgataatctggggcaggctctgatgtctctattcgtgctggcctccaaagacgggtgggtggacataatgtacgatggactcgacgcggtgggcgtggatcagcaacctatcatgaatcacaacccatggatgttgctttacttcatcagcttcctcctgatcgtggcattcttcgtgctaaatatgtttgttggtgtggttgtggagaacttccacaagtgtaggcagcaccaggaagaggaggaagcccgcagacgtgaggagaagagactgaggagactggagaagaaaaggaggaaggcacagtgtaaaccctactattctgattactctcgtttccgcttgctggtgcaccacctttgcaccagtcactacctggatctgttcataactggcgtgatcggcctgaacgtcgtgaccatggcaatggagcattaccagcagccgcagatcctggacgaggccctaaagatctgtaattatattttcacggtcatcttcgtgctggagtccgtattcaaactagtggcttttgggttccggagattttttcaggataggtggaatcagctggacttagccattgtgctgcttagcataatgggcataacactcgaagaaattgaggtcaacgccagtctccctatcaaccccaccatcatacggattatgcgggtactgagaatcgccagagtgctgaagttactcaagatggctgttggtatgcgagccttgctagacaccgttatgcaggctctgcctcaggttggcaacctgggcctgttattcatgctgctgttcttcatctttgcagcactgggggttgaactgttcggcgacctggagtgtgatgaaacccatccatgcgagggcttgggccgccatgcgaccttcagaaacttcggaatggcttttcttaccctatttagagtgtctactggcgacaattggaacggcatcatgaaagatactctccgggattgcgatcaagaatcaacatgctataataccgtcatctccccaatttatttcgtgagctttgtcctgaccgcccagtttgtgctcgtgaacgtcgtcatagcggttttaatgaagcacctcgaggaatctaacaaagaggcaaaagaggaggctgagctcgaggccgaactcgagcttgaaatgaagactctttcccctcaaccacacagtcccttgggcagccctttcctgtggcccggtgtagaagggcctgattcacctgattccccaaagcccggtgccctacatcccgccgctcatgctcgttcagcatcacacttttcgctggaacaccctaccatgcagccccacccaacagaacttccggggcctgacctgctaacagttcgcaagagtggcgtcagtcggacacactccctgcctaacgactcctacatgtgcagacacggatctacggctgagggacccttaggtcacaggggttggggactgcctaaggcccaatccgggagcgttctctctgtgcatagtcagcccgccgacacttcttatatcttgcagctgccaaaagacgctccccatctgcttcagccccactcggcacctacctgggggacgattcccaagctccctcctcccggaaggagccccctcgctcaacggcccttgcggagacaggccgcaataaggactgacagtctcgatgtgcagggtctcggctctagagaggacctgctggcagaggttagtggccccagcccacccttggcgagagcatactctttttggggccagagcagtacccaggctcagcagcactcacgcagccattctaaaatatccaaacatatgaccccccccgcaccgtgtcccgggccagaaccaaattgggggaaaggcccacccgaaacccgttctagtctggaattggatacagagttgagctggatatcaggagacctactcccgccaggtggacaagaagagcctccgtccccacgagacctaaagaagtgttattccgttgaggcccaaagctgtcaacggagacctacctcatggcttgatgagcagcgaagacactcaatcgcagttagttgtttagactctggcagccagccccatcttggcaccgatcccagtaaccttggcgggcagcctctgggagggcccgggtcccggcccaagaaaaagctgagtccacccagcataactatcgatcccccagagtctcagggtccccggacaccaccgtccccgggcatttgcttgaggcgacgggcaccatcctccgactcaaaagatcctttggcgtctgggcctcccgattcgatggccgcctctcccagccccaaaaaggacgtcttatcgctgtcaggactgtcatctgatccagcggatttagatccttag

SEQ ID NO: 40700 - DNA, 6921 bp, Artificial Sequence
  Description of Artificial Sequence: Synthetic coding sequence
atggacgaggaggaggacggcgccggcgccgaggagagcggccagccccgctcattcatgcgcttgaacgatttgtctggcgctggcgggcggccaggtcccggtagcgcggagaaggaccccgggagcgcggactccgaggctgagggattaccttatcccgccctggccccagtggtgttcttctacttgtcacaggattcccggcctcggtcatggtgtctgcggaccgtctgcaatccctggttcgagaggattagcatgctggtcattctgctgaattgcgtgacccttggaatgtttcgaccttgtgaagatattgcatgtgatagtcagcgatgtaggattctgcaagccttcgatgatttcatctttgcgttctttgccgtagagatggtggtgaagatggtggcccttggaatatttggcaagaaatgctaccttggcgacacatggaataggctagatttctttatagtaattgctggcatgctcgagtattccctggacctgcaaaatgtctcattctcagctgtgaggactgtccgcgtcctgcgccccttgagggcgatcaaccgtgtgccaagtatgcgaatcctggtaaccctcctgctggataccctgccaatgctggggaacgtgctactactgtgtttcttcgtcttcttcatttttggaatcgttggcgttcagctgtgggccggactgcttagaaatcggtgtttcctgcccgaaaatttctcattgcctctgagtgtggacctggaacgatactaccagacggagaacgaggatgagagccccttcatctgttctcagcctcgggaaaacggcatgaggagctgcagatctgtccctacactgcgcggggacggcggaggggggcctccctgtggcctggattatgaggcctacaattcatcatccaatacaacatgtgtcaactggaaccagtattataccaattgctccgcaggggagcacaacccctttaagggcgcaataaacttcgataacataggatacgcctggatcgccatctttcaagttattactctcgaggggtgggttgacatcatgtactttgtcatggatgcccactcattctacaattttatctacttcattctgctgataatcgttggatcttttttcatgattaacctgtgccttgtggtcatcgccacgcagttcagtgagacaaagcagagggagagccagttgatgcgcgaacagcgcgtgcggtttctgtccaatgcttcaactttggccagcttttcagagccaggatcctgctatgaagagctgctgaagtatctggtctacattctcagaaaggcagcgcgacggctggcacaggtatctagggcggccggcgttagggtcggcttactgtcctcaccagcccctttaggtggccaggagactcagccctctagttcttgctctcggagccatcgccgcctgtccgtgcaccatctcgtgcatcaccatcatcatcatcatcaccactaccacctgggcaacggaacactccgagccccaagagcctccccagaaatccaggaccgcgatgccaacgggtcaagaagactaatgctacccccaccttccacaccagcgttatccggagccccacctgggggggcagagtcagtgcactccttttatcacgccgattgtcacctggaacctgttcggtgccaggcccctccccccaggagtccttcggaagcttccggacgtacagtagggagcggcaaggtgtatcccactgtccacacttcccctcccccagagacgctaaaagaaaaagctttagtggaagttgctgcgtcttcaggccccccaaccctgaccagcctgaatatccctcctggcccttatagttctatgcacaagctcctggagacgcagtccaccggcgcttgtcaatcgagctgtaagatatcgagtccttgcctcaaggccgacagtggcgcatgtggtcccgatagctgtccctactgtgccagagcaggagcaggcgaagtggagctagccgatcgggagatgcccgactcagactcagaggctgtttatgaattcacacaagatgctcagcacagcgacctgagagatccacactctaggagacagcgaagccttgggcctgacgccgagccctctagcgtcctcgcgttctggcggctcatatgtgatacattccgtaagattgtggacagcaaatattttgggcgcggtatcatgatagctatcctagtcaacacccttagtatgggtatagaataccatgaacagccagaagaattgacgaacgctctggagatatcaaacattgtattcacaagcctgtttgcgctcgaaatgctgcttaagctgctcgtgtatggtccattcggatatatcaaaaacccatataacatctttgatggggtcattgttgtgatctcggtatgggaaatagtcggtcagcagggtgggggcctgagcgtgctcagaacatttcgtctaatgagagttctcaagttagtgagattcctgccagccctgcaaagacagctcgtggtgctgatgaagactatggataacgtagcaaccttttgcatgttactgatgcttttcatctttatcttctctatcctaggcatgcatctgttcggttgtaaatttgccagcgagcgggacggagacaccttgcccgataggaagaattttgacagcttgctctgggcaattgtaactgtgttccaaatcttaacccaggaggattggaataaagtcctgtataatgggatggcgtcaacctcatcctgggctgctctatactttatcgccctgatgacttttggcaactatgttttattcaacctgctggtcgcaatcctcgtggagggttttcaggctgagggcgatgcaaataagtctgagtcagagccagacttcttttctccatccttggacggagacggtgacaggaaaaagtgcttggcccttgtgtcactcggagaacatcctgagcttagaaagagtctcctgccccccttaattatccacacagcagcgactccaatgtctctgcctaaaagtacttcaaccggactcggcgaagcattgggcccagccagtagaaggacctcttccagtgggtcggctgagccaggggccgcacacgaaatgaagtctcctccaagtgcacgtagcagcccccactccccttggtccgccgccagtagctggaccagccggcgctcgtcccgtaactcattgggtcgggccccatccctgaagcgccgatccccgtccggcgaacgaaggtcactgctatctggagaaggacaggaatctcaggatgaagaggagtcgtcagaagaggaacgggcctcaccagctgggagtgaccaccggcatcgaggctccctggagcgggaagccaagagctcttttgatcttccagatacattgcaggtcccaggattacacagaacagcaagcggccgcggcagcgctagcgaacaccaggactgtaatggaaaaagcgctagcgggcggcttgcgagggcacttagaccagatgacccccctcttgacggagatgacgcagatgatgaaggtaacctatcaaagggcgagagggtcagggcgtggataagggctaggctacccgcctgttgtcttgaaagagactcctggtctgcttatattttccctccccagtctaggtttaggctgttatgccaccgtattatcacccacaagatgttcgatcatgtggtccttgtgatcattttccttaactgcattacaatagctatggaacggccgaaaatcgatccacacagcgccgagcgcattttcctgaccctgtccaactacatcttcactgcagtcttcttggcggagatgactgtgaaagttgtggcattgggatggtgctttggggagcaagcctatttgcgatcctcttggaacgttctcgacggcctgctcgtgctcatcagtgtgatcgatatcctcgtctccatggtctctgactctggcaccaaaattcttggtatgttgcgagtgctgcggttgctgagaaccctgaggcccctgcgggttatctctcgcgcgcagggcctgaagcttgtagtcgaaaccttaatgtctagcctgaaacctatcgggaatatcgtcgttatttgctgcgctttttttatcattttcggaattcttggcgtccagctcttcaagggtaaatttttcgtatgccagggcgaggacacccgaaatatcactaacaaatctgattgtgctgaagcttcttatagatgggtgagacacaagtacaacttcgataatctcgggcaggccctgatgtcattgttcgttctggcctcgaaagacggttgggttgatattatgtacgacggcctggacgctgtcggagtcgatcaacagccaattatgaaccataacccttggatgctgctgtattttatctcatttctccttattgtcgcattctttgttctcaatatgttcgtgggggtggtcgtggaaaacttccacaaatgtagacagcaccaagaagaggaggaagccaggcgcagagaggagaagcggctgcggagattggagaagaagcggagaaacctgatgctggacgacgttatcgccagtgggtcttccgctagtgctgccagcgaggcacagtgtaaaccttactacagtgattattctcggtttcggttgttagtacatcatctgtgtacctcccattaccttgatctgtttatcaccggtgtcatcgggctgaatgtggtgaccatggctatggagcattaccagcaaccccaaattctggatgaggctctcaagatctgtaattatatcttcacagtgatctttgtcctcgagtccgtgttcaagctcgtagcttttggtttccgccggtttttccaggacaggtggaaccagctggatctggccatcgtgctactttccataatgggcatcacgcttgaggagatcgaggttaatgcttctctgcctattaaccccacaatcattagaattatgagagtgctgagaattgcacgcgtactcaagctcctgaaaatggctgtaggtatgagagcgctgttggacaccgtgatgcaggccctcccacaggttggcaatcttggactcctgttcatgcttctgttttttatattcgctgctctgggggtggagcttttcggcgacctcgagtgcgatgagacacacccttgtgaaggcctggggaggcacgcgacctttaggaatttcgggatggctttcctcaccctgttccgcgtttcaacgggggataactggaacgggattatgaaagatacactacgcgattgcgatcaggagtccacctgttataataccgtgattagccccatctacttcgtcagttttgtgttaactgctcagtttgttctcgttaatgtggtgattgccgtattaatgaaacacctggaggagtccaataaggaagcaaaggaggaggccgaactggaagctgagctggagctggagatgaagacactgtccccccagcctcactccccactggggtcccccttcctctggcctggggtggaaggcccggacagccctgatagtcccaagccaggagccctgcatcccgctgcgcatgcccgatcagcctcccatttttccttagaacatcccacgatcccactggccgaaatggaggcgttgtctctcacgtcagaaattgtgtcggagccatcctgctcattggccctgacggatgacagcctgccggacgacatgcacactctccttctatccgcattggagtccaatatgcagcctcatcccaccgagctgcctggcccagacctgctaactgtacgaaaaagcggtgtttccagaactcacagtctgcccaacgactcatacatgtgccgtcatggctcaacggccgagggtcccttgggtcaccgcggctggggattgccgaaggctcagtcgggaagtgtcctgtcagtacacagccagcctgctgacactagttatattctccagctgcccaaagacgccccgcacctgcttcaaccccattccgccccgacttggggtactattcctaaattgcccccacccggacgaagccctctggctcagcgccctctccggcggcaagccgctatccgcaccgacagtcttgacgtccagggcttgggatccagagaggatctgctggcagaggtatcagggcccagcccgcccttggcgagagcgtacagcttctggggacagagcagcacccaagcacagcagcattcccgttcccacagtaagatcagcaagcatatgacccccccagctccgtgccccggaccggagccaaattggggcaagggccctcccgagacacgatcttctcttgaactggacactgagctctcttggatcagtggcgatctgttgccccccggtggacaggaagaacctccttcacctagggatttgaagaaatgctatagtgtcgaggctcagagttgtcagaggcggccaacgtcctggctggatgaacagaggcgccactctattgccgtgagttgcctggatagtggatctcaaccacacctagggactgacccatccaatctcggcgggcagcccttgggaggacccggaagccgcccgaagaagaaattgagccctcccagtatcacaattgacccccctgaatctcaggggccccgtacccccccttcccccggtatttgtctgcgccgtcgggcccctagcagcgattcaaaagacccccttgcgagtggcccacctgactcaatggctgccagtccgagtcctaagaaggacgtcctcagtctttctggcctaagttccgatccagctgatctggatccatag

SEQ ID NO: 40701 - DNA, 5262 bp, Artificial Sequence
  Description of Artificial Sequence: Synthetic coding sequence
atggacgaggaggaggacggcgccggcgccgaggagagcggccagcctaggtctttcatgagactcaatgatctgagtggcgcagggggaagacccggacctgggtctgcggagaaggatcctggctccgcagactcagaagcagaaggacttccctacccagccctcgccccagtggtgtttttttacttaagccaggactcccgccctagatcttggtgccttaggacagtgtgcaacccctggtttgagcgtatctcgatgctggtcatcctgctgaactgtgtgactctgggtatgtttcgcccgtgcgaggatatcgcatgcgatagtcagcggtgtaggatcctgcaggccttcgatgactttattttcgccttcttcgctgtggagatggtggttaagatggtcgctctcggcatatttggaaagaaatgttacctaggtgatacttggaacagactggatttctttattgtcatcgcgggtatgctggaatactctctcgatctgcagaacgtgtcattctcagccgtgaggactgtgcgtgtcctgagaccacttcgggcaataaaccgagtgccctccatgaggatccttgttaccttgctgctggacactctcccaatgctcggaaacgttctactgctttgcttcttcgtgtttttcatcttcggcattgtgggcgtacagctatgggccggactcctgaggaaccgctgtttcctgccggaaaatttttcactccccctgtcggtcgacctggaaaggtactaccagacagagaacgaagacgaatcgccttttatttgcagtcagccgcgcgagaatggcatgcgatcatgtagatcagtccccacactgcgcggcgatggggggggggggccaccttgtggactcgactacgaagcatacaactcttccagtaacacaacctgcgttaattggaaccaatactacactaactgctccgctggcgagcataacccctttaagggcgctatcaacttcgataatatcggctacgcttggattgccatcttccaggttattactttggagggctgggtcgatatcatgtactttgtgatggatgctcactccttctacaattttatttacttcatcctgctgattatcgtcggcagtttttttatgataaacctatgtctagtggtgatcgccacccagttctctgaaaccaaacaaagagagtcccagttgatgagagagcagcgtgtacgattcctatccaacgcatcaacgctggcttctttttcagaacctggaagctgttatgaggagctgctgaagtacctggtttatatcttaaggaaagcggcgaggaggctggcccaggtgtcgcgcgctgccggcgtgcgggtgggattgctcagtagtccagctcctctgggcgggcaggagactcagccatcttccagctgctcaaggtcccaccggcggctctctgtgcaccatttggtgcatcaccaccaccaccaccatcatcattaccatctcgggaatggcacgctacgggccccccgcgcttcaccagaaattcaggatcgtgatgcaaatgggtccaggcggttgatgctcccccccccgagtacacctgcgttgtccggagcaccacctggcggagccgaaagtgtccacagcttttaccacgcagactgccatctggagccagtccgatgtcaggctccaccccctagatctccatcagaagcctcaggtagaacagtggggagcggcaaggtctatccaacagttcacacaagcccgccccctgaaaccctcaaagagaaggccctagttgaagtggctgcctcaagcgggccgccaacgctcacatcgctgaacattccacctggcccatacagttcgatgcacaaactgctggagacccagtccactggggcctgccagagctcttgcaagatatcgagtccatgtttgaaagctgactccggggcatgcgggccagattcatgtccttattgtgcaagggctggggctggcgaggttgaactagccgacagagagatgcccgattctgactctgaggccgtgtatgagtttactcaggacgctcagcatagtgatctaagggatccccactctagacgccagcgcagcttaggtcccgacgcagaacccagttccgttctcgccttctggaggttaatatgtgacacgttccgaaaaatcgtagatagtaagtactttggacgcgggattatgatcgctatactggtcaacaccctgagcatgggcatcgagtaccatgagcagcccgaagagctgaccaacgcattggaaataagtaatatagtgttcacatcgctcttcgctttggaaatgctgctgaagttgctagtttacggtccatttgggtacattaagaatccctataatatttttgatggggtgattgtcgtaatcagtgtgtgggagatcgttggccagcagggcggcggtctgagcgtcctgcgcacatttcgcctgatgagagtgcttaagctggtgaggttccttcctgctctgcagcggcagctcgttgtcctaatgaaaactatggacaatgtcgccacattttgcatgctgctgatgctcttcatctttatctttagcatcctcggcatgcacctgttcggatgtaaatttgcgtcggagagggacggggatacccttcccgatcggaagaattttgactccttgctttgggccatcgtcaccgtctttcagatattgacgcaggaagactggaacaaggtgttgtacaacggcatggccagtacttcgtcctgggccgcattgtatttcatcgcattgatgaccttcggaaattatgtgttgttcaatctgctagtcgcgattctggtagagggatttcaggctgaaggcgacgcgaataagtcagaatctgaaccggacttcttctcaccctcactggacggagatggggaccgcaagaagtgcctcgcattggtctctctcggtgaacatccggaattgcgcaaatccttgctgccccctttaatcatccacaccgccgccacgcccatgtctctgcccaagtctacctccacaggtctgggcgaagcccttggtccggctagtcggcgtacaagctctagcggcagcgccgagccaggagcggctcacgaaatgaagtcaccgcctagtgctcgttcttctcctcactcgccgtggagtgcggcatcttcctggacatctaggcgctcatcacggaacagccttgggagagccccctcactgaaaagacgctctccttcaggtgagagacgaagcctgctgtcaggcgagggacaagaatctcaggacgaagaggagtcgtctgaagaggagcgggccagtccagcaggctccgaccatcgtcaccgcggttcactagagcgtgaagcaaagtcatcttttgatctgccggatactctgcaggtcccagggctgcaccggacagcctcaggcagagggagcgcatccgagcatcaggattgcaacggcaagtcagcctcaggtcgtctggcacgagcattacgaccagatgatcctcccctggacggcgatgacgccgacgacgaaggcaatctgagcaaaggcgagcgggtaagagcctggatccgggcaaggctgccagcctgctgcctggagagggattcttggagtgcctatatattcccacctcagtccagatttcgcctgctctgtcaccgcatcatcacgcataagatgtttgaccacgttgtcctggtcatcatattccttaattgtatcacaatcgcaatggaaagacccaagattgatccacattcagcagagcgcatcttcctgactctttccaactacatcttcacagccgtcttcctcgctgagatgacagttaaggtggtggccctcgggtggtgttttggagagcaggcttacctgagatctagctggaatgtcctggatggactgctggtgctgattagcgtcatcgacatactggtgagcatggtgtcagatagcggcacaaagatcttgggcatgctgagggtgctaaggctcctcagaacactgcggcctttacgggtgatttctcgagctcaaggcttgaagcttgtagtggagacacttatgtcttcgctgaagcctatcggaaacatcgtggtcatttgctgtgccttttttattatctttggtattctcggagtacagctattcaaaggaaaattctttgtgtgtcagggtgaggatacacgtaatatcacaaacaaaagtgattgtgccgaagcgagttaccggtgggttagacacaaatacaatttcgataatcttggacaagccctgatgtcgctgttcgttttagcaagcaaagatgggtgggtggatattatgtatgatggtttggatgcagtcggggtagaccaacagcctataatgaatcacaacccctggatgctgctctattttatctctttcctgctaatcgtcgcattctttgtgttgaatatgtttgtcggtgtagtcgtggagaactttcacaagtgtcggcagcatcaggaagaagaggaggcgcggaggagggaggagaaacgactgagacgattggaaaaaaaaaggcgcaatctgatgttggatgacgttatcgccagcggtagctctgcctcggccgcctcagaagcccagtgtaagccctattacagtgactatagtcgcttccgcctgctggtgcatcacttatgtacgtcacactatttggacctcttcatcactggtgtgattggactgaacgtggtgactatggccatggaacattaccagcaaccccagatcctggacgaggccctaaagatttgcaattacatctttacagttattttcgtcctcgagtcagtcttcaaattagtcgcgtttgggttccgacggttcttccaggacagatggaatcaactggaccttgccatcgtgctcctctcaatcatggggatcaccctcgaggaaatagaggtgaacgcctcgctgccaattaacccgacgatcatcaggattatgcgcgtgctccgaatcgcacgagtgctgaaacttctgaaaatggccgtcgggatgagggccctccttgataccgtcatgcaggctctgccccagctgtgggcttggtcttccctggagacctggtcagtaactcgccacactcccgtgagggcctgggccgtgatgccccccttcggcacgctggcttggccgtcatag

SEQ ID NO: 40702 - DNA, 6753 bp, Artificial Sequence
  Description of Artificial Sequence: Synthetic coding sequence
atggacgaggaggaggacggcgccggcgccgaggagagcggccagcctaggtcattcatgagactgaacgacctgtctggagccggcggcagaccaggtcctggttcagcagaaaaggatcccggcagcgccgactctgaggccgaggggctgccttaccctgcattagcccccgtcgtcttcttttatttatcacaagactccagacctcgaagttggtgtcttcggacggtgtgtaatccctggtttgagcgcatttcaatgctggtgattctcctgaactgtgtaaccctcgggatgttcaggccgtgcgaagacattgcttgtgatagccagcgctgtaggatcctgcaggccttcgacgatttcatttttgctttctttgccgtggagatggtagtgaaaatggtggccctgggcatcttcgggaaaaagtgctacttgggcgacacctggaacaggttggacttcttcatcgtgatcgcaggaatgttagagtattcgttggatttgcagaacgtctccttcagcgcagtacgcacggttagggtgctgagacccctcagagcgataaatcgagtcccatccatgcggattttagtaactctacttcttgatacactgcccatgcttggcaatgttcttctgctctgcttcttcgtcttcttcattttcggaattgttggtgtgcagctgtgggcaggcctcttgcggaaccgttgctttctccctgaaaatttctcactccccctgagtgttgatcttgaacgctactatcaaacagagaacgaagacgagagcccgtttatttgcagtcagccccgcgagaacggtatgaggagctgtcgatctgtccctaccctgcgcggtgacggtggaggaggaccaccctgcggcttagattacgaggcatataacagtagcagcaatactacttgcgtcaactggaaccaatactacactaattgttctgcaggtgaacacaatccgttcaaaggcgccatcaactttgataacatcggttatgcttggatagccatcttccaggtcatcactcttgagggatgggtagacattatgtacttcgtcatggatgcccactccttctacaacttcatctactttatcctcttaatcattgtcggctcattttttatgatcaatttatgcctggtcgtgatcgctacacagttttccgaaaccaagcagagagagtcacaacttatgcgtgaacaacgggttaggtttctctccaacgccagcaccctggctagcttcagcgagcctggctcatgctatgaggagctcctgaaatacttggtgtatattctgcgcaaagctgcacgtcggctcgctcaagtatcgcgagctgccggtgtccgcgtgggtctgctctccagccccgcgcctttaggcggacaggagacacagccctcaagctcctgctcacggtctcatcgtcgcctgtcagtgcatcacctggtgcatcatcaccatcaccaccaccatcattatcatcttggaaacggtacactcagggctccccgggcctcccccgagatccaagaccgggatgctaatggctccaggaggctgatgctgcctcctcctagtacgccggctctttccggtgcgccgcccgggggggcagagtcagtgcattccttctaccatgccgattgtcatctcgaaccagtcagatgccaggctcctcctcccagatcccctagtgaagcttccggacggactgtcggtagtggcaaagtgtatcccacagtgcatacatctccccctcccgaaaccttgaaggagaaagcactggtggaggtcgcagcctctagcgggcctcctacactgacgagcctgaatatcccccctggcccctacagtagtatgcataagcttctggaaacccagagtacaggggcatgccaatcctcatgtaaaataagcagcccttgtctgaaggctgactctggcgcatgtggaccggacagttgcccttattgtgcaagggcgggggcaggcgaggtggaactcgctgaccgggaaatgcccgacagcgactccgaggccgtttacgagttcactcaggatgcccagcactcagacttgcgagacccacatagccgaaggcagaggagtctgggacctgacgccgagcccagcagcgtgctcgctttctggcggctaatctgtgacactttcagaaagatagtcgactctaagtactttggtcgagggatcatgattgcaatccttgtgaacactctgtcaatgggcatagaatatcatgagcaacctgaagagttgaccaatgcactggaaatatcaaacatcgtcttcaccagtttgttcgcccttgagatgctcttaaagctgctcgtatatgggcccttcggatatattaaaaatccatacaacattttcgatggagtgattgtggtgataagcgtgtgggagatcgtaggccaacagggtggagggctgagtgtactccgcacattccggctgatgagggtcctaaagctagtgcgatttctgcccgctctccagcgacagctcgttgtcctgatgaagacgatggataatgtggccacgttctgtatgctcctcatgctttttatcttcatcttttctatcctgggtatgcatctgtttggatgcaaattcgcctctgaaagggacggagacacacttccggatcgaaagaactttgacagtctactctgggccattgtcactgtttttcaaattcttactcaggaggactggaacaaggtgctctacaacggcatggcctctacatcttcctgggccgcactctacttcatcgccctgatgaccttcggaaactatgttttgttcaacctactggtggccatccttgtagaggggttccaagccgaggaaatcagcaagcgagaggacgcgtccggccaactcagttgcatccaactgccagtcgacagccaggggggcgacgcgaataagagcgagtcagaaccagacttcttctctccatctctcgatggggatggtgacaggaagaaatgtctcgccttggtttccctgggcgaacaccctgagctcagaaagagtttactccctccattgatcatccatactgctgctacacccatgagtctgccaaagagcactagcactggactcggggaagccctcggccccgcgtcccgcaggaccagcagttcgggaagtgcggagcctggcgccgcccacgagatgaagtcacccccttcggctcggagctccccccattctccttggagcgccgcatcaagctggacttctcggagatcaagtagaaactctctcggcagggctccatctctgaaaagacgtagccccagtggcgagcgtcgttcactgctgagcggtgaaggtcaagagagccaggatgaggaggagtcaagcgaggaggagcgtgccagccccgctgggagtgaccatcggcacagaggctccctcgaacgcgaagcaaagagcagctttgacctccccgataccctgcaggtcccagggctgcaccgtacagcgtcagggcgcggatcggcttccgagcatcaggattgtaatggcaaatcggcttccggacgtctcgccagggcactgagacccgatgaccccccactggatggtgacgatgctgacgatgaaggtaatctgtccaagggtgagcgggttagagcttggattcgagccaggctaccagcttgctgccttgaacgcgactcctggtccgcatacatcttccccccacagtccaggtttagactactgtgtcatcgcatcatcacccataagatgtttgatcatgtggtgcttgtcattatttttctcaactgtattaccatagccatggaacggccaaagattgatccacactcagccgagcgaatcttcctaacgctgagtaactacattttcaccgccgtatttctggcggaaatgaccgtgaaggtggtggcccttgggtggtgtttcggagagcaagcttaccttaggtcctcctggaacgtgcttgatggtcttttagtcttaattagtgtgatcgatatcctggtgagcatggtttcagactcagggactaagattctagggatgcttagagttctccgactgctgagaacgctgcggcctctgagggtcatatctagagcccaggggctgaaactggtagtggaaaccctgatgagttcactgaaacctattggaaatatcgtggttatctgttgtgccttctttataatatttggaatcctgggcgtgcagttatttaaaggtaaattttttgtatgccagggcgaagatacacgcaatatcacaaacaagtctgattgcgctgaagcaagctacaggtgggtgcggcacaagtacaacttcgacaacctcggtcaggcactcatgtctcttttcgtcctggcgagcaaggatgggtgggtcgatattatgtatgatggactagacgcagtcggcgtcgatcagcagaacttccacaaatgcaggcagcaccaggaagaagaggaggccagacgaagggaagagaagcgtttgcggcggctggagaagaagcgtcgaaatctgatgcttgatgacgtgattgcatcagggtcttcggccagcgccgcgtccgaggcacagtgtaaaccatactactcagactactcaaggtttcgtctactcgtgcaccacttatgcacctcccattatcttgacttgtttattaccggagtcattgggctcaacgtcgtgacgatggctatggaacactatcagcagccccagatcttagacgaagcactgaaaatctgtaactacatctttacagttatctttgtcctggagtccgttttcaagttagttgcctttggatttaggcgcttcttccaggatcggtggaaccagctggacctcgcaatcgtgctgctgagtatcatgggaattacgctggaggagattgaggtcaatgccagccttcccattaatcccaccatcattcgtatcatgagggtcctgcgtatcgctcgggtgctgaagctacttaaaatggcagttgggatgagagcactcttagacactgttatgcaggcactgcctcaggtgggaaatctcgggctgctatttatgctgttgttcttcattttcgcagccttgggagtggaactgtttggtgatcttgagtgtgacgaaacacatccatgcgaaggactgggacgtcacgctacctttaggaattttgggatggctttcctgactctgttccgcgtcagtactggcgataattggaacggaatcatgaaggacactctcagagattgtgaccaggaatcaacctgttataacaccgtgatctccccaatttactttgtgtccttcgtgctgacagcccaattcgtccttgtgaatgttgtcatcgctgtgctaatgaagcatctcgaggagtcaaacaaggaagcgaaggaagaggcagagctcgaggccgaactggagctggagatgaagacactgagcccccaaccccactcaccactaggctctccgttcctttggcctggagtggagggtcctgactcaccagattccccgaaacctggcgcccttcaccccgcggcacacgctaggagcgcttctcattttagcttggaacatcctaccatgcagccgcatcccacagagctgccgggacctgatttactaactgtccgaaaaagcggcgtgagtcggacccacagcttaccaaatgacagttatatgtgtcgccacggatctactgctgagggtcccctgggacatagagggtggggactgcccaaggcccagtccggttcagtcctaagcgttcactcccagcccgcagacactagctatattctccagctcccaaaggatgccccgcatttactgcagccccacagcgcaccaacatggggcaccattcccaaactgcccccgcccggaagaagtccattggctcaacgcccacttaggcgccaggcagcaatccgtactgattctctggatgtccaggggctgggctctagagaagatctgctcgccgaagttagtggcccaagccccccacttgcacgtgcatatagcttctggggtcagagctcaacccaggcacagcagcactcccggtcgcatagcaaaatttcgaagcatatgacgccgcctgcaccgtgtcccgggcctgagccaaactggggtaaaggtccgccagaaaccaggtcttccctggaactcgacacagaactcagctggatttcaggcgacttattgcccccgggcggccaagaggagccgcctagcccacgcgatctgaagaaatgttactctgtagaagcccagagctgtcagagacgaccgacctcctggctcgacgaacagcggagacactccatagcggtgtcatgcctggatagcggcagtcagcctcacctgggtaccgaccccagtaacctcggagggcaacccctaggcgggcccggctctcgaccgaaaaaaaagctgtcccccccgtccataacaatcgacccacccgaatctcaaggcccccgcacacctccaagtcccgggatctgcctcaggcgtcgcgccccaagcagcgactccaaagaccccctggcaagcggacccccagattcaatggcagcatccccatctcccaagaaagatgtgctgtctctttccggcctctcttcagaccctgcagatctcgatccctag

SEQ ID NO: 40703 - DNA, 5208 bp, Artificial Sequence
  Description of Artificial Sequence: Synthetic coding sequence
atggacgaggaggaggacggcgccggcgccgaggagagcggccagcctcggtcatttatgcgactcaacgatctaagcggcgccggggggcggcctggccccggatctgcagagaaagaccccggttccgctgatagcgaagccgaggggctgccatacccagctctggcacctgtggtgtttttttacttgagccaagactctcgccctcgatcctggtgccttaggaccgtctgtaatccatggttcgaacggatctcaatgctggtgatcctactcaattgcgtaaccctcggaatgttccggccctgcgaagacatagcctgtgatagccaaagatgccgcattctgcaggcctttgacgattttatattcgcattctttgctgttgaaatggtagtcaaaatggtggcgctggggatttttgggaagaaatgctatctcggcgatacatggaatagactcgacttctttatagtgatagctggaatgctggagtacagcctagatctgcagaatgtgtccttttccgccgttagaaccgtgcgggtgctccgccccctgcgcgcaatcaatcgggtcccttcaatgcgcatcttggtgacactgcttcttgacacactccccatgctagggaatgtgctgctgctgtgctttttcgtgttctttatcttcggaattgtaggcgtccagctgtgggcggggctcctaagaaataggtgcttcttgccagagaatttcagcctgcctctgtccgtcgaccttgaacgctattaccagacggagaacgaggacgaatctccctttatctgcagccaaccacgggagaacggcatgaggtcctgccgaagtgtgccaaccctccgaggagatggcggcgggggccccccgtgtggattggactacgaagcgtataatagctcttcgaataccacctgtgtcaactggaaccaatactataccaattgctctgcgggcgaacataacccctttaagggggcaattaattttgacaacattggatacgcctggatagctattttccaggtcatcacgctcgaaggctgggtagatattatgtacttcgtaatggatgcccactccttctacaatttcatctattttattctgcttatcatagttggatcctttttcatgattaacctctgcctggtagttatcgcaacccagtttagtgagactaaacagagggagtctcagctgatgcgggagcagcgcgtacgcttcctctccaacgcatctactctagcaagcttcagcgagccaggttcgtgctatgaagaacttttgaaatacttggtttacatactccgcaaggcagcccgcagactggcccaggtctcccgcgcggctggcgtacgcgtgggactgctaagtagtcccgcccccctgggcgggcaagaaacacagccatcatcttcgtgcagccgcagccaccgaagactgagcgtgcaccatctcgtgcatcatcaccaccatcatcaccaccactaccaccttggtaatgggactctgcgcgctcccagggcatcaccagagattcaggacagagacgccaatggctccaggcggcttatgctacctcctccctccactccagctttatctggtgccccacccggaggcgctgaaagtgtgcattccttttatcacgccgactgccatctagagcctgtgcggtgccaggctccaccacctcggtctccttcagaggcctctggaagaaccgttggatcaggcaaagtctacccgactgttcatacctcgccaccacccgagaccctcaaggagaaagctttggtcgaggtggccgcttcttctggccctccaaccctcacttctctgaatatcccacctggcccatactcctccatgcataagctcttagaaacccagagcaccggcgcctgtcaatcttcttgcaagattagcagtccctgtttgaaggctgattctggagcttgcggtcctgactcttgcccctattgtgctagggccggtgccggcgaggtggaactcgcagacagagaaatgcctgatagtgatagtgaagccgtctatgaattcacccaggatgcacagcacagcgatctgagagaccctcacagccgccgccaaagaagccttgggcccgacgcagaaccctctagtgtcttggccttctggcgactcatttgtgacacatttcgaaaaatcgtagactctaagtactttggccgggggatcatgatagccatcctcgtcaatacgcttagtatggggattgagtaccacgaacaaccagaggaactgacaaacgcactcgagattagcaacatcgtgttcacctcactatttgccttagaaatgctcctgaaacttctggtctacgggcctttcggatacatcaaaaacccttataatatcttcgatggggttatcgtcgtgatttcagtgtgggagattgtaggacaacaaggggggggactgtccgtgctacggaccttcaggttgatgagagtgttgaagctcgtgcggtttctgcctgccctgcaaaggcagctggtggtgttaatgaagaccatggacaacgttgcaacattctgcatgttgctaatgttgtttatcttcatcttttctatactgggcatgcacctgtttggctgtaagtttgcctccgagcgtgatggcgatactttgccagaccgcaagaattttgatagcctgttgtgggcaatcgtgactgtttttcaaattcttacccaagaggattggaacaaggtgctctacaacggaatggccagtacaagttcttgggctgccctctatttcatcgcccttatgacctttggaaattatgttctgttcaatctactggttgctatcctagtcgaggggttccaagccgaaggagacgccaataaatctgagagcgagcctgactttttcagtccgtcacttgatggggacggggatagaaaaaagtgtctcgctcttgtttccctgggagagcatccggagctcagaaaatctttactccccccacttatcattcacacagccgctacacctatgagtcttccgaagtccacctccacaggtctgggggaggcactgggtcccgctagtagacgtacatcttccagcggctccgctgagcctggcgccgcacatgagatgaaatctcctccttctgctcgctctagccctcactccccatggtcagccgcgtcttcttggacttcccgcaggagcagccggaactcactcggaagagctcctagtctaaagcggcggtccccaagtggcgaacgtcggtctcttctttctggcgaaggacaggagtcacaggacgaagaagagagttctgaggaggagcgcgcctcccctgccggttccgatcatcgccaccgcggaagcctcgagagagaagctaagagctccttcgacctgcctgacacgctgcaagtgcccgggcttcaccgcacagcgagtggcagaggctcggccagtgagcatcaggattgtaatggtaaatccgcctcaggacgactggcccgggcacttcgcccggacgatccacctctggacggcgatgacgctgatgatgagggaaatttgagtaaaggtgaacgcgtgcgcgcttggatccgcgcaagactgccggcgtgctgtttagaaagagattcctggagcgcttacattttcccgccccagtccaggtttcggctactatgccacaggatcatcacacacaagatgtttgaccacgttgtactggtaatcatctttctgaattgtatcaccattgcaatggaacgtccgaagatagatccacattctgccgaaaggatcttcctgaccctttctaattatatttttaccgctgtgttcctggccgaaatgactgtaaaagtggtcgccctaggttggtgtttcggagaacaggcttacctacggagctcgtggaacgtgctggacgggctgctggtgctgataagcgttattgacattctggtgtcaatggtctcagattccggcacgaagatacttggcatgttgagagtgctacgtctgctgcggaccttgagaccccttcgcgtcatctccagagcccagggattgaagctggtggtggaaaccctaatgtcttccctgaagccaattggcaatatcgtggtgatttgctgtgcgttcttcattatcttcgggatcttaggagtacagctcttcaagggaaagttcttcgtctgtcagggggaagacacccgaaacattacaaacaagtctgactgcgcagaggccagttaccgttgggtgcggcataaatataactttgataacctaggacaggcactaatgagcctattcgtattggctagtaaggatgggtgggttgatattatgtacgatggcctggatgccgtgggcgtcgaccaacagcctataatgaatcacaacccatggatgcttctgtactttatttcttttctcctgattgtggctttcttcgttttgaatatgttcgttggtgtagtggtcgaaaactttcacaaatgtagacagcaccaggaagaggaagaagctcgtcggcgggaagagaagcgactgagacgcctggaaaaaaaaaggagaaaggctcagtgtaagccctattattctgattattcgcgcttcagactgcttgtgcatcacttgtgtacgtctcattacttggatctcttcattaccggcgtgatagggttgaacgttgttacgatggccatggagcactaccaacagccgcagatactggacgaagccttgaagatatgcaactacatttttacggtaattttcgtgctggagtctgtgttcaagctcgtggccttcgggtttaggaggttcttccaagaccggtggaaccagttggatttggctattgtccttttgagcatcatgggaatcacactggaagagatagaggttaatgcttcgctgccaataaatcctacaatcattcgaatcatgcgcgtgctgagaatcgccagggtcctgaagttactgaaaatggcagtaggaatgcgggcactgcttgatactgtcatgcaggcactgccccaactgtgggcttggagttccctggaaacctggagcgtaacaaggcatacaccagtgagggcttgggcggttatgccaccttttggcacacttgcctggccgtcttag

SEQ ID NO: 40704 - DNA, 5298 bp, Artificial Sequence
  Description of Artificial Sequence: Synthetic coding sequence
atggacgaggaggaggacggcgccggcgccgaggagagcggccagcctcgcagcttcatgagactgaatgatctatctggtgctggcgggcgtcccggacccggatccgccgaaaaagaccccggcagcgccgacagcgaagcggagggtctgccctatcctgctctcgcaccggtcgttttcttctatctttcgcaggatagtcggccccggagctggtgtctccgcaccgtttgcaatccgtggtttgaacgcatctctatgctcgtgatcctgctgaattgtgttaccctgggcatgttccgcccctgtgaagatattgcatgcgactcccaaagatgccggattttacaggctttcgacgactttatcttcgcgttctttgccgtggaaatggtggtcaaaatggttgccctgggaattttcggaaaaaagtgctacttgggagacacatggaatcgactggattttttcattgttatagcagggatgctggagtatagcctagatcttcagaatgtgtcttttagcgcagtgaggaccgtgcgggtgctgcgccccttgcgagccatcaatagagttcccagtatgcggatcctggttacattgctgctcgacacactgcccatgctcggcaacgtcctcctcctatgtttcttcgtgttctttatttttgggattgtaggcgtgcaactctgggccgggctcttaaggaatcggtgttttctgccagaaaactttagcttgcccctgtccgttgacctggaaaggtactatcagaccgagaacgaggacgagtcgccattcatctgctctcagccccgggagaacgggatgcgcagctgtagatccgtacccactctgcgtggcgatggaggagggggccccccgtgcgggctggactacgaggcatataatagcagtagcaacacgacctgcgtcaattggaaccaatattacaccaattgctctgctggggagcacaatccatttaaaggcgctatcaactttgacaatatcggctatgcctggattgcaattttccaagtgattaccctcgaagggtgggttgatatcatgtatttcgtgatggacgctcacagcttttacaattttatctacttcatactacttattattgtaggcagctttttcatgataaatctatgcctcgtggtgatcgcaacacaatttagcgagacgaaacagagggaatctcaactgatgagggagcagagggtgcggtttctgagcaacgcaagtacgctcgcaagcttcagcgaaccgggtagctgttacgaggagttgctgaagtacctcgtatacatacttcgtaaagccgctcgaaggctcgcccaggtgagtcgagcggccggggtgcgtgtgggcttactgagtagcccagcgccgctcggcgggcaagaaacccagcccagcagctcctgttccaggtcgcaccgtaggctcagcgtccaccatctggtgcatcaccatcatcatcatcatcaccactatcacctgggaaacggcaccctgcgggctcccagagcgagccctgagattcaggaccgcgacgcaaacgggtccaggcgtctaatgctgccacccccctctacaccagctctgtcgggagcaccacctggtggtgcggagtccgtgcattccttctaccacgccgactgtcacctggaacccgtccggtgtcaggcccctcctccccgctcacctagtgaggcgtcgggacgaacggttggctctgggaaagtgtatcccacagtgcacaccagccctccccctgagactctcaaagagaaagcccttgttgaggtggccgctagtagcggcccccctacacttacttctctgaatattcctccgggcccctacagtagcatgcacaagctgttggagacacagtctaccggggcctgtcagagttcttgtaagatctccagcccttgtttgaaggctgactcaggagcttgcggtccagacagttgcccctattgtgccagggcaggggccggtgaagtcgaactggccgaccgcgagatgcccgacagcgattccgaggccgtgtacgagttcacccaggatgcacagcattcagatctccgagacccacattctcgcaggcagcgctcgctggggccagatgctgagccctctagtgttctggccttctggagactaatttgcgacactttccgaaagatcgttgactctaaatactttggcaggggtattatgattgctattctggtcaataccttgagtatggggattgaataccatgagcagcccgaggaattaaccaatgcccttgagatctccaacatcgtatttacaagcctctttgcacttgagatgctgctcaagctccttgtctatggaccctttggctatattaagaatccctataacatcttcgatggcgtcatagtggtaatctccgtgtgggagattgtgggacagcagggcggcggactgagtgtactgagaactttcagactcatgcgggttctgaaattggttcgatttctgcccgcactgcagcgccagctcgtagtccttatgaagactatggacaacgtggcgactttctgtatgcttctgatgctttttatctttatcttttctatcttgggaatgcatctgttcggctgcaagttcgccagtgaaagagatggcgacactcttcccgatagaaaaaacttcgattcactgctgtgggccatagtcaccgtgtttcagatccttacacaggaggactggaataaagtcctctataacggtatggcctccacaagtagctgggctgccctctacttcatagccctgatgacgtttggtaactacgtgttgttcaatctgcttgtggcgatcctggtcgaagggttccaggcagaagagattagtaagcgtgaggatgcttcaggccaactcagttgtatccagttgccagtggactcccagggcggagacgccaataagagtgagtctgagcccgattttttcagcccatccctagatggagacggtgacagaaaaaagtgtttggctcttgtgtcccttggcgagcacccagagctgaggaagtccctgcttccaccattaatcattcataccgccgcaactcccatgtccttgcctaaatccactagcaccggactaggggaagcactgggcccagccagtagacggacaagcagttctgggagtgctgagcctggagccgctcacgagatgaaatccccgccctctgcaagatctagtcctcacagtccctggtccgcagcaagtagttggaccagccggcgtagctcccggaactcactcggccgggccccttccctcaagaggcgtagtccctccggcgagcgccggagtcttctctcaggggaaggccaggagtctcaggatgaggaggagagcagtgaggaagaaagggccagccccgccggttccgaccacagacaccgaggctcattggagagagaagctaagagctcattcgatctcccagatacactgcaggtaccaggcctacacaggactgctagcggcagagggagtgcttctgagcaccaagactgcaacgggaagagtgcttccggaaggctagccagggccctgagacctgatgacccccctctggatggggatgacgccgacgatgagggaaacctctcaaaaggtgaacgagtccgggcctggataagggcccggctgcctgcctgttgcttagagcgggactcgtggagcgcgtacatcttcccgccacaaagcagatttagactgctgtgtcatcgcattatcactcataaaatgtttgaccatgtcgtgcttgtgattatcttcttgaattgtatcactatcgccatggaacggcctaaaatcgaccctcactctgccgaaagaatctttttaacgctgtctaattacatattcacggcggtttttttggctgaaatgacagtgaaagtggtggctctgggctggtgtttcggcgaacaagcatatctgcgcagttcttggaacgtactggatgggctgctggtgctcatctctgtgatagacatcctggtgagcatggtctctgacagtggtactaagattctggggatgctccgcgtcctcaggctcctgcggacccttagaccactgcgtgttatttccagagctcaaggtctgaagcttgtggtggagaccctcatgtcctctctcaagcctattggaaacatcgtagtgatttgctgcgccttctttattatcttcggaatcctgggggtgcagttatttaagggaaaattcttcgtttgccagggtgaggacacacgtaacattaccaataagtcggattgcgctgaggcgtcttatagatgggtgcggcataagtacaactttgacaatttggggcaggcgcttatgtccctgttcgtcctggcatcgaaagatgggtgggtagacattatgtacgatgggctggatgccgttggggtagaccagcagccaatcatgaaccacaatccgtggatgctgctgtacttcatctccttcctgctcatcgtcgcgttctttgtgctcaacatgttcgtgggcgtggtagtcgagaatttccataagtgtagacaacaccaggaagaagaagaagcccggcgtagggaggagaagcggctgcgacggctggaaaagaagcggagatctaaggagaaacagatggccgaagcgcagtgcaagccatactattccgactattccagatttcggctcctggtccatcacctgtgcacctcccactatctggatctgttcatcaccggagttatcgggctgaacgtggtcaccatggctatggagcactatcagcagccacaaatactcgacgaggccctcaagatctgcaattatatatttactgtgatttttgtactggagagcgtcttcaagctagtcgcgtttgggttcaggagattcttccaggacagatggaatcagctggatcttgctatcgtgttgctgagtattatgggcattaccctggaggagatcgaggtaaatgcctccctgcccattaatcctaccatcattaggattatgagagtcctacgtattgccagagtgctgaaattgttgaaaatggccgtgggcatgagagctttactcgatactgtcatgcaagcactcccacaactttgggcttggagttcactggaaacttggtctgttacccggcacacccctgtgcgggcgtgggctgtgatgcctccattcggaacactggcctggccctcttag

SEQ ID NO: 40705 - DNA, 6618 bp, Artificial Sequence
  Description of Artificial Sequence: Synthetic coding sequence
atggacgaggaggaggacggcgccggcgccgaggagagcggccagccaaggtcatttatgaggctgaacgacttatccggagctggaggccgcccgggacccgggagcgcggaaaaggacccgggatcagccgatagcgaagctgaaggacttccctatccggctctcgccccagtggtttttttctacttgagtcaagactcgcgccctaggagctggtgtctgaggaccgtgtgtaatccctggttcgagagaatctctatgttggtcatactgctgaattgcgtcaccttgggaatgttccggccatgtgaggacatagcttgtgacagccagcgttgcaggattctccaggcctttgatgactttatttttgcattttttgccgtggagatggtcgtgaagatggtcgctcttggaatttttggcaaaaaatgctatctgggcgacacttggaaccggctggatttcttcattgtgatagctggaatgctggagtactctctcgatctgcagaatgtgagcttttccgccgtccgcactgtacgtgtcctccgccccctacgcgctattaaccgggttccctcgatgcggattcttgtcaccctgctcctggacactctgcctatgctcggcaacgtcctgcttttgtgcttttttgtattcttcattttcggcatcgtgggcgtacaactgtgggctggactactgagaaaccgttgcttcttgcccgagaacttttcactaccactttccgttgacctggaaagatattatcagacggaaaatgaggatgaatccccttttatttgcagccaaccccgagagaatggaatgcgaagttgtaggagtgtgccaacgctgaggggagatgggggtgggggtcctccatgtggcctggattacgaggcgtacaatagcagctccaatacgacctgtgtaaactggaatcagtactatacgaactgctccgccggtgaacacaacccatttaagggtgcaatcaacttcgataatatcgggtacgcctggatagccatattccaagtaattaccctggaaggctgggtggacatcatgtactttgtgatggatgcccattccttctataatttcatctattttatacttttaataattgttggatcgtttttcatgataaacctgtgcttagttgtgatcgccacccaatttagtgaaactaaacagagggagtcgcaactgatgagagagcagcgggtgcggttcctctcaaatgccagtactctcgcttcctttagcgaacctgggtcgtgttacgaggagctcctcaagtacttggtgtatattctgcggaaggcggcaagaaggctggcccaggtctcacgtgctgccggcgtcagagtggggcttctcagcagccctgcccctctgggcgggcaagaaacccagcctagttcttcttgctccaggtctcatcgaaggctgagcgtacatcacttggtacaccatcatcaccaccatcatcatcattaccatctgggaaacgggactcttcgtgcgcccagagcaagccccgaaatccaggatagggatgcaaatggctccaggagactgatgctgccccctccctccaccccagcacttagcggtgctcctccaggtggcgccgagtctgtccatagcttttatcacgccgactgtcatcttgagcctgtgagatgccaagccccccccccacggagtccttccgaggcttccggccgaaccgtggggagcggcaaagtctatcctacagtgcacacaagccctccaccagagacccttaaagaaaaagcactggtcgaggtggccgcgtcatctggtccacctacactcacctcactaaatatcccaccaggaccttactcttccatgcataaactgctggagacgcaatccaccggcgcctgccagtcatcgtgcaagatctccagcccatgtctgaaagctgacagtggcgcttgcggcccagatagttgcccttactgcgccagggccggagccggtgaagtggaactggccgaccgcgagatgcccgactctgatagcgaggcagtgtatgagtttactcaggatgcacagcactctgacttgcgtgacccacactccagacgccagagatccctgggtcctgatgcagagccatctagcgtgctcgccttttggaggctgatctgtgacacattccgaaaaattgtggattccaaatactttggacgtgggatcatgatcgccatactggtcaataccttatccatggggatcgagtatcatgagcagcccgaggaattgactaatgctctggagattagcaacatcgtgttcacatcgcttttcgcactagaaatgctgctaaaactcttggtttatgggccgttcggctatattaagaacccctataatattttcgatggcgtaatcgtggttatttccgtgtgggaaatagtcgggcagcaggggggaggactgagcgttctgcgtacttttcggcttatgcgggtacttaagctggtgcgcttcctgccggccctgcagaggcagttagtcgtcctaatgaagacaatggacaatgttgctaccttctgcatgttgttaatgcttttcatcttcatattctcgattcttggaatgcacctttttggctgtaaatttgcttctgaaagggacggggacaccctgcccgacaggaagaattttgactctctgttgtgggcaatcgtaacagtcttccagattctgacccaggaggactggaataaagtgctgtacaacgggatggcgtccacatccagttgggcagctctgtactttatcgcgctgatgaccttcggaaattatgttttatttaacttgctggttgccatcctcgtcgaaggttttcaggcagaggagatcagcaaaagggaagatgctagtggccaattatcatgcattcagctgccagttgacagccagggaggggatgctaataaatccgaatctgagccggactttttttctccctccttggacggggatggggacagaaaaaagtgccttgctctggtgagcttaggggagcaccctgaactccggaaaagccttttgccgcccttgatcattcacactgctgccactcctatgtctcttcctaagagcacctccacaggactgggggaagctctcggacccgctagcaggcggaccagtagctctgggtccgcggagccgggagccgcgcatgagatgaaatccccgccaagcgcaaggtccagcccacacagcccttggagtgccgcaagcagctggaccagtcgccggagttcgagaaatagtctagggcgcgccccaagtctgaagagaaggagcccctcgggcgagagaagatcactgctttctggcgaggggcaggaatcacaggatgaggaggagtcctccgaggaggaaagagcaagtcccgctgggagtgatcaccgccacagagggtcccttgaaagagaagccaagtctagcttcgacctacctgatactctgcaggttcccgggctccataggactgcctccggccggggatcagccagcgaacaccaggactgtaacgggaaatcggctagcggacgcctggcccgggctctgcgacctgacgatcccccccttgacggtgacgacgccgacgacgagggcaatctgagcaagggcgaacgcgtaagggcatggatacgtgcaaggttgccagcgtgttgtctagagcgcgacagctggtctgcctatatatttcctccccagagtcgttttcgccttctgtgccaccgcattattactcataagatgtttgaccatgttgtgctggtaattatcttcctcaactgtatcactatcgcaatggagaggcctaaaatcgatccccactccgccgagcggatcttccttaccttaagcaattacattttcacagctgtgttcctggctgagatgaccgtaaaggtggtcgcacttggttggtgtttcggggagcaggcctacctcagaagtagctggaatgtgctcgacgggctgctggtcctcattagtgtgatcgacattctcgtgagcatggtgtccgatagtgggactaagatcctgggaatgttgagggtgttgcgactactcagaacgctgaggcctctgagggtgataagccgagcccaaggcctaaagctggtcgttgagactctaatgagcagcctcaaacccatcggcaatattgtcgtgatatgttgtgccttcttcataatcttcggcatcctgggcgtgcaactgtttaagggtaaattcttcgtatgccagggggaagacaccaggaatattactaataagagcgactgtgccgaggctagctatcgctgggttaggcacaaatacaattttgacaacctgggtcaagccttgatgtcactcttcgttctggcttccaaggacggatgggtggatatcatgtacgatgggctggacgcggtcggcgtagaccagcagcccataatgaaccataacccgtggatgctgttatactttatcagtttcctgctgattgtggcattcttcgtgctgaatatgtttgtcggggtggtggtagagaatttccataagtgccgacaacaccaagaggaggaagaagcccgtaggcgagaggaaaagcgactgcggcggctggagaagaagagacgcaacctgatgctcgacgacgtgatcgccagtggaagctctgccagcgccgcctccgaggctcagtgtaagccatattacagtgactactccaggttccggctgttggtccatcatctgtgtacttctcattacctggatctttttataacaggtgtcattggactaaacgtggtgaccatggctatggagcactaccagcagccccagatccttgatgaagcacttaaaatctgcaattacatcttcaccgtcatttttgtgctggagtcagtatttaagctcgtcgcctttggatttcggaggttctttcaggataggtggaaccagctagatctggcaatagtgctccttagtattatgggtattactttggaggaaattgaggtcaacgctagtctacccatcaaccccaccatcatccggatcatgcgagtcctacgtattgcccgggttctgaaactgctgaaaatggccgtaggcatgagggcgctcctggacaccgtcatgcaggcactccctcaagtcggaaatctggggttgctatttatgctcctcttcttcatcttcgccgccctgggcgtggaactattcggcgatctggagtgcgatgaaacccacccctgtgaagggctgggacgccatgccacatttcgcaacttcggaatggcattccttactctgttccgagtcagcacaggcgataactggaatgggatcatgaaggacaccctcagagactgtgaccaagaaagcacctgctacaacactgtcatctcccctatctactttgtaagctttgtgttaacagcacagtttgtcttggtaaatgttgtcatcgccgtcttaatgaaacatcttgaggagtctaacaaagaggcgaaggaggaggctgagctagaggccgaacttgaactggagatgaagacattatctcctcagccccatagccctcttgggtctccttttttgtggccaggagtcgagggaccggatagcccagactctccgaagccgggggctctgcatccggcagcccacgcccggagtgcctcccactttagcttagaacacccaacaatgcaaccccacccaacagaactgcccgggccagacctgcttactgtcagaaaaagcggcgtgtcccgtactcatagcctgcctaatgatagctacatgtgtcgccatggcagtaccgctgaaggcccccttggccaccgggggtggggtctgcccaaagcacagtcagggagcgtgctgagtgtacactcacaacccgccgatacttcctacatcctacagctgcccaaggacgcccctcatttactgcagccgcattccgcacctacgtggggcaccattccaaagctgccaccaccaggtcgcagtccactggcacaacgaccactgagacgacaggctgccatccgaacagactccctggatgttcagggcctcggttcacgcgaggacctgttagctgaagaggagcctccgagcccccgggacttaaagaagtgctactctgtcgaggcacagagctgccagcggcggcctacatcttggctggatgagcagcgtagacacagcatcgccgtttcctgtctggattctggcagccaaccccatcttggaaccgatccgtccaacctaggcggccaaccactggggggcccagggagcaggcccaaaaaaaaactctcccccccctctattaccattgacccccctgagtcccaggggccgaggaccccaccttcgccgggcatctgcttgcgcaggagagcaccgagcagtgacagcaaggatccactggcatcaggacctccagattctatggcggcctctcccagtcctaaaaaagatgtgctttcattgtccgggctgtcgtccgatcccgcagatctcgacccatag

SEQ ID NO: 40706 - DNA, 5331 bp, Artificial Sequence
  Description of Artificial Sequence: Synthetic coding sequence
atggacgaggaggaggacggcgccggcgccgaggagagcggccagcctaggagcttcatgagactgaatgatctatcaggcgccggtggcaggcctggacccggctccgccgaaaaagatcctggctcagccgattcggaggccgagggacttccttacccggctctagcccccgtggttttcttctacctcagccaggattcccgtcctaggagctggtgcctaagaaccgtatgtaatccgtggtttgagcgcatctcaatgttggtgatcttgttaaattgtgtgaccttagggatgttcaggccgtgcgaagacattgcttgtgattcccagcgctgcagaatcttgcaggcgttcgacgattttatctttgccttctttgccgttgaaatggttgtcaaaatggttgccctgggcatatttggcaaaaagtgctatctcggcgacacatggaatcggctagacttctttatcgtgatcgccggtatgcttgagtacagcctggatctgcagaatgtgagcttcagcgctgttcggaccgtcagggttctgaggccactgagagccattaaccgcgtgccgtctatgagaattctcgtgaccctccttctggataccctgccaatgcttggaaatgttctgctcctgtgtttcttcgtcttctttattttcggcattgtgggagtccaactctgggctggactgctaaggaaccggtgctttctcccagaaaacttcagcctgcccctttccgtagatctagaacgttactatcagacagaaaacgaggatgagagccccttcatctgctctcagcccagagagaacggaatgagaagctgcagatccgtacccactctgagaggcgatggaggcggtgggcccccctgcggcttggactacgaagcgtacaatagtagcagcaataccacctgcgtcaattggaaccagtactatacaaattgcagtgcgggggagcacaacccctttaagggtgctataaactttgataacatcggctacgcatggatcgccatttttcaagtcatcactctcgagggctgggtggacataatgtatttcgtaatggacgcacattcgttctataattttatctactttatattgctcataatagtggggagctttttcatgattaacttatgcctcgtagtgattgctacccagttttctgaaactaagcagcgggagagccaattgatgagagagcagagggtgcggtttctatctaatgccagcacattggcatccttctctgaaccagggagttgttatgaggaattgttgaagtacttagtatatatcttaagaaaggcagcccggcggttagcccaggtcagccgagccgctggagtacgagtggggttgctatcctccccagcccccctggggggccaggagacccagccctcctctagttgctcccgttctcatcgcaggctttcggtccaccatcttgtccatcaccaccaccatcaccaccaccattaccacctgggaaatgggaccttgagagcacccagggcaagccctgaaatccaggatagggatgctaatggatctcgccggttgatgctcccccctcccagcactcccgctcttagtggagctccgccaggtggagccgagagtgtgcactctttttatcacgctgattgtcatttggagcccgtgcgctgccaagctcctccaccaaggtccccatctgaagcgagcggccgcactgtaggttcggggaaggtgtaccccacggtccatacttcgcccccccccgagactcttaaagagaaggctcttgtggaagtggctgcctcctctggacctccaacactgacttccctcaatattccccccggaccatatagtagtatgcacaagcttttggaaacccagtcaaccggcgcttgccagtctagttgtaaaatttcctctccctgtctgaaagccgacagcggagcctgtggcccggacagttgcccttactgtgcccgagctggagccggggaggttgaactcgcagatcgagaaatgcccgactctgattctgaggcagtgtacgagttcacacaggacgctcaacatagcgatctgcgggacccacatagtaggaggcagcgatccctgggccccgatgctgagccttctagcgttctcgccttctggcgcctgatttgcgatacattcagaaaaatcgttgacagtaagtatttcggccgggggatcatgattgcgatccttgtaaataccctgtctatgggcatcgagtatcacgagcagcctgaggaactgacgaacgccctggagatttcgaacatcgtttttacatcactcttcgctctggaaatgctccttaagctgcttgtctatggcccattcggatacattaaaaacccctataatattttcgacggggtgattgtagtgatttcagtatgggagatcgttggccagcaaggcggtgggttatctgtactccgaaccttcaggttaatgagggtactcaagctggttagatttctgcccgccctccagagacagctggtcgtcttgatgaagaccatggacaatgtggccactttctgtatgctccttatgctcttcatattcatttttagcatcctcggtatgcacctgttcgggtgtaaatttgcttccgaacgcgacggcgacaccctgcccgaccggaaaaattttgacagcctgctatgggctattgtgactgtgttccagatcttaacacaggaggattggaacaaagtattgtacaacggcatggcttccacaagttcctgggccgctctgtattttatcgcgctgatgacattcgggaattacgtacttttcaacttacttgttgcaatcttagtggagggctttcaggccgaggaaatctctaagagggaggatgcctccggccagcttagttgtatccagctacccgtcgacagccaggggggggacgcaaataagtctgaatctgagcccgacttcttctctccctccctggacggggatggtgacaggaagaaatgtctagccctggtgtctcttggggagcatccagagttgaggaagagcctgctgcccccattgatcatccacaccgccgctacacctatgtccttaccaaaatcgacaagcacaggactgggggaggccctgggaccggcttcacggcgaacatccagctccggttccgctgagcctggcgcggcccatgaaatgaagtctcccccaagtgcaagaagctccccacatagcccatggagcgccgcaagcagttggacatccagacgaagttcccggaacagcttaggaagggccccttcattgaagaggcgttccccatcaggcgagcgccgatccctcttgtccggagagggacaggaatctcaggatgaggaggaaagtagcgaagaggagcgggccagccccgccggctccgaccaccgacacagagggtcattagaacgcgaggccaaatcgtcctttgacctgcctgatacgttgcaagttccaggtctgcacagaacagcctctggccggggtagcgcttcagagcatcaggattgcaatggaaagtcagcctccggcagactggctcgggccctgcgacccgatgacccgccgctcgatggagacgatgcggatgacgagggtaacttaagcaaaggagaaagagtcagagcctggataagggccagattgcccgcctgttgcctcgagagggattcgtggtccgcatacattttcccaccacagagcagatttagacttctatgccacaggataatcacccacaaaatgtttgaccacgtcgttctggtcattatatttctaaattgtattacaattgctatggagagaccaaagatcgatcctcactccgctgagcggatttttctgactctgtccaactacatcttcacagcagtgttcttggccgagatgacagtcaaagttgtggcactcggctggtgtttcggcgagcaagcatacctgaggagttcttggaacgtcctggatgggctgctggtgttgatttcagtcatcgacatactggtatcgatggtctccgactcgggaacaaaaattttaggcatgctgcgcgttctccgactcctgcgaacgttacggcccctgagggtcatttctagggctcaaggtctaaagctcgtcgtggagacattaatgtccagtcttaaaccaatagggaatatcgtggtgatctgctgtgcttttttcataatcttcggtattctgggggttcaattgttcaaaggaaaattctttgtttgtcagggggaagacacacggaatattacaaataagagcgactgcgctgaggcgtcctaccgctgggtccgacacaagtataatttcgataatctggggcaagcattaatgagtctgtttgtactggcatcgaaagacgggtgggtcgacatcatgtacgacggactggatgctgtgggcgtggaccaacagcccatcatgaatcacaacccctggatgttgctctactttatctcttttctgctcatagtagctttttttgtactgaatatgtttgttggggttgtggtggagaattttcacaaatgtaggcagcatcaggaagaagaggaagcccgcagacgtgaggagaaacgtctgcggcggctagagaagaagcggcgcaatttaatgcttgacgacgtgatagcaagcggttcctctgcatctgccgcatccgaagctcagtgtaagccttattactcagactattccaggttccggctgctggttcatcacctgtgcacctctcattacttggacctcttcattaccggagtgattggacttaatgtggtgactatggcaatggagcattaccaacagcctcagatccttgatgaggctctcaagatctgcaattatatcttcaccgtgatctttgtactcgagtcagttttcaaattggtggcctttggcttccgtaggttttttcaggatagatggaatcagctggacctcgctatcgtgctattgagcatcatgggaatcacacttgaagagatcgaggtaaatgcctcactgcctataaacccaaccatcatcagaattatgagagtactccgcatcgcccgagtcctcaagcttcttaagatggcagtcgggatgcgggctcttcttgacactgtgatgcaggccttaccccagctctgggcctggtcatccttagagacttggagtgtgacaagacacactcccgtgcgagcctgggccgtgatgcccccctttgggacgctcgcctggccgtcatag

SEQ ID NO: 40707 - DNA, 7101 bp, Artificial Sequence
  Description of Artificial Sequence: Synthetic coding sequence
atggacgaggaggaggacggcgccggcgccgaggagagcggccagccgcgatcgtttatgcggttgaacgacctgtccggagccggtggaaggcctggtcccggcagtgccgagaaagatcccgggtctgccgattctgaggctgagggtcttccttatccagccctcgcaccggtggtctttttttatctcagccaagactccaggcctaggagttggtgtctgcgcacggtttgcaatccttggttcgagaggatatccatgctcgtgatattgctcaattgcgtgacgctcgggatgtttcgtccatgtgaagacattgcatgcgacagccagagatgccggatcttgcaagcgtttgatgacttcatcttcgccttctttgccgtagaaatggttgtgaagatggtagccctgggaatctttggtaagaagtgttacttgggagatacatggaaccgcctagattttttcatagtcattgcaggtatgttggaatactccctggatttacagaacgtgtcattctccgcggtcaggaccgtacgggtgcttcgaccactgcgggctatcaatagagttcccagtatgcgtatattagtgaccttgctgttagatacattgccaatgctgggaaacgtactcctgctgtgcttctttgtgttcttcatcttcgggatagtcggggtccagctctgggcaggccttctcagaaatcggtgttttctacccgagaatttttcattaccgctttctgtcgacttggagagatattaccaaaccgaaaacgaggatgaatcgccattcatatgctcacaacctcgagaaaacggcatgaggtcctgtagatctgtgccaaccctgcggggggatggaggaggtggtccgccctgcggcctggattatgaagcttacaactcaagctctaataccacatgcgtgaactggaaccagtattatacaaattgctcagcaggcgaacataatccctttaagggtgccattaactttgataacatcggttatgcttggatcgccattttccaggtaattacattagagggatgggttgatatcatgtattttgtaatggacgctcacagcttctacaactttatttacttcattctgctcataatcgtaggcagtttctttatgattaatttatgtctggtggtgattgcaacacagtttagcgagactaaacagcgcgagtcccagctgatgcgcgagcagcgcgtccgattcctgagcaacgcctccaccctcgcttctttctcggaacccggctcttgctacgaggaactcttaaaatacctggtgtacatccttcggaaagcagctcgccggttggcacaagtgtcccgggctgctggggtcagggtcggcctcctgtcatctccggcccccctcggaggtcaggaaacacagccaagttcttcttgttctcgatcccacaggaggctctctgtgcaccatcttgtacatcatcatcatcaccaccaccaccattatcacttagggaacggcacactccgagcccctcgagcctctccagaaatccaggacagggatgccaatggcagtcggcggcttatgctgccaccaccaagcacccccgctctcagcggtgccccccctggtggtgctgagtctgtgcacagcttctaccacgccgactgccacctcgaacctgtccggtgccaggcgccaccaccaagatctccatctgaagcatctggtcgaaccgtcggcagtggtaaggtgtaccctactgtgcatactagtcctccacctgagacactcaaagagaaagcccttgtggaggtcgccgcttcttcaggcccacctactctcaccagcctgaatatccctccaggtccctattcctccatgcacaagctcctcgagacccaatcgacaggggcctgtcaatctagctgcaagatttcaagcccgtgtctgaaggccgattctggcgcttgcgggcccgacagttgtccctactgtgccagagccggtgctggtgaggtggaactggcggatagagaaatgccagatagcgattctgaagccgtatacgaattcactcaggatgcccagcactcagacctgcgagatccgcattcacggcggcagagatccctcggacccgacgccgagccttcatccgtgctggccttctggcgtctgatctgcgatactttcaggaaaatcgtcgatagcaaatattttggcagaggcattatgattgctatcctggttaacaccctctctatgggtatcgaatatcatgaacaaccagaggaactcaccaatgccctggaaatctcaaacatagtctttacatccctgtttgcccttgaaatgctgctgaagctccttgtgtatggaccttttggatatatcaaaaacccctacaacattttcgatggggtgattgttgtaatctcggtgtgggagatcgtcggccaacagggcgggggtctcagcgtgcttaggacatttaggctaatgcgggtcttgaagctcgtgcgcttcctcccagcacttcaaaggcagctggttgtgctcatgaagactatggataatgtggctacattctgcatgctgctgatgttgttcatttttattttctcaattcttgggatgcaccttttcgggtgcaaattcgcaagtgagcgggatggggacacgctacctgacagaaaaaatttcgatagccttttatgggcaatcgtaactgtgtttcaaattttaactcaggaagattggaataaggtcttgtataatggaatggctagtacaagcagctgggccgctctgtatttcatcgctctaatgactttcggcaactacgttctgtttaacctactcgtggccattttggtcgagggattccaggctgaagaaatctcaaaacgagaggacgccagcggacagctgagttgcatccagcttcccgtagactcccagggtggggacgccaacaaatcagaaagcgagcctgacttctttagcccatcactggatggcgacggcgacaggaaaaagtgtttagcactcgtgtctttaggcgaacatcccgagttaaggaaatccctgctgccacctctcattatccacaccgctgctaccccaatgagcctgcccaagtccacgagtacgggattgggggaagccctcggcccagcaagccgccgcacttcaagttccggttctgcagagccaggcgcagcacatgagatgaagagccccccgagcgccaggagctcccctcacagtccttggagcgcagcatcatcttggacctcgcggagatcttctcgtaattcactgggtcgtgccccttccctgaaaaggcgttcaccttccggggagcgtcgtagcttgctgagtggggagggacaagagtcacaagatgaggaggagtcatccgaagaggaaagggcttctccggcaggatctgaccacaggcataggggatcattagagagggaggccaaatccagctttgatctaccagacaccttgcaagtgcccggcttgcacaggaccgcctctggacgaggctctgcctccgagcaccaggattgtaacggaaagtctgcgagcggacggctggcgcgggccctgcggcctgacgacccaccattagacggcgacgacgctgatgacgagggtaatcttagtaaaggcgaacgggttagggcctggatccgggcccggctgcctgcatgttgcctagagagagacagctggtcagcctacatatttccccctcagtctcggtttcgactgttatgccacaggattattacccataagatgttcgatcacgttgtgctcgtgattatcttcctgaactgcatcactatcgcgatggaacgtcctaaaatcgacccgcacagcgcagagcggatcttcctgacattgagcaactatatatttacagctgtttttctcgcggaaatgacagtaaaggtagtggccttaggatggtgctttggagagcaagcttacttaagatcaagctggaacgtgctcgacggcctcctggtgctgatcagcgtgattgacatcctcgtcagtatggtttccgacagtgggacaaagattctgggcatgctgcgggttcttcggctgctgcgaactctccgcccattgcgcgtcataagccgagcacaaggactgaaactggtcgttgagacattaatgtctagtctcaagcccatcgggaacatcgtggtgatatgctgtgctttctttataattttcggcatactcggcgtccaactctttaaaggcaaatttttcgtctgccagggcgaggacacacggaacatcactaacaagtctgactgcgctgaggcatcatacaggtgggtcagacacaagtacaattttgataatctgggacaggcgctgatgagccttttcgtcctcgcctctaaggatggatgggtagacattatgtacgatggtctagacgccgtcggcgtggatcaacaaccaatcatgaatcacaacccctggatgctgctttacttcatatctttcctgctgatcgtagcctttttcgtgctcaacatgttcgtgggcgtggtggtggagaacttccataagtgcagacagcaccaggaggaggaggaagcccgacggcgcgaagagaagcgcctccggaggctcgaaaagaagagacgcagtaaagaaaagcagatggctgaagcacagtgtaaaccctactattccgactatagtcgcttcaggttgttagtgcatcacctatgtacctcccattacttggaccttttcattaccggcgtaatcggcctgaatgtggtgacaatggccatggagcactaccagcagccgcagattttagatgaagcccttaaaatctgcaactatatttttacagtgattttcgtgcttgaatctgtttttaagctggtggcatttggttttcgtagattttttcaggatcgatggaaccagctggacctggcaattgtgttactgtcaatcatggggatcaccctggaggagatagaagtgaatgcctctctccccatcaatcccactatcatccgtatcatgcgtgtccttcgaatagcccgcgtcctgaagctgctaaagatggcagtaggaatgagggccctgctggacaccgtcatgcaggccttgcctcaagttggtaacttggggctgctgttcatgctgttgtttttcatcttcgcggctttgggcgttgagctgttcggggacctggaatgtgatgagacacacccctgcgaaggcctcggccggcacgcgacatttcggaattttgggatggcctttctgacgctctttcgagtgtctacaggcgacaattggaatggtataatgaaggatactttgcgggactgcgaccaagaatcgacctgttataacactgtcataagcccaatctactttgtgtcttttgtattgaccgcacagttcgtgttggtgaatgttgtgatcgccgtgctgatgaagcacctggaagagtcaaacaaggaagcaaaagaggaagcagaactggaagctgagctcgagttggagatgaaaaccctgtctccccagcctcattctcccctgggaagtcccttcctctggcccggcgtcgaggggccggactcccccgacagccccaagcccggcgctttgcatcccgccgcccatgctcggagtgcttcccacttctctttagaacatcctaccgacagacagctgtttgatacaatatcattgctgatccaaggctccctggagtgggagctgaagctgatggatgagctggcaggtcctgggggacagccaagtgcattcccgagcgcccccagtctgggaggaagtgaccctcagatacccctggccgaaatggaggccctgtctctgaccagtgagatagttagcgaacctagttgctctctggctctgacggacgatagcctgccagacgatatgcacaccctactcttatctgccctggagtctaacatgcagccgcacccaactgagctgcccggccccgatctcctgacagtgcgtaagagtggcgtttcacgcacccatagtctgcctaacgactcctatatgtgtcgccacggatccacggccgaaggtcctctgggtcacagaggttggggtttgccaaaggcgcagtccggtagcgtgctgtctgttcactcccagccagcggatacgtcatacattttacagctgcccaaggacgcaccccacttactccagccacacagcgcccccacctggggaacgattccaaagctgcctccccctggaagaagcccgctggctcagcgcccactcaggcgccaagcagcgattcgcaccgattccttggatgtgcaagggctcggatcccgcgaggacctgctggctgaggtctccggacctagtccaccgcttgcccgggcttacagtttttgggggcagtcctcaacacaggcccagcaacacagtaggtctcacagtaaaatttcgaagcacatgaccccccccgccccttgtcccggccctgaacccaactggggcaaagggcccccggagacccgatcctctctagaactcgacactgagctctcttggatcagcggagacctgctaccacccggcggacaggaggagccccctagcccacgtgacctgaagaaatgttatagcgtagaggctcagagctgccagcggcgccccaccagctggctggatgagcaacgtcgccattccatagccgtgagttgcttggattccggcagtcagccccaccttggcaccgatccatccaaccttggtggacagccgctaggaggacccgggagccgtccaaaaaagaagctatcacccccaagtattacgatcgaccctccagaatcccaggggcccaggacaccacccagcccgggaatctgcctgcggcggcgcgccccttcctccgactccaaagatcccttggcttctggaccaccagatagcatggcagcttccccctcgcctaagaaagacgtgttgtccctgtccggcctgtcctctgatcccgccgacctcgacccttag

SEQ ID NO: 40708 - DNA, 6999 bp, Artificial Sequence
  Description of Artificial Sequence: Synthetic coding sequence
atggacgaggaggaggacggcgccggcgccgaggagagcggccagccacgctcttttatgcgcctgaacgatctatctggcgcaggagggcgaccaggaccgggaagtgctgaaaaggatccaggaagcgcagacagtgaagccgagggcctcccatacccagccctcgctccagtggtttttttttatctgtcccaagacagcaggccccgcagttggtgtctgcgcacagtgtgcaacccatggttcgagcggatctccatgttggtaatcctcctcaactgtgtgacactgggtatgttccgcccctgtgaggatatcgcttgtgatagtcagcgatgtcgtattctgcaggcttttgacgattttattttcgccttcttcgctgtggagatggtcgtgaagatggtggctctggggatctttggaaagaaatgttacctgggagatacgtggaatcgactcgatttttttattgtgatcgccggtatgctggagtacagccttgatttacagaacgtgtctttctcggctgtccgcacagtgcgagtgctacggcctctgagagcaatcaaccgcgtccccagcatgagaatcctggttaccctcctgctggatacccttccaatgctggggaatgtcctactcctgtgcttcttcgtgttcttcatatttggaatcgtgggtgtccagctctgggcagggctgctgcggaataggtgctttctgcccgaaaacttcagcctgccgctatccgtcgacctagagaggtattatcagaccgaaaatgaggacgagtcaccattcatctgttctcagccacgtgagaacgggatgcggtcctgtcgatcagtcccaacccttcgaggggacggcggcggaggacctccatgcggtctagactacgaagcgtataattccagcagcaatacaacctgtgtcaattggaaccagtactacacaaactgctcggccggagaacacaacccattcaaaggagcaataaacttcgataatatcgggtacgcgtggattgccattttccaggtgattaccctggagggatgggttgatattatgtattttgtcatggacgcccactcattctacaatttcatctactttatcctgcttatcattgttgggtccttctttatgattaatttgtgcctggtcgtcatcgctacccagttttctgagaccaagcagcgcgaatctcagctgatgcgagagcaacgtgtgcggtttttgagcaatgctagcacgctggcctccttctcggagcctggaagttgttatgaggaactgttgaaatacctggtctacatcttgagaaaggccgcccgacgcctcgcacaagtctccagagctgcgggggtccgggtgggccttttatcctcccccgcacctctgggcgggcaagagacccagccttcttctagctgcagccggtctcacagacggctcagcgttcaccacctggtgcatcaccaccatcatcatcatcaccattaccacctgggaaatgggacactacgggccccccgtgccagcccggagatccaagacagagatgcgaatgggtctaggcgcttgatgctcccgccaccttctactcctgccctcagcggcgcgccacccggcggggcagagtctgtgcactcattctatcacgctgactgccacctggagcccgtgcgctgtcaggcgccgcctccccggtctcctagtgaagcatccgggcgcacagtgggctctggcaaggtttaccctaccgtgcacacctctccaccaccagaaaccctcaaagaaaaggccttggtggaggtggcagcttctagcggaccccccacactgactagcctcaatatccccccaggtccttacagctccatgcataaactcctcgaaacacagagcacaggtgcctgccagtcttcttgtaagatttcttccccctgtcttaaagccgactccggagcgtgcgggcccgattcgtgtccgtactgcgcccgcgcaggcgctggcgaagttgagctggcagaccgcgagatgccggattccgatagcgaagccgtgtacgagtttacacaggatgcacaacacagcgaccttcgcgacccgcactcccggcgtcagcgttccctagggccggatgctgaaccctcttctgtgctggctttttggaggctcatttgtgatacttttaggaaaattgttgactccaaatacttcggaagaggtatcatgatcgctatcctggtaaatactctgtcaatgggcatagagtaccatgagcagccggaggagctgaccaatgcccttgagatttctaacatcgtcttcacgagtctgttcgcgctggaaatgcttctgaagcttcttgtctacggcccgttcggatacatcaagaacccttataacatctttgacggcgtcattgtagtcatcagtgtgtgggagatcgtcggccagcagggtgggggactgtccgtcctgcgaacattccgcctgatgagggtcctcaagctggtcaggttcctccctgccctccaaagacagctggtggtcttaatgaaaaccatggacaatgtggcaaccttttgtatgctcctgatgctcttcatcttcatcttctccatcctgggcatgcacctattcggatgcaagtttgcttctgagcgtgacggagatactcttccagatagaaagaactttgatagcctgctgtgggctattgtcaccgtcttccagattctcacccaggaggattggaataaggtgctttacaacgggatggcttctacctctagctgggccgccctatattttatcgctctgatgacctttggaaattacgtactgttcaatctgcttgtcgccatactggtggagggatttcaggctgaggagatcagcaagcgggaggacgcttccggccaactctcctgtatccaacttccagttgactcacaaggtggtgatgcaaataagtcagagagcgaacccgacttcttttcccctagcctggatggcgacggagataggaagaaatgtttggccttagtcagtctgggggaacaccctgaactccggaagagcctactcccccccttaattatccataccgcggccactcctatgagtctgccaaagtcaacatcaactggactaggggaagcactgggccccgcttcacggcggacttcatctagtggctctgcggagcccggcgccgcccatgaaatgaagtcaccacctagcgccagaagttccccacattcaccgtggagtgcagcttcctcctggaccagtcggagaagctcccgaaactcgctcggacgggcaccgagcctgaaaagacgaagcccttctggagagagacggtcacttctctctggagaaggtcaagagtctcaggacgaggaggagtccagtgaagaagagcgggccagcccggcgggatctgaccacagacaccgtggcagcttggagcgggaggccaaaagcagttttgaccttcccgacaccctgcaagtgccgggactccatcgaactgctagcggccgcggtagtgcttccgagcatcaggactgcaatggaaagtctgcatcaggaaggctcgctagggccctcaggccagacgacccacctttagacggcgatgacgctgatgacgagggcaacctatcaaaaggggagagagttcgagcatggataagagcgcggctgccggcctgttgcctcgagcgcgactcctggtcagcatatatatttccaccacaatctagatttcggctgctgtgccatcggatcatcacacataagatgtttgatcatgttgtcctggtaatcattttcttgaattgcattaccatcgccatggagcggcctaaaatcgatccccacagcgctgagcgaatctttctgaccctatctaactatatattcacagcagtgtttctggcggaaatgacggtgaaggtcgtcgctctggggtggtgcttcggcgaacaggcttacctgcggtcgtcatggaatgtgcttgatggactcctggtgttaatatccgtgatagacattctggtgagtatggtctcggattccgggacgaagatcctgggtatgctccgcgtgctccgcctcctccggactcttcggcctctgcgcgttatcagccgagcacagggtttaaagctggttgtggagaccctgatgagctccctaaagccgatcggcaacattgtagtcatttgttgcgcctttttcataatctttggtatcctgggcgttcaattattcaaggggaaatttttcgtctgccagggtgaggatacccggaatatcacaaataagtcggattgtgctgaggcctcctaccgctgggtgcgccacaagtacaatttcgacaatcttggccaggctctcatgagcttattcgtgcttgcgtccaaggatggatgggtggatattatgtatgatggactggacgccgtgggcgtggatcagcagccaattatgaatcataacccttggatgttgctgtattttatcagcttcctgctcattgtagccttcttcgtgttgaacatgttcgtcggcgttgtggtcgaaaatttccacaaatgtaggcagcaccaagaagaagaggaagcccgacgacgtgaggagaaaagactgagaagactagaaaaaaagcgcagaaatttgatgctggacgacgtgatcgcttccgggtctagtgcaagcgccgcttccgaggcccagtgtaaaccatattattccgattactctaggtttcgcctcctggttcatcatctgtgtaccagtcactatctggacctgttcattactggggtaattggcctgaacgtcgtgaccatggcaatggaacactatcaacagcctcagattctggacgaggcattaaagatctgcaattacatattcaccgtcatcttcgtgctcgagtccgtgttcaagttggtagcttttggatttaggcggttttttcaggaccggtggaatcagctggatctggctatagtcctgctgagcatcatgggcattacactcgaggaaattgaggtaaatgccagcctcccgatcaaccctaccattattcgtattatgagggtcctgcggattgcacgagtactgaagttgctgaagatggccgtgggaatgagggcgcttctggacacagtgatgcaagcgcttccccaggtggggaacttggggctcctgttcatgttactgttttttatctttgccgcgttgggggtcgaacttttcggcgatctggagtgtgacgagacccatccatgcgagggcctgggtcgccatgccacgtttagaaattttgggatggcctttctgaccctgttccgagtttccactggcgacaactggaacggaattatgaaagacaccctgagggactgtgaccaggaatctacatgctataataccgttatttcccctatttactttgtgtcctttgtgttgacagcccagtttgtcctggtgaacgtcgtgattgctgtgctgatgaaacacttggaggagtccaataaggaagcaaaagaggaggccgagcttgaggcagagctggaactggaaatgaagaccctgtctcctcaaccccactccccactcgggtctccttttttgtggcctggagtcgaaggtcccgatagtccagactcccctaagccgggagccctgcacccagctgcccacgctcggtcagcgagtcattttagcctggaacaccccacggatcgtcagctgttcgatactatatccttgctcattcaaggttcactggagtgggaattgaaactgatggacgagcttgctggcccagggggacaaccaagtgccttcccttcagccccaagcttgggagggtctgacccacagatgcagcctcacccgacagaactccctggtcctgatctgttaaccgtccggaagagtggcgtgtctaggacacacagcctccctaatgactcctacatgtgccgacacggctccacggctgaaggtccactggggcatagggggtggggcttacctaaggcccagtctggatcagtcctgtccgtacatagccaacctgccgatacttcttacattttacaactgcctaaagacgcgcctcatttgctgcagccacattccgcccctacttggggtacaattcccaaactcccaccacccggtcgcagcccactggcccaacggcctctgcggcgacaggccgcaatacgcaccgattctcttgatgtccaggggctgggaagccgggaagatttgctggccgaagtgagcggaccaagcccaccacttgcacgcgcttacagcttctgggggcaatcctcgactcaggcccaacagcactcccgctctcatagcaagattagcaaacacatgacaccaccggcaccatgccccggtcctgaaccaaactgggggaaggggcctccggaaacccgttctagcttggagttggatactgagctgagttggattagcggggatcttctgccccccggagggcaagaggagccaccatcacctcgcgaccttaaaaagtgttattctgtggaagctcagtcctgccagagaagacccacaagctggctggatgagcagcggcgccatagtatcgctgttagctgccttgacagcgggtctcagcctcatttaggtacagacccttctaacctgggtggtcagcctctcggtgggcctggctctagaccaaagaagaagcttagtcccccctcaatcaccatcgacccccccgagagccagggaccaaggacacctccctctccggggatctgtctgcgcaggcgagcaccgtcatctgacagtaaggatccactagctagcggaccaccggactcgatggcagcgagcccctctcccaagaaggacgtgctgtctctgtccggtctatccagcgaccctgctgatttggatccttag

SEQ ID NO: 40709 - DNA, 6834 bp, Artificial Sequence
  Description of Artificial Sequence: Synthetic coding sequence
atggacgaggaggaggacggcgccggcgccgaggagagcggccagcctcgcagctttatgcgccttaacgatttgagcggcgccggaggccggccggggcctggatcagctgaaaaagaccctggaagtgcagatagtgaggccgaaggacttccatacccagccttggcccctgttgtgtttttctatctgtctcaggacagcaggcctaggagctggtgtctgaggacagtgtgtaatccgtggttcgaaagaatttccatgttggttattctgctgaactgtgtgactctgggaatgttccggccctgcgaagatattgcttgtgattcacagcgctgcaggatccttcaagcgtttgacgactttatttttgcatttttcgccgtggagatggttgttaagatggtggctctgggcatcttcggaaagaagtgttacctgggggacacgtggaataggctggacttcttcatcgtcatagctggaatgctggagtacagcctggacttacagaacgtgtcctttagtgccgtgcggaccgtcagggtcttgcgtccactcagagccataaatcgagtgccatctatgcgcattctggtcaccctgctgcttgacacactccctatgttgggcaacgtgcttctgctctgtttcttcgtctttttcatcttcggtattgttggtgtgcagctatgggccggcctgctgagaaatcggtgtttcctgccggagaactttagcttgccactttccgttgacctggagcggtattaccagacagaaaacgaggacgaatcccccttcatttgcagccagccacgtgagaatggcatgcgaagttgtagaagcgttcccacgctgagaggggatggggggggaggcccaccctgtggtctggactacgaggcttataacagctcttccaacacaacatgtgtcaattggaatcagtattataccaactgttccgcgggcgagcacaacccctttaaaggggccatcaacttcgataatatcggttatgcctggatagcgattttccaggtgatcactctggaaggatgggtagacatcatgtatttcgtgatggatgcccacagtttctacaatttcatctacttcattctgttgatcattgttggcagttttttcatgatcaacctctgcctggtcgttattgccacccagttcagcgaaacgaaacaacgcgaatctcagctgatgagggaacaacgagtgcgctttctctctaatgcaagcactctcgcgtctttctcggagcccgggtcatgttacgaggagctcttgaagtaccttgtgtatatcctgcggaaagcagctcgacgtctggcccaggtgtccagagctgcgggagtgagagtgggactgctcagctcccccgcccccttaggcggccaggagacgcagccatcctcatcatgttccaggtcacacaggaggcttagcgttcaccatcttgtgcatcaccatcaccaccaccaccatcactatcaccttggtaatgggacgttacgcgcgcctcgggctagtccggaaatccaggatagggatgcaaatggtagtagaagattaatgctgcccccccctagcacaccagccctgtccggggcacccccaggtggggctgagtcagtgcacagtttctaccatgccgactgtcatctcgaaccagtgaggtgtcaggctccacctcctagatcaccgtcagaagcttctgggaggactgtaggttctggcaaggtttaccccactgtgcacactagcccacccccggagacattgaaggagaaagcccttgttgaagtcgccgctagcagcggacctccgaccctgaccagcctaaacatccctccagggccctacagttctatgcacaaactactggaaacacaaagtacgggcgcttgtcagagctcctgtaagatctctagcccatgcctgaaagctgatagcggcgcctgtggtcctgatagttgtccgtattgcgccagagctggagctggtgaagtcgagctggctgacagggagatgcccgactccgacagcgaagccgtttatgagttcactcaagacgcgcagcactcagatctgcgagatccacacagcagacgacagcggagcctggggccagacgcagaaccatcgtccgtattagcgttttggcgactgatttgtgacacttttagaaagattgtggattctaagtactttggtagagggattatgatagccattttggtgaatactttgagtatgggcatcgagtaccacgagcagcccgaggagctcaccaacgccctggagattagtaatatcgttttcacctcgctgtttgccctggagatgcttctgaagctgcttgtgtatggacccttcggttacattaagaatccgtacaacatattcgacggggtgatcgtggttatctcagtgtgggagatcgtcggacaacaaggtggaggcctgagcgtcctcaggacattcaggctgatgagggtgttgaagttggtacggtttctgcccgcgctgcagagacagctcgtggtgcttatgaagaccatggacaacgtggctacattttgtatgctcctgatgctgtttatctttatcttttcaattctcggcatgcacctttttggctgcaagtttgcctcagagagggacggcgatactctccccgaccggaagaattttgatagcctgttgtgggccattgtcaccgtttttcagattctaacacaggaggactggaataaagtgctgtacaacgggatggcgtcaacctctagctgggccgcgctgtattttattgccctgatgacttttggaaactacgtgctgttcaatctgctggtggctattctcgtggaaggatttcaagcggaagagatctccaagagggaagacgcttcagggcagctctcctgcatccagctcccagtagactctcagggcggagacgccaacaaaagcgagtcagaacccgacttctttagcccaagtctcgatggggatggtgacagaaagaagtgcctcgcactggtcagtttaggggaacatcctgagttgcgcaaatccctgctgccacctctgattatccacaccgccgcgacccccatgagcttacccaagtctacatccacaggccttggggaggcactcgggccagctagccgacgaacatcttcgtcgggctcagctgaacccggcgccgctcatgaaatgaagagccccccttccgcacgctcgtcacctcacagcccctggtcagccgccagctcgtggacatcacgcaggtcatcacgaaatagcctgggacgggcgccctctttgaagcggcgcagcccttctggagaacggaggagcctcttaagcggtgagggtcaagagtcacaggacgaagaggagagctccgaggaggaaagggcttctcccgccggctccgaccatcgccacaggggttctttagagcgcgaagctaaatccagcttcgacttgcctgatacattgcaagtaccaggattgcatcgcacagcttcagggcgagggtctgccagcgagcatcaggattgtaatggcaagtccgcttctggcaggcttgccagggcactaagaccagacgacccacccctcgacggagatgatgcagacgacgagggaaatctgtccaagggagaacgcgtccgtgcttggattagagctcgtttacccgcgtgctgcctcgaaagggactcttggtccgcctatatcttcccgccgcaatctcgttttcgtttattatgtcataggataatcactcacaagatgttcgatcacgtggtgttagtcataatatttttgaattgtataaccattgccatggagcgaccgaaaatcgatccgcacagcgccgagaggatctttctcaccctcagcaactatatctttacagcggtctttctggccgagatgactgtaaaagtggtggccttgggctggtgtttcggggaacaggcataccttcgctccagctggaatgttctagacgggttgctggtgcttatttctgtgatcgatatacttgtatctatggtcagcgatagcggcactaaaattttgggtatgcttcgggtgcttcgactgctccggaccctccggcccctacgtgtcatctctagagctcagggcctcaagcttgtcgttgaaacactcatgtcgtctctgaaacctatcggaaatatcgttgtgatctgttgcgctttctttattatttttgggatcctcggcgtgcagttgttcaagggcaaatttttcgtgtgtcagggtgaggacacgcgcaatatcacgaacaagagtgactgcgctgaggcatcatacaggtgggtcagacataagtataactttgataatcttgggcaggcactgatgtctctgttcgtgctggcctctaaggacgggtgggtggatataatgtatgacggcctggacgctgtgggggtcgaccagcagccaatcatgaatcacaacccatggatgcttttgtactttattagcttcttgctgatcgtagctttcttcgtcctgaatatgttcgtgggtgtggttgtagagaacttccacaaatgccgccagcatcaggaggaggaagaggctagacgtcgagaagagaagcggctgcgccggttggaaaagaagcgccgtaacctgatgttggacgatgtgatcgcatcaggaagcagtgcctcagccgctagcgaggcccagtgtaagccctactattcggactatagtcggttccgacttttggttcaccatctttgtacctcacactacctagacctgttcattaccggcgttatcggactgaacgtagtcactatggctatggagcactatcaacagccacagatcctggacgaggctttgaagatttgcaattacatcttcaccgtaatttttgtcctggagtccgtgtttaagctggttgcctttgggtttcgacgattcttccaagatagatggaatcagctagatctggcaatagtcctgctgagtattatgggtatcaccctcgaggagattgaggtgaatgcaagtctgccaataaatccaacgattatccggatcatgcgggtcctgcgcatcgcccgcgttttgaagttgctgaagatggctgtcggtatgcgcgccctgctcgacacagtggggaatctgggattactctttatgctgctcttcttcatttttgctgccctcggcgtggagctgtttggggatcttgagtgtgacgagacccacccctgcgagggactcggcagacatgccacgtttcggaatttcgggatggctttcttgacactgtttcgcgtttctacgggcgataattggaatgggatcatgaaggatacactgagggactgcgaccaggaaagcacatgctacaatactgtcatctctcctatttattttgtgagcttcgtgctgacagcccagtttgttttagtcaatgtcgtgattgccgttctgatgaaacatctagaagaatctaataaggaggctaaggaagaggcagagttagaggcagagttggagctggagatgaagactctcagcccacagcctcacagccccctgggttcccccttcctgtggcccggagttgagggcccggactctcctgatagcccgaagcctggtgcactccaccccgctgctcacgctcgctctgcaagccacttttccctcgagcaccccaccatgcagcctcaccccaccgagttgccagggccagacctgctcaccgtacgcaaatctggggtgtcccggacccattcattgccgaacgactcttatatgtgccggcatgggtctaccgccgaaggcccacttggtcatagaggctgggggctgccgaaggcacagtccggcagcgtcctatcggtgcacagccagcccgctgacacatcatacattctgcaactgcctaaagacgcaccccacctactgcagccccattctgcacccacgtggggcactatcccgaagctcccccctcccggacgtagccctctggcgcaaaggccacttcgccgacaggctgcaataaggaccgatagcttggatgtccaaggcctgggctcacgcgaggatctgttggctgaggtatctggccccagtccacctcttgccagggcgtactccttctgggggcagagctcaacgcaggcacagcaacactcacgcagccacagcaagatttctaagcacatgacacctcccgccccctgtcccggtcccgagcccaactgggggaaggggcctccagaaacaagaagtagccttgagctcgacacggagctcagctggatttctggcgacttactgccacccggcggccaggaagagccccccagtccaagggacctgaaaaaatgctacagcgttgaggctcagagctgtcaacgccgcccaaccagttggctggacgaacagcgtcggcacagcatcgctgtctcctgcctggacagtggctctcagccacatctgggcactgatccctccaacttgggagggcaaccactggggggacctggctcacgacccaagaaaaagctgagtcctccatctatcacaatagacccccctgagtctcaaggcccaagaacaccacctagtcctggcatttgtctgaggcggagggctccaagttcagacagtaaagacccattggctagtggcccccccgattccatggccgcctccccaagccctaaaaaagatgtcctgtcgctttccgggctgtcgagtgatccagcggatcttgacccttag

SEQ ID NO: 40710 - DNA, 6585 bp, Artificial Sequence
  Description of Artificial Sequence: Synthetic coding sequence
atggacgaggaggaggacggcgccggcgccgaggagagcggccagccccgcagcttcatgcgactcaatgacctgtccggtgctggaggaaggcccggccctggatcagccgagaaagaccccggatccgccgattcagaagcagagggcctgccctaccctgcattagcaccagttgttttcttttatttatcacaagacagcagacctcggtcttggtgcctacggaccgtctgcaatccttggtttgaaagaatatcaatgctcgtcatcctgctgaattgcgtaactttaggcatgttcagaccttgtgaggatatcgcttgcgatagccagaggtgccgtatcctgcaagctttcgatgattttatcttcgcattcttcgcagtagagatggttgtaaagatggtagccttggggatcttcggcaagaaatgctacttaggagacacttggaaccgtcttgattttttcatcgtcatagctggaatgctcgaatatagcttggatctgcaaaacgtcagtttcagcgctgtgcggactgttcgagtgctgcggcccctgagggcaatcaatcgcgtgccttcaatgcggattctggttactctcctgctagatactcttccgatgctgggtaacgtccttcttctgtgctttttcgtgtttttcattttcggcatcgtaggcgtgcagttatgggcagggctactgcgtaatcgatgcttcctgcctgagaacttctccctgccgttgtcggtggaccttgagcggtactaccagacggaaaatgaggacgaatcgcctttcatctgcagtcagccccgggaaaatggaatgcgctcctgtaggtcagttcctaccctgcgaggagatggaggaggaggaccaccgtgtggtctcgactacgaggcgtacaatagcagcagcaacacgacctgcgtgaactggaaccaatactacacaaactgttcagctggcgaacacaatccattcaaaggagcaataaatttcgataatataggttatgcttggatcgcaatttttcaggtaataacactggagggatgggtggacattatgtattttgtgatggatgcccactcattttataatttcatttactttatcctgctgattattgtggggagcttctttatgatcaacctgtgtctggtggttatcgccacccagttcagcgaaaccaaacagcgagaatcccagctcatgagggaacagcgagtcagatttctgagcaatgcttccaccctggcaagctttagcgagccagggagttgctacgaggaactgctgaaatatttagtgtacatactgaggaaagccgcccgacggctcgcccaagtctctcgcgctgcaggtgtgcgcgtcgggctcttgtccagtccagcacccctgggcgggcaggagacgcagccaagctcttcttgttccagaagtcatcgccgcttgtcagttcatcacctggtccaccatcatcaccaccaccatcaccattaccatctggggaatggaacgcttcgggcgcctagagcgtcacccgagattcaagaccgagacgccaacggctcccgccggttaatgctgcccccaccatcaacccccgccctgagcggcgcaccgcctggcggtgctgagagcgtgcattcattttaccacgccgactgccacctggaacccgtccggtgccaggcgcccccacccaggtcacctagcgaggcatccggaagaaccgtcggctccggcaaggtgtatcctacagtgcatacttccccacccccagagacattgaaagaaaaagcgctcgtcgaggtagccgccagcagtggtcctccaacactgacttcactgaatattcctcccggaccctactcctccatgcacaagctgcttgagactcagagcaccggggcgtgtcagtcaagctgcaaaatctctagtccgtgtttaaaagccgacagtggcgcgtgtgggcccgattcctgtccctattgcgcgagagcaggggccggtgaggtggagctggcagatagggaaatgcccgattccgacagcgaggctgtctatgaattcacccaggacgcccagcactccgatctgagagatccccacagtagacggcagcggtccctcgggccagatgccgaaccaagttccgtgcttgctttttggaggttgatatgcgacacattccgaaaaattgtggactccaaatacttcggacgcggcataatgattgcaatattggtgaataccctttccatgggcatagaataccatgaacagccagaggagcttaccaacgccctcgagataagcaacatcgtgtttacgagcctgttcgccctcgagatgttgctgaagctcctggtttatggccctttcggttacatcaagaatccatataatatcttcgacggagtaatagtggtcatcagcgtgtgggagattgtgggccagcaggggggcggactctctgtactgaggacctttcgcttgatgcgggtactcaagctggtgcgctttctgccagctctccagcgccagcttgttgtcctcatgaagactatggacaacgtcgccactttctgtatgctgctgatgctgttcatctttatcttcagcatactgggcatgcatttatttggctgtaaattcgcgtccgaacgagatggcgatactcttccagaccggaaaaatttcgactctctgctgtgggccatagtgacagtgttccaaatcctcacacaggaggactggaacaaggtgctctataacggcatggcctcgacatcgagctgggccgctctgtatttcatcgcacttatgacgttcgggaactatgtgcttttcaatctgctggttgcaatactggttgagggcttccaggctgaagagataagtaaacgggaagacgcctccggccagttgtcctgcattcagcttcccgtcgattcgcagggaggggacgcaaacaagagcgagagcgagccagactttttttctcccagcctggatggggatggagacaggaagaagtgcttggctctggtatctctcggagaacatccagagctgaggaaaagcctgctgccaccactgatcatccacacggccgcaacacctatgtccttgccaaagtccacctccactggcctaggagaggccctgggacccgccagccggaggaccagtagcagcggcagtgccgagcccggcgccgcccacgagatgaagtcgcctccatcagctcgttcgtctcctcattcaccttggtccgcagcctcaagttggacttccaggcgcagctcacgtaactcattagggcgggcccccagcctcaaacgcaggtccccctccggagagaggagaagcctactgagtggcgagggccaggaatcccaggatgaagaggaaagctcagaggaagagagagcgagcccggccggtagtgaccaccgtcatcggggatccttagagcgggaagctaagtcaagtttcgatttgccagacactctacaggtccccggcttacatcgaacagcatcaggtcgaggtagtgcttctgaacaccaagattgcaacggcaaaagcgcgtcaggtcgtttggcaagggcactacgaccagatgaccccccattggatggcgacgatgcggacgatgaaggtaatttgtccaagggggagcgcgtccgtgcctggattcgggccagactaccagcatgctgtctcgagagagacagctggtcagcgtacattttcccacctcagagccggttcaggcttctgtgccacaggatcattacgcacaaaatgttcgatcacgtagtattggtaattattttcctcaactgtataactattgccatggaaagaccgaagattgacccccactcagccgaacgcatcttcctgacgctgtccaattacatctttaccgctgtcttcttggccgaaatgaccgttaaggtagtcgcccttgggtggtgttttggggagcaagcctatcttaggtcttcctggaatgtgctggacgggctattggtcctgatatcagtaatagacatacttgtgagtatggtctccgactcaggcaccaaaattctgggcatgcttagggtactgcggttgctcagaacactgaggcctttacgcgtgattagcagagcgcaggggttgaagctagtagtggagaccttgatgagtagcctgaagccaatcggtaatattgtggtaatttgctgtgccttttttataatcttcggaatattgggcgttcagcttttcaagggaaaattctttgtctgtcagggagaagataccaggaatatcacaaacaagagcgactgtgccgaggcttcctatcgatgggtgcgacacaaatacaatttcgataatctgggacaggcacttatgagccttttcgtcctcgccagtaaagacggatgggtcgatataatgtatgacgggctggacgctgtgggtgtggatcagcagccaatcatgaaccataatccctggatgctgctatatttcatctcttttctgctgatagtggcatttttcgtgctgaacatgtttgttggggtggtggtggagaattttcacaaatgcaggcagcatcaggaggaggaggaggcccggcgtcgggaggaaaaacgattgagaaggctcgaaaagaaaaggcgcagcaaagagaaacagatggcagaagcgcaatgcaagccctattatagcgactactctcgcttccggctactggtgcatcatttgtgtaccagtcactacctggacctgtttattactggcgtgatcgggctcaatgtagtgactatggccatggagcactaccaacaacctcaaatccttgacgaggctcttaaaatctgcaattacatcttcactgtcatcttcgtccttgaaagcgtgttcaaactcgtcgcctttggattccgacggttcttccaggataggtggaaccaattggaccttgcaatcgtgttactgtcgatcatggggatcacgcttgaggagatagaagtgaatgcctccctgccaataaaccctactattatcagaataatgcgcgtgctgagaattgctagagtgctcaagctgctgaagatggcggtgggaatgagggctctgctagacactgttatgcaggcgctccctcaggtgggcaacctaggtctgctgtttatgttgttattctttatattcgccgcgttgggagttgaactctttggagatttagagtgcgatgaaacccatccgtgtgagggattgggaaggcacgccacctttcggaactttggaatggcattcttgactctctttagagtaagtaccggtgacaactggaatggaattatgaaagatactttacgggactgtgatcaggagtcaacttgctacaacactgtgatcagtcctatctacttcgtttcattcgtattgaccgctcaattcgtactggtcaacgtggtaatcgccgttctgatgaagcacctggaagaaagtaataaggaagccaaagaagaggcagaactcgaagccgagttagaactcgagatgaaaactctctcaccacaaccccactcccccctgggttcccccttcctctggcctggagtcgagggaccagatagtccggattcccccaagccaggcgcacttcatcccgccgctcacgcaaggtccgcgtctcacttcagcttggaacaccccacaatgcagcctcatcccactgagctgcctgggccagacctgctcacagtccgcaagtcgggcgtgtctcgtacacactcgctgccaaatgactcttacatgtgtcgacatggctctaccgccgagggccccttgggccaccgcggctgggggctgcctaaggcccaaagcgggtccgttctgtcggtccactcccaacctgcagatactagttacattctccagcttccaaaagatgcaccgcacctccttcaaccccatagtgcccctacctggggcacgatccctaagctgccaccaccgggcagatcacctctcgcacagagacctcttcgccggcaggccgccatccgcaccgattctctggacgttcagggcctcggaagccgcgaagacttgcttgctgaagaagagcctccctctccacgcgacttgaagaagtgctatagcgtggaagcccaaagctgccagagacgcccaacctcttggctcgatgaacagaggcgccattcaatagctgtgtcgtgccttgacagcgggtcacagccacatttaggcaccgatccatctaacttgggaggacaacctctcggcgggccgggaagcaggcctaaaaaaaagctctccccgccttcaattaccatcgacccacccgaatctcagggcccccgcacaccgcccagccccggaatatgcctgcggcgcagggccccttcgagcgacagcaaggatccacttgcctcaggcccaccagactcaatggccgccagcccatcacctaaaaaagatgttcttagtctgtcaggtctgagttcagaccccgccgatttggatccatag

SEQ ID NO: 40711 - DNA, 6897 bp, Artificial Sequence
  Description of Artificial Sequence: Synthetic coding sequence
atggacgaggaggaggacggcgccggcgccgaggagagcggccagcctcgtagcttcatgagactgaatgacctgtcaggagctggaggccgccccgggccaggaagtgccgaaaaagatccaggctcagctgactccgaggccgaggggctcccttacccagcactcgcccctgtcgttttcttctacctgagtcaggacagtaggccccgctcctggtgtcttcggactgtctgtaacccctggtttgagcgcatctcgatgttggtgatactattgaactgtgtaacactgggaatgttccgcccttgtgaagacattgcctgcgattcccagagatgccgcatccttcaagcattcgacgatttcatctttgccttttttgccgtcgagatggtagtcaagatggtggctctggggatctttggcaagaagtgctatttgggcgatacctggaatcgactggacttctttatcgtgattgccggtatgctcgagtactccctggacctgcagaacgtttccttcagcgcagtgcgcaccgtgcgggtgctccggccccttcgggcgatcaacagggtccctagtatgcggatcctggtcactctgctccttgacactttgcccatgctcggcaacgtgttgctgctttgcttctttgtattctttatatttggaatagtcggcgtccagctgtgggctgggttactgaggaatcggtgtttcctgcctgagaacttctcactcccactgagcgttgatctggagagatattatcagactgagaatgaggacgagagcccgttcatttgctcccaaccgcgggagaatggcatgaggtcctgccgttctgtgcctaccctgcgcggtgacggaggggggggtcctccctgtggcctggactatgaggcttacaattcatcctcgaacacaacctgtgttaattggaatcagtattacacaaactgctccgctggggaacacaacccctttaaaggcgccataaattttgacaatatagggtatgcctggattgctatcttccaagttatcaccctggaaggctgggtcgacatcatgtattttgtgatggatgcccacagtttctacaattttatctactttattctgctgatcatcgtgggctcattttttatgataaatctatgtctcgtcgtcatagccacgcaatttagcgagacaaagcagagggagtcacaattgatgagagagcagcgcgttcggtttttgtccaatgctagtactcttgctagcttttctgagcctgggtcctgctatgaagagctgcttaagtacttagtctacatactccgcaaggccgcacgccgccttgcgcaggtttcgcgcgccgccggagtccgggttggattgcttagctcacctgccccacttgggggacaagagacccagcctagttcaagctgctcacgcagccacaggcggttgagcgtgcatcacctggtgcaccaccaccaccatcaccaccatcattatcatctgggtaacggtacactccgagcccctcgtgcgtctccagagatacaggatagagatgcgaacggatcgaggaggctgatgctacccccgccgtcaactcccgccctgtctggagcacctccaggaggtgcagagtcagtgcattctttttaccacgccgattgccatctcgaacctgttcggtgccaggctccgccacccaggagccccagcgaagcatcaggccgcactgtggggtccggcaaggtttaccctaccgtgcacacatcaccaccccctgagacattgaaagaaaaggccctggtcgaggtggccgcatcgtcaggaccgcccacactgacatctctgaacattccgccagggccctactcttcaatgcataagctcctcgaaacgcagtcaacaggggcttgccagtctagctgcaagataagtagcccatgcctaaaggcggattctggcgcatgcggtcccgattcttgtccctactgcgctcgcgcaggtgccggcgaagtcgagctggccgatagggagatgcctgactcagactctgaggctgtctatgagtttacgcaagacgcccagcactctgatctgcgagaccctcatagcagacgccagcgctcgctgggaccagacgccgagccttcttccgttctagccttttggcgcctaatttgtgatacatttcggaaaatcgtggattccaaatactttggccgggggatcatgatcgcaatactggtcaacactctgtccatgggcatagagtaccatgaacaacctgaagaactgacaaatgcactcgagatctccaacattgtctttacatccctcttcgcactggaaatgctcctcaagttgttagtgtacgggccattcgggtacattaaaaatccatataacatattcgacggcgtgatagtggtcatatctgtttgggaaatcgtgggacagcaaggggggggtctatcagtcctgcggacctttcggctgatgagggtgctcaaacttgtccgtttcctgccagccctgcagagacagcttgtcgtactcatgaaaacgatggacaatgttgcgacattttgcatgctgctgatgctctttatcttcatcttcagcatcctagggatgcacctgttcggctgtaagtttgcctctgaacgtgatggtgacactcttccagatagaaaaaacttcgacagccttctatgggccatagtgacagtattccaaatcttaacacaagaggactggaacaaagtgctatacaacggcatggcttctacctccagctgggctgcactatacttcatagctctgatgaccttcgggaactatgtgctgttcaacctgctagtcgcaatccttgtggagggattccaggctgaaggggacgcaaataagagcgaaagcgagcctgatttcttctccccctccctggatggagacggggacagaaaaaagtgtctggcccttgtgtccctgggagaacatccagagcttaggaagtccctcctgccacctcttatcattcacacagccgctactccaatgtcgctaccgaaaagtacatcaaccggcctcggagaggcactggggccagctagtcgcaggacatcatcgagcgggtctgccgagcctggcgcagcccacgaaatgaaatcgccaccctccgcccgttctagtcctcattcgccctggtccgccgccagttcgtggacatccagaaggagttctagaaattcactgggcagggccccatctctcaagcgccgctcccccagcggcgagcggagaagcttgctcagcggggaaggacaggaatctcaggacgaagaggagtcaagtgaggaggagagagcctctccagccggcagcgaccacagacatagggggtctttagagcgcgaagccaaatcctctttcgatctgccggatacactgcaagttccagggcttcaccggaccgcaagcggccggggaagcgctagtgaacaccaggattgtaatggcaagagcgcttccggccgcttggctcgtgctttgagacccgatgatcctccactcgatggagatgatgcggacgatgaagggaacttatcaaagggagagagggtacgcgcctggatcagggcgagacttccggcctgctgcttggagagggacagctggagcgcctacattttcccacctcagagccggttcaggctgttatgccaccggatcattacccataagatgttcgatcacgtggttctcgtgattatctttttgaactgcatcactattgcgatggaacgtccgaaaatcgacccccattccgctgaaaggatcttcttgactctttccaactacatcttcacagcagtatttctcgccgagatgacagtgaaggtggtcgccctcggctggtgcttcggagaacaggcctaccttagatcgagctggaacgtgctggatggcctattggtgttaatctctgttattgacatcttggtgagtatggtctccgattcgggaacgaagattctgggcatgctgcgcgtgctgcgtctgcttaggactctacgcccacttcgagtgattagccgagctcaggggttaaaactcgtggtcgaaaccctgatgagcagccttaagccaattggaaatattgtggtcatttgttgtgcctttttcattatattcggtattctcggtgtgcagctgttcaaagggaagttttttgtgtgtcagggggaagatacccgtaatatcactaataagtctgactgcgccgaggcctcatatcgctgggtgaggcataaatacaactttgacaatttagggcaggcccttatgagccttttcgtattggcgagcaaagatggctgggtggacatcatgtatgacggactggacgccgtgggggtagaccagcagcctatcatgaaccataacccatggatgcttctctacttcatcagctttctcttgattgtcgcattcttcgtattgaacatgtttgtgggggtggtggtggagaacttccataagtgccgccagcaccaggaggaagaagaggcacgccgccgcgaggagaagaggcttcgcagattggagaagaaaagacggtcgaaagaaaaacagatggcagaggctcagtgtaaaccatactactcagactattcaagatttcgtttgttagtccaccacttatgtacatcgcactacctggatttgttcatcaccggcgtcattgggttgaatgtcgtaacaatggccatggaacactatcagcagcctcagatcctggacgaagctctcaagatatgtaattatatctttacagttatcttcgtgctggaatccgtttttaaactggtggctttcgggtttagacgattctttcaggaccgctggaatcaactggacttagctattgttctgctgtccatcatgggaatcaccttggaagaaatcgaagtgaatgcctccctgccgataaacccaactattataaggatcatgcgggtgctgcggattgctagagtgctgaagcttctgaagatggcagtaggtatgagggcactattggacactgtcatgcaggccctgccacaggtgggcaatctcgggttgttatttatgctgttgtttttcattttcgcagcattgggagtggagctattcggtgatctggagtgtgacgagacgcatccttgcgagggcctcggtcgccatgcgacctttagaaactttggcatggcatttctaaccctctttcgtgtgtccaccggcgacaactggaacgggattatgaaagatacccttcgagattgcgaccaggaaagcacatgttacaacactgtgatcagtccaatctatttcgtgagttttgtgctgacagctcagttcgtcttggtcaacgtggtgatcgctgtcctcatgaagcatctggaggagtccaataaggaggccaaagaggaagcggaattagaagcggagctggaattggagatgaagaccctgagcccacagcctcactcacccttaggatcccctttcctctggccaggcgtcgaggggccagactctccagatagtcccaaacctggtgccttgcatcccgctgcacatgcaagaagcgcctctcacttctccttagaacatccaaccgatcgccaattattcgacactatatcgctgctgattcaggggtccttggaatgggagctgaagctcatggatgagctcgcaggtcctggcggccagccttccgcctttccttccgcgccaagtctggggggctcagatcctcaaatgcagccacaccctacagaactccccgggccagatctattgaccgttcggaagtccggggtgtcccgtacgcattcgcttcccaatgacagctatatgtgcagacatggcagcacggccgagggacccctcggacacaggggatggggcttaccgaaagcacaaagtggatccgttctctcggtccattcacaacccgccgacactagttacatcctacagctccctaaagatgcaccccacttgcttcagccacattcagctcctacttggggtactatcccaaagttgccgccccccgggcggagtcctctggcccagaggccactccgcagacaggccgccatacggacagactcactcgacgttcagggactgggctcccgggaggacctgctcgccgaggtgagtggcccgagcccaccactggcccgggcctattcattttggggacagtcctcgacccaggcgcagcaacacagtaggtcccattctaagatctctaagcatatgactcctcctgcaccttgcccggggcctgaaccgaactggggcaaggggccacccgaaacaaggagctctctggagctggacactgagctctcttggattagcggggacctgcttcccccgggcggtcaggaggaacctccaagcccccgcgaccttaagaaatgttattctgtggaagcccagtcttgccaaaggcgcccaacaagctggcttgacgagcagcggcgccacagtatcgcagttagttgcctcgactctggtagccaacctcacctgggcacggaccctagcaacctgggcggccagccgctcggaggtccgggaagcagacccaagaagaagctcagtcctccgtctataaccatcgatccccccgagagccagggtccaaggactccgcctagcccaggcatctgcttgagacgccgggctcccagctcggactctaaggaccctctagccagtggcccgcctgactccatggcagcttctccatccccgaagaaagacgtactgtccctgagtggtctctcttcagatcccgcggacctggacccttag

SEQ ID NO: 40712 - DNA, 6699 bp, Artificial Sequence
  Description of Artificial Sequence: Synthetic coding sequence
atggacgaggaggaggacggcgccggcgccgaggagagcggccagcccaggagcttcatgcgactaaatgacctttccggggctgggggaagacccgggcctgggagcgcagaaaaggatccaggttccgcagacagcgaagcggaggggctgccatacccagcactagcccctgtcgtattcttctacctctcccaggactcccgcccccgaagttggtgtctgaggaccgtttgtaacccatggttcgaacggatttcgatgctggttatcctcctaaattgcgtgaccctggggatgttccgtccttgtgaagatatcgcatgcgatagccagcgttgcaggatattacaggcctttgatgactttatctttgccttttttgccgttgaaatggtagtcaaaatggtggccctgggaatctttggaaagaagtgctatcttggcgatacctggaataggcttgacttttttatcgttattgctggcatgctagagtattcgctggatcttcagaatgtgtctttcagcgctgtccggactgtccgcgtattgcggcccttgagagccataaacagagtaccatcgatgaggatcttggtgacgctgttgctcgatactctcccaatgctgggtaacgtacttctgctctgtttctttgtctttttcattttcggcatagtcggagtacagttgtgggctggattgttaagaaatagatgtttccttccagaaaatttctctttacccttgagcgtggacctggagcgttactatcaaaccgagaatgaggacgagtccccgtttatctgcagccagcctagggagaatggcatgcgatcctgcaggtccgtgcctaccttgcgaggtgatggcggcggaggcccgccttgcggtctggattacgaagcttacaactctagctccaacacgacgtgtgtgaactggaatcagtactacacaaactgttctgcaggcgaacacaaccccttcaagggagccatcaattttgacaacatcggatatgcttggatcgcaattttccaagtcataaccctcgaaggctgggtagacatcatgtatttcgtgatggacgcccattctttctacaacttcatttacttcatcctcctgatcattgtaggatccttcttcatgataaacctgtgccttgtcgtgatcgccactcaattttccgaaacaaagcagcgggaaagccagctgatgcgtgagcagagggttcggtttttgtctaatgcttctacgctagcttctttcagcgagccaggtagctgttatgaggagcttctgaagtatttggtgtatatcctgcggaaggccgcccggaggttggctcaggtctcccgcgcagccggcgtgagagttggactcctctcctctccagccccactgggtggccaggagacgcagccatcttccagttgcagcaggagccatcggagactgtctgttcaccacttagttcatcaccaccaccatcaccatcaccattaccacctaggaaatgggaccctgcgcgctcccagagcgtcacccgagattcaggatagagatgcaaatggcagccggaggcttatgttgcctcccccttcaacacccgccctttccggggctccacccggtggggccgagtccgtacactccttttatcacgccgattgccacttagaaccagtgagatgtcaggccccccctccccggtccccatctgaggcatctggtaggacagttggatcaggcaaggtttacccgacagtgcatacttccccgccgccagaaacgctcaaagaaaaggcgctcgtcgaggtggcagcgtcaagcgggccgcctacactgaccagtcttaacattcctcccggcccctacagctccatgcacaaactcttggagacgcagtctactggagcatgccagagcagctgtaaaatttcaagtccatgtcttaaggccgatagcggggcgtgtggtccagattcctgcccttattgcgcaagagccggagccggcgaggtggagctggctgacagggagatgccggattctgactctgaagcagtttacgaattcacgcaagacgcccaacacagcgacctgcgggacccccattcgaggcgccagcgcagtttaggcccagacgctgaaccgtcatcagtgctggccttctggcgattaatctgtgacacgttcagaaaaattgttgactctaaatactttggacgaggaataatgattgccatcttggtgaacaccctatcgatgggcattgagtaccatgagcagcctgaggagctcaccaacgccctcgaaataagcaatattgtttttacaagcttgtttgcgctggaaatgctgcttaagctgctggtctacggcccatttggttacatcaagaacccctacaatattttcgatggcgtgatagtggtgatctcagtctgggagattgtcggtcagcaagggggaggtctgtcagttctgcggacctttaggcttatgcgtgtactcaaacttgtgcggtttctgccggctctgcaaagacagctcgtggtactgatgaagacaatggataacgtagcgaccttctgtatgctgcttatgttgttcatattcatctttagtatcctgggcatgcacctttttggatgtaagttcgcttcagagcgtgacggggatacactccccgatcgtaagaattttgactctctgttgtgggccatcgtgaccgtgttccagattctcacccaggaagactggaataaggttttatacaacggcatggcgtcaacttccagctgggctgccctctatttcattgcattgatgacgtttggcaactacgtactgtttaacttgctcgtggccattctggtcgaagggttccaagccgaagagattagtaagcgagaggatgcctccggacaactgagttgtatccagcttcccgtggattcccaaggcggagacgctaataagtctgagtccgaacccgatttcttctctccttcactggatggcgacggagatcgaaaaaaatgcctggcgttagtttctttgggagaacaccccgaactgcgcaagtccctgctccctcccctgatcatccacactgctgccactcctatgtcactccccaaatccacttctacaggtctcggcgaggcactcggaccggcctcaaggaggacctctagttccgggtcggccgaacccggggcagcccatgaaatgaagagccccccgtccgccagatcctctccgcattcaccatggtcagcagcatcttcatggaccagccggcggtcgtcccgcaattctttaggacgtgcacccagtctcaagcgccgttctccaagcggggagcgaaggtctctcctgtcaggggaaggccaggagtcccaagatgaagaggaaagcagtgaagaggaaagagcatcacctgccggctctgatcatcgacaccgaggcagcctcgagcgggaagccaagagcagtttcgacttgcctgatacgcttcaggtgcctggactccacaggaccgctagtggaagagggagcgcttcagagcatcaggactgtaatggaaaatccgcgagcgggaggctcgcaagggcacttagacctgacgacccccccctagatggcgatgacgcagacgacgaaggcaacctctcgaagggagaaagagtgcgtgcatggattagggctcgtttaccagcttgctgtctcgagcgggattcatggagcgcatatatattcccgcctcagtcaaggtttaggttgctttgccatcgcatcattacccacaaaatgttcgaccatgtcgttttggtgatcatctttctcaactgcatcaccatcgcaatggaaaggccaaaaatagatccccatagcgccgagcggattttcctgacacttagcaactacatatttacagcggtcttcctcgccgaaatgacagtgaaagtggtggccttgggctggtgcttcggcgaacaggcctatttgcgatcttcctggaacgttttagacggcctcctggttctcatttctgtgatcgacatactcgtgagtatggtttctgactccggtaccaaaatcctcggaatgctgagggtgctacgtctgctgcgcacactgcgcccactaagagttatttctcgcgctcagggactaaaattggtcgtggagactcttatgtcaagtctgaagcctatcggaaatatcgtagttatctgctgcgccttctttattatatttggaattttgggcgtccagttgtttaagggcaaattttttgtctgtcaaggggaggatactaggaacatcaccaacaaaagcgactgcgctgaggctagttatcgttgggttcgtcacaagtacaattttgacaacctaggccaggcgctaatgagtctgtttgttttagctagtaaggatggatgggtggatattatgtacgacggcctggacgccgttggggtggatcaacagaactttcacaaatgcagacagcaccaggaggaagaggaggctcgtaggagagaggaaaagaggctaaggagactggaaaagaaacgacggaaagctcaatgtaagccatattactcagactattctagatttcgactccttgtacatcatctgtgtacgtcccactacctggatctgtttattactggtgtgataggcttgaacgttgtaaccatggccatggagcactaccagcagccgcagatcctggatgaggccttaaaaatttgtaattatatatttaccgtgatatttgtccttgagtcggtgttcaagctggtcgcttttgggtttcgaagattcttccaggacaggtggaaccagctcgaccttgctatcgtattgctgtctattatgggaatcacgctggaggagattgaggtcaacgcaagcctgccaataaacccaactatcatcagaatcatgagggtgctcaggatcgccagggttctgaagctcctgaagatggccgtcgggatgagagctcttttagacaccgtgatgcaggctctgccacaggtcggcaacttgggcctcctgttcatgttgctgtttttcatcttcgccgctctaggggttgagttgttcggagaccttgagtgcgatgaaacccatccctgcgaagggttggggagacacgctacctttcgcaacttcggaatggctttcctgactctgtttagggtatctactggagacaattggaacggaatcatgaaggatactctgagagattgcgaccaggagtcgacttgctataacaccgtgattagccccatttatttcgtctcctttgttctgaccgctcagttcgtgctcgtcaacgtcgttatcgcagtgttgatgaagcacctcgaggaaagcaataaagaagcaaaagaagaggcagagctggaagccgagttggagcttgagatgaaaaccctctctcctcaacctcactcacctttaggtagcccttttctctggcctggagtagagggcccagatagccctgactcacccaaacctggcgccttgcatcccgccgcccacgctcggagcgctagtcatttttctctggagcatccgactatgcagccgcatcccacggagctgccaggaccggacctcctgactgtgcggaaatccggggtttctcgcactcattcactccccaatgactcatatatgtgccgtcacgggagcacagctgaggggcctcttggtcatagggggtgggggctccccaaggctcagtctggcagcgttttgtccgtccattcccagcctgccgatacaagttacattctccagctgccaaaggatgcgccgcatctgttacagccccactcagcgcctacttgggggacaatacccaagcttccccccccggggcgcagtccacttgcgcagaggccattgcgaagacaggccgctattagaaccgattctctggacgttcaaggcctgggaagtagagaagatctgctcgccgaggtttctggcccaagtcctcccctcgcacgcgcgtactctttttggggacaaagtagcacccaagcccagcagcattcccgatcccacagcaaaataagcaagcatatgaccccccccgcaccttgtccaggcccagagccaaattggggcaaaggcccaccagagactaggagctcccttgaactcgatacggagctgtcttggatttcaggcgacctgctgccgcccggagggcaggaagagcctccgagtcccagggatctaaagaaatgctatagtgtggaagcgcaatcatgtcagaggagacctacgtcgtggctcgacgaacagaggagacatagtatcgcagtaagctgcctggactcagggagtcaaccacatctgggaaccgatcctagcaacctagggggtcagcccttaggaggcccaggaagccggcccaagaaaaagctgagccctccatccataacgatcgatcccccggagagtcaagggccccggacacccccatctccgggaatttgcctgcggcgtagagccccttcctcggattctaaggatccccttgcctcaggcccacccgattcaatggccgcatctccatcgcccaaaaaagatgtcctgagcctctctgggctgagtagcgatcccgctgacctcgacccttag

SEQ ID NO: 40713 - DNA, 5277 bp, Artificial Sequence
  Description of Artificial Sequence: Synthetic coding sequence
atggacgaggaggaggacggcgccggcgccgaggagagcggccagccaaggagcttcatgcgcctcaatgacctcagtggagccggggggcgccctggacccgggtcagccgagaaagacccaggatctgcggattcggaagccgaggggctgccatatcctgccctggcccccgtagtgttcttctacctctcccaggatagtagacctcggagttggtgcctccgaaccgtgtgcaacccttggttcgagcggattagcatgctagtgattttgcttaattgtgtaacgctggggatgttccggccctgcgaggatatcgcctgtgattctcaacgctgcagaatcttgcaggcttttgatgactttatatttgcgttctttgccgtcgagatggtggttaagatggtcgcgttgggaatattcggaaaaaagtgttacctcggcgacacgtggaataggctcgactttttcattgtgatcgccggaatgttagagtattctctagacttgcagaatgtgtctttctctgcagtgcgcacggtgagagtcctgagaccgctgcgggcgataaacagagtcccctctatgcgcatactggttaccctgctgctcgatactctacctatgctgggaaacgtcttactactgtgctttttcgttttcttcattttcggtattgtcggagtccagctgtgggctggcctcctgcggaaccgctgctttctccctgagaacttctcactgccgctgagcgtggacctcgagaggtattatcagacagagaacgaagatgagtccccgttcatctgttcccagcctagagagaacggaatgagatcctgccggagtgttcccacgctgcggggtgacggcggcgggggaccaccttgcgggctggattacgaagcgtataacagctctagtaatactacatgtgtcaactggaatcaatactacaccaattgcagcgcaggcgaacacaaccccttcaaaggggcgatcaacttcgataacataggttatgcttggatcgccattttccaggttatcacactcgaggggtgggttgacattatgtacttcgtgatggacgcccattctttctacaattttatctacttcattctgctgatcatcgtcggcagcttttttatgatcaatctctgtctcgtagtcatcgctacccaattctcggaaaccaagcagagggaatcgcaactgatgcgagagcagcgcgttcgcttcctgagcaatgcatctacactggctagtttttcagagcctggcagctgttacgaggagcttctaaagtacctcgtttatattctccgaaaggccgctaggcgattggctcaggtcagccgcgctgccggagttcgggtgggcttattatcaagcccagcccctctgggcgggcaagagacccaacccagcagttcatgctctcgttcccatcgcaggttgagtgtgcaccatctcgtgcatcaccatcaccatcatcatcaccactatcacctgggaaacgggacgctgcgagcccctagggcctcccctgaaattcaggatcgagacgccaacggcagtaggcggcttatgctgcctccaccaagtacgcctgcgctctcaggggcccctccaggaggagccgagagcgtgcattctttttatcatgcggactgccacttagagcctgtaaggtgtcaagcaccacccccccggtcacctagcgaagcctctgggcgcacagtgggctccgggaaagtataccctacggtccatacgtccccgcctccagagactctaaaggagaaggccctggttgaagtcgccgcttcttcagggccccctactctcacctctcttaatatcccccccggaccctacagctcaatgcataagcttctggagacacagtctacaggggcctgccagtcatcttgcaagatctccagcccctgcctcaaggcagacagtggggcatgcgggcctgatagctgtccgtactgcgcgagggccggcgccggggaggtggaattagccgaccgggagatgccagacagcgattcggaggcggtttatgaatttactcaagacgcccagcacagcgacctccgggatcctcattcaaggaggcagaggagtctcggccccgatgcagagccctcatccgtacttgccttctggaggctgatctgtgataccttccggaaaattgttgactctaagtatttcggaagaggaatcatgattgcaatactcgttaatacgctgagtatgggtatagaataccacgaacagccagaagaactaacaaatgcactcgaaatcagtaacatagtcttcacatccttgtttgctctggaaatgctgctgaagctgcttgtctacgggcctttcggatacattaagaacccatataatattttcgatggcgtaatcgtggtgatatctgtgtgggaaatcgtcgggcagcagggtggcgggctctccgtgttgcgaactttccgccttatgagagtcctgaagttagtgaggtttctgccggctctgcagcggcagctggtcgtacttatgaagaccatggacaacgtcgcgaccttctgcatgcttctgatgctgtttattttcatcttctccatcctggggatgcatctgtttggctgtaagttcgcctccgaacgtgatggggacacgctgcccgatcgaaaaaattttgactctcttttatgggctattgttacggtctttcagatcctgacacaggaagattggaacaaggtgctgtataacgggatggctagcacttcgtcttgggccgctctgtactttatcgccttaatgaccttcggcaactacgttctcttcaacctgttggttgcaatcctggttgaaggttttcaggccgaggagatcagtaagcgggaggatgcctcagggcaactgagctgtatacagctgccagttgattctcaaggaggcgacgccaacaaaagcgaaagcgagcctgatttcttctccccaagcttggacggcgacggagaccgtaagaaatgcctggcattggtgtcattgggcgaacatccagagcttaggaagagtctacttcccccgttgataatccacacagccgccaccccaatgtcactgcctaagtctacatcaacagggctgggggaggcactagggccggccagcagaagaaccagctcctcaggttctgccgagcctggtgccgcacacgaaatgaagagccccccctccgcccggagtagcccacatagtccatggtccgcagcctcttcctggacatcgcggcggagtagcagaaactcactcgggcgggccccctctttaaagcggcggtccccctctggagagcggaggtcactcttatcaggggaaggacaggagtctcaggatgaggaagagtcctctgaagaggagcgggcctctccagcaggaagtgaccacaggcaccggggctctctggagcgcgaagccaaatcctccttcgatctgccagatacattgcaagtacccgggttacaccggactgcctccggccggggctctgcctctgagcaccaggattgcaacgggaagagcgcaagcggccgactggcacgcgccctgcggcccgacgacccccccttagacggtgatgatgcggatgacgagggcaatctcagcaaaggagaaagggtgcgtgcctggataagggctcggctgcctgcctgctgcctggaaagggattcatggtctgcttatatttttcccccccaatcaaggttccggctgctttgccatagaattatcacccataagatgttcgaccacgtagtcctggttattatcttccttaactgcatcacaatcgctatggaaagacccaagattgacccgcactcggccgaaaggatcttcctaacactgagtaattatattttcactgcagtgttcctcgccgagatgactgtaaaagtggtggcactcgggtggtgttttggcgagcaggcctatctgcgctccagctggaatgtgctagacgggcttttggtgttgattagcgtgattgatattctcgtcagcatggttagtgattcaggcacaaagattctggggatgctgcgagtcctccgacttctcagaacactcaggcctctgagggtgatttcgagagcccagggcctgaaattggtggtggagactctcatgtcctctctcaaacctatagggaatatcgtggtaatctgctgcgctttcttcatcatttttggaattttgggagtccagttatttaagggcaagttttttgtgtgccagggagaagacacccgcaatattaccaataaatctgattgcgcagaagcatcttatcggtgggttcgccataagtataacttcgacaatctgggccaggcattgatgtcactgtttgtgctcgcttctaaagacgggtgggttgacatcatgtacgatggtctggatgccgtgggcgtggatcagcagccaatcatgaaccacaacccttggatgttgctctactttatctcctttctgctgatcgttgccttctttgtcctgaacatgttcgtgggggtggtagtggaaaattttcataaatgtcggcagcatcaggaggaagaagaagctcggcggagagaagagaagcgtttacgtcgactggaaaagaagaggcggaaggcccaatgtaagccgtattattctgactattctcgctttagacttctggtccaccacctgtgtacatcccactacctggatttgttcattaccggggttattggcctgaacgtggtgaccatggcaatggagcattatcagcagccacagatcttagacgaagccctgaagatctgtaactatatctttactgtgatattcgtcctcgagagcgttttcaaactcgttgccttcgggttccggaggttcttccaggatcgctggaatcagttagatctggcaatcgttctgctatcaatcatgggcattacactcgaagaaatcgaggtcaatgcctcgctgcctatcaatcccaccatcatccgcattatgcgcgttctcaggatagcaagggtcctgaagcttttaaagatggctgtgggcatgagggcactgctggacaccgtgatgcaggctctaccacagctatgggcatggtcaagcttggagacctggagcgttactcgacatactcctgtcagggcctgggcggtaatgcctccatttggtaccctggcatggccaagctag

SEQ ID NO: 40714 - DNA, 5241 bp, Artificial Sequence
  Description of Artificial Sequence: Synthetic coding sequence
atggacgaggaggaggacggcgccggcgccgaggagagcggccagcctaggagcttcatgagactcaatgaccttagtggagccggcgggaggcccggccctggaagtgctgaaaaagatcccggaagcgcagactcagaggcagaaggtctgccctatcccgccctggcccctgtggtgttcttctatctgtcacaggacagccgaccacgttcatggtgcctccggacagtttgcaatccgtggtttgagcgcatctccatgctggtaatcttgttgaactgtgttaccctgggtatgttccgcccctgcgaagatatagcatgcgacagccagcgatgcagaattcttcaagctttcgatgatttcatcttcgcctttttcgcagttgagatggttgtaaaaatggtcgctttgggaatcttcgggaagaaatgctaccttggggatacttggaacaggcttgactttttcatcgtgatcgcgggcatgctggaatatagtttagatttgcagaacgtgtctttttctgccgtcaggaccgttcgggtgcttcggcccctgagggcaatcaatcgcgtaccgtctatgcgcatcctggtcactctccttctagatactctcccaatgctgggtaacgttctgctcctgtgtttttttgtgttttttatttttggcattgtgggcgtgcagctgtgggcaggactgctgcggaaccggtgctttctcccagagaacttcagcctcccgctgagcgtagatctggagaggtactatcaaaccgaaaacgaagacgaaagtcccttcatctgctcccagccccgcgaaaacggaatgaggtcttgtaggagcgtgcctacactgcgaggcgacggtgggggggggcctccctgcggcctcgactatgaggcctacaacagcagctctaacactacgtgtgtgaattggaaccagtattacacaaactgtagcgcgggagagcacaatccattcaaaggcgcgattaactttgataatatcggatacgcttggatagcaatattccaggtgatcacactcgagggctgggttgatataatgtacttcgtgatggatgcgcactccttctacaacttcatctatttcatactcctgataattgtcggtagcttttttatgattaacctctgcctcgtagtgattgcaacgcagttctcagagactaagcagagagagagccagctcatgagagaacagcgagtgcggttcctgtcaaatgccagtactttggcctcattctcagagccggggtcctgttacgaggagctgcttaagtacttggtttacatactgaggaaggcagcccgccgtttggcccaagtaagccgtgctgccggagttagagtggggctcctctcctccccggcaccactgggtgggcaggagacccagccgtcgtctagttgttcaaggtcacaccgtagactgtctgtccaccacctcgtccatcaccatcaccaccatcaccatcattaccatttagggaacggcacgcttcgggccccccgggctagtcctgagatccaggacagagacgcaaacggatcgaggcgtctgatgctgccgccaccttccacgcctgccctgagcggcgccccacccggtggggccgaatctgtccactcattttaccatgcagactgccacctcgaaccagttcgctgccaggctcctccaccaaggagtcccagcgaggcttccgggaggacagttggcagtgggaaggtctatcccactgtgcacacctcacctccgcccgagaccctgaaggagaaggctctcgtggaggtggccgcaagtagcgggcctcctaccttgaccagtttgaatatacctccaggaccctactcttctatgcacaagcttcttgagacccagagcacgggcgcttgtcagtcttcatgcaagatcagtagcccttgcctgaaggctgatagtggagcgtgtggtccagacagctgcccttattgcgcccgtgctggggccggcgaggtggagctggcggacagagagatgcccgactctgactccgaggccgtgtatgaattcacccaggatgcccaacattccgatctgagagaccctcactctcggagacagcgtagcttaggacctgatgctgaaccctcgtcagtactagccttttggcggctgatatgtgatacatttcgcaaaatcgtggatagcaagtattttggaagggggataatgatcgctatcctggtcaatacactttcgatgggtatcgagtaccacgagcagcctgaggagctgaccaatgctctggaaatttctaatatcgtgttcacaagcctctttgcactcgagatgctattaaagctgctggtgtacgggcctttcgggtatatcaaaaacccctataacatttttgacggcgttattgtagtcattagcgtctgggagatagtgggtcagcaaggcggcggattgtcagtcctgagaacttttcgactcatgagggtcttgaagcttgtcaggttcttgccggcccttcagcggcagttagttgtgctcatgaagactatggataacgtggccaccttctgtatgcttctcatgttgttcatcttcattttttccatcctggggatgcatctctttggctgcaagtttgcctctgaacgggatggcgataccctgcccgatcggaagaacttcgactcattgctgtgggccatagtcacagtattccaaattctgacccaggaggactggaacaaggttctgtacaatggcatggcgagcacctcttcttgggcggctctgtactttatcgcgcttatgacctttggtaactatgttctgttcaacctgctggtcgcaattctagtggaagggttccaagccgagggggacgccaataagtcagaaagtgagcccgacttcttcagcccttccttagacggtgatggcgatcgaaagaaatgcttggctttggttagcctcggtgaacaccctgagttaaggaagagtttactcccaccgctgattatccacaccgctgcaacccccatgtcgctgcccaagtcaacatctaccgggttgggcgaggcgctgggacccgcaagcaggagaactagcagctcgggttccgccgaacccggcgctgcccacgagatgaaaagtccaccctcggcacgctcaagccctcattcaccttggtcagctgcgagtagctggaccagccggcgcagctcccggaattcactgggccgggcgccatcactgaaacgccgatctcccagcggggaaagacggtctctgctgtcaggagaggggcaagagagtcaggatgaggaggaatctagtgaagaggagcgagcatctccagcaggcagcgatcaccggcataggggctccctggagagagaggctaaatccagctttgacctacccgatactcttcaggtgcccggattgcaccgtaccgcttccggccgtgggagcgcatctgaacaccaggactgcaacggcaagagtgctagtggaaggctggcccgcgcgttgcggccagacgatcctcctttagacggcgatgacgcagacgatgagggtaatctttcgaagggagaacgagtgcgggcctggatcagggctaggctacccgcctgttgcctcgagagggacagttggtcagcctatattttccccccacagagtcggtttaggttgctgtgtcatcggatcattacccataagatgttcgaccacgttgtgcttgtcattatctttctgaattgcattactatcgcaatggaacgacctaaaatcgatccacatagcgccgagagaattttccttaccctgtcgaactatatcttcactgctgtgtttcttgcggagatgacggttaaggtggtcgcactcggttggtgcttcggggagcaggcttacctccggtcatcatggaatgtactggacggcctactggtactgattagtgtgatcgacatactggtgtcaatggtatcagactcaggcacaaagattctggggatgctgagagtgctgcgcctgctgcgaactttacggccacttcgggtgattagccgcgcccaaggcctgaagctggtggtggaaaccttgatgtcctcactgaagccaatcggaaatatcgtggttatatgctgcgctttctttatcattttcggtattttgggggttcaactgtttaagggcaagttctttgtctgtcagggagaggacacccgaaacatcacgaataaatctgactgcgctgaggctagttaccggtgggtcagacacaagtacaatttcgataatctgggtcaagcactcatgtccctgttcgtgctcgcctccaaagacgggtgggtagacatcatgtacgacggtttggacgctgttggcgttgaccagcagcccattatgaaccataacccctggatgctgctgtactttatctcatttctgttgatcgtggccttcttcgtcctcaatatgtttgtgggcgtcgtggtggaaaatttccacaagtgtaggcagcatcaagaggaagaagaggcgcgccgtcgtgaggagaagcgcctgcgtcgcctggagaaaaagcggcggaatttaatgctggacgacgtgatcgcaagcgggtcttccgcaagcgctgcctcagaagcccagtgtaaaccgtattatagcgactactctcgctttagactgctggtgcaccacctctgtacatcacattatttagatctctttatcaccggggtgattggactgaacgtggtaaccatggccatggaacactatcagcagccacagattttagatgaagcgttaaagatttgcaactatatctttactgtaatcttcgtgctggagtcagttttcaaactcgttgccttcgggttccgaaggtttttccaagatcggtggaaccagctggatttggcaattgtgctcctctctatcatggggatcacactagaagagattgaagtcaacgctagcctaccaatcaatcccaccatcatccgtatcatgcgggttctgcgtattgcccgagtgttaaaactcctgaagatggctgttgggatgcgggcgctcctggatacactctgggcctggtctagcctcgagacctggtccgtgacacgccacacaccagtaagagcctgggcagtgatgcctccctttggtacattagcctggccctcttag

SEQ ID NO: 40715 - DNA, 6822 bp, Artificial Sequence
  Description of Artificial Sequence: Synthetic coding sequence
atggacgaggaggaggacggcgccggcgccgaggagagcggccagccaaggagcttcatgcggctaaatgacctgagcggtgcgggcggacgccccggcccaggcagcgcagagaaggacccggggtcagccgattccgaggcagaggggctgccctacccagcgctggctccagtggtgtttttttacctctcccaggatagtagacctcggagctggtgtctgcgaacagtttgtaacccctggtttgaacggatttctatgttggttatcctcctcaattgtgtgacattaggcatgtttcggccatgtgaggatatcgcctgcgacagccagcggtgtcgcattttgcaagcattcgatgacttcattttcgccttcttcgcagtggaaatggtcgtgaaaatggtggctctgggtatcttcgggaagaagtgctatctgggagatacttggaaccggctagattttttcatcgtgattgctggcatgttagaatatagcctagacctgcagaacgtctccttttccgccgtgaggaccgtgcgcgtgctgcggcccttaagagctatcaacagggtcccttcaatgcggattctcgtcacactgctgctggacactcttccaatgctgggaaatgttctgctgctgtgcttcttcgtattctttatcttcggaatcgtaggcgtgcaactgtgggcgggtctactgagaaaccgatgcttcttacccgaaaatttctccctaccactgagtgtggacctggaacggtactatcagacagagaacgaagacgagtcccccttcatctgttcacaaccccgagagaacgggatgaggagctgtcggagcgtgcctacactgaggggggacggggggggaggacctccgtgcgggttggattatgaggcctataactcttcctctaataccacatgtgtgaattggaaccagtactataccaactgtagcgccggtgagcataacccctttaagggagcgataaacttcgacaacatcggctatgcatggatcgccatttttcaggtgatcacactggaaggatgggtggacataatgtattttgtgatggatgcacactctttttacaatttcatctatttcatactgctgatcatcgtgggatccttcttcatgatcaatctgtgtctcgtggtcattgctacccaattttctgagaccaagcagagagagtcgcagttgatgcgtgaacagcgagttagattcttgtctaatgcctctactctagcctctttctccgaacccggaagctgttacgaggagctcctgaaataccttgtgtacattcttagaaaggccgcaaggagactggctcaagttagccgagccgccggggtcagggtgggcctactcagcagccctgcccccttgggcggtcaggagacccagccctccagctcatgcagcagatcgcataggaggctgtctgtccatcatttggtgcatcatcatcaccaccaccaccaccactaccaccttgggaacggaactctcagggctcctcgggcctcccctgagatccaggatagggacgcgaatggcagcagacgcctgatgctgccgcccccatctactccggccttgtctggcgcgccaccaggtggcgcagagtccgtccattctttttaccatgccgactgtcacctagaacctgtcaggtgccaggctcccccacctagaagcccctctgaggcatctgggaggaccgtaggttctgggaaagtgtatccaacggtgcacactagcccacccccagaaacattaaaggaaaaagccctcgttgaggtggcggcctcctctggacctcccacccttacaagcttgaatattcctcccgggccttactctagcatgcataaactgctcgaaactcagagcactggcgcgtgccagtccagctgtaaaatctccagcccttgcctgaaagcggactccggagcatgtgggccggactcctgtccatattgtgcgcgagctggggcgggagaagttgagctggctgaccgcgagatgccggactccgacagcgaggccgtctacgaattcacgcaagacgcgcaacattccgacttgcgagatccacattcccgccggcagagatccttaggtcccgatgccgagcctagctctgtcttagctttttggaggctcatctgcgacacatttaggaagattgtagactctaaatacttcggtcggggtatcatgattgccatactggtcaatacgctcagtatgggaatcgaataccacgaacagccagaggagctgaccaatgcattagagatatccaacatagtttttacttcattattcgctctggagatgctgctcaaattgttggtctacggaccatttggctacataaagaatccctacaacatctttgatggcgttattgttgtgattagcgtatgggaaattgtgggacagcaaggcggcgggctgtctgtcctacggacatttaggctgatgcgggtgctcaaactggtaaggttcctccccgctctgcagagacagctagtagtcttaatgaagacaatggacaacgtggcaactttttgcatgttgctgatgttgtttatctttatcttctcaatactcgggatgcacctgtttggatgcaaattcgcatccgagagagacggagacaccctgccagaccgaaaaaactttgattcactgctgtgggcgatcgtgaccgtattccagattctgacacaagaggactggaataaagtgttgtacaatgggatggcctcaacaagtagctgggccgcactctattttatcgctctgatgactttcggtaattacgtcctttttaatttactggtggccatcctggtggagggttttcaggctgaggagatcagcaagcgagaggatgcctccggccagctcagctgtatacagctccctgtcgactcccagggaggtgatgcaaacaaaagcgagagcgagccagattttttcagcccaagcctggacggtgacggcgataggaagaagtgtctggcgctggtcagcctaggggaacatccagagctccggaagtctctcctgcctccattaattattcacaccgctgccacaccaatgtcgctacccaagtcaacatcgactgggctcggggaggccctcgggcctgcctcacgtagaaccagctcatccggctctgcagagcctggcgctgcacacgagatgaaaagcccccccagcgcccggtcaagcccccacagcccttggtcagcagcaagctcttggacaagccgccgttcatccaggaacagccttggccgggctccaagcctgaagcgccggtcaccgagcggtgaaaggcggtcgttgttgtcaggtgaaggacaagagtctcaggatgaggaggagagtagcgaggaagagcgggccagtccggcagggagtgatcacaggcatcgggggagcctcgaaagggaagcaaagtcctcatttgatctcccagatacccttcaggtcccggggttgcatagaaccgcttcaggaaggggcagcgccagcgagcaccaagactgtaatggtaagtcagcttcggggcggctagcccgcgcattaagacctgatgatcccccccttgatggggatgatgcagatgacgaggggaacctgtctaagggggagagggtgcgggcatggatacgagctaggctccccgcctgttgcttagaaagggactcctggtcagcatatatcttcccaccacagtcccggtttcgcctcctctgtcatagaatcataacacacaaaatgtttgatcacgtagtattagtcattattttcctcaactgtatcactattgccatggaaaggccgaaaatagacccccacagtgctgaacgtattttcctcactctgagtaactacatctttacagcagtctttctggcagaaatgactgtaaaagtcgtggccctaggatggtgctttggtgaacaggcctacttacgctcctcttggaacgttctggacgggctgctcgtgctgatctccgtgatcgatattcttgtgtctatggttagtgactctggcactaaaatcctggggatgttgagagtgcttcgcctgcttcgcacccttcggcccctacgggttatctccagagcccagggattgaagcttgtggtggagaccctcatgtcaagtctgaagcccatcggcaatatcgtggtgatttgttgtgcgttttttattatctttggtattctcggtgtgcagttgtttaaagggaaattttttgtttgtcagggcgaggacactcgaaatatcacaaacaaaagcgactgtgcggaagcctcatatagatgggtgaggcacaagtataattttgacaacctggggcaggcacttatgtctttgtttgtgttggccagcaaagacggatgggtggatattatgtacgatggcctggatgcagtgggcgtggaccagcagccgattatgaaccacaatccatggatgttgctttatttcatctcgtttctcttgatcgtcgcctttttcgtgctgaacatgtttgtaggagtcgtcgtggagaattttcataaatgccggcagcatcaagaagaagaggaggcgaggaggagggaggaaaagcgcttgcggcgactagaaaaaaagcgtaggagcaaggaaaagcagatggcagaagcccagtgcaaaccatattattcggactactctcgatttcgtctgctggtgcatcacctgtgcacctctcattatttagaccttttcataacaggcgtcattgggctgaatgtcgtgactatggcaatggagcattatcagcagccccagatcctcgacgaggcccttaagatttgcaattacattttcaccgtcatcttcgtgttggagtctgtgtttaagttggtcgcctttggattcagacgctttttccaggacagatggaaccagctagacctcgcgattgtgctcctgagcattatggggattactttagaagaaattgaggtgaacgcctccctgcccatcaatcctacaataattcggataatgcgggtgctgaggatcgcccgtgtcctcaagttactgaaaatggctgtagggatgagagctctgctggacacggtgatgcaggcgctcccccaggtgggaaacttgggcctgctgtttatgctgctgttcttcatttttgccgcactgggtgtggagttgttcggtgatctggagtgtgatgagactcacccttgtgaaggtctcgggagacacgccacttttaggaattttggaatggcctttctgacactgtttagagtcagcacaggtgacaattggaacggcattatgaaagatactttaagagattgcgatcaggaaagtacctgctataatacggttattagcccgatctacttcgtgagcttcgtgttaacagcgcagttcgtcctggtgaatgtggtaatagccgtgctgatgaaacacctggaggaaagtaacaaggaagctaaagaggaagcggagcttgaagccgaacttgaactcgaaatgaagacactgtctcctcaaccgcattctcctctgggatctcccttcctctggcctggagttgaaggacccgattctcccgattcgccgaagcctggcgccctacacccagcagcacatgcccgatccgcatcccatttttccctggagcatcccaccatgcaacctcacccaactgaactgcccgggcctgacttattaaccgtgagaaagtccggggtgtctagaacacattctctcccaaacgattcctacatgtgtcggcacggatctacggcggaaggccctctgggacatagaggatggggcctgcctaaggctcagtctggttcagtcttatctgtccactcccagccagcagacacaagctatattctccagctacctaaagatgctccacatctgctccagccgcattccgccccaacatggggaacgatccccaagctacctcctcccggcagatctcccctggcccaaaggcccctgagacggcaggcagctatccggacagactcactggacgtgcaaggacttgggagcagagaggacttgctggctgaggtctccggcccaagtcctcccctcgctcgcgcctacagcttttggggtcaatcttcaactcaggcccaacagcactcacgcagtcactctaaaataagcaaacacatgacccctcccgcgccttgccccgggccagagccaaattggggtaagggcccaccagagaccaggagctcccttgagctcgacaccgagctgagctggatcagtggtgatctgttaccacctggaggccaagaagaacccccctcaccaagagacctaaagaaatgttatagcgtggaagcgcaatcctgtcagcgacgacctacctcttggctggatgagcagcggcgacattccatcgctgtctcctgcctggattcgggttcacagccgcacctcggcactgacccttctaacctaggcgggcagcctctgggcggcccgggcagtcggcccaaaaagaagctgtcccccccctccatcactatcgaccctccagaatctcagggtccccggactcccccctctcctggcatatgtctgcgaaggagagccccaagtagcgattccaaggatcccctggccagtggaccacccgacagtatggccgcgagtccgtccccaaaaaaagatgtgctgtcactgagcgggctgtcatccgatcctgcagatctggatccctag

SEQ ID NO: 40716 - DNA, 6864 bp, Artificial Sequence
  Description of Artificial Sequence: Synthetic coding sequence
atggacgaggaggaggacggcgccggcgccgaggagagcggccagccgagatcattcatgcgcctcaacgacctgtccggcgccggaggccggcccgggcccgggtcagctgaaaaagatcctggttccgcggactcagaggccgaagggctgccgtaccccgccctggccccagtagtttttttttatctgtcccaggatagtcggccgcggtcttggtgcctgagaaccgtctgcaacccctggtttgaacggataagcatgttagttattctgcttaattgcgtgaccttgggtatgtttcgtccctgtgaggatatcgcttgcgacagccagcgctgccggatcctgcaggcctttgatgattttatattcgcattttttgcagtggaaatggtggttaagatggttgctcttgggattttcggtaaaaaatgttatctcggagacacctggaataggctcgacttcttcatcgtgattgctgggatgctcgagtatagcctggacctgcagaacgtgtccttctctgctgtgcggaccgtgagagtcctgcgaccgctccgggctattaatcgggtgccttccatgcgaatactggtgaccctgcttctggatacgttgccaatgctaggcaacgttctactactctgtttctttgtgttctttatctttggcattgtcggcgtgcagttatgggcggggctgttacggaaccgctgttttctgccggaaaacttttctttgcctctgtccgtggacttggagcggtactaccagaccgaaaacgaagacgagtcaccctttatctgtagtcaaccaagggagaatggtatgaggagctgtaggtctgtcccaaccctgcgcggcgatggagggggtggacccccttgcgggctagattacgaggcatacaattcctcatccaacaccacctgcgtgaattggaatcagtactatactaactgtagcgcaggcgagcataatccttttaagggcgccatcaattttgataatattgggtatgcctggatcgcaattttccaggtgataacccttgaaggatgggtggatatcatgtacttcgtgatggacgctcattcattctacaacttcatctacttcatcttactaatcatagtgggttctttttttatgattaacttgtgcttagtcgtgatcgccacccagtttagcgaaaccaagcagcgcgaatctcagctaatgagagagcagcgcgtgaggtttctgtccaacgcttcaactctcgcttctttcagcgagcccgggtcgtgttacgaagaactgctgaaatacctggtttatattctcagaaaggccgcacggagactggcccaggttagccgtgccgctggagtccgggtcggattacttagctcaccagcaccattgggcggacaggagacacaacctagctcttcatgtagtaggagtcataggcgcttgagcgtgcaccatttagtccatcaccaccaccaccaccatcatcattatcacttagggaatggtacattgcgggcccctcgcgcctccccagagattcaggatcgggacgcaaatggtagcaggagattgatgctgccgcctccttcgacacctgcccttagcggtgccccgcccggaggcgcagagtccgtgcacagcttctaccatgcagattgtcacctcgagccggttagatgtcaggctccaccaccacggtctccatcggaagcttcaggcagaactgtcggctcggggaaggtctatcccaccgttcacacctccccacccccagagactctcaaagagaaagccctcgtggaagtcgctgctagctcaggcccaccgactctaacatcactgaacattccgccaggcccctatagcagcatgcacaaactattagagacccagtcaacaggagcgtgccaatcctcttgcaagatctcctccccttgtctgaaggccgactctggcgcatgcggacccgacagttgcccctattgcgcgcgtgctggcgcgggggaggtggaattggctgaccgggagatgcctgatagtgatagcgaagctgtctatgaattcacccaagacgcacagcattccgaccttcgcgacccacactcccgtcgccaacggtctctcggtccggacgccgaacctagctcagtgcttgctttctggcgccttatatgcgacaccttcagaaaaatcgtggacagtaagtacttcggtaggggcattatgatcgcaatcctggtcaatactctaagcatggggatcgaatatcacgaacagcccgaagaattgaccaacgccttagaaatctcaaatatcgtcttcacctccttgttcgcactggaaatgctcctcaagctattagtctatgggccgtttggttatatcaagaatccatataacatttttgacggggttattgtggtgatcagcgtctgggaaattgtcggccagcagggcggagggctgtctgttttgaggaccttccgcttgatgcgagttctcaagctggtaagatttttaccagccctccagcgacagctggtggttcttatgaagacaatggataatgtcgcaacattctgcatgctgctcatgctgttcatcttcattttctctattctcggcatgcaccttttcggatgcaaattcgcttctgaaagagacggtgacacacttcccgacagaaagaactttgacagcctgttatgggcaattgtaactgtgtttcagattttaacacaggaggactggaacaaagtgttgtataacggcatggcctccacgagctcctgggctgccctctattttattgcacttatgacttttgggaactatgttttgttcaacctcttggttgccatcctggtggaggggttccaagctgaggagataagtaaaagagaagatgcgagcggacagcttagttgcatccaactgccagtggactcacaaggtggagacgcaaataagagcgagagtgaaccagattttttcagtcccagcttagacggcgatggggatcggaaaaagtgcctcgcgttggtgtcattgggcgagcacccagagctgcgtaagtcactgcttccacccctcattatccacaccgcggcaacccctatgtctctgccaaaaagcaccagcacgggtctaggggaggctctgggcccagctagcagaagaacatcatcctccggcagtgcagagccaggcgctgcccatgagatgaaatctccaccctcagctcgctcctctcctcactccccgtggtctgcagcctcatcatggacatcaagacgaagcagtcgcaactctctcgggagagccccatctttgaagcgcaggagtccgagtggagagagaaggtctcttctgtccggcgaagggcaggaaagtcaggatgaggaggagtcatcagaggaagagcgcgctagtcccgctgggtccgatcacaggcaccgaggctctcttgagcgggaggccaaaagtagtttcgacctgccagatacactccaagtgccggggctgcaccggacagccagcggacgggggtcagcttcagaacaccaagactgtaacggcaaatccgcctctggtaggcttgcacgagccctgcggccagatgaccccccactcgacggtgacgatgctgatgatgaagggaacctcagtaagggtgagagggtgcgcgcttggatcagggctagacttcctgcttgttgtctggagcgagatagctggtctgcctacatctttccaccacagtctagattccgcctgctctgccatagaatcatcacccacaagatgtttgaccacgtggtgttggtgattatctttttgaactgtattacaatagccatggaacgaccaaaaatcgacccccacagcgctgaaaggatcttccttacgctctctaattacatatttacagcagtgtttctggctgagatgacagtgaaagttgtggcactcgggtggtgtttcggggaacaggcctacctgcggtccagctggaacgtgttagacggccttcttgtgttaatctctgtgatcgatatcctcgtatccatggtctcggatagcggtactaaaatcctggggatgctacgggttctgagactcctgaggaccttaagacctctgcgagttatatcccgcgctcaggggctgaagctggtagtggagactttaatgtctagcctgaaacctataggaaatattgtggtcatatgctgcgccttctttatcatattcggtattctgggcgttcagctctttaaaggcaagtttttcgtgtgtcagggtgaggacacacgcaacattaccaacaaatcggactgtgctgaggcctcctacagatgggtgaggcataagtataattttgataacctcggacaggccttgatgagcctgttcgtgctcgcctccaaagacgggtgggtcgatattatgtacgacgggctagatgcagtgggagtggatcagcaaaactttcataaatgtaggcaacaccaggaagaagaagaggcgcggcggcgagaggagaaaagactcaggaggctggagaagaagagacgatctaaagaaaaacagatggctgaagcccagtgtaagccgtactattccgactacagccggtttcgtcttctggttcatcacctgtgcacctcccattatttggatctgttcatcacgggggtgattggcctgaacgtcgtaacgatggccatggaacactatcagcagccccagatattggacgaggctctgaaaatttgcaattatattttcactgtgattttcgtgctggaatccgtgttcaaattggtggcatttggatttagacgcttctttcaagatagatggaatcaactggatctggccatcgtgctactgtccattatgggtattacactggaagagatcgaggttaatgcctccttgcccatcaatcccacgattatcagaatcatgagggttttacgcattgcaagggtccttaagctgttgaagatggcagtggggatgcgggccctccttgatacagtgatgcaggccttgccccaggtaggaaacctgggacttctgtttatgctcttattctttatctttgccgccttgggggttgagctgtttggcgatctagagtgtgacgaaacccacccctgtgagggtctgggtcggcacgcgacctttagaaacttcggtatggcttttcttaccctcttcagggttagcactggtgacaactggaatggcattatgaaggatacactgcgggattgcgaccaggagagcacatgttacaacacagtgataagtcccatttacttcgtgagtttcgtgctgaccgcacagttcgtcctcgtgaacgtggtgattgcggtgcttatgaaacatcttgaagagtctaataaagaggccaaagaggaggcggaattagaggccgagctggagcttgaaatgaaaactctgagtcctcagccccacagtcccctaggatcgccgtttctttggccaggagtggagggaccggattcaccagactcacctaagccaggcgccctgcaccctgccgcccatgcacggtctgccagtcatttctcattggagcatcccaccgataggcagctattcgacacaattagcctgttgatccagggcagtcttgagtgggaacttaagttgatggacgagctagcaggcccaggaggacagcccagcgcattcccctcagctccttcattaggaggatcagaccctcagatgcagccacacccaactgagcttccaggaccagatctgctgactgttaggaaaagcggggtgagtcgaacccactccctcccaaacgattcttatatgtgccgacacggcagtactgccgaggggcctttagggcaccgagggtgggggctccctaaggctcaatccggatcggtgctatctgttcactctcagcccgccgacacgagttatatattgcaacttcctaaggatgctccacacttgttacagccccattccgccccaacttggggaacaatcccgaaactgcctcccccgggtaggagtcccctcgcacaacgccctctgaggcggcaagcagccattcgaacagattccttggacgtgcagggactcggatctcgggaggacctgcttgccgaggtgagcgggcctagcccgcccctagccagagcatatagcttttggggacagtcaagtactcaggctcagcaacactccaggtctcactctaaaatcagtaagcacatgacaccacccgccccttgcccggggcccgagccaaactggggtaaaggccctcccgagaccagatccagcctcgagctcgacacggagctgtcgtggatttccggggatcttctacctccaggcgggcaggaggagccgccatctcccagggacctcaaaaagtgctactcagtggaagcacagagctgtcagcgccggcccacatcatggcttgatgagcagaggcgacactccattgccgtgtcctgtctggactccggctcacaacctcatttgggtactgacccttccaacctaggagggcaacccctgggcgggcccggcagtcgtccaaaaaaaaaactaagccctcccagtataacaatcgatcctcccgaaagtcagggcccacggactcccccaagccccggcatctgcctccgccgaagggctccatcttccgacagcaaggatcctctcgctagtggacctcctgactctatggcggcaagcccctcccctaagaaggatgttttgtctctgtcggggctgtcttccgaccccgccgatctggacccctag

SEQ ID NO: 40717 - DNA, 6720 bp, Artificial Sequence
  Description of Artificial Sequence: Synthetic coding sequence
atggacgaggaggaggacggcgccggcgccgaggagagcggccagcctagatctttcatgcgcttgaacgacctgagtggtgctggcgggcgcccaggccccgggtctgccgaaaaggaccccgggagcgccgattcggaggctgaagggttgccttaccctgcactagcgcctgtggtgtttttttacttgagccaagattctcgccccagaagctggtgtctgcgcactgtatgcaacccctggtttgagaggatctccatgctggtcatccttctcaattgcgttaccttaggcatgttcagaccctgcgaggacattgcctgcgatagccaaaggtgtcgtatcctccaggcctttgacgacttcatattcgcgttctttgctgtcgagatggtggttaagatggtggcactcggaatattcggcaagaagtgttatttgggcgatacctggaaccgtctggacttttttattgtaattgccgggatgttggagtactctctggaccttcagaatgtgtcatttagtgccgtgcgtacagtgagggttttgcgaccactgcgggccattaacagagtgccgtcaatgaggatcttagtgactcttctgctcgacacgttacccatgctgggaaatgttcttctgctgtgtttttttgtgtttttcatcttcggtattgttggcgtacaactatgggccgggctgttaagaaatcggtgttttctccccgaaaatttctctctacccctgagcgtcgatctcgagagatattaccagaccgagaatgaggatgaatccccgttcatctgttcccagcctcgcgagaacggtatgcgctcatgtcgctccgtgccaacgctgaggggcgacgggggaggcggccctccatgcgggttggactatgaagcatacaacagcagttctaacaccacctgtgtgaactggaatcagtattatactaattgtagcgccggtgagcataacccctttaaaggggctatcaactttgataacatcggatacgcatggatcgcaatcttccaggtgataactctggagggatgggttgatattatgtactttgtgatggatgcacactcattctacaattttatctatttcatcctgctcatcattgttggaagctttttcatgatcaacctttgtcttgtggtaattgccacccaattcagtgagactaagcagcgcgagtctcaattgatgcgcgaacagagggtgagattcctgtctaacgcttctactctcgctagcttttctgaaccgggatcttgttacgaggagctacttaagtatttggtctatattctgaggaaagctgctcgacgtctcgcccaggtatcacgagccgctggagtgagggtcggtctgctatcctcaccagctcctctgggcgggcaggagactcagccttcatccagctgctcacgctcgcaccggcgcctgagtgtgcaccaccttgtccatcaccaccatcatcatcatcaccattaccatctcggaaatggtactttgcgggccccaagagcctctccggaaattcaggatagggacgcaaacgggtctagacggttgatgttaccacctccgtccacacctgctctgagcggcgcgccacctggtggcgccgagagtgtacacagtttctaccacgcggattgtcacttagaacccgtccggtgtcaagctcctcctcctaggagtccaagtgaagcatcggggagaaccgtcggaagcggcaaagtctaccccaccgtacacacaagtccacccccagaaactctgaaagaaaaggcactcgtggaagtcgcagcctccagtggccctcctacactgacgtccttaaacattcctcctgggccatacagctcaatgcacaaactcttggagacccagtcaactggcgcctgtcagtcctcctgtaagattagctcaccttgtctcaaagccgactcaggagcatgcgggccagactcatgcccatactgcgcccgcgccggagctggcgaggtggaactcgccgaccgtgagatgccagatagcgactcagaggccgtgtatgagtttacacaggatgcccaacactccgacctgcgggacccccacagcaggagacagcgaagcctgggcccagatgccgagcccagctctgtgctcgccttttggaggctcatctgcgacaccttccggaaaatcgtcgactctaagtacttcggaagaggcatcatgattgccatcctcgttaatactctgtctatgggcatcgaatatcatgagcagcctgaggaactgacgaacgctctggagatttccaacatcgtttttacctcactgttcgccctggaaatgctgctgaagttgctcgtttatggcccctttgggtatataaagaacccttataatatattcgacggcgttatcgtggtgattagtgtatgggaaattgtcggccagcaaggcggcggactatctgtgctccgtacctttcggctgatgagggtattgaaattggtgagattcctccctgcgctacagaggcaactcgttgtcctcatgaaaaccatggacaacgtggcaactttttgcatgctgctcatgttgtttatctttatattttcaatcctgggcatgcacctttttggttgcaaatttgcctccgagagagacggcgatactctgcctgacagaaaaaatttcgatagcctgctgtgggcaattgtgaccgtatttcagatattgactcaggaagattggaacaaggttctttacaatggaatggcaagcacatctagctgggcagccctgtactttattgccctgatgaccttcggtaactatgtgctctttaatttgctcgtggctattttggtggaaggatttcaggcggaggagatttccaagagggaagatgcgagcggccagctaagctgtatccagctgccagtggacagtcaaggtggagacgcaaacaagtcagaaagcgagccagacttcttttcaccgtcacttgatggagacggggaccggaaaaaatgcctggcacttgtttcgctgggggagcatcctgagctgcgcaaatctttactgccgccattaatcatccacaccgccgccacccctatgtctctgccgaaaagtaccagcacaggcttgggcgaagcccttggacccgcctcacgaagaacatcatccagtgggtctgccgaacccggcgcggcacatgagatgaaatcaccacccagcgcaagaagttccccacactctccatggagtgcggcgagtagctggacttcccgaagatcaagtcgaaacagtttgggtagggcaccctccctcaaacgccgtagccccagcggagagcgacggtccctgctttctggggagggccaagagtcacaggatgaagaggagagtagcgaagaagagagggccagccccgcaggctcagaccatcgccaccgcggctctcttgagcgggaggcaaaaagttcctttgatctcccagatacacttcaggtgcctgggctgcatagaacagcttccggccgcggctccgcaagtgagcaccaggattgtaacggaaaaagcgcctctggacgtctggcccgcgccctgcggccagatgaccctcccctggacggggatgacgccgatgatgaaggtaatttgtcgaagggcgagcgcgtgagggcctggattcgggcgcgtctcccagcctgctgccttgagcgcgatagctggtctgcgtacattttccctcctcagagccggttccggttgctgtgccacagaattattactcacaaaatgttcgaccacgtggtgctggttattatttttctgaactgtatcactattgctatggagcggccaaagatcgacccccactctgctgaacggatcttccttacgttgtctaattatatcttcaccgccgttttcctggctgagatgacagtgaaggttgtggccctgggctggtgctttggtgagcaggcatacctccgctcatcttggaatgtgctcgacggactcctggttctgatttctgtgatcgatatcctggtaagcatggtaagtgacagcgggactaaaattctgggaatgctccgggtgctgcggttgttgcgcacgttaagacccctccgcgtgatatctcgggcccagggactcaagcttgtagttgagaccctaatgtccagcctgaaacccattggcaacatagttgtgatttgctgtgctttctttattatattcggaatccttggggtgcagctgttcaagggcaaattttttgtatgccagggcgaggacactcgcaacatcaccaacaagagtgattgtgctgaggcttcttacaggtgggtccgccacaagtataactttgataatttggggcaagcactgatgtcactcttcgtgttggcgagtaaagacgggtgggttgacattatgtacgacgggctcgacgccgtcggcgtggatcagcaaaacttccacaagtgtcgacagcaccaagaagaagaggaggcgcggcgaagggaggaaaaaagattgcggagactcgaaaaaaaacgaagaagcaaggagaagcagatggctgaggcccaatgcaagccatattacagcgattatagtagatttcgattgttggtgcaccacttgtgcactagccactatctggacctcttcattaccggcgtgataggcctcaacgtggtaactatggctatggagcactaccagcagccccaaatattagatgaagccttaaaaatttgtaactacatctttactgtgatatttgtgctggaaagtgtatttaaacttgtggctttcggttttcgcaggttttttcaggatcggtggaaccagctcgacctggcaatcgtactgctgtcaataatgggaattacgctggaagaaattgaagtgaacgcctctctgcccatcaaccccacaattatcaggatcatgcgagtactgagaatcgcaagggtcctcaaattgttgaagatggcagtgggcatgcgggccctcctcgatactgtcatgcaagctctgccacaggtgggaaacttagggctgttgttcatgcttctcttcttcattttcgccgctctgggggttgagttgtttggagacctggagtgcgacgagactcacccttgtgaagggctaggtcgccatgcgacatttagaaattttggaatggcatttttgacgctgtttagggtgtccactggcgataattggaatggcatcatgaaggacaccctgcgcgactgtgaccaggagtcaacctgctacaatacggtgatctcacctatttacttcgtgtcctttgtactaactgctcaatttgttctggttaacgtcgtaatagccgtacttatgaagcatctggaggaatccaataaggaggccaaggaggaggcggagctcgaagccgagcttgaactggagatgaagaccctgtcacctcagcctcacagtccacttggttccccattcctttggccaggcgtggagggccccgattctccagatagtcctaaacccggggccctgcatcctgccgctcatgcccgatctgcttcgcatttttccctggagcaccctacaatgcagccccacccgacagaacttccaggtcctgacctgctgaccgtgcgaaaatccggcgtgtcacgcactcatagcttgcccaacgattcctacatgtgtcggcacggcagtacggccgaagggccactgggccatagggggtggggactcccaaaggcgcaatctggatctgtgctaagcgttcactctcaacctgccgacacctcctacattctgcagctgccaaaagatgccccccacctgctgcagccacacagtgctcccacgtggggcacaattcctaaactgccacctccagggcggtctcctctcgctcagaggcccctccgacggcaagcggcaatccggaccgattcgttagatgtgcagggactcggcagccgcgaagacttattggccgaggtctccggtccctctccccccctagctagagcttactctttttggggccagtcctctactcaggctcagcaacattctcggtctcacagtaaaatttccaagcatatgactcctcctgccccttgtcctgggccagaacccaactggggcaagggtccaccagagaccaggtcttctctcgagctggataccgagctctcttggatttccggggacttgctgccaccaggggggcaggaggagccccccagccctcgggacttaaagaagtgttactcagtggaggcccagtcgtgccagaggagacctacctcttggctggatgagcagagaagacactctatcgctgtgagttgcctcgatagcggctcccagccacatctcggcactgacccatcaaatctcggaggacagccactgggagggccgggcagtcgtcccaagaaaaagttgtcacccccttcaataaccatagacccccctgagagccaggggccaaggacccccccaagccccggaatctgtctccgccgccgggctccctctagcgattcaaaggaccctctggccagtggccctcccgacagcatggccgcttccccatcacccaaaaaggatgtactgtctcttagtggtctctccagcgacccggccgatttggatccatag

SEQ ID NO: 40718 - DNA, 6876 bp, Artificial Sequence
  Description of Artificial Sequence: Synthetic coding sequence
atggacgaggaggaggacggcgccggcgccgaggagagcggccagccccgttccttcatgcgactgaacgatcttagcggtgcgggaggaagacccggtcctggatctgctgaaaaggaccctggcagcgctgattctgaggctgaaggcctcccttatcctgccctagcccctgttgtattcttctacttgtcccaagactcacggccaagaagctggtgtctgaggacagtgtgtaatccctggttcgagaggattagcatgctggtgattctgcttaattgtgtcacactaggcatgtttaggccctgcgaagatatcgcatgtgattcgcagcgatgccggatcctgcaggcctttgacgatttcatcttcgctttctttgctgttgaaatggtggtaaagatggtcgctctggggatcttcggcaagaaatgttacctgggcgacacatggaacaggctggactttttcatcgtgattgcgggaatgttagagtattcccttgatctccagaatgtttctttctccgccgtccgtaccgtcagggtgctccgcccattgagagccatcaatagggtgcctagtatgcggatcctggtgactctgcttttggacactctgcctatgctcggaaacgttctgctcttatgtttttttgttttcttcatttttggcatagttggcgtgcagctttgggccggattgctgaggaacagatgcttcctgcccgaaaatttcagtctcccactttctgtcgatctcgagcgctactaccagacagagaacgaagatgagagcccgtttatttgtagccagcctagagaaaacggaatgcggtcgtgccgctccgttcctacccttcgaggggacggaggaggcggccctccatgtggattggactatgaggcctacaacagcagttcaaataccacttgcgtgaactggaaccagtattacaccaactgtagtgccggagaacataacccgtttaaaggggcaattaattttgataatatcgggtatgcctggatcgccatcttccaagtcatcacgctggaaggatgggtcgacattatgtatttcgtaatggatgcccattctttctataacttcatctatttcatactcctcattattgtcggaagtttttttatgatcaatctgtgcctggtagtgatcgccacacagttcagtgaaaccaaacagcgagagtctcagctgatgcgggaacagagagtgcggtttttaagcaacgcttccacgctggctagttttagcgaaccaggatcatgttatgaggaactgctcaaatacttagtgtatatactgcggaaggctgcacgcagactcgctcaggtttctcgagcagcgggcgttcgtgtgggcctcctctcatccccggcccctctaggggggcaggaaactcagccatccagttcatgctcaaggtcacatagacggctgagcgtgcaccatttagtacaccatcatcaccaccatcatcatcattatcacctgggcaatggcaccctgcgggcccctcgggccagtccagagatccaggacagggacgctaacggcagccggaggctgatgttacctcccccaagcacccctgccctttcaggggcccctcccggcggagctgaaagtgtgcacagcttttaccacgccgattgccaccttgaaccggtgcgctgccaggcacctcccccccgatctcccagtgaagccagcgggcggacggttggaagtggcaaggtgtaccccaccgtacacacatcccctcccccagagaccctgaaagaaaaagcactagtcgaggtggcggccagcagcggacccccaaccttgaccagcctgaatatcccacctggcccttatagctcgatgcataaattattggaaacacagtcaaccggcgcatgtcagtcgagctgcaagatctcaagtccatgtctgaaagccgattctggggcctgcggccctgactcatgcccctactgtgctcgggccggggcaggagaggtcgaacttgctgaccgagagatgcccgatagcgattctgaggccgtctacgaatttacccaggatgcacagcactccgatttgagggatcctcactcgagacgacagagatcactaggccccgacgcggagccatcctccgtgctagccttttggaggctcatctgcgacaccttccggaagattgttgactcaaagtactttggtaggggaatcatgatcgcgatcctggtaaacactctgtcaatgggaattgagtatcacgagcagccagaagaactgaccaatgctctggaaatatcaaatattgtgttcacatccctgttcgcactagagatgcttctcaaactcttagtctacggcccattcgggtatattaaaaacccctataatatcttcgatggagtgattgtcgtcatcagtgtttgggaaatcgtgggacagcagggaggtggacttagtgttcttaggacatttcgcctgatgagggttctgaagctagtaaggtttcttcccgctcttcagcgccagttggtagtcctaatgaagactatggataatgtggctactttctgtatgttactgatgttgttcatatttattttttcaatcctgggtatgcacctgtttggttgcaagttcgcgagcgagcgagatggcgataccttgcctgatcggaagaattttgactccctcctgtgggccatcgtgacggtgtttcaaattctcacccaggaggattggaacaaagtcctatataatggcatggccagcacctcctcgtgggcagccctgtactttattgccttgatgaccttcggaaactatgtgctgttcaaccttctcgtcgcaattctggttgaaggttttcaagccgaagaaatttccaagcgagaagacgcaagcggacagctaagctgtatccagcttcccgttgatagccagggcggcgatgctaataagagcgagtccgagccagactttttttcccctagcctggacggggacggagaccggaagaagtgcctggctcttgtgtcactcggagagcatccagagctccgcaaaagcctcctgccccctctgattatccacacagccgctactcctatgtcccttccaaagtccacttctacgggcctaggggaggctctaggacctgccagccgccggacatccagctctggctctgcagaacctggcgcagcacacgaaatgaagtccccaccaagcgcaagatcatcaccgcactctccttggagcgccgcttcgtcctggacgtcacgacggtcatcacgtaactctctcggtcgggctccatctctaaaaaggcggtctccaagcggagaacgccggagcctcttgagtggcgagggtcaggagtcccaggatgaggaggagtcctctgaggaggaacgcgcttccccagcgggttctgaccaccgacatcggggaagccttgagagagaggctaagtcctcctttgatttgccagatactctgcaggtgcccgggttgcataggaccgcaagcggcaggggcagcgccagcgagcatcaggactgcaacggtaagagtgcgagcggtcggcttgcaagagctctgagacccgacgatcccccactggacggggacgacgcggacgacgaaggcaatctgagcaagggcgaacgagtcagagcctggatccgcgccaggcttcctgcgtgctgcctggagcgcgactcctggagcgcctatattttccctccccagtcgcggttcagattactctgccataggatcataacgcacaagatgtttgaccatgtcgtcttagtaattatcttcctgaattgcattactattgcaatggagagacctaagattgatccacactcagctgaacggattttccttaccctctctaattatatttttacagcagtcttcttggcggaaatgacagttaaagtggtcgcattaggctggtgttttggcgaacaggcgtacctgaggtctagttggaatgtattagacggcctactcgtcctgatctccgtaattgatatactggtgtcaatggtgagcgattctggaactaaaatactcgggatgctccgtgtgttaaggctcttacgcacgttgagacctttgcgggttatctccagagcgcagggattgaagcttgtcgtggaaactctgatgtcttccctgaagcctataggcaatattgttgtaatttgttgcgccttcttcatcatattcggtatcctgggggtgcagttgttcaaaggcaagttcttcgtctgtcagggtgaggacaccagaaatatcaccaataagagtgactgcgctgaggccagctacagatgggttcgccataagtataatttcgacaacctgggtcaggctcttatgtccctgttcgtgttggcttcgaaagatggctgggtggatattatgtacgacggactcgatgcagtaggcgtagaccagcagccgataatgaaccacaacccttggatgctgctgtacttcatatctttcttacttatcgtggctttttttgttctgaatatgtttgtgggggtcgtggttgagaatttccacaagtgtcgacagcatcaggaggaagaggaggcacgtcgacgggaggaaaagcgcctccggaggctggagaagaaaagacggtctaaagagaagcagatggccgacctgatgctcgacgatgtgatcgcatcaggctccagcgcatccgccgcaagtgaagcacagtgcaagccctattacagtgactactccaggttccgtctccttgtgcaccatctgtgcacaagccactatctggacctctttattactggggtgatcggcttgaacgtggttactatggccatggagcactaccaacaaccgcagatactggatgaagcattgaagatttgtaattacatcttcacagtgatcttcgtgttggagtctgtctttaaactggtagccttcggctttaggcgattcttccaggataggtggaatcaattggatcttgccattgtcctcctctccatcatgggaatcaccctggaagagatcgaggtgaacgcctcactgcctatcaaccccacgataatcaggatcatgcgggtgctgaggatcgcacgtgtgctgaaacttctaaagatggccgtaggaatgagagccctcctagataccgtcatgcaggccctcccacaggtcggtaacctggggctcctgttcatgctccttttttttatttttgccgcactgggggtggagctcttcggcgatcttgagtgcgacgagacccacccatgtgaaggactcggtcgccacgctaccttcagaaacttcgggatggcgttcctcaccctctttcgggtgtctaccggagacaattggaacggtatcatgaaagacacactgagagactgtgaccaagaatcaacttgctacaataccgtcataagtcccatctattttgttagttttgtcttgactgcccagttcgtgctggtgaatgtagtaattgctgttctaatgaagcatctcgaagagagtaacaaggaagctaaggaggaggccgaactcgaagcagaactggaactggaaatgaagacactttccccacaaccccattctcccctgggtagcccctttctctggcctggcgtagaggggcccgactctcctgacagtcctaaacctggggccctgcatcctgctgcccatgctcggagtgcaagccatttttctctcgaacaccctaccatgcagccgcatcctactgagctcccagggcccgatctgctgaccgtaagaaaaagcggagtatctagaacccatagcctgcctaacgattcctacatgtgtcgacacggcagcactgcagagggtcctctcggtcatcgcggctgggggctacctaaagctcagagtggctcagtgctgtccgttcattcgcagccagctgatacctcgtatatcctacagctacctaaggatgccccccacctactccagcctcattccgctcctacctgggggaccattccaaaacttccccctccgggacgaagccccctggcgcagcggccgcttaggcgccaggccgcaattagaacagatagcctggacgtgcaggggctcggatcacgcgaggatctcttggccgaagtgtccgggcccagtccacctctggcgcgggcctactctttctggggtcagtcgtctacacaggcccagcagcactcgaggagtcacagcaaaatctctaaacacatgacaccgcctgcaccttgtcctgggccggagccaaattggggcaagggccctcccgaaaccaggtcatctcttgaactcgacactgaacttagttggatcagtggggacctcctcccacccgggggccaagaggaacctcctagtcctcgggacctcaaaaagtgctactcggttgaagcacagagttgtcagagacgccctaccagctggctggatgagcagagacgccactccatcgccgtatcctgtctggattctgggagccagccgcatttgggcaccgatccttctaatttagggggacagccgctcggaggcccaggatcccgcccaaagaaaaagctgagtccaccaagcatcacgatcgatcccccagaatcccaggggcccagaactccgccttcacccgggatttgccttcggagaagagcaccttcaagcgactctaaagatcctctcgctagtggacctcccgactcaatggccgcctcgccttctccgaagaaagacgtcctgagcctgagcggcctgagctccgatcccgccgacctggatccatag

SEQ ID NO: 40719 - DNA, 6780 bp, Artificial Sequence
  Description of Artificial Sequence: Synthetic coding sequence
atggacgaggaggaggacggcgccggcgccgaggagagcggccagccccgatcattcatgcggctcaacgacctgagcggggccggtggccgacccggccccgggtccgccgaaaaggaccctggctcagccgatagtgaagctgagggccttccctacccagccctcgctccagtggtatttttctatctgagtcaagacagtaggcctaggtcttggtgcttgaggacagtgtgcaatccgtggttcgagaggatctccatgctggtgatcctgcttaactgcgtcactctcgggatgttcagaccctgtgaggacatcgcttgtgatagtcagagatgtcgaatcctgcaagcattcgatgactttatcttcgcattttttgccgtggagatggtggttaagatggtcgccctgggcatatttggaaagaagtgttatctgggtgatacctggaatcgtttggatttcttcatcgttatagcagggatgctggaatatagcctggatctgcagaacgtcagcttctctgcagtgcggactgtgcgggtgctgaggcccttaagagccattaacagggttccctcaatgcggatactggtaaccctgctgctcgatactctgccaatgctgggaaatgttcttctgctgtgctttttcgtctttttcatctttgggatcgtgggtgtccaactctgggctgggctcctgaggaacagatgtttccttcctgagaatttcagtctgccattgtcagtggacctggagcgctactaccagacagaaaatgaggacgagagcccattcatttgctcacagcctcgagagaacggcatgagaagctgccgcagcgtgcctaccctgcgcggcgatggcggagggggtcctccctgtggcctggattacgaagcctataactctagctccaatacaacatgtgtaaactggaatcagtattacactaactgcagcgccggagagcacaatccattcaagggtgccatcaactttgataacattggatacgcctggatcgcaatctttcaggtcataacccttgaggggtgggtggacataatgtattttgtcatggatgcccactcgttctataactttatttattttatcctcctaatcatcgtcggatctttctttatgattaacctgtgcctggtcgtcatagccacccagttttcagagacaaagcagcgcgaatctcaactaatgcgagagcagcgtgtgagatttctgtctaatgcttccaccttagcctcattctctgagcccggatcttgctacgaagagctgctgaaatatctggtgtatattttaagaaaggctgcacgtaggctcgcacaggtaagcagagcggccggagtgagagtgggactgctttcaagtccagctccccttggcggccaagagacacagcccagctcctcctgcagtcgtagtcatagaaggttatccgtgcaccacttggtccatcatcaccaccaccaccaccaccactaccacctggggaacggcacccttagagctccaagagcttctccggagatccaggatcgtgatgctaatggctcgcgccggctcatgctccctcctcccagcactcctgcattgtccggcgccccacctgggggcgctgagagcgtccactccttctatcacgcagattgtcacctggagccggtgaggtgtcaggccccccctccccgctccccctcagaggctagcggccggaccgtgggctccggtaaagtttacccaacggttcatacatcacccccacccgagactctaaaagagaaagctctggtcgaggtcgctgcctcctctggtcctcctacccttacctctctcaacattcctccgggaccttactcctccatgcacaagctgctcgagactcaatctactggcgcctgccaaagctcctgcaagatctcctcgccctgcctgaaggctgattccggcgcatgtggccctgactcgtgcccttactgcgcgagggcgggtgctggggaggtggaactcgccgatcgcgagatgccagacagcgacagcgaggcagtatacgaattcacacaggacgcccagcacagcgatctgcgcgacccacatagtaggagacagcgcagcttgggacccgacgctgagccgtcatctgtgctggcattttggcgtctgatctgcgatacgtttcgcaagatagttgacagcaagtattttgggagaggcattatgatcgcaatcttggtcaatactctcagcatgggaatcgagtaccatgagcaaccagaggagttaactaatgcgctggagatcagcaatatcgtattcaccagtctattcgccctcgagatgctgttgaagctgcttgtgtacggaccctttggatacattaagaacccctacaacatttttgatggggtcatcgtagtcatctctgtgtgggaaatagtggggcagcaggggggaggtctgtcggtattgcgcacttttcggctgatgcgggtgctcaaactagttaggttccttcccgctttacagcgtcagcttgtggtgctcatgaaaaccatggacaacgtggccaccttttgtatgcttctcatgctgttcatattcatcttcagtatcctgggaatgcacctgtttggatgtaagtttgcctctgagagagacggagacactctcccagacagaaaaaactttgattccctgctgtgggcaatcgtgaccgttttccagatcctcacgcaggaggactggaacaaggtattgtacaatggcatggctagcacttctagttgggccgccctgtactttatcgcactcatgacatttgggaattatgtgttgtttaacttactcgtggctatcttggtcgagggctttcaagctgaagaaatttcgaagagagaagatgcctcaggccagcttagctgcatccagcttcctgtcgacagccaggggggtgatgccaacaagtcagagagcgagcctgatttttttagcccttccctggacggagatggcgaccggaaaaagtgtctggcccttgtgtccctgggggagcaccccgagctgcgaaagtctctcctaccaccattgatcatacatacagcggcaacccccatgagtttgcctaaaagcacctcgaccggactcggcgaagcacttggtcccgcctcccgcaggaccagttctagtggcagcgctgagccaggagcagctcacgaaatgaagtcaccccctagcgcgcggtccagccctcacagcccatggtccgctgcctcaagctggacatcgcggcgctcctcaagaaatagtcttggtagggcacccagcttgaagcggcgcagccccagcggcgaaaggaggtctctgctgtctggcgaagggcaggaatctcaggacgaggaggaatccagcgaagaggagcgcgcttctccagctggatccgaccataggcatagagggtccctggaacgagaagccaaatcctctttcgatttacctgacactctgcaagtgccgggcctgcatcgaacagctagcggcaggggatcagcctccgagcatcaggattgtaacggaaagtctgcaagtggcagactagcccgagccttgcgccctgatgatccacccctggacggcgatgacgctgatgacgaaggcaatctgagcaaaggagaaagggtgcgggcttggatcagggcgcgtttacccgcctgttgtctggaacgagactcttggtcagcctatatttttcctcctcagtccagattccggctgttgtgtcatcggatcataacacataagatgttcgaccatgtggtgctcgtgatcatcttcttgaactgtatcaccatcgcgatggaacggcctaaaatagacccgcacagcgcagagcggatatttctgacactctccaattacatattcacagctgtgttccttgccgagatgacagtaaaggtcgttgctctgggttggtgttttggggagcaggcttatttgagaagttcctggaatgtgctggacggacttctggtccttatcagtgtgattgatatcctggtgagtatggtgtcagattctgggactaaaatacttggcatgctgcgcgtactacgcctgctgaggaccctgcgacctttgcgtgttatcagcagggctcaggggctgaaacttgtcgtcgagaccctaatgagttccctcaaaccaatcggcaacatagtggttatttgttgtgccttttttatcattttcggtatactgggtgttcagctgttcaaaggaaaatttttcgtatgccagggagaggatacacgaaacattacaaataagtctgattgcgcagaagctagttataggtgggtgcgccacaagtataatttcgataatttgggccaggccctgatgtctctgttcgtactcgcatcaaaagacggctgggtggacatcatgtatgacggactggacgctgtgggtgtcgatcagcagccgataatgaatcataatccctggatgcttctatatttcatctctttcctcttgatagtggcatttttcgttctgaacatgttcgtaggggtcgtggtcgagaattttcacaaatgccggcagcatcaggaggaagaagaagctagaagaagagaggagaagaggctgagacgcctggaaaaaaaacggcgcaaggcgcagtgcaaaccatattactcagactactctaggtttcgccttctagtgcaccacctgtgcactagtcattacctggacttattcatcaccggagttataggcctgaacgtggtcacaatggccatggagcactaccaacagccccagattctcgatgaggccctgaagatttgtaactacatttttacagtgatttttgttttggagagtgtttttaagctcgtggcattcggattccgacggttttttcaggatcgttggaatcagcttgacttggcgatcgtgctgctgagcataatgggtattaccctggaggagatagaagttaacgcctccctgccaatcaacccaacgatcattcggattatgcgggttctcaggattgcacgcgtactgaagttgcttaaaatggcagtaggaatgcgcgcactcctggacacagtcggtaacttagggctgctgtttatgctcctcttctttatcttcgcagctctgggcgttgaactgttcggcgacctggaatgtgatgaaacccatccgtgcgaagggcttgggcggcacgcaacctttcggaacttcggcatggcatttttaaccctattcagagtctccaccggggataactggaacgggattatgaaggacacactcagggattgcgatcaagaatccacgtgctataacacggtgatcagtcctatctactttgtgtcctttgtcctgacagcccagtttgtgctggtgaatgtggtaatcgctgtccttatgaagcaccttgaagaatccaacaaggaggctaaggaggaggcggaactggaagccgaactagagttggagatgaaaaccttatccccgcagcctcattcgccattgggctcaccatttctgtggcctggagtggagggaccagactctcccgatagccccaagcccggtgccttgcaccccgcagcacatgcccggagcgccagccacttttcacttgagcaccccaccatgcaaccacatcctaccgaactgccgggacccgacctactgacagttagaaagtccggcgtgtctcggacccactccttgcccaacgactcatatatgtgtcgacatggctctacggcggaagggcctctgggccaccgtggttggggactgccaaaagcccagtcagggtccgtactctcagtgcattcacagccggctgacacatcttatatcttacagttgcctaaggatgcacctcatttactgcaaccccattcagcccccacatgggggacgatccctaagctcccacctcccggcaggtccccgctagcgcaacgtcccctgaggcgccaggccgccatacgaacagactccctcgatgtccaaggccttggctccagagaagacttgctggccgaagtaagcgggccttccccccctttagcgcgagcttatagcttctggggccagagcagtacccaggcccagcaacactctagaagccactccaagatttccaaacacatgacaccccctgctccttgccccggaccagagcccaactggggaaagggaccacccgagacaagatcctctctggaattggacaccgagctcagctggatttcaggtgatcttctcccccccggcggacaggaggagccaccaagtccccgcgatctcaagaaatgctactctgtggaggctcaatcttgccagcggcggcccacaagctggctcgacgagcagcggagacactctatcgctgtttcctgcttggattcaggcagccagccgcaccttggaaccgatccgtcaaacctgggaggtcagcccctcggaggtcccggcagccgtccaaagaagaagctgtctcctccgagtatcacaatcgatccgcctgagtcccagggcccgcggaccccacccagccccggtatctgcctgcggaggcgcgcacccagcagcgattccaaggacccgctggccagcggacctcctgattcaatggctgccagtccctcccctaagaaagacgtcttgtcactgtcaggactgtcttccgaccctgccgacttggacccgtag

SEQ ID NO: 40720 - DNA, 6684 bp, Artificial Sequence
  Description of Artificial Sequence: Synthetic coding sequence
atggacgaggaggaggacggcgccggcgccgaggagagcggccagccgcgctccttcatgcgactgaatgatctgtccggcgctggggggagaccaggtcccggtagcgctgagaaggaccccggatctgcagatagcgaagcagaaggactgccataccccgctctcgctcccgtggtatttttctatcttagccaggattctagaccaagaagttggtgtctgcgaactgtctgtaacccatggttcgaacgcatttctatgcttgttattttattgaattgtgtgaccttgggaatgttcagaccttgtgaagacattgcatgtgactctcaaagatgtcgcattttgcaggcctttgatgattttatatttgccttctttgctgtggagatggttgtaaaaatggttgcacttggcatatttggaaagaaatgctatctgggcgatacctggaacagactggatttcttcattgtgattgcagggatgctggaatattccctggacctgcagaacgtttcatttagtgccgtgcgcacagtcagggtactgcgcccactcagggcaattaacagagtgccctctatgcggattcttgttactctgctgctggatactttgccaatgttgggaaacgtgctcctactgtgcttcttcgtattctttatatttgggatcgtcggtgtacagctttgggccggattattaaggaacaggtgttttttgccagagaatttcagtctgccgctctccgtggacttggagagatactaccagacagagaatgaagatgaatctccctttatatgctcacagccacgtgaaaatggtatgagatcttgtagaagtgtgccaacactccgtggagatggagggggcggaccgccttgtggactggactatgaagcatacaattcttctagtaatactacctgtgtgaattggaatcagtactacacaaactgctccgccggagaacataacccgttcaagggtgctatcaacttcgacaacataggctacgcctggatcgcaatctttcaagttattacgctcgaagggtgggtggatattatgtatttcgtcatggatgcccactccttttacaatttcatatacttcatcctgcttatcattgtcggatcattctttatgattaacctgtgcctggtggttattgccacccaattttccgaaaccaagcagcgcgagtcgcagctgatgagggagcagagggtgaggtttctgagtaacgcgagcaccctggccagttttagcgagcccggctcatgctatgaagaactgctgaagtatctcgtgtacattctgaggaaagctgccagaagactggcccaggtctctcgcgcagccggcgtcagggtggggcttttgtcctctccggcccctctcggtggtcaggaaacccagccttcatccagttgtagtcgctctcacagacgactctcggtacatcatctggtgcaccaccatcaccaccatcaccaccactatcatctgggcaacgggacgctaagagccccacgagccagtcctgagattcaggacagggacgccaacgggagtagaagattgatgttgccaccccccagcacccccgctcttagcggcgcccccccagggggggccgagtccgtgcactcgttctaccatgccgattgccatctcgaaccagtccgatgtcaagccccgcctcctaggagcccttcagaagcctccggcaggacagttgggtccggcaaggtctaccccactgtgcataccagtccccccccagaaaccctgaaggagaaagccctggtcgaagtggctgcttcgtcaggccctcctaccctgacctcccttaatattcctccagggccttattcgagcatgcataaactgctggaaacccagtccacgggagcatgccagtcctcttgcaagatcagcagcccttgtcttaaagcagactcaggggcctgcggccccgacagctgtccttactgcgctcgcgccggcgcaggagaggtggagctggccgatcgggagatgccagactcggactcggaagccgtgtatgagtttacccaagacgctcaacattccgatttgcgggatccacacagtcggcgtcaaaggagcctcgggccagacgccgaaccgtcatccgtgctggccttctggcgattaatatgcgacactttccgaaaaattgtggactcaaagtacttcggaagaggcattatgatagcaattctggtcaacacactgtccatggggatcgaatatcatgagcagccggaggagctgacaaatgcgctcgaaatctccaatattgttttcactagtttatttgcactggaaatgctcctaaagctgctggtgtacgggccttttggatatattaaaaacccttacaacatctttgatggtgtcatagtcgtgataagcgtgtgggagatcgtaggacagcagggaggtgggctgtccgtcctgcgcacatttcggctaatgagagtcctgaaactcgtgcgatttttgcccgcattgcaaaggcagctcgtagtcctgatgaaaactatggataacgtcgccactttctgcatgctattgatgctgttcattttcatttttagcatcctcggcatgcacttgttcggttgtaagtttgcatccgagcgcgatggtgacacgttacccgataggaagaattttgatagtctgctttgggcgatagtaaccgtctttcagatcctcacacaagaagattggaacaaggtgctttacaatggaatggcatctaccagctcctgggctgctctgtactttatcgcccttatgacattcggcaactacgtcttgtttaacttactagtggccattcttgtggaggggtttcaggctgagggagacgccaacaaatctgaatccgaacctgattttttctccccctcgctcgacggagatggcgatcggaagaaatgtttggcgctcgtgagcctgggcgagcatcccgagcttcgcaagtccctactcccccccctgattattcatacagccgccaccccgatgagcctgcctaagtccacgtcaaccggcttgggcgaagccctgggaccggccagtcggcgtacgagcagctccgggtccgccgaaccgggcgcagcacatgaaatgaaatctccgccgagcgctagaagctctccacactccccatggagtgcagcgagttcatggacatcaagacgctcttctagaaatagcctaggcagggctccgagtctaaagagacgcagcccatccggggaaagacggagcctgcttagcggagaaggccaggaaagtcaggacgaggaggagagcagtgaggaagagcgtgctagccctgccggcagtgaccacagacatcggggcagcctggagagagaagcaaaatcgagcttcgacctcccagatacccttcaggtgcctgggttacaccgaacagcctcaggccgcggcagcgcaagcgaacaccaggactgtaacgggaaatcagcctccggccggctggccagagccctgcggcctgatgatccgccattagacggtgacgacgccgacgacgaggggaacctaagtaaaggggaacgagttagggcctggatccgggcacgtctgcccgcatgctgcctggagcgcgactcctggagcgcttacatctttccaccacagagccgattccgtcttctctgccacaggatcatcacccacaagatgtttgaccacgtggtacttgtcatcatcttcttaaattgcataacaatcgccatggagagacctaaaattgaccctcacagcgccgaaaggattttccttaccttgtctaactacatctttactgccgtgttcctggccgaaatgacagtgaaggtagtggctctgggatggtgctttggcgagcaggcctacctgcgcagtagttggaatgtgctcgatggacttctggttctcatctcggtcatcgacattctcgtttcaatggtaagcgatagtgggaccaagattctcgggatgttgcgtgtcctgcggctcttaagaacattgagacctctgagagtaatctcgcgggcccagggtctaaaattagtggtggaaaccctaatgtcctccctgaaaccaatcggcaacatcgtcgtcatatgctgtgccttttttatcatttttggcattctgggcgtgcagctgtttaaagggaaatttttcgtttgtcagggcgaggatacaagaaacataacgaacaaatccgactgcgctgaagcctcataccgatgggttcggcacaagtacaattttgacaatctagggcaagcgttgatgtctttattcgttctcgccagcaaagatggctgggttgatatcatgtacgatggacttgacgctgtgggagtggatcagcagaattttcataaatgccggcagcaccaggaagaggaggaggcgcgaagacgcgaagagaagcggctaagacgtttagaaaaaaagaggcgtaatctcatgctggatgatgtgatcgcatccggatcgtctgccagcgccgcctctgaggcccagtgtaagccttattatagcgactacagcaggtttcgcctgctagtgcatcatctgtgcacatctcattacttggatctttttatcacaggcgttatcggccttaatgtcgtgaccatggccatggaacactaccagcagccacagattttggatgaggcactcaaaatttgcaattacatttttacagtcattttcgtgcttgaaagcgtattcaagctggtcgctttcgggtttcgtagatttttccaggatcgctggaaccagctcgacctggcgattgtactattgagtattatggggattactctggaggagatcgaggtgaatgcttcccttccaattaatcctacgatcatcaggatcatgagggtcctccgaatcgcacgcgtgctgaaactcttgaagatggctgtggggatgagggcgctgctggacacagtgatgcaagccctgcctcaggtgggcaatctaggcctactgttcatgctgttgtttttcatctttgcagccctgggcgtggaactcttcggcgatctggaatgtgatgagacccacccctgtgagggattgggtagacacgcaacatttcgcaactttggaatggcttttctcaccctgtttcgggtgagcaccggcgacaactggaatgggattatgaaagataccctgcgtgactgtgatcaagagtccacgtgttataatacagtgatcagcccgatctacttcgtttcctttgtcctgaccgctcaatttgtcctcgtgaatgtcgtcatcgccgttcttatgaagcaccttgaggaaagtaacaaagaggcaaaggaagaagcagaactcgaagccgagctagaactagagatgaagacgctctccccgcaacctcatagcccccttgggtccccattcttgtggcctggcgttgagggtccagactccccagacagtccgaaaccgggggctctccaccctgcagcccacgcccggtcagcttctcatttctccctggaacaccctacaatgcagccacatcccaccgagttgcccggacctgacctgctcacagtgcgtaaaagcggagtgtcccgcacgcactcactcccaaacgacagctacatgtgtcgacacgggtcgactgccgaggggccattggggcacaggggctggggtctgccaaaggcgcagtcaggttccgtgctttcagtccactcccagcctgctgacacctcttacattctgcagctacctaaagacgccccacacctgttacaaccccattccgccccaacatgggggacaatcccaaaattgccaccgcccggccgctcccccctggctcagaggcctcttcgtcgccaggccgccatcaggacagactctttggacgtgcagggactgggctctcgggaggatcttctcgctgaggtgtctgggccctcaccacccctcgctcgggcttattcattttggggtcagtcttccacacaagcccagcagcatagcaggagtcacagtaagatcagtaagcacatgacacctccggcgccttgccccggcccagagcctaactggggaaagggaccccccgagactcggtcaagcctggaactcgacacggaactaagttggatatccggcgatctgctgcccccagggggccaggaggagccaccttcacctcgtgacctgaaaaaatgctactctgttgaggcccagtcgtgccaaaggagaccaacaagctggctcgacgaacagagaaggcatagcattgccgtatcctgtctggacagcggtagtcaaccacatctgggtaccgacccaagtaacctaggtgggcagcccttaggcggccctgggagcaggcctaagaaaaaattaagccccccgtctatcacaatagacccccccgagtcccaggggccacggaccccccctagcccgggcatttgtctgagaagacgagctccttccagtgattccaaggatcctctggccagcgggccgccagattcaatggccgcctccccttctcccaaaaaggacgttctgtcactgagtggcttaagttccgaccctgcagacctggatccgtag

SEQ ID NO: 40721 - DNA, 6855 bp, Artificial Sequence
  Description of Artificial Sequence: Synthetic coding sequence
atggacgaggaggaggacggcgccggcgccgaggagagcggccagcctaggagcttcatgcggctgaatgacctcagcggtgccgggggccgccccggacctggcagtgctgagaaggaccccggttccgcagactccgaggcggagggtctcccctatcctgctttggcacccgtggtcttcttttaccttagccaagattcccgaccgcgctcctggtgcctgcgcaccgtgtgtaatccatggtttgaacgcatctccatgcttgtgatcttgctgaactgcgttactctgggtatgtttagaccatgtgaagacatcgcttgcgattcacagagatgtaggatactccaagcatttgacgatttcattttcgcattcttcgccgtcgagatggtcgtgaaaatggtggcccttggaatattcggcaagaagtgttacctaggcgatacttggaacagacttgacttttttattgtgattgctggtatgctggagtactccctcgacctccaaaacgtaagcttttctgccgtgagaaccgtgagagtactccgccccctgagggccatcaaccgggtgcccagcatgcggatactggtgaccttacttcttgacactctacctatgctgggcaatgttttgttactttgcttcttcgtgtttttcatctttggaattgtgggagtgcagctgtgggccggcctgctgcgtaaccgttgtttccttccggagaactttagcctgcccctgtcagtcgatcttgagcgttactaccagacagagaacgaggatgagtctccttttatctgttctcagcctcgggagaatggcatgcgcagttgtagatcagtgcctacgctgcggggcgatggaggaggtggtcccccctgcggcttggactacgaagcatataattcatcctcaaacactacttgcgtcaactggaaccagtattatactaattgttctgcgggtgagcataatcccttcaaaggcgccatcaatttcgataacataggctatgcctggatcgctatattccaggttataaccttggaaggatgggttgacattatgtattttgtgatggacgcccattccttctacaatttcatttatttcatcctgctcatcattgttgggtctttcttcatgattaatttgtgtctagttgtcattgctacacagttcagtgaaacgaaacagcgggaatcgcaactgatgagagagcagcgcgtgcgcttcctaagcaatgcttccacattggcctcctttagcgagccgggcagttgttatgaggaactgcttaaatacctggtatacatccttagaaaggctgcccgccggcttgcccaggtgagcagggccgcgggcgttcgggtgggcctgctttccagtccagcccctctgggcgggcaggagacccaaccgtcctctagttgcagtcggagccatcggaggctgtccgtgcaccatttagtgcaccaccaccaccaccatcatcaccattatcacctcggcaacggtactttaagggcccctcgggcctccccagagattcaggatcgggatgcgaacggctcccgaagactgatgctgcctccaccaagcaccccagcgctcagcggtgctccaccagggggcgcagagtccgtccactctttctatcacgccgattgtcatctggaacccgtgcgctgtcaggcaccacccccgcgctctcccagcgaagcctccgggaggacggtggggtcgggcaaagtatacccaactgtgcacacttcacctcctccagagactctcaaggagaaagcattggtagaggtggccgcctcctctggcccgcccactctcacttccctgaatatcccccccggtccatacagttccatgcataagcttctcgaaactcagtccaccggtgcctgccagtcatcctgtaaaatttcctctccttgcctcaaagcagactccggcgcctgcggccctgactcttgtccctattgcgcccgggctggagcaggggaagtggagctcgctgaccgggagatgccggattctgattcagaggccgtgtacgagttcacacaagacgcccagcattctgatctacgtgatccacactctcggcgccagagaagccttggccctgatgccgagccctcttcagtcctcgcattctggagactcatttgcgatacttttcgcaaaattgtggattcaaaatatttcgggaggggcataatgattgctatcctcgtgaatactctaagtatgggaattgagtaccacgaacagccagaggagttaacaaacgccctcgaaatttccaatatcgtttttacctcactcttcgcactggagatgcttttgaagctcctggtgtacggtcccttcggatacatcaagaacccgtacaatatatttgacggcgtcatcgttgtgatttcagtctgggagatagtaggccagcaggggggaggtctgtcagtgctgagaacctttagactgatgcgcgtgctgaagctggtgagattcttgcccgcgcttcagcgtcagctggtcgtgttgatgaagaccatggataatgtggcaacattttgcatgttgttgatgctattcatcttcatattcagcattttggggatgcacctgtttggctgtaaatttgcatcggaacgcgacggcgatacccttccagacagaaaaaacttcgactccctgctctgggctattgtgactgtgttccagatcttaactcaagaagattggaataaggtcctgtacaatggtatggcctcgaccagcagttgggcggccctgtatttcattgcgctcatgaccttcggtaattacgtcttgttcaacttgttggtggccatcctggtggaggggtttcaggccgaagagatcagcaagagagaggatgcttcgggccaactttcctgtatacagcttcccgtagatagccaggggggcgacgctaacaagagtgaatcagagcccgatttcttctcccctagcctggatggggacggcgaccgcaagaaatgtctggctctagtctcccttggagaacacccagaattgcgtaaatccctactcccaccattaatcatacacaccgccgcaaccccaatgtctctccctaaaagcacatccaccgggctcggcgaagccttaggccctgcatctcgccgaacttccagctcagggagcgcggagcccggtgctgcacacgaaatgaaatctccccccagcgcccggagctcacctcactcaccctggtccgcggcatcgagctggacttctcgaagatcttctcgcaactctttggggagagcacctagtttaaaacggcgatcgccttcaggggagcgccgcagtctgctgtcgggcgagggacaagagtcccaagacgaagaggaaagctcagaggaggagcgcgcttcccctgccggtagcgatcatcgccatcgaggtagtctcgagagagaggcaaagtcatccttcgatctgccggatacacttcaggttcctggcctccaccgaaccgcttcggggaggggctccgccagtgagcaccaggattgtaacggaaagtctgcatctggtaggcttgcacgcgctttgaggcctgatgatccccctctggacggcgacgacgccgacgacgaagggaacctttccaagggggagagagtgagagcatggatacgcgctagactgcccgcctgctgcctcgagcgggattcttggagtgcctatatctttccgccacagtcacggtttaggctgctttgccataggatcattacccataaaatgtttgatcacgtggtgttggtaataatttttttaaattgcatcaccatcgccatggagcggcccaagattgacccacattcggccgaacgaatttttctgacgttgtcaaactatatattcactgccgtgtttctggcagagatgacagtgaaagttgtcgccctcggatggtgcttcggtgagcaggcctacctgcggtcttcctggaacgtgctggacggactgcttgtcttaatcagcgtgatcgatatattggtgtccatggtgagtgattctgggactaaaattttgggcatgttaagggttctgcgactgttgcggactcttagacccctcagagtaatcagtcgagcccaagggcttaaactcgtcgtggagactctcatgagcagcttaaagccaattggcaacattgttgtcatctgctgtgcttttttcataattttcgggattcttggcgtgcagctcttcaagggtaagttcttcgtgtgtcaaggagaagacactcggaacatcacaaacaaatctgactgcgcggaagcctcgtatcgctgggtccgccacaagtacaattttgacaatttaggccaggccttaatgtccctgtttgttctcgcctcgaaggatggctgggtggatatcatgtacgacggcctcgatgccgtcggagtggatcagcagcctataatgaaccacaacccttggatgctactatatttcatcagttttctgctgattgtcgccttcttcgtgttgaatatgtttgtgggcgtagttgtggagaacttccataaatgtcggcagcaccaagaggaggaggaggcgaggcggcgggaggaaaaaaggttgcgtagactcgagaagaaacgaagaaatctgatgctcgacgatgtaatcgcctctgggtcaagtgctagcgcagcaagtgaggcgcagtgcaagccttattattccgattactccaggtttcggctgctagttcaccacttgtgcacctcccactacctggatctctttattaccggagtcatcggcctcaacgttgtaaccatggctatggaacactatcagcagccacagattttggacgaagctctgaaaatctgtaactatatcttcaccgtgatatttgtgcttgagtccgtattcaagctcgtagcatttggattcagacgatttttccaggacagatggaaccaactggatttggccatagtactcctgtccataatgggtatcactctagaggagatcgaggtaaacgcgtctttacccattaacccaactatcataagaatcatgagggtgctgcgcattgcacgcgtgcttaagctcctgaagatggcagttggaatgcgtgccctgttggacactgttatgcaggccttaccacaagtcggcaacctcgggctcctgttcatgctgctgttttttatattcgccgccctcggggtcgagctgtttggagatctcgaatgcgacgagactcacccctgtgaaggcctggggagacatgccacattccggaattttgggatggcattcctgacattatttcgagtgtccacaggcgacaactggaacgggataatgaaggataccttacgtgactgtgaccaggagtctacatgctataacaccgtcatctctccaatttatttcgtgagcttcgtcttaactgcccagttcgtccttgtaaacgtagtaattgccgtactcatgaaacacctggaggaaagcaataaagaggccaaagaggaagccgaacttgaagcagagctagagctggagatgaagactctcagcccgcaaccccactcccccctcggatcaccattcttatggcctggcgtagaaggacccgacagtccagacagcccgaaacctggagctttgcacccagccgctcacgcgcgtagcgcatcccatttctccttggagcatcccaccatgcagccccatccaaccgaactgcccggccctgatctcttgacagtgcgaaagtccggggtttctcggactcacagccttcctaacgactcttatatgtgtcgccatgggagcaccgcagaggggcctctgggccacagaggttgggggttgcctaaggcccagtcagggtctgtgctctcggttcactcacagcctgctgacacatcatacatcctgcaactgcccaaagatgcgcctcacctgctgcagccgcattctgcccctacatggggtaccatacccaaactgccaccccccggcaggtcccccctcgcgcagcggcctctgcgccgtcaggctgctatccgcacagactcgctggatgttcagggtctaggatctcgcgaagatctcctggccgaggtgtcagggccgtccccacctttagctcgggcctacagcttttggggccagagctcaacccaggcacagcagcactcacgctctcactccaaaataagcaaacacatgacacctccagcgccatgcccaggccctgagcctaactggggtaagggaccacccgaaacaaggagctctctcgagttggacactgagctttcctggatatctggggatcttctgccacctgggggacaggaggagcctccatccccccgggatctcaaaaaatgttacagcgtggaggcccaaagttgccagagaaggcccacctcgtggctcgacgagcaaaggagacactctatcgccgtttcatgcctggattccggatctcagcctcatcttggcactgatccgtcaaatttaggcgggcaaccgcttggggggcccgggagtcgaccaaaaaaaaagctcagtccaccgtctataacaatcgatccgcctgaatctcaagggccccgaactcccccttcccctggtatctgtcttagacgcagagccccttcaagcgactctaaggaccctctcgccagtggccccccggactctatggctgctagcccctctcctaaaaaggatgtgttgtccctttcgggactgagcagtgatcccgccgacctagatccatag

SEQ ID NO: 40722 - DNA, 6945 bp, Artificial Sequence
  Description of Artificial Sequence: Synthetic coding sequence
atggacgaggaggaggacggcgccggcgccgaggagagcggccagcccagatcctttatgagactcaacgatctgtcgggtgccggagggcggcccggcccaggctctgcagagaaagatcccggatccgctgattcagaggcagaagggcttccttacccagccctcgcaccagtggtgttcttctacttgagccaggacagtaggcccaggtcctggtgtctccgcacagtctgcaacccctggttcgagcgcatctctatgcttgtgatcctgcttaactgtgtgacgctaggcatgtttagaccttgcgaggatattgcatgtgacagccagaggtgccgaatcctgcaggcattcgatgacttcatcttcgccttttttgccgtagagatggtcgttaagatggtggctttgggcatattcggaaagaaatgttatctcggtgacacctggaataggctggatttctttatagtgatagcagggatgcttgagtattccctcgatctgcagaacgtaagcttctccgccgtgcgaaccgtcagagtcctgcgaccactgcgcgcaatcaatcgggtgcctagcatgcgcatactagtcactcttctgctggacactttacccatgcttggcaacgtcctgctcctgtgtttttttgtattttttatctttggaatagtcggcgttcagctgtgggccggcctcctgaggaacaggtgtttcctgccagagaatttctctctccccttgtcagttgatctggagagatactatcagacagaaaacgaggacgagtctccctttatttgttcgcagccacgagagaacggtatgcgatcctgccgttccgtgcccactcttcggggtgacggagggggtggccccccctgtgggctggattacgaggcctataacagctcatccaatacaacttgtgtgaattggaaccaatactacaccaactgttccgctggtgaacacaatccgttcaaaggcgcgattaatttcgacaacatcgggtacgcttggattgcaatcttccaggttatcaccctcgaaggatgggttgatataatgtactttgtgatggacgcccactcgttttataatttcatctactttatcctcctgatcattgtggggagtttcttcatgataaacctgtgtctggtggtcatcgccacacaattcagcgagacaaagcagcgggaatcccagctcatgcgggaacagcgcgtgcgtttcctgagcaatgcaagtaccctggcatccttctccgagccggggtcctgctacgaagagcttttaaaatacctcgtttatatcttgagaaaagcagctcgacgtctggcacaggtgagccgtgccgccggtgtgcgggtgggcttgctgagcagtccggccccactgggaggccaggaaacccagcccagcagcagttgttccaggagccaccggcgcttgtccgtgcatcatctcgtgcatcatcaccatcatcaccatcatcactaccaccttggaaatgggaccctcagggcaccacgggcaagtcctgaaatccaagatcgcgacgccaatggatcacgcagattaatgttgcctccgccttccactcccgccttgagcggcgctccgccaggaggcgcggagtccgtgcactcgttctatcatgccgactgccaccttgaaccagtgaggtgtcaggccccaccccctcgcagcccctctgaggcgtccgggaggactgtcgggagtggtaaggtgtacccaactgttcacacttcaccccctcccgaaacgctgaaagagaaagctctcgtggaggtggctgcctcaagcggtccgcccacactaactagtttgaatatcccaccaggtccttatagtagtatgcacaagctgctggaaacccagtccaccggcgcctgtcagagctcctgtaaaatttcctctccgtgtcttaaagccgactcaggtgcgtgtggccctgactcctgcccatattgcgccagagctggggccggcgaggtggaattagctgacagagagatgcccgatagcgattcggaagctgtttacgagttcacccaggacgcccaacactcagatttaagggatcctcacagcaggagacagaggagtctgggtcctgatgcggaacctagttctgtgttggcgttctggagactgatctgcgatactttccgcaagatagtggattcaaaatatttcgggcgggggattatgattgctatcctggtaaacacattgtctatgggcattgagtaccacgagcaaccggaagaactgactaacgcactggagatctccaatatcgtcttcacgtcgttattcgcgctggagatgttattgaagctgctggtgtatggaccatttgggtatataaagaacccatacaatatcttcgatggcgtcatcgtcgtcatttctgtctgggaaatagtcgggcaacagggtggtggattaagcgtcctccgcaccttcagattgatgcgcgtattgaagttggtccggttcctacccgctctgcagcgccagctagtggttctaatgaagactatggataatgtcgcaacattctgcatgctgctaatgttgttcatcttcatatttagcatattgggaatgcacctgttcggctgcaaatttgcctctgaaagggacggcgataccctccccgatcggaaaaattttgactctcttctgtgggcaatagtgaccgtttttcagatactgacacaggaggattggaacaaggtgctctacaacggtatggcatcaaccagtagctgggcggccctgtacttcatcgcattgatgacattcgggaattacgttctgtttaacttgctggtggctattttggtagagggatttcaggcagaagaaatctcaaagagggaagacgcctctggacagctgagctgcatccagctcccagtggactcccaggggggcgacgcgaataagagcgagtccgagcccgattttttttcgccaagccttgatggagatggtgacagaaagaaatgcttggccctagtgtccctgggagagcaccccgaactgcgcaaatccctgcttccccccttgattatccacactgcagctacccctatgtccctgcccaaaagcacgtcaacaggtctaggggaggcccttgggcccgctagccgacggacaagtagtagtggctccgcagaacccggagctgcccacgagatgaagtcgcccccaagcgcacgctctagcccccacagcccatggagtgccgccagctcttggacgtcccgacgcagtagccgcaattcactcgggcgcgccccgagcctaaagaggaggagcccaagcggagagcgccgcagtctgctcagtggcgaggggcaagagtcccaagacgaagaggagagctccgaagaagagagagcttcccctgccgggagcgaccataggcaccgaggatctcttgagcgggaagccaagtcttccttcgatttgccagacactttgcaggtcccagggcttcacagaacagcctctggaaggggaagcgctagcgaacaccaagactgtaatggaaagtcagcatctggacgcctggctcgagccttgaggccagacgatcctcccctggacggagatgacgctgacgacgaaggcaatcttagcaaaggcgaacgtgtgagggcatggatcagagctcgcctaccagcgtgctgtttggagcgcgacagctggtccgcctatatctttccgccacagagtaggttccggctgctgtgccaccggattatcacacacaaaatgttcgaccatgtggtcttagtaattatttttctgaactgcataactattgccatggagcgacctaaaatcgacccccacagcgccgagcggatattcctgacactcagcaattatatttttaccgcggttttcctggctgaaatgacagtaaaggtggtggcactgggatggtgttttggagaacaggcctatctccggagtagttggaatgtcttagacgggttgctggtacttattagcgtaatcgacatactggtcagcatggtgagcgacagtggcacaaagatcctcggaatgttgcgcgtccttcgactcctgcggaccctgcgtcctcttagggtgatttcacgtgctcagggcctcaaattggttgtggaaacactcatgtcctctctaaagccaataggtaacatcgtagtcatctgctgtgccttctttatcatatttgggatactgggcgttcagctgttcaaaggcaagttcttcgtgtgtcaaggtgaagataccagaaatataaccaacaaaagcgattgtgccgaagcgtcataccgatgggtacggcacaagtataatttcgacaatctcgggcaggcgcttatgtctctgtttgtattggctagtaaggacggatgggtggatatcatgtacgacggacttgatgcagttggcgtggaccagcagcccattatgaaccacaatccatggatgctgctgtattttatttccttcctgttgattgttgcttttttcgtcctgaatatgttcgtcggcgtggtagttgaaaactttcacaagtgcagacagcatcaggaagaagaggaggcccgcagaagggaagagaagcggctgagacggttggagaaaaaaagaaggaaggcacaatgcaaaccctattacagcgattactctaggttcaggctactggtacatcacctgtgcactagccattatctggacctgttcattacaggagtcattggtctcaatgtagtgacaatggcgatggagcattatcaacagccccagatcctggacgaagctctgaagatatgcaactacatattcaccgttatctttgtattagagagtgtgtttaagctcgtcgcatttggtttccggaggtttttccaagatcggtggaatcagctcgacttggcgattgtccttctcagtatcatgggaatcacgttggaggaaatagaagtgaacgcctccctccccattaatccaacgatcattcggatcatgcgggtgttgcgcattgccagggtgttaaagctcctaaaaatggctgttggcatgagagccctgcttgatacggtgatgcaagctctgccccaggtgggtaaccttggactactgttcatgctcctcttttttatttttgccgcattgggagtggagcttttcggtgatctcgagtgcgatgaaactcatccctgtgagggtcttggacggcacgcgacgtttagaaattttggaatggcctttcttacacttttcagggtaagcaccggtgataactggaacggaattatgaaggatactctgcgcgactgcgaccaggaaagcacatgctataataccgtgataagtccaatttattttgtttccttcgttttgaccgcccagttcgtgctggtgaacgtcgtgattgctgtgttaatgaagcatttagaagaaagtaataaagaggctaaggaggaggccgagctggaggcagagctggaactagaaatgaaaacactttctccccaaccgcacagcccgctgggtagtcccttcttgtggccaggcgttgaggggcccgactcgcccgatagtcccaaacctggcgccctgcacccagccgcacatgcgcgatccgcaagccacttctctctggagcaccccactgatcggcagctctttgacacaatctccttgttgatccaggggtccctggagtgggaacttaagctgatggacgaactcgctggaccgggtgggcagcccagcgcctttccatccgccccctcattaggaggatcagacccccagatgcagcctcacccgacagaactgcctggccccgatctgctcaccgtcaggaagagtggagtgagtaggacccatagtctgcccaacgactcttatatgtgtcgccacggcagcaccgccgaaggcccacttgggcatcggggttggggcttaccaaaagcacagtccgggtccgtactgtcggtccattcccagcccgccgacacttcttacattctccagctgccaaaggacgcgcctcacctgcttcaaccccatagcgcccctacgtggggcacaatccctaagctacctccccccggccgaagcccactggcccaacggccgttgcgcaggcaggccgcaatccgcacagattcactggatgtccaaggcctcggaagtagggaagatctattagccgaggtcagcggcccttccccgcctttggcccgagcatactctttttggggccagtcttccactcaggcccaacagcattcacggtcacattccaaaattagtaagcatatgacccctcctgccccttgtcccggacccgaaccgaactgggggaaggggcctcctgaaaccaggtcaagccttgagcttgacacggagctgtcctggatatcaggggacctgctacccccaggaggacaggaagagcctcctagtcctcgcgaccttaagaaatgctattcagtggaggcgcagtcctgtcagcggcggcccacctcttggctagacgagcagcggaggcatagcatagctgtcagctgcctggatagtggcagccaaccacaccttggtaccgatccttccaacctcggaggtcagcctttaggcggacctggatccagacccaagaagaagctttctcccccttccattacaatagatcctccagagtcccagggaccacgcacccctccatccccagggatatgccttaggcggagggcccctagttctgattccaaagaccctctggctagcggaccacccgactcaatggccgccagtccttcccctaaaaaggacgtgctgtcactcagtggcctctctagcgatccggccgacttggacccctag

SEQ ID NO: 40723 - DNA, 6966 bp, Artificial Sequence
  Description of Artificial Sequence: Synthetic coding sequence
atggacgaggaggaggacggcgccggcgccgaggagagcggccagccccggagtttcatgcgtctcaatgatctttccggggcgggtgggcgccccggacccggaagcgctgagaaagacccaggatctgcagatagtgaggcggagggactgccatatcctgccctcgcgcctgtggtattcttttacctttcccaggactcccgcccgcgttcatggtgtctgaggacagtctgcaacccgtggttcgagcgcatctctatgctcgtcatcctgctgaattgtgtcacgttaggaatgtttcggccttgtgaagatattgcctgcgactctcaacggtgccggattctccaggcgttcgatgatttcattttcgctttctttgcagtggagatggtcgtcaagatggttgcgctggggatttttggaaaaaagtgctacctcggtgacacatggaatagactggattttttcattgtcatcgctgggatgctggagtattccctggatctccaaaatgtctccttcagcgccgttcggactgtgcgcgtactgcgcccgctccgggccatcaatcgcgtgccttcaatgcgcattctggtaacccttctgcttgacactctgccaatgctgggaaacgtccttctgttgtgcttcttcgtattcttcatttttgggatcgtcggagtccaattatgggcaggcctcctgagaaacaggtgtttcctccccgaaaatttcagtctacctctctctgtggaccttgaacgttactaccaaactgagaatgaagatgagtcccccttcatatgctcccagccccgcgagaatgggatgcggagctgtaggtcggtccctaccctccgaggcgacggcgggggggggcccccatgcggcctcgattacgaagcctacaactcatcaagcaatactacttgtgtgaattggaaccagtactacacaaattgctctgcgggtgagcataaccccttcaagggtgccataaattttgacaacatcgggtacgcctggatcgctattttccaagtcatcacgctggaaggatgggtggatattatgtacttcgttatggatgcccactcgttttataattttatttatttcattttgttaattattgttggtagcttctttatgataaatctgtgtttggtggtgattgcaacacagttttcagaaacaaagcagagggagtctcagttgatgcgcgagcagagggtgcggtttttgtcaaatgctagtaccctggctagtttcagcgagcctggcagctgttacgaagaattactcaaatacttggtctacatactgcgtaaggccgccagacgactggcgcaggtgtctcgggccgcaggtgttcgggtcgggttgttgtcctctccggcccctctcggcggccaggagacgcagccttctagttcctgttctcgcagccacaggcgactttccgtgcaccatctggtgcatcaccatcaccatcaccatcaccattaccacctgggcaatggtacattgcgtgcccctagggcgtcacccgaaatccaggatcgcgatgctaacggatcccggcgactgatgttacccccacccagcaccccagcactgtcaggggcccctcccgggggagctgagtcagtgcatagtttctatcatgctgactgtcatctcgaaccggtacgctgtcaggctcctcctcctcggagtccctccgaagccagcgggcgaacagtcggcagtggcaaagtgtaccccacagtccacacaagcccaccccccgagactctgaaggagaaggctctggtggaggtggcagcttctagtggcccgcccaccttgaccagcctcaatatccctcccggtccctatagcagcatgcacaagctactcgaaacccagtccaccggagcatgccagagtagctgtaaaatctcaagcccctgtctgaaggccgactctggcgcctgcggtcccgacagctgtccatattgtgccagggccggtgctggagaggtggagctagcggaccgtgagatgcctgacagtgacagcgaagctgtatatgaattcacccaggatgcgcaacactctgatcttagagacccacactctcgccggcaacgttctctcggccccgatgcagagccctctagcgtccttgccttctggcgcctgatttgtgatacgttcaggaagatcgtcgacagcaaatactttggtcggggcataatgatcgccatactggtgaacaccctaagcatgggcattgaatatcatgagcagcctgaagagttgacaaatgccctggagataagcaatatcgtgttcacctccctgtttgccttagaaatgctgctcaagctgttggtgtacggaccatttggttacatcaagaatccttacaatatcttcgacggagtaatcgtcgtcatctcagtgtgggagattgtaggacagcagggaggggggctctctgtactgcggacgttccgtctaatgcgagtactcaaactggttagatttctgcctgcacttcagcgccagctggtggtccttatgaagacaatggataacgtcgctactttctgtatgctcctcatgcttttcatcttcatattctctatcttaggtatgcatctattcggatgtaaatttgcctccgaaagggatggggacacattgccagataggaaaaattttgactctttactgtgggcgatagtgactgtctttcagatcttaacccaggaggactggaacaaggttctgtataacgggatggcgagcaccagttcttgggcagccctgtactttattgccctgatgactttcggcaactatgtcctcttcaatctccttgtggcaatactggttgagggattccaggctgaagaaatttctaaacgcgaggacgcctctggccaactgagctgtatacaactccctgtggactcacaagggggagacgctaacaagtccgagtccgaaccagatttcttctccccttctcttgacggtgacggcgaccgaaagaaatgtctggcactggttagccttggtgaacaccctgaattaagaaaatctttgttgccccctcttatcatccataccgcggccacccccatgagtttacctaagtcaacctcgactggtttgggcgaggctctggggccggcctctaggcgcacctcctccagcgggtccgccgaacccggcgcagcacacgaaatgaagtcccctccgagcgcaagatcctctccgcattccccctggagcgcagcttcaagctggacgtcgagaaggagttccaggaattcactcgggcgggcccccagtcttaaacgcaggtcaccttcgggagagcgcaggtccctcctgtctggagagggacaggaatcacaagacgaagaagagtcatctgaggaagaacgagcttcccctgcaggttcggaccacagacatcgcggctcattggagcgcgaggcgaagagtagctttgacctgcccgacactcttcaggtgcctggattgcacagaacagcctcaggcagggggagtgccagcgaacaccaggactgtaacgggaagtctgccagtggccgtctggcccgtgccttgaggccggatgacccaccgctggacggggatgatgctgacgacgagggcaatctttctaagggagagagagtacgcgcatggattagagcccgattgcccgcctgctgccttgaacgtgatagctggtctgcctacatctttccaccacagtcaaggttcaggcttctgtgccataggatcattactcataaaatgtttgatcacgtggtgctagttatcatttttttaaattgcataaccattgctatggagaggcccaaaatcgatcctcactctgcggagcggattttcctgacactttcaaattacattttcaccgccgtgttcctggccgagatgacggtgaaggtggtggccttgggctggtgctttggggagcaagcctacttacgctcttcctggaatgtgttggacggactgctcgttttaatttcagtgattgatatcctcgtgagcatggtgtctgacagtggaacaaagatcctcggaatgctccgagtgcttcggctattgcggaccctgcggcccttacgagtgatttcaagagcgcaaggactaaagctcgtggtggaaaccctgatgtcttctctgaagccaatcgggaacatcgttgtaatctgctgcgcattcttcataatcttcggcatcttaggggtccagctgtttaaagggaagttttttgtgtgtcaaggagaggatacccgcaatattaccaataagtccgattgcgctgaggcgagttataggtgggtgagacataaatacaatttcgacaatctgggtcaagccttgatgtccttattcgtgctggcatctaaggacggatgggtagatatcatgtatgatggactggatgccgtgggagtggatcagcaacccataatgaatcacaacccatggatgctgctgtatttcatttcattcctgttgatcgtggccttttttgtactgaacatgttcgtgggcgttgtcgtggaaaattttcacaagtgccgacagcaccaggaggaagaagaagccaggcgccgagaggagaagcgacttagacggttggagaagaaaagacggtcgaaggaaaagcagatggccgaagcccagtgtaagccctattactccgattactcgaggttccgcctactggtccaccatctgtgcacgagtcactaccttgacctgttcatcaccggcgtcattgggctaaatgtggtcactatggctatggagcattaccagcagccgcagatcctggacgaagcccttaagatttgtaattacatctttaccgtaatctttgtgctcgagtctgtgttcaaactcgtggccttcggattcaggaggttcttccaggacagatggaaccaacttgacctggcaattgttctcttgtcaatcatggggattaccctcgaagagatcgaggtaaacgcctctctccccatcaatccaaccataatccgcatcatgcgcgtcttacggatagcccgtgtcctcaagttactaaaaatggcggtgggcatgagggctctgctggacacagttatgcaggctttgccgcaggttgggaatcttggcttgttgttcatgctgttgtttttcatctttgccgccctgggagtcgagctgttcggtgatttggaatgcgatgagacccatccatgcgaaggccttggacgccacgccacatttagaaatttcggtatggcttttctgactctgttcagggtgagcacaggcgataactggaatggcattatgaaagatactctgcgggattgtgaccaggaaagcacttgttacaacactgttatctcgccaatctacttcgtgtcattcgtgttgactgctcagtttgtgctggtcaacgtagttatagcagtgttgatgaaacacctggaggagagtaataaagaagctaaggaagaggccgaactggaggctgagctggagctggaaatgaaaacgttaagtcctcagccccattcgccccttggaagccctttcctctggccgggagtcgaaggaccggactcgccagatagccccaaacctggcgctcttcaccccgccgcccatgctcggagtgcgtcccacttctccctggagcatcctaccgatagacagctcttcgataccatcagtctgttgatccagggctccctggagtgggaactgaagctcatggatgaactggcaggcccgggcggccagcccagtgcattcccatcagcgccgtcactgggcggatccgatcctcagatgcagccccatcccaccgaactgcccgggcctgacctactgactgtacggaaatccggggtgagtcgcactcattctctgcccaacgactcctacatgtgtcgccatggatcaacagcagagggcccactgggacatcgcggctggggactccccaaggcccagagcgggtctgtcctctcagtgcactcccagcccgctgacacatcatacatcctgcagctgcctaaagatgcgccacatttgcttcaacctcattccgcaccaacgtgggggacaatccctaaactccctcctccaggtaggagccccctggctcagaggcctctgcggagacaggcggcgatcagaactgactccctagatgtgcagggattgggctcccgagaggatctgctcgctgaagtgtccggtcctagccctcctctcgctcgcgcatattctttctggggacagagtagcacacaagcccaacagcactcgcggtcgcatagtaagatctccaaacatatgacgcccccagcgccctgccccggccctgagcccaattggggcaaaggtccccctgagacaaggtctagcctggaactggataccgagcttagctggatcagcggtgacctgttgccgcccggcggccaggaggaaccaccctcccctagggatttaaagaagtgctactctgtggaggcccaatcctgtcagcggcggcctacgagctggctggacgaacagcggcgccactcaatagctgtatcatgcctggatagcggatctcagccccatttgggaaccgacccgagcaacctgggtggacagcctctcggcgggccgggcagtcgacccaagaagaaactgtcccctcctagcattacaatcgaccctcccgaatcccaaggtcctagaaccccgccttcccctggcatttgcctgcgtcgcagagccccatcatcagactcgaaggaccctctagcttctggtccccccgactcaatggctgcctcccccagtcccaaaaaagacgtactgtcactgagcgggttatcaagcgatcccgccgatctggatccgtag

SEQ ID NO: 40724 - DNA, 1035 bp, Artificial Sequence
  Description of Artificial Sequence: Synthetic coding sequence
atggacaagttccggatgctgttccagcacttccagagcagcagcgagtccgtgatgaacggcatttgtttgcttctcgccgccgtaacagtgaagttgtattccagcttcgattttaattgcccttgcctggtacattataacgcgctttatggcctggggctcctgctcactcctccgttggcgctgttcctgtgtgggctgctggctaaccgccaaagcgtggttatggtggaggaatggcggcgcccagctgggcacagaagaaaggacccaggaatcattcgctatatgtgctcctctgtgttacaacgtgccctcgcagcccccctcgtgtggatcttgctagcactcctggacggcaagtgttttgtgtgcgcgttcagctccagtgtggatcccgagaaattcctagattttgcgaatatgacaccctcccaggtccagcttttcctcgctaaggttccctgcaaagaggatgaattagtccgagactctcctgcccgcaaagcagtgtctaggtatctgaggtgtctgtcccaggcgatcggctggtcagtgacgctgctgctgatcattgccgccttcctggctagatgtcttcggccgtgttttgaccagaccgtattccttcagagacgatactggtcaaattacgtcgacctagagcagaaactgtttgatgaaacatgctgtgaacatgctagggactttgcgcacaggtgcgttttgcacttctttgcgtctatgcgcagtgagttacaggcgagaggtctgagacggggaaacgccgggcgtagactcgagctcccagcggtgcctgaaccacctgagggcctggattctgggtcaggtaaggctcatctccgcgccatatcatctagagagcaggtggacaggttactgtccacctggtattcctccaaaccccccctggatttggccgccagtccagggctgtgcggcggtggcctcagccaccgagctccaaccctcgctttgggaaccagactatcacaacacaccgatgtgtag

SEQ ID NO: 40725 - DNA, 1431 bp, Artificial Sequence
  Description of Artificial Sequence: Synthetic coding sequence
atgggccggaaggaggaggacgactgcagcagctggaagaagcagacaacaaacattcggaaaactttcatctttatggaggtgcttggctcgggggccttttccgaggtgttcctagttaaacagcgcctcactggcaagctgttcgcactcaagtgtatcaaaaaatctcccgcatttcgggactcctctttggaaaacgaaattgcggtgctgaagaaaattaagcatgaaaatatcgttaccctggaggacatctacgaatctaccacccactattatctggtcatgcagctcgtgtcaggcggggagctgtttgatcgtattctggaacgtggtgtgtacacagaaaaggatgcgagcctggtgatacagcaagttctctctgctgtcaaatacttgcacgaaaacggcatcgtgcaccgtgacttgaagccggagaaccttctgtatttaacacctgaggagaatagcaagatcatgattaccgatttcggactcagcaagatggagcagaacggcatcatgagcacagcgtgtgggacacctggatacgtggctcccgaggtccttgcccagaaaccctactctaaggctgtggactgttggtccatcggagtcataacctacattctgctgtgcggctaccccccattctatgaagagaccgagagcaagctgttcgaaaaaatcaaggaggggtactacgagttcgagtcacccttctgggacgatatttctgaatcagccaaggactttatctgccatctcctggagaaggaccctaacgaaaggtacacctgcgagaaggccctctcccacccatggattgatggaaacactgctctgcatagagatatctatccatctgtcagcttgcaaatacagaaaaacttcgctaaatcgaaatggagacaggcctttaatgcagccgctgtcgtccaccacatgcggaagctccacatgaacttgcactcacctggggtgagacccgaagtcgagaaccggccaccagagactcaagccagtgaaacatctcggccctcatcccccgaaattactatcacagaggccccagtgctcgatcatagcgtagcattaccggccctgacccagctgccgtgccagcatgggcggaggcccactgcaccaggcggtagatccctgaattgtctcgtgaacggctccctgcacatttcaagttcccttgtccctatgcaccagggatcactcgccgctggcccctgtgggtgttgttcaagctgcttaaatattgggagcaaaggtaagagctcatattgttctgagcctactctccttaagaaggcaaacaagaagcagaacttcaagtctgaagtgatggtgcccgtgaaagcttcagggagctcccactgtcgggccggacagaccggcgtgtgcctcatcatgtag

SEQ ID NO: 40726 - DNA, 1431 bp, Artificial Sequence
  Description of Artificial Sequence: Synthetic coding sequence
atgggccggaaggaggaggacgactgcagcagctggaagaagcagaccaccaatattcgcaaaacatttatttttatggaagtgctcggctccggcgcattctcagaggtgttccttgtcaaacagaggctcaccggaaaactgttcgccctcaagtgtatcaaaaaatctccagcgttcagagattcatcactcgagaatgaaatcgctgtcctcaagaaaatcaaacatgaaaacattgtcaccttggaagacatctatgaatccacaacccattactacctcgtgatgcagcttgtgtccggtggcgagctatttgatcgcatcctcgagcgcggtgtgtataccgagaaagatgcatcattggtaattcagcaggtattaagcgccgttaaatatcttcatgagaatggaattgtacaccgggatctcaagcctgaaaatctcctgtacctgacccccgaggaaaactcaaagattatgatcaccgacttcggactgagcaaaatggaacagaatggaatcatgtcgactgcctgcgggacgccggggtacgtggccccggaagtgctggcacagaaaccttatagcaaggctgttgattgctggagtatcggggtgatcacctacatcctgctatgtggctaccctcccttctatgaagaaacggaaagtaaattgttcgagaaaattaaagagggttattatgagttcgagagtccattttgggacgatatcagcgagtccgccaaggatttcatttgtcacctgttagagaaagaccctaatgaaagatatacatgtgagaaagcactctcgcacccctggattgacggaaacactgccctgcaccgggatatctatccttccgtgagtctacagatccagaagaatttcgccaagagcaagtggagacaggcctttaacgctgctgcagtggtccaccatatgcgaaaacttcacatgaacctgcacagcccaggcgtacgaccagaggtggagaatagacccccagagacccaggcaagcgagacgagcagaccgtccagtccagaaatcacaatcaccgaggccccggtgctcgatcacagcgtggcacttcctgcgctgactcagcttccatgccagcacgggcgccggccaaccgcaccaggagggagaagcttgaattgcttagtgaacggtagcctgcacatcagctcttctttagtgcccatgcaccaaggctcgctcgccgccggtccttgcggctgctgctctagctgcctgaacattggttcaaaaggcaagtctagttactgctccgagccgacactgttaaagaaagcaaataagaagcagaacttcaaatctgaagtcatggttccggtgaaggcctccgggagttctcactgccgagccggtcagacaggtgtctgccttatcatgtag

SEQ ID NO: 40727 - DNA, 654 bp, Artificial Sequence
  Description of Artificial Sequence: Synthetic coding sequence
atggtgaagctgggctgcagcttcagcggcaagcccggcaaggacccaggggatcaagatggggccgctatggattcagttccactgatttctccattagatatctctcagctgcagcccccgctgcccgaccaagttgtaatcaaaactcagaccgaataccagctgagctcacccgaccagcagaactttcctgatctggaaggccaacgtctaaactgcagtcatcccgaagagggcaggagattgccaacagcccgaatgattgcctttgcaatggccctgctgggatgtgttctcatcatgtacaaggcaatatggtacgaccaatttacctgccctgatggtttcctgttacgtcataagatctgcactcctctgaccttggagatgtattacaccgagatggaccccgagcgccatagatctatcctggccgccattggagcctacccactcagtaggaaacatggtaccgagacccctgccgcttggggggacggctatcgcgcagctaaagaagagcggaaaggccccacccaagccggcgcggcagcagctgccacagaaccccctggaaagccaagcgctaaggcggagaaggaagcagcacgcaaagcagctggaagcgctgctccaccccccgctcagtag

SEQ ID NO: 40728 - DNA, 477 bp, Artificial Sequence
  Description of Artificial Sequence: Synthetic coding sequence
atggtgaagctgggctgcagcttcagcggcaagcccggcaaggaccccggcgatcaggatggggcagcaatggactccgtgcccctgattagtcctctggatatctctcagttacagccacctctgccagatcaagtggtgattaaaacacagaccgaataccaactctcttcacccgatcagcagaattttcctgacctggaagggcagaggttgaattgttcacaccccgaagagggaaggcgcgtgacaacacccactccccccaccgtggggactcaagaccgccgccgtcgctggaaggcagccggtggcgcatgggtgccaagtagaccagtctggggcccgttggcgctgcgagaagaacgtgtggccgtgagccaccctgcccaatcatggcctcaccggctgccttgtacccaccaggctccaagccggggctgcagatgccgattgactaagcaatggaggtcgtag

SEQ ID NO: 40729 - DNA, 375 bp, Artificial Sequence
  Description of Artificial Sequence: Synthetic coding sequence
atggtgaagctgggctgcagcttcagcggcaagcccggcaaggacccaggtgatcaagatggtgccgccatggattctgtgcccctcattagccccttggacatcagtcagttacagccgcctttgcccgaccaggtagtcatcaagacacagactgagtatcaattgagcagcccagatcagcagaacttccccgacctggaaggacagcgccttaactgctcccatcctgaagaaggacgccggctccccaccgcgcgcatgatcgccttcgcaatggctttgctggggtgtgtgctcatcatgtataaggccatctggtatgatcagttcacatgccccgacgggttcctcctaaggggtccggagttttag

SEQ ID NO: 40730 - DNA, 375 bp, Artificial Sequence
  Description of Artificial Sequence: Synthetic coding sequence
atggtgaagctgggctgcagcttcagcggcaagcccggcaaggaccctggagaccaggacggcgccgctatggattcagtcccgttgatatccccgctggacatctctcaactgcaaccccccttgcccgatcaggtcgtgataaaaactcagaccgaataccagctgtcatcccctgatcagcaaaatttcccagatttagaaggacagagacttaactgttcacatcctgaggaagggaggcggctgcccactgctaggatgattgccttcgctatggcccttctgggctgcgtgctgatcatgtataaggcgatctggtatgatcagtttacctgtcccgacggctttctgctgcggggcccagaattctag

SEQ ID NO: 40731 - DNA, 1833 bp, Artificial Sequence
  Description of Artificial Sequence: Synthetic coding sequence
atgcacttccaggccttctggctgtgcctgggcctgctgttcatctcgatcaacgccgagttcatggatgatgatgtggagacagaggactttgaggagaattcagaggagatcgacgttaacgagagtgagctcagctctgaaattaagtacaaaaccccacagccaattggcgaggtgtactttgccgaaacctttgacagcgggcgactggccggttgggttcttagtaaggccaaaaaggatgatatggatgaggaaatttcgatctacgatgggcgctgggagatcgaggagctcaaggaaaaccaggtccctggcgaccgaggcttggtgttgaaatcaagagccaagcaccatgcgatcagcgccgtgctcgccaaaccattcatcttcgccgacaagcctcttattgtccagtacgaggtgaacttccaagacggtatcgattgcgggggcgcttacattaagctgttggccgatactgatgacctgatactcgaaaacttttatgataaaacgagttatattattatgttcggtccagacaaatgcggtgaagactacaagctccacttcatattccgacacaagcacccaaaaactggtgtcttcgaggaaaaacacgccaaaccccctgacgtggatctgaagaaatttttcaccgaccggaaaacccatctgtatacccttgtcatgaacccagacgatacctttgaggttctcgtggaccaaacggtagttaacaaaggcagtctgctggaagatgtagtgccacccattaagccccctaaagaaatcgaagatccaaatgacaaaaaacctgaagagtgggacgaaagggctaaaatacccgacccatcagccgtgaagcctgaggactgggacgaatctgagccagcccaaattgaggatagcagtgtggtgaaaccagccgggtggttagatgatgaaccaaagtttattcccgacccaaatgcagagaagcccgatgactggaatgaagatacagatggcgagtgggaggctccccaaatcctgaatcctgcgtgccggattggatgcggtgagtggaagccccccatgattgacaatccaaagtataagggggtgtggagacccccactggtggataatccaaactaccaggggatctggtccccaaggaagattcctaacccagactactttgaggatgaccacccttttctcctgacaagcttttccgctctgggattggagctgtggtccatgacctccgatatctacttcgataattttataatctgttctgaaaaagaggtagctgaccattgggccgcagacggatggaggtggaagatcatgatagcgaatgcaaataaacctggggttctgaaacagctcatggccgcagcagaagggcacccatggttgtggctgatatacctggtaactgccggcgtgccaatagccctgatcacctcattctgctggcctaggaaggtaaaaaaaaaacacaaggacacagaatataagaagacagacatatgcattcctcagaccaaaggcgtactggagcaagaggaaaaagaggagaaggcagctctcgagaaaccaatggacttagaagaggagaagaaacaaaatgacggggagatgttagagaaggaggaagaatccgagcccgaagagaaatccgaggaggagatcgagatcatcgagggtcaggaggagtccaatcagagtaacaagtccggaagtgaggatgaaatgaaagaggctgacgagtcaactggttccggggatggcccaattaagtctgtccgaaaacggcgagtgaggaaggactag

SEQ ID NO: 40732 - DNA, 1833 bp, Artificial Sequence
  Description of Artificial Sequence: Synthetic coding sequence
atgcacttccaggccttctggctgtgcctgggcctgctgttcatcagtataaacgccgaattcatggacgatgatgtggaaaccgaggacttcgaggagaactctgaggaaattgatgttaatgagagcgaacttagttccgaaatcaagtacaaaacgccacagcccatcggagaagtctactttgctgagacattcgacagcggaagactcgccgggtgggtgttgagcaaagcgaagaaagacgacatggacgaggaaatttctatctatgatggccgctgggagatagaagaactgaaggagaaccaggtgccaggagacagagggctagttcttaagtcaagggccaaacaccacgccatttcggctgtcctggccaagccgttcatctttgccgacaaacctctgattgtgcagtatgaagtcaactttcaggatggtatagactgtggaggtgcgtacattaagctactggccgatactgacgatcttatcctcgaaaatttttatgataagactagttacatcattatgtttgggccagataaatgcggagaggattacaaactgcactttatattcaggcacaaacaccctaaaacgggcgtgttcgaggagaaacatgctaaaccccccgatgtcgacctcaaaaaattttttaccgacaggaagactcatctgtatacgctggtgatgaatccagatgacacttttgaggtgctcgtggaccaaaccgtcgtgaacaaggggtccctactggaggacgtggtgccgccaataaaacccccgaaggagattgaagatcccaatgataaaaagcctgaagagtgggacgagagagcaaagatacctgacccttctgccgtgaagccagaggactgggacgagtctgagcccgctcagatagaagactcatccgtagttaaaccagccggatggcttgacgatgaacccaagtttattccagatccaaacgcagagaagccagacgactggaacgaagacacagatggagaatgggaggccccgcaaatcctgaatccagcatgtcgtatcgggtgtggagaatggaagccccccatgatagataatcctaaatacaaaggcgtatggaggccaccactagtggataaccccaattatcagggcatctggtctccacggaaaatacccaaccctgactactttgaagacgaccatccttttttgctgacatctttctctgctttgggcctcgaattgtggtccatgaccagtgatatctacttcgacaatttcattatttgtagcgagaaggaggtagctgaccattgggccgctgacggctggcggtggaagataatgatcgccaatgccaacaaaccaggagttttaaagcaactcatggcagctgcagagggccatccttggctttggttgatctacctagtcaccgccggtgttcccattgccctgattacaagcttttgctggcctaggaaggtgaagaaaaaacacaaagataccgagtacaaaaagaccgacatatgcatcccacagaccaagggcgtcctggaacaggaggagaaggaggagaaggccgcactggagaaaccaatggacctcgaagaggagaagaaacagaatgatggtgagatgctggagaaagaagaagaaagcgagccggaagaaaagtcagaggaggagatcgagattatcgaaggacaggaagagagtaaccagtctaacaagtccggttccgaggatgagatgaaagaagccgacgaaagtactgggagtggtgacggacctattaaatcagtacggaagaggcgcgtgcgcaaagactag

SEQ ID NO: 40733 - DNA, 540 bp, Artificial Sequence
  Description of Artificial Sequence: Synthetic coding sequence
atgcacttccaggccttctggctgtgcctgggcctgctgttcatctccatcaacgcagagttcatggatgatgacgtggaaacagaggatttcgaagagaactccgaggaaatcgatgtaaacgagtccgagttatcatccgaaataaaatacaagacaccacagcctatcggcgaggtgtatttcgccgagacctttgattctggccgactggcagggtgggtgctgagcaaggcaaaaaaagatgacatggacgaagaaattagtatctacgatggcaggtgggaaattgaggagctaaaggagaaccaggtcccgggcgaccgagggctggtgttaaagtctagagctaaacaccacgccatttccgctgtgctggcaaagccttttatcttcgcggacaaaccgcttattgtccaatacgaggtgaattttcaagacggaatcgattgtggcggggcgtatatcaagctacttgccgacacagacgatctgattttggagaatttctacgacaaaacctcatacatcattatgtag

SEQ ID NO: 40734 - DNA, 1833 bp, Artificial Sequence
  Description of Artificial Sequence: Synthetic coding sequence
atgcacttccaggccttctggctgtgcctgggcctgctgttcatctccatcaacgcagaattcatggatgacgacgttgagacggaagatttcgaggaaaatagcgaggaaatcgatgtgaatgagtccgagctcagtagcgagattaagtataaaaccccacagccaatcggcgaggtgtattttgctgaaaccttcgacagcggtcgcttggccggatgggtgttgtccaaggcaaagaaggacgacatggacgaagaaatcagtatctacgatggacgatgggaaatcgaagagctaaaggagaaccaagtgcccggcgaccgcggcttagtgttgaagagtagggctaagcatcatgcaatcagtgctgtactcgccaagccgttcatattcgctgacaaacccctaatcgtccagtacgaggtcaacttccaggacgggatagactgcgggggagcctatatcaagctcctggccgatactgacgatcttatcttggaaaacttctatgacaagacttcctacatcatcatgttcggcccagacaaatgtggggaagactataaactgcacttcatttttcgccataaacatccgaagaccggcgtgtttgaagaaaaacatgccaagcccccggatgtggatctgaagaagttctttaccgatcggaaaacccatctctatacccttgtcatgaacccggatgacacttttgaagtcctcgtggaccaaaccgttgtgaataaaggtagtttgctggaggacgtggtgcccccaataaagccaccaaaggagattgaagaccctaacgataagaaacccgaagagtgggacgagagggcaaagattcccgacccctctgcagtgaagcctgaagattgggatgagagcgagccagcccagatcgaagacagctccgtggtcaagccagcggggtggctggacgacgaaccaaaattcatccccgatccaaatgcagaaaagcccgatgattggaacgaggacactgacggcgaatgggaggctccccagattctgaaccccgcttgcagaattggctgtggtgaatggaaaccacccatgattgacaacccaaaatataaaggtgtctggaggccccccttggtcgacaatcctaattaccagggaatatggagtccccggaagatccccaatcccgactactttgaagacgaccacccttttctgcttaccagtttcagtgctctgggcctcgagctttggtctatgaccagcgatatttacttcgacaatttcatcatttgttcagagaaggaagtggcagatcattgggcggcagatggttggaggtggaagatcatgattgcaaatgctaataaacccggagtcttaaaacagctaatggctgcagctgaaggacacccttggttgtggctcatttatcttgttaccgccggggttcccattgcactgatcacaagcttttgttggcccagaaaagtgaagaaaaagcataaggacaccgagtacaagaaaacagacatctgtatcccccagaccaaaggcgtcctggagcaagaagaaaaggaggaaaaggccgcccttgagaagccgatggacctggaagaagaaaaaaagcagaatgatggcgaaatgttggagaaggaggaggaaagtgagccagaagagaagtctgaagaagagatcgagatcattgagggccaggaagagagtaaccagtctaacaagtcaggaagtgaagacgaaatgaaagaggccgacgaaagcaccggctctggtgacggaccaataaagagcgtgcgcaagcggagagtgcgcaaggactag

SEQ ID NO: 40735 - DNA, 1584 bp, Artificial Sequence
  Description of Artificial Sequence: Synthetic coding sequence
atggacgaggagatcagcatctacgacggccggtgggagatcgaggagttaaaagagaaccaggtccccggagatcggggtttggttctgaaatcaagagcgaagcaccacgccatcagtgcggtgttggccaaaccctttattttcgcggacaagccattaatagtgcagtacgaagtcaattttcaggatggcatagactgcggaggcgcttacatcaagcttcttgccgataccgatgacctaatattggagaacttttacgataaaacttcctatataatcatgttcggaccagacaaatgtggggaggattacaaactccattttatatttaggcacaaacaccctaaaaccggagtgtttgaggagaaacatgcgaaaccccccgacgtggatctgaagaagttctttacagatcgaaagacccatctgtatactctggtcatgaaccctgacgatacttttgaagtgcttgtcgatcaaaccgtcgtaaataaggggagcctcctggaggatgtggtgcctcctattaaacctccaaaggaaattgaagaccctaatgacaaaaagccagaggaatgggacgagcgcgctaagattcctgacccatccgccgtcaagcccgaggattgggacgagtcggaacctgcacagatcgaagatagctccgtggtgaagcccgctggttggcttgacgatgagcccaaattcataccagatcccaacgcagaaaaacccgacgactggaatgaagacaccgacggcgagtgggaagccccacagattctgaatcctgcctgcaggataggatgtggggagtggaagcctcccatgatcgataatccaaagtacaagggcgtgtggcgccccccactagtagacaacccaaactatcagggaatctggagcccaagaaagattcccaacccggattactttgaagatgaccatcctttcctcctcacttccttctcagccttgggcctggagctgtggagcatgacaagcgatatttatttcgataacttcatcatctgttccgagaaggaagttgcggaccactgggctgccgacggctggaggtggaaaatcatgatcgccaatgctaataaaccaggtgttctcaagcaacttatggccgccgctgaaggccatccctggctttggctcatctatctggtcaccgccggtgttccgatcgcgctgattacctcgttttgttggcctagaaaagtaaagaagaaacataaggatactgagtacaagaagacagacatttgtattccacaaacgaaaggcgtcctcgaacaagaggagaaggaggaaaaggcagcgcttgagaaaccaatggacctggaggaagagaagaaacaaaatgacggggagatgttagagaaagaggaggagtcagaaccggaagaaaaatcggaagaagaaattgagataatagaggggcaggaagaatcgaaccagagtaataagagcggaagtgaggatgagatgaaagaagctgacgagagtaccgggagcggggatggccctattaaatccgtgcgaaaaaggagagtcagaaaggactag

SEQ ID NO: 40736 - DNA, 3750 bp, Artificial Sequence
  Description of Artificial Sequence: Synthetic coding sequence
atggtggaggccgccccccccggccccggccccctgcggcggaccttcctcgtcccagaaatcaaatcactggatcaatacgatttctctcgggcaaaggctgcagcctctctcgcctgggtgttacgggctgcatttggaggcgctgaacacgtgcctcctgagctttgggaaccattctataccgatcagtacgcccaggaacatgtaaaaccccctgtcacgagactgcttctgtccgcagagctttattgcagagcttggcgacaggcactaccccagctggagacaccacccaatccatccgctctgctggcactgctggccaggcgagggacagtgcccgcactgccagagcgacccgttcgggaagcagatctgagacaccagcctatcctcatgggagcacatttggcggttatagatgccctgatggcagcctttgcctttgaatggacaaagactttgccaggtcctctcgccctgacctccttagagcacaaactgctgttctgggtcgacacaaccgttcgtcgactgcaggaaaagaccgaacaagaagccgcccagcgggcctcacctgctgctccagcagacggcgcggcccccgcacaaccctctattcgatataggaaggaccgggtggtggctaggagagccccttgcttcccaactgtcacttctctgcaggatctggctagtggcgcagcgctggctgctactatccactgttattgcccccaactcctcagactggaagaagtgtgtctaaaagatccaatgagtgtcgccgactcactgtacaatttgcaattggttcaggatttttgcgcttcaaggttaccccggggttgcccactatcccttgaggacctgctgtacgtgcccccaccgctcaaagtcaatcttgtggtcatgttggctgagttatttatgtgctttgaggtattgaaaccagatttcgtgcaggtgaaggatcttcctgatggacatgccgcaagtccccgagggaccgaggccagccctccgcaaaataatagtggcagctctagtcctgtgttcacctttcgccaccctttactgagctctggtggacctcagtctccgcttcgcggatcaacaggatctcttaaaagcagtcctagtatgagccatatggaggccctaggcaaggcctggaaccgtcagttgtctcgaccattgagccaggctgtgtcattttcgactccattcggactggactcagacgtggatgtggtcatgggagatccagtcctcctgagaagcgtgtcctccgattctctcggacccccaagaccggccccagcgagaactcccacccaacctcctcctgaacctggcgaccttcctacgatagaagaagcactgcagataatccattcagctgaacccaggttactgccggacggtgccgctgacggctctttctatctacacagccccgagggaccctccaaaccatcccttgcgtccccttatcttccagaaggaacgtcaaaacctctctctgatcgccctacgaaggcccccgtttacatgccccatcccgagacacccagcaagccaagtccatgtctggtgggcgaagccagtaagcctccggcgcccagcgagggctcgcccaaggccgtggcctcttcgccagccgccacaaacagcgaagtgaagatgacaagtttcgcagaacgtaaaaagcagttagtaaaggcagaggctgaagcaggagcaggtagtcccacctcaacccctgcaccgcccgaagctctcagctcagaaatgtcggagctctctgccagattagaggaaaagaggcgggctattgaagcccagaagagacgaatagaggcaattttcgccaagcatcggcagcgactgggcaagagcgcgtttttgcaggtgcagcctcgggaggctagcggagaggccgaggcagaagctgaggaagccgactccgggccagtcccaggcggggaaagacctgccggtgaaggacagggagagccaacctcccgccccaaagctgttacttttagccccgatttgggtcctgttccacacgagggtctaggtgaatataaccgcgccgtgagcaagcttagcgccgccctgtcctccctgcaacgcgatatgcaaagactgacggaccagcaacagagactgttggccccccctgaagcaccaggttccgctccacccccagctgcttgggtcatcccggggccaacaaccgggcctaaagccgcatccccctctccggctcggcgcgtccccgcaacccgcaggagcccagggcccgggccgagccagagcccacgatctcccaagcacacccgaccagcagagttgcgcctggcccctctgacccgagtactaacccccccccacgatgtcgacagtttgccacatttgcggaagttttccccctctcaggtgcccgtacagactagaagtagcatcctgttggctgaagagacccctcccgaagagcccgccgccaggcctgggctgattgagatccccctggggagtttagctgacccagctgcggaggacgaaggagatggctcgcctgccggggctgaagacagtctggaggaggaggcgagttcagaaggagaaccccgcgtgggccttggtttcttttacaaagatgaagataaaccagaagacgagatggcccagaaacgtgcgagcctgttggagcgccagcagagacgcgcggaggaagctaggaggcgcaagcagtggcaggaagtggagaaagagcagcggagagaggaagccgctcgtctggctcaggaagaggccccaggacctgccccacttgtgtcggctgttccgatggcaaccccagcaccggctgctcgggcaccggctgaggaggaagtcggtccgcgaaaaggtgatttcacacgacaggagtatgaaagacgggcccagcttaagctgatggacgacctggataaagtgttacggcctcgcgccgctgggtcagggggcccagggagagggggaagacgcgcaacccggcctcggagtggatgctgcgatgacagcgccctggcacggagccctgccagagggctcctcggcagccggctctctaagatttactcacaatctaccttatctctcagcacagtcgcaaacgaggctcataataacctgggggtgaagaggcctaccagccgcgccccgtccccttcgggtctgatgtcacctagccggctccctggcagcagagaacgagactgggagaatggttccaatgcttcctctccggcaagcgtccctgagtacacaggtcctagactttacaaggagccctctgccaagagcaataagttcatcatccataatgccctttcccattgttgtctggcaggcaaagtgaacgaaccccagaagaataggattttagaggagatcgagaaaagcaaggccaaccattttctgattctgttcagggacagctcatgccaattccgggctctgtacacactcagcggggagacggaggagctctctcgattggccggctacggcccccggaccgtcactccagccatggtggagggaatttacaagtataacagcgaccggaagcgttttacccaaatcccagctaaaactatgagcatgtccgtggacgcctttaccatccaaggccacctgtggcaggggaaaaagcccaccacaccaaagaagggaggcgggacgcctaaatag

SEQ ID NO: 40737 - DNA, 3831 bp, Artificial Sequence
  Description of Artificial Sequence: Synthetic coding sequence
atggtggaggccgccccccccggccccggccccctgcggcggaccttcctggtccccgaaattaagtccctcgaccagtatgatttcagccgggccaaagccgcagcatctctcgcctgggtcttgagggccgcattcggtggcgccgaacacgtacctccggagctgtgggaacccttctacaccgatcagtacgctcaggaacatgttaaacctccagtcactcgcttgcttttaagtgccgagctatactgccgggcctggcgacaagccctgccccagctggaaacccctcccaacccttccgccctgctggcgcttctggcgagaagagggactgttccagcgctgcctgagaggcctgttagagaagccgatctgcgccaccagccaatcctcatgggcgcccacttggctgtgatagatgcacttatggctgccttcgcattcgagtggaccaaaacactgcctggcccactcgctttgacctcactggaacacaagctgctgttctgggtggacaccactgtccggaggctgcaggagaagacagagcaagaagctgctcagagagcaagcccagccgctccagctgatggagccgcacctgctcaacctagctgccccacaagatggtattggaagcttgtgccacatgcaattgctttttgcctgaaggaatctgggtcaaagccgcctatgattcggtatagaaaggaccgcgtggtcgcgaggagagctccatgtttcccgaccgttacctcactgcaagatctcgcttccggcgccgcccttgcggcaacaattcattgttactgtccacagctgcttcggttggaagaggtgtgcttaaaggacccaatgagcgtggccgactcactctataaccttcaactggtgcaagacttctgtgcttcgcgtctccccagggggtgtcccctgtctctcgaggacctattatatgtgccgcctccattaaaagtgaatctggttgtgatgctggcggagctcttcatgtgcttcgaggtcctcaagcccgattttgttcaagtaaaggacctgcccgatggtcacgccgcctctccaaggggaacggaggcctcaccaccccaaaacaactctgggagctcgagcccggtatttacattccgccacccactgctatcttcaggcggtccccagtctccgctgaggggcagtactggctcattgaagtcatctccatctatgtctcatatggaagcgcttggtaaagcctggaatcgtcagctgtcccggccactgtcccaggcagtatctttctcgactcccttcggactggacagcgacgtcgatgtggtgatgggtgaccctgtcctgttaagatctgttagttccgattccctaggtccaccccgccctgcaccagcacgaacacccacccagcctcctccagagcccggcgacttacccaccattgaggaagctctgcagatcattcatagtgccgaaccccgactgttgcccgatggggcggccgacggctctttctacctacacagcccagagggaccaagcaaaccttctctagcatcgccgtatctaccagagggaacctccaaaccactaagcgacagacctaccaaagcccctgtgtatatgcctcacccggagactcctagtaaaccttccccctgcctcgtgggcgaggcctcaaaaccaccagctccctccgaggggtcccctaaggcggtagccagctctcctgccgcaacaaatagcgaagtaaagatgaccagcttcgccgagaggaagaaacagctggtcaaggcagaggccgaggcaggcgccgggtctcctacttccaccccagcaccccccgaagcgctctcatccgaaatgagcgaacttagcgcccgactggaagagaagaggcgagcaattgaagcccagaaacgtcgtatagaggccatctttgcaaagcaccgacaacgcctaggcaagtccgccttcctccaagtccaacctagggaagcttcgggggaggctgaggctgaggccgaagaggccgattctgggccagtcccaggtggcgagagacccgctggtgaaggccaaggcgagccgacctcaaggcctaaagcagtgaccttttcacctgacctcggccccgttccgcatgagggcctaggcgagtacaatcgggcggtgtccaagttgtccgctgccctgtcaagtctccagcgcgacatgcaacgcctgaccgatcaacagcagcggttattggcgccgcccgaggccccgggatcagccccgcctccggcagcttgggtcatacctgggcctactaccggtcccaaagctgcctctccatctcccgcacgcagagtgcctgcaacccgccgatccccaggtccaggtcctagccaatcacctaggagcccgaaacacacgagacctgccgagctacgcttagcaccccttacacgtgtactgacaccaccgcatgacgtggactctctgccccacctccggaagttcagtcccagccaagtgcccgtccagacccggagctcaattctcctggccgaggaaacaccccctgaggagcccgccgcccgcccagggctgatcgaaatccccctgggttctctcgccgacccagccgccgaggacgaaggggacggttcccccgcaggagctgaagactcccttgaggaagaggcatcatccgaaggagagccccgagttggcctaggatttttttataaagacgaggacaagcctgaagacgagatggctcaaaaacgcgcaagcctgcttgagagacagcagcgccgcgccgaagaggccaggcggcgcaagcagtggcaggaagtagaaaaggagcagaggagggaggaagccgcaagattggcccaggaagaagctcccggccccgcgcctctggtgagcgccgtgcctatggctacaccggccccggccgcccgggccccggccgaggaggaggtcggccccaggaagggcgacttcacccggcaggaatacgaacggcgcgctcaacttaaactgatggacgaccttgacaaagtgctgcgcccacgggccgccgggtctggagggccaggccggggtggacggcgggctactcgacctcggagtggatgttgcgatgatagcgcgctcgctaggtcccctgccaggggcttgctagggagtagactgtccaaaatctatagccagagcacactgagcttgtccaccgtagctaatgaggcacacaacaatctgggagttaagaggcctacctctcgggctcctagtccttctgggctcatgagcccgagtcgcctgcctggctcacgggagagggattgggaaaacgggagcaacgcctccagccccgccagtgtccccgaatacactgggccccgcttgtataaagaaccgtccgctaagtctaacaagttcattatccacaatgccctgagtcactgctgcctggcagggaaggtgaacgaaccgcagaagaacagaatactggaggaaatagagaaatcaaaggctaatcactttctgattctgtttcgagacagctcttgccagttccgcgccctgtacactctgtcgggagagaccgaagagctctccagactggcgggatacggccctcggaccgtgacgcctgccatggtggaaggcatttataaatacaatagtgaccgcaagcggtttacacagatacccgccaaaacgatgtcgatgtctgttgatgcgttcactatccaaggccatttatggcagggtaagaaaccaactacacctaagaaaggcggaggcacgcctaaatag

SEQ ID NO: 40738 - DNA, 660 bp, Artificial Sequence
  Description of Artificial Sequence: Synthetic coding sequence
atgcccttccaccacgtgaccgccggcctgctgtacaagggcaactatttgaataggtctctttcggctggttccgacagcgagcagctggccaatatttccgtggaagagttagacgaaatccgcgaggctttccgcgttctcgaccgggatggaaacggcttcatcagtaaacaggagctgggcatggccatgcgctccctaggctatatgccatccgaggtcgaattagccattattatgcagcgcttggatatggacggcgacggccaggtggatttcgacgagtttatgaccattctgggcccaaagctggtttcctccgaaggccgggatgggtttctcggcaacactatcgactcaatcttttggcaatttgacatgcagcgaatcactctagaggagctgaagcatatattgtatcacgcttttagagaccaccttacaatgaaggacatcgagaacatcatcattaacgaggaggaatccctgaacgagacctccggaaattgtcagaccgagttcgagggggtccacagccaaaagcagaacaggcaaacgtgcgtgagaaagtccttaatctgtgcctttgcaatggccttcatcatcagcgttatgctgatcgcagcaaatcaaatcctgaggtccggcatggaatag

SEQ ID NO: 40739 - DNA, 786 bp, Artificial Sequence
  Description of Artificial Sequence: Synthetic coding sequence
atgcggctgcccgagcagcccggcgagggcaagcccgagaacgagaagaaaggcgatgggggggcacttggaggaggagaagaaccaccaagaagtcaggcccctgacttccctacttgggagaagatgccctttcaccatgtgactgccggcctgctctacaagggcaattatctgaacagatctttaagcgcaggttccgacagcgaacagctcgccaatatctcagtggaagagcttgacgagattcgcgaagcattccgtgtgctggatcgggatgggaatggcttcatttccaagcaggagcttggaatggctatgcggagcttggggtacatgccctcagaggtggaactggccataatcatgcaaaggctggacatggacggtgacgggcaggtggattttgacgagttcatgactatcttgggacctaagctggtctcctctgagggtagagatggtttcttaggcaatacaattgacagcattttttggcagtttgacatgcagcgcatcacgcttgaagagctgaagcacattctttatcacgccttccgcgaccaccttacgatgaaagatattgagaacatcatcattaatgaggaagagtcattgaacgaaacctcggggaactgtcaaaccgagtttgagggcgtgcactcacaaaagcagaataggcagacttgcgtgcgcaagagcctgatttgtgcatttgcaatggccttcatcatttctgttatgctcatcgccgccaatcaaatcttgcgaagtggaatggagtag

SEQ ID NO: 40740 - DNA, 660 bp, Artificial Sequence
  Description of Artificial Sequence: Synthetic coding sequence
atgcccttccaccacgtgaccgccggcctgctgtacaagggcaactatctgaataggtctctcagcgccggctctgattcggagcagctggcgaacattagtgttgaagagctggacgagatcagagaagcgtttagggtgttggatcgggatggcaatgggttcatctccaagcaagaacttggaatggctatgcgttccctgggctacatgccaagcgaggtggaactagcaataatcatgcagcgccttgatatggacggcgatgggcaggtggattttgatgaattcatgaccatcttgggccctaagctggtgagttcggaaggtcgcgacggattcctggggaacactattgattcaattttctggcaatttgacatgcagcgcattactctcgaagagctcaagcacatactgtaccatgccttcagagatcacctgacaatgaaggacattgaaaatatcattattaatgaggaagagtctcttaacgagacgtccgggaattgccagacggagttcgaaggcgtacatagccagaagcagaatcggcaaacctgcgtcaggaagtcactcatctgcgccttcgcaatggccttcattatctctgtgatgctcatcgcagcgaatcagatccttcgttctggaatggagtag

SEQ ID NO: 40741 - DNA, 660 bp, Artificial Sequence
  Description of Artificial Sequence: Synthetic coding sequence
atgcccttccaccacgtgaccgccggcctgctgtacaagggcaactacctcaacaggtccttatccgctgggagtgacagcgaacaactggccaacatctcagtcgaggagctggacgagatcagggaagcgtttcgtgtcttagatcgcgatggtaatggtttcatctcaaagcaggaactgggcatggcaatgcgtagcctgggctacatgccgagcgaagttgagcttgccatcattatgcagagactggatatggatggcgacgggcaggtggactttgacgaattcatgacaatcttgggacctaagttggtgtcatcagagggacgcgacgggtttctcggaaacacaattgacagcattttctggcagttcgatatgcagagaattacactggaggaactcaaacatatcctttaccatgcgttccgcgatcatctgacaatgaaagacattgaaaacattatcatcaacgaggaagagtccttaaacgaaactagtggtaattgtcagaccgaatttgagggcgtccacagtcagaagcagaaccgccagacttgcgttcgcaagtctctgatctgcgcctttgctatggccttcattatttccgtgatgttaatcgcagctaatcagatcctgagaagcggcatggagtag

SEQ ID NO: 40742 - DNA, 786 bp, Artificial Sequence
  Description of Artificial Sequence: Synthetic coding sequence
atgcggctgcccgagcagcccggcgagggcaagcccgagaacgagaagaaaggtgatggaggcgcgcttggagggggagaggagccgcctaggtcccaggctcctgatttccctacttgggagaagatgcctttccaccatgtgaccgctgggctgctgtacaagggaaattatttaaaccgctccctctctgctgggtctgatagtgaacaactcgcaaatatctccgttgaggaactcgatgagatacgggaggcatttagagtcctggaccgggatggtaacggattcatcagcaagcaggaactgggcatggctatgaggagcctagggtacatgccaagcgaggttgaactggccataattatgcagaggctcgacatggacggggatgggcaagtggactttgacgaatttatgacgatcctcggccccaaactggtgtcatctgaaggacgtgacggcttcctgggcaatacaattgattctatattctggcaattcgatatgcagaggataaccctggaggaattgaagcacatcttgtaccacgccttcagggaccacctgactatgaaggacatcgagaacattattattaacgaggaagagagcctgaatgagacatctggcaactgtcagaccgagtttgaaggggtgcacagtcagaagcagaaccgccaaacttgcgtaaggaagtccttaatctgtgccttcgccatggccttcatcatctctgtgatgctgatagccgctaatcagatcctaaggagcggaatggaatag

SEQ ID NO: 40743 - DNA, 660 bp, Artificial Sequence
  Description of Artificial Sequence: Synthetic coding sequence
atgcccttccaccacgtgaccgccggcctgctgtacaagggcaactatctgaaccggagcctgagcgccgggtcagattccgagcaactggccaacatcagcgtggaagaactggacgagatccgcgaggctttccgcgtcctggaccgggacggtaatggctttatcagcaaacaggagctcggaatggctatgcgttcgcttggttatatgccgtccgaggtagaactggccataatcatgcaacgactggatatggacggagacgggcaggtggattttgatgagtttatgactatattggggccaaagctggtgagcagtgagggtcgggacggctttctaggcaacaccattgactccattttctggcagtttgatatgcagaggatcacattagaagagttgaagcatatcttataccacgcatttagggatcacttaaccatgaaagatattgaaaatattattatcaacgaggaagagtcactgaacgagacaagcggcaattgccagactgaattcgagggtgtgcactcccagaagcagaacagacagacatgcgtacggaagtcactaatctgcgcttttgctatggccttcatcatctccgtgatgctgattgctgcaaatcagatactccgtagcggcatggagtag

SEQ ID NO: 40744 - DNA, 378 bp, Artificial Sequence
  Description of Artificial Sequence: Synthetic coding sequence
atgcccttccaccacgtgaccgccggcctgctgtacaagggcaactacctgaatcggtccctcagcgcaggatctgattctgagcagcttgccaacataagtgtggaagagttagatgagatacgtgaggcttttcgggttttagatcgcgatggcaatggctttattagcaaacaggagcttgggatggcaatgcgttccctcggatacatgccaagtgaggtcgaacttgcaatcataatgcaacgcctggacatggatggcgacgggcaggttgacttcgacgaattcatgaccatcctggggcctaagctcgtgtcctccgaggggcgggacggcttcttggggaacactatagactctatcttttggcagtag

SEQ ID NO: 40745 - DNA, 747 bp, Artificial Sequence
  Description of Artificial Sequence: Synthetic coding sequence
atgttcctggccaaggccctgctggagggcgccgaccggggcctgggcgaggctctggggggtctgttcggcggaggaggccagcgtcgcgaaggcggtggaagaaatattggggggattgtgggaggcatcgttaattttatttcagaagcggcggcagcccagtatacccctgagcctcccccgactcagcagcatttcacctcagtcgaggcatcagagtctgaggaggtccgccgtttcagacagcagtttacccagctcgccggcccagacatggaggtcggggccactgacttgatgaatattttgaacaaagtgctgtctaaacacaaagatctgaagaccgacgggttttccctagacacctgcagaagcatcgtctctgtgatggattctgataccaccggcaagttgggtttcgaggaattcaagtatctttggaacaacataaagaagtggcagtgcgtgtacaagcagtatgacagggaccatagcggctcattagggtccagccaactccgaggcgcactccaagccgccgggttccagctgaacgaacagctgtaccagatgattgtgaggaggtacgcaaacgaggatggcgatatggattttaataatttcattagctgtcttgtgagactagacgctatgttccgagcattcaagagtcttgacagggatagggacggcttaattcaagtgagtatcaaggaatggctccagctgaccatgtatagctag

SEQ ID NO: 40746 - DNA, 2868 bp, Artificial Sequence
  Description of Artificial Sequence: Synthetic coding sequence
atgctgcccggccggctgtgctgggtgcccctgctgctggccctgggggttggaagcgggagtgggggggggggggactccaggcaaagaaggctgcttgccgccaaggtgaacaagcataaaccatggatcgaaacatcttaccatggtgtgattactgagaataacgacactgtaatactggacccccccctagtggctctggacaaggatgcacccgtaccgttcgccggagagatatgtgcttttaagatccacggtcaagagctgccatttgaagcagtggttcttaataaaacgagcggcgagggaagacttcgcgcgaaatcacccattgattgtgaactgcagaaggagtataccttcatcatccaggcgtatgactgcggtgccggccctcacgagaccgcttggaagaagtcacataaggcagttgttcatatacaggttaaggatgtaaacgagttcgctccgacctttaaggagcccgcttataaggctgtggtcaccgaggggaagatctacgactccattctccaggtagaggctatagatgaagattgtagtccgcaatattcacaaatctgtaattatgaaattgtcaccactgacgtgccctttgctatcgatcggaacggtaatattcgcaacactgaaaaactgtcatacgataagcagcaccaatacgaaatcctggtgacagcatacgattgcggccagaagcctgccgcacaggacaccttggtgcaggtagacgtgaaaccggtctgtaagcccggatggcaagattggacgaagcgaatcgagtaccagcccggctctggttctatgccattatttccctctatacacctcgaaacgtgcgacggagccgtgtcctccttacagatagtaacagaattgcaaactaattatatcggaaaaggctgtgaccgcgaaacatatagtgaaaaatccctgcagaaattgtgcggagcctcttccggaatcattgacttgctcccttctcctagcgcggcaacaaattggactgcaggcctgttggtggactctagcgaaatgatcttcaagttcgatggccgacagggggccaaagttcctgatggtatcgttcccaaaaacctaaccgatcaattcactatcaccatgtggatgaagcatggtccatccccaggggtgcgtgccgagaaggaaaccattctctgtaacagtgacaaaaccgaaatgaataggcaccattatgcactgtatgttcacaattgcaggcttgtttttctgctcaggaaagactttgaccaggccgacacctttcgccccgctgaattccattggaagctagatcagatttgcgacaaggagtggcactattatgttattaacgtcgagtttcccgtggttaccctttatatggacggagctacttatgagccttatctggttactaacgactggccaattcacccctcccatattgcgatgcaacttactgtgggagcctgttggcaagggggagaggtcactaagccgcagtttgcccagttcttccatggcagccttgcctctcttacaatcagaccaggtaagatggagtctcagaaggttatctcgtgcctgcaggcttgtaaggaaggcctggacatcaatagcctggaatccctgggacaggggattaaataccactttaaccccagtcagtctattctggtcatggaaggtgacgatattggcaatattaatagagcccttcaaaaggtctcctacatcaatagtagacagttccctaccgccggcgtccggcgccttaaggttagcagtaaggttcagtgtttcggagaagacgtgtgtatctccatccccgaagtagacgcctatgtcatggtcctgcaggccattgagcctagaatcacattgagaggtacagaccacttctggagaccggcagcccagtttgagagtgccagaggtgtgacactgtttcccgatatcaaaatcgtgtcaacattcgcaaaaacagaagccccaggcgacgtcaagacaaccgacccaaagtctgaggttctagaagagatgcttcacaatctggacttctgcgatatactggtcatcggcggtgacctagatcccagacaggagtgtctggaacttaaccactccgaacttcatcagaggcatctggacgccacgaactcaactgcaggatacagcatttatggcgttggaagcatgagccggtatgagcaagtgttgcaccatatacgctatcgaaactggagacccgctagtcttgaggcccggaggttccgcattaaatgcagtgagctgaacggaagatacaccagtaacgagttcaacctggaagtgagcatcttgcatgaagatcaggtgtccgacaaggaacacgtcaatcatctgatagtccagcctccctttctgcagtctgtgcaccatccagagtctcgcagtagtattcaacattcttctgtagtgccttccattgctacagttgttattatcatcagtgtatgcatgcttgtctttgtggtcgccatgggcgtatatcgcgttaggattgcccatcagcattttatacaggagaccgaagctgcgaaggagtcagaaatggattgggatgactccgcattaaccatcacggtcaacccaatggagaaacatgagggacccggacatggcgaggatgagacggaaggagaggaggaggaggaagccgaagaggaaatgtcaagcagttccggttcagatgattccgaggaggaagaagaagaggaaggtatggggagggggcgtcacggccagaatggagcacggcaggcccagctggaatgggacgactctacactgccttactag

SEQ ID NO: 40747 - DNA, 2871 bp, Artificial Sequence
  Description of Artificial Sequence: Synthetic coding sequence
atgaccctgctgctgctgcccctgctgctggccagcctgctggcctcatgctcatgtaataaggcgaacaagcacaaaccttggatcgaagcagaatatcaagggattgtcatggagaatgataatacagtgttgctgaatcctccactttttgccctggacaaagatgcacctctcagatacgcaggcgaaatttgtgggtttcggctccatggttccggcgtgcctttcgaagccgtgatcctggacaaggctaccggcgagggcctgatccgcgctaaggaaccggtagactgtgaggcgcagaaggagcatacatttacaattcaggcctatgactgtggagaagggcctgacggggctaacacaaaaaaatcacataaggcaacggtgcacgtgcgtgtgaacgatgtgaacgaatttgcccccgtgtttgtcgaaagactgtaccgcgccgcagtgacagagggaaagctgtacgaccggatcctgagggtggaggccatcgacggcgattgttcgccgcagtatagccaaatctgttactatgagattctcacccccaacacgcctttcttaatcgataatgatggcaatatcgaaaatacggaaaaactccaatattccggggagagactgtacaagtttaccgtcaccgcctacgactgtggcaagaagcgtgctgcagacgatgccgaggtcgaaattcaggtgaagcccacttgcaagcctagttggcagggttggaataagcggatcgaatacgccccaggggctggctctctcgctcttttccctggcattcgcctggaaacatgtgacgaaccgctgtggaatatacaggccactatcgagttgcaaaccagccacgtcgccaagggctgcgatagggacaattattccgagcgggcgctgcgtaaattgtgtggggccgccactggtgaggtggacctcctgcccatgcctggaccaaatgctaactggactgccggactgagtgtgcattactcgcaagacagcagtctgatttactggtttaacggcacccaggccgtgcaggtccccctaggagggccttcgggactaggatctggaccccaggacagcctgagcgaccactttacactatccttttggatgaaacatggggtcaccccaaataagggaaagaaggaggaggaaaccatcgtttgtaataccgtgcaaaacgaggatgggttcagtcattactcactgactgtgcacgggtgcaggatcgccttcctctattggcccttattggagagtgcacgccctgtcaagtttctgtggaagctggagcaggtttgcgatgacgagtggcaccactatgccctgaatttagagtttccaacagtgaccctttacacagatggaatcagctttgatcccgccctgattcacgataacggactgatacatccacccaggagagaacctgcactgatgattggagcttgctggaccgaggagaagaataaagaaaaggaaaagggggacaattcaacagacacaacccagggcgaccccctgagcattcatcattatttccatgggtacctggccggtttctccgttaggtctgggaggctagaaagtagggaggtgatcgagtgcctgtatgcctgcagagaaggcctggactatcgcgactttgagtccctcgggaagggaatgaaggtgcacgtcaatccatcgcagtccttgttgacgctggagggtgatgatgtggagactttcaaccatgcactgcagcatgttgcttacatgaacaccttgcgtttcgccacccccggcgtgcggcccctccgcctcacaacagctgtgaaatgtttttcagaggagtcatgtgttagcatcccagaagtggaagggtacgtcgtcgttctgcagcccgacgccccacagattctgctgtccggcacagcccattttgcccgccctgctgtcgatttcgagggaaccaatggggtcccactgttccccgacctgcaaatcacctgctcaatcagccatcaggtcgaggcgaaaaaagacgagtcgtggcagggcaccgtgacagacacaagaatgtccgacgaaatagtacataatcttgacgggtgcgagatcagcttggtgggcgatgacctcgaccccgaacgtgaatcgctgctcctggacacgacatccctgcagcagcggggactggaattaaccaatacgagtgcatatctgactatcgctggggtcgagtctattaccgtttacgaggagattctgagacaggccaggtacagactcagacatggcgcagccctttacaccagaaaatttcggcttagctgcagtgaaatgaatggccggtatagctctaatgagtttattgttgaagtgaatgtcctgcacagtatgaacagggtcgcacacccctcccacgtcctgagcagccagcagttcctacaccgagggcatcaacctcccccagaaatggccgggcactctttagcttccagccatcgcaatagtatgataccgagcgccgccactttgatcattgtcgtctgcgttgggtttctggtcctgatggtggtgctgggcctcgtaaggatacacagccttcaccgccgggtttccggcgccggaggcccaccgggcgcgtccagtgatcctaaagatccagatctgttctgggatgattcagcgctgaccattatagtgaatccgatggaatcctaccagaaccggcagtcttgtgtgactggagccgtgggcggccaacaggaggatgaagattcttcagattccgaggtcgctgattccccttctagtgatgaacgcaggattatcgagacacccccccacagatactag

SEQ ID NO: 40748 - DNA, 2907 bp, Artificial Sequence
  Description of Artificial Sequence: Synthetic coding sequence
atggtgctgggctgcgagctgagcggcagcacccgggtggtggtgggcgtcgaggccctgctgaccggcgcctcctcgccactccccggcgttggcccagctaataaacataaaccatggatcgaggcagagtatcaggggatcgtgatggaaaatgataatacagtgctgctgaatccccctctctttgcactggataaggacgcaccccttcgttacgccggagaaatatgtggatttagactgcacgggagcggagtacctttcgaagctgtgattctcgacaaggcaacgggggaaggtctaattagggccaaggagcccgtcgattgcgaagcacaaaaagagcatacattcacaatacaagcatatgattgcggcgagggcccagatggagctaacaccaagaaatcccataaggccacagtgcacgtaagagttaatgacgtcaacgagttcgcaccagttttcgtcgagaggctctacagagccgcggtgaccgaagggaagctctacgacagaatactgcgggtggaggccattgatggtgattgtagccctcagtactcacagatttgctattacgaaatattaacccctaatacgccctttctcatcgataatgatggaaatatcgaaaacaccgagaaactgcaatactctggggaacggctctacaagtttaccgtaacagcctacgactgtggcaagaaacgagccgcagacgacgcggaggtggagattcaggttaagcccacctgtaaaccttcatggcagggttggaataagcgcattgaatatgcccctggagccggatctctggcccttttccctgggattagacttgagacctgcgacgagcccctctggaacattcaggcaactatcgaactgcagacatcgcatgtcgctaaggggtgcgatcgagacaattactccgaacgggcacttagaaagctctgtggggcggccacaggtgaagtggacctactccctatgccagggcctaatgccaattggaccgccggtctcagtgtacactatagtcaagatagttctctgatatattggttcaacgggacacaggcggttcaggtaccactcgggggcccttccggattagggtctggaccccaggactccctcagcgatcattttaccttgagcttctggatgaaacacggcgttacaccgaataagggcaagaaagaggaggaaacaatcgtttgcaacaccgtgcagaatgaggatggttttagccactactccttaactgttcatgggtgcagaatcgcattcctgtactggcctctcctggaaagtgcccgtcccgtcaagtttctatggaagctcgaacaggtctgtgatgacgagtggcaccattatgccctgaacttagagtttcctaccgttaccctgtacaccgacgggatttcgttcgacccagcactgatacatgacaacgggctaatacatcctcctagacgagaacccgcattgatgatcggggcatgctggacggaagaaaagaacaaggaaaaggaaaagggcgacaactcgacagacacaacacaaggggaccccctgagcatccatcattattttcacggctatctggccggattcagcgtccgatcagggcggctagagtccagggaagtgattgagtgcttgtacgcttgcagagaaggacttgactaccgtgattttgaatccctcgggaaggggatgaaagtacacgtgaacccctcccagtccctcctgaccctggaaggggacgatgtggaaaccttcaatcacgcgctccagcacgtggcttacatgaatacactgagatttgcaacacctggggttcgcccattgcgcttaaccaccgccgtgaaatgcttctctgaggagtcctgcgtcagtattccagaggttgaggggtatgttgtggttctgcagcctgacgcaccccaaatactgctgagcggcactgctcatttcgccaggccggccgtggacttcgaggggactaatggagtaccattgttccctgacctgcagataacctgctccattagccaccaggtggaggccaagaaagacgagtcctggcagggaaccgtgaccgacactaggatgagtgatgagatcgtccacaacctggacgggtgcgagattagtctggttggcgatgacttagatcccgagcgagagtctctgttattagatactaccagtttacaacagcggggtctggagcttacgaatacgtccgcgtatctcaccatagcaggtgtggaatccatcactgtttatgaagagattctgagacaggccaggtacagactcaggcacggggctgccttgtacacccgaaaatttaggctctcatgctccgagatgaacggtcgctactcttcaaacgagtttatcgtggaagtgaatgttctgcacagcatgaaccgcgtagcccatccttcccatgtgctgagcagccaacagtttctccacaggggccatcagcctcccccagagatggctgggcacagtctggcatcgagtcatcgcaactccatgattccgagtgctgctacactcatcattgtggtgtgcgtggggttcctcgtgctgatggtggtcctcgggctggtgaggatccactctctgcaccgtagggttagtggggcgggggggccaccaggggctagcagcgacccgaaggatccagacctgttctgggatgattctgccttaactattattgttaaccctatggagtcctatcagaaccgccagtcctgtgtgacaggagccgtcgggggccaacaggaggacgaggactcaagtgattcggaggttgccgatagtccctcctcggatgaacggagaattatcgaaacacccccccaccggtattag

SEQ ID NO: 40749 - DNA, 405 bp, Artificial Sequence
  Description of Artificial Sequence: Synthetic coding sequence
atgaccctgctgctgctgcccctgctgctggccagcctgctggccagttgttcttgcaacaaagccaacaagcataaaccatggattgaagccgaataccagggtatcgtgatggaaaacgacaataccgttttgctcaatccacctctatttgcactagataaggatgcccccttaagatatgcaggggagatctgtggattccgcctgcatggcagtggtgtacccttcgaggcagtcattttggacaaggccactggagagggtctcattcgcgcaaaggagccagtggattgcgaggctcaaaaggagcacacgttcacaatccaggcatatgactgcggcgagggtccagacggagccaatacaaaaaaatcccacaaagccaccgtccacgttcgctag

SEQ ID NO: 40750 - DNA, 1422 bp, Artificial Sequence
  Description of Artificial Sequence: Synthetic coding sequence
atgcccttcggctgcgtgaccctgggcgacaagaagaactacaaccagccttcagaagtgaccgaccgctacgacctcgggcaggtgatcaaaactgaggaattctgcgagattttcagggccaaagataagaccacgggaaagttacacacttgtaagaaattccagaagcgcgatgggcggaaggtcagaaaagcagccaagaatgagataggaatcttgaaaatggtgaaacatcccaatattctccaactggtggatgtgtttgtgacccggaaagaatattttatattcttggagctcgctacagggcgggaagtatttgattggatcttggaccagggctattattctgaaagggatacctccaacgtagtgcggcaagtgctggaagctgtggcatacttgcacagtctgaagattgtgcacagaaacttaaagctggaaaacctggtgtactacaatcgactcaaaaactccaagatagtcatttccgatttccacctggctaaacttgaaaatggtttgatcaaagagccttgtggaacacccgagtacctgggaaatccacctttctatgaagaagtcgaggaggatgactacgagaatcatgataaaaacttattcaggaagatacttgctggggattacgagttcgatagtccctattgggacgacatatcccaggctgcgaaagacctcgttactcggctgatggaggtggaacaggaccagaggataaccgccgaggaggctatttcacacgaatggatttctggtaacgcggcctctgacaaaaacattaaggacggtgtgtgtgcgcaaattgaaaagaacttcgcccgcgcgaaatggaaaaaggcagttagggtaacaactctcatgaagcggctgagggcccctgagcagagctcgacggccgctgcccagtctgccagcgccaccgatactgcgactcccggcgccgccgggggggctacggccgctgcagcttctggggctacttccgcccccgagggtgacgctgcccgtgccgccaagtccgataatgtcgccccggcggataggtcagcgacacccgcaaccgatggttcggccactccagccacagatggctctgtgaccccagcgacggatgggtcaatcactccggcaacagatggtagcgtgacacctgcgacagaccgtagcgctaccccagcgacagacggtcgagccacacccgctaccgaagagagcacggtgcctactacccagtcatcagccatgcttgccactaaggccgcagccactcctgaacccgctatggcgcagccagacagtacagcaccagagggagctactggccaggcacccccctcctcgaagggcgaagaagcggcaggatatgcacaagagtcacaacgggaggaggcgtcgtag

SEQ ID NO: 40751 - DNA, 1506 bp, Artificial Sequence
  Description of Artificial Sequence: Synthetic coding sequence
atgcccttcggctgcgtgaccctgggcgacaagaagaactacaaccagccatccgaggtgaccgaccgctatgatctggggcaggtgattaaaaccgaagagttctgtgaaatattccgagccaaggataagaccactggcaaattgcatacctgtaagaagtttcagaaacgtgacggtagaaaggtcaggaaggctgctaaaaacgaaatcggcattctaaaaatggtcaagcatccaaatatacttcagctggtcgatgtcttcgtgacacgcaaggagtactttattttcctggaacttgccaccgggagagaggtgttcgattggatactggaccagggttactatagtgaacgagacacaagcaacgtcgtccgtcaagtgctggaagctgtcgcctacttgcactccttgaaaatcgtccatcgaaatctgaagctggagaacctcgtgtactataatagattaaagaactcgaagatagtgatatctgatttccatctcgcaaaacttgagaacggactcatcaaggaaccttgtggtacacctgagtaccttgccccagaagtggtggggcgccagagatacggccgacctgttgactgttgggccataggcgtcatcatgtacatcctcctgagcgggaatccgcctttctatgaggaggtcgaggaagatgattacgagaatcacgataaaaatctcttccggaagattcttgccggggattatgaattcgactccccatactgggatgatatctcacaagctgcaaaggatctggtcactaggttgatggaagtcgagcaggaccagcggatcacggcagaggaggcgatcagtcacgagtggatttcaggaaatgccgcgtccgataaaaacattaaagatggggtttgcgcacagattgaaaaaaattttgcacgtgcaaaatggaaaaaagcggtcagggtcacgacactcatgaaacgcctgcgggcccccgagcagtctagtaccgcagctgctcagagcgcttcggccactgataccgcaacccccggtgccgctggaggcgccacggcagctgcggcatccggggcaacgtctgcccccgagggggacgcggcaagggccgcaaagtccgataacgtcgcaccagctgatcgctctgccactcctgcaaccgatggctcagccacgcctgctactgatggatcagtgactcctgcaaccgacggttcaatcacacctgccacagacggaagtgttacccccgctacggatcgcagtgctacccccgctacggacggccgggcaacaccggcgacagaggagagcactgtgcccactacccagtctagcgcaatgctggccaccaaggctgcagccactcctgagcctgctatggcgcaacccgatagtaccgcacccgagggcgccacgggacaggctcccccttcttccaagggggaggaagccgccggttatgctcaggagtctcagagagaggaagcctcttag

SEQ ID NO: 40752 - DNA, 1413 bp, Artificial Sequence
  Description of Artificial Sequence: Synthetic coding sequence
atgcccttcggctgcgtgaccctgggcgacaagaagaactacaaccaacccagtgaggtcaccgaccgatatgacctcggccaggtgatcaaaaccgaagaattttgtgagatattccgcgccaaagacaaaacaactggcaagttgcatacatgcaagaagtttcagaagagggacgggcggaaagtgcgtaaagccgccaagaatgagattggtattctgaagatggtgaagcaccctaatatcctgcagctagttgatgtctttgtcacacgaaaggagtattttattttccttgagctcgcaacaggacgcgaggtgttcgattggattctcgatcagggatattattctgaacgggacacttcaaatgtggtgaggcaggtgctagaggctgtggcctatcttcactcactgaaaattgtgcacaggaacctgaaacttgaaaatttggtgtactataaccgactgaagaatagcaagattgtgatttcagactttcacctcgccaaactcgagaacggactgataaaagagccctgtggaactcccgagtaccttgcccccgaagtggtgggacggcaacgttacggccggccggttgattgctgggctatcggagtcatcatgtatatcctgttgtccggcaacccccccttctatgaggaggttgaggaagacgactatgaaaaccatgacaagaatttatttaggaagattctggctggagactacgaatttgattctccttattgggatgacatctctcaagccgcaaaagaccttgtcacaaggttaatggaggtagagcaggaccagcggatcaccgcagaagaggccatctctcatgagtggatctccggcaacgccgcttccgataagaatataaaagacggtgtttgcgcccagatagagaagaactttgcccgggccaaatggaagaaagctgtaagagttaccacccttatgaaacggttaagggcccctgagcagtcgtctacagcggcggcccagagtgcctctgcgaccgacactgcgacccccggggccgctgacaggagcgcaactcccgctacagacgggtctgctacaccagctaccgatggatccgttacacctgcaactgatggatctatcacacccgccaccgacgggtctgttacacctgccacagatagatcagctacgcccgccacggacggccgcgccacacctgccactgaagagtctacggtcccaacaacccagagctccgctatgctggccacaaaggctgctgcaaccccagagccggcgatggctcagccggactccacagcccccgaaggagcaaccggacaagcacccccctctagcaaaggagaggaggcagccggttatgcccaggagtcacagcgggaagaggcctcctag

SEQ ID NO: 40753 - DNA, 1560 bp, Artificial Sequence
  Description of Artificial Sequence: Synthetic coding sequence
atggacgccgtgctggagcccttccccgccgaccggctgttccccggcagttccttcttagacctaggtgatctgaatgagtcagactttctgaacaatgcccacttcccggagcacctggaccactttacggagaacatggaagacttctccaatgacctgttttcttcttttttcgatgatccagtcctggacgagaagtctcccctcctggatatggagctggatagcccaacaccggggatacaggctgagcacagctactccttgagcggggactctgccccacagtcgccacttgtcccgatcaaaatggaagacactactcaggacgccgagcacggggcctgggcgttgggccacaagctttgttccattatggtcaagcaggagcaatctcccgaactccctgtggacccccttgctgccccaagcgccatggctgctgccgctgctatggccactacgccactgctcggcctgtcaccactaagtcggctgccaatcccccaccaggctcctggggagatgacgcagcttccagtcatcaaagcagaacccttagaagtgaatcagttcctgaaggtaacccctgaggacctggtgcaaatgccgccaacgccgcctagctcccatggctctgactccgatggctcgcaatcgcctcgcagcttgcctccaagctcacccgtgaggccgatggcccggtccagtacagccatctcaacctctcccctgttaaccgctccccacaaattacagggcacctcaggacccctgctgctgaccgaagaggagaaaaggacgctcatcgccgaaggataccccattcccacaaaattgccactgaccaaagctgaagagaaggccctgaaacgcgtgcggagaaagatcaaaaataaaatcagcgcacaggagtcacggcggaaaaaaaaagaatacgtcgagtgtttagaaaagaaggtggagaccttcaccagcgagaataacgaactgtggaagaaagtcgagacgcttgagaatgccaaccggacgttgctccagcagctgcagaagctgcagaccctagtgacaaacaaaatctcccgcccatataagatggccgccacacagacaggcacatgtctgatggttgccgcattgtgcttcgtcctcgtgcttggatcgctggttccttgtcttcccgaattcagttctggatcccagacagtcaaggaggatccccttgcggccgacggggtgtacacggcaagtcaaatgccttctagatccctactgttttacgacgacggggctggactttgggaagatgggaggagtaccttactccccatggagccgccagatggctgggagattaatcccgggggacctgctgagcagcgtcctcgtgaccacctccaacacgatcatctggatagtactcacgaaactacaaagtacctctccgaggcctggcccaaggacgggggaaatgggacttccccagactttagtcacagcaaagaatggtttcacgatcgggatctcggcccgaacacgacgattaagttgagctag

SEQ ID NO: 40754 - DNA, 1296 bp, Artificial Sequence
  Description of Artificial Sequence: Synthetic coding sequence
atggacgccgtgctggagcccttccccgccgaccggctgttccccggtagctcattcctggacctaggcgacctcaacgagtcggatttcctgaataacgctcattttcctgaacatttagatcattttactgaaaatatggaggactttagcaatgatctcttctctagcttcttcgacgatccagtattggatgagaagagccccttgctggatatggaattggactccccgacccccgggatccaggccgagcacagctactctctgagcggcgactccgctccccaatctcccctggttccgataaaaatggaagatacaactcaagaggatttggttcagatgccacctaccccaccaagttcacacggcagcgactccgacgggtcccagagcccccggagtctcccccccagctcccctgtgagacccatggctcggtcctctactgccatttcaacctctcctctgcttactgccccccataaacttcaagggacctccggccctctcctgcttacagaggaagagaaaaggaccctcattgccgaggggtaccctataccaactaaattaccactgactaaagccgaggagaaagccttgaagagagtgagacgtaagatcaaaaacaaaatttctgcccaggaaagccggcggaaaaagaaggagtatgttgagtgcctcgagaagaaggtcgagacttttaccagtgagaataacgagttgtggaaaaaggtggagacccttgagaatgctaacaggaccctacttcagcagctccaaaagttgcaaacccttgtcaccaacaagatttcccggccgtataagatggcggccacccagacgggaacctgtctgatggtagctgccctttgcttcgtgctggtgctgggcagcctagttccgtgcctgcctgagtttagctctgggtcacagactgtaaaggaggaccctcttgccgctgacggcgtgtatacggcatcccaaatgccatctagaagcctgctgttctacgacgatggagcaggcttatgggaagacggtcgaagcaccctcttacccatggaacccccagatgggtgggagataaacccagggggacccgcagaacagagacccagagatcacctccagcacgaccacttagactctactcacgaaactactaaatacctgagcgaagcgtggcccaaggacggcggcaatggcacctccccagacttctcccacagcaaagagtggtttcacgacagagatcttggtccaaataccaccattaagctttcctag

SEQ ID NO: 40755 - DNA, 1560 bp, Artificial Sequence
  Description of Artificial Sequence: Synthetic coding sequence
atggacgccgtgctggagcccttccccgccgaccggctgttccccggctcttccttcctcgacttgggagacctcaatgagtctgacttcctgaataatgcccacttcccggaacacctcgaccatttcaccgaaaatatggaggactttagcaatgacctgtttagcagcttcttcgacgatcccgtgctggatgaaaaaagccctttgcttgacatggagctagactctcccacacccggcatccaagcagagcacagctactcactcagcggagattcagcacctcagtcacccctggtgccaatcaagatggaagacaccacccaggacgctgagcacggggcctgggccctggggcacaagctgtgtagcatcatggtgaagcaggaacaaagtcctgagctccccgtggaccccctggccgccccctcagctatggccgctgctgccgctatggctacaacccctcttctcggcctctctccactttctcggctgcccattccccatcaggcccctggcgagatgacacaactccctgtcattaaagctgagcctcttgaggtcaatcagttcctgaaggtgaccccggaggatctggtgcagatgcctccgaccccaccttcctctcatggtagtgattcggatggatcccagagccctagaagccttccccccagctcacccgtaaggccaatggcacgaagcagcacagcaatcagtacctcacctttgttgaccgctccgcacaaattgcaagggactagcggtccactcttgcttaccgaggaggagaagcgaacattaatcgctgaaggatacccgattcccactaaactgcccttaaccaaggctgaggagaaggccctaaaacgcgttcggcgtaagattaaaaataaaatcagtgcccaggagtctagaagaaagaaaaaggagtacgtggaatgtcttgagaagaaagtggaaactttcacctctgaaaacaacgaactgtggaaaaaagttgagacactcgaaaatgctaaccgtaccttgcttcagcagctccaaaaacttcaaactttagtaacaaataaaatcagccgtccttacaaaatggctgccactcagacaggcacctgcctgatggttgccgcgctctgcttcgttttagtcctggggtccttggtgccgtgcctgccagagttctcctctggatcacaaaccgtgaaggaggacccactggccgccgatggcgtttataccgcgtcacagatgccgagtaggtcactcttgttctatgatgacggagccggcctttgggaggatggacgctcaacacttttgccaatggagcccccagatggttgggaaataaatcctggggggcctgccgagcagagaccaagagatcaccttcagcacgaccacttagactcaacacacgagaccaccaagtatctgtctgaggcttggcccaaggacggtggaaatggaaccagtccagacttttcccacagtaaagagtggtttcatgacagagacctggggccaaatacaacaattaaactgtcctag

SEQ ID NO: 40756 - DNA, 1563 bp, Artificial Sequence
  Description of Artificial Sequence: Synthetic coding sequence
atggaggtgctggagagcggcgagcagggcgtgctgcagtgggacagaaagctcagtgagctgtctgaaccaggggatggggaggctctaatgtatcatacccacttcagcgaactgcttgatgaattttcccagaacgtgttgggacagttactgaacgacccttttttgtctgaaaaatccgtttccatggaagtagaacctagtccgacatctccagcacccctaatccaggccgaacatagctactccctgtgcgaagagcccagagcgcagagtccgttcactcatatcacaacatcagattcattcaacgacgacgaggtcgagtcagaaaagtggtatctgtccaccgactttccctctacttctattaaaacagagcctgtgaccgacgagcccccccccggactagtgccctcagtgacgcttacgatcacggcaataagtactccgctcgaaaaggaagaacctccgctggagatgaacacaggagtcgatagctcctgccagactatcatcccgaaaattaaattggaaccacatgaagtggaccagttccttaatttcagccctaaggaggctccagtggatcacctccacctgcctccgacccctccgtcttcccatggctctgacagtgaagggagcctttccccaaaccctagactccatccattttcactgccccaaactcattccccctcaagggccgctccacgagctccgtcagcgctcagctcatctccgctgctgaccgctccccacaaactccaaggatcgggacctctggtgctgactgaggaggaaaaacggactctgatagctgaaggctatcccatccctacaaaactcccacttagcaaatcagaggagaaggccctgaaaaaaattcgaaggaagattaagaacaaaatctctgcacaagagtccaggcggaagaagaaggagtatatggactctcttgagaagaaagtggaaagttgctccaccgagaacctagagctgcggaaaaaagtcgaagtgttggaaaataccaataggacactgttgcagcagctgcaaaagctccaaacactagtaatgggcaaggtgtccaggacctgcaagttggccggtacccagaccggcacatgtctgatggtggtggtgctgtgcttcgccgtcgcattcgggagtttctttcaaggctacgggccatacccaagtgcaacaaaaatggcactgcccagccagcactccctacaggagccctacaccgccagcgtggtgcggtcccgcaatctgcttatctacgaggagcactcacccccagaagagtcttcttctccagggtccgcaggggagcttggtgggtgggacagggggtcaagcctgttgcgggtctccggtctggaaagtcgaccagatgtagacctgccacacttcatcatttcaaatgaaacaagtttggaaaaatccgtattgctggaactgcagcaacatctcgtctcagctaagctggaagggaatgagaccctgaaggttgtcgaacttgatcgaagagtgaatactaccttctag

SEQ ID NO: 40757 - DNA, 528 bp, Artificial Sequence
  Description of Artificial Sequence: Synthetic coding sequence
atggaggtgctggagagcggcgagcagggcgtgctgcagtgggacaggaagctgtcagaactctccgagcccggcgatggggaggcactcatgtaccacacgcatttctcggaactcctggatgaattcagtcagaatgtgctagggcagctcctgaatgacccctttctgtctgaaaagagtgtctctatggaggtggagccctctccaactagtcctgcgccactgatccaggccgaacactcctattcattatgtgaggagccacgggctcagtccccctttacccatattacaactagcgacagctttaatgatgacgaggtagagagtgaaaaatggtacctctctacggacttccctagtacaagcattaagaccgagccggtcacagacgagcctccccctggcctggtgccatctgttactttgacaatcacagcaatcagcacacctctggaaaaagaagaacctcccctggaaatgaacaccggggtggacagttcttgtcagaccaacaccacatag

SEQ ID NO: 40758 - DNA, 747 bp, Artificial Sequence
  Description of Artificial Sequence: Synthetic coding sequence
atggaggtgctggagagcggcgagcagggcgtgctgcagtgggacagaaaactgagcgaactttctgagcccggcgatggggaggctctgatgtatcacacacacttttccgaacttctggacgagttttcccagaacgtcctgggacaactcttgaacgacccctttttgagcgaaaagtctgtgagcatggaggtcgaacctagtcctacctcacccgctccacttattcaggctgagcattcctattcactgtgcgaagagccccgggcccagtctccttttacacacatcaccacatcagactcctttaacgatgacgaggtcgaatctgaaaaatggtacctctcaacagatttcccatctacctctatcaagacagaacccgttaccgacgagccaccaccaggattggtgccctcagtgacactgaccattactgctatttctactcccctggaaaaggaggagcccccactggagatgaacaccggggtagattcaagttgtcagaccatcatcccgaagatcaaactggaaccgcatgaggttgatcaatttcttaacttttcaccaaaggagggtctgtccgcactcccggtatctctctgggtcatggacatggttagcggatctactgaaagggaatatggagaaagagcgggaatgtctctataccacagatgctgctcttggctttacgagatcgccctattccttaagaacaaaaacttcgccagtaagtag

SEQ ID NO: 40759 - DNA, 1383 bp, Artificial Sequence
  Description of Artificial Sequence: Synthetic coding sequence
atggaggtgctggagagcggcgagcagggcgtgctgcagtgggacaggaaactgtcagagcttagcgagcctggggacggggaggctctcatgtaccacacccacttctcagaacttttagatgagttctcgcagaacgtgctcggccagctgctgaatgatcccttcctcagcgagaagagcgtgagcatggaagttgaaccaagcccaactagtcccgcgcctttgatccaggcggaacattcctactccttgtgtgaggagcctcgcgcacagtccccatttactcatatcactacatctgactcatttaacgacgatgaggtcgaatctgagaaatggtatctttccactgattttccttctacttccatcaagacagagcccgttacagatgagcctccccctggactcgtgcccagcgtcacacttacgataacagccatttctaccccactagagaaggaagaaccccccttagaaatgaacactggggttgacagttcctgtcaaactatcatccccaagattaagctggagccccacgaggtggatcagtttctcaacttttcacccaaggaggcccctgtggatcatcttcacctgccgccaactccaccgtcttcgcacggtagcgacagcgaaggttccctgtcccctaatcccagactgcaccctttctcacttccacaaactcattcacctagtcgcgccgccccacgcgccccgtccgcgctgtcttcctccccactattgactgcccctcataaattgcaaggctcggggcctcttgtgcttaccgaggaagagaagaggacgctgatcgcagaaggctatccaattccgactaagctaccgttgtctaaatcagaggaaaaagctctcaagaaaatccgacgcaaaattaagaacaagataagcgcccaagagtctagaagaaagaagaaggaatacatggattctctggaaaagaaggtggagtcttgttccaccgagaacctagagctccggaaaaaggtggaagtgctggagaatacaaatcgtacgctgctgcagcagttgcagaaactccaaacccttgtgatgggaaaggtaagtcggacctgtaagctggcggggacgcaaaccggcacatgtctgatggtagttgtgctctgctttgcggttgcatttgggtcttttttccaggggtacggtccatacccttctgccacaaagatggccctcccatcacagcacagcctccaggaaccctatactgccagtgtcggaaaaactgcttgcggaaagctaggaagagtgctgttttacttcccacgggcaggttttctgtctctccccaagggcattttttgcgagagtccaatgtttaagaagtggtag

SEQ ID NO: 40760 - DNA, 453 bp, Artificial Sequence
  Description of Artificial Sequence: Synthetic coding sequence
atggaggtgctggagagcggcgagcagggcgtgctgcagtgggaccgcaagctgtccgagctctctgaaccaggtgatggcgaagcgcttatgtaccacacccatttttccgagcttttggatgagttctcccagaatgtcctgggacagctcctcaatgacccgttcctgtcagaaaagagtgtgagtatggaggtggagccaagcccaacatctcccgctcccctaattcaggctgaacactcctactccctgtgcgaggaacctagggcacagtctccatttacgcacattaccacatccgatagtttcaatgatgacgaggtcgagtctgagaagtggtatctctccaccgacttccccagcacatccatctgtcattctgatcaccattcccatctgcatcctgtcggcaagggtgggactagcagtgggaatgaacactgggggtag

SEQ ID NO: 40761 - DNA, 1311 bp, Artificial Sequence
  Description of Artificial Sequence: Synthetic coding sequence
atggtgggcttcggcgccaaccggcgggccggccggctgcccagcctggtcctagtcgtgctgctggtagtgatcgtggtgctcgccttcaactattggtccattagcagccggcatgttctcctccaggaggaggtggcagaactccaaggacaggtgcagcgaaccgaggtggccagaggccgtctcgagaaacgcaattcagatctcttgctgctcgtagatacccacaaaaagcaaatcgatcagaaggaagctgactacggacgattgtcatctaggttacaagcgcgggagggccttggtaagcggtgcgaggatgataaagtgaagctgcagaataatatttcataccagatggcggatatccatcacttgaaagagcagctcgctgagctccggcaggaattcctgcggcaggaagatcaattacaggactaccgcaaaaataacacatatcttgtcaaacgattggagtacgaaagtttccaatgcggccagcagatgaaggaattgcgggcgcagcatgaagagaatatcaagaagttggctgaccaatttctggaagagcagaagcaggagacccagaaaatccaatcgaatgatgggaaggaacttgacatcaataatcaggtggtgccaaagaatatccctaaggtcgccgaaaacgtggccgacaagaacgaagagccatctagtaaccatatcccacacggcaaagagcagattaaacgcggtggagacgccggaatgcctggcatcgaagaaaacgatctggcgaaggttgacgatcttcccccggcactccgcaaaccgcctatctcagtctcccaacacgagtcacaccaggctattagtcacttacccacagggcaacctttgtccccaaatatgccacccgactcgcacattaatcacaatggtaacccagggacgtctaaacagaatccgagttctcccctgcagaggcttatcccagggagtaatctagactctgagccacgaattcagaccgatatattaaaacaggcaacaaaggatagggtaagcgacttccacaagctcaagcaatcacgctttttcgacgagaacgagtctccagtggaccctcagcacggatcaaagctggctgactataacggtgatgacggaaacgtgggcgaatatgaagcagataaacaggctgagctggcctacaatgaagaagaggatggggatggaggagaagaggacgtgcaagacgatgaggaaagggaactccagatggaccctgcagactacggtaaacagcatttcaacgatgtgctgtag

SEQ ID NO: 40762 - DNA, 1143 bp, Artificial Sequence
  Description of Artificial Sequence: Synthetic coding sequence
atggtgggcttcggcgccaaccggcgggccggccggctgcccagcttagtgctggtagtcctcctggtggtaatcgtggtgctcgcctttaactattggtccattagctctcgccatgttctgttacaggaagaggttgcggaactgcaaggccaggtgcagcgcaccgaagttgcccgaggcaggctagaaaagaggaacagcgatcttctcctgttagtggatactcacaagaagcaaatcgaccaaaaagaagctgactatggtcggctgtcaagtcgcttacaggcccgtgagggcttagggaaaagatgcgaggacgacaaagtgaaactccagaataacatcagttaccagatggcggacatccatcatctgaaggagcaactggcggaactcagacaagaatttctgagacaggaggatcaactgcaagactatcgtaaaaacaatacgtacctggtcaaacggctcgagtatgaatcctttcagtgcgggcagcaaatgaaagagctgagagctcagcacgaagaaaacataaaaaaacttgcggaccaatttctggaggaacagaagcaggaaacccagaaaatccaatctaatgatggaaaggaattggatattaataaccaagttgtgcctaagaatattcccaaggtggctgaaaacgtggcagacaagaacgaagaaccctcaagcaatcacatacctcatggtaaggaacagataaaacgaggtggcgacgcagggatgcccggcatcgaggagaacgacctggccaaagtcgatgacctcccacccgccctcagaaagccaccaatctctgtgtcacaacatgaatcccaccaggccataagtcacctcccaaccggccaaccactcagcccaaatatgcctccggactctcacataaaccacaacgggaacccaggcaccagtaaacaaaacccctcctcccctctccagcgactcatcccagggagcaatctcgatagcgagccccgcatccagacagatatccttaagcaggctacaaaagacagagtatctgacttccacaagctcaagcaaaacgacgaagagagggaattgcagatggatcccgcggattacgggaagcagcacttcaacgacgtgctctag

SEQ ID NO: 40763 - DNA, 534 bp, Artificial Sequence
  Description of Artificial Sequence: Synthetic coding sequence
atggtgggcttcggcgccaaccggcgggccggccggctgcccagcttagtgctggttgtgctgctagtcgttatagtggtgctcgctttcaattactggagtattagctccagacatgtcttactgcaagaagaggtagcggagctgcaagggcaggtgcaacggacagaggtggcaagaggccgtctggaaaaacgaaattccgatctgctgctgctagtggatacccataaaaagcagatcgaccagaaagaggccgactatggcagactctcatcccgtttacaggcaagggaaggcctggggaagcgctgcgaggacgataaagtgaagttgcagaataacatttcctaccagatggccgatatccaccacctgaaagaacaacttgcggaacttagacaggagttcctgaggcaggaggaccaactacaagactaccggaagaataatacctatctcgtgaaacgactcgagtatgagtccaagagaccaaagagatttaaccagatgatggagcgcaactggatatag

SEQ ID NO: 40764 - DNA, 1248 bp, Artificial Sequence
  Description of Artificial Sequence: Synthetic coding sequence
atggtggtgatcgtggtgctggccttcaactactggagcatcagctctcgccacgtgctgctgcaggaggaagttgcagagttgcagggccaggtccagcggactgaggtggctcgtggtcggctagagaagcgcaattccgacctgctgctgctcgtggacacccacaaaaagcagatcgatcagaaagaagcagactatgggcggttgtcctccaggcttcaggctagagaagggttgggcaagcgatgcgaggacgacaaagtcaagctgcagaacaacatcagttaccaaatggctgacatccaccacctcaaggaacaattggcagaactaaggcaagaatttttgaggcaggaggatcagctccaagattatcgtaagaacaacacataccttgtgaaacgattggaatacgaatcttttcaatgcggccagcagatgaaagaactgcgtgcacagcacgaagaaaacatcaaaaagctggccgaccaattcctggaagagcagaagcaagaaacacagaagattcagtcaaacgatggaaaagagctggatatcaataaccaggtggtgccaaagaacatccctaaggtcgcagagaatgtggcggacaagaacgaagaaccgtcctccaatcatatcccacatggcaaagaacagattaagcggggcggcgacgccggtatgcctggtatagaggagaacgatctggcaaaagtcgacgatctgccaccagcactgcggaagccacctatctccgtgtcacagcacgagagtcaccaagcgatctctcacctacctaccggtcagccccttagccctaatatgccaccggattcccacatcaaccacaacggaaacccagggacatcgaagcagaacccttcatcaccactgcagagactgattcctgggagcaacctggactcagaacccagaattcaaacagatatcttgaaacaggctactaaggatagagtgtccgacttccacaagctgaagcagtctaggttttttgacgaaaatgaaagtccagtggatccacagcacgggagtaagcttgccgattacaacggggatgatggtaacgttggcgaatatgaggcggataagcaggccgaattagcgtataatgaggaagaagacggggacgggggcgaggaggacgtccaggacgacgaagagcgcgagctccaaatggaccctgccgactacggcaaacagcactttaatgatgtgctctag

SEQ ID NO: 40765 - DNA, 75 bp, Artificial Sequence
  Description of Artificial Sequence: Synthetic coding sequence
caggacgacgaggagcgggagctgcagatggaccccgccgactacgggaaacaacatttcaatgacgtactttag

SEQ ID NO: 40766 - DNA, 1302 bp, Artificial Sequence
  Description of Artificial Sequence: Synthetic coding sequence
atggtgggcttcggcgccaaccggcgggccggccggctgcccagcctggtgttggttgtgcttctggtggtaatagtagtccttgccttcaattattggtctatttcttctagacacgtcctgctgcaggaagaggtggccgaactgcagggacaggtgcagcgcaccgaggttgcacgcggccgcctcgagaagcggaactcggacttgctgctgctggttgacacccacaagaagcagatagaccaaaaagaggcagactacggacgcctgagcagccgactgcaagctagagagggattgggcaagaggtgcgaggacgacaaagtcaaattgcagaacaatattagctatcagatggccgacattcatcatcttaaggagcaactggctgagttgagacaggaattcctccgtcaggaagatcagctccaggactacaggaagaacaacacttacctcgtaaaacggctggaatatgaatcatttcagtgcggccagcaaatgaaagaactgcgagcccaacacgaggaaaacatcaagaaattggcagatcagttcctggaagagcagaagcaagaaacccaaaaaatacagtctaacgatggaaaggagttggatattaacaaccaggtggttccgaagaatataccaaaggtggcagaaaacgtggccgataaaaatgaagaaccatctagcaaccatatccctcacggcaaagagcagatcaagaggggaggagatgccggtatgcccgggattgaggaaaatgatcttgctaaagtggatgaccttcctccagctctaaggaagccacctatatctgtgtcacagcatgaaagccatcaagcaattagtcacttacccacagggcagcccctgagtcccaatatgccccctgattcgcatattaaccataatgggaatcctgggacgtctaaacaaaatccttctagccccctccagcggctgatccccggatcaaacttggattcagaaccaaggattcaaaccgacattttgaagcaagcaaccaaagatcgtgtgtcggatttccacaagctgaagcaaagccgattctttgatgaaaatgaatcccccgttgatcctcagcacggctcaaaattagctgattataacggggacgatggaaatgtcggcgaatatgaagctgacaaacaagctgagctggcctacaacgaggaagaggatggcgacgggggtgaggaagacgttcagggcgaacgaggcccaggactccacgccattaccatgaaacccacgtctaagtttttcgggtag

SEQ ID NO: 40767 - DNA, 549 bp, Artificial Sequence
  Description of Artificial Sequence: Synthetic coding sequence
atgaagggctggggctggctggccctgctgctgggcgccctgctggggacagcatgggccagaagatctcaagacctacactgtggtgcctgtcgcgcactggtggatgagttggaatgggaaatagctcaagtggaccctaaaaagacaatccagatgggtagctttaggataaacccggacgggtcccagtcggtggtggaagtgccttatgcaaggtccgaggctcacctaacagagctactagaggagatttgcgacagaatgaaagagtatggggaacagattgatccgtccacacatcggaagaactacgtgcgcgtcgttggacggaacggcgagagtagcgagttagacctgcagggtatccgaattgatagcgatatctcagggactctgaaattcgcgtgtgaatcaatcgtggaagaatacgaggatgagctgatcgagttcttctcacgcgaggctgataacgtgaaagataaactgtgttccaaacggaccgacctctgcgaccacgctttacatatatctcacgacgaactgtag

SEQ ID NO: 40768 - DNA, 507 bp, Artificial Sequence
  Description of Artificial Sequence: Synthetic coding sequence
atgaagggctggggctggctggccctgctgctgggcgccctgctggggacagcatgggcccggaggagccaggacctacactgtggagcctgtcgggccctggtggacgagctcgagtgggagatcgcccaggtcgacccaaagaaaactatccagatggggtcttttcggatcaacccggatggaagccagtctgtggtggaggtgccttacgctcgctccgaagcccaccttaccgaactgctggaagaaatctgtgacagaatgaaagagtacggagagcaaatcgaccctagtacgcaccgaaaaaactacgtgagggtcgtgggcagaaacggggagagctcagaactcgatttgcaagggatcagaattgatagtgatatcagcggaacactcaagtttgcctgcgaatctatagtggaagagtatgaagacgaactcatcgaattcttcagcagggaagcagataatgttaaggataagctctgctctaaaagaacttag

SEQ ID NO: 40769 - DNA, 1644 bp, Artificial Sequence
  Description of Artificial Sequence: Synthetic coding sequence
atgaccaagaccgaccccgcccccatggccccccccccccggggcgaagaagaagaagaagaggaagaagacgaacctgttccagaagccccctcaccaactcaggagagacgccagaagcccgtggtccatccaagcgcacccgccccgctccccaaggactacgcctttacattctttgatcccaatgatcctgcctgtcaggagattctgtttgacccgcagaccaccattcccgaactgttcgctatcgtgcgtcagtgggtgccccaggttcagcataagattgacgtgatcggcaatgagattttacggaggggatgccatgtgaatgacagggatgggctcaccgacatgacactgttgcactacgcctgcaaggcaggtgcgcatggcgtaggggaccctgcagcagccgtccggttatctcagcagctgctcgcccttggggcagacgtgacgctgcgaagtcgatggacaaatatgaatgctttgcattacgccgcctattttgatgttcctgacctggtgagagtcctgctgaagggtgcacggccgagggtggtgaacagtacctgcagtgatttcaaccacgggagtgcgctgcacatcgccgctagctcgctttgcctgggagctgccaagtgcttgcttgagcatggtgcaaaccctgccttgaggaatcgaaaaggacaggtcccagcggaagtggttcctgaccctatggatatgtcactcgacaaagcggaggcggctctcgtagcaaaagagctaagaacccttctggaagaggctgttcccctttcctgcgctctgcctaaggtaacactgcctaactatgataatgtgcccggaaacctcatgctgagtgcactgggcctcagacttggagaccgggtacttctggatgggcagaaaacaggaaccctgagattttgtggcactaccgaattcgcctccgggcagtgggtgggagtggaattggacgagccagaggggaaaaacgacggttcggttggtggggtcaggtattttatctgcccccccaaacagggccttttcgcctctgtaagtaagatctctaaggccgtggatgctcctcctagctctgtaacaagcacaccgaggacgccacgaatggacttctctagggtaacaggtaagggacggagggagcataaaggcaagaagaaaaccccatcctctcccagcctcggctcactgcagcagagggatggagctaaagcggaggtgggtgatcaggtgctcgttgcgggacagaaacagggcatcgtaagattttatggcaaaacagacttcgctccgggatattggtatggcattgaattggaccagccaactggcaaacatgatgggagcgtgttcggcgtacgctattttacgtgccccccccgacacggcgtgttcgctccagctagtagaatccaaagaatcggcggcagtactgactcgccaggtgatagtgtcggcgccaaaaaggtccatcaagttactatgacacaacccaaaagaacatttacaaccgtacggacccctaaagatattgcatctgagaatagcatttcccggctgctattctgttgctggtttccttggatgctgcgggctgaaatgcagtcctag

SEQ ID NO: 40770 - DNA, 1572 bp, Artificial Sequence
  Description of Artificial Sequence: Synthetic coding sequence
atgaaccccagcccccggccccccgcccccccccggagcgccggccgatctctcctttgtactcctaggcacttaccaccttctttaagaaccactttaaccttctttgatccgaacgacccagcttgccaagagattcttttcgatcctcaaacgaccatccctgaactgtttgccattgtgagacaatgggtcccccaggttcagcacaagatcgacgtaataggaaacgaaatcctgcgccggggctgtcatgttaacgaccgggatggactgaccgatatgaccttattacattatgcttgtaaggctggcgcccacggagtaggagatcccgccgccgccgtacgcctgtcccaacagcttcttgcccttggcgcagacgtaactctgcgtagccgctggaccaatatgaatgcactgcactatgccgcttatttcgacgtgcccgacctggtgcgcgtgctcctgaagggggcaagacccagggtcgtgaacagtacatgttctgattttaaccatggctctgctttacacatagccgcatcctctctctgtctgggagctgctaaatgcctactcgagcacggggccaaccccgcactgagaaatcgcaagggtcaggtacccgctgaggttgtcccagatcccatggacatgtctctcgacaaagcagaggccgctctggttgccaaagagctcagaactctcctggaagaggctgttcctctgagctgtgccctgccaaaagtgaccctgccaaactacgacaatgtgcccgggaacctgatgttgtctgcattgggcctgagactgggggacagagtgctgctggacggacagaagacaggcactcttcgattctgcggtaccactgagttcgcaagcggccaatgggtcggcgtcgaactagatgaacccgagggaaaaaacgatggctccgtcggtggcgtgcgatactttatttgccccccgaaacagggtttatttgcatcggtgtccaagattagtaaagccgtggatgctccaccctccagcgtcacaagcaccccacgaacaccgagaatggacttctctagggtaactggtaaagggagacgggagcacaaggggaagaagaaaacaccatcttcccccagtctgggctcactccagcagcgggatggagctaaggctgaggtaggcgaccaggtgctcgtggccgggcagaaacagggtatcgttagattttatggaaagactgacttcgctcctggctactggtacggaatagagctcgatcagccaaccggcaagcacgatgggagcgtcttcggagtgcgttacttcacgtgcccacctagacacggagttttcgctccggcttcgaggatccagcgcatcggtgggtcaacagactccccaggcgacagtgtgggcgccaaaaaagtgcaccaggtaactatgacgcagcccaaaagaacatttaccaccgtacgtacacccaaggatatcgcatccgagaatagtatatctcggcttttgttctgctgctggttcccctggatgttacgcgccgagatgcagtcctag

SEQ ID NO: 40771 - DNA, 1290 bp, Artificial Sequence
  Description of Artificial Sequence: Synthetic coding sequence
atgaccctgctgcactacgcctgcaaggccggcgcccacggcgtgggcgatcccgcagccgctgtgaggttgtcccaacaattgctagccttgggtgcagatgtaacccttagaagccggtggacgaatatgaacgccctgcattatgctgcttactttgacgtgccagaccttgtaagggtccttctgaagggtgctagacctagggtggtgaattctacgtgcagcgacttcaatcacggcagcgcactgcacatcgctgcgtcatcattatgtttaggtgccgccaagtgcttactggaacatggcgcaaatccagccctacgcaaccgaaaggggcaagtgccagctgaggtggtccccgatcccatggatatgtccttagacaaggcagaggctgccctggtggccaaagagcttcgcactcttctcgaagaagctgttcccctgtcctgtgctttgccaaaggtgactctgcctaattacgacaatgttccaggcaatctgatgctgtccgccctgggattgcggctcggcgatagagtactgttagacggacagaaaaccgggaccctccgcttctgcggaaccacagagtttgcgtccggtcagtgggtgggggtcgaactagatgaacccgaaggtaagaacgacggcagcgtcggaggcgtgcgctacttcatttgcccacctaaacaagggttgtttgcaagtgtatccaagatctcaaaggcggttgacgctccaccctcatctgtcacatccaccccacgaactcctcgcatggatttctcacgggtgactggaaaaggtcgtcgagaacataagggcaaaaagaaaactccatcttccccctcgttagggagcctccagcaacgagatggtgccaaggccgaggtcggagatcaggttctggtggctggacagaaacagggcattgtcagattttacggtaagacggatttcgctccaggctattggtacggcatcgagctggatcagcccacgggaaagcacgacggatctgtgttcggtgtgagatacttcacatgccccccgcggcacggcgtgttcgcccctgcctcacgcattcaaagaattggcggtagcactgacagccccggagattctgttggagccaagaaggtgcaccaagtcaccatgacacaacccaagagaacatttacgacagttcggactcctaaggatatcgcttcggagaattctatcagtaggttgctgttctgctgctggtttccttggatgctgagagctgagatgcagtcatag

SEQ ID NO: 40772 - DNA, 1059 bp, Artificial Sequence
  Description of Artificial Sequence: Synthetic coding sequence
atgaagcccgccctgctggaggtgatgcggatgaaccggatctgccggatggttctggccacatgtcttggatctttcattctggtgattttctactttcagtctatgcttcaccccgtgatgcgaagaaaccctttcggggtggatatctgctgtcgtaaagggagcaggtccccactgcaggagctctacaacccgattcagcttgagctctccaacacagctgtgctacatcagatgcggagggatcaagtgacagacacctgtagggctaactccgctacctcgaggaagagaagagtgctgactccgaatgacctcaagcacctagtggtggatgaggatcacgagctcatttactgttacgttccgaaagtcgcttgtactaattggaagcgcctgatgatggtgctgactgggagaggtaaatacagcgatcccatggagattccggccaacgaagcccacgtcagcgctaatctgaagaccctaaatcaatatagtattcccgagattaaccatcgtctgaagagttatatgaagttcttgtttgtcagggagccttttgagcggctggtcagcgcctaccgtaataagttcacgcagaagtataatatctcatttcataagagatacggcacaaagatcataaagcggcagcgaaagaatgccacgcaggaggccctccgaaaaggggatgatgttaagttcgaggagtttgttgcctatctcatcgacccacacacacagcgtgaggagcctttcaacgagcactggcagacggtttacagcctgtgccacccatgccacatccactatgatttagttggtaaatatgaaaccctggaggaggattccaattacgtcctgcagctggcaggggtcggctcctacctgaaatttcctacttacgccaaaagcacccggacgacggacgagatgacaacagaattttttcagaatatttcgtctgagcatcagacccagttgtatgaagtgtacaagctcgatttcctgatgttcaactacagtgtgcctagttatttgaaactcgaatag

SEQ ID NO: 40773 - DNA, 1044 bp, Artificial Sequence
  Description of Artificial Sequence: Synthetic coding sequence
atgaagcccgccctgctggaggtgatgcggatgaaccggatctgccgaatggtgctcgctacatgcctgggcagcttcatcctggtcatattttactttcagatcatgagaagaaatcctttcggagtggacatctgttgcagaaagggcagtaggagcccacttcaagaactgtacaaccccatccagttggaactgagcaacaccgccgtcctccaccaaatgcggcgcgaccaggtgacagacacctgtagggctaactcagcaacctctaggaaacggcgcgttctgactccaaacgatctgaaacacttagtggtagatgaggaccatgaactgatctactgctacgttcccaaggtcgcctgtactaactggaagcggctgatgatggtgctgaccgggagaggcaagtatagcgaccccatggagatccctgccaacgaggcccacgtgtcagcaaacctgaagacactaaaccaatattccattcctgaaatcaatcataggttgaaaagctacatgaagttcctgttcgtgcgtgaaccctttgagcgcctggtaagtgcatatcggaacaaatttacgcagaagtataatattagctttcataaacgttatggcaccaagatcattaaaaggcaaagaaaaaatgccacacaggaagccttacggaaaggagatgatgtgaagttcgaagaattcgtggcctacctgatagatccacacacgcagcgcgaagagcccttcaatgagcactggcaaaccgtgtacagcctctgtcatccctgccacattcattatgacttggttggcaagtacgaaacgctggaggaagattccaattacgttcttcagctggcgggagtgggatcttatctgaaattccccacatatgctaagagcactaggaccaccgatgagatgaccactgaattttttcagaacatttcatcagagcaccagacacagttgtacgaagtctacaagctcgatttcctcatgtttaactatagcgtgccctcttaccttaagttggaatag

SEQ ID NO: 40774 - DNA, 1245 bp, Artificial Sequence
  Description of Artificial Sequence: Synthetic coding sequence
atgaccaaggcccggctgttccggctgtggctggtgctgggcagcgtgttcatgattcttcttataatcgtttactgggattccgccggcgctgcgcacttctatctccatactagcttctcaagaccacacacaggtccccccctgccaactcccgggccagatcgggacagagaactgaccgctgactccgacgtagatgagtttttagacaagttcctgtctgccggggttaaacagagcgatcttccccgcaaagagacggagcaaccaccagccccagggagcatggaagagagcgttcgaggctacgattggtctccacgggatgcccggcggagcccagatcaggggaggcagcaggcggagaggcggagcgttctaagaggtttttgtgctaactcttcgctggccttcccaactaaagagagggcttttgacgacattcccaattccgagctgagccacctaatagttgacgacagacacggcgctatctactgttatgttcccaaagtcgcctgcactaattggaaacgtgtgatgatcgtgcttagcgggtccttattacatcgcggtgctccatatcgggaccctctgcgaattcctagggagcacgtacataacgctagtgctcatcttacgttcaataaattttggcgccgctacggcaaactgtccaggcacctgatgaaagtgaagctaaagaagtacactaaatttctttttgttagagatccatttgtgaggcttatctccgcgttccgtagcaagtttgagctggagaacgaggagttttaccgtaagttcgctgtgccgatgttgaggctttacgctaaccacacatctttgcctgcatctgctagagaggcattcagggccggactgaaagtgtcttttgcgaattttattcagtatttattagatcctcacaccgaaaaattggctcccttcaacgaacactggcggcaggtttataggttatgccacccctgccaaatcgattacgatttcgtggggaagttggagactttagatgaggatgccgcccagctgttgcagctactgcaagtcgatagacagctgaggttccccccctcctacaggaatagaacggcaagttcttgggaagaggactggtttgcaaagatccctcttgcctggaggcagcagctctacaagctatacgaagccgacttcgtcctgtttgggtaccctaagccagagaatctgctgagagattag

SEQ ID NO: 40775 - DNA, 738 bp, Artificial Sequence
  Description of Artificial Sequence: Synthetic coding sequence
atgaccaaggcccggctgttccggctgtggctggtgctgggcagcgttttcatgatactgctcatcattgtgtattgggacagcgcgggcgccgctcatttctatctccacacttcgttttcaagacctcacactgggcctcccctccccacacccggacctgacagagatagggagcttactgctgattctgacgtggatgagttcctcgacaaattcttgtcagctggcgtaaaacagagtgatctcccccggaaagagacagaacagccaccagctccagggagtatggaagagagcgtcaggggatatgactggtcacccagagatgctagaagatccccagaccagggacggcagcaggccgaacgacggagcgtgcttagaggcttttgcgcaaattcaagcttagcatttccaactaaagagcgggccttcgacgatatccccaacagtgagctttcccacttaatcgtggacgatcgacatggcgctatctattgttatgtgcctaaggtggcttgtaccaattggaagagggtgatgatcgtgctgtccggctctctgctccacagaggtgccccttacagggaccctctgcggatcccacgagagcatgtacataacgcaagcgcccacctcacattcaacaaattctggagacgctacggtaagctgtcaagacatctcatgaaggtaaagttaaagaagtatacgaagtttctgtttgtgcgctag

SEQ ID NO: 40776 - DNA, 1026 bp, Artificial Sequence
  Description of Artificial Sequence: Synthetic coding sequence
atgggccggcggtgctgccggcggcgggtgctggccgccgcctgcctcggtgctgccctcttgctgctgtgtgcggcccctagaagtcttcgacctgccttcggtaaccgcgccttgggatcctcgtggttaggaggggagaagaggtcgcccttgcagaagctgtacgacctcgaccaagacccccggtcaactcttgctaaggtgcacagacaacgaagggacctcctaaacagcgcgtgttctcgtcacagtcgcagacaacgcctgcttcaaccagaggatctgaggcatgtgctcgttgacgacgcacatgggctgctgtattgttatgtaccaaaagtcgcttgtacgaactggaagcgcgtccttctggcgctttcaggacaggcccgaggggatcccagagccatttctgctcaagaggctcacgcacctgggcggctgccctcactagctgacttttctccggctgagattaatcggcggctgcgtgcttatctggcctttctcttcgttagagaacctttcgaacggcttgcatcagcctacagaaacaaactggctaggccatactccgccgcattccagcgtcgttacggagctcgcatagtccaacggcttcggcccagggcgctcccagacgctcgagcccgggggcatgacgtgcgatttgctgagtttctcgcctatttgcttgatcctcgaacccggcgggaagagccgttcaatgagcactgggagcgagcccatgccttatgccatccatgtcgccttcggtacgacgtcgttggtaagtttgagactcttgctgaagacgcggcttttgtccttggactggccggtgcctccgatttatcattccccggtcccccccggccacgcggcgcagctgccagccgggacttagcagctcgcctgttcagggatatcagcccgttctatcagcgcagacttttcgacctttacaagatggattttttactgtttaactactctgcaccatcatacctgcgattgctatag

SEQ ID NO: 40777 - DNA, 678 bp, Artificial Sequence
  Description of Artificial Sequence: Synthetic coding sequence
atgggccggcggtgctgccggcggcgggtgctggccgccgcctgcttaggagcagccttactcttactgtgtgctgcgccgaggtctctgaggcctgcatttggtaatcgtgcactcggttctagctggctcggcggggaaaaacgctcccccttacagaagttgtatgacctggaccaagaccctcgctctacattggccaaggtgcatcgtcaacgaagagatctgctgaacagtgcatgctcacggcacagccgccgccagaggctccttcagcccgaggacctccgccatgtactggtggatgacgcccatggcctcttgtactgctacgtccccaaagtagcctgtacgaactggaaacgagtgctgctggccctgtccggtcaggccaggggtgacccccgggccattagtgcccaagaagcccatgcccctggtcgcttgccaagcttggcggatttttccccggccgagattaataggcgtctgagagcatacctagcctttttgtttgtgagagagccgttcgagcgactggcatctgcatacaggaataagctggctcggacgcgatccgctacccgcgttgccagtgccaccactagttgggcatcttcacgacggtggcggcggaccagacccagctgctgggcctggcgcgctcatcccacttag

SEQ ID NO: 40778 - DNA, 1161 bp, Artificial Sequence
  Description of Artificial Sequence: Synthetic coding sequence
atgctgctgcccaagaagatgaagctgctgctgttcctggtgagccaaatggcgattctagctctttttttccatatgtacagtcacaacatttctagcctctctatgaaggctcaacctgaaaggatgcacgtgctcgtgctgagctcttggagatctggatccagcttcgtggggcaactcttcggacagcatcccgacgtattctacttgatggagccagcctggcatgtctggatgacctttaaacagtccactgcctggatgctgcacatggcggtgcgagacctcataagagcagtgttcctatgtgatatgtctgtctttgatgcctacatggaacccgggccacgcaggcaatctagtctcttccagtgggagaatagcagagcgctctgttccgcacctgcctgtgatattattccacaggacgagattattcctcgcgctcactgtcggcttttatgctctcagcagcctttcgaggtcgtggaaaaggcctgcagaagctactcacacgtcgtgttgaaagaggttcggttctttaacctgcagtccctctatcctctgctaaaagatccatccctaaatctgcatattgttcatctggttcgcgacccgagagctgtgttcaggtctagagagcgcacaaaaggcgatctgatgattgatagcagaattgtgatgggacagcacgagcaaaagctgaaaaaggaggaccagccttactatgtgatgcaggtaatttgtcagtcccagctcgaaatctataagacaatacagtctctgcctaaggccctgcaggaaaggtaccttctggtgagatatgaagacctggctcgggctccggtcgcgcagaccagtaggatgtacgagttcgtgggtcttgagtttttacctcacctgcagacgtgggtccacaacataactagaggtaaagggatgggagatcatgccttccacacaaatgcaagggacgctctgaatgtgtcccaggcatggagatggagtctcccgtacgagaaagtcagtaggctccagaaagcttgtggagatgccatgaaccttcttggctatagacatgtccggtctgagcaggagcagcgtaatttgctcctagatctgctcagtacctggaccgttcccgaacagattcactag

SEQ ID NO: 40779 - DNA, 1161 bp, Artificial Sequence
  Description of Artificial Sequence: Synthetic coding sequence
atgctgctgcccaagaagatgaagctgctgctgttcctggtgagccagatggctatcctggccctttttttccacatgtattcacataacattagcagtctgagcatgaaggcgcagcctgagagaatgcacgtcctggtgctctcctcatggcgatccggtagttctttcgtcggacagctctttggacagcacccagacgtgttctatttgatggagccagcgtggcacgtatggatgacattcaaacaatcaacagcttggatgctgcatatggccgtaagagacctcatccgggccgtgttcttatgcgacatgtcagtgtttgatgcatacatggaaccaggcccccggagacagtcttctctgttccagtgggagaacagccgcgctctttgctcagcccctgcgtgcgacatcattccacaagacgaaatcatcccaagagcacattgtcggctgctctgcagccaacagccatttgaggtcgtggaaaaggcctgtcggtcttattcgcacgtggtccttaaggaggttagatttttcaatctgcagagcttataccctctcttaaaggatccatcactgaacctacacatcgtccacctcgtacgggaccctagagccgtgttcaggagtcgagagcggacaaaaggcgacctcatgatcgatagccggattgtaatgggtcagcatgagcagaagctcaaaaaggaggaccaaccatattacgtgatgcaggttatctgccagtcacagctggagatctacaagacgatccagtcattgccaaaagccctacaggagagataccttctagtgcgatatgaggatctcgctagggccccagttgcgcagacctctcgaatgtacgagtttgtgggcctggaatttcttccacacctgcaaacttgggtacacaatattacaagaggcaagggcatgggggaccatgcctttcataccaatgcgcgggacgcattgaatgtgagccaggcttggcgatggagcttgccctacgagaaagtcagtaggctgcagaaggcctgtggggacgctatgaacctactcgggtaccggcacgtgcgttctgagcaggaacagcggaacttactcctggatttactgtcaacgtggacggtgcctgaacagattcactag

SEQ ID NO: 40780 - DNA, 918 bp, Artificial Sequence
  Description of Artificial Sequence: Synthetic coding sequence
atgctgggccggaacacctggaagaccagcgccttcagcttcctggtcgagcagatgtgggctcccctctggtccaggagtatgcggcctggcagatggtgttctcagaggtcctgcgcctggcagacatccaataatacccttcacccactgtggacagtccctgtgagtgtgcctggcggcactcggcagtcacctattaacatccagtggcgcgatagcgtctatgatccccagttaaaacctctgagagtcagctatgaggccgccagttgcctgtacatctggaataccggctacctcttccaggtggaatttgacgacgccactgaagctagtggaatttctggaggcccactggagaatcattatcgcctgaagcagtttcacttccactggggcgccgtaaatgaagggggaagtgaacacacagtggatgggcacgcctaccccgcagaactccatctcgtgcattggaactcagtgaaatatcaaaactacaaggaagcagttgtaggcgagaatggcctcgccgtgataggtgtatttttgaaactgggagctcatcatcagacactacagcggctagtggatatactgcctgaaataaagcacaaagatgcgagagctgcgatgaggccctttgatccttctactcttctgcccacgtgttgggattactggacatacgccggctccttaaccacgccgcccctcaccgagtccgtcacttggattattcagaaagagcccgtggaggtagcaccatcacaactctcagctttccgaaccctgctgttctcagctctgggcgaagaggaaaagatgatggtgaacaactatagacctctgcagcccctgatgaatcgcaaggtttgggcatccttccaggccactaacgagggaacacggagttag

SEQ ID NO: 40781 - DNA, 714 bp, Artificial Sequence
  Description of Artificial Sequence: Synthetic coding sequence
atggacaaggtgtgcgccgtgttcggcggcagccggggcatcggcagggcagtggcccagctgatggcgcggaagggctatcggctcgctgtgattgcccgaaacctggaaggagcaaaggctgccgccggtgacctaggtggcgatcacctcgcgtttagctgcgacgtggcaaaagaacatgatgttcaaaatactttcgaagaactggaaaaacatctgggacgggtgaatttcctggtgaacgccgccggaatcaatcgtgacggattgttggtacgaaccaagacagaggatatggtgagccaactgcatacaaatctcctaggttcaatgctcacctgcaaggcagccatgcgcacaatgattcagcaacagggcggctccatagttaatgtaggctccatagtcggtctcaagggtaactcggggcagagtgtatactcagcatcaaagggaggtctcgttgggttctcacgggccctcgctaaggaagtcgcacgcaagaagatcagggttaatgtggtcgcccctggcttcgtacataccgacatgacgaaggacctgaaagaggagcatctgaagaagaatattcccttgggccgttttggcgagacaatagaggtcgcgcacgcggttgtatttcttttggagtccccatacatcactggacacgttctagttgtcgacggggggctccagctcatcctgtag

SEQ ID NO: 40782 - DNA, 540 bp, Artificial Sequence
  Description of Artificial Sequence: Synthetic coding sequence
atggacaaggtgtgcgccgtgttcggcggcagccggggcatcggccgcgctgtggctcagcttatggctaggaaaggatatagactggccgtaattgcccgcaacctggagggggcaaaagccgcagccggggacctcggcggagatcacctggcctttagctgtgacgtagcgaaagagcatgatgtgcaaaatacatttgaagaactcgagaagcatctaggccgggtcaacttcttagtaaacgctgctggaatcaaccgagatggtcttctggtgcggactaaaacagaagacatggtttcacaactccacacgaacctccttggctctatgctgacgtgtaaggcagccatgcgcaccatgatacaacaacagggcggaagcattgttaatgtggggtccattgtcgggctcaagggcaactccggtcagtcagtttatagcgcgtccaaggggggccttgttgggttttcaagagctttagcgaaagaagttgcccggaaaaagattcgcgtgaacgtggtggcacccgggtag

SEQ ID NO: 40783 - DNA, 1872 bp, Artificial Sequence
  Description of Artificial Sequence: Synthetic coding sequence
atgaccgcccagagccggagccccaccacccccaccttccccggccccagccagagaactcccctgacaccctgccctgtacaaacaccaaggctaggaaaggccctaatccactgctggacagacccaggccagcctttgggagagcaacagcgtgtgcgtcggcagagaacagagacctccgagcctacaatgcggttacaccgtctgcgcgcccgcctgtctgctgtcgcctgcggactgctcctactactggttagagggcagggtcaggacagcgctagcccaataaggactacccacacggggcaggtgctaggctctctcgtgcatgtgaagggggctaatgccggtgtgcagacattcttagggatcccatttgccaagccccccctaggtcctctgcgatttgccccccccgaaccccccgaatcttggtccggcgtacgtgacggcacaacccatcctgcaatgtgcctgcaggacctgactgccgtggagagcgaatttttgagtcaatttaatatgacattcccttcagactccatgtcagaggactgcctgtacttaagtatctatacccccgcccactcacacgaagggagtaatcttcctgtaatggtttggatccacggaggggcgctggtgtttggcatggcctccctctacgacgggtcaatgcttgccgctctcgaaaacgtggtggtagtgatcatccaatacaggcttggggtgctgggctttttttcgactggggataaacacgccactggcaactggggctacttggaccaggtcgccgccttgcgctgggtacaacagaacatcgctcatttcggcggcaaccccgaccgcgtgactatttttggggaatccgccggcggcacctcagtatccagcttggtggtgtcacctatttcacagggattattccatggtgctatcatggaatccggcgttgccttgctgccgggcctgattgcgagtagcgctgatgtgatctctactgtagttgccaatctgagtgcctgcgatcaggtcgactctgaggcactggtcggttgtctgcgcggcaagtccaaagaggagattttagccatcaacaaaccttttaagatgatacctggcgtggttgacggcgtgttccttccgcggcatccccaggaacttctggcctccgccgactttcagcccgtgccttccatagtaggggtgaacaacaatgagttcggctggctcattccaaaagtgatgcgcatttatgatacccaaaaggagatggatcgggaggccagtcaggcagccctgcagaagatgctgaccttactgatgctgccgccaactttcggggacctccttcgcgaagagtatataggtgacaacggagaccctcagaccttgcaggcccagtttcaggagatgatggcggatagcatgttcgtgatacctgctttgcaggtggctcacttccaatgttcacgcgccccagtgtatttctatgaattccaacaccaaccttcatggctgaaaaacatccggcccccacatatgaaggccgaccatggagacgaactcccattcgtgtttaggagcttcttcggcggaaactacatcaagttcaccgaggaagaggagcagttgagtcgtaaaatgatgaaatactgggccaactttgctagaaatggcaatccgaatggggaaggccttccgcactggcctctgtttgaccaggaggagcagtacctgcagctcaatttacaaccagctgtggggcgagccctcaaggctcatcgcctgcagttctggaaaaaggctctgccccagaagattcaggagctagaagagcccgaggaaaggcataccgaattgtag

SEQ ID NO: 40784 - DNA, 1824 bp, Artificial Sequence
  Description of Artificial Sequence: Synthetic coding sequence
atgaccgcccagagccggagccccaccacccccaccttccccggcccaagccagagaacccccttgacgccttgtccagtgcaaacgccaagactcggaaaagcactcatccactgctggactgatcctggtcaacccctcggagaacagcagcgggtgcggcggcagagaacagagacatccgaacctactatgaggctgcataggttgcgcgccaggctgagcgcagttgcttgcgggctgttgctccttctagtgcgcggccaggggcaggattcagcgagccccatccgcactactcacactggccaggtgctcgggtccctggttcatgtcaagggggccaatgcaggagtgcagacctttcttggaatcccatttgccaagcctcccctcgggccccttcggtttgccccgccagaaccccccgagagctggtcaggggtacgggatgggacgacacaccccgccatgtgcctgcaagatttgactgccgtggaatcagagttcctgagccaattcaatatgactttcccaagcgattccatgtctgaagattgtttatacctttctatctacacacctgcacattcccacgaagggtccaatttgccagtcatggtctggatacatggaggggccttggtctttggcatggcttccctgtatgacggctctatgcttgcagcattggagaatgttgtagtggtgattattcagtatcgcctcggcgttctcggcttttttagcactggggacaaacatgctaccggaaactggggctacttggaccaggtggccgctttacggtgggttcagcagaacatagcccacttcggcggcaatcccgaccgggtgaccatctttggcgaaagcgcaggaggaacaagcgtgagctcattggtagtgtcgcctatatcccaggggctgttccatggagctattatggagtctggtgtagcacttctccctggcttgatcgccagtagtgcagatgtaatatcaaccgttgtggctaacttgtcggcctgtgaccaagtggatagcgaggcattggttggatgcctccgaggtaaaagtaaggaggaaatcctggcaatcaacaaaccatttaagatgatccccggtgtggtcgatggagtgttcctgcctcggcacccacaggagctcctggcttccgccgacttccagcctgtcccatccatcgtgggagtaaacaacaatgaattcggctggctgatccccaaagtgatgagaatctatgacacgcagaaggagatggacagagaagccagccaagccgctttgcagaaaatgctgaccctgctgatgttgcctccaactttcggggatcttttgcgggaagagtatatcggggacaacggcgatccacagacgctgcaggcccaattccaggagatgatggccgacagcatgttcgtcattcctgctctgcaggttgctcactttcaatgcagccgagcccctgtgtacttctacgagtttcagcatcaaccctcctggctgaaaaacatccggcctcctcacatgaaagccgaccatgtgaaatttaccgaggaagaggaacagctaagtcgcaaaatgatgaagtattgggcaaatttcgcccggaacggaaatccaaacggtgagggcctgccacactggccactttttgatcaggaggagcagtatctgcagctgaatctgcaacccgcagttggcagagcattgaaggctcacaggttgcagttctggaagaaagctctccctcagaaaatacaagaactcgaggaacctgaggagaggcacacggaactgtag

SEQ ID NO: 40785 - DNA, 903 bp, Artificial Sequence
  Description of Artificial Sequence: Synthetic coding sequence
atggagatccccatgggcacccagggctgcttcagcaagagcctgctgctgtcagcttcaattctagtattatggatgctacagggtagtcaggctgcattgtatatacaaaagataccagagcaaccccagaaaaatcaggacctcctgttgtccgtgcagggggtgcctgacacctttcaggatttcaattggtacctgggggaggagacatacggtggcactcgtctcttcacctatattcccggcatccaacggccacaacgggatggcagcgcaatgggccagagagacattgtgggctttcctaatgggagtatgctgctgcgccgcgcacagccaacagacagcggaacataccaggtggccatcactattaattccgagtggacgatgaaggcaaagactgaggttcaggtggcggagaaaaacaaggagcttcccagtacacacttacctaccaacgcagggattcttgctgcaaccattatcggatcgttagccgctggggccctgttaatcagttgtatagcctaccttttggtgactcgcaattggcgtggacagagtcaccggctacccgctccccggggtcaagggtccctgtctatcctctgctcagccgtgtctcccgtgccgtcagtaacaccatcgacatggatggccacgacagaaaaacctgagctcggacccgcgcatgacgctggcgataacaatatttatgaggtaatgccatcacctgttctcctagtttctcccatttccgatactcggagcatcaaccccgcccggcccctgcccacccctccacatcttcaagccgagccagaaaaccaccagtatcaacaggatctgctcaacccggatcctgcaccctactgccagttagtgccaacttcatag

SEQ ID NO: 40786 - DNA, 900 bp, Artificial Sequence
  Description of Artificial Sequence: Synthetic coding sequence
atggagatccccatgggcacccagggctgcttcagcaagagcctgcttctgtcagcgagtatactggtgttgtggatgcttcagggcagccaggcagcgctgtatatccagaaaattccggagcagccccagaaaaaccaggacttattattgagtgtgcagggagttcctgacacattccaagacttcaactggtacctaggagaagaaacttacggcggaactcgcctcttcacctacatccccgggatccagagaccgcaacgcgatggatctgccatgggacagcgcgatattgtaggatttccaaatggaagcatgctgctccgaagagcacaacccacagactccggcacctatcaggtggctatcactataaacagtgaatggacaatgaaggccaaaaccgaggtccaggtggctgagaagaacaaggagctcccatccacccatttgcctacgaacgcagggattcttgctgctaccatcatcggcagtctggccgctggcgcactgctcatttcatgcatcgcctatcttcttgtcacaagaaactggcgcggacagagtcatcggctcccggcacccagagggcaggggtctctgtcaattctgtgcagcgcagtgtcccccgtcccatccgtgaccccttcgacttggatggcaaccactgaaaagcctgaacttggtcctgcccacgacgcaggcgataacaatatctatgaggtgatgccctcccccgttctgctggtgtccccgatttcggatacgcgcagcattaacccagcacgccctctgccaactcccccacacctccaggccgagccggagaaccatcagtaccaggatttgctaaatcctgaccctgccccctactgccagttggtgcccacaagttag

SEQ ID NO: 40787 - DNA, 879 bp, Artificial Sequence
  Description of Artificial Sequence: Synthetic coding sequence
atgggcccccccagcgcctgcccccaccgggagtgcatcccctggcaaggactccttctcactgccagcctgctgacgttttggaatgcaccaaccacagcatggttatttatcgccagtgcacccttcgaagttgcggagggcgaaaacgtgcatctcagtgtcgtgtacttacccgagaacctttactcttacggctggtataaaggcaaaacagtcgaaccaaatcagttgatcgccgcttatgtgatcgatacccacgtgagaactccaggccccgcttactcaggacgggaaactattagcccatcaggagatctccactttcaaaatgtgacactggaagatacggggtactatacgttgcaggtgacctatcggaactcccaaattgagcaggcctcccaccacctgcgagtgtatgagagcgtggctcagccttcaattcaggcctcgagcacaactgttactgagaagggaagtgtggtcctgacatgccacactaataatacgggtaccagctttcagtggatctttaataaccagcgtttacaggttacaaaacgtatgaaactcagctggttcaaccacatgctgacgattgatcctatcagacaggaggacgccggcgaataccagtgcgaagtcagcaaccctgtgagtagtaatcgaagcgacccattgaagctgactgtaaagtacgacaatacactgggtatattgattggggtgttagtgggttcacttctcgttgcggctttggtgtgttttctgctcctgcgcaaaaccgggcgagcttccgaccagtctgacttccgggagcagcagccgcccgcctccaccccgggccacggcccttccgacagctccatctcgtag

SEQ ID NO: 40788 - DNA, 882 bp, Artificial Sequence
  Description of Artificial Sequence: Synthetic coding sequence
atgggcccccccagcgcctgcccccaccgggagtgcatcccctggcaaggcctgttgttgacagcttctctgttgactttttggaatgctcccacaacggcttggttgttcatagcatcagcaccattcgaggtggcagagggcgagaatgtgcatttaagcgtggtttacctgccagaaaatctctactcctacggttggtataagggaaagactgtggaacccaaccaactgatagcagcctacgtgatcgatacacacgtgaggaccccaggccctgcctatagcggcagggagaccatatctccgagcggtgatcttcattttcagaacgtcacactggaagacacgggttattatacactccaagtgacctaccgaaattcccaaatcgaacaagcttcccaccacctccgagtttatgagtcagttgcacaacctagtatccaagcttctagtactaccgtaaccgagaagggatctgtcgtgctaacctgccacaccaataacactggtactagctttcaatggattttcaacaatcagaggttacaagtgactaagagaatgaagctttcgtggtttaaccatatgttaacaattgatccgatacgacaggaggacgcgggagaataccagtgcgaggttagcaacccagtctccagcaatcgctcagaccctcttaagctgaccgtcaagtctgatgataacacattgggcatcttgattggtgtcttggtgggaagtcttctggtagccgccctggtgtgttttctgctcctgcgtaaaacaggacgggcatccgatcagagcgacttcagggagcagcagcctcccgcctcaacacccggacatggccctagcgactctagcatttcatag

SEQ ID NO: 40789 - DNA, 900 bp, Artificial Sequence
  Description of Artificial Sequence: Synthetic coding sequence
atgatggcctacatgaaccccggcccccactacagcgtgaacgccctagctctgtcaggtccatccgtcgacctgatgcatcaggcagtgccctatcccagcgccccccggaaacagaggcgggagagaaccacgttcacgcgaagccagctggaagagcttgaagccctcttcgccaagacccaatatccagacgtttacgctagagaggaggttgcactaaaaatcaatttgccggaatcaagagttcaggtttggttcaagaaccggcgagccaagtgtagacagcagagacagcagcagaagcaacaacagcagcccccaggcggtcaagcaaaggctcggcctgccaagcggaaagccgggaccagccctagaccctctaccgatgtgtgcccggatcccctgggaatatccgactcatattcaccgcccctgccaggtcctagcggctccccaacgaccgccgtcgctactgtatctatttggagcccagcctcagaatcaccacttcccgaggctcagagggcaggccttgtggcctccggaccgtctctgacttccgcgccatatgcgatgacatacgcgcctgctagcgccttctgttcatctccctcggcctacggcagcccttcctcatacttctcaggcctcgacccttacctcagtcccatggttccccagctgggtgggcccgcactctcacctctgagtggcccttctgtgggcccctctctggcccagtcccccaccagcctgtctggccagagctatggtgcctactctccagtcgattctttagagttcaaagatcctactggcacatggaaatttacctataacccaatggatcccttagattataaggatcagagcgcctggaaattccagatcctgtag

SEQ ID NO: 40790 - DNA, 639 bp, Artificial Sequence
  Description of Artificial Sequence: Synthetic coding sequence
atgggcccccccagcgccagcccccaccgggagtgcatcccctggcaaggcctgctgctgaccgcttcactgctcaacttctggaatccgcccactactgcgaagttaactattgaatcaatgcctctcagcgtggcggaaggaaaagaagtcctgttgctggttcacaatttacctcaacatttatttggatacagctggtacaaaggtgagcgtgtcgatggcaactcactgatcgtcggatatgtcattggcacacagcaggccactcccggagcagcgtacagcgggcgggagacaatctacaccaacgcttccctgcttatccaaaatgtaacccagaacgatatcgggttctatacgttacaggtgattaagtccgatctcgtcaatgaagaggccaccggccagtttcatgtgtaccaggagaatgctcctggcctgcccgtgggagcagtcgcaggtattgttacaggcgtcctcgtgggcgtggccctagtggctgctctagtgtgctttcttctcctcgccaagaccggcaggccttggtcattgccccaactctgcttgctcgacgtgcccagtctccattgcccaggtccccccacccaacctcaggactcttcttttcacctatag

SEQ ID NO: 40791 - DNA, 759 bp, Artificial Sequence
  Description of Artificial Sequence: Synthetic coding sequence
atgggcccccccagcgccagcccccaccgggagtgcatcccctggcaaggactattgctcactgccagtttgctaaatttctggaatccaccaacaaccgccaaattgaccatcgagtccatgcctctctcagtggctgaaggcaaggaagtcctcctgttggtgcataacctcccacaacacctgtttggctattcatggtataagggggaaagggtcgatggtaatagtctaatagtcggatatgttataggcacacagcaagcaacccccggcgccgcctacagcggacgggagactatttatacgaacgcctcattgctgatccagaatgtaactcagaacgatatcgggttttacacacttcaggttatcaagagcgacctcgtgaacgaggaagcaactggacagtttcatgtgtaccaggagaacgctcccggactgcccgtcggagcagttgccggtattgtcaccggagtgctggtgggcgttgccctggtggcagctcttgtatgcttccttctcttggctaaaacaggtcgtacaagtatccaacgagacttaaaagaacagcaacctcaggctttggccccagggcggggcccttctcactcttccgccttctctatgtctccgctgagcaccgcgcaagccccgctgcctaatccacgaacagctgcctcaatttatgaggagctgcttaaacatgacacaaacatctattgcaggatggaccacaaagcagaagtagcctcttag

SEQ ID NO: 40792 - DNA, 534 bp, Artificial Sequence
  Description of Artificial Sequence: Synthetic coding sequence
atgggcccccccagcgccagcccccaccgggagtgcatcccctggcaaggtttgctcttaactgcttccctgctaaatttttggaaccccccgacaaccgcaaagctgaccattgagtctatgccactttcagttgcagagggcaaggaagtcttgctcctcgtgcataatttgccgcaacaccttttcgggtacagctggtataaaggtgaacgtgtcgacggcaacagtctcattgtgggttatgtgataggtactcagcaggcaacacccggcgcagcttattccggacgggaaactatctacaccaatgctagcctgctcatccagaacgttacacaaaatgacatcggcttttatactctgcaggtcatcaaaagtgatttggtgaacgaagaggcaacggggcagtttcatgtgtacccagagctgcctaaaccatcaatctcctcgaataattcgaatcctaaagaagataaggatgccgtggcttttacctgcgaacctgaaattcatagtaccacttgcctgtag

SEQ ID NO: 40793 - DNA, 774 bp, Artificial Sequence
  Description of Artificial Sequence: Synthetic coding sequence
atggccgccccctgggccagcctgcggctggtggcccccatgtggaacggacgaatacgagggatccaccgcctgggcgcagccgtcgcacctgagggtaatcagaagaagaagcggactatactacagtttcttaccaactatttctatgatgtcgaggcgctgagggactaccttctccagcgggagatgtataaggttcacgagaaaaataggtcttacacctggctggagaagcagcatggaccatatggggcaggtgcatttttcatcctgaagcagggtggagccgtcaagttccgagataaggaatggataagacctgataagtatggccatttctctcaggaattctggaatttctgtgaggtccccgtggaggcagtcgacgcaggcgactgcgatattaattacgaagggctggataacctcctgaggctcaaggaattgcagtcactgagtctccaaaggtgctgtcatgtagacgactggtgtctgagcaggctgtaccctttggcggactctctgcaggaactctctttggctggctgtccccggatatcagaacggggccttgcttgtctgcaccatctgcagaatctgcgccgccttgatattagcgacttaccagccgtcagcaaccccggcctgacgcagattctggtagaagagatgctgccgaattgtgaggtcgtaggcgttgactgggcggagggcctaaagagcggccctgaagagcaaccccgcgacaccgctagtccagtgcccgcctag

SEQ ID NO: 40794 - DNA, 798 bp, Artificial Sequence
  Description of Artificial Sequence: Synthetic coding sequence
atgggcagccccagcgcctgcccctaccgggtgtgcatcccctggcagggattgcttcttacagcttcattactcactttctggaatctccctaacagtgcccagaccaacatcgatgtggtgccgtttaatgttgctgagggtaaagaggttctcctagtggtgcacaatgagtcacaaaatttgtacggctacaactggtacaaaggtgagcgggtccacgccaattaccgaataattggatacgtgaaaaacatttcccaagagaatgcgcccgggcctgcacataacggtcgcgagacaatttatccgaatgggactctgctgattcaaaatgtcactcacaacgacgctggcttttacacactccacgtcatcaaagagaacttggtgaacgaagaggtcaccaggcaattttacgtgttcagtgagcccccaaaaccaagcattactagcaacaacttcaatccagtggagaataaggacatcgtagtacttacgtgccagcctgagactcagaataccacctacttatggtgggtcaataatcagagcctactggtgagtccacggttgctactgagcacagacaaccgcaccctcgttttgctttccgcaaccaagaatgatattggcccttatgaatgtgaaatacaaaacccggtaggcgccagcaggagtgaccctgtgactttgaacgtgcgctacgaatctgtacaagcatcctctcccgacttgtccgcaggcacagccgtgtccatcatgatcggagttctggccggcatggctctgatttag

SEQ ID NO: 40795 - DNA, 519 bp, Artificial Sequence
  Description of Artificial Sequence: Synthetic coding sequence
atgggcagccccagcgcctgcccctaccgggtgtgcatcccctggcagggactacttctgacagctagcctgctgaccttctggaatctaccgaactccgctcagaccaatattgacgtcgttccatttaacgtcgcagagggaaaggaagtgctcctcgtggtgcacaatgaatcacagaacctttacggctacaactggtacaagggagaaagggtgcatgctaactatcggataataggctacgtcaaaaatattagccaggagaatgctcccggtcccgcccacaacgggagagagaccatctaccctaatggcacattgctcatacagaacgtgacgcacaatgatgccggcttttacacactccacgtcatcaaggagaacctggtgaatgaggaagtcacccggcagttttatgtcttttatgagtctgtgcaagcttcctcccctgacttgtctgccggaacagccgtgtctattatgattggagttctggctggcatggccctgatctag

SEQ ID NO: 40796 - DNA, 798 bp, Artificial Sequence
  Description of Artificial Sequence: Synthetic coding sequence
atgggcagccccagcgcctgcccctaccgggtgtgcatcccctggcaaggcttactgctgactgctagcctactgacattttggaatctccccaactccgctcagaccaatattgacgtagtgccgtttaatgtcgccgagggcaaagaggttttactcgtcgtacataacgagagtcagaacctgtacggttataattggtacaaaggggaacgagtgcacgccaattacaggattattggctacgtgaaaaacatctcccaggagaacgcccccgggccagcccataacggcagggaaaccatataccccaacggaaccctcctcattcaaaatgtgactcacaacgacgcgggcttctatactctgcacgtcatcaaggaaaatctggttaacgaagaggtcacaagacagttttacgtgttcagcgaaccccctaagccatcaatcacatccaataattttaatccagtggaaaataaggatattgttgtccttacgtgccagccagaaacgcagaacacgacttacctgtggtgggtgaacaaccagtccctcctggttagtccaaggttgttactcagtaccgataaccgcaccttagtccttctatctgcaacaaaaaatgacattgggccctatgaatgcgagatccagaatcctgtgggggctagtcggtccgatccagtgacattgaacgtgcgctacgaatctgtgcaggctagctcccctgatctctcggcagggacagctgtcagtatcatgatcggcgtccttgccggcatggccttgatctag

SEQ ID NO: 40797 - DNA, 735 bp, Artificial Sequence
  Description of Artificial Sequence: Synthetic coding sequence
atgggcagccccagcgcctgcccctaccgggtgtgcatcccctggcagggtctcctgctcaccgcgtccctgctgacattctggaatctccctaactccgcgcagaccaacatcgacgtcgttccatttaatgttgcagaaggcaaggaggtgctgctcgtcgttcacaacgaaagtcagaacttatatggctacaactggtataagggcgagagagttcacgccaacggcagagagacaatttatcctaatgggacccttctaatccagaatgtcactcacaacgacgccggcttctatacattacatgtaatcaaagagaatttggtaaatgaggaagtcactcggcagttctacgtctttagcgagccacccaagccctccattacatctaataacttcaatcccgttgagaacaaagacatcgtggtgctcacatgtcagcccgaaacacaaaacaccacctatttgtggtgggttaacaaccagtcacttctcgtgtcccctaggctgttgctgtccaccgataacagaactctcgtgctgctctccgcaacaaagaatgacattggcccttacgaatgtgagatccagaaccctgttggagccagtcgatctgaccctgtgaccctgaatgtgaggtacgagtcagtgcaggcatcctcccctgacctttccgccggaaccgcagtgtctattatgattggcgtgctagcaggcatggcactgatctag

SEQ ID NO: 40798 - DNA, 2361 bp, Artificial Sequence
  Description of Artificial Sequence: Synthetic coding sequence
atgaagggcaccggcatcatggactgcgcccccaaggccctgctggctagggccttgtatgacaattgccccgattgctccgacgagttggcattctcgcgcggcgatatcctgaccatcttagagcagcatgtgccagaatcggagggctggtggaaatgcctcctgcatggcagacagggactcgcacccgctaacagactccaaattttaacagaagtcgcagccgaccgaccatgcccccccttcctgcgcgggctggaagaggcacccgctagttctgaagagacctatcaggtacccacactcccaaggcctcccactccagggccagtctacgagcagatgcgctcctgggccgagggaccacagccccccactgcgcaagtgtatgagtttcctgatccgcccacttcagcccgtatcatttgtgagaaaactctgtccttcccaaagcaagccattttgaccttgcctcgacccgtccgcgccagccttccaacactaccctctcaggtctacgatgtacctacgcagcataggggtcccgtggtgctgaaggaacctgagaaacaacagctttatgacatccctgccagtccaaagaaggcgggtctgcaccctccagattcccaggccagtggacaaggtgttccgctgatctccgttacgacactgcggagaggcggatactctaccctcccgaatccacagaagagtgagtggatttatgatactcctgttagcccagggaaggcttcagtgagaaacactcccctcacatcgttcgctgaggagagcaggccgcacgccctgcctagctcctcctccacgttttacaatcctccgtccggccgctctaggagcctgactccccaactcaacaataatgtgcccatgcagaaaaagctgagtctaccagaaatcccaagttatggattcctcgttccacgggggaccttccccctggacgaggacgtctcatacaaagtacctagttcatttttaatccctcgggttgagcaacagaatacaaagcctaatatttatgacatacccaaggccacttcatcagtaagtcaagctggcaaagagctggagaaagctaaggaggtgagtgagaattccgcaggtcacaatagttcatggttttctcgccggactacttccccctctccagagccagatagactttctggaagtagttccgatagccgagctagcatagtgtcttcctgcagcaccacctctacagacgactccagcagttcgtcctctgaggaaagcgccaaagaactctcactggatttggacgtagcaaaggaaactgtaatggccctacagcataaagtggtatcctccgtcgcgggactgatgctcttcgtttcacgaaagtggagattccgggactatttggaggcgaacatcgatgcaatccatcggagcacggaccatattgaagagagcgtccgagagtttctggactttgcccgaggcgtccatggcaccgcctgcaatttgaccgactccaacttgcagaacagaattagagaccagatgcagacgatcagcaactcatatcgaattctgctcgaaactaaggaaagcttggataatcgtaattggccgcttgaggtgctggtgactgattctgtccagaatagtccagatgatttggaacgtttcgtgatggttgccagaatgttacccgaagacattaaaaggttcgcaagcatagtcattgcaaatggccgtttactatttaagagaaattgtgagaaggaggagaccgttcagctgaccccaaatgcagagtttaaatgcgaaaaatatatccaacctccccagcgagaaaccgagtcacatcagaaaagcacgccaagcactaaacagagagaggatgaacactcttcagaactgctaaagaagaatcgggccaatatctgtggacagaaccctgggccattgatccctcaaccctcctcgcagcaaacaccggagagaaaaccacgcttatctgaacattgccgactgtacttcggtgcgttgttcaaggccattagcgcatttcacggaagcttatcttccagtcaaccagctgagatcatcactcagagcaaactggtgataatggttgggcagaagcttgtagacaccctgtgcatggagacccaggagcgagacgtgcggaacgagatcctccgcggcagcagtcacctctgtagcctgttgaaagacgtcgcactcgctacaaagaatgcagtgcttacctacccatcacccgcggcattgggtcatcttcaagcggaagcagaaaagctggaacagcacacaaggcagttccgcggaacactggggtag

SEQ ID NO: 40799 - DNA, 2361 bp, Artificial Sequence
  Description of Artificial Sequence: Synthetic coding sequence
atgaagggcaccggcatcatggactgcgcccccaaggccctgctggcccgagccctatatgacaactgcccagattgttcagacgagctcgccttcagtcgcggtgatattctgacaatcctggagcaacacgtgcctgagagtgaaggctggtggaagtgtcttctccacggacggcaaggcctggcccctgcaaatcgcctccaaattctgactgaagtggctgctgatcggccctgtccacctttcttgaggggcctggaggaagctcccgcctcgtctgaggaaacctaccaggtcccaaccttgcctcgtcctcctaccccaggcccggtgtatgagcagatgaggtcctgggccgaaggcccacaacccccaacggcccaggtctacgagtttcctgatcctccgacttcggcgcgtattatatgtgagaagactctgagcttccccaagcaggctattcttactttgcctagacccgtcagggctagcctgccaacactgccgtcacaggtttacgatgttcctacccagcacagagggcctgtggtactgaaagagcccgagaaacaacagctgtatgacatccctgcatcccccaaaaaggctgggctgcatcctcctgattcccaggcttccgggcagggcgtcccattgatttccgtgacgacgctgagaaggggaggctactctactctgccaaatccccagaagtcagaatggatttatgatacgccagtatcacccgggaaggcgtctgtccgtaatacccctctgacttccttcgccgaggagtcccgaccccacgccctaccctcatccagtagtaccttctataatcctccctcgggcagatcccggagtctgacaccacaactcaataacaatgtgcctatgcaaaaaaagctgagtctcccagaaatcccctcttacggctttctggtgccccgcggaaccttccctctggacgaagatgtttcctataaggtgccctccagtttcctcatccctagggtggagcagcaaaatacaaaaccgaacatctacgatatccctaaagctacgtcttcagtttcacaggcggggaaagagcttgaaaaggccaaagaagtttccgaaaactcggctggtcacaatagcagctggttttcacggagaacaacctcgccatcacctgagccagatagactaagcgggagtagtagcgattcccgcgcctctatagtcagcagttgttcaactacttccaccgatgacagcagttcatctagttcggaagaaagcgcaaaagagttatcactggacctcgacgtcgctaaggaaaccgtgatggccctacagcataaagttgtcagttcggtggccggactcatgctatttgttagtcgaaaatggcggttcagggattatctcgaggcgaacattgatgcgatccatagatcaacagaccatatcgaggaatccgtgcgagaattcctggactttgccagaggcgttcatggcactgcttgcaacctgactgattccaatctccaaaaccgcattagggatcaaatgcagaccatctccaactcctacagaattctgctggagactaaggagagcctcgataatcgaaactggcccctggaagtgctggtgacagactcagtacagaattcgcctgacgacctggagagatttgttatggtcgccagaatgttgcccgaagacatcaagagattcgcatccatcgtgattgcgaacggacgactcctgttcaaaagaaattgtgaaaaagaggagacagtgcagttgaccccaaatgcagagtttaaatgcgaaaagtatatccaaccaccgcagagggagactgaatcacatcaaaaatccactccatctaccaagcagcgggaggacgagcacagtagtgagctgttgaaaaaaaatagagctaacatttgtgggcagaatcccgggccattgataccacagccctctagccagcagacacccgagagaaaaccacgtctcagcgagcactgtagactgtacttcggcgcactgttcaaggcgatttcagctttccacggctcattaagcagcagtcaacccgccgaaataatcactcagagcaagcttgtgataatggtgggccaaaaattagtagatacactgtgtatggagactcaagagcgtgacgttagaaatgagatactccgagggtctagccacctctgttcattgctgaaggatgtcgctttggccactaaaaatgccgtgctgacttacccttcacccgccgccctcgggcatctgcaggccgaggccgagaagctcgaacaacacacccgtcagttccggggcaccctggggtag

SEQ ID NO: 40800 - DNA, 1050 bp, Artificial Sequence
  Description of Artificial Sequence: Synthetic coding sequence
atgaagggcaccggcatcatggactgcgcccccaaggccctgctggcccgcgctctgtacgacaactgcccagattgtagtgacgaactcgcgttttcccgaggagacattctcaccatccttgagcaacacgtgcccgaaagtgagggctggtggaagtgcctgctgcacggtcgccagggcctggcacccgctaatcggctgcagatccttaccgaagtcgcagctgatcgcccatgtccacccttcctccggggcttagaagaggcgccagcctcctccgaagagacgtatcaggttccaactctgccccgcccccctacgccaggcccggtttacgagcagatgcggagctgggcggagggtcctcagcccccgacggctcaggtgtacgagttccccgaccctccaacaagtgctcgaataatatgtgagaagactcttagctttcccaagcaagctatactaacattgcccagaccggtcagagcctcactacccaccctcccttcacaggtgtacgatgttcctacacaacacagaggtccagttgttctgaaagagcccgaaaagcagcagctgtacgatatccccgcttcacctaaaaaagcgggactccacccccccgatagccaggcaagtaaccctggtcccctcatcccacagccttcctcacaacaaactcctgagcgtaagccacgcctgagtgaacattgcagactgtattttggagccctctttaaggctatttccgcttttcatggctccctgtcttcatcccagccagccgaaataataacgcagagtaagttggtgattatggtgggtcagaagctggtcgacactctatgcatggaaactcaagaaagggatgtgaggaacgagattttgaggggatcctcacacctctgcagtctcctcaaagatgtggccctcgccaccaagaatgccgtactgacgtacccttcgcctgcggcattaggacatctgcaagccgaggccgagaaactggaacagcacacacggcagttccgcggaacactggggtag

SEQ ID NO: 40801 - DNA, 687 bp, Artificial Sequence
  Description of Artificial Sequence: Synthetic coding sequence
atgagcagcagcgaggaggtgagctggatcagctggttctgcggcctgaggggaaatgagttcttctgcgaagtcgatgaagactacatacaagataagtttaacctcactggactcaatgaacaggtgccccattatagacaggcccttgatatgatactggacctggagccggacgaagagcttgaagacaatcctaaccagagcgatttaatcgagcaggcagccgaaatgctctatggccttatacatgcccggtatattctcacaaacagaggtatcgcccagatgttggagaaataccaacaaggagattttggctactgtcctagggtgtactgcgagaaccaacccatgctgcctattgggttatctgatatcccgggcgaggctatggtgaaactgtactgcccaaagtgcatggacgtctatacgcccaagtctagcaggcatcatcacaccgatggcgcctacttcgggactgggttcccccacatgctgtttatggtgcacccagagtacaggcctaagagacccgctaaccagttcgtcccctcctcttgtagccggcatccggacgtacctttgctgccacgccgtaggccattctgtagaatgcactttcggctcagggaggtgtatcatcagcagctgatacctgtgcacggagaccaccaccttctctag

SEQ ID NO: 40802 - DNA, 1182 bp, Artificial Sequence
  Description of Artificial Sequence: Synthetic coding sequence
atgtacgcctggttcttcctgcccagcttcagccagagcccccccacctttggattcctcctggacattgacggagtgctcgtgagaggtcatcgggtcatccccgccgcattgaaagcctttcgtcggcttgtgaatagccaaggccaactccgcgtaccggttgtcttcgtgacaaatgcaggtaacatcctccagcactccaaagctcaagaactgtccgccctcctcggctgtgaggttgatgccgatcaggtcatcctctcacactcaccaatgaagttgttttccgagtaccacgagaagagaatgctggtgagcggacagggaccggttatggagaatgcccagggactgggattccgtaatgtcgtcaccgtagatgagcttagaatggctttcccactattggatatggtcgacctggagcgccggctcaaaaccacacctttgcccaggaatgatttcccaaggatagaaggcgttttgctgttgggcgagccagttaggtgggaaacgtccctgcagctgataatggacgtcttattatcgaatggttcccccggagcaggacttgcgaccccaccctatccccacctcccagtgctggctagcaacatggatctgctgtggatggcagaagccaagatgcctagattcggccacgggacatttctgctttgtcttgagactatctaccagaaagttaccggtaaggaactgcgatacgagggcctgatggggaaaccatcaatcctgacctaccaatatgccgaagacctcattcgtcgacaggccgagcgtagaggatgggccgcccctattcgtaagttgtatgctgtcggggacaatccgatgtccgacgtctacggcgccaacctcttccaccaatatttacaaaaagcaacacatgatggagcccctgaactcggagctggaggcactcggcagcaacagccgagcgcaagccagagctgcatttcaattcttgtgtgcacaggagtgtacaacccccgtaatccccagagtactgaaccagtgttaggcgggggggagcctccttttcacgggcatcgcgacctgtgtttttctccaggcttaatggaagcatctcacgtagttaatgacgtgaatgaggctgtgcaactggtcttcaggaaggaggggtgggcgctcgagtag

SEQ ID NO: 40803 - DNA, 1272 bp, Artificial Sequence
  Description of Artificial Sequence: Synthetic coding sequence
atggccgcctggggctgcgtggccgccctgggcgccgcccggggcctgtgttggagagccgctagagctgctgctggcctccagggccggccggcccgccgctgttatgcggtgggaccagcccagagtcctcctaccttcggtttcctgctggacattgacggcgttttggtgagggggcaccgggtgatcccagccgctctgaaggcatttagaaggttggtgaacagtcagggccagctgcgcgttcctgtggtgtttgtgacaaatgcaggaaatatacttcagcactctaaagcccaggagcttagtgctctgctgggatgtgaggtggatgccgatcaagtgatcctctcacattcccctatgaaactgtttagtgaataccacgaaaagcggatgctagttagcggccagggacccgtaatggaaaacgcacagggcctaggctttagaaacgtagttacagtggacgaattgagaatggcgtttccactgctggacatggtcgatctggaacgtcggctcaaaactaccccactgcccaggaacgacttcccgagaatcgagggggtgctgcttctgggggaaccagttcggtgggagacctctctgcaactcataatggacgtcctgctgagcaacggctcgcctggcgctggtctggctacccccccatatccacatttacctgtgctggcatccaatatggaccttctctggatggcagaagcgaagatgcccagatttggccatggtaccttcctactttgcctggagaccatttaccagaaagtcactggtaaagaactgcgatacgaaggcctgatgggcaagccctctatcctcacctaccagtacgcagaggacttgatccggcgtcaagcagaaagaaggggttgggcagctccgataaggaaactgtacgcggttggtgataaccctatgagcgacgtttatggtgctaaccttttccaccaatatctgcagaaggcaacgcacgacggtgcaccggaactgggcgccggggggactcggcaacagcagccttcagcttcgcagtcatgtatatctatcctggtctgcactggggtgtataatcctagaaatccccaatctaccgagccagtgcttggagggggggagcctccgttccatggacatagggatctctgtttctctcctggcctgatggaagcaagccatgtcgttaatgatgtcaatgaggccgtccagttagtctttaggaaggagggctgggccttggagtag

SEQ ID NO: 40804 - DNA, 789 bp, Artificial Sequence
  Description of Artificial Sequence: Synthetic coding sequence
atgacccagcccgtgccccggctgagcgtgcccgccgccctggcccttggttcagctgccttaggagctgccttcgccacaggtctgttcctcgggaggcggtgcccaccatggagaggtcgaagagagcagtgcttacttccccctgaggacagcagattgtggcagtatctactttctcgatccatgcgagagcaccccgcattacgttctctgcggttgctgacgctcgaacagccgcagggcgacagtatgatgacttgcgaacaggctcagcttcttgctaacctggcacgcctgatccaggccaaaaaagctctggatcttggaacatttactgggtactcagcgctggcccttgctttggcacttccagcagatggcagagtggtgacatgcgaagtggacgctcagcccccagagttgggacgtcccttgtggaggcaggccgaggcggagcacaagatagacctgaggctcaagcccgccctggaaactcttgatgagctgctggccgccggcgaggccggtacatttgatgttgcagtcgtggatgcggacaaggagaattgctccgcttattacgagcgatgccttcaactgctgaggcctggcggcatccttgctgtcctgcgggtgctgtggaggggcaaggtcctgcagcccccaaagggcgacgttgccgctgaatgtgtgaggaacctgaacgagcgcattcggcgggacgtgagagtgtatatctcgctgctgcctctgggggatgggctcaccttggcatttaaaatctag

SEQ ID NO: 40805 - DNA, 864 bp, Artificial Sequence
  Description of Artificial Sequence: Synthetic coding sequence
atgacccagcccgtgccccggctgagcgtgcccgccgccctggccctcggatcggccgcactaggcgccgcctttgccactggtctgttcctgggccggcggtgtccaccctggcgtggaagaagagagcaatgcctgctgcccccagaggacagccgattgtggcaatatctgctgtcaagatctatgagggaacatccagctctcagaagcctgaggttgctgacactggagcagccgcagggcgattctatgatgacctgcgagcaggcccagctgctggcaaaccttgctcggctgatccaagccaagaaagccctcgacctcggtacatttactggttattcggccctggcactggcactggcgctgcccgctgacggaagggtggtcacttgcgaggtcgatgccgggaggggtggcgcccaggatagaccccctgcagaggccaggctgggcgatcccggtcgagccgcaggtggtgggcgaggcaggcacctgaggaggggaaggggagggtgtgggcaaggcgagctgttaagacttctgcgggctctcccggcagcagccgctacacgtagacatcctaggcgcccacagtctcctgtcgcgcgtgaaggagctgctaccagcgaacgtggaaggggcggtcgcgtctgcgctaaacccaaacgcacccatcccgccgggcgacaggggttacatcagccaccagcaccaggccggtggacgcatctggggttgcaggatctaggtctggccccgagtgagtgggcaaggggcagggtggcctgggaaccacaagagctcactttaagctttaaatttgagaataaggtgggactggggcacacaacatcgtag

SEQ ID NO: 40806 - DNA, 966 bp, Artificial Sequence
  Description of Artificial Sequence: Synthetic coding sequence
atggacgtgcgggccctgccctggctgccctggctgctgtggctgctgtgtaggggggggggtgatgcagattctagagcacctttcacccctacgtggcccaggtcacgggaacgggaggccgcggcattccgcgaaagcctcaaccggcatcggtatctgaatagcctgtttccttcagagaacagtacggccttctacggcatcaatcagttttcttacctgttcccagaggagtttaaagccatttacctcaggagcaaaccttccaagttccctagatactccgccgaggttcacatgagcatccccaacgtgagtctcccactgaggttcgactggcgggataagcaggtcgtgacacaagtccggaatcagcaaatgtgcggtgggtgctgggctttttccgtcgtgggcgcagtggagtctgcgtacgcaattaagggaaagcctctagaggatttgagcgtccaacaggtgattgactgttcctataacaattacggctgtaacggcgggagtacactcaatgccttaaattggttaaataaaatgcaagtcaaactggtaaaggactccgaatatcccttcaaggcccaaaatggcctgtgccactacttttctggttcacactccggattcagtataaaagggtatagcgcatatgatttttccgaccaagaagatgaaatggctaaagccctcttaacgttcggcccactggtggtgattgtcgacgccgtctcttggcaggactatctgggggggatcatccaacaccattgctcctctggggaagccaaccacgcggttctcattaccgggtttgataagacgggctctactccatattggatcgtgagaaactcatggggatcgtcgtggggcgtggatgggtatgctcacgtgaagatgggatctaatgtgtgtggtatcgccgactctgtgtcctccatctttgtttag

SEQ ID NO: 40807 - DNA, 1593 bp, Artificial Sequence
  Description of Artificial Sequence: Synthetic coding sequence
atggccgcctaccagcaggaggagcagatgcagctgccccgggccgacgccatccgttctagactgatagacacattctccctgattgagcacttacaaggactttctcaggcggtccctcggcataccatccgggaactgctggacccttcaagacagaaaaaactggtgctaggagaccagcaccagctcgttcgtttttctataaagccacagaggatcgaacaaatcagccacgctcagaggctgctttcccgcctccacgtgcgctgtagtcagcgacctccactcagtctttgggctggctgggtgctggagtgccctttatttaagaacttcattatatttctggtcttcctaaacactataattctaatggttgagattgagctgctggagagcacaaacacgaagctgtggcccttgaagctcacccttgaagttgctgcatggtttatactactgatcttcatcctggaaatcctactgaagtggctctctaactttagcgtcttctggaaaagtgcctggaacgtgtttgacttcgtggtcaccatgctctccctgctgccagaggttgttgtcctcgtcggggtaactggacagagtgtatggttacagttactgcggatttgtcgcgtattgcggagtctgaaactcctggctcagtttcgacaaattcagattattatcctggtgctcgtgcgggctctgaaatccatgacatttctattgatgctgctgcttatctttttctatatctttgctgtgaccggggtctacgtgttttccgagtatacccgcagccctagacaggacttggagtaccacgtgtttttttcagacctgcccaacagccttgtgaccgtgtttatcctgttcacgctcgatcactggtacgcgttgctccaggacgtttggaaggtgcccgaagtgtcacgtatcttttcctctatttattttattctctggttgctcctgggaagtattatcttcaggagtattattgtggccatgatggtgacaaacttccagaacatccgtaaagagttgaatgaggaaatggcccggagggaggtgcaactgaaagccgatatgttcaagcgtcagattatccaaagacgcaagaacatgagccacgaggcactcacttcaagtcacagcaagatagaggatagctcgaggggagcctctcagcagcgagagtccctcgatctgtctgaagtgtccgaggtggagtcaaactatggagccacagaggaagacctgatcactagtgcctccaagaccgaggagactctcagcaaaaagcgagagtatcagagtagcagctgcgtgtctagcacatcgtctagctactcctccagtagtgagtctaggtttagcgagagcattgggaggctcgattgggagaccctagtgcacgagaatctgcctggtctcatggagatggaccaagatgaccgggtgtggccacgggacagcctgttccgatattttgaattgttagagaagctacaatataacctagaggaacggaaaaaactgcaagagtttgcagtgcaagctctaatgaatctggaagacaaatag

SEQ ID NO: 40808 - DNA, 1593 bp, Artificial Sequence
  Description of Artificial Sequence: Synthetic coding sequence
atggccgcctaccagcaggaggagcagatgcagctgccccgggccgacgccatacggagccggctgatcgatacattttctttgatcgagcacctccagggcttatcacaagctgtgcctaggcacaccatacgggaactcctcgacccgtcgcgccagaaaaaactggtgcttggggaccagcaccagcttgtgagattctcaatcaaaccacagcgtatcgaacagataagtcatgctcagagactcctctctcgtctccacgtgagatgcagccaacgcccgccattaagtctttgggcggggtgggtactggaatgcccattgtttaaaaatttcatcatttttctcgtttttctgaatacaatcatcctgatggtagagatcgaattgttggaatctacgaatacaaaactatggcccttgaaactgaccttggaagtagccgcgtggttcatcctgctgatcttcatactggagatcctgttgaagtggctctctaacttcagcgttttctggaaaagcgcttggaacgtgttcgacttcgtcgtgacaatgttgagcctacttccagaagtggttgtcttggtgggcgtcacaggtcagtctgtgtggctccagctgctgaggatctgtagggtactgcgcagcctcaaactcctcgcccagttcaggcagattcagattatcatcctcgtgctcgttcgagccctgaaaagcatgaccttcttacttatgctgctcctgatttttttctatatctttgccgttactggagtgtatgtcttctctgaatatactcgatcgcctcgccaggatttggagtaccacgtttttttctctgatctgcccaatagtctggtaactgtttttatattgtttaccttagaccattggtatgctctcttgcaagatgtgtggaaggttcctgaggtcagtcggattttcagcagcatatattttattctctggctgctcctgggaagcatcatctttcgttctatcatcgtggccatgatggttactaattttcagaacatcagaaaagagctgaatgaggaaatggcaaggcgggaggtgcagttgaaagccgatatgttcaaacggcaaataatccaaaggcgcaaaaacatgagtcacgaagccctcacctctagccactccaagatagaagattcctcccgtggtgcatctcagcaacgggagtccttggatctctccgaggtgagcgaggtagaatcaaattacggcgccaccgaagaagatctcatcacctcagcctccaagactgaggagactctgagtaaaaagcgcgaataccagagtagttcctgtgtctcatccacttccagctcctatagttcaagtagtgaaagccgtttctctgagagcattgggcgtttggactgggaaacgctagtccacgagaatttgcctggtttaatggagatggaccaagacgacagggtatggccacgcgatagcctgtttaggtatttcgaattgttggagaagcttcagtacaacttggaagaacggaaaaaactgcaggagtttgccgtacaggccctcatgaatcttgaggacaagtag

SEQ ID NO: 40809 - DNA, 1587 bp, Artificial Sequence
  Description of Artificial Sequence: Synthetic coding sequence
atggccgcctaccagcaggaggagcagatgcagctgccccgggccgatgcaatccgctccagactgatcgatacattttccctgattgagcacctccagggcctttctcaggctgtcccgcggcatacaatccgcgagctactggacccctctcgccaaaagaagctggttctgggcgatcagcaccagcttgtgaggttttcaattaaaccacaacgaatcgaacagatttcacacgcccagcgtctgctcagcaggctccacgtgaggtgcagtcagaggcctcccctgagcctttgggccggttgggtgctggagtgcccattatttaaaaattttataattttcttggtattcttaaatacaatcatcttaatggttgagattgagctcctggaaagcacaaacacaaagctatggcccttaaaactcactctggaagtggcagcctggtttattcttctgatttttatcctcgagatcctgctcaagtggctgtctaacttcagcgtgttctggaaaagcgcttggaacgtctttgacttcgtggttacaatgctctccctgcttccagaagtggtggtgctggttggagtgaccggccaatccgtgtggcttcagctgcttcgcatctgccgcgttttgaggtctctcaaattactggcccagtttcgccaaatccagattataatcttggtcttagtgagagctctgaagtcgatgacgtttctactaatgttgctccttatttttttctacatattcgcggtcaccggtgtatacgttttttcagagtacacacgctccccccgacaggacctggagtatcatgttttcttcagtgatttgcctaacagcctcgtgaccgtgttcatcctgtttactctggatcactggtatgcactccttcaggacgtctggaaagtgcctgaggtttcacggattttctcaagcatttacttcatcctctggctcctactagggtctatcattttccggagtatcattgtggcgatgatggtgaccaacttccaaaacattaggaaggagctgaacgaggagatggcacgtcgggaagtccagctgaaggccgatatgtttaagcgtcagattattcagcgacgaaagaatatgagccacgaagctctcacttcctcacatagtaagatagaagacaggggcgctagtcaacagagagaaagcctcgacctttctgaggtgtccgaggtggaatctaactatggtgcgacagaggaagacctgataactagtgcttcaaagaccgaagaaaccctgtccaaaaagagagagtaccaaagcagttcctgcgtcagctctacaagctcctcttattctagtagcagcgagtctaggttttccgaatccatcggtagactggactgggaaacactggtgcatgagaatcttccgggcttaatggagatggatcaggacgacagagtgtggccaagagactccctgtttaggtattttgagttgctggaaaagctacagtataatctggaggaacgaaagaaactgcaggagttcgcagtacaggctttgatgaatttggaggataagtag

SEQ ID NO: 40810 - DNA, 1245 bp, Artificial Sequence
  Description of Artificial Sequence: Synthetic coding sequence
atggccgcctaccagcaggaggagcagatgcagctgccccgggccgatgctattcgctcacggctcattgacaccttcagcctcatcgagcacctccaggggctttctcaggcagtgccacgacacaccatcagggaactgcttgacccaagtaggcagaaaaaactcgtcctcggcgatcagcaccagctggtcaggttttccattaaacctcagcgtatagagcagatatctcacgctcaacggttactgagtcggctgcacgtgcgctgcagccagcgtccccccctgagcctgtgggcaggttgggtgctcgagtgccctttgttcaaaaatttcataatctttctcgttttcttaaacaccatcattctcatggtggagattgagttattagagtcaacgaacaccaaactgtggccacttaagttaaccctagaggttgccgcctggttcattcttttgatcttcattctcgaaattctactaaaatggctgagcaatttttctgtgttttggaagtccgcctggaatgtgtttgattttgtggtgaccatgctgtccttattaccagaggtagttgtcctcgtgggcgtgactgggcagtctgtatggcttcagcttcttcggatatgtcgggtcctgcgctcactgaagctcctggctcagttcagacagatacagattattattcttgtcctggtccgggcactgaagtcaatgacatttctactgatgctcctactcatcttcttttacatctttgctgtgacaggcgtctatgtgttcagcgaatacacccggagtcctaggcaggacctcgaataccatgtgttttttagtgatctacccaacagcctcgtgaccgtgttcatactcttcaccttggaccattggtatgcactccttcaggatgtgtggaaggtgcctgaagtgtcccggattttttcgtcaatttacttcatattatggctactgctgggcagtatcatcttccggtccatcatcgttgctatgatggtgaccaatttccagaacatccggaaggaactaaatgaggaaatggcccgacgcgaggtgcagcttaaggcagatatgtttaagagacagatcattcagcggagaaaaaacatgagtcacgaggctctgacttcttcccatagcaagatagaggataggtccttcggcctgggcgactcttgtgcccgcaagagcgcgcgcgccaacgggaacggaagcggttag

SEQ ID NO: 40811 - DNA, 1587 bp, Artificial Sequence
  Description of Artificial Sequence: Synthetic coding sequence
atggccgcctaccagcaggaggagcagatgcagctgccccgggccgatgctatccggtctcgactgatcgacacattttcattaattgaacatctgcagggcctcagtcaagccgtcccccggcatacaattcgcgagttgttggatccttctagacagaaaaaactggttcttggggaccagcaccagttagtccggttctcaatcaaaccccaacggatcgaacagattagccacgcccagaggctgttatcacggttacatgtgcggtgcagccagaggccgcccctgtcactgtgggcggggtgggtcctcgagtgtcccctttttaaaaatttcattattttcctggtcttcctcaacactatcatcctcatggtggagattgagctcttagagagtacgaacacaaagctttggcccctcaaactcactttggaggtcgcggcctggttcatcctgttgattttcattttggaaatcttattaaaatggttgtccaatttctccgttttctggaagtcagcttggaatgtattcgattttgtggtcacaatgctgtcgctgctccccgaagtcgtggtactggtaggggtaaccggtcagtctgtatggttacaactgctgagaatttgcagggtgctgaggtctttgaagctgctggctcagtttagacagattcagatcatcatcctggttctcgtacgagcgctaaaatccatgaccttcctgctgatgttgttgctgattttcttctacatatttgctgtaacgggagtgtatgtcttttcagaatacacccgaagccctcgtcaggacttggaataccacgtctttttctcggatctcccgaattctctggtgacagtattcattctgttcacactggaccattggtatgcactgctccaagatgtctggaaggtccccgaggtatccagaatattctctagtatttatttcatactctggttgctcttgggcagcattatctttcggagcataatcgtggcaatgatggtgaccaattttcagaacatcagaaaagaactgaacgaggaaatggctaggcgtgaggtgcagctcaaagcagacatgttcaaacggcaaatcattcagcggagaaagaacatgagtcacgaggccttaacgagctctcattccaagattgaggaccggggagcctcccagcagagagagtcactggatctgtcagaagtatccgaggtggaaagcaactacggcgccactgaggaagacctgatcacaagtgcctccaagactgaggagaccttatcaaagaagcgtgaatatcagagcagttcttgcgtgtctagcaccagctctagctactcctcttcatccgaatcacgattttcagagtcaatcggaaggctggattgggaaacattggtccacgaaaacttgccaggcttgatggaaatggaccaggatgaccgagtgtggccccgggacagtctgtttcggtacttcgagctcttggagaagttgcagtacaacctggaggagaggaaaaagttgcaagagttcgcagttcaggcgcttatgaacctcgaggataaatag

SEQ ID NO: 40812 - DNA, 195 bp, Artificial Sequence
  Description of Artificial Sequence: Synthetic coding sequence
atggccgcctaccagcaggaggagcagatgcagctgccccgggccgacgccattagatcccgactcatcgacactttcagcctgattgagcatttgcaaggcttgagtcaggctgttccccggcacacaatacgagaactcctcgatccttccagacaaaaaaagctggtcctcggggatcagcatcagctctag

SEQ ID NO: 40813 - DNA, 147 bp, Artificial Sequence
  Description of Artificial Sequence: Synthetic coding sequence
atggccgcctaccagcaggaggagcagatgcagctgccccgggccgatgccatccgctcccggttgattgacacctttagcctgattgagcatctgcaaggactatcccaggctgtgccacgccacactatccgcgaactattgtag

SEQ ID NO: 40814 - DNA, 243 bp, Artificial Sequence
  Description of Artificial Sequence: Synthetic coding sequence
atggccgcctaccagcaggaggagcagatgcagctgccccgggccgacgcaattcgctcaagacttattgatacttttagcctaatcgaacacttgcaaggcttgtctcaagctgtgccccggcacaccatacgcgaactgctggatccttcccggcagaagaagttggttctcggggatcagcatcagcttgtgaggttcagtatcaaaccccaacggatcgaacagataagccatgcctag

SEQ ID NO: 40815 - DNA, 1449 bp, Artificial Sequence
  Description of Artificial Sequence: Synthetic coding sequence
atggccgccgccgccgccggcgccggcagcggcccctgggccgcccaggaaaaacagttcccacctgccttgctgtcattttttatttacaaccccaggttcggtcctcgggagggtcaggaggaaaacaagattcttttctatcaccccaacgaagtggagaagaacgagaaaatccggaacgtcgggctttgcgaggccatcgtgcagttcacacggaccttttctccctctaagcctgctaagtctttgcacacccagaaaaatagacaattcttcaatgaaccagaggagaacttctggatggtaatggtcgttaggaaccctattatcgagaagcaatctaaggatggaaaaccggtaatcgaataccaagaagaggagctcctagataaagtttactccagcgttttaagacagtgctactccatgtataagctttttaatggaacttttcttaaggccatggaggacggcggtgtcaagctgcttaaagaacggctggagaagttctttcacaggtatctacaaacgctgcacctgcagtcctgcgatctgttggatatttttggaggaattagcttctttccactggataaaatgacttatctgaagattcagtcctttatcaatcgaatggaagaaagtctcaacatcgtcaagtatactgcatttctgtacaatgatcagctcatttggtcagggctagaacaggacgatatgagaatcctctacaagtacctgactacaagtctgttcccgcgacatatcgagccggagttggctgggagagactccccaattagggcagaaatgccaggtaatctgcaacattatgggcgtttcctgactggccctctgaacctcaacgatccggatgctaagtgtcggttccctaaaatctttgtaaatacggatgacacctacgaggagctacacctgatcgtctataaagcaatgagcgccgctgtgtgctttatgatagacgcttccgtccaccctaccctggacttctgtcggagactcgatagcattgttgggccacagcttaccgtacttgccagtgacatctgtgaacaattcaatattaataagagaatgtctgggagcgagaaggaacctcagtttaaattcatctactttaaccacatgaacctggctgagaagtctacagtacatatgaggaagacgcctagtgtgtccctcacctctgtccacccagatttgatgaaaatcttgggggacatcaactcggactttaccagagtcgatgaagacgaggaaattatcgtaaaggctatgagtgactactgggtcgtgggcaagaagagcgatagacgtgagctatatgtaatcctcaatcaaaaaaacgcaaacttaatcgaggttaatgaggaagttaagaaactgtgcgccactcagttcaacaacatcttttttctcgattag

SEQ ID NO: 40816 - DNA, 1020 bp, Artificial Sequence
  Description of Artificial Sequence: Synthetic coding sequence
atgtacaagctgttcaacggcaccttcctgaaggccatggaggacggaggcgtgaaactccttaaggagagattagagaagttctttcacaggtacctacagacactccacctccagtcttgcgacctcctggacatcttcgggggcatcagcttctttccgttggataaaatgacttacctgaagatccagtcattcatcaacagaatggaggagtcccttaacattgttaagtacacggcgttcttatacaatgaccagttgatctggtccggtcttgagcaagacgacatgaggatactatacaagtatctcacaacaagcctgttcccccggcacattgagcctgaattggctggacgtgattcccctatacgagcagaaatgccaggaaatcttcagcactacggcaggttcctgaccggccctttgaatctgaatgaccccgatgctaagtgcaggtttcccaagatctttgtgaatactgatgacacttatgaagaattgcatttaattgtatacaaggcaatgtcagcagcggtgtgctttatgatcgacgctagcgtgcatccgacactcgatttttgccgtaggctggactccattgttggaccacagctaaccgtcctggccagcgacatctgcgagcaattcaacattaataaacggatgagcgggtccgagaaggaaccccagttcaagtttatttactttaaccatatgaacctggccgaaaaatctacggtccacatgcgcaagacaccctcagtgtcactcaccagcgtgcaccccgacctgatgaaaatcctgggcgacatcaattcggactttactagagtggacgaagatgaggagattatcgtcaaggctatgagcgactattgggtggtgggaaagaagtcggataggagggagttgtacgttatactcaaccagaagaatgcaaatttaatagaggtgaatgaagaagtgaaaaaattgtgcgcaacacagttcaataatattttctttcttgactag

SEQ ID NO: 40817 - DNA, 1449 bp, Artificial Sequence
  Description of Artificial Sequence: Synthetic coding sequence
atggccgccgccgccgccggcgccggcagcggcccctgggccgcccaggagaaacagttcccacctgctctgttgtccttttttatctacaatcctagattcggtccacgtgagggacaggaggaaaataaaattttgttctaccaccccaacgaggtcgagaagaacgagaaaattaggaacgtcgggctgtgcgaagcaattgtacagtttactcgcacattcagtccaagtaaaccagcaaagagtctacatacccagaagaatcggcagtttttcaacgagcccgaggaaaacttttggatggtcatggtggtgcgaaaccctattatcgagaagcagagtaaggatggaaagccagtgatcgagtatcaggaagaagagttactggacaaggtctacagcagtgtgcttcggcaatgttactcgatgtacaaattattcaatggtacttttctcaaagccatggaggatggaggagtgaagcttctgaaggaacgcctggagaagtttttccaccgatacttgcagacccttcacctccagagttgcgatctcctggatatcttcgggggcattagctttttcccgttagataagatgacctacctgaaaatccaaagctttatcaatcggatggaggaaagcctgaatattgtgaagtacaccgccttcctgtataacgaccagttgatctggtcgggccttgaacaggatgacatgaggatcctgtacaaatatctgactactagcttgttcccccgtcacatagagccggaactggcaggccgggatagccctatcagggctgaaatgcctggcaatctgcagcactacggccggtttctcacaggtcccctgaaccttaatgaccctgacgcaaagtgtcggtttccaaagatcttcgtcaacacagacgatacatatgaagaattgcatctcatcgtgtataaagctatgtctgcagcagtgtgtttcatgatcgatgctagtgttcaccccaccctggatttctgcaggcgactcgactctattgtggggcctcagctcaccgtcttggctagcgatatatgtgagcagttcaatattaacaagaggatgtcgggcagtgagaaggagccgcagtttaagtttatttattttaaccacatgaatttagccgagaaatccaccgtgcatatgcgcaaaaccccatctgtgagtctgaccagcgtccatcccgacctcatgaagattctgggagacatcaactccgattttacccgagtggacgaagatgaagaaatcatagtgaaggccatgtctgattattgggtggtcgggaagaagtctgacagacgcgagctttatgtgatcttgaaccagaaaaacgctaaccttattgaagttaacgaggaagtcaaaaaactctgcgccactcagtttaacaacatcttctttctggattag

SEQ ID NO: 40818 - DNA, 1020 bp, Artificial Sequence
  Description of Artificial Sequence: Synthetic coding sequence
atgtacaagctgttcaacggcaccttcctgaaggccatggaggacggtggcgtgaaattactcaaggagagactggagaagttctttcacaggtacctgcagaccctgcacctccagtcctgtgacctgctggatatcttcggtggcattagcttctttcctctagataaaatgacatacctgaagatccagtctttcataaacagaatggaggaaagcctcaatatcgtcaaatacactgcctttttgtacaacgaccaactgatatggagtgggcttgagcaagacgacatgcgaatcctctataagtacctgaccacctcccttttcccccggcatatcgaacccgaactagctgggagagacagccctatccgagccgagatgcccggaaatctgcaacattacgggcggttcctgaccggaccgctgaatctgaacgatcccgacgccaagtgcagattcccaaagattttcgtgaataccgatgacacctacgaagagctccatttaattgtttataaggctatgtccgccgccgtgtgcttcatgatcgacgcaagtgtccacccaacactggatttttgtagaagactcgatagtattgtggggccccagctcacagtgttggcttccgatatctgcgagcagttcaacatcaacaagagaatgagcgggagcgaaaaggaacctcagttcaagtttatctactttaaccacatgaacctcgctgaaaaatcaactgtccacatgcgcaagactccctctgtatctctgactagcgtgcaccccgacctgatgaaaatcctgggcgatataaatagtgatttcactcgcgtggacgaggatgaagagatcattgtgaaagccatgtctgattactgggttgttggaaagaagagtgacaggagagagctgtatgtgatcctgaatcagaagaacgcaaatctgatagaggtaaacgaggaagtcaaaaaattgtgtgccacacagtttaacaatatcttcttccttgattag

SEQ ID NO: 40819 - DNA, 3066 bp, Artificial Sequence
  Description of Artificial Sequence: Synthetic coding sequence
atggccggcatcagctacgtggccagcttcttcctgctgctgaccaagctgagcattggccaacgtgaggtaaccgtccagaaaggcccactgttccgtgcagagggctaccccgtgagcatcggatgtaacgtgactggacatcagggcccttcagaacagcacttccagtggtccgtgtatctgccaacaaatccgacgcaggaggttcagataattagcaccaaggatgctgccttcagctatgctgtgtacactcagcgtgtgagaagcggggacgtctacgtagagagggtacagggtaactctgtgctgcttcacattagcaagctgcaaatgaaggatgcgggggagtatgaatgccacacacccaacacggatgagaagtactatggatcttacagcgccaaaaccaacctgattgtcatcccggacacactttccgcaactatgtcgtctcagaccctgggcaaagaggaaggagaaccactggccctcacatgtgaggcctcgaaagccaccgctcaacatacacacctgtccgtgacctggtacctaacccaggacggcgggggttcacaggccaccgagatcatttctctgtcgaaagattttattctggtgcccgggccgctctacaccgaaaggttcgctgcctcagatgtgcaactcaacaagctgggtccgaccactttccggttgagcatcgaacgtctacagagctcagatcaggggcagctgttttgtgaggccactgaatggattcaggatccagatgagacttggatgttcatcaccaagaaacagactgaccagacaacacttcgaatccagcctgccgtgaaggattttcaagtgaacattacagccgattctctatttgcggagggaaagcctctggaactggtgtgcttggtggtgtcatctggtcgcgaccctcagctacagggcatctggttctttaacgggacggaaatcgcccatattgacgctgggggcgtgttggggctgaaaaatgattacaaggagcgggccagccagggagagctgcaagtgagtaaattgggcccaaaagctttttctctgaaaatcttttcactgggaccagaagatgaaggtgcctacagatgcgtggttgccgaagtaatgaaaaccaggacagggagctggcaagtgctccagcgcaagcagtcaccagattcccatgtccacctgagaaaaccagccgctcggtcagtggtaatgtccactaaaaataagcagcaggttgtgtgggagggcgagacactcgcatttttgtgcaaggctggcggcgccgagtccccactaagtgtgtcttggtggcacataccgcgggatcaaactcagcccgaatttgtggccggaatgggtcaggatgggatcgttcagctcggggcttcttacggagtcccctcatatcatggcaatacgcgcctggaaaaaatggactgggccacattccagcttgaaattacatttaccgccatcacagatagtggaacctatgagtgtcgcgtctccgaaaagagtcggaatcaggccagagacctgtcttggacacagaagatttcggtcacagtcaagtctctagagagcagcttacaggtgtcactcatgtctagacagccccaggtgatgctcaccaacactttcgatttatcatgcgtcgtgagagcaggatatagtgatctaaaggtgcccttgaccgtcacatggcagtttcagcccgcttcttcccacatcttccatcagctcatcagaattacacataacggaaccatagagtggggcaatttcttgtctagattccagaagaagactaaggtgagtcagagcctattccggtcgcagctactcgtgcacgacgctaccgaggaggagaccggcgtttatcagtgtgaagtggaggtttacgaccgcaactccctttacaacaaccgtcccccaagagcctctgccattagtcatcctctaagaattgcagtgactttgcccgaatcaaaacttaaagtgaattctcggtctcaggtgcaggagctgtctatcaattcaaacaccgatatcgaatgcagcatcctgtcacgtagcaatggcaacctccagttggctatcatctggtactttagtcccgtcagcaccaacgcctcctggttgaagattctcgagatggatcaaacaaatgtgatcaagacaggggatgaattccataccccacagcgcaagcaaaaattccacactgaaaaggtatcccaagacctcttccaactgcacatactgaacgtggaagattcggataggggaaagtaccattgcgctgtagaagagtggctcttgtctaccaatggtacttggcataagctgggggagaagaaatcagggctcacagagctcaaactgaagccaaccggaagcaaggttagggtgtctaaggtgtactggacagagaatgtgaccgaacatcgcgaggtagctattaggtgttccctagagagcgtgggatcatccgcgaccctttattccgtcatgtggtattggaaccgagaaaactccggttctaaattgctggtacacttgcaacatgacggcctgctcgaatatggagaagaaggcttgcgtcggcacctccattgttatagaagcagttccacagactttgtacttaaactccatcaggtggagatggaggacgctggcatgtactggtgtcgggtggctgagtggcaactgcacggccacccttcgaagtggattaatcaggcctcagacgagtcacaacggatggtgttaaccgtgctgccaagtgagccaactctgcctagtagaatctgctcatccgcaccactcctctactttctttttatctgtcctttcgtgctgcttctcctcttactcatcagtctgctgtgcctttactggaaggcaaggaaactgagtacactgcggtcgaacacgagaaaggaaaaagccctttgggtggacctcaaggaggccggtggcgttacaactaaccgcagagaggatgaagaagaggacgaaggcaattag

SEQ ID NO: 40820 - DNA, 3066 bp, Artificial Sequence
  Description of Artificial Sequence: Synthetic coding sequence
atggccggcatcagctacgtggccagcttcttcctgctgctgaccaagctttccataggtcaacgggaggtaactgttcagaaagggccgctgttccgggccgaaggctatcccgtgagtattgggtgtaacgttacaggccatcaagggccatcagagcaacatttccagtggtcagtatacctaccgactaaccctacccaggaggtgcaaattatctctaccaaagatgcggctttttcctacgcagtgtatactcagcgggttagaagcggtgacgtctatgttgagcgcgtacaggggaatagtgtcctgctacatatttctaaactgcagatgaaggacgctggggagtacgagtgtcacacaccaaacacagacgagaagtattatggttcttattcagcaaaaactaacctgatcgttataccagacacactgtcagcaaccatgtcatcacaaacacttgggaaggaggaaggagaaccgcttgcactgacatgcgaggcttccaaagcaaccgctcagcatacacacttgtccgtcacctggtatctgacgcaggatggaggaggcagtcaggcaactgagattatttccctgtcaaaggattttattcttgtgcccggtccattgtacaccgagcgctttgccgcttcagacgtgcagttgaataaactgggcccgacaacgtttcgcctgtccatcgaaagactgcaaagttccgaccaaggacagttattctgcgaagcgactgaatggatccaggaccccgatgaaacttggatgtttatcactaaaaagcagacagaccagaccaccctcaggatccagccagcagtgaaggactttcaggtaaacattaccgctgatagcctcttcgccgaagggaaaccgctcgaattggtgtgccttgtggtatctagcgggagagatccccaactgcagggaatatggttttttaacggcactgagatagcacacatcgacgcagggggtgttttaggtttgaagaatgactataaggaacgggcaagccagggtgagctgcaggtgagcaaactgggccccaaggctttttccctgaaaatatttagtctgggccccgaggacgagggagcctaccgctgtgtcgttgcagaagttatgaagacccgcacagggagctggcaggttcttcagaggaaacagtcgcccgactctcacgtccaccttcggaagcccgccgccaggagtgttgttatgtccacaaaaaataaacaacaggtggtgtgggagggagagaccctcgcattcctctgtaaggcgggcggtgccgaatcccctttgtcggtgtcctggtggcatatcccacgtgaccagacccaacctgagttcgtcgctggcatggggcaggacggcatcgtgcagctgggagcaagctatggggtaccttcataccacggcaatacaaggctcgaaaaaatggactgggccaccttccaactcgagatcacctttaccgccattaccgatagtgggacctatgagtgcagggtgagcgagaagtcgcgcaaccaggcccgtgatttatcttggacccagaaaatctccgtgaccgtaaagtccctggaatcatcactccaggtctccctcatgtctcgacaaccccaggttatgttaacaaatacctttgacctcagctgcgtcgtcagggcaggctattccgatctcaaagtgcccctcaccgtaacctggcaattccagcccgccagttcccacatcttccaccagcttatacgtatcacgcacaatggaacaattgagtgggggaatttcctgagcaggttccagaagaagaccaaggtgtcgcagtcccttttccgctcgcagctcctcgtgcatgatgccacggaagaggagacaggagtgtatcagtgtgaggtagaagtgtatgaccgcaacagcctttacaacaacaggcccccgcgggcatctgctatttctcaccctttacggattgccgtgacattgcctgagtctaagttaaaggtcaattctcgatcacaagtccaggagctgtccatcaacagcaataccgatatagaatgctctatcctctcccggtcaaacggcaacttgcagctggccataatctggtacttctctcccgtctcaacgaatgccagctggctgaaaattctcgagatggaccagaccaacgttatcaagaccggtgatgaatttcatactccgcagcggaagcagaaatttcacactgagaaagtgagccaagacctctttcagctgcatattctcaacgtagaggacagtgaccggggcaaataccattgcgcagtcgaggaatggttattgagtacaaacggaacctggcacaagctgggcgaaaaaaagagcggtttgacagaattgaagctgaagccaacgggaagtaaagtgcgagtttctaaggtatactggacagagaatgtgaccgaacacagagaggtcgctatacgttgctctctggaatctgtcgggtcttctgctaccttgtatagtgttatgtggtattggaatcgcgaaaactctggaagcaagctgctggtccacctgcaacatgacggcctcctcgagtatggagaggagggactgaggagacatttgcactgctaccgaagtagtagcactgacttcgttcttaagctccatcaggtcgaaatggaggacgcagggatgtactggtgccgggtggctgagtggcagctccatggccacccctccaagtggatcaatcaagcctctgacgagagccaacgcatggtgctgacagtgctgccatctgagccaacgctgccgtctagaatctgctcctctgcccccttgctttatttcctattcatttgcccatttgtcctcctgctgctgttgctgatatccctgctgtgtctgtactggaaggccaggaagctgagtactctgaggtccaatacccgcaaagaaaaggcactgtgggtggacctgaaagaagccggcggagttactactaaccggcgggaggatgaagaggaagacgaggggaattag

SEQ ID NO: 40821 - DNA, 546 bp, Artificial Sequence
  Description of Artificial Sequence: Synthetic coding sequence
atgctgctggagcccggccggggctgctgcgccctggccatcctgctcgcaatcgtagacattcagtcaggtgggtgtataaacattacctcttctgcttcacaggagggcacacgcctgaatctgatctgcactgtatggcacaagaaggaagaggccgagggatttgtggtgttcctctgcaaagatcggtctggtgactgctcaccagagacctccctgaagcaactgcgtctgaaacgggatccggggatcgatggcgtgggagagatcagttctcaattgatgtttacaatctcccaagtcactccattgcactccggcacatatcagtgttgtgcccgctctcaaaagagcggaatcaggctgcaagggcacttcttcagcatactgttcactgagacaggcaattacacggtcaccggcctgaaacaaagacaacacctcgagtttagccataacgaggggacgctgagctcaggatttcttcaagagaaagtgtgggtgatgctcgtgacctccctagttgctcttcaagccctctag

SEQ ID NO: 40822 - DNA, 546 bp, Artificial Sequence
  Description of Artificial Sequence: Synthetic coding sequence
atgctgctggagcccggccggggctgctgcgccctggccatcctgcttgctatagtcgacattcagagcggcggatgtataaatataacatcaagcgcatctcaggaaggaaccagacttaatctgatctgtaccgtgtggcataaaaaggaggaggccgagggctttgttgtatttttgtgcaaggataggtccggagactgctctccagaaactagcctgaagcaattgaggcttaagcgggaccccgggattgacggcgtgggcgagatcagctcccagctgatgttcaccatttctcaagtgactccacttcactccggcacctaccagtgctgcgcccggtcccagaagagcggtattagattgcaaggccacttcttttccatccttttcacggaaacaggcaactacaccgtgaccggacttaagcagaggcagcaccttgagttctcccataacgagggaacactgtcaagcggattccttcaggagaaagtttgggtgatgttagtcacaagtctggtcgcactgcaggcgttgtag

SEQ ID NO: 40823 - DNA, 378 bp, Artificial Sequence
  Description of Artificial Sequence: Synthetic coding sequence
atgctgctggagcccggccggggctgctgcgccctggccatcctgctggctattgttgatatccagtccggagagaccggtaactatacagttactggcttaaagcagcggcaacatctggaattctctcataacgagggcaccctctcttccggatttctgcaagagaaggtgtgggtcatgctggtcactagcttggtagccctgcagggaatgtccaaaagggccgtgtctactcctagcaatgagggcgcaattatcttccttcctccatggctcttctcacggaggagaagattagaaaggatgagccgcggcagagagaagtgttattctagtcccgggtatccacaggaaagcagtaatcagtttcattag

SEQ ID NO: 40824 - DNA, 546 bp, Artificial Sequence
  Description of Artificial Sequence: Synthetic coding sequence
atgctgctggagcccggccggggctgctgcgccctggccatcctgcttgcaatcgtggacatccagtctggcgggtgtataaacataacttcatccgcaagccaggaaggcactagactcaatttgatttgtacagtgtggcataaaaaagaggaagcagaaggattcgttgtgtttctgtgcaaagatagatccggggattgttctccagagacctcccttaagcagttacggttgaaacgagaccctggaatcgacggcgtgggtgagatcagttctcagttaatgttcacaatctcccaggtgacaccacttcactccgggacctatcagtgttgtgcccgcagccagaagtccggaattcgcctgcagggtcattttttctcaattctgttcaccgagactggaaactacacagtgaccgggctcaagcaaaggcagcatctcgaattttcccataatgaaggcaccctgagctctggctttttgcaggagaaggtgtgggtaatgctggtaactagccttgtggcccttcaggccctgtag

SEQ ID NO: 40825 - DNA, 516 bp, Artificial Sequence
  Description of Artificial Sequence: Synthetic coding sequence
atggaggcccccggcccccgggccctgcggaccgccctgtgcggcgggtgttgttgcttgctgctgtgcgcccagttggccgttgctgggaagggtgcccgaggttttggccgaggagctctgatccgcctgaacatctggcctgccgtccagggagcctgtaagcagctggaagtttgcgagcactgtgttgagggcgatcgtgctagaaacctcagcagttgcatgtgggagcaatgcaggcccgaggagcctggccactgtgtcgcacaatccgaggtggtcaaggaagggtgtagcatctacaacagatctgaggcatgtcctggaaaaggagtgctggctcctaaacctagctgtatgggacttccttcacattctttgcctcctcgacgcaagcagcccctgtcaggtggcgggttttgctctccgatccctggacctggtatctccagtgccttcagttccctgcgttctcctctgctgtctttacctattagcagctctgaaaactag

SEQ ID NO: 40826 - DNA, 522 bp, Artificial Sequence
  Description of Artificial Sequence: Synthetic coding sequence
atggaggcccccggcccccgggccctgcggaccgccctgtgcggcgggtgctgttgtctgctcctttgcgcccagctggccgtggctggaaaaggcgctagaggattcggccgaggagccctaatacggctgaacatctggccagctgtgcagggtgcttgtaagcagctcgaggtgtgtgagcactgcgtggagggggacagagcccggaatctgtcatcatgcatgtgggaacagtgtaggcccgaagagcccgggcactgtgtcgctcagtccgaggtcgtgaaggaagggtgtagtatttataaccgctcagaggcttgtccagcggcgcatcatcatcctacctacgagcccaagacagtgacaactggatcaccgcccgtccccgaggcccatagtccaggattcgacggggcaagttttatcgggggagttgtgcttgtgttgagcctgcaggccgttgcctttttcgtactccacttcctcaaagcaaaagactctacataccagaccctttag

SEQ ID NO: 40827 - DNA, 525 bp, Artificial Sequence
  Description of Artificial Sequence: Synthetic coding sequence
atggaggcccccggcccccgggccctgcggaccgccctgtgcggcgggtgctgctgtttgctgttatgtgcgcagttggccgtcgccggaaagggagcaaggggattcggaaggggggcacttatcaggctgaacatctggccggctgttcagggggcctgtaaacagctggaggtgtgcgagcattgcgtggagggagatcgcgcccgtaacttgtccagctgcatgtgggaacagtgtcggcctgaggaacctggtcactgtgttgcccaaagcgaagttgtgaaagaaggatgcagcatatacaatagatccgaagcttgcccagctgctcaccaccatccaacctatgaacctaagaccgttaccaccggttcccctccggttcctgaggctcactcccctgggttcgacggagcctcattcattggaggagtggtattggtcctttccctgcaggcagtggcttttttcgtgcttcacttcctaaaggctaaagatagcacatatcaaaccctcatctag

SEQ ID NO: 40828 - DNA, 1986 bp, Artificial Sequence
  Description of Artificial Sequence: Synthetic coding sequence
atggccttcgacgtgagctgcttcttctgggtggtgctgttcagcgccggatgcaaggtgattactagctgggaccagatgtgcatcgagaaagaggcaaataagacatacaattgtgagaacttggggctgagcgagattccagacacactgcccaacacaaccgaattcctcgaattttcctttaacttccttccaactatacataataggacctttagtcgcctgatgaacctgacattcctggacttaacccggtgccagataaactggatccacgaagacacttttcagtctcaccaccaattgagcacattagttctgaccggaaatcctctgatatttatggccgaaacttctctgaacggccccaagagcctaaagcatctattcttgattcagaccggcatatcaaatctggagttcatcccggttcacaatcttgagaacctggaatctctgtatttgggttccaaccacatctcatctatcaaattccccaaagactttccggctcggaatttgaaggtcctggattttcaaaataatgctatccactatatctccagagaagacatgcgctctctcgagcaggctatcaatctaagcctaaatttcaatggcaacaatgttaaaggcatcgagctcggggccttcgactctactatattccagagcctaaatttcggcggcacgcccaacctctccgtcattttcaatggactgcaaaatagtacgacccaaagtctttggttgggaacttttgaggacatcgacgacgaagatatatccagcgccatgcttaaaggtctgtgcgagatgagcgttgaaagtcttaatctacaggagcataggttttcagatatctctagcactacctttcaatgcttcacccagctccaggaactggacctgactgccacacacctgaagggtctaccatcagggatgaagggtctgaatctgctcaagaaattagtgctttcagtaaatcactttgatcaactgtgtcaaatctccgcagctaattttcccagtctcacacacctgtacatacgcggcaacgtgaagaagttacacctgggcgtcggatgtttggaaaagcttggtaacctccagacacttgacctttctcataatgatattgaagcctccgactgctgctcattgcaactgaagaatctgagccatctacagaccctcaacctatctcacaatgaaccacttggcctgcagtctcaggcctttaaggaatgccctcagctggagctgctggatctggccttcacgagactgcatatcaatgccccacagtccccgtttcaaaatctccatttcctgcaggtactgaacctgacgtattgttttctggacacatcaaatcagcacctcctagccggactgccggtcttgagacatttaaacctcaagggtaatcattttcaagatggcacaatcaccaagaccaacctccttcagacagttgggtctctggaggtcctaatcctctcctcgtgcggcctcttgagtattgaccagcaggcatttcattccctgggcaagatgtcacacgtggatctgtcccataactctcttacctgcgattcaatcgattccctgagccaccttaagggaatttatctgaacctggccgccaactcaataaacattatttcacctaggttgctgccaatcctctcacagcagtctaccatcaatctgtctcataacccccttgactgtacctgctccaacattcacttcctgacatggtacaaggagaacctgcataaactggaaggatcggaggagaccacttgtgctaatcccccctcgctgcgtggcgtcaagctgagtgatgttaagctgagttgcggcattacggccatcgggattttcttcttaattgttttcctgctgcttttggcgatactgctgtttttcgctgtgaaatacctgcttagatggaagtaccagcacatttag

SEQ ID NO: 40829 - DNA, 816 bp, Artificial Sequence
  Description of Artificial Sequence: Synthetic coding sequence
atgagcgccccccggctgctgatcagcatcatcatcatggtgagcgctagctctagttcctgcatgggaggaaaacagatgacccaaaactatagcacgatatttgccgaggggaatatcagccagcccgttcttatggatatcaatgccgtcctttgctgtcccccaattgccctcagaaacttgatcattatcacctgggagattattctgagagggcaaccctcctgcacaaaggcctacaagaaagaaaccaatgagaccaaggagacaaactgcaccgtcgagcggattacgtgggtgagccgaccagatcaaaactctgacctgcagattaggcccgtcgacactacccatgacggctattataggggtattgtcgttactcctgatgggaactttcaccggggctaccatctgcaggtgctggtgacacctgaggtcaacctcttccaatctaggaatattactgcagtgtgtaaggccgtaaccggtaaacctgcagctcagattagttggatccccgaggggtcaattctagctacaaagcaggaatactgggggaatggcacagtgaccgtaaagtcaacatgcccatgggagggtcacaaatcgacggtgacctgccacgtttctcatctcacaggaaacaagtctctttccgtgaagctcaattctggtctgcggacttcaggctcccctgctctgtcacttttgatcattttgtacgtcaaattaagcctgttcgtggtgattctcgtgacaactggtttcgtgttcttccaaaggattaaccacgtgaggaaggtcctatag

SEQ ID NO: 40830 - DNA, 753 bp, Artificial Sequence
  Description of Artificial Sequence: Synthetic coding sequence
atgggcggcaagcagatgacccagaactacagcaccatcttcgccgaggggaacatcagtcaacccgtgcttatggacatcaacgccgtgctatgttgccctcctatagccctaagaaatctaatcatcatcacttgggagattattcttcgcgggcaaccatcctgcacaaaagcatataagaaagaaacaaacgagaccaaagaaaccaactgcacagtcgaacgaatcacatgggtctccagaccggaccagaactccgacctccagatccggccagtcgacacaacgcacgacggttattacagaggtattgtggtgacacccgatgggaatttccatagaggctaccacctccaggtgttagttacccccgaagtcaatctgttccagtccagaaatattaccgcggtgtgtaaggccgttaccggcaagcccgcagcacaaatctcctggatcccggagggctcaatcttggctaccaagcaagagtactggggcaacggcactgtcacagtaaagtccacttgtccttgggaaggccataaatctaccgtcacatgccacgttagtcacttaactgggaataaaagcctgagtgtaaagttaaattctggtctgcggaccagtggctcgcccgccctgtccctgctgattatcttgtatgtcaagctgtctctgtttgtggtaattctggtaaccacagggttcgtcttttttcagaggatcaaccatgtcagaaaagtcctatag

SEQ ID NO: 40831 - DNA, 753 bp, Artificial Sequence
  Description of Artificial Sequence: Synthetic coding sequence
atgggcggcaagcagatgacccagaactacagcaccatcttcgccgagggtaacatttcccaaccagttctgatggacatcaacgctgtgttatgctgccctcccatcgctttgcggaatcttattatcatcacctgggagatcatactcagggggcaaccaagctgtaccaaagcatataaaaaggagacgaacgaaacaaaagagactaactgcactgtggagcggattacgtgggttagccggcccgatcagaatagtgatctgcagatccggccagtggacaccacccacgacggctactatcgcgggattgtggtaactccggatggtaactttcacaggggctaccacctgcaagtgttagtgacccccgaggtgaatctattccagagccggaacattaccgcagtgtgcaaggctgtcacaggcaagccagccgcccagatcagctggattccagaagggtcaatcctcgccacaaagcaggagtattggggaaacggaacagtcaccgtgaaatctacctgcccctgggaggggcacaaatcgacagtcacatgccatgtgtcccacctgacaggcaacaagtcactgtcagttaagttgaactcaggcctcagaacctcaggaagccccgccctttctctgcttataatcctgtacgtgaaacttagcctgtttgttgttatcctcgtcaccaccggctttgttttctttcagcgtattaaccatgtgagaaaggttctctag

SEQ ID NO: 40832 - DNA, 531 bp, Artificial Sequence
  Description of Artificial Sequence: Synthetic coding sequence
atgcggatcttcgccgtgttcatcttcatgacctactggcacctgttaaacgctccctacaataagattaaccaaagaattctggtggttgacccggtgactagcgaacacgagctgacctgccaagctgaaggctatcccaaggcggaagtgatttggacaagcagtgaccaccaggtactctccggaaaaaccacgacaacaaatagcaagcgtgaggagaaactgtttaacgttacatctaccttgcgcatcaacaccacaactaatgagatattttactgcacatttcgcagactggacccagaagaaaatcacaccgcggaattagttatccccgagctgcctctggctcatccccccaacgagcgcacccatcttgtgatccttggtgccattcttctctgcctgggggtggccttaacttttatcttcaggttacgaaaaggacggatgatggacgtcaagaaatgcggtattcaagacacaaattccaagaaacagtccgacactcacttggaagagacctag

SEQ ID NO: 40833 - DNA, 873 bp, Artificial Sequence
  Description of Artificial Sequence: Synthetic coding sequence
atgcggatcttcgccgtgttcatcttcatgacctactggcacctgctgaacgccttcactgtgactgtgcccaaggacctctacgtggtggagtatggttctaatatgactattgagtgcaagttcccagtcgagaaacaactcgatctcgccgccctcattgtgtattgggagatggaagacaagaacattattcagtttgtacacggagaagaggatctcaaggtgcagcacagcagctacagacaacgagcgagactgctgaaagatcagttgtcccttgggaacgccgcgctccagatcacagatgtaaagctgcaggatgccggggtctaccggtgtatgatttcttacggcggtgctgactacaagcggattactgtcaaggttaacgctccatacaacaaaatcaaccaacgcatccttgtggtggatcccgtaactagcgagcacgaactgacctgtcaggctgagggatatccaaaagctgaggtaatctggaccagctcagaccatcaagtgttgtcaggaaagacaactacaactaacagtaaacgggaggagaaacttttcaatgtaacttcaaccctccggataaacactacaacaaacgagatcttctattgcacctttaggcgtctcgaccctgaggagaaccatacagctgagctggttatcccggaattgccactagcccatccaccaaatgaaaggacccacctggtgatcttaggtgctattctgttgtgtctcggcgtagctctgacattcattttcagactgagaaaaggaagaatgatggacgtgaagaaatgtggcattcaggacactaattctaagaagcagagcgacactcatttggaagaaacatag

SEQ ID NO: 40834 - DNA, 585 bp, Artificial Sequence
  Description of Artificial Sequence: Synthetic coding sequence
atgtggctgagccccagcctgctgctgctgatcctgcccggctactccatagctgcaaagattacaggtcctactacagtcaatggatctgaacaaggtagtctgaccgtccagtgtgcatatggatctggatgggagacctacctaaaatggagatgccagggcgccgattggaactactgcaatattttagtcaagactaacgggtcagagcaggaggtcaagaagaatcgggtttcgatacgcgacaatcaaaagaatcatgtttttaccgtcacaatggagaacttgaagcgggacgacgcagactcatactggtgtggaaccgagagaccggggatagacttgggcgttaaggtccaggtgactattaatcctggcactcagacagccgtgtctgagtggacaactactacagccagtttggcttttactgcggccgctacccagaagaccagtagcccactcaccagatcacccctaaagagcacccatttcctgtttctgtttttgctcgagttacccttgcttctgagtatgcttggcaccgtcttgtgggtcaacaggcctcagcggagatcttag

SEQ ID NO: 40835 - DNA, 702 bp, Artificial Sequence
  Description of Artificial Sequence: Synthetic coding sequence
atgcggctgctggtgctgctgtggggctgcctgctgctgcccggctacgaagccttggaaggacctgaagagatctccggcttcgaaggcgacacagtctccctgcagtgcacatacagggaggaattgcgggatcacagaaaatactggtgtcggaaaggcggaatcctgttttctcggtgctctggcaccatatacgccgaggaggaggggcaggaaaccatgaaaggacgcgtatccatacgagatagcaggcaggaactttccctgattgttaccctctggaacctgactcttcaagacgcaggggaatactggtgtggcgtggaaaagagaggaccagatgagagcctcctcatcagcctgttcgtgtttcccggtagtagccggccacctatgcaactcgactctactagcgcagaagacacctcacccgccctaagcagcggatcttccaagccacgcgtgtccatacctatggtcagaattctcgccccagtgcttgtgctgctctcattgttaagcgccgctggcctgatcgcattctgttcacatttactgctgtggagaaaggaagcacagcaggcaaccgaaacccagcggaatgaaaaattttgcctgagcaggcttaaccacagaaccagtgagctggaccccgatgaggcatttgaaatctctagcctgacttttctgtctgtgtag

SEQ ID NO: 40836 - DNA, 999 bp, Artificial Sequence
  Description of Artificial Sequence: Synthetic coding sequence
atgcggctgctggtgctgctgtggggctgcctgctgctgcccggctatgaggctctcgagggaccggaggagattagcggctttgagggcgatacggtgagccttcagtgcacttaccgcgaagagcttcgtgaccacagaaaatactggtgtcgaaagggcgggattctctttagcaggtgttcaggcactatctacgctgaggaagaagggcaggagaccatgaagggaagagtttcgatcagagattcacgccaggagctgtctctcatagtgactctctggaatctgaccctgcaagatgctggcgagtactggtgcggtgtagagaaacgcggaccagatgaatctcttctgatatccctgtttgtctttccaggcccttgttgtccgccaagcccatctcccactttccaacctctggccacaactagactgcagcccaaggccaaagcccagcaaacccagcctccgggtttaacatctcccggtctctatcctgccgcaactaccgcaaagcagggaaagacaggagcagaggccccacccctgccggggaccagccagtacgggcacgagagaacttcacaatataccggaaccagtcctcacccagcaacctcaccccctgccggctcttcaaggcctcccatgcagctagattccacatccgccgaagacacttctcctgccctgtctagtggaagctccaagccacgggtgtccatcccgatggtacgtatcttggcacctgtgctggtgctgctctccctcctctcagccgcaggtctaattgcattctgctcacatctgctgctgtggcgcaaagaggcgcagcaggcgactgaaacccagaggaatgagaaattctgtctttctcgcctaactgcggaagagaaggaagccccctctcaggccccagaaggggatgtgatcagcatgccccctcttcacacatctgaggaggagctgggctttagcaaattcgtgtctgcttag

SEQ ID NO: 40837 - DNA, 822 bp, Artificial Sequence
  Description of Artificial Sequence: Synthetic coding sequence
atgcggctgctggtgctgctgtggggctgcctgctgctgcccggctatgaagctctggagggcccagaggaaatttcggggtttgagggagacacagtgagcctccaatgcacttatagagaggaactccgggatcatcgaaagtattggtgccgcaaaggtggtattctcttttcaagatgctctggcaccatttacgccgaagaggaaggccaggaaaccatgaaggggcgagtctccattcgtgactcgcggcaggaactctccctgatcgtgacattatggaaccttacccttcaggacgccggcgagtattggtgtggcgtcgagaagcggggacccgatgagtccctcttgatttccctcttcgtgttcccggcctcccccggcctgtatcccgctgcaacaacagcaaaacagggaaagaccggggctgaggcgcctccactcccgggaacatctcaatatggtcacgaaagaacttcccagtacactgggaccagtccgcaccctgctacctctcccccagccggatcttccagacccccgatgcagctcgactccaccagtgcagaggataccagtcctgccctttcttccggatcaagtaaacccagagtctccattcccatggttagaattcttgccccagtgttggtcttgctcagcttactgtctgccgccggtctgattgccttctgcagtcatctattattgtggcgcaaagaggctcaacaagcaaccgagacacagcgaaacgaaaaattctgtctgagtcggctgaactccttaatgttctcactgtctctgccttggctgtag

SEQ ID NO: 40838 - DNA, 924 bp, Artificial Sequence
  Description of Artificial Sequence: Synthetic coding sequence
atgcggctgctggtgctgctgtggggctgcctgctgctgcccggctatgaggctttggagggacctgaggagatttccggctttgagggtgacacagtctcattacagtgtacctatcgggaggagttgcgcgaccatcggaaatattggtgcaggaaaggcggaattttattttctagatgttcaggtaccatttacgccgaagaggagggccaggaaacgatgaaggggcgcgtgagtatccgagactcccgtcaggagctgtcgttgattgtgaccctttggaacttgaccttacaggacgccggcgagtactggtgtggagtagaaaagaggggaccagacgaatcgctcctgatatctctgtttgtgtttcccggaccatgttgccctccaagtccatctccaacctttcagcccctggccacgacccgcctgcagcccaaggcaaaggcccagcagactcagccaccaggactgacgtcacctggcctgtaccccgccgcgaccactgcaaagcagggcaagacaggggccgaggctccacctctacccgggacttcccagtatggacacgaacgaaccagccagtacaccggcacatctccacacccagccacaagtcctccagcgggctcttcaaggccaccgatgcagctggactcaacgtcagccgaagacacctcacctgccctgagctccggtagttcaaaaccgagggtgagtatacccatggttcgaatccttgcccctgtgcttgtccttctttctctgctctcagcggccggcctgattgcgttctgcagccatctcctcctgtggcgaaaagaggctcaacaggccacagagacacagagaaacgaaaagttttgcctttcgagactcaatagccttatgttcagtctttccctgccctggctatag

SEQ ID NO: 40839 - DNA, 561 bp, Artificial Sequence
  Description of Artificial Sequence: Synthetic coding sequence
atgtggctgccctgggccctgctgctgctgtgggtgcccgccagcacgtctatgacacccgcctccattacagcagcaaagacctctactattacaaccgcttttcctcctgttagctcaacgactctctttgccgtcggggcgactcattccgcctctatacaggaagaaacagaggaagttgtaaactctcaactgcctctacttctctcactgctggcccttctactgctgctgctggtgggggccagcctgctggcttggcgaatgtttcagaagtggattaaagcgggagaccattccgagctgagccagaatccaaagcaggcggctacccagtctgagctgcactatgctaacttagagctcttgatgtggcctctgcaagagaagccagcgcctccaagggaggtagaggtggagtactcaacagtggcatccccacgggaggaacttcactatgcttcagtggtattcgacagcaatacaaaccgaatcgccgcccagcgcccccgggaggaggagcctgactcagactactcagtgattagaaagacttag

SEQ ID NO: 40840 - DNA, 900 bp, Artificial Sequence
  Description of Artificial Sequence: Synthetic coding sequence
atgtggctgccctgggccctgctgctgctgtgggtgcccggctgcttcgccctctccaaatgcaggactgttgccggcccggtgggggggagcctctcagtgcaatgcccctatgaaaaagagcacagaaccttaaacaaatactggtgtaggccaccacagattttcctctgcgacaaaatagtggagacgaaaggaagtgcaggtaaacgtaacggaagagtgagcatcagggattcgccggccaatctgtcatttacagtgaccctggagaacctcacggaggaggatgcaggcacttactggtgcggggtggacactccttggctgcgggacttccacgaccccgtggtagaggttgaggtaagcgtcttcccagctagtacctccatgaccccagcttccatcaccgccgcgaaaacctcaacgattaccacagcgttcccgccagttagcagcaccacactcttcgcagttggagccacacactctgccagcatccaagaagagacagaggaggtagttaactcccagctccccctcttgctgagtcttctggctcttctcctgctcctgctggtgggggcctccttattggcctggaggatgttccaaaaatggatcaaagccggggatcattcagagcttagccagaatccaaaacaggctgctacccagagcgaactgcattacgccaacctcgaactacttatgtggcccctccaggagaaaccagcgcctccccgggaagtagaagtggaatactctaccgttgccagcccacgggaagaactccactacgcctctgtagtcttcgatagtaatactaatcggatcgccgcgcagcggcctcgtgaggaagagccagacagcgattattctgtcatcaggaagacatag

SEQ ID NO: 40841 - DNA, 312 bp, Artificial Sequence
  Description of Artificial Sequence: Synthetic coding sequence
atgtggctgccctgggccctgctgctgctgtgggtgcccgccggcgatcatagtgaactgagtcagaacccaaagcaggcagcaacacagtccgagctgcactacgctaaccttgagctgttgatgtggcctcttcaagaaaagcccgcccctcctagggaggtggaagtggagtactctactgtggcttctccacgggaagagttacactacgcctcagtggttttcgactctaataccaaccgtatcgcagcccagagacccagggaagaagagcccgactcagactatagtgtaatcaggaaaacctag

SEQ ID NO: 40842 - DNA, 453 bp, Artificial Sequence
  Description of Artificial Sequence: Synthetic coding sequence
atgtggctgccctgggccctgctgctgctgtgggtgcccgccagcacttctatgacaccagcctctatcaccgccgcaaagactagcacgattaccaccgcattcccgccagtgagttccacgacattgttcgccgttggagcgacccatagtgctagcatccaagaagagaccgaggaggtggtgaatagccagcttccgcttctccttagtctgctggcccttctgctcttgcttttggtgggcgcctctctgctggcttggcgaatgttccagaaatggatcaaggccggtgatcacagcgagctgtcccagaacccaaaacaggcctctcccagggaagagctccactacgcaagtgtcgtgtttgattctaatacaaatcggattgcagcccagagaccgagggaggaggaacctgattctgattacagcgtcatcagaaagacttag

SEQ ID NO: 40843 - DNA, 675 bp, Artificial Sequence
  Description of Artificial Sequence: Synthetic coding sequence
atgaccgcccgggcctgggccagctggcggagcagcgccctgctgttactcctcgtgcctggatactttcctctcagccacccgatgactgtggccggcccagtggggggatccctttcagtgcagtgcaggtatgaaaaagagcatcgcacattaaataagttttggtgtcgtccacctcagattctcagatgcgacaaaatcgtggagacaaagggatctgcagggaagcggaacgggcgggtttcaattcgggactcgcccgccaatctgagcttcaccgtgactctggagaatcttaccgaagaggacgccggaacttactggtgcggggtcgataccccttggttaagagacttccacgacccgatcgtcgaggttgaagttagcgttttccctgccggaacaacaacagcctcatcgccacaatcctcaatggggacttccggtccgcccacaaagctgcctgttcacacatggccctcggtgacccggaaggacagcccagagccatcccctcatcctgggtccttgttctccaacgtccgttttctcctattggtacttttggaactgccccttttgctctcaatgctgggtgccgtactgtgggttaataggccacagcgatcctcccggtcgaggcagaattggccaaagggggagaaccagtag

SEQ ID NO: 40844 - DNA, 618 bp, Artificial Sequence
  Description of Artificial Sequence: Synthetic coding sequence
atgtggctgctgcccgccctgctgctgctgtgcctgagcggctgcctatccctgaagggtcctgggtccgtgactggaacggctggagattccctcacggtgtggtgccagtatgagtctatgtacaaaggttataacaagtattggtgccgcggacagtacgacacctcatgcgaatccatcgtggagacaaagggagaggagaaggtagaaagaaatgggcgcgtaagcatcagagaccacccagaggcactggcattcactgttactatgcagaacctaaacgaggatgatgctggatcctactggtgcaaaatccagacagtgtgggtgttggattcttggtcgcgagatccaagcgacctggttcgggtttacgtctctccggctattacaactccccggaggacaactcatcccgcgactcctcccattttcctggtggtgaaccccggaagaaacctgtcgacgggagaagtgctgacacagaattcggggtttcgactgagttcccctcatttcctgctggtagtgctgctgaaactgcccctacttctttccatgctgggagccgtgttctgggtgaatcgtccacaatgggcaccaccagggcgctag

SEQ ID NO: 40845 - DNA, 699 bp, Artificial Sequence
  Description of Artificial Sequence: Synthetic coding sequence
atgacccaggcccccctgcacatcctgggcttccagctgggcccccgctttgcagaggacggcagccagggtgacagaaatatgtggttgttacccgctcttctgctcctgtgcctctcaggttgcttgtccctgaagggtcccggctctgtgacaggtaccgctggggatagtctgacagtgtggtgccagtatgagtccatgtacaaagggtacaacaagtattggtgcagaggacagtatgatacatcttgtgaaagtatagttgaaaccaagggcgaggagaaggtggagcgcaacggaagagtgagtattcgcgaccacccagaggctcttgcttttaccgttaccatgcagaatcttaatgaggatgatgccggctcctactggtgcaaaattcagaccgtttgggttcttgacagctggtctagggacccttcagacctagtccgagtctatgtgtcccccgccatcacgacccctaggcgtactacacatcctgctacccctccaattttccttgttgtaaatccaggcaggaacctgtccactggcgaggttttgactcagaactcggggttccgcctcagttcaccccattttctccttgtagttcttttgaagctgcctctgttgcttagcatgctcggtgccgtgttctgggtgaaccgtccacagtgggccccccctgggcggtag

SEQ ID NO: 40846 - DNA, 369 bp, Artificial Sequence
  Description of Artificial Sequence: Synthetic coding sequence
atgtgccacctgcaggaggaggccggcggccggtggaagggcggcggatgcttgtccctgaaagggcccggaagcgttactgggaccgccggagattcacttactgtgtggtgtcagtacgagagtatgtataagggatataataagtactggtgtagggggcagtacgatacttcttgcgaatccatagtggagaccaagggggaggagaaggtcgagagaaatggaagagtgtctatccgcgaccaccccgaagccctggcattcacagtgactatgcaaaaccttaacgaggatgatgctggctcttattggtgtaagatacagactgtctgggtgctagattcctggtccagggatccctcctag

SEQ ID NO: 40847 - DNA, 741 bp, Artificial Sequence
  Description of Artificial Sequence: Synthetic coding sequence
atgagcgagaacaccaaggagacctggaccagccggaagtggatgactcaagccccactgcatatcttgggatttcaacttgggccgcgctttgcagaagacggctcccagggagatcggaatatgtggctattaccggctcttctgctcctctgcctgtccgggtgcctgtcacttaagggccctggttcagtgacaggcaccgcaggagactctttgacggtttggtgccaatacgaatccatgtataaaggatacaataaatattggtgtagagggcagtacgacacttcctgtgaatctattgtggaaacaaaaggggaagaaaaggtggagcgaaatgggcgcgtttcaattcgtgatcaccccgaggcccttgcttttaccgtaactatgcagaacctgaacgaggatgatgccggttcttattggtgtaagattcagactgtctgggtcctcgactcgtggagcagggatccctccgatctcgtgagggtatatgtcagtccagcaatcacaacaccgagaaggacaactcaccccgctactccccctatttttctcgtggtcaacccagggagaaacctgtccacaggcgaggtgctgacccagaattctggcttccgactctcttcacctcacttcctgctggtagtgttacttaagctgcctttactgctatctatgctgggggcagtgttctgggtcaacaggcctcaatgggctccaccaggtcgttag

SEQ ID NO: 40848 - DNA, 300 bp, Artificial Sequence
  Description of Artificial Sequence: Synthetic coding sequence
atgggctgcgaccggaactgcggcctgatcgccggcgccgtgatcggtgccgtcctggctgtgttcgggggcattctgatgcccgtgggtgatttgttgatccagaaaactatcaaaaaacaggtagtcctcgaggaagggaccattgcttttaagaattgggtgaagacaggcactgaggtgtatcgacagttctggatatttgacgtgcagaatccccaagaggttatgatgaatagttcctgcatcccctacttgtctaagtccatatgtagcaatgaccctcagtttacctattag

SEQ ID NO: 40849 - DNA, 186 bp, Artificial Sequence
  Description of Artificial Sequence: Synthetic coding sequence
atgaagcggttcctgttcctgctgctgaccatcagcctgctggtgatggtgcagattcagacaggcctgagtggacaaaatgacacatcacaaaccagctctcccagtgcgagtagcaacatttcagggggcatctttcttttcttcgtcgcaaacgcgattatacatttgttttgtttcagttag

SEQ ID NO: 40850 - DNA, 1038 bp, Artificial Sequence
  Description of Artificial Sequence: Synthetic coding sequence
atggcccagcaccacctgtggatcctgctgctgtgcctgcagacctggccagaggcggctggtaaggatagtgaaatcttcaccgtgaacggaatcctgggggaatcagtgacctttcccgtgaacatacaggaacccaggcaggtgaagattattgcctggacaagcaaaacttcggtggcctatgttactcctggggactctgaaacagctccggtggtcactgtcacacaccggaattactacgagagaatacacgccctcggaccaaactataatttagtcatttctgacctccgcatggaggacgcgggggactacaaagcagatatcaacacccaggccgacccttacaccaccacgaaaaggtataacttgcagatttaccgaagactggggaagcctaagattacccagagcctgatggcctccgtgaactccacttgtaacgtcaccctcacttgctcagtagaaaaagaggagaagaatgtgacgtacaactggagcccgctgggcgaggaaggcaacgtgctgcagatctttcagacccctgaggatcaggagctgacttatacctgcaccgcccagaatccagtcagcaacaacagtgactcaatttccgctcgacagctgtgcgcagacatcgctatgggtttccgaacacatcatacagggctgctaagcgtgctggccatgttctttctccttgtcctgattctgtccagcgtcttcctctttcgcttattcaaacgtcgtcagggccgcatattccccgagggttcctgtctgaatacgtttactaagaacccttatgctgcctccaagaagaccatttacacctatatcatggcctcgcgcaacacccagccagctgagtctagaatttatgacgagatcttacaatccaaggtgctgcccagcaaagaagagccagtaaacacagtgtacagtgaagtccagttcgccgacaaaatgggtaaagcatcaacacaggactctaagcctccaggcacatccagctatgaaattgtgatctag

SEQ ID NO: 40851 - DNA, 843 bp, Artificial Sequence
  Description of Artificial Sequence: Synthetic coding sequence
atggcccagcaccacctgtggatcctgctgctgtgcctgcagacctggcctgaggctgcaggcaaggattctgaaatcttcaccgtgaatggcatcctcggggaaagtgtgacgttcccggtgaatattcaggaaccacggcaggttaagattatagcctggacaagcaaaaccagtgtcgcctacgtgaccccaggtgattcagagacagcaccagtggtgactgtgactcacagaaattactatgagcgaatacacgcactgggacccaattataatctcgtgatttccgatcttcgcatggaggatgccggtgactataaggcagatatcaatacgcaggccgacccatatacaaccacgaagaggtataacctgcagatctataggcggctcgggaaaccaaaaatcactcagtccctgatggcttcagttaacagcacatgcaatgtaacccttacctgcagcgttgagaaggaagaaaagaacgtcacatataattggagtccgctaggggaggagggcaatgtcctgcagatttttcagaccccagaagaccaggagctgacgtatacgtgcacagcacaaaaccctgtctccaacaattcggactccatttccgcacggcagctgtgtgcagacatcgcaatggggtttcggactcaccacactggtctcctctctgtcctagcgatgttcttcttactggtactgatcctgtcgtctgtgtttttatttcgcttgttcaagagacgacagggtcggatattccctgaaggcaaaatgtggaagctgacgttctcacctcctggcacggaagccatttaccctcgctttagctag

SEQ ID NO: 40852 - DNA, 726 bp, Artificial Sequence
  Description of Artificial Sequence: Synthetic coding sequence
atggcccagcaccacctgtggatcctgctgctgtgcctgcagacctggcccgaagcagcgggaaaagatagcgagatatttacggttaacggaattcttggagagtccgtgactttcccagtgaacattcaggagcctagacaggtcaagattatagcctggacctcaaagactagcgtcgcctatgtgacgcctggcgacagcgagaccgctccagtcgtgacagtgacacataggaattactacgaacggatccacgcacttggccctaactacaacttagtgatttccgatttacggatggaagatgctggagattacaaggcagatattaacacccaggcagacccatacaccacaactaaaagatataatctccaaatatacaggcggctgggaaagccaaagatcacacagtccttgatggcttcagtaaactcaacttgtaacgtaactttgacttgttccgtggagaaagaagagaaaaatgtgacgtacaactggagtccactaggagaagaaggcaatgttctacagatctttcagacgcctgaggaccaagaactgacttacacttgtaccgcacagaatcccgtcagtaacaactccgactctatcagcgctaggcagctgtgtgcgggaaatcagctctgccctagcctgctagtctcactcagagaccactccgaggaactccaggggctcaacgttgggcacatcctgtag

SEQ ID NO: 40853 - DNA, 1020 bp, Artificial Sequence
  Description of Artificial Sequence: Synthetic coding sequence
atggcccagcaccacctgtggatcctgctgctgtgcctgcagacctggccggaagcagccggcaaggattctgaaatttttaccgttaatggtattctaggcgagtcagtgacattccccgtcaatatccaagagccgagacaggtcaaaatcatcgcctggacatctaaaactagcgtagcttacgtgacacccggcgacagcgaaactgctcccgttgtgacagttacacatcgaaactactacgagcgtatacacgctcttggccccaattataacttggtcattagcgaccttcgaatggaagacgccggggattataaagcagacatcaacacccaggctgacccctacaccacaactaaacgatacaatctgcagatatatagacgccttgggaagccgaaaatcacacagtcgctgatggctagtgttaactctacatgcaacgtcaccctgacctgctccgtagaaaaagaggaaaagaacgtcacctataactggtccccattaggagaagaggggaatgttctgcagatcttccaaacaccggaggaccaggagctgacttatacctgcacagcacaaaatcccgtctctaataacagtgacagtatttccgcccgacagctgtgcgccgatattgcaatgggtttcaggacccaccacactggcctcctcagtgtgctggccatgttcttcctcctcgtgcttattttgtcctccgtgtttttattcagattgtttaaacggagacaagggtcgtgcttgaatactttcactaagaatccatacgcagcttcaaagaagaccatttacacatacatcatggcatctcgaaacacgcagcccgccgagtcaagaatatacgacgaaattctgcaaagtaaagtgttaccttccaaggaagaacctgtcaacaccgtgtattcagaggtgcaattcgccgataaaatgggcaaggctagtacccaggatagcaaaccacccggcacatcatcttacgaaattgtcatctag

SEQ ID NO: 40854 - DNA, 819 bp, Artificial Sequence
  Description of Artificial Sequence: Synthetic coding sequence
atggcccagcaccacctgtggatcctgctgctgtgcctgcagacctggccagaagctgccgggaaagatagcgagatattcacggtcaatggaattttgggagagagcgtcacctttcctgtgaacattcaagaaccccgccaggtgaaaatcatagcttggacgagtaagacctccgtggcttatgtcactcccggggattcagagaccgcccctgtggttactgtcactcatcggaattattacgaaaggatccatgccctaggtcctaattacaacctcgtgatctccgatctgcgtatggaggatgccggagactataaagctgatatcaacacacaggcggacccatacaccacgaccaaacgttataatctccaaatctacaggaggctgggcaagcctaagatcacgcagtcactgatggcaagtgtgaacagcacttgcaacgtcaccttgacttgctcagttgagaaagaggaaaaaaacgtgacatacaattggtccccactcggagaagagggcaatgttcttcagattttccaaactccggaagatcaagaactcacttatacctgcaccgcccagaatcccgtgagtaataatagtgactccatctcagctagacagctttgcgccgatatcgcaatggggtttcggactcaccataccggcctgctttctgtgcttgcaatgttctttttactagtactaatcctttcttccgtctttctattccggctcttcaagaggcgacaaggggcgagtcttcagggtcgggcttccgaacattccttgttcaggtctgcagtatgttag

SEQ ID NO: 40855 - DNA, 987 bp, Artificial Sequence
  Description of Artificial Sequence: Synthetic coding sequence
atggcccagcaccacctgtggatcctgctgctgtgcctgcagacctggcctgaggctgcgggtaaggactccgaaatattcacagtgaatggaatacttggggaatccgtcaccttccccgtgaatatccaagagccacgacaggtcaaaataattgcttggacgtccaaaactagcgttgcctacgtgactcccggcgattccgaaaccgcaccagtcgttactgtaactcatcggaactactacgagaggatccacgccttgggcccaaactataacctggtgatctctgacctccgaatggaggatgcgggtgattacaaagctgatataaatacgcaggctgatccttacacaactaccaagagatataatctgcaaatataccggagattaggcaaacccaagataacacagagcctcatggcgagcgtgaattccacatgtaatgtgacactgacttgctctgttgagaaagaggaaaaaaacgttacttataattggtcccccttgggcgaagaggggaacgtcctgcaaatcttccagacacctgaggaccaggaactgacatacacttgcacagctcaaaatcccgtgtctaataacagcgacagcatatctgcacggcagttgtgcgccgacattgccatgggcttccggacccaccacaccggattgctctccgtgctagcaatgtttttcctgctcgtgctgatcctgtcatcagtctttctatttcggttgtttaaacgacggcaagacgccgcctccaaaaaaaccatctacacttatatcatggcctctcgcaatacgcagcctgcagagtcacgcatttatgacgagattcttcagtccaaggtccttcccagcaaagaagagcccgttaataccgtgtacagcgaagtgcagtttgctgataaaatgggtaaggcttccacacaggatagcaaaccccctggcacatcgagttacgaaattgtcatatag

SEQ ID NO: 40856 - DNA, 645 bp, Artificial Sequence
  Description of Artificial Sequence: Synthetic coding sequence
atggcccagcaccacctgtggatcctgctgctgtgcctgcagacctgcagactgggcaagccaaagatcacacagtcactgatggccagtgtaaactctacctgtaacgtgacgttaacctgttctgtggagaaagaagagaagaatgtaacctataattggtccccactaggggaggagggcaacgtgctacagatttttcagacaccagaagaccaggagctaacatatacatgcacggctcagaaccctgtcagtaataactccgattccatttccgcccggcagctctgcgctgacatcgctatgggctttcgcactcatcatacaggtcttctttctgtgctcgctatgttttttctcctggtgctgatcttgtccagtgtattcctatttcgactctttaagcggcggcaggatgctgcaagcaagaagaccatctacacgtacatcatggcgtcacggaatacccaaccagccgaatcgagaatctatgacgaaattctccagagtaaagtgctgccgtccaaggaggagccagtcaatactgtgtactctgaagtacagtttgcagataagatgggaaaggcctcaacccaggattccaaaccacctggcacgtctagttatgaaattgtgatttag

SEQ ID NO: 40857 - DNA, 1959 bp, Artificial Sequence
  Description of Artificial Sequence: Synthetic coding sequence
atggccaccagcatgggcctgctgctgctgctgctgctgctgctgacacaacccggcgcaggaactggagctgatacagaagccgttgtgtgcgtgggaaccgcatgttacaccgcccattctggaaagctctccgcagccgaggctcagaatcactgcaaccagaacggaggcaacctggcaacagtgaagtccaaagaggaggctcagcacgtgcagcgggtgctagctcagctcctgaggagggaggccgccctaacagctcgcatgagtaagttctggattggtctgcagcgcgaaaaaggcaagtgtctggatccgagcctgcccctgaagggcttctcttgggtgggtggcggcgaggacactccctactccaattggcacaaggaactccggaatagctgcatatcaaagcgctgtgtgtccttgcttctggacctctcccaacctctgctgccctcccgactgcctaaatggtctgaggggccttgtggttccccagggtctcctgggtccaacatcgagggattcgtttgtaagttttctttcaagggcatgtgtcgccccttagccctcgggggacctggccaggtgacatacactacccctttccaaaccactagctcttcccttgaggccgtccctttcgccagtgccgctaacgtggcttgcggggagggtgacaaggatgaaacccaatcccactatttcttgtgcaaggaaaaagcccccgacgtgtttgactggggtagctccggaccgctgtgcgttagtcctaaatacggctgtaatttcaataacggtggatgccaccaggactgcttcgagggcggagacggcagtttcttatgcgggtgtaggccggggtttagattgctggacgacctggtgacctgcgcctccaggaacccctgcagctcatcgccttgccggggaggcgcaacatgcgtccttggaccccatgggaagaattatacatgcaggtgtccccaggggtaccagctagatagctctcagcttgattgtgtggacgttgacgagtgccaggattcaccctgcgcacaagaatgtgtgaacactccaggcgggtttcgatgtgagtgttgggttggctatgagccaggaggccctggggagggagcatgccaggatgtagacgagtgcgccctcgggcggagtccttgcgcacagggctgtaccaataccgacggcagcttccattgtagctgcgaggagggttacgtgctggctggcgaagatggcacacaatgtcaagatgtcgatgaatgcgttggccccgggggaccattgtgcgactctctgtgcttcaacacccaaggctccttccattgtgggtgtctgccaggctgggttctggcgccaaatggagtgagttgcactatgggcccagtgtcccttggccctccaagtggtcctcctgatgaagaagataaaggggaaaaggagggatcaaccgtacctcgggcggccaccgcttcccctacccgcggcccagaggggaccccaaaggctacacccaccacctccaggcctagtctatctagcgacgccccaatcacttctgctcccctgaaaatgctagcaccaagcggatcacctggtgtgtggcgggaaccatccatacatcacgccactgcggcttccgggcctcaagagccagccggtggcgatagctctgtggctacccaaaacaatgatggtacggacgggcagaagctcctactgttctatatcttaggcaccgtcgtggccatcctgttgctgttagcattagccctcggcctgttagtatatagaaagcgcagggccaaacgtgaggagaaaaaggaaaagaagccccagaacgcggccgatagttattcctgggtacctgagagggccgagagtcgagcaatggagaaccagtattctccaaccccaggcacagattgttag

SEQ ID NO: 40858 - DNA, 1044 bp, Artificial Sequence
  Description of Artificial Sequence: Synthetic coding sequence
atggccaccagcatgggcctgctgctgctgctgctgctgctgctgacccaaccgggcgcgggcacaggtgctgatactgaagctgtcgtttgcgtgggtactgcctgctacacagctcacagtggcaagctgtccgccgcagaggctcaaaaccactgtaatcagaatggaggaaatctggcaaccgtaaagagtaaagaggaggcacagcatgtgcaaagagtgctggcacagctgctcagaagggaggcagctctcaccgcacgcatgtctaaattctggatcggacttcagcgtgaaaaggggaagtgccttgatcctagcctcccacttaagggcttcagttgggtgggggggggagaagacaccccgtactctaattggcataaggagcttagaaacagctgcatcagcaaacggtgcgttagtcttctcctggacctgtcccaaccactcttaccatctcgactgcccaagtggtcggagggcccgtgcggttctcccggtagccccggcagtaacatcgaggggttcgtttgtaaattctctttcaaaggaatgtgtcgtcccctagctctggggggcccagggcaggtcacatacaccacgccctttcagacgacatcatcttctcttgaggctgtccctttcgcttcagccgctaacgtcgcttgcggagaaggagacaaggacgagactcagtcgcactactttctttgcaaggagaaggctccggacgttttcgactggggctcatccggacctctctgcgtgtcaccaaaatacgggtgtaattttaacaacggagggtgtcatcaagattgtttcgaaggaggagacggtagctttttgtgcggctgccgcccaggtttcaggctgctggacgacctggtaacctgtgcttcaaggaatccttgcagcagcagcccctgcaggggaggggctaccgggttgagccaggcagagagcgaggaggggggtgaggaaggagaggaagcaccagaatgcggaaggcagttactacttgggagccgagctagttag

SEQ ID NO: 40859 - DNA, 447 bp, Artificial Sequence
  Description of Artificial Sequence: Synthetic coding sequence
atgcccgtgctgaagcagctgggccccgcccagcccaagaagcggccagatcggggagctctcagcatatctgctcctctgggcgatttccgccacaccctgcacgtgggccggggcggcgacgcgtttggcgatacttcctttctttccagacatggaggaggcccgccgcctgaaccaagagcacctcccgccggagccccccgcagccccccaccacccgccgtgccccagtccgccgcgccatcaccagcagatcctttattgagctttcatcttgacttgggcccttcaatgctcgacgctgtgctgggggtgatggatgctgcaaggccagaagccgccgcggcgaagcctgacgcagagccgcgacctggcacccagccacctcaggcaaggtgccgccccaatgccgatctcgagctcaatgacgtgatcggactctag

SEQ ID NO: 40860 - DNA, 240 bp, Artificial Sequence
  Description of Artificial Sequence: Synthetic coding sequence
atgagcgagttctggcacaagctgggctgctgcgtggtggagaagccccagcctaagaaaaaaagaaggcgcattgaccgcaccatgatcggcgagcccatgaatttcgtgcatttgacacacatcggatccggtgaaatgggggcaggcgacgggctggcaatgaccggcgctgttcaggagcagatgaggtctaagggaaaccgcgaccggccgtggagcaattcccgagggctgtag

SEQ ID NO: 40861 - DNA, 240 bp, Artificial Sequence
  Description of Artificial Sequence: Synthetic coding sequence
atgagcgagttctggcacaagctgggctgctgcgtggtggagaagccgcagccaaagaagaagaggagacggatcgaccgtaccatgatcggggagcctatgaatttcgtccacttaacacacatagggtctggtgagatgggtgctggagatggactcgcgatgaccggtgcagtgcaggagcagatgagaagcaaaggcaacagagaccgcccttggagcaatagccgaggcctgtag

SEQ ID NO: 40862 - DNA, 255 bp, Artificial Sequence
  Description of Artificial Sequence: Synthetic coding sequence
atgagcgagttctggctgtgcttcaactgctgcatcgccgagcagcctcagccaaagagaagacggagaattgatagaagcatgatcggggagcctactaattttgttcacacagctcacgttggatcgggggatctctttagcggaatgaacagcgtctcttcgatccaaaaccagatgcaatccaagggtggatatggggggggaatgccagcaaacgtgcagatgcagctggtggataccaaagccggttag

SEQ ID NO: 40863 - DNA, 255 bp, Artificial Sequence
  Description of Artificial Sequence: Synthetic coding sequence
atgagcgagttctggctgtgcttcaactgctgcatcgccgagcagccacagccaaaaaggcgccgccggattgacaggagcatgataggggagcctacaaatttcgtccacacagcccacgtgggctctggggaccttttttcaggaatgaactccgtcagctctattcagaatcagatgcagagcaagggaggttacggaggtggcatgcctgccaacgtgcagatgcagctggtcgatacaaaagcgggctag

SEQ ID NO: 40864 - DNA, 255 bp, Artificial Sequence
  Description of Artificial Sequence: Synthetic coding sequence
atgagcgagttctggctgtgcttcaactgctgcatcgccgagcagccccagcccaaacgcaggcggcgcatagacaggtcaatgataggggaaccaacaaattttgtgcataccgctcacgtcggtagcggagatctgttttccggcatgaacagcgtaagctccatacagaaccagatgcagtcaaaaggagggtatgggggaggtatgcctgctaacgtgcagatgcagcttgtcgatacaaaagctggatag

SEQ ID NO: 40865 - DNA, 1482 bp, Artificial Sequence
  Description of Artificial Sequence: Synthetic coding sequence
atgttccccgtgttcccctgcaccctgctggccccccccttccccgtcttgggcctggatagtcggggcgttgggggtctgatgaatagtttcccacccccacaaggtcacgcgcagaaccccctgcaggtgggagccgagctgcagagcaggttttttgcctctcaaggctgcgcccagtctcccttccaggctgctcctgccccccctcctacaccacaagcacctgctgccgagcctttgcaggtggatctcctgcccgtgctggcagctgctcaggagtctgccgcggccgcagcagctgcagcagccgctgcagctgcagtggccgccgctcccccagcacctgccgccgcatccacggtggacaccgcagccttgaagcagccccccgctcccccgccacccccacctcctgtgagcgcccctgctgccgaagccgcgcctcccgcgtctgccgccaccatcgctgcagccgctgctactgcagtggttgctcccacttccactgtggcagttgcgcccgtggcatccgctctggagaaaaaaacaaagtccaagggaccctacatttgcgcgctatgcgccaaggaattcaagaacgggtataaccttagacgccatgaagcgatacacactggcgcaaaagccggcagagtgcccagcggcgcgatgaagatgcctacaatggtgccgctgtccttgctgtccgtgccacagctgtctggagcaggaggcggaggcggcgaggccggtgctggaggcggcgcagcagcagtggcagccggcggtgtcgtcaccacaaccgcgtctgggaaacggattaggaaaaatcatgcttgcgagatgtgcggcaaagcctttcgggacgtataccacctaaacagacacaaactgtctcacagcgatgagaaaccataccaatgtcccgtgtgtcagcagcgcttcaagaggaaagatagaatgtcctatcacgttcgatctcacgatggagctgtacacaagccttataactgctcgcactgcggtaaatctttctcccggcccgatcaccttaacagtcacgtgagacaggtccattcaactgaacggccatttaaatgtgagaaatgcgaagccgcgtttgccacgaaagaccggttaagggctcatacagttcgtcacgaagagaaggtgccctgccacgtgtgtggcaagatgctctcgtccgcttacatttccgatcatatgaaggtacacagccagggtccacaccatgtctgtgagctgtgcaataaaggctttacgacagccgcttacctgcgaatccacgccgtcaaggaccacggactacaggctcccagagctgacagaatcctctgcaagctgtgctcagtacactgcaaaacccccgcacagctggccggacacatgcagactcacttggggggggcagctccacctgtgcccggcgatgcaccacagccccagcctacatgctag

SEQ ID NO: 40866 - DNA, 549 bp, Artificial Sequence
  Description of Artificial Sequence: Synthetic coding sequence
atgctgcccaccgccgccggcttcagcatctggggccagcccggcgcagcccgggaggctcctagatgtcagacaaagatcagctcgtgctcctgtccgacatcttccgtcagtgctgcgcacggaccggggcctaacgaacgagcccgaggccttggagggttacccgaccctgccctatctcctagggtacccttccaaggatacgcccggattgttttcgcaatcattagtttctattttatgccgtgctgtccacttactgcctcgtctttttacctgctctcagggctattagatgctttcgacggccatgcagcccgcgctctgaaccagggaacacggtttggtgccatgctggatatgcttactgatcgttgtagcactatgtgccttctggtcaatttagctctgttatacccaggcgctactctgttttttcagatttctatgagccttgatgtagccagtcactggctgcatcttcaccgctcagccgcaatcttgggcgcctgggctacttggcgccactattccggggtggggtag

SEQ ID NO: 40867 - DNA, 1215 bp, Artificial Sequence
  Description of Artificial Sequence: Synthetic coding sequence
atgatctggaagcggagcgccgtgctgcggttctacagcgtgtgcgggttgctgctgcaagcggccgccagcaaaaataaggttaagggttcacagggccagtttccactgacacaaaacgtcactgtcgtggaggggggtaccgcgatcctcacctgtagggtggaccagaatgataataccagccttcaatggagcaaccccgcccagcaaaccctgtatttcgacgacaagaaagcactgagagataaccggattgaactagtgcgcgcatcctggcatgagctgagtatctccgttagcgatgtgtcccttagtgacgaaggtcagtacacttgttccctcttcaccatgcctgtaaagacaagcaaagcctacttgaccgtgttgggtgtcccagagaagccgcagatctctggcttctcatcacctgtgatggaaggcgacctgatgcagctgacctgcaagactagtggcagtaaacccgccgcggatatacgatggttcaagaacgacaaagagattaaggacgtaaagtacttgaaagaggaggatgcaaatcggaagacctttacagtctcatccaccctagatttccgcgttgatcgttcagatgacggcgttgccgtaatttgcagagtggatcacgagtctctcaacgcaacaccccaagtggccatgcaggtgctcgaaattcactacacaccctccgtgaaaatcataccatccacaccattcccccaggagggacagcctcttatcctgacatgcgaaagcaaaggcaagcctctgcctgagcccgtgttgtggacgaaagacggcggtgaactccctgatccggacagaatggtggtgagcggcagggaactcaacatcttgtttctcaacaagacagacaacggcacctacagatgcgaggccactaatacaattggccagtccagtgccgagtatgtcctcattgtgcacgatccaaacgccctggcagggcagaatgggcccgaccacgcgctcatcggagggatcgtcgccgttgtggtgttcgtcaccctgtgctctattttcctgctggggcgctacctagccaggcataaaggaacctatcttacgaacgaggcaaagggcgccgaggacgcccctgacgctgacactgccatcattaacgccgagggatcccaggtgaatgccgaggagaaaaaggagtactttatttag

SEQ ID NO: 40868 - DNA, 1314 bp, Artificial Sequence
  Description of Artificial Sequence: Synthetic coding sequence
atgttcgtgctgttcctgtgcaacctgagcctggtgcccgccgccgcaagcaagaataaagtcaagggaagtcaaggtcagttcccattaacacagaatgttactgtggtggaaggtggcactgcaatcctaacctgcagagtggatcaaaacgacaatacttctctgcagtggagtaacccagcacagcagaccctctacttcgacgataaaaaagctttacgggataatcggattgaactggtcagagcctcttggcacgagctaagtatcagtgtcagcgatgtgtctctatcagacgagggccaatatacatgttcactgttcaccatgccagtgaaaactagtaaggcttaccttaccgtgctgggcgtgcccgaaaaaccacagatttcggggttttcttctccggtcatggaaggagaccttatgcagctcacttgcaagacgtcgggcagtaaaccggcagccgacattaggtggttcaagaacgacaaggagatcaaagacgtgaagtatctgaaggaagaggacgccaatcgcaaaacgtttacggtgagcagcaccctggactttcgcgtggatagatccgacgatggggtggctgtgatctgccgagtggatcatgaatctctcaacgctaccccacaggttgccatgcaggtgcttgagatccactacacaccatcagtaaagatcattccctccaccccgtttccccaggagggccagcccttaattttaacctgcgagagcaaaggaaagcctctgccagaaccagtgctctggactaaggacggaggcgaactgccggatccggaccgcatggtggtgagcgggagggaactcaatattctttttctgaacaagacagataatgggacttatcggtgcgaggccacaaacactattggacagagcagtgccgaatatgtgctcatcgtgcatgacgttcctaatacactgctcccaacgaccattattccttcattaacgactgccacagtgacgactaccgtggcaatcacaacaagccctactacctcagccactacatcaagcatccgcgacccaaacgcactagcaggtcagaacggcccagatcacgcacttatcggtggtattgtggcggtcgttgtattcgtcacgttgtgtagcatattcctgctggggcggtaccttgccagacataagggcacctatctaacaaacgaagcaaaaggcgcggaggatgccccggatgctgacaccgcgataatcaacgctgaaggatcacaagtgaacgctgaagagaagaaagaatacttcatttag

SEQ ID NO: 40869 - DNA, 1308 bp, Artificial Sequence
  Description of Artificial Sequence: Synthetic coding sequence
atgatctggaagcggagcgccgtgctgcggttctacagcgtgtgcggcctgctgttgcagggctcacaggggcagtttcccctgactcagaatgtcaccgtcgtggaaggtgggaccgccatcctgacatgcagggtcgatcagaatgacaatacttccctccagtggtctaatccagcacagcaaactctttatttcgacgacaaaaaagccctgcgcgacaaccgcatcgaactggtgcgcgccagctggcatgagctgagtatttctgtgtcggacgtgtcactgtccgacgaagggcagtatacctgcagcctgttcacgatgccagttaagacatcgaaagcatatctcaccgtcctgggcgtccccgagaagccccagatctccgggttttctagtccagttatggagggggatctgatgcagctaacttgcaaaacgagcgggtccaagcctgcagcagatatccggtggtttaagaacgacaaggagataaaggacgtgaaatatctgaaagaggaggacgctaataggaagacttttaccgtgtccagcacgttggacttcagggttgatagatctgacgatggcgtggctgtgatctgtcgggttgaccatgagagtctcaatgctaccccccaggtggccatgcaggtgctcgaaattcattatacacccagtgtgaagatcatcccttcaacacctttccctcaagagggccagccccttatccttacatgtgaatccaaaggcaagccccttccggagcctgttctatggacaaaagacgggggagagctgcccgatccagatagaatggtagtgagtggtagagaactcaatattttgttcctaaataaaacagataacggcacctacagatgcgaggccaccaacactattggccagagttcagccgagtatgtgctgatcgtgcacgatgtgcctaacacattactcccaacaacaattatcccatccctgaccactgcaaccgttacaaccacagtcgcaatcacgactagcccgactactagcgctaccaccagctccatcagagacccgaacgcattggccggacagaatggcccagaccacgctctgataggcggcatagtggcagttgtcgtgttcgtgaccctgtgtagtatctttctactgggccggtatctggcccggcataaggggacatatctgacaaatgaagcaaagggcgctgaagatgcccccgacgccgatacagccatcataaatgcagagggcagccaagtgaatgccgaagagaagaaggagtactttatctag

SEQ ID NO: 40870 - DNA, 1299 bp, Artificial Sequence
  Description of Artificial Sequence: Synthetic coding sequence
atgggcgcccccgccgccagcctgctgctgctgctgctgctgttcgcatgttgttgggcccctgggggcgcaaatctgtcgcaagacggctattggcaggaacaggacctggaactggggacactcgcccccctggacgaggccatcagtagcactgtctggtcttcccctgatatgctcgccagtcaagattctcagccatggacctccgacgaaacagtggtcgcgggtggaacagtggttctcaagtgccaagtgaaagatcatgaggactcctcacttcaatggtccaatcccgcacaacagactctgtactttggcgagaagagagcactgcgagacaacagaattcaattagtgacttccacccctcatgagctatccatcagcatctccaatgtggccctggccgatgagggtgaatatacttgttcaatatttactatgcccgtgcgcaccgcaaagtccctggtgaccgtactcgggatacctcagaaaccgatcatcacaggatataagtcctcactgagagaaaaggatacagctacactcaactgtcagagctcgggcagcaagcccgccgcccgtctgacatggcggaagggggaccaggaactgcacggagagcctacgcgtattcaggaagacccaaatggtaagacattcacagtgtccagtagtgtcacttttcaggttactcgggaggatgacggggcatcgattgtctgtagcgtcaaccatgagagcttaaagggcgcagatcgcagcaccagccaaaggatcgaagttctgtacacacccactgctatgatccggcccgacccacctcacccgagagagggtcagaagttgctgctccattgcgaaggaagagggaaccccgttccccagcaatacctctgggaaaaggaaggctctgttcccccgctcaagatgacccaggagagcgcactgatcttcccttttctgaacaagagcgattccggaacctatggttgtactgctacttccaatatgggatcctacaaggcttactacacactgaacgtgaatgatccaagccctgtcccctcctcctcatccacctatcacgctattatcggtggaatcgttgctttcatcgtcttcctcttgctcatcatgctaatctttttgggtcattacctgattcggcacaaaggaacgtatcttactcacgaagccaaaggtagtgatgacgcccccgacgctgacacagcgatcatcaacgccgaaggtggccaatcaggcggcgatgacaagaaagaatacttcatttag

SEQ ID NO: 40871 - DNA, 1197 bp, Artificial Sequence
  Description of Artificial Sequence: Synthetic coding sequence
atgggcgcccccgccgccagcctgctgctgctgctgctgctgttcgcttgttgttgggcacctggtggagctaatttgtcgcaggacgattcccaaccctggacgtccgatgagacagtggtggccgggggtaccgtcgttctcaagtgtcaagtgaaagaccacgaggacagctctctgcagtggtccaatccagctcagcagaccctctatttcggtgaaaagagggctctgagagataaccgcatccagctcgttacaagtacgccacatgaactgtccatctctatttccaacgtggctctggcagacgagggggaatatacgtgctccatttttacaatgcctgttcgcactgcaaagtccctggtaacggtgcttggaattcctcaaaagcccattattacaggttataagtcttccctgcgcgagaaagataccgccacacttaattgccagtcttccggttcaaagccggccgctaggctgacatggagaaagggcgatcaggagctgcacggcgaaccgactcgcatacaagaagatcccaacggcaagacctttaccgtctcctcttctgtaacgttccaggtgacgcgggaggacgacggcgcctctattgtgtgcagcgtgaaccatgaaagtttaaagggggccgaccgaagcacctcccaacgcatcgaggtgctgtatacccccactgccatgatcagacccgacccaccccaccctagagagggtcagaagttacttctgcactgcgagggtcgaggcaatccagtcccccagcaatacctgtgggagaaggagggatctgtcccgccacttaagatgacccaagagtcagcacttatcttcccgtttctaaataaatccgacagtggaacttacggatgcaccgctaccagtaacatgggctcttacaaggcctattataccctcaacgttaacgatcctagtcctgtacctagtagctcaagtacatatcacgccatcatcggcggtattgttgcattcatagtgttcttactgttgataatgctcatcttcttgggccactatttgatcaggcataaaggaacatacctgacccacgaggccaagggcagcgatgacgccccagatgccgatactgccataattaatgccgagggaggccagtctggtggcgacgataaaaaagagtatttcatctag

SEQ ID NO: 40872 - DNA, 705 bp, Artificial Sequence
  Description of Artificial Sequence: Synthetic coding sequence
atgggcgcccccgccgccagcctgctgctgctgctgctgctgttcgcatgttgttgggcgcctgggggcgcaaatctgagccaggacgactcacagccatggacctcagacgagaccgtggtggccggcggaaccgtggttttgaagtgccaggtgaaagatcacgaagattcgtccctccagtggtctaaccccgctcagcaaacactctactttggagaaaagcgggctttgagagataatcggatacagctggtgacttccacgccccacgagctgtctatctcgatttcaaatgttgcgctggccgatgagggagagtacacctgttctatctttaccatgcccgtgaggaccgcaaaatcactcgttaccgtgctgggtatccctcagaaacccattatcaccgggtataagtcttctctacgggagaaagataccgccaccttgaattgccagagttccggcagcaaaccagccgccagacttacatggcgcaagggagaccaggaactacacggcgaacccacacggatacaggaggatccaaacgatactcccaccgccatgattaggccagaccctccacacccgagggaagggcagaagctcttgctgcactgcgaggggaggggcaatcctgtgccccagcaatatctgtgggaaaaggaaggaagcgtgccacccttgaagatgacccaatag

SEQ ID NO: 40873 - DNA, 2130 bp, Artificial Sequence
  Description of Artificial Sequence: Synthetic coding sequence
atgcccagcgccaccagccacagcggcagcggcagcaagagcagcggcccgcctcctccctcggggtcctccgggagcgaggccgctgcgggcgccggggccgccgcacccgccagtcaacacccagctacaggcaccggagccgtgcagactgaggctatgaagcaaatactgggcgtgattgacaaaaagttacgcaatctggagaagaagaaggggaagctggacgactatcaggagcgcatgaacaagggcgaaaggcttaaccaagaccagctggacgctgtctcaaaatatcaggaagtcaccaataacctcgagtttgctaaggagctgcagagaagtttcatggcattgtcacaggacatccagaaaactattaaaaaaaccgcaagacgggagcagttgatgcgggaagaggcagaacagaaaaggctcaagaccgtgctagagctccagtatgtgctggataagttaggtgacgatgaggtcagaaccgatctaaaacagggcctgaacggcgttccgatactgtccgaggaggagctgtctctgctcgacgaattttacaagctagttgaccccgaacgagatatgtctctgagactgaacgaacagtacgagcacgcctcaatccacctttgggatcttctcgaaggaaaggaaaagcctgtctgcggaaccacctataaggtcctgaaggagatcgttgagagagtctttcaatcaaactatttcgacagcacccataatcatcagaacggactgtgcgaagaggaagaggccgctagcgcacctgccgtagaagaccaggttcccgaggccgagcctgagcctgcagaggagtacacagaacaatctgaggtagagagcactgaatatgttaaccggcagttcatggctgaaacccagttcacttcaggtgaaaaagaacaggtggacgagtggactgtcgaaacagtcgaggtcgtcaattccctccagcagcagccccaggccgcatcaccctcagttcccgaaccgcacagcttaacacccgtggcacaggccgaccccttggtacgccggcaaagggtacaggatctgatggcacagatgcaggggccctataatttcattcaggattctatgctggatttcgaaaatcagacccttgaccccgcaatcgtgtccgcacagcctatgaatcctacgcagaatatggatatgccacagctcgtatgcccccccgtgcacagcgaatctcgcttggcccagccaaatcaggtccccgtgcagcccgaggcaacacaggtgccactggtctcctccaccagcgaggggtacacagcttcccagcccttgtaccaaccttcacacgcgacagagcaacggccacagaaagagccaatcgaccagattcaggccactatttcactgaatactgatcaaacaaccgccagctcaagcctgcccgccgcatcacagccgcaggtttttcaagccggcacatctaaaccactgcacagtagtgggatcaacgtgaatgccgcccctttccagagcatgcagacggtgttcaatatgaatgccccagtcccccctgtgaacgaacctgaaacactaaaacagcagaaccaataccaggcatcatacaatcagtccttcagcagtcagccccatcaagtggagcaaactgaacttcagcaagagcaactgcaaaccgtagtggggacgtaccatggcagccctgaccagtcccaccaggtcaccggcaatcaccagcagccaccccaacaaaacaccggttttcccaggagcaaccagccttactataactccagaggcgtgagccgtggagggtcacgcggggctcgtggcctgatgaatggctatcggggaccagccaacggctttcgagggggatatgatggatatcgaccttcattctctaatactcccaacagcggttatacccagtcacagttttcggcacccagagactacagcggctaccagcgcgacggctaccagcagaacttcaagcgcggttctggccagagtggccctagaggcgcccccaggggtagggggggacctccacgcccgaacaggggcatgccacaaatgaacactcagcaagtcaattag

SEQ ID NO: 40874 - DNA, 2130 bp, Artificial Sequence
  Description of Artificial Sequence: Synthetic coding sequence
atgcccagcgccaccagccacagcggcagcggcagcaagagcagcgggcctccacctcccagcggatcatcaggatccgaggcagccgcgggagctggggccgcggccccagcctcacagcaccctgcaaccggaacgggcgcagtgcaaaccgaggctatgaagcagatactgggggtgatcgataaaaagttgcgtaacttagagaaaaagaagggaaaactggacgactatcaagagcgcatgaacaaaggcgagcggctgaatcaggatcagcttgacgccgtctcgaaataccaagaggttactaacaacttggagtttgccaaggagctccaacggagttttatggccctcagccaggacattcagaagaccatcaagaagacggcaaggcgcgaacagctgatgcgcgaagaggccgagcaaaaacgtcttaagaccgtactcgagctgcagtacgtcctggataagctaggagatgacgaagtgcggaccgacctaaagcagggattgaacggtgtccctatcttgtcggaggaggagctctctctcttggatgagttctataagctggtagatcctgagcgcgacatgtctttaaggctcaatgaacagtacgagcacgcatccatccatttgtgggaccttttagaagggaaggagaagcctgtatgcgggaccacctataaggtattaaaggagatagtcgagagagtgtttcagtcaaactattttgacagcacacacaatcaccaaaacggactctgtgaggaagaagaagcggcttctgcccctgccgtggaggaccaggtccctgaggcagaaccggaaccagccgaggagtacaccgaacagtctgaggtagaatccaccgaatatgttaatcgtcagttcatggctgaaacacagtttacatccggcgagaaggagcaagtggatgagtggactgttgagaccgtggaggtggttaatagcctgcagcaacagccccaggcggcaagtccctctgttcctgaacctcattctctgaccccggtagcacaggctgacccactggtcaggaggcagagagtccaggacctgatggcccagatgcagggaccatacaacttcattcaggacagtatgttggactttgagaaccagacgttggaccccgctatcgtgtcggctcagccaatgaatcccacccagaacatggacatgccgcagctggtttgtccaccagtgcactccgagagccgcctggcccagcccaaccaagtccccgtgcagcccgaagcgacccaagtgcccctggtaagttctacctcagaggggtacacggccagtcagccactctaccaaccttcacacgcaaccgagcaacgacctcagaaagaacctatcgaccagatccaggcgaccatttctctgaacacagaccagacgaccgctagctcctccctgccagctgctagccagccacaggtgttccaggccggcaccagcaagcctctgcattcctcgggaattaacgtcaacgctgcccctttccaatctatgcagacagtgtttaatatgaatgcccccgttcctccagtcaacgaacctgaaaccttgaagcagcagaatcagtatcaagcatcatacaatcaatcctttagcagccagcctcaccaggtggaacagacagagctgcagcaggaacagcttcaaacagtcgttgggacataccatggctcccccgatcagtcccaccaggtgaccggcaatcaccaacagcctccacagcagaatacaggttttccccgatccaaccagccttactataatagtcgcggcgtcagcaggggaggttcccgaggcgcaaggggccttatgaacgggtaccgaggccctgccaacggattcagagggggctacgacgggtatcgcccatcgttctcaaacacccccaatagtggctatacgcagtcacagttctccgctccgagggattatagcgggtaccaacgggatgggtatcaacaaaatttcaaacgtggaagcggccagtctggtcctaggggcgctcctcgtggcagaggagggccacctaggcccaatagagggatgcctcaaatgaatacgcaacaggtcaactag

SEQ ID NO: 40875 - DNA, 2085 bp, Artificial Sequence
  Description of Artificial Sequence: Synthetic coding sequence
atgcccagcgccaccagccacagcggcagcggcagcaagagcagcgggcctccaccaccaagtggctccagcggtagcgaagcggctgccggcgccggggccgcggctcccgcatctcagcatccagccacgggaactggagctgtgcagaccgaagctatgaagcagatcctgggcgtgattgataagaaactgaggaatcttgaaaagaagaaaggaaagttggatgattaccaggaaagaatgaataagggcgaaaggctgaaccaagatcaactcgacgcggtctccaagtatcaagaggtgaccaacaatcttgagttcgcaaaggagttacaacgatctttcatggccctgtctcaggacattcagaagacgattaagaaaacagctcgaagagaacagctgatgagagaggaggctgaacaaaagcggcttaaaacagtactcgagctccagtacgtattggataagctgggagatgatgaagttaggacagaccttaagcaaggactgaacggtgtcccgatcctgagcgaggaggagttgtccctattagacgaattttacaagctcgtggacccagagagggatatgtccctgcggttgaacgaacagtacgaacacgcctccattcatctttgggatcttctagaggggaaggagaagcccgtgtgcggaaccacctacaaagttttgaaagagatagtggagagggtctttcagtcaaattacttcgatagtacccataaccatcagaacgggctgtgtgaagaagaagaggccgcaagtgcgcccgccgtagaggatcaggttcccgaagccgagccggagcccgccgaagagtacacagagcagtcagaagtggaatccacagaatacgtgaatagacaatttatggctgagacacagttcacctcaggagaaaaggaacaggttgatgagtggactgtagaaacagtggaggtggttaatagtctccagcagcagccacaggctgcttcaccctctgtgccggaacctcattcactcaccccagttgcccaggccgatccgttggtgaggaggcagcgtgttcaggatctgatggctcaaatgcagggcccatacaactttatccaagactcaatgcttgacttcgagaatcagaccttagatcctgctatcgtgagcgcccagccaatgaaccccacccaaaatatggacatgccgcagctggtgtgtcctccagtgcacagtgagtccagactggcccagcctaatcaggtccccgtccagcctgaagcgacacaggtgcctctggtctctagtacttctgagggttacacagctagccagcccctttaccagcccagccacgccacagagcagaggccgcagaaggagccaattgaccagatccaggccaccatttctctgaacacggatcagaccactgctagctcatccctgcccgcagccagccagccacaggttttccaagccggaacttctaagcccctgcatagttctgggataaacgtcaatgccgccccctttcaatcaatgcagacagtcttcaatatgaatgccccagtcccgcccgtgaacgaaccggagactctgaagcagcagaatcaataccaagcctcttataaccagtccttcagcagccagccacaccaggtggaacagactgagctgcagcaagagcaactgcagacagttgtcggtacttatcacggcagccccgatcagagccaccaggtgactgggaatcaccagcagcctcctcaacagaacacggggtttcctcgtagtaaccaaccgtattacaattcccggggcgtgtctaggggcggaagtaggggagccaggggactgatgaacggatatcggggtccagcaaatggattccgcggcggctacgacggctacaggccatcctttagcaatacacccaacagcggctatactcaatcccagttttccgccccccgggactactcaggataccagagggatggctaccagcagaactttaagcgcggaagtggtcaaagtggacctagaggggctccccgagggaatattctatggtggtag

SEQ ID NO: 40876 - DNA, 2274 bp, Artificial Sequence
  Description of Artificial Sequence: Synthetic coding sequence
atgagcgagaacagcagcgacagcgacagcagctgcggctggaccgtcatctctcatgagggtagcgatattgaaatgctgaactctgtgacaccaaccgacagttgcgaacctgcgccagaatgctcctctctagaacaagaggaactgcaggccctgcaaatcgaacagggtgagagctcccagaacggtacagtgctgatggaagagacagcatatcctgccctagaagagacctccagcaccatcgaagctgaagagcagaaaatccccgaggattccatctacatcggtaccgcctctgacgatagtgacatcgtgaccctcgagccgcctaagcttgaagagatagggaaccaggaggttgtaatcgtggaggaggcacagtctagcgaagatttcaatatgggatcctcttcctcatcccagtacactttctgccagcccgagactgtcttttcaagtcaaccctctgatgacgagtccagcagcgacgagacctccaatcagcctagtcccgctttcagaagaaggcgggcacgcaaaaagacagtgtccgcatctgagagcgaagaccggcttgttgcagagcaggaaactgagccaagcaaggagttatctaagcgccagttttccagcggattgaacaaatgtgtcatcttggccctggtgatcgctattagcatggggttcggtcacttctatggcactatccagatccaaaagcggcagcagctcgtgagaaaaatccacgaagatgagctcaacgatatgaaggactatctgagtcaatgtcagcaggagcaggaatcttttatagattataaaagtttgaaagagaacctggccagatgctggaccctcacagaggccgaaaagatgtcattcgaaacacagaagacaaacttggccacggagaaccagtacctcagagttagcctggaaaaggaggaaaaagcattgtcttctttacaggaggagttaaacaagttgcgggaacagataagaattctggaggacaaggggaccagcaccgagctcgttaaggaaaaccagaagctcaagcagcaccttgaagaagagaaacagaagaagcacagcttcctgtcgcaaagggagaccctgcttacagaggccaaaatgctcaaacgcgagctcgagagagagcgacttgttacaacggccctgagaggggagctgcagcagttgagcggctctcaattacatggcaagagcgatagtcctaacgtgtataccgaaaagaaggagattgctattctgcgggagaggttgacagagcttgaaagaaagcttacgtttgaacagcagcgcagcgatctgtgggagcggttgtatgtggaggcgaaggatcaaaacggcaagcagggcaccgacggtaaaaagaaaggggggcgcggctctcatagggccaaaaataaaagtaaggagaccttcctgggctcagtgaaggagactttcgacgcaatgaagaatagcaccaaggaattcgtcagacaccataaagagaagatcaagcaagctaaggaggctgtcaaggagaatctcaagaagttcagcgactccgtaaagtctacattccgccacttcaaggacacgactaagaatatctttgatgaaaaagggaacaagagattcggggctaccaaggaggcggcagagaagccacgaacagtgtttagcgattatttacacccccagtacaaggctcccaccgaaaatcatcacaataggggtcctactatgcaaaatgatggcaggaaagaaaaacccgttcactttaaagagtttcggaagaataccaattccaaaaagtgctcaccaggccatgactgtagggagaacagccactcattccgcaaagcatgctctggcgtattcgattgtgcacagcaagagtccatgagcctgtttaataccgttgtgaacccaattcggatggatgaattccgccaaattatccagcgatacatgttgaaggaattggacaccttctgtcactggaacgaactagaccagtttattaataaattcttcctgaacggtgtcttcatacatgatcaaaagcttttcaccgactttgtgaacgacgtgaaagattacttaaggaatatgaaggaatatgaggtagataacgatggcgtattcgaaaagttggacgagtatatctaccgccatttctttgggcatactttttcaccgccttacggaccgagatcagtctatatcaagccttgccactactcttcactgtag

SEQ ID NO: 40877 - DNA, 1275 bp, Artificial Sequence
  Description of Artificial Sequence: Synthetic coding sequence
atgagcgagaacagcagcgacagcgacagcagctgcggctggaccgttattagccatgagggcagcgacattgaaatgttgaattctgtcacccccacggatagttgcgagccagcgccagaatgctcttccctagagcaggaagagctccaggcactgcagatcgagcagggagagagctcccaaaacggcaccgtattaatggaagagacagcctaccccgcgctcgaggaaacttcaagcaccatcgaggcagaagaacagaaaatcccggaggactctatttatattggaactgcttcggatgattccgacatcgtgactttagaacctcccaagctggaagaaataggcaatcaggaagtggtgattgtcgaagaggcccagtcctcagaagattttaacatgggttcttcctccagttcgcagtatactttctgtcagcctgagaccgtgttttcctctcagccttctgatgatgaatcatcttccgacgaaacatcgaatcaaccctcgccggccttccggaggcggcgtgcaaggaaaaaaaccgtcagcgctagcgagtccgaagatcggctagttgcagaacaagagaccgaacccagcaaggagttatccaaacggcaattcagcagcgggctgaataagtgcgtcatcctggctttggttatagccattagtatgggattcggccacttttatggcaccatccagattcaaaagcgccagcagctcgtgcgtaagattcatgaggacgagctcaacgatatgaaggattacctttctcaatgccagcaggagcaggaatctttcatagattataaatctctgaaagaaaacctggctagatgctggacgttaacagaagcagagaaaatgtctttcgagactcaaaaaacgaaccttgcaactgagaaccagtatcttcgaaagctcttcaccgactttgtcaacgatgtgaaagactaccttaggaatatgaaagaatatgaggtcgataatgacggggtcttcgagaagctggatgagtatatttacaggcactttttcggacacactttctcacccccatacggccctagccgccccgacaaaaaacagagaatggttaatatcgagaacagcagacaccggaagcaggagcagaagcacctccagcctcaaccctataaacgcgaagggaagtggcacaaatatggccggactaacggcagacagatggccaacttggagatcgagctgggacagctccccttcgatcctcagtattag

SEQ ID NO: 40878 - DNA, 2424 bp, Artificial Sequence
  Description of Artificial Sequence: Synthetic coding sequence
atgagcgagaacagcagcgacagcgacagcagctgcggctggaccgtgatttcacacgaaggttctgatattgaaatgttgaactcagtgacacccacagactcctgtgagcccgccccagagtgctcttctctggagcaagaagagctgcaggctctccagatagaacagggagagtcttcccagaacggaaccgttctgatggaggaaactgcctaccccgccctcgaggagactagttccacaatcgaggctgaagagcagaaaataccagaggactctatttacatcggcaccgcaagcgacgactcagatatcgtgacacttgaaccacccaaactcgaggaaatcggcaatcaggaggttgtgattgtggaggaggctcagagtagcgaggattttaacatgggcagctcttctagcagccagtatacattttgccagcccgaaacggtcttcagcagccagccctccgatgatgagtcctcttccgatgagaccagtaaccagccttctccagccttccgtcgccgacgcgctaggaagaaaactgtgtcagcgagcgaatccgaagatcgactggtggccgagcaagagactgagccctcaaaggagctgtcgaagcgtcaattctcgtccgggctgaacaagtgtgtcatcctggcactggtgatcgctatcagtatggggttcggtcatttttacggaactatccagatacagaagcggcaacagttggtccgcaagatccatgaggatgaacttaacgacatgaaagactacctgtcccagtgtcaacaggaacaggaaagctttatcgactataaaagcctgaaagaaaacctggcgcgctgctggacactcacagaggcagaaaaaatgagtttcgagacccagaaaacaaacctcgccacagaaaaccaatacctgagagtgtcactggaaaaagaggaaaaagctctctccagcttacaagaagagctgaataagctacgcgaacaaattagaatcctcgaagacaagggcacttcgacagaactggtgaaagagaaccagaagctaaagcagcaccttgaggaggagaaacagaagaaacatagcttcctcagccagcgagagacactactgaccgaggcaaagatgctaaagagagaactggagcgggagcgtctcgtaaccacagcactgagaggtgaactgcaacagctcagtggctcccagctgcatgggaaatctgatagcccaaatgtgtacactgaaaagaaggaaattgcaattctacgcgagaggctgacggaactagagagaaaacttactttcgaacaacaaagaagtgatctgtgggagagactttatgttgaagccaaagaccagaacggcaagcagggcacggacggaaagaaaaaaggcggccgcgggtcccaccgcgctaaaaataaatcgaaagaaacgtttctcgggagcgtgaaggagacgtttgacgctatgaagaactcgacaaaagaattcgtccggcaccacaaggaaaagatcaaacaggctaaagaggcggtaaaggagaacctgaaaaaattttctgattctgtgaagtcgacctttcggcacttcaaggatacaactaagaatatctttgacgagaagggtaacaaacggttcggggccacgaaggaagccgctgagaaaccacgcaccgtcttcagcgactacctgcatccccaatataaagcaccaaccgagaaccaccataatcgcggccccactatgcagaacgatggaagaaaggagaaaccagtgcattttaaggaattcagaaagaataccaacagcaagaaatgttcacctggtcacgactgcagggagaattctcactctttcagaaaagcatgtagcggagtttttgactgtgctcagcaagagagtatgtctctcttcaataccgtcgttaaccccatccgcatggacgagttccgacagattattcagcgttacatgcttaaggagctggacacattctgccattggaacgagttggatcaatttatcaataaatttttcttgaacggagtcttcatccacgaccagaagttgtttacagattttgtcaatgatgttaaggactacctcaggaatatgaaggagtatgaagttgataacgatggtgtgttcgaaaagctagacgaatacatctataggcacttttttgggcataccttctctcccccttatggtccatcacggcccgataaaaaacaacgtatggtgaacatcgaaaactcaagacaccgcaaacaggagcagaaacacctgcagccccagccatacaagcgcgaagggaagtggcataaatacggcagaacaaacggccgccaaatggccaaccttgaaatcgagctgggccaattgccctttgaccctcagtactag

SEQ ID NO: 40879 - DNA, 717 bp, Artificial Sequence
  Description of Artificial Sequence: Synthetic coding sequence
atggagtacgccatgaagagcctgagcctgctgtaccccaagagcttaagccgccatgtcagcgtgagaactagcgttgtgacccagcagctcctgtccgagccatcccctaaagccccacgagctagaccttgtagggtcagtaccgcagatcgctccgtacgtaaagggattatggcatattctctcgaggatcttttgctcaaggtgagggacactctgatgctggccgacaaaccattctttcttgtgctcgaggaggatgggactaccgtggagaccgaggagtattttcaagcactcgccggtgatacagtttttatggtcctgcagaagggacaaaaatggcagcccccaagcgaacaggggactcgtcaccctctgtccttgagccacaaaccggcgaaaaagatcgacgttgcccgcgtgacatttgacctttataaattaaacccgcaagatttcattggctgcctgaatgttaaagctacattctatgacacctattctctgtcctatgacctacattgttgtggggctaagcgcataatgaaggaagcctttcgatgggccctgttctccatgcaggccactgggcacgtccttttaggcactagttgttacttacagcaacttcttgacgccactgaggaaggccagccacccaaaggcaaagcttcgtcactgattccaacctgtttgaagatccttcagtag

SEQ ID NO: 40880 - DNA, 402 bp, Artificial Sequence
  Description of Artificial Sequence: Synthetic coding sequence
atggagtacgccatgaagagcctgagcctgctgtaccccaagagccttagtcggcacgtctccgttcgaacaagcgtggttacccagcagctgctctctgaaccatctccaaaagccccacgtgccagaccttgcagagtgagtacagccgatagaagcgtcaggaaggggataatggcctatagcctcgaggatctcctgctgaagggtagctttcccctgggtccgcttcaacatgccggccaccgtccccggaccgcctggcatctgctgctaccagccgccgcacctaggtgctatgggggaagagccgctccgcaagggcaaggactgatcccataccctgacttatccgaggacactgccgtgaaagcgcaagtgctaggatccttcccccagtag

SEQ ID NO: 40881 - DNA, 495 bp, Artificial Sequence
  Description of Artificial Sequence: Synthetic coding sequence
atgctggccgacaagcccttcttcctggtgctggaggaggacggcacgaccgtggagacagaggagtattttcaggccctcgctggcgacacagtgttcatggtgctccagaagggccagaaatggcagcctccatctgaacaggggacccgccaccctctgagcctgtcccacaagcccgccaagaaaatcgacgtggccagagtcaccttcgatctttataagcttaatccacaggatttcatcgggtgtctaaatgtgaaggccacgttttacgacacttacagcctcagctacgatctccactgttgcggtgccaaacggattatgaaggaagcttttcgctgggcccttttttccatgcaggccacggggcacgtgctgcttggaacaagttgctacctccagcagctcttggatgcaactgaggagggacaaccaccgaaaggtaaagcatccagcctcattcccacatgcctgaagatcttgcagtag

SEQ ID NO: 40882 - DNA, 495 bp, Artificial Sequence
  Description of Artificial Sequence: Synthetic coding sequence
atgctggccgacaagcccttcttcctggtgctggaggaggacggcaccacggtggaaacggaggagtacttccaggcgcttgccggagataccgtttttatggtgctgcagaaaggccagaaatggcagcctcccagcgagcaaggtacccgccatcctttatccctgtcacataagccggcgaagaaaattgacgtcgcacgggttactttcgatttatacaaactaaatcctcaggattttattggttgtctcaatgtcaaagctaccttctatgatacgtactccttatcttacgacttgcactgctgtggtgcaaagcggatcatgaaagaggcatttagatgggccctgttctccatgcaggcaacagggcacgtgttgcttggtacttcctgctatctgcagcagctgctagatgctactgaagaggggcagccgcccaagggtaaggcaagcagtctgattccaacctgcctgaaaatcttgcaatag

SEQ ID NO: 40883 - DNA, 747 bp, Artificial Sequence
  Description of Artificial Sequence: Synthetic coding sequence
atggagtacgccatgaagagcctgagcctgctgtaccccaagagcctgagccgccatgtttctgttagaacatcggtggtgacgcagcagctcttgtccgagccttccccgaaagccccaagggcccgaccctgcagagtctctacggcagatcgctcggtcagaaaaggaatcatggcctatagcctggaggatctcctgctcaaaacgagaaatcctgaggccagatcacaggaagtcagggataccctcatgctggcggacaagccgttctttttggtgctcgaggaagacggcactactgtcgagaccgaggagtacttccaggcattagcaggggataccgtgtttatggttctgcagaagggacagaagtggcagccaccaagtgagcaggggacccgccaccctttatccttgtcacataagcccgctaagaaaatcgatgtggctagagtgacatttgacctatacaagctgaacccgcaagactttatcggatgcctgaatgtgaaagcaactttctatgatacttacagtcttagttacgacctgcactgttgtggcgcaaaaaggattatgaaagaggcctttagatgggctctttttagtatgcaagctaccggccacgtcctcctgggcacttcatgttacttacagcagctacttgatgcaaccgaggagggccagcctcctaaaggtaaagccagctcccttattcctacatgcctgaagatcctgcagtag

SEQ ID NO: 40884 - DNA, 987 bp, Artificial Sequence
  Description of Artificial Sequence: Synthetic coding sequence
atggccaacagcgccagccccgagcagaaccagaaccactgcagcgccatcaacaattctatcccactcatgcaaggaaatctacccacactgacactgtcagggaagattcgcgtgaccgtgacgttttttcttttcctcctgagtgcaacatttaatgcaagcttcctgctgaagttacagaaatggacacagaaaaaagagaaggggaagaagctgtcccggatgaagttgctcctgaaacatctgactctagctaacctgcttgagactctcatcgtcatgcctctggatggtatgtggaatatcactgttcaatggtacgccggagagctattatgcaaagtcctgagttatctcaaacttttctcgatgtacgcaccggctttcatgatggtggttatatccttagatagaagtctggcaataacgaggccactggcactcaagagcaactctaaagtcggccaatctatggtgggcctggcctggatcttatcaagcgtttttgcgggccctcaactgtacatctttagaatgattcatctggcggatagctccggtcagaccaaggttttttcccagtgtgtgacccactgctcatttagccaatggtggcatcaggccttttacaacttcttcacctttagctgtttattcattatccccctttttattatgctgatctgcaacgccaagatcatattcaccctcacccgggtgctccaccaggacccgcacgaactacagttgaatcagagcaaaaacaatattccaagggccagattaaaaacattgaagatgacggttgctttcgcgaccagtttcacagtgtgctggacaccatattatgtgctcgggatttggtattggttcgacccagagatgctgaaccgcctgagcgaccccgtgaaccacttttttttcctgtttgcctttctgaacccctgtttcgatcccctaatttatgggtatttcagcctatag

SEQ ID NO: 40885 - DNA, 504 bp, Artificial Sequence
  Description of Artificial Sequence: Synthetic coding sequence
atgagcctggccctgcggagcgagctggtggtggacaagaccaagcgcaagaagagacgcgagcttagtgaagagcaaaagcaggaaatcaaggacgcatttgaattgtttgacacagacaaagacgaagccatcgactaccatgaactgaaggtggccatgagggcactggggttcgatgtcaagaaggctgacgtcctgaaaattctgaaggactatgatcgcgaggctacagggaagatcacctttgaggactttaacgaggttgtaactgattggatactcgaacgggacccgcacgaggaaatactgaaagccttcaagctgtttgacgatgacgattctggcaagatcagcctgcgtaacctacgtagggtggctcgagagctcggggagaatatgagcgatgaagagctgagagctatgatcgaggaattcgacaaggatggagacggcgagatcaatcaggaggagtttatcgcaattatgaccggcgatatttag

SEQ ID NO: 40886 - DNA, 789 bp, Artificial Sequence
  Description of Artificial Sequence: Synthetic coding sequence
atggccgtgaccgcccaggccgcccggcggaaggagcgggtgctgtgtttattcgacgtggatggcaccttgactcccgcacggcagaagattgatcctgaagttgccgcattccttcaaaagcttagaagcagggtccagattggcgttgtgggcgggtcggactactgcaagattgcagagcagctgggcgatggggatgaggtgatcgagaagtttgattacgtcttcgcagaaaatggtaccgtgcaatacaaacacggcagattgctttctaagcagacaattcaaaaccacctgggagaagagctccttcaggatcttattaacttttgcctgtcgtacatggccttgttgcgattgcctaaaaagagaggcacatttattgaatttagaaatggcatgctgaacatcagcccaataggaagaagctgcactctggaagaaagaattgaattctctgaactcgacaagaaggagaaaatacgggaaaagttcgtggaagcgctcaaaacagaatttgccggcaaagggctcagatttagtagaggcggtatgattagctttgacgttttcccagaaggttgggacaaaaggtactgtctggactccttggatcaggatagttttgacaccatacatttttttggcaacgaaacatcacctggtggcaatgatttcgaaatttttgccgacccccggaccgtggggcacagcgtcgtgtcccctcaggacaccgttcagaggtgtagggagatattctttccggagactgcccatgaggcatag

SEQ ID NO: 40887 - DNA, 1020 bp, Artificial Sequence
  Description of Artificial Sequence: Synthetic coding sequence
atgttcagcgaggtgctgcacggcctgatcggccggacccagcggtcagccggcgtcgatcaaaaccatccacgggcagtgctggtgcctagttcactgaggattgggataatccctgcaggatcaaccgattgtgtatgctacagcactgtgggcacctcagacgcagagacatcggcgttacatattgtcgtgggagattccctcgcgatggacgtttcaagtgtacaccataactccacacttttacgctactccgttagtctgttgggatacgggttttacggtgacatcatcaaagactctgaaaaaaagcggtggctcggattggcccggtacgatttctctgggctgaagacttttcttagtcatcattgctatgagggcaccgtctcttttttgcctgcccagcacaccgtgggaagcccacgggacagaaagccttgtcgggccggttgcttcgtgtgcaggcagtcaaagcagcaactggaggaggaacaaaaaaaggccttgtacggcctggaggccgctgaggatgtagaagagtggcaggtcgtgtgcgggaaatttcttgccattaacgctactaatatgtcttgcgcgtgccgacggagccctcgggggctgtctcccgcagcccatctcggagatgggagctcagatctcatactaattaggaaatgttcccgattcaacttcctgcgcttcctgatcagacatactaaccagcaagaccagttcgactttacttttgtagaagtgtaccgggtgaaaaagtttcagtttacatcgaagcacatggaagacgaggatagcgatctcaaggagggtggtaagaagaggtttggacacatttgctcatcacatccctcttgctgctgtaccgtgagcaactcttcttggaactgtgacggtgaagtgttacactccccagccatcgaggtcagggtgcactgccagttggtgagattgttcgcaagggggattgaagagaatcctaagccagattcccactcttag

SEQ ID NO: 40888 - DNA, 1053 bp, Artificial Sequence
  Description of Artificial Sequence: Synthetic coding sequence
atggccgccgccggccccgccgccggccccaccggccccgagcccatgccctcctacgcccaactggtgcagagaggctggggtagcgcccttgctgccgcccgcggttgtacagactgtggctggggtctggccagacggggcctggccgaacacgcccatcttgcgcccccggagctcctgctgctggctctgggcgccctgggctggacagctcttcggtcagctgccactgctagactgttccggcctcttgctaagaggtgttgcctgcagcctcgggacgccgccaagatgcctgaatctgcctggaagtttctgttctatcttggcagctggtcctactctgcgtatctgctgtttggaaccgattatcctttttttcatgatccaccgagtgtattctatgactggacaccaggtatggcagtgcctagagatatcgccgctgcctatctgttacaaggttccttttacggacacagcatttatgcaaccctgtacatggatacttggagaaaagactccgtagtcatgctgctacaccacgttgtgaccctcattttaatcgtcagttcttacgcattcaggtatcacaacgtgggaattcttgtgctgttcttgcatgacatctccgatgtgcaactggaatttaccaagctgaatatttattttaaatctcgaggcggctcttaccacagattgcacgctttggcggccgacctgggatgcctctctttcggatttagctggttttggttcaggctctattggttccctctgaaagtgctgtacgctacgagccattgttcactccgtaccgtccctgatatacccttctactttttcttcaacgctttgctactgctcttaactctcatgaacctgtattggttcctctatatcgtggccttcgccgcaaaggtgttgaccggccaggttcacgaactgaaggatctgcgggagtacgataccgccgaagcccagtccctgaaaccatccaaggccgaaaaacctctgaggaatggtttggttaaggataagaggttttag

SEQ ID NO: 40889 - DNA, 1014 bp, Artificial Sequence
  Description of Artificial Sequence: Synthetic coding sequence
atggccgccgccggccccgccgccggccccaccggccccgagcccatgccatcttacgctcagttggtacaacgcggctggggctccgctctggcagcagctagaggctgcaccgactgtggatggggcctggcccgccgtgggctggccgaacacgcccacctagctccaccggaactgctacttctggctcttggcgcattaggctggactgccttgaggtcagctgctacagcgcgcctctttaggccactggcgaagcggtgttgcctccaaccccgcgacgcggcgaagatgcctgagtctgcttggaaattcctattttacctcgggtcttggagttactcggcgtacctgctgttcggcactgattacccattcttccacgaccccccttcagtgttctatgattggaccccaggaatggctgtgccccgcgatatcgctgcagcttacttgctccagggaagcttttacggccattctatatacgcaactctctacatggatacttggcgaaaggactcggtggtaatgcttctgcatcacgtggtgacactgatcctgatcgtttcttcatatgcttttcggtaccataacgtgggcattttggtactttttctgcacgatatcagtgacgtgcagctcgaatttaccaaactcaacatttatttcaaatcccgaggaggctcttatcacaggctgcatgctctggcagcggacctgggttgcttgtccttcggatttagctggttctggtttcggctgtattggttccccctgaaagtcctctatgccaccagccattgctcactgcgcaccgtgccagacattcctttttacttcttcttcaacgctcttctattgctcctgacccttatgaatctgtactggttcctgtacatagtagccttcgcagccaaggtgctgactgggcaggtccacgagctaaaggatttgagggagtacgacaccgcagaagcccaatcacttaagccttccaaagccgaatag

SEQ ID NO: 40890 - DNA, 720 bp, Artificial Sequence
  Description of Artificial Sequence: Synthetic coding sequence
atgcccgagagcgcctggaagttcctgttctacctgggcagctggtcctatagcgcttatctactttttgggacagactatccattctttcacgaccctccatcagttttttacgattggacccctgggatggcggtgccaagagacatcgcagctgcttatcttcttcagggaagcttctatggtcacagtatttacgcgaccctgtatatggatacctggcgaaaggatagcgtggtgatgctcctgcaccatgtcgtgaccctcattctcatcgtgtccagctatgcatttaggtaccacaacgtgggcatactggtactgttcctgcatgacataagcgacgtgcagctggaattcaccaagctgaacatctatttcaagagtcggggggggtcctatcaccgcttacatgccctggccgcagacctgggctgtctaagtttcgggttcagttggttttggttcaggttatactggtttccgcttaaagttctctacgctactagtcattgttcactccgaactgtgccggatattccattctatttcttttttaacgcattgctgttgcttctgaccttaatgaatctttactggttcctatacatcgtcgccttcgcggctaaagtgctgactggccaggtgcatgagctgaaagatctccgcgagtacgatacagcagaagcccagtccttaaaaccttccaaggccgagtag

SEQ ID NO: 40891 - DNA, 1143 bp, Artificial Sequence
  Description of Artificial Sequence: Synthetic coding sequence
atgctgcagaccctgtacgactacttctggtgggagcggctgtggctgcctgttaatctcacatgggcagacctggaagaccgcgacggacgggtctacgcgaaggcctctgacctttacatcacactgcctctggctctgctgttcttaatcgtaagatatttttttgagctgtacgtcgctacccctctggcagctctgctcaacatcaaggaaaagacgcgccttagagcccccccgaatgccactctggagcacttctacctgaccagcgggaaacagccaaaacaggtggaagtcgagttgctcagcaggcaatcaggcctgagtggccgtcaggtcgaacgatggttcaggcgcaggaggaatcaggaccggccaagtttgttgaagaaatttagggaggcctcatggagatttacattctacctgatagccttcatagccgggatggctgtgatcgtagacaagccgtggttctacgacatgaagaaagtgtgggagggctatcctatccagtcaaccataccgagccagtattggtattatatgatcgagctctccttttactggagcctgctctttagcattgcttcggacgtcaaacgaaaggatttcaaggaacagattatacaccacgtggccaccattatccttatctcatttagctggttcgcaaattatatccgagctggtacgctaatcatggccctgcacgatagctctgactatctgctggaaagcgctaagatgtttaactatgcggggtggaaaaacacatgcaataatatttttatcgtgttcgccattgtgtttattatcaccagattggtaatcctgcctttttggatacttcattgcactttagtctatcctctggaattatatccagcttttttcgggtactattttttcaatagtatgatgggcgtcctgcagctcctgcatatcttctgggcttaccttatccttagaatggcacataagttcattacaggcaagttagtcgaggacgagaggtctgacagggaagaaacggagtctagtgaaggcgaagaagctgctgccggtggaggagcaaaaagtaggccactcgctaacggccatccgatcctgaataacaaccacaggaaaaacgattag

SEQ ID NO: 40892 - DNA, 693 bp, Artificial Sequence
  Description of Artificial Sequence: Synthetic coding sequence
atggccgtgatcgtggacaagccctggttctacgacatgaagaaggtatgggagggctacccaatccagtccactatcccctcccagtattggtactacatgatcgagctttcattctactggtccttgttatttagcatcgcatctgatgtgaaacgaaaggacttcaaggaacagatcattcatcatgtagccacgattatattgataagtttcagttggttcgcaaactacattagagcaggaactctcatcatggccctgcacgattcaagtgactatctcctcgagagtgctaaaatgttcaactacgccggctggaaaaacacttgcaacaacatcttcatagtctttgcaatcgtgtttatcattacgcgcctcgtcatcctgcccttctggatactgcattgtaccctcgtgtatccccttgaactctaccccgccttctttggctactacttctttaattcaatgatgggcgtgctgcagctgctacatattttttgggcttatttaattttgagaatggcccacaagtttatcacggggaagttggtggaagacgagcggagcgacagggaggagaccgagtccagtgaaggagaggaagctgctgctggagggggggctaagagcagacccctggccaatggccacccaatcctgaataacaatcatagaaaaaacgactag

SEQ ID NO: 40893 - DNA, 750 bp, Artificial Sequence
  Description of Artificial Sequence: Synthetic coding sequence
atgctgcagaccctgtacgactacttctggtgggagcggctgtggctccccgtgaacctgacctgggcagacctggaggatcgggatgggcgggtgtatgccaaggcatctgacctgtatataaccctccccctcgctctactgtttttaattgtccgttacttcttcgagctctatgtcgctacgccgctggccgccctattgaacataaaagagaagacccgattgagagcccctccaaacgccacgctggaacatttctacctgacttctggaaaacaaccaaagcaggttgaagtggagttactgtctagacagagcggactcagtggccggcaggtagaaagatggtttaggaggcgacggaatcaagataggccctcgctcctgaaaaaattcagggaagccagctggagattcacattttatctcattgccttcatcgcaggcatggctgtgatcgtggataagccctggttttatgatatgaaaaaggtctgggaggggtacccaattcaaagcaccataccatctcaatattggtactatatgatcgagctctctttttattggtccctgctcttcagcattgcctcagatgtgaagagaaaagacttcaaagagcagatcattcatcacgtagctactatcatcctcatcagtttctcctggttcgcgaattatatccgggccggcacactgataatggcgctgcatgattctagtgattacctgctggaggttcgttag

SEQ ID NO: 40894 - DNA, 975 bp, Artificial Sequence
  Description of Artificial Sequence: Synthetic coding sequence
atggtgcccctggccctgcacttccccggcgaggtgggcctgcaggaaaccgctgtgagaatgctccagacgttgtacgattacttctggtgggagaggctgtggctaccagtgaatctgacctgggctgatctagaagaccgcgacgggagagtgtatgcaaaggcctccgacttgtatatcactctgcctcttgctctgctctttctgatcgttcggtacttttttgaactgtatgttgccacaccacttgccgccctactgaatataaaagaaaagactagactgagagcaccgccaaatgcaacccttgagcatttctacctgacaagtggcaagcagccgaagcaggtagaggttgaactcttgagtcgtcagtccgggctgtccggaagacaagttgagcggtggtttaggcgccggcggaaccaggatcgtccaagtttgctaaaaaagttcagagaggcttcatggcgttttactttctacttgatagcctttatcgccggaatggctgtgattgttgataagccttggttttacgacatgaaaaaagtttgggaggggtatcctatccagagtaccatccctagtcagtattggtactacatgatcgagctcagtttctactggtccctgctattcagcatcgccagcgatgtgaaacggaaagacttcaaggagcaaatcatacaccacgtcgccacaataatcctgatatccttttcctggtttgccaattacatacgggcagggactctaataatggctttgcacgactctagtgattatctgctcgaatctgctaagatgttcaattacgcgggttggaagaacacctgcaacaacatctttattgttttcgctatcgtatttatcattaccaggctcgtgatcctgcccttctggatcctgcactgtacgttagtctatccactggagctgtacccagccttctttgggtactatttctag

SEQ ID NO: 40895 - DNA, 1143 bp, Artificial Sequence
  Description of Artificial Sequence: Synthetic coding sequence
atgctgcagaccctgtacgactacttctggtgggagcggctgtggctgcccgtaaacctgacctgggcagatctggaggacagagacgggcgggtgtatgcaaaagcaagcgacctgtatatcacactccctctggccctgctttttctgatcgtacgttattttttcgaattgtacgtggctactcctctggctgcattgctgaacatcaaggagaagactcggctgcgtgcaccacctaatgccactctcgagcatttctatctgacaagtggcaaacagcccaagcaggtcgaagtggagctgctctcaagacagtcgggcctttccgggcggcaagtagaaagatggttcaggcggagacgcaatcaagataggccatccctgctgaagaaatttcgcgaagctagctggagatttactttttaccttatcgccttcatagctggaatggctgtaattgtggataaaccctggttctacgacatgaagaaagtttgggaagggtacccgattcaatctacaattccatcgcaatattggtattatatgatagaactgagtttctactggtccctgttattcagcattgcaagcgacgtcaagaggaaggacttcaaggagcagattatccatcatgtcgccacaatcattctgattagcttcagttggtttgcaaattatatccgggccggcactctcattatggcccttcacgactcctcagactacttgctggaatctgcgaaaatgtttaactacgctggatggaagaacacatgcaacaatatcttcattgttttcgccatagtcttcatcatcacccggctcgtgattttacccttctggatcttgcactgcaccctggtctaccctctggagctgtatccagccttcttcgggtactacttttttaactctatgatgggcgttcttcagcttctccacatcttttgggcttatctcatcctgcgaatggctcacaaatttattacgggaaagttggtggaggacgaacgatcagatagggaggaaaccgaaagctctgaaggtgaagaagctgctgctggcggaggagccaagagcaggcctctggccaacggtcaccccattctgaacaataaccatcggaagaacgattag

SEQ ID NO: 40896 - DNA, 579 bp, Artificial Sequence
  Description of Artificial Sequence: Synthetic coding sequence
atgctgcagaccctgtacgactacttctggtgggagcggctgtggctccctgtaaatctgacgtgggctgacttagaggacagagacgggcgcgtgtacgcgaaggcgagcgacctctacatcacattgcctctggccctgctattcctcattgtacgctatttcttcgaactgtacgttgccacccccctggcagccctcctgaatataaaagagaagacgcgcctgcgggctccaccaaatgctacccttgagcatttttatctaacatcaggcaagcagcccaagcaggtcgaggttgaactgctctcgcgtcagtctggcttgagcggccggcaagtggagcgctggtttagacgaagacgtaaccaggatcgaccttccctgctgaaaaaatttcgtgaggcttcttggagattcactttttacctaattgcctttatcgccggaatggctgtgattgtggacaaaccctggttttatgatatgaagaaggtgtgggagggctatcccattcaatcgacaatacctagccagtactggtactatatgatcgagctgtccttctactggtcctag

SEQ ID NO: 40897 - DNA, 390 bp, Artificial Sequence
  Description of Artificial Sequence: Synthetic coding sequence
atgctgcagaccctgtacgactacttctggtgggagcggctgtggttgccagtgaaccttacatgggcagatctggaagatagggatggacgcgtttatgcaaaagctagtgatttgtacataacccttccactcgcactcctgtttttaatagtgaggtacttctttgagctctacgtcgctacccccctggccgccctgctgaacattaaggagaaaacaaggctgcgggcacctccaaatgccacattggaacatttttacctcacttccggcaagcagcccaagcaggtggaggtcgaactgcttagtcggcaatccgggttaagtgggagacaagtcgaaaggtggtttcgacgccgccgaaatcaggatcgtccatccttgtag

SEQ ID NO: 40898 - DNA, 672 bp, Artificial Sequence
  Description of Artificial Sequence: Synthetic coding sequence
atgctgcagaccctgtacgactacttctggtgggagcggctgtggttgccagtgaacctgacatgggctgacttggaggatcgggacggcagagtatacgccaaggccagcgatctctatataaccttgcctctggccctccttttcttgattgtgcggtatttctttgaactttatgtggcgacaccactcgcagccttgctgaacatcaaagaaaaaaccaggctgcgcgcaccccccaacgcgacactcgagcatttttaccttacatccgggaaacagcctaaacaggttgaagtggagctccttagccggcaaagcgggctaagtgggagacaggtggagcgctggttccggcgacgcaggaaccaagatagaccgtccctgctcaagaagttccgcgaggcatcatggcgattcactttttacctgattgcattcatcgccggcatggcggtcatcgtggataaaccatggttctacgacatgaagaaagtttgggagggatacccaatacaatccactattccgtcacagtactggtattacatgattgagttatctttttattggagtttattattttcgattgcgagcgatgtcaaaagaaaagatttcaaggaacagataattcaccacgtggcgaccattatcttgatctcttttagttag

SEQ ID NO: 40899 - DNA, 1152 bp, Artificial Sequence
  Description of Artificial Sequence: Synthetic coding sequence
atgttctggaccttcaaggagtggttctggctggagcggttctggctgcccccaactatcaagtggagtgatctggaagaccatgatggcttggtgttcgtgaaaccttctcacctttatgtgactatcccttatgccttcctgctgcttatcattcgtagggttttcgagaagtttgtcgcctcacccctggcgaagagctttgggatcaaggaaacggtacggaaagtgacaccaaacaccgtcctggaaaatttctttaaacactcaacccgccagccactgcagacagacatttacggcctcgccaagaagtgtaacctgaccgagagacaagtcgaacggtggtttcgctctagaaggaatcaggagaggccatccaggcttaagaaatttcaggaggcttgttggagatttgccttctaccttatgatcaccgtagccggaattgctttcctctacgataagccatggttgtacgatttatgggaggtgtggaacgggtatcccaaacaacctctgctgccctctcagtactggtattatatcctcgaaatgtcattctattggtcattgctattccgcctagggtttgacgttaaacggaaggattttttggcccacattatccatcacctggcggcgatctcactgatgtcttttagctggtgtgccaattatattagaagtggaactctggtgatgattgtacacgacgtggcagacatatggctagaatcagccaagatgttcagctacgctggttggacccagacgtgtaatacacttttcttcatcttctctaccatattctttatctcccggctgattgtgtttccattctggatcctctactgtactctgatcctccctatgtatcacctcgagccatttttcagttacatctttctgaacttgcagcttatgatcctgcaggtgcttcacctgtactggggctattacattctgaaaatgttaaacaggtgtatctttatgaagtccatccaagacgtacggagtgatgatgaagattacgaggaagaggaggaagaggaggaagaggaagccacaaagggaaaagagatggactgtctcaaaaatggactaagggccgagagacacctcatacctaacggacagcacggccattag

SEQ ID NO: 40900 - DNA, 1152 bp, Artificial Sequence
  Description of Artificial Sequence: Synthetic coding sequence
atgttctggaccttcaaggagtggttctggctggagcggttctggctgcctcccactataaaatggtctgatttggaggaccacgacgggctggtatttgtcaagccatcacatctgtatgtgaccattccctacgcatttttgttgctcattatccgcagagtgtttgagaaatttgtagctagccccctcgctaaatcatttgggataaaagaaaccgtgcgtaaggtcaccccgaacacggttttggaaaattttttcaaacattccacaaggcagcctctgcagaccgacatttatgggctggcaaagaaatgtaatttgacagagcgtcaagtggagagatggttccgctcgcgaagaaaccaggaaaggccctctcggttaaagaagttccaggaggcctgctggaggttcgccttctacctaatgatcacagtagctggaattgcatttttatacgataaaccctggctgtatgacttgtgggaagtgtggaatggctatcccaaacaacctttgctgcccagccagtactggtattatattcttgaaatgtccttctattggtctcttctctttagactgggttttgatgtgaagcgaaaggacttcctggcgcatataatccaccatctcgccgctatctcacttatgtcgttcagctggtgcgccaattacatccgctctggcacgttagtcatgatcgtccacgacgtggctgatatatggttggaatcggcaaagatgttcagttacgccgggtggacccaaacctgcaataccctgtttttcatcttcagtaccatattcttcatcagcagactgatcgttttcccgttttggatcctatattgtacccttatcttgcctatgtatcatttggaaccttttttctcttacatctttctaaacctgcagctaatgatcctgcaggttctgcatttgtattggggatattatattttgaaaatgctcaaccgatgcattttcatgaaaagcatccaggacgtgagatctgacgatgaagactacgaggaagaagaggaggaagaggaagaggaagccaccaagggaaaggagatggactgcttgaaaaacggactgcgcgccgaaagacacctaattcctaacggccagcacggccactag

SEQ ID NO: 40901 - DNA, 1152 bp, Artificial Sequence
  Description of Artificial Sequence: Synthetic coding sequence
atgttctggaccttcaaggagtggttctggctggagcggttctggctgccgcccactatcaagtggtccgatctggaggatcatgacggcctcgtgtttgtgaagcccagccacttgtatgtaaccattccttatgcctttctactcctgatcattcgaagggtctttgaaaagttcgttgcatcacccctggctaaatcatttggcattaaagagaccgtacgcaaagtgacacctaataccgttctggaaaatttcttcaagcactcaacaaggcaacccttgcagactgacatttacgggctcgcaaaaaaatgcaatctgaccgaaagacaggttgagaggtggttccgatcaaggcgcaaccaggaacggccttcgagactgaaaaagttccaggaggcttgctggcgtttcgccttttatcttatgatcacagtcgcaggcatcgccttcctgtatgacaagccctggctctacgacctctgggaagtgtggaacggctatccaaaacaacccctgcttccgagtcaatactggtactatatccttgaaatgtctttttactggagtctcctctttaggttgggcttcgacgtaaaaaggaaggatttcctcgcgcatatcatccaccatctggctgccataagcctgatgtccttttcttggtgcgccaattatatccgatctggcaccctggtgatgatcgtgcacgatgtcgctgatatctggctggaaagtgcgaagatgttctcgtacgccggctggacccaaacctgtaacactctttttttcatttttagcactattttctttatatctagactgattgtcttcccattttggatcctgtattgcacattgattctgcccatgtaccacctggagcctttctttagctacatatttctcaatttgcagctcatgatcctccaggtgcttcacctctactggggctactacattctgaaaatgctcaaccggtgcatattcatgaaaagtattcaggacgtgaggagcgatgacgaggattacgaggaggaagaggaggaagaagaagaagaagctacaaaaggaaaagagatggattgtctgaagaatggacttcgggcagaaagacatcttatccctaacggccaacacggccattag

SEQ ID NO: 40902 - DNA, 468 bp, Artificial Sequence
  Description of Artificial Sequence: Synthetic coding sequence
atgttctggaccttcaaggagtggttctggctggagcggttctggctgccaccgacaatcaaatggtctgacctagaggaccacgacggcctggtgttcgtcaagcctagccacctctatgtgaccatcccttatgcctttctcctcttaatcattagacgagtatttgaaaaatttgtggcctctcctctggctaagtcctttgggattaaggagacagtccggaaggttactccaaatactgtgctggagaacttcttcaagcactcgacaaggcagccgctccagaccgacatctatggcctggctaaaaagtgcaatctgaccgaaaggcaagtggaaaggtggttccgctcgcgccggaaccaagagcgccctagccggctaaaaaagtttcaagaagcctgttggagatttgcattctatttgatgataactgttgctggaatcgccttcttgtacgactag

SEQ ID NO: 40903 - DNA, 48 bp, Artificial Sequence
  Description of Artificial Sequence: Synthetic coding sequence
atgttctggaccttcaaggagtggttctggctggagcggttctggtag

SEQ ID NO: 40904 - DNA, 174 bp, Artificial Sequence
  Description of Artificial Sequence: Synthetic coding sequence
atgttctggaccttcaaggagtggttctggctggagcggttctggctaccgcctaccatcaagtggagcgatttggaagaccatgatggccttgtcttcgtcaagccttctcatctgtacgtaactatcccgtatgctttcctgctccttataatcagacgtgtgtttgagtag

SEQ ID NO: 40905 - DNA, 1185 bp, Artificial Sequence
  Description of Artificial Sequence: Synthetic coding sequence
atgctgagcagcttcaacgagtggttctggcaggaccggttctggctgccgccaaacgtgacttggacagaactggaggaccgcgacggtcgcgtctacccccacccccaggacctcctcgccgcattacccctggctctggtgttgctggctatgaggcttgctttcgagagatttatcggccttcccctgtccagatggctcggcgttagggaccagacacgacgtcaagtgaaaccaaacgctacactcgagaagcactttctaaccgaggggcaccgacccaaagagccccagctctctctgcttgcagctcaatgcggtctgacactacaacagacccaacgatggtttcgaaggcggcggaaccaggaccggcctcagctcacaaaaaaattttgtgaagcttcatggcggtttctcttctatttaagctccttcgtcgggggactgtcagtgttatatcacgagtcatggctttgggcccctgtgatgtgctgggataggtacccaaaccaaacactgaagccttctctttattggtggtatctgctggaactcgggttctacctgtccctcttaatccgcctccccttcgacgttaagagaaaagacttcaaagaacaggtcattcaccactttgtcgccgtgatccttatgaccttcagctactcagctaacttactcagaatcggctcattagtattactgctgcacgacagctccgactacctccttgaggcttgcaaaatggtgaactacatgcagtaccagcaagtgtgcgacgcactcttcctcatcttcagttttgtgttcttctatacacggctggtcctttttccaactcagatcctctacacgacctactacgaatcaatttccaaccgggggcctttttttggatactatttctttaatggcctgctgatgctgctacagctgctgcacgtcttctggagctgtctcattcttaggatgctgtattcttttatgaagaaagggcagatggagaaagacatccgcagcgacgtcgaggagtctgactccagcgaggaagccgctgctgcccaggagcctctgcagctgaagaacggggcagcgggaggacctagaccggccccaacggatggaccacgatcacgagtagcaggcagactaaccaacagacacaccaccgcaacatag

SEQ ID NO: 40906 - DNA, 342 bp, Artificial Sequence
  Description of Artificial Sequence: Synthetic coding sequence
atgctgagcagcttcaacgagtggttctggcaggaccggttctggctaccgcctaatgtgacctggaccgaactcgaggacagagatggtcgagtctaccctcatccacaggatctcttggcagccctgcctctggctctggtgctcttagccatgcgcctggccttcgaacgatttattggtctgccgttgtctcgatggttaggggtccgcgaccaaactaggcgacaggtcaagcccaatgcaactctggaaaaacattttctaaccgagggccatcgcccaaaagagcctcaactgagcttgctcgctgcccagtgcggtttaacattacagcagtag

SEQ ID NO: 40907 - DNA, 579 bp, Artificial Sequence
  Description of Artificial Sequence: Synthetic coding sequence
atgctgagcagcttcaacgagtggttctggcaggaccggttctggctccctccaaatgtcacttggaccgaactcgaagaccgtgacggcagggtctacccccacccacaagatctgcttgccgctctccctttggccctcgtgttattggcaatgaggctggcttttgagcgttttattggtctgccgctgagcagatggttgggcgtgagggaccagacacgacgccaagtgaagccaaacgccactctggaaaagcactttctcaccgagggacataggcccaaggagcctcagctaagcctgctggccgcccagtgcggtctcaccttacaacagactcaacgctggttcagaagacgccggaaccaagacaggccacagctcactaaaaaattctgtgaggcttcttggcggtttctcttttatctgtcgtctttcgtcggggggctctccgtcttataccatgaaagttggctgtgggctcctgttatgtgctgggaccgctacccaaatcagacactcaagccctctctgtactggtggtatctgctggagctgggcttctacctatcctag

SEQ ID NO: 40908 - DNA, 1185 bp, Artificial Sequence
  Description of Artificial Sequence: Synthetic coding sequence
atgctgagcagcttcaacgagtggttctggcaggaccggttctggctcccgccgaatgtgacttggacagagctggaggacagagacggtagagtctacccccacccccaggatcttctggcagccctgcccctggccctagtgctgctggccatgaggctagcctttgagagattcattggccttcccctcagccgatggctcggagtccgggatcagacacgccgccaggtgaaacccaatgctacgctggaaaagcactttttaaccgagggtcacaggcctaaagagcctcagctgtccctcttggccgcccagtgtggccttactctccagcagactcagagatggtttcgcagaaggcgcaatcaggatagaccccagctgactaagaagttttgtgaagcctcctggcggttcctcttctacctatcctcatttgtagggggtctgagcgtcctctaccacgagtcatggctatgggcacccgtaatgtgttgggaccgataccccaatcagacgcttaagccctcactctactggtggtacctgttggagctgggattctatctgtctctgttgatccgacttccgtttgacgtcaaaagaaaggacttcaaagagcaggttatacaccatttcgtcgccgtgatattgatgaccttctcttactctgcgaacttattacgaattgggtctcttgtgctgcttctgcacgattctagcgattatctgctggaggcttgcaagatggtgaattatatgcagtatcagcaagtgtgcgatgcactcttcttgatcttttctttcgtcttcttttacacacgcctggtgttatttccgacccaaattctctatacaacgtattacgagtcgatcagtaaccgggggccttttttcgggtactacttttttaacggcctgcttatgcttctccagctgttacatgtcttttggagctgcttgattctgcgcatgctgtatagcttcatgaaaaaaggacaaatggagaaagatattcgatccgatgtcgaagagagtgattcgagcgaggaggccgccgcagcccaggaacctcttcagctgaagaacggcgctgctggtgggccgcgtccagccccgacagatggccctcgatcaagagtagccggacggttgacgaaccgacatacgacagctacatag

SEQ ID NO: 40909 - DNA, 99 bp, Artificial Sequence
  Description of Artificial Sequence: Synthetic coding sequence
atgctgagcagcttcaacgagtggttctggcaggaccggttctggcttccccctaacgtgacatggactgagctggaagatcgtgacgggagggtgtag

SEQ ID NO: 40910 - DNA, 279 bp, Artificial Sequence
  Description of Artificial Sequence: Synthetic coding sequence
atgctgagcagcttcaacgagtggttctggcaggaccggttctggcttccaccaaacgtcacttggacagagcttgaagatagggatggacgggtatatccacacccacaagatttgctcgccgcactgccattagcactggttctcttagccatgcgtctggcttttgagaggtttatcggcctgcccctttccagatggctgggcgtaagagaccagacacgcagacaggtgaaacccaacgccacactcgagaaacatttcctcaccgagggatag

SEQ ID NO: 40911 - DNA, 1179 bp, Artificial Sequence
  Description of Artificial Sequence: Synthetic coding sequence
atggccaccgccgcccagggccccctgagcctgctgtggggctggctttggtctgagaggttttggctgcctgagaatgtgtcgtgggcggacctcgagggccccgctgatggctacgggtatcccagaggtcggcatatactgtctgtgttccccttagcagcaggcatattcttcgtgaggctacttttcgagcgctttatcgcgaaaccgtgcgccttgtgcataggcattgaagactcgggcccttaccaggcccagccgaatgctattctggagaaggtgtttattagcatcaccaagtatcctgacaagaagaggctggagggcctgtccaagcagctggattggaatgtccggaaaatccagtgctggttcagacataggcggaaccaagacaaaccacctactcttaccaagttttgcgagtcgatgtggagattcacgttctacctttgtattttctgttacggtattaggtttctgtggagttccccctggttctgggacatacggcagtgctggcacaactatcccttccagccactaagtagcggactgtatcactactatatcatggaactggccttctattggagtctgatgttcagtcagtttaccgacataaaaagaaaggacttccttattatgttcgtgcaccatctagtgacaatcggactgattagcttctcctatatcaataatatggtgagggtgggaacactgatcatgtgtctccacgatgttagcgattttttgctcgaagccgctaagttggcaaattatgcaaaatatcaacgcctgtgcgacacgctgtttgtgattttttctgcagtgttcatggttacgagactcggaatctatccattctggattctgaacacaacccttttcgagtcctgggaaataattggtccttacgcaagctggtggctcttgaacggcctgctgctcacactgcaactgcttcatgtgatctggtcctacctgatcgcccgaatagccctgaaagctctgatcagagggaaagtgtccaaagacgaccggtcagacgtggagagttccagtgaggaagaggatgtgacaacctgcactaaatctccgtgtgatagcagctccagcaacggcgctaaccgtgtgaatgggcacatgggagggtcatactgggccgaagaatag

SEQ ID NO: 40912 - DNA, 588 bp, Artificial Sequence
  Description of Artificial Sequence: Synthetic coding sequence
atggccaccgccgcccagggccccctgagcctgctgtggggctggctgtggtctgaaaggttctggctgcccgagaacgtttcttgggcggacctggagggcccagcagatggctatggatacccacgcgggcggcatatcctgtcagtgtttccgctggccgccggtatctttttcgttcgactgctcttcgagcgttttatcgccaagccctgcgcgctctgtataggaatagaggatagtgggccctatcaggcccaacctaatgctatcctggaaaaggtgtttatcagtatcacgaagtatcctgacaaaaagagactagagggtctcagcaagcaacttgattggaatgtgcgaaaaattcagtgttggttcagacaccggcgtaaccaggacaaacccccaaccttgacaaagttttgcgagtcaatccacctggggtctggaaccagcgatagtgctgggatcaccattcatttcagtctctttcaggtcggtttcattaccattatcagttggaattggcctagcatcggcccattgtgcttcttgagtctgcagaccctgaaggagcgcacatcctag

SEQ ID NO: 40913 - DNA, 1005 bp, Artificial Sequence
  Description of Artificial Sequence: Synthetic coding sequence
atgatgaagccccggcccaagcggttcatcgccaagccctgcgccttgtgtattggtattgaagatagtggaccttatcaggcacagcctaacgctatacttgagaaggtcttcatctccatcacgaagtatcctgacaagaagcgcctcgaaggcctgtccaagcaactggattggaatgtgcgtaagattcaatgctggtttcggcatagacggaatcaggataagcctcctaccctgaccaagttttgcgagtccatgtggcgcttcaccttttacctgtgcatcttttgctatgggatccgcttcctgtggtcatccccctggttctgggacattaggcaatgctggcacaactacccatttcagccacttagcagtgggctctaccattattacatcatggagctggccttttattggagtcttatgttctcacagtttacggatataaagcgtaaggactttctcatcatgttcgtccatcacctagtgactattggcttgatatctttttcctatatcaacaatatggtacgcgttgggactctgattatgtgcctgcacgacgtgtccgatttcttattagaagccgctaaactggctaattacgccaagtatcagcgattgtgcgacaccctgttcgtgatcttttctgctgtcttcatggtcactcgtcttggcatatatcctttttggatcctgaacaccaccttatttgagtcgtgggagatcattggcccctatgcctcttggtggttgttaaatggcctcctcctcacgctccaattgttacacgtgatctggtcttatttgatcgctcggatagctctgaaggccctgatccgcggaaaagtgtcgaaggacgacaggtccgacgtagaatcatcctccgaggaagaggacgttacaacatgcaccaagtctccgtgcgattccagtagctctaatggagccaatagggtgaatggccatatgggagggtcctactgggcagaggagtag

SEQ ID NO: 40914 - DNA, 588 bp, Artificial Sequence
  Description of Artificial Sequence: Synthetic coding sequence
atggccaccgccgcccagggccccctgagcctgctgtggggctggctctggtccgaaagattctggctgccagaaaatgtctcctgggccgatctggagggaccagcggacggatacggataccctaggggtagacatattctctcagtgttcccacttgcggcaggtatatttttcgtgagactactgtttgagcgatttatcgccaagccgtgtgctttatgtattggaatcgaggacagtggtccataccaagctcagcccaacgcgatacttgaaaaagtgttcatctcaattacaaagtaccccgataagaaaaggcttgaaggcctttcaaaacaactagattggaatgtccggaagatccagtgctggtttaggcatcgtcggaatcaggataaacctcccaccctgacaaaattttgcgaatccatacacctaggctcaggcacatcggatagcgccggcatcacgattcatttttctcttttccaggtaggcttcatcacaataatctcctggaactggccctccattggcccgttatgtttcttgtcccttcagacgctcaaggagagaacatcttag

SEQ ID NO: 40915 - DNA, 1155 bp, Artificial Sequence
  Description of Artificial Sequence: Synthetic coding sequence
atggccggcatcctggcctggttctggaacgagcggttctggctgccccacaatgtgacatgggcagatttgaaaaatacggaggaagccaccttcccacaagccgaagacctgtacttggccttccctctggccttttgcatctttatggtgaggcttatcttcgaacgcttcgtggctaaaccctgtgccatcgccttgaatattcaagctaacggcccacagatcgctccacctaacgccatcctggaaaaggtgttcaccgctatcaccaagcatcccgacgaaaagcgcctagaggggctgtccaaacaattggattgggatgtacggagcattcagagatggtttcgccaacgccgaaaccaagagaagccttcaaccctgacacggttttgcgagagtatgtggcggtttagcttttacttgtacgtgtttacatacggcgttaggttcctgaaaaagacaccgtggttatggaacactaggcactgctggtacaactacccctaccagcctctgactacagacctacactactattatattctggaactgtcgttctactggagcctgatgttcagccagtttaccgatatcaaaagaaaggacttcggtattatgttcctccatcacctagtgtcaatttttctcatcaccttttcgtatgtgaataatatggcaagagttgggacactggtgctgtgcctgcacgattccgcagatgcccttcttgaagcagctaagatggctaattatgctaagtttcagaagatgtgtgacctgctgtttgtaatgttcgcagtcgtattcataacaacacggctcggtattttccctctgtgggtattgaataccacattgtttgagagctgggaaattgtcgggccatatccctcctggtgggtattcaatctcctgttactgctggttcagggcctaaattgcttctggtcttacttgatcgtgaagattgcctgtaaggccgtatctcgcggcaaggtctccaaagacgatcggagcgatatcgaatcaagctccgacgaggaagatagcgaacctccaggtaaaaatccacacaccgcaacaactacaaacggtacatcagggacaaacggttacctcctcactgggagttgctctatggatgactag

SEQ ID NO: 40916 - DNA, 1179 bp, Artificial Sequence
  Description of Artificial Sequence: Synthetic coding sequence
atggccggcatcctggcctggttctggaacgagcggttctggctgcctcacaacgtcacctgggctgatctgaagaatacagaggaggccacttttccacaggccgaggatctgtatctcgcattcccgctcgctttctgcatctttatggttaggctgattttcgagcgctttgtcgcaaagccttgtgcaatcgccctaaacattcaggctaacgggccgcagattgccccccctaatgctatcttagaaaaggtgtttacagccatcacaaagcacccagatgagaagcggctggaaggactgagtaagcagctcgattgggatgtcagatcaattcagaggtggttccggcagcgcagaaatcaagaaaagccttccacactcaccagattctgtgagtctatgtggaggtttagtttttacctgtatgtttttacctatggcgtccgcttcctaaagaaaacaccgtggctgtggaacacacgacactgttggtataattatccttatcagcctctgacgactgatctccattactactacatcttggagctctccttctactggtcactcatgtttagccagttcaccgacatcaaaaggaaagactttggtatcatgttcctgcaccacctcgtaagtatttttttgatcacattctcgtatgtgaacaatatggccagagtggggacgttggtgctatgcttacatgacagtgcggatgcgcttctggaagcagctaaaatggcaaactacgctaaatttcaaaagatgtgcgatctgctgtttgtgatgtttgctgtcgttttcattaccacccgtctcggcatcttccctttgtgggtgctgaatacgacactgttcgagtcctgggagattgtgggaccctacccgagttggtgggtgtttaacctcttgctccttctcgtgcaggggctcaattgcttctggtcttatctcattgtcaaaatcgcatgtaaggccgtgagtcggggaaaggccggtaaatggaatccccttcacgtgtctaaggacgacagaagtgacattgagagcagctccgacgaagaggattcagaacccccaggaaagaacccgcacaccgccaccactacgaatggaacttccggaacgaatgggtatctgcttacagggtcctgtagtatggatgactag

SEQ ID NO: 40917 - DNA, 675 bp, Artificial Sequence
  Description of Artificial Sequence: Synthetic coding sequence
atgcaggcccccggccggggccccctgggcctgcggctgatgatgccagggagacgaggcgctttacgggagcccggcggatgcggcagctgtctgggtgttgccctagcactgcttctcctattgcttcccgcatgttgcccagtccgcgctcaaaatgacactgaacctatcgttctggaaggaaagtgtctggtggtttgtgatagctcaccgagcgctgatggcgctgtgacttctagtctgggtatctccgtacggtctggctcggccaaggtagctttctccgcgacgagatcaacaaaccatgagccatctgagatgtccaatcgcacaatgactatctactttgaccaggtcctcgtaaacattggcaaccacttcgacctggccagcagcatttttgttgcaccaagaaagggcatctacagttttagtttccacgttgtgaaagtctataatcggcagactatccaggtctcactcatgcagaatgggtatccagtgatctctgcctttgctggcgaccaggacgtgacacgcgaggccgcttctaatggggtgttgttgctcatggaacgggaagacaaagtgcacttaaagctggagcgcgggaacctcatggggggctggaagtatagcacattcagtggcttcctggtgttccctctgtag

SEQ ID NO: 40918 - DNA, 1788 bp, Artificial Sequence
  Description of Artificial Sequence: Synthetic coding sequence
atgcgggccgcccgggccgcccccctgctgcagctgctgctgctgttgggaccatggttagaggcggccggcgtggcagagtcccctctgccggccgtcgtgttggccatcctggcaagaaacgccgaacactctctgccccactacttgggggctctcgagagactggattaccccagagcacgaatggccctctggtgtgctaccgaccacaatgtggacaatacaacggagatgcttcaggaatggcttgcagctgtgggcgatgattatgcagccgtggtatggaggcctgagggcgagcctagattctaccctgatgaggagggtcctaaacattggaccaaggagcgacatcaattcctcatggaactaaaacaggaggcgcttacgttcgccagaaactggggggcagattatatcctgtttgctgatactgacaacatactgactaacaatcagaccctgcgtttgcttatgggccaaggactgccggttgtggcccctatgctcgatagccagacctactattccaatttctggtgcgggattacgcctcagggatattacagaagaactgctgaatattttccaactaaaaatagacaaagacgaggatgttttagagtgcctatggttcactcgacgttcctggcaagcctccgcgcggaaggcgctgaccagttggccttctatcctccgcatcccaactatacctggccttttgacgatattattgtattcgcttatgcatgtcaagcagccggagtgtctgtgcatgtgtgtaatgagcacaggtacggatatatgaatgtgcccgtgaagagtcaccaggggttggaggatgagcgcgtgaactttattcaccttatcttggaggctttagtggatggtccccggatgcaggcctcagcccacgtgactaggccaagcaagaggccctccaagattgggtttgatgaggttttcgtgataagcttggccaggaggcctgatcgacgggaaaggatgctagccagcttgtgggaaatggagatcagcggcagggttgtggacgctgtggacggctggatgctaaattctagcgctatccgtaatctcggcgtggatctgctgcccggctaccaagatccctactccggtaggaccttgacaaagggtgaagtaggatgcttcctttcccactattcaatctgggaggaggtggtcgcccggggtttagcgcgagtcctggttttcgaagacgatgtgcggttcgagagcaattttcggggcaggctggagcggcttatggaagatgtggaagcggagaaactcagctgggacctgatttatctgggtcgaaaacaggtgaaccctgaaaaagagacagccgtagaaggacttccaggcctggttgttgccggctattcatactggacgcttgcttatgccttaaggctcgcaggcgctagaaagttgctggccagccagccactgagacgtatgttgcccgtagacgaattccttccaatcatgttcgatcagcaccctaacgagcagtataaagctcacttttggcccagagatctggtggctttttccgcgcaaccgctcctggccgcacctacccactatgccggggacgccgagtggctaagcgacacagagaccagctcaccctgggacgacgattccggacgcctgatctcttggtctggtagccagaaaaccttgcggtctcctcgactggatcttactggttcaagtggtcacagcctgcaaccacagccccgggatgagctttag

SEQ ID NO: 40919 - DNA, 1554 bp, Artificial Sequence
  Description of Artificial Sequence: Synthetic coding sequence
atgctgcaggagtggctggccgccgtgggcgacgactacgccgccgttgtatggaggccggagggagagccaagattttaccccgacgaagagggacctaagcattggactaaagagaggcaccagttcctgatggaattgaaacaggaagctttgactttcgctaggaattggggtgctgattacattctgtttgccgacaccgacaatattctcaccaataatcagactttacgtcttttaatgggccagggactccccgtagtggctccgatgctcgacagtcaaacttactacagcaatttttggtgcggcatcacccctcagggctattacaggcgtactgccgaatacttccccactaaaaacagacagcgacgaggctgtttccgagtgcctatggttcattcgaccttcttggcgtctcttcgtgctgagggggctgaccagttagccttttatccaccacatcctaattacacttggccgtttgacgatatcatcgtgtttgcctacgcttgccaggctgcaggggtgtccgtccatgtgtgcaatgagcaccggtacggatatatgaatgtccctgtaaagagtcaccaaggcctcgaggatgagcgggtaaattttatacacctgatcctggaggcactcgtcgacggacctcgaatgcaagcctcagcgcacgtcactcgtccaagtaaacggccttccaaaattggtttcgacgaggtgtttgtaattagcctggctaggaggcctgaccggcgggagaggatgctggcttcactgtgggaaatggaaattagcggtcgggtcgtagacgccgtggacggatggatgctgaattcctctgcgatcagaaatctaggtgtggatcttctgcccggctaccaagacccatacagcgggagaaccctcactaagggcgaagtcgggtgctttctctctcactactcaatctgggaggaagtcgttgccaggggactggcacgagttttggtctttgaagacgatgtgcgcttcgagtcgaacttccggggtcgcctggagagacttatggaggatgtagaagccgaaaagcttagctgggatttaatctatctgggaagaaagcaggtaaacccagaaaaagagactgcggtcgaaggcctacccggacttgtggtcgccggttactcttattggacactggcgtatgctctaagattggccggagccagaaagctacttgccagtcagcccctgcgacgaatgttacctgtcgacgagtttttgcctattatgtttgatcagcaccctaatgagcaatacaaggctcatttctggcctcgggacctcgtcgcattttcagctcaacccttgctggccgcaccgacacattacgctggcgatgccgagtggctgagcgacaccgaaaccagctcgccatgggacgacgattctggtaggttaattagttggagcggatcacagaaaacgctaaggagtcctagactggatttgaccggtagctctggccactctctccagcctcaacctcgggacgagctctag

SEQ ID NO: 40920 - DNA, 240 bp, Artificial Sequence
  Description of Artificial Sequence: Synthetic coding sequence
atgctgcaggagtggctggccgccgtgggcgacgactacgccgccgtggtgtggcggccagagggtgagccgcgcttttatccagacgaggaggggcccaaacactggaccaaggaacggcatcaatttttgatggagcttaagcaggaggccctgacatttgcccgaaactggggcgccgattacatcctgtttgcagacactgacaacattctcactaataaccaaacactgcggtag

SEQ ID NO: 40921 - DNA, 1647 bp, Artificial Sequence
  Description of Artificial Sequence: Synthetic coding sequence
atgcgggccgcccgggccgcccccctgctgcagctgctgctgctgttaggcccctggctcgaggccgccggggtggcggagtctccgctgcccgccgtcgtcctggcaatccttgccagaaacgccgagcactccctcccgcactacctcggcgccttagaaaggttagactacccccacgaagagggtccaaaacactggacaaaggagagacatcagtttctgatggagctgaaacaggaagctcttactttcgcccggaactggggggccgactatatcctatttgccgatactgacaatattctgaccaataaccagactctgaggctcttgatgggccagggactacccgtggttgctccgatgctggattcacagacttactattccaatttttggtgcgggattaccccccagggttactataggcggactgccgagtatttcccaactaaaaaccgtcagagacgaggatgtttcagggtaccaatggtacactcgaccttccttgcttcgttacgtgccgagggcgccgaccaactcgccttctacccaccccaccctaattacacgtggcctttcgacgatatcattgtattcgcctacgcttgtcaagcagctggcgtcagcgtccacgtgtgtaatgaacaccgatatggttatatgaatgtgcccgtgaagtctcaccaggggctggaagacgagcgagttaactttatccatctgatcctcgaagcacttgtcgacggcccacgcatgcaggcttctgcgcatgtaaccagacccagtaagaggccatccaagattgggttcgacgaggtttttgtgattagcttggctcgacggcccgacaggcgggaaagaatgctggcatcattgtgggaaatggaaattagcggacgggttgttgacgcagtagacggctggatgctcaacagttctgccatccgcaatttaggcgtcgatctgcttcccggataccaggatccatattctggaaggacgctgactaaaggggaagtgggctgtttccttagccattactcaatctgggaagaggtcgtggcacgcggcctagccagggtgcttgttttcgaagatgacgtaaggtttgaaagcaactttagagggagactggaacgcctgatggaggatgtcgaagcagagaagctgtcctgggatctcatctacttgggaaggaaacaggttaacccggagaaagagacggcggtggagggcctaccgggactggtcgtagccgggtatagttattggaccctcgcctatgctctcagactggcaggggcacgtaagctcctcgcttcacagccactgaggcggatgctgcctgttgacgaattcctccctataatgtttgatcagcatcccaacgagcagtacaaggcccatttttggccaagagatctcgtcgcgttctccgcccaacctctgttagccgccccaacccattacgccggtgatgccgaatggttgagtgacaccgaaaccagcagtccctgggacgacgatagcggacggcttatctcctggagcggatcacagaaaacgctgcgatcccctagactggacctaaccggctccagcgggcattccctacaacctcagccccgggacgagctctag

SEQ ID NO: 40922 - DNA, 195 bp, Artificial Sequence
  Description of Artificial Sequence: Synthetic coding sequence
atgctgcaggagtggctggccgccgtgggcgacgactacgccgccgtcgtctggcgtccagagggggagcccagattttatcccgacgaggaaggtcccaaacactggacgaaggagcgacaccagttcttgatggaattaaagcaggaagccctgacattcgctcggaattggggagcagattatatcttgtag

SEQ ID NO: 40923 - DNA, 657 bp, Artificial Sequence
  Description of Artificial Sequence: Synthetic coding sequence
atgctgcaggagtggctggccgccgtgggcgacgactacgccgccgtggtgtggagacctgaaggggaaccacgtttctatcccgatgaggagggccctaaacattggacgaaagaaaggcatcagtttcttatggagctgaagcaggaggcactcacctttgcccggaattggggtgccgattatattctgtttgcagacacggacaacatattaacaaacaaccaaaccctcaggttactcatgggtcagggcctgcctgtagtggcacccatgttggattcgcaaacatactactcgaacttttggtgtggtatcacaccgcaggggtactacagaagaactgccgaatacttcccaacaaagaacagacagcggcgaggctgctttcgcgtgccaatggtgcactctactttcctggcttctctgcgggctgaaggggccgaccaactcgcgttctaccctcctcatccaaattacacatggccgttcgatgatattatcgtctttgcatacgcctgtcaagctgctggcgtaagtgtgcatgtctgtaacgaacatcggtatggttatatgaacgtgccagtcaagagtcaccagggtcttgaagatgagagggttaattttattcatctgatcctcgaggctctcgggtag

SEQ ID NO: 40924 - DNA, 330 bp, Artificial Sequence
  Description of Artificial Sequence: Synthetic coding sequence
atgctgcaggagtggctggccgccgtgggcgacgactacgccgccgtggtctggagaccagagggcgaaccacggttctaccccgatgaggaaggcccgaagcactggacaaaagaacgtcatcaatttctaatggaactcaaacaggaggcgctgaccttcgcacggaactggggcgctgactacatcctattcgcagacactgacaacatactgaccaataaccagaccttgagacttctcatggggcaaggcctaccagtggtggctccgatgttagatagccaaacctactacagcaacttttggtgtggcatcactccacagtag

SEQ ID NO: 40925 - DNA, 348 bp, Artificial Sequence
  Description of Artificial Sequence: Synthetic coding sequence
atggaggtgaaggacgccaacagcgccctgctgagcaactacgagactctgaaatacattagcaagactccctgccggcaccagtctccagagattgttcgggagttcttgaccgcactcaagtctcacaagctcaccaaggcagaaaaacttcagctcctgaaccatcggcccgtcaccgcggtagaaattcaattgatggttgaggagtctgaggagcgcctcacggaagaacagatagaggctctgctgcacaccgtgacatcaattctacctgctgagcctgaagccgaacagaagaagaatacgaactccaatgtggcaatggacgaagaagatccagcgtag

SEQ ID NO: 40926 - DNA, 447 bp, Artificial Sequence
  Description of Artificial Sequence: Synthetic coding sequence
atggaggtgaaggacgccaacagcgccctgctgagcaactacgaggtgtttcagttgctgacagacctcaaagagcagagaaaagagagcggtaaaaacaaacattcatccggccagcagaatctgaatactataacttacgagacactaaaatatatttccaaaacaccttgcaggcaccagtcaccagaaattgtacgagagtttctgactgcccttaagagtcacaaactgacgaaagcagaaaagctacagttgctgaatcaccgtccggtcactgccgtggaaattcaactcatggtcgaggagtccgaggagcgcctcacagaggagcagatcgaggctctcctgcacacggtgacttcaatcctgccagcggaacctgaagccgagcaaaagaaaaacaccaactctaatgtggcaatggacgaggaggatcctgcttag

SEQ ID NO: 40927 - DNA, 216 bp, Artificial Sequence
  Description of Artificial Sequence: Synthetic coding sequence
atggaggtggccgagaagctgcagctgctgaaccaccggcccgtgactgcggtggaaatccagctaatggtcgaagaatcagaagaacgcctcactgaagagcagatagaggccctgttgcacacagtgacatccattctcccagcagaaccagaagcagagcaaaagaaaaacacaaacagtaatgtggcaatggacgaggaggacccagcttag

SEQ ID NO: 40928 - DNA, 348 bp, Artificial Sequence
  Description of Artificial Sequence: Synthetic coding sequence
atggagatgaaggacgccaacagcgccctgctgagcaactacgagacactcaagtacattagcaagaccccctgccgccaccaatctccagagatcgtgcgtgaatttcttactgcactcaagtctcataagctcacgaaggccgagaaattgcagcttctcaatcacagaccggtgacagctgtagagatccagctgatggtggaagagtccgaagaacgtcttactgaggagcaaatcgaggctctcctccatacagttacctcaattctccctgctgaaccagaggccgagcagaagaagaacactaactccaatgtggcaatggatgaggaagacccggcctag

SEQ ID NO: 40929 - DNA, 426 bp, Artificial Sequence
  Description of Artificial Sequence: Synthetic coding sequence
atgcagcggggcgaccccggcgagcacctgggcgcccggagctggcatctgggagccgtgggcggcggtggggactcctgtgaggtaaaggacgccaactcagccctgcttagcaattatgagacacttaagtatatttctaaaactccctgcaggcatcagtcgccagagatcgtgcgggaatttctcactgcattgaagagccacaaattgaccaaagccgaaaaactgcaactcctgaaccaccgacctgtgacagccgttgaaatacagctaatggtggaagaaagtgaggagagactcaccgaagaacagatcgaggcgctgttgcataccgtcactagcatcttgcccgccgaaccagaagctgagcagaaaaagaacacaaacagcaatgttgccatggacgaagaggatccagcctag

SEQ ID NO: 40930 - DNA, 702 bp, Artificial Sequence
  Description of Artificial Sequence: Synthetic coding sequence
atgagcaagctgggcaagttcttcaagggcggcggcagcagcaagtcccgggctgctccctccccccaggaggccctggtgcgcctgcgggagacggaggagatgttgggaaaaaaacaggagtatctggaaaatcgaatacaacgcgagatagctctggccaagaaacacggcactcagaacaaacgggcagctctccaagcactgaaacgaaaaaagcgctttgaaaagcaacttacgcagatagatggcacattgtctacaatagagtttcagagggaagcattagagaacagtcacaccaacacagaagtattgaggaacatgggctttgccgcaaaggctatgaagagcgtgcacgagaacatggacctcaataagatcgatgatctcatgcaggagataacggaacaacaggacatcgcccaggaaattagtgaggcattttcacagagagttggttttggggatgactttgatgaagacgaactgatggctgaattagaagagctggaacaggaggagctgaacaagaaaatgaccaacatacgattgcccaatgtgccctcctcatctctccccgcccaacccaaccggaaacctggaatgtctagcacagctaggcgcagcagggcggcttccagccagcgagcagaagaggaggacgatgatatcaagcaattagcagcctgggcaacatag

SEQ ID NO: 40931 - DNA, 1293 bp, Artificial Sequence
  Description of Artificial Sequence: Synthetic coding sequence
atgctgtgcagcctgctgctgtgcgagtgcctgctgctggtggccggatacgcccacgacgacgattggattgaccccactgatatgttaaattatgacgcagcatcaggaacaatgaggaaatctcaggctaaatacggtatttccggagaaaaggatgtatcccccgatctcagctgtgctgatgagatctcagaatgttaccacaaattagatagccttacctataagatcgacgagtgcgagaaaaaaaaacgcgaagattatgaaagtcagtccaacccggtctttaggcggtacctgaataaaatccttatcgaggctggtaagcttggccttttggccttcgcccagcatcaagccgaggtggccaaaatggagccactgaataatgtctgtgctaagaagatggattggaccggatccatttgggagtggttccgttcttcctggacttataaggacgatccttgccagaaatattacgagttgctgttagtgaatccaatctggctggtgcctcccaccaaagcactcgctgtgaccttcacgaccttcgtgactgagcccttaaagcatatcgggaagggcacgggtgagttcatcaaggcactgatgaaggaaattccggcccttctgcacctgcccgtgctgattatcatggccttagcaatcttgtcgttctgttacggggcggggaagtctgtccacgtactccgacacataggcgggccagagtccgaacctccacaagctcttcggccccgcgaccggagaagacaggaggaaatcgattatcgaccagacggaggggccggcgatgcagatttccactatcggggtcagatgggcccaaccgaacagggaccttatgctaaaacttacgaggggagacgagaaattcttcgggagagggacgttgacctgcgattccaaaccggtaataaatccccagaagttcttagggcttttgacgtgccagacgctgaagcaagagagcacccaacagtcgtaccatcacataaatcccctgtcctggacactaaacccaaagagacgggaggaatcttgggtgaaggcacccccaaggagagcagtactgaaagctcacaaagcgcgaagcccgtcagcggccaagatacatccggtaatacagagggttcacccgctgccgagaaggcacagctcaagagcgaggctgccggctctcctgaccagggctccacatacagccccgcacgcggcgtggcaggccctcggggccaggatccagttagtagtccctgtgggtag

SEQ ID NO: 40932 - DNA, 1101 bp, Artificial Sequence
  Description of Artificial Sequence: Synthetic coding sequence
atgctgtgcagcctgctgctgtgcgagtgcctgctgctggtggccggatatgcgcatgacgacgactggatcgaccctacagatatgttgaattacgacgctgcttctggaaccatgcggaaaagtcaggcgaagtacggaatctctggcgagaaagacgtgagcccggacctgtcttgcgcggatgagataagcgagtgttaccataagctggacagtctgacatacaaaatcgacgagtgcgagaagaaaaagagggaggattatgagtcccaatccaaccctgtattcaggagatatctgaacaaaattcttatagaagccggcaaactggggctcgccctcgctgtgacgtttacaacattcgtaactgagcccctgaagcacattggaaaaggcaccggtgaattcatcaaggccttgatgaaggagattcctgctctcctgcatctcccagtgttgatcattatggctctcgctatcctatctttttgctatggcgccggtaagtctgtccatgtgttacgtcatatagggggcccagagagcgagcctccacaagcgcttaggcctcgagatagacgccggcaggaggagattgattaccgcccagatgggggcgccggcgacgctgattttcactaccgagggcagatgggtcccactgagcaggggccctacgctaagacttatgagggccgtagggagattctccgcgaacgcgatgtggacttacggttccagaccggtaataaatccccagaagtgctacgtgccttcgatgtgccagacgccgaggcccgagaacaccctactgtggtgcctagccacaagagcccagtcctcgacacaaagcctaaggagacaggcggcatcctcggggagggaaccccgaaggaaagtagcactgagtcatctcagagtgccaaaccggtgtctggacaggatacctcaggcaacactgaaggttctccggccgccgagaaagcgcagttgaaaagcgaggctgcaggatcacctgaccagggatctacatattctcccgccaggggtgtagctggaccaagaggccaggatcctgtgtcaagcccatgtgggtag

SEQ ID NO: 40933 - DNA, 1656 bp, Artificial Sequence
  Description of Artificial Sequence: Synthetic coding sequence
atgctgtgcagcctgctgctgtgcgagtgcctgctgctggtggccggttacgcccatgacgacgactggattgacccgactgatatgttgaactacgatgccgctagcggaacaatgcggaagtctcaagcaaaatacggcatttctggggaaaaagatgtgtcccctgatcttagttgtgccgatgaaattagcgaatgctaccataaactcgactccctcacctacaagatcgatgagtgcgagaaaaagaaacgcgaggactatgagagccagtcgaaccccgtgtttcgccgatatctgaataaaattttgatcgaagcaggaaaactgggcttacccgacgaaaataagggtgacatgcactacgacgcggagattattctcaaacgtgaaacattgctcgaaatccagaagttcttaaacggcgaggattggaagcctggagctttggacgacgctctctcagacatccttattaacttcaaatttcatgactttgagacgtggaagtggaggttcgaggatagcttcggggtcgatccctacaacgtgctgatggtcttgctgtgcctgctgtgcatcgtagtcctcgtagctacagagctgtggacttatgttaggtggtacacacagttgcgccgagtccttatcatttcatttctgttttcgcttggttggaattggatgtacctctataaactcgctttcgcccagcaccaggctgaggtcgcaaagatggaacccctgaataatgtatgtgctaagaagatggactggactggcagtatttgggagtggtttagatccagttggacctataaagacgatccgtgtcaaaaatattacgaacttctattggtgaacccaatatggttggtgccacctaccaaagcactagccgtgacttttactacatttgtcacagagcccttgaagcatattggaaaagggaccggagaatttatcaaagcccttatgaaggaaatacctgccctgctgcatctgcctgtattgattattatggctttggcaattctatccttctgctacggagccgggaagtcagtgcacgtcctacgccatatcgggggcccagaaagcgaaccaccccaggcccttcggcctagggatcgacgcaggcaagaggaaatcgactaccgccctgatggaggtgctggtgacgccgatttccattatcggggccaaatgggtccaacagagcagggcccgtacgctaaaacgtatgaaggtcggagggaaatcctaagagagcgcgatgttgatcttaggtttcagactggcaacaaaagccccgaagtcctaagagctttcgacgtgcccgatgctgaagctagggagcatcctactgtagtgccttctcacaaatccccagtgctcgacactaaaccaaaggagaccggcggtattctgggtgaaggcacccctaaggagagctcaacagaatcttcacagagcgccaagccagtgtctggccaagataccagcggcaataccgaggggtccccagcggccgaaaaggcacaactcaagtccgaggcagcgggaagccccgaccaggggtctacatattcaccggccaggggcgtggcaggcccacgaggacaggaccccgtaagcagcccctgcggctag

SEQ ID NO: 40934 - DNA, 1101 bp, Artificial Sequence
  Description of Artificial Sequence: Synthetic coding sequence
atgctgtgcagcctgctgctgtgcgagtgcctgctgctggtggccgggtacgcccacgacgatgactggattgaccctacagatatgctgaactacgatgccgcatccggtactatgagaaagtctcaggcaaaatatgggatcagcggtgaaaaggacgtgagcccagatttgagctgcgccgacgagatctccgagtgctatcacaagcttgactccctcacttataagatcgacgagtgtgagaagaaaaaacgcgaagattatgaatctcagtccaaccctgttttcagacgttacctgaacaaaatcctcatcgaggctgggaagcttggactggcactggcagtgacctttaccacatttgtgaccgaacctctcaaacacatagggaagggaaccggggagtttatcaaggctctcatgaaggagatacctgccctgcttcatcttcccgttctgattataatggcactggctatcctatcgttttgctatggcgctggaaagtctgtgcacgtccttcggcacattggtggaccggagtctgagcctccacaggccctgaggccccgggatagacgccgccaggaagaaatcgattatcggccagacggcggcgccggcgacgctgactttcactacagaggtcaaatggggcccactgagcagggaccttatgcaaaaacatacgaagggcgcagagaaatcctccgcgagagggatgtcgatctccgctttcaaacaggaaacaagagtcccgaggtcctaagagcctttgatgttcccgatgccgaggctagagaacacccaaccgttgtgccaagccacaaatcgcccgtccttgacacgaagccaaaagagactggaggcatcctgggtgaagggacgcctaaagagagtagcaccgagagctctcagtctgctaaaccagtgagcggacaggacacctctggcaacactgagggctccccagccgccgagaaagcccaacttaaaagtgaagcagccgggtccccggatcaggggagcacgtactcacctgcaaggggggtagcaggccccagaggccaggaccccgtgagctcgccttgtggctag

SEQ ID NO: 40935 - DNA, 1293 bp, Artificial Sequence
  Description of Artificial Sequence: Synthetic coding sequence
atgctgtgcagcctgctgctgtgcgagtgcctgctgctggtggccggctacgcccatgatgatgattggattgaccctaccgatatgcttaactatgatgccgccagcggcaccatgcggaagagtcaggcaaaatacggcatttctggtgaaaaagatgtgagccccgacctgtcatgtgcagacgagattagtgaatgttaccataaattggatagtcttacatataagattgacgagtgcgagaagaagaaacgagaggattatgagtcccagagcaaccctgtgtttcggcggtatttgaacaaaattctaatcgaagcagggaaactcggcctcctcgcctttgcccagcatcaggcagaggttgcaaagatggagccgctaaataacgtatgcgcaaaaaagatggactggacaggtagcatctgggagtggtttagatcatcgtggacgtacaaggatgacccttgtcagaagtattacgaactgctgcttgtgaaccccatctggctggttccccctacgaaagctctagctgttactttcacaacattcgtgaccgagccactgaaacatatcggcaagggaaccggggagttcatcaaggctttaatgaaagaaataccagctttgctgcacctccccgtgctgattatcatggccctggccatccttagtttctgctatggggccggtaaatcggttcacgtactcagacatatcggcggccccgagagtgaacctccacaagccctgaggcctagagataggcggcggcaggaggagatcgattaccgccccgacggaggagccggggacgctgactttcattatcgcggacagatggggcctacggagcagggcccttatgctaagacctacgaggggcgcagggagatcttgagagaaagagatgtcgatttgcgcttccagaccggaaacaagtctcctgaggtgctaagagcattcgacgtcccggacgcagaagcccgcgaacatcctactgtggtgccttctcataagtcacccgttctggatacaaaacctaaggaaacagggggcatactgggcgaggggacgcctaaagagtccagtaccgagtcctctcaaagtgccaaacccgttagcggacaggacacttctggcaacactgaggggagcccagctgccgagaaggcacaactgaaaagtgaagccgctggaagccccgatcagggcagtacgtacagcccggcaaggggagtagctgggccccgagggcaggatcctgtgtcatcgccatgcggatag

SEQ ID NO: 40936 - DNA, 1506 bp, Artificial Sequence
  Description of Artificial Sequence: Synthetic coding sequence
atgctgtgcagcctgctgctgtgcgagtgcctgctgctggtggccggctacgcccatgacgacgactggatcgatccaacagatatgctcaattacgatgctgccagcggtacgatgcgcaaatcgcaggccaaatacggtatttccggagagaaggatgttagccctgatctgagctgcgccgatgagatttctgagtgctaccacaaactcgacagtttaacctataagatagacgagtgtgaaaagaagaagagagaagattatgagtcccaaagcaatcctgtctttaggaggtacctaaataagattctgatcgaggcaggcaaacttggattattccacgattttgagacgtggaaatggaggttcgaagactcttttggcgtggatccctataatgtcttgatggtgttgctatgcttgctgtgcattgtagttctggtggcgactgagctttggacctacgtaaggtggtacacacaacttcggcgtgtgctcattatctcctttttattttctctcgggtggaactggatgtacctgtacaaactggcatttgctcagcaccaggccgaggttgccaagatggagcccctgaacaatgtgtgcgccaaaaaaatggactggacaggctcaatttgggagtggtttcggtcttcctggacctacaaagacgacccctgtcaaaagtattacgagctgctgctggtgaacccaatttggctggtgccccctaccaaagccctcgccgtcacctttactaccttcgtgaccgaaccactgaaacacatcggcaaaggtactggggagtttatcaaggcgttgatgaaggagattcctgcccttctgcatttgcctgtgctcattatcatggccctcgcaattctgtcattctgctacggcgccgggaagtccgttcatgtgctcaggcatattggaggtcctgagtctgagcccccccaggctttgaggcctagagatcgacggaggcaggaggaaatcgactatcgccctgatggcggggctggcgacgccgactttcactatcgcggtcaaatgggtcctaccgagcaaggtccatatgccaaaacctatgagggcaggcgcgagatcctcagagagcgagacgtcgacttgcgctttcagacagggaacaaatcgcctgaggtgctaagagctttcgatgtgcccgatgccgaggccagagagcacccaaccgttgtccctagccataaatcccccgtgctcgacaccaaacctaaagagacaggggggatcctgggagagggcactccaaaggaatcttctaccgagtctagtcagagtgccaagcctgtaagcgggcaagacacatcgggaaatactgaagggtctcctgctgccgagaaagctcagctgaagtcagaagctgccggttcccctgatcagggttcaacctacagccctgcacgtggagttgccggaccccgcggccaggatcccgtgtcttctccttgcgggtag

SEQ ID NO: 40937 - DNA, 1656 bp, Artificial Sequence
  Description of Artificial Sequence: Synthetic coding sequence
atgctgtgcagcctgctgctgtgcgagtgcctgctgctggtggccgggtacgcccatgatgacgactggattgaccccacggatatgttgaactacgacgcagccagcggcaccatgagaaaaagtcaggcgaagtacgggatctctggtgagaaggacgtgagcccagatctcagctgcgcggatgaaatcagcgagtgttatcacaagcttgactcgctaacctacaaaatcgatgaatgcgagaagaaaaaacgcgaagactacgagtcacaatcaaacccggtgttcaggcgatacttaaacaagatcctcatcgaggcgggcaagcttgggctcccagacgaaaataagggagacatgcattatgatgcggagattatcttaaaaagagaaactctcctggagatccagaagttcttgaatggtgaagattggaaaccgggggctctggatgacgccctctcagacatcctcataaacttcaagttccacgatttcgaaacatggaaatggaggttcgaggatagctttggagtggacccttacaacgtcctgatggtgttgctttgcctgctttgtatcgtggtgctggtggcaacagaattatggacctacgtgagatggtacacacaactgcggcgcgtactgattatatccttcctgttttctctgggttggaattggatgtatctgtacaagctggcctttgcccaacatcaagccgaggtggccaaaatggagccactaaacaatgtttgtgccaagaagatggactggaccggctcaatctgggagtggttccgctctagttggacgtacaaggacgatccttgtcagaagtattatgagctgttactcgtgaatccaatttggcttgtcccacctactaaagctctggccgtcactttcaccacttttgttactgaacctttgaaacacataggcaagggcacgggcgagttcattaaagccttgatgaaggaaatccctgcccttctccacctgcctgttttaatcatcatggcgttggctattctgagcttctgctacggggccggaaaaagcgttcacgtcttaagacacataggcggtccagagtctgagccccctcaggcgcttagaccacgagataggagacggcaagaagagatcgactacaggcccgatggaggggccggagacgctgacttccactatcgcggacaaatgggtccaaccgaacaaggcccgtatgcaaaaacatatgaaggtaggagagaaatactgagagagcgagatgtggacttacggttccagacaggaaataaaagccctgaggtgctccgagcctttgatgttcccgacgcggaagccagagagcaccccaccgttgtgccgtctcataagagccctgtcctcgatacaaaacctaaggagaccggcggcatcctgggagaaggcacccctaaggagagctccaccgaaagcagtcagagcgcaaagcccgtgtctggccaggacacatcaggaaacaccgagggatcgcccgccgcagaaaaagcgcagctcaagtccgaggctgcaggcagtccagaccaaggatccacttacagcccagccaggggagtggctggccccagaggacaggaccccgtgagtagcccatgtggatag

SEQ ID NO: 40938 - DNA, 789 bp, Artificial Sequence
  Description of Artificial Sequence: Synthetic coding sequence
atgctgtgcagcctgctgctgtgcgagtgcctgctgctggtggccgggtatgctcacgatgacgactggattgacccgaccgatatgttaaattacgatgccgctagtggtaccatgcggaagagtcaagcgaagtacgggatctccggtgaaaaagacgtgtctccggacctttcatgcgccgacgagatttcagagtgctaccacaaactggacagcctgacatacaagatcgatgagtgtgaaaagaagaagagggaggattacgaaagccagtccaatcccgtgtttagacgctaccttaataaaattctcatcgaggctgggaagctgggccttcccgacgaaaacaagggagacatgcattacgacgcagaaatcatcctgaaaagggagaccctccttgagattcagaagtttctcaatggcgaggactggaagcctggagcgctggacgatgctctgtcagatatattaataaactttaagtttcacgattttgaaacctggaaatggcgatttgaggacagctttggcgtggatccctataatgtccttatggtgttactctgccttctttgcatcgtcgttctggttgcaacagaactttggacttatgtgaggtggtacacgcagctgaggagggtgctgatcatttcctgtgcccagtcagaggccagtagggtgaagcaggtgggcaacttgtttcaggcgtgggcttttgccgtttgtgacccagttcttctgcaggtgcctgtgtgccctatcctggtattctgctacagttag

SEQ ID NO: 40939 - DNA, 1506 bp, Artificial Sequence
  Description of Artificial Sequence: Synthetic coding sequence
atgctgtgcagcctgctgctgtgcgagtgcctgctgctggtggccggatatgcccacgacgatgattggatcgatcccacagacatgctgaactatgatgctgcatccggtaccatgagaaagagtcaggcaaaatacgggataagtggggagaaagatgtctctccagacctgtcttgcgctgatgagattagcgaatgttatcacaagctcgactctctgacttataagatcgacgagtgcgaaaaaaaaaaaagagaggactatgagtcccagtccaatcccgtgttccgccggtacctgaacaagatcctgattgaagctgggaaactgggcctctttcacgactttgaaacatggaaatggcgcttcgaagattctttcggagtggatccctacaatgtcctgatggtactgctctgcttactatgcatcgtagtcttggtggccactgagctgtggacctacgttcggtggtatacgcagttgcggagagttttaattatttcgttcctgttttcattgggctggaattggatgtatttgtacaaattagccttcgcccagcaccaagcagaggtcgcgaagatggagcctctgaacaacgtctgcgctaagaagatggactggacaggcagtatctgggaatggttcaggtcatcctggacgtataaagacgacccgtgtcagaaatactacgaacttttattggttaaccccatctggctcgtcccccccacgaaagcactcgctgttacattcacaacatttgtgaccgagcctctcaagcacatcggcaaaggcacaggggagttcattaaagccttgatgaaagaaataccggctctgctgcacctgcctgttctgattattatggcacttgcaatcctgtctttttgctatggagcaggtaaatcagtccacgtgctacgtcacattggtggcccggaatccgaacctccccaggccctgagaccccgcgatagaaggagacaagaggagatcgactatagacccgacggcggggcaggcgacgccgactttcattacagggggcagatgggccctaccgagcaggggccttatgccaaaacatatgagggacgacgagagatcctgagagagcgggatgtcgatctcagattccagactgggaacaagagtcctgaagtcctgcgtgcttttgatgtgcctgatgccgaagcacgcgagcatcccacggttgttccctctcacaaaagccccgtgctggacacgaagccgaaggagaccggcggaatccttggggaaggtactcctaaggaatcctctacagagtcatcccagtcggcaaagccagtttcgggacaggacactagcggaaacaccgaggggtctccagccgctgaaaaggctcagctgaaatccgaggccgcagggtctcctgatcagggctctacttacagcccagcgcggggggtcgctgggccaagaggccaggatccggtgtcgtcaccatgtggctag

SEQ ID NO: 40940 - DNA, 726 bp, Artificial Sequence
  Description of Artificial Sequence: Synthetic coding sequence
atggccgaggagcagccccaggtggagctgttcgtgaaggccggctctgatggcgccaaaataggaaattgccccttctctcagcgtcttttcatggtattgtggctgaaaggagtgacctttaacgttactaccgtggacaccaagcgccgcaccgagaccgtgcagaaactctgccctgggggccagctgccattccttctgtatggcacagaagttcataccgacactaataagattgaggagtttctcgaagctgtgctgtgtcctccacgttaccccaagctcgccgctcttaatccagaaagcaatacggccggtcttgatatcttcgccaaattctctgcatacattaagaactctaatcccgctctcaacgacaacttggaaaaggggcttttgaaggcactgaaggtgcttgataactacctgacttctcccttgcctgaggaggtggatgagacatcggcagaggatgaaggtgtcagtcagaggaaatttctggatggaaacgaattgactttagcagactgtaaccttctgccgaagttacatatcgtgcaggtggtgtgcaaaaaatatagaggatttacaattcctgaagctttccgtggagtccaccgatacctttctaacgcctatgcacgagaagagttcgcttctacgtgtcctgacgacgaggagatagagttggcctacgaacaggtagcgaaagcactcaaatag

SEQ ID NO: 40941 - DNA, 726 bp, Artificial Sequence
  Description of Artificial Sequence: Synthetic coding sequence
atggccgaggagcagccccaggtggagctgttcgtgaaggccggcagcgacggagcgaaaatcgggaattgccctttttcacagcgcctgtttatggtactgtggttgaagggggtaacttttaacgtgaccacagtggacacaaagcgcaggactgagacagtccagaagttgtgcccggggggacagctaccattccttctgtatggcacggaggttcatacagacacaaataagattgaggaattcctcgaagcggtgttgtgcccaccacgctaccctaagttagccgcgctcaatcctgagtccaatacagcaggcctcgatatctttgccaaattctccgcatacattaaaaattccaatccagcattgaacgacaatctcgagaagggcctgctgaaagctttgaaggtgctcgataactatttaacctcccctttgcccgaggaggtcgatgagacatcggccgaggatgagggcgtgtcccagcggaaattcttagatggtaacgagctcacactggctgactgtaatctcctgcccaagcttcacatcgtgcaggtcgtgtgtaagaaataccgaggtttcacaatccccgaagccttcaggggtgtccatcgctacctgtccaacgcttatgctagggaagagttcgccagcacatgtcccgatgacgaagagatcgagttggcttacgaacaggtcgccaaagcattgaagtag

SEQ ID NO: 40942 - DNA, 726 bp, Artificial Sequence
  Description of Artificial Sequence: Synthetic coding sequence
atggccgaggagcagccccaggtggagctgttcgtgaaggccggctcagacggagctaaaattgggaactgtccattcagccagagattgtttatggtgctgtggttaaagggtgtgacttttaacgttaccaccgttgatacaaaaagacgtaccgagacagtccaaaagctctgtccaggcgggcagctcccattcctgctctatggtacagaggtccacaccgatactaataaaattgaggagtttctcgaggctgttttgtgcccaccaaggtacccgaagctggccgccctgaatcccgagtccaataccgctgggttagatatcttcgcaaagttttcggcatatatcaaaaatagcaaccctgcactcaacgacaacctggagaagggcctgctgaaagctctgaaagtattggataactatctgacctcccccttgcccgaagaagtcgacgaaacctcagctgaggatgagggggtatcacagcgaaaatttctggacggaaacgagctgacgttggccgattgtaacctgctgcccaagctgcacattgtgcaggtggtgtgtaagaagtacagaggatttacaatcccagaagcattccggggtgtgcaccgctacctgtccaatgcctatgctcgtgaagagttcgcatcaacttgccctgacgacgaagaaattgaactggcatatgaacaggtggcgaaggcactgaagtag

SEQ ID NO: 40943 - DNA, 726 bp, Artificial Sequence
  Description of Artificial Sequence: Synthetic coding sequence
atggccgaggagcagccccaggtggagctgttcgtgaaggccggcagcgacggggctaaaattggtaattgccctttcagccagcgactgttcatggtgctgtggttgaagggagttacatttaacgtaacaactgtggacaccaaaaggagaactgagaccgtgcagaaattgtgccccggaggtcaactcccttttttgctatacgggacagaggtgcacacagacaccaataagatcgaagaatttcttgaggcagtgctctgccctcctcgataccccaagctagcggccctgaaccccgagagcaatacggcaggcctcgatatttttgctaagttctcagcgtatattaagaattcaaatcctgcactgaacgataacctcgagaagggactgttgaaagcacttaaggtgctggacaattacctcacatcccctttaccagaagaagtcgacgagacaagcgctgaggatgagggcgtatcccagcgaaaattcttggacggtaacgagttgactctggccgactgcaacctgctgcccaaacttcacattgtgcaggtggtgtgcaaaaagtaccggggttttacgattcccgaggcctttaggggcgtgcaccgctatctgtcaaacgcttatgcaagagaggaatttgcctctacttgccccgatgacgaggagatcgaactggcttacgaacaggtcgctaaagctctgaagtag

SEQ ID NO: 40944 - DNA, 726 bp, Artificial Sequence
  Description of Artificial Sequence: Synthetic coding sequence
atggccgaggagcagccccaggtggagctgttcgtgaaggccggctccgacggagcaaaaatcggaaactgcccttttagtcagcgtctgtttatggtactgtggttaaaaggtgtcacctttaacgttactactgtggatacaaagaggcgtacagaaacagtgcaaaaactgtgtcccggtggtcaactgcccttcctcctctatggtacggaggtccacactgatacaaataaaatagaagaattcttagaggctgtcctatgccctcccagatatccgaagctggccgctctaaatcccgagtcaaacactgctggactggatatctttgcaaaattctccgcctatatcaaaaacagtaaccccgccttgaacgacaatctggagaaaggacttctgaaagccttgaaggtgctcgataactacttgacatctccattaccagaagaggtagatgagacctccgcggaagatgagggggtgagccagcgaaagttcctcgatgggaacgagcttacgctagcagattgcaacctcctgccaaagcttcatatagtccaggtcgtttgcaaaaagtaccggggctttaccatccctgaggctttccgcggggtccaccgctatctgagcaacgcctatgctagggaagagttcgcttctacctgtcctgatgacgaggaaatcgagttagcttatgagcaggttgccaaggctctgaagtag

SEQ ID NO: 40945 - DNA, 726 bp, Artificial Sequence
  Description of Artificial Sequence: Synthetic coding sequence
atggccgaggagcagccccaggtggagctgttcgtgaaggccggcagcgatggtgcaaagataggaaattgtcctttcagccagcgcctcttcatggtgctgtggctgaagggagtgaccttcaatgtgactactgtggatactaagagaaggaccgaaaccgtccagaagctatgtcctggcggccaattgccatttctgctatacgggaccgaggtgcacaccgacacaaataaaattgaagaattcctggaggcagtactgtgccctcccagatacccaaagctggccgctctcaatcctgaatctaacactgctggcctggatatcttcgctaagttcagtgcctatatcaaaaactctaatcccgccctcaatgataatttggagaagggcctgctaaaagctttgaaggttttagacaactacctgacttcccccctgccagaggaagtcgacgagacatcagccgaggatgaaggagtttctcagcggaagttcctggatggcaatgaacttaccctggccgattgtaacctgcttcccaaactacacattgttcaggtggtttgtaagaagtaccgaggcttcacaatccccgaggcttttcgcggcgtccatagatacctctctaatgcctacgcccgcgaggaatttgcgtcgacctgtcccgatgacgaagagattgaactcgcttatgaacaagtcgcgaaggccctgaagtag

SEQ ID NO: 40946 - DNA, 726 bp, Artificial Sequence
  Description of Artificial Sequence: Synthetic coding sequence
atggccgaggagcagccccaggtggagctgttcgtgaaggccggctcggatggagccaaaatcggcaactgccccttcagccagcggctctttatggtgctgtggctcaaaggcgtgactttcaatgttactacggttgacaccaagcggcgtaccgaaaccgttcagaagttgtgtccaggcggacagctgccttttctgctgtacggcactgaggtccacacggacaccaataaaattgaggaatttctggaggccgtgctctgtccgccacgatatccgaagctggctgcacttaatcctgaatctaatacagctggccttgacatattcgcaaagttctccgcgtacatcaagaattctaatcccgccctgaatgataatctcgagaaggggttactcaaggccctcaaggttctggacaactatctgacctcaccacttccagaggaggtggacgagacctccgctgaggacgaaggtgtgtctcaaaggaaattcttggatgggaatgagctcacgttggccgactgcaatttgctgccgaagcttcatattgtgcaggtggtttgtaaaaaatatagaggattcacaatacccgaggccttcagaggcgtccacaggtacttgagcaacgcgtacgcgagggaggagttcgcttctacctgccctgacgatgaagaaatcgagctcgcatatgaacaggtcgcgaaagctctgaagtag

SEQ ID NO: 40947 - DNA, 726 bp, Artificial Sequence
  Description of Artificial Sequence: Synthetic coding sequence
atggccgaggagcagccccaggtggagctgttcgtgaaggccggctctgacggcgcaaagattgggaactgcccatttagccagcgactcttcatggtcctttggctcaagggtgtgactttcaacgtgactaccgtggacacgaagcggagaacagagaccgtacagaagctttgtcccggcgggcagcttccgttcctcctttacggaaccgaggtccacacggacacgaacaagatcgaagagtttcttgaagctgtcttgtgccctcctcgctatcccaagctcgccgctctaaatccagaatcgaatactgccggcctggatatctttgccaaatttagcgcttacatcaagaattccaaccctgcccttaatgataatctggagaagggactgcttaaggctctaaaggtgctggacaattatttaacttctccattgccagaagaagtggatgaaacatcagcagaggatgagggtgtctcccaacgcaaatttttggatggtaatgagctcaccttggcagactgcaatctcctgcccaaactccacattgtccaggttgtatgcaaaaagtaccggggcttcaccatccccgaggcttttaggggcgtgcaccgatacctgtctaatgcatacgcccgagaggaatttgcgtcaacatgccccgatgacgaagaaattgaacttgcatacgagcaagtggccaaggccctgaaatag

SEQ ID NO: 40948 - DNA, 726 bp, Artificial Sequence
  Description of Artificial Sequence: Synthetic coding sequence
atggccgaggagcagccccaggtggagctgttcgtgaaggccggctcagatggagctaagatcggcaactgtccattttcgcagaggttattcatggtgctgtggctcaagggtgtcaccttcaatgtgacaaccgttgataccaagaggcggactgaaacagtgcagaagctatgtcccggcggccagctaccgtttctcctgtacggcacagaggttcatacagacaccaataaaatcgaagagtttcttgaagccgttctatgtcccccccggtacccaaaactcgcggcacttaacccggagtcgaacactgcaggcctggatatatttgcgaagttctccgcatacattaaaaacagcaatccggccctgaatgacaacctggaaaaagggctgctcaaggcattaaaagtactggataactacctaacgtcgccacttcccgaagaagtcgacgaaactagcgccgaagacgagggcgtgtcacagagaaagtttctcgacggaaatgagctgacacttgctgattgcaaccttctgcccaaactccacattgtgcaggtcgtatgtaaaaaatacagaggcttcaccatccctgaagccttccgtggagtccaccgctatctctccaacgcctacgcccgagaggagtttgcaagcacatgccctgatgacgaggagatagagctcgcgtatgagcaggttgcgaaggccctcaaatag

SEQ ID NO: 40949 - DNA, 726 bp, Artificial Sequence
  Description of Artificial Sequence: Synthetic coding sequence
atggccgaggagcagccccaggtggagctgttcgtgaaggccggcagcgatggcgcaaaaattggcaactgcccattttcacaaagactatttatggttctgtggctcaagggcgtgacttttaatgtaacgaccgtggatactaaacgacgaaccgagactgtgcaaaaactttgtcctggggggcagctcccattcctcctttacggcacggaggtgcacactgatacaaataaaattgaagagtttcttgaagcagttctttgcccgcctcgctaccctaaactcgccgcccttaaccccgaatccaacactgctgggttggatatatttgcaaagttttccgcctacataaagaatagcaatccagccctcaatgacaatctggagaaggggctgctcaaagccctgaaggtactcgacaactatctcaccagtcctctgcctgaggaggtggatgaaacttctgccgaagacgagggtgtctctcagcggaagtttttggatgggaatgagttaactcttgccgactgcaatctgcttcctaaattgcacatcgtacaggtcgtgtgcaagaagtaccgcggattcaccattcccgaggcctttaggggagtacatcgctacctgtcaaacgcatacgcaagggaagaattcgcgagcacctgtcctgatgacgaggaaatcgagctggcatatgagcaggtggccaaggccttgaagtag

SEQ ID NO: 40950 - DNA, 726 bp, Artificial Sequence
  Description of Artificial Sequence: Synthetic coding sequence
atggccgaggagcagccccaggtggagctgttcgtgaaggccggctccgacggggctaaaatcggcaactgtccattttcacagagactgttcatggttctgtggctgaaaggggtgaccttcaatgtgaccacagttgacactaagagacggacggagacagtccaaaaactgtgtcctgggggtcagctgccatttctactgtacggaacggaagtgcataccgatacgaataaaatcgaggaatttttagaagcagtgctttgccccccgcgataccctaagttggccgcactgaaccctgagagcaatacagctggtttagatattttcgccaagttctccgcctacatcaaaaactcgaatccagcgttgaatgacaacttagaaaaaggtttgctgaaggctctcaaagtcttggataattatctgaccagtcccctgcccgaggaggtagatgagaccagtgcagaagacgagggcgtgtcacagaggaaattccttgacgggaacgaacttaccttagccgactgtaacctgctccctaagttacacatcgtgcaggtggtttgcaagaagtacagggggttcaccatcccagaggccttccgcggtgtacatcgttacctgtcaaacgcctatgccagggaggaattcgccagcacttgcccagacgacgaagagatagagctcgcctacgaacaggttgctaaagccctgaaatag

SEQ ID NO: 40951 - DNA, 726 bp, Artificial Sequence
  Description of Artificial Sequence: Synthetic coding sequence
atggccgaggagcagccccaggtggagctgttcgtgaaggccggctcagatggggctaaaattggaaattgtccttttagccagaggctttttatggtcctgtggttaaaaggggtgaccttcaacgtaacaaccgtggatacgaagcgcagaactgaaacagtacaaaaattgtgcccaggagggcagctaccgtttcttctatacggcacggaagtccacaccgatacaaacaaaattgaggaatttctggaagcagtgctttgtcccccgcgatatccgaaactcgctgctctgaaccctgaatctaacaccgccggccttgatatattcgccaagttttcagcttacataaagaactccaatccggctctgaacgataacctggagaaaggcctccttaaagcattaaaagttctcgacaattacctgaccagcccgctgcccgaggaggtcgacgagacatcggccgaggacgaaggggtttcccagcgcaagtttctcgacgggaacgagctgaccctcgctgattgcaacttgctaccaaaactacatatagttcaggttgtgtgcaaaaaatatagaggctttactatcccagaagcattccgcggtgtgcacaggtacctgagcaatgcatatgcaagagaggagttcgcctctacatgtccggatgatgaagaaattgaattagcatatgaacaggtcgcaaaggctttgaaatag

SEQ ID NO: 40952 - DNA, 726 bp, Artificial Sequence
  Description of Artificial Sequence: Synthetic coding sequence
atggccgaggagcagccccaggtggagctgttcgtgaaggccggcagcgatggcgcaaagatcggaaactgtccattctcgcagagactattcatggtcttatggctgaaaggcgttacgttcaacgtgactacagtggacacgaagcgaaggacagagacggtccaaaagctctgccccggtgggcagctgcccttccttctgtacgggaccgaggtgcacaccgacaccaacaaaatcgaagaatttcttgaggcagtcctgtgtccccctagatacccgaagctggctgctctgaatccagagtcaaataccgccggtctggacattttcgcaaagtttagcgcttacattaaaaattctaaccctgctctgaatgataatttggagaaaggtttattgaaggccctgaaggtactagacaactacttaacgagccccctgcctgaagaagttgatgaaacgagcgctgaggacgagggagtatcccagcgaaagttcctggacggcaacgagttgactctcgcggattgtaatttgcttccgaaactgcacatcgtgcaggtcgtctgtaagaaatacagaggtttcaccatccccgaagccttcaggggcgtacacaggtacctcagtaacgcctatgcgagggaggaatttgcatcgacatgccccgatgacgaggaaatagaactcgcatatgagcaggtagctaaggccctaaagtag

SEQ ID NO: 40953 - DNA, 726 bp, Artificial Sequence
  Description of Artificial Sequence: Synthetic coding sequence
atggccgaggagcagccccaggtggagctgttcgtgaaggccggcagcgatggcgccaaaattggaaattgcccgttctctcagcgtctctttatggtgctgtggctgaaaggagtcacctttaatgttacaacagtggacactaaacgtcgaaccgaaaccgtgcagaagctctgcccggggggccagctccccttccttctgtacggcacggaggttcacactgacacgaataaaattgaagagttcttggaagctgtgctgtgtcctccgcggtacccaaaacttgcggccttgaaccccgaatcaaataccgcgggattagatatctttgccaagttcagcgcctatataaagaactctaatccagcactgaatgataatctggaaaaaggactcctgaaggccctgaaagtgctggacaattaccttacgtcacccctacccgaggaggtcgatgagacatccgctgaggatgagggggtatcgcaacgcaaatttttggacggcaatgagttgactctcgctgactgtaatctgctcccaaagttgcacatagtgcaggttgtgtgcaagaagtaccgcggtttcacaattcctgaggctttccgcggtgtccaccgttacctgagcaatgcctacgcccgtgaagagttcgcttctacgtgccccgacgacgaggagatcgagttagcctatgaacaagtggcgaaggccctaaagtag

SEQ ID NO: 40954 - DNA, 726 bp, Artificial Sequence
  Description of Artificial Sequence: Synthetic coding sequence
atggccgaggagcagccccaggtggagctgttcgtgaaggccggcagtgacggggccaaaatagggaattgtccattctctcagagattatttatggttctttggctgaagggagttacattcaacgttacaaccgtggacacaaagcggaggaccgagacggtgcagaaattgtgccccggtggtcagctcccctttctcctgtacggtacagaggtccacaccgacacgaataagatagaagagtttctagaagcggtgctttgcccacctcggtacccaaagctggcagcccttaatccagaatctaataccgctggactggacatcttcgcaaaattcagcgcctacatcaagaattcaaatcccgctctgaacgataatctggaaaaaggtctgttgaaagcattaaaagtcctggataactatcttacgagcccactgccagaggaggtggacgaaacctctgccgaggacgaaggagtgtcacaaagaaagttcttggacgggaatgagctgactctggctgattgtaacctgctacctaagctccacattgtgcaagttgtgtgcaagaagtataggggatttactatccccgaagcctttcggggggtccatcggtacctgtccaacgcctacgctcgggaggagttcgcctctacctgccctgatgacgaggaaatagagctggcatacgaacaagtagccaaagcattgaagtag

SEQ ID NO: 40955 - DNA, 726 bp, Artificial Sequence
  Description of Artificial Sequence: Synthetic coding sequence
atggccgaggagcagccccaggtggagctgttcgtgaaggccggcagtgacggagccaagatcggcaactgcccattctctcagagactgtttatggttctgtggttgaaaggtgtcactttcaatgtgactaccgtcgacactaaacggaggacggaaacagtccagaaactctgtccaggcgggcagctcccattcctgctatacggtacggaagtgcacacagacaccaacaagatcgaagaatttctggaagcagtgctgtgcccgccaaggtaccctaagctcgctgcactgaatccggaaagcaatacagctggattagatattttcgccaagttttccgcatatattaaaaactccaaccctgctttgaacgacaatctggagaagggactgctgaaagccctgaaggtactggataattatttgacatctcctttgccagaagaggtggatgaaacttccgccgaagacgagggcgtctctcagaggaaattcctagacggcaacgaactgaccctagcagactgtaatttgttgccaaaactgcacattgtgcaagtggtttgcaaaaaatatagaggatttaccattccagaggccttccgcggtgtccatagatacttgtccaatgcatacgccagggaagaatttgcctccacctgcccagacgacgaggaaattgagctggcgtacgaacaggtagccaaagcgctgaaatag

SEQ ID NO: 40956 - DNA, 726 bp, Artificial Sequence
  Description of Artificial Sequence: Synthetic coding sequence
atggccgaggagcagccccaggtggagctgttcgtgaaggccggctctgatggcgctaaaattggcaactgtccatttagccagagattatttatggtgctttggctcaaaggtgtcacctttaatgttacaaccgtcgacacaaaaaggcggaccgaaacagtgcaaaagctatgtcccggcgggcaactgccatttctgctctacggtacagaggtgcatacagacacaaacaagatagaggagttcctggaagcagtactgtgccctccgcgataccctaaactggccgctctgaaccctgagtcaaacacggccgggctggacatcttcgccaaatttagcgcctatattaagaattccaatccggccctgaatgataacctcgaaaaagggctactgaaggcattaaaggtcttagacaattatctgaccagccccttgccagaggaggtggatgagacctcggcagaggacgagggcgtatcccagagaaagttcctggacggtaatgagctgacgctggccgattgcaaccttcttccaaagttacatattgtccaggtggtgtgtaagaagtataggggctttacaatccccgaagcctttcggggggtacaccgctatctatcaaacgcctatgcccgcgaggagttcgcaagcacctgcccggacgatgaggagatcgaactggcatatgaacaggtcgccaaagcactgaagtag

SEQ ID NO: 40957 - DNA, 726 bp, Artificial Sequence
  Description of Artificial Sequence: Synthetic coding sequence
atggccgaggagcagccccaggtggagctgttcgtgaaggccggctcagacggggccaagatcggcaactgcccgttctcccagcgcctgtttatggtgctgtggctgaaaggggtgacgtttaatgtgacaactgtcgataccaagagacgtacagagacggtacaaaagttatgccctggaggccagctgcctttcctgctgtatggtactgaggtacacacggatacgaataagattgaggaattcctagaggctgttctgtgccccccaaggtatccgaagcttgctgcactgaaccctgagtccaataccgcaggcttagatattttcgctaaattttccgcgtatattaagaattctaatcccgcactgaatgataatcttgaaaagggactgcttaaggccctgaaggtcttagataactacctcactagccctcttccagaggaagtcgacgagacctctgccgaagacgaaggcgtgtcccagagaaaatttctcgatgggaatgagctaacgctagctgattgcaacctgctgcccaaactccacattgttcaggtcgtgtgcaaaaagtaccgggggtttacaatccctgaggctttccgaggagtccaccgctatttgagcaatgcatacgcaagggaggaattcgctagcacttgccctgatgacgaggaaattgaattagcatatgaacaggtggccaaagcactgaagtag

SEQ ID NO: 40958 - DNA, 726 bp, Artificial Sequence
  Description of Artificial Sequence: Synthetic coding sequence
atggccgaggagcagccccaggtggagctgttcgtgaaggccggcagcgatggagctaagattggcaattgccccttctcgcagcggctgtttatggtgttgtggctcaagggcgtcacgttcaacgtgacgactgtggataccaagagacgcaccgagactgtccagaaactctgtccggggggtcaactccccttcctgctctacgggaccgaagttcataccgatacaaataagattgaagaattcctcgaggcagtcttatgccccccccgctatcccaagttggccgcgctaaaccctgagtcaaataccgctggacttgatatctttgcgaagttcagcgcttacatcaaaaatagcaatccggctctgaatgataacctggaaaagggccttctgaaggcactgaaagtccttgataattatttgacttcaccactacccgaggaggttgatgaaaccagtgctgaggatgaaggggtgagccaacgcaagttcctagacggaaatgaacttactcttgctgattgcaatctgctccctaagctccacattgtccaggtggtttgcaaaaagtatagggggtttaccattcctgaggccttcaggggcgtgcatcgatatttgagcaatgcttacgcaagagaagagtttgcatcaacctgccctgatgacgaggagattgaattagcctatgagcaggtcgccaaggccctcaaatag

SEQ ID NO: 40959 - DNA, 726 bp, Artificial Sequence
  Description of Artificial Sequence: Synthetic coding sequence
atggccgaggagcagccccaggtggagctgttcgtgaaggccggctccgacggggccaagattggcaattgtcctttttctcagcgcctgttcatggtactgtggttgaagggagtcacgtttaatgtgacaactgtcgacacaaagaggcgcactgagacagttcagaagctgtgtccaggcggtcaactgcctttcctcctttacggtacggaggtccacaccgacacaaataagatcgaggagtttctggaagccgtgttatgtcccccgagatatccaaaactggctgctctcaaccctgaatccaatactgccgggctcgacattttcgccaaattctccgcctatataaagaactccaaccccgcactgaatgataatcttgagaaaggcctgttaaaggctctaaaggttctcgacaactatctcacatccccacttccagaggaggtcgatgagacctctgccgaggatgaaggggtgagtcagagaaaattcctggacggtaacgaactgacccttgctgattgtaaccttctccctaagctccacatcgtgcaggtggtttgcaaaaaatacagaggtttcacgatcccagaggcgtttcggggggtgcaccgatatctgagcaacgcatacgctcgcgaggagtttgcaagtacgtgtcctgacgatgaggagatcgagttggcctacgaacaggtggcaaaagcccttaagtag

SEQ ID NO: 40960 - DNA, 726 bp, Artificial Sequence
  Description of Artificial Sequence: Synthetic coding sequence
atggccgaggagcagccccaggtggagctgttcgtgaaggccggctctgacggggctaagatcggaaattgtccattttcgcagagactgtttatggtgttgtggctgaaaggggtgacttttaacgtgacaacagtcgacacgaagcggaggaccgaaaccgtccagaaactgtgtccgggtggtcagttgccattcctgttgtatggcacagaagtacataccgataccaataaaatcgaagaatttttggaggcggtgttatgtccacctcgataccctaaacttgctgccctgaacccagaatcaaatacagccgggttggatatttttgcgaagtttagcgcttatatcaagaacagtaaccccgcccttaacgacaatttggaaaagggtttactgaaggccctcaaagtattggacaactatctgacttcacccctgcctgaagaagtggacgaaactagcgctgaggatgagggcgtctcgcagcgcaaattcctggacgggaatgagttgactctggccgactgcaacctcctccctaagctgcatattgtccaggtcgtttgcaaaaaataccgcgggtttacaattccagaagcttttcgaggcgttcaccgatatttaagtaacgcttatgccagagaggaatttgcaagtacctgtcctgacgacgaggagattgaactcgcctatgagcaggtggcaaaagccctgaaatag

SEQ ID NO: 40961 - DNA, 726 bp, Artificial Sequence
  Description of Artificial Sequence: Synthetic coding sequence
atggccgaggagcagccccaggtggagctgttcgtgaaggccggctctgacggggccaaaattggaaactgtcccttttcgcaacgcctctttatggtgttgtggcttaagggtgtgacgtttaacgttaccacggtggatacaaaaagaaggacagagactgtgcagaaattgtgcccaggagggcagctgccattcctgctttacggcacagaggtacacaccgataccaacaaaatagaagaattcctcgaagcggtgttgtgtccaccacgttacccaaaactagcagccctgaaccctgaaagcaatacggcagggctcgacatatttgccaaattctccgcatatattaaaaactctaatccggctctcaatgacaatctagaaaagggtctattgaaagccctgaaagtgcttgacaactacctgacatcccctctgcctgaggaggtggatgagacctccgccgaggacgagggagtgtcccaaagaaaattcctggatggtaacgagctcaccttagctgattgcaatctgctgccaaaactacacatcgtgcaagtcgtgtgtaagaaatatagaggcttcaccataccggaggccttccgcggagtgcacagataccttagcaatgcttatgcccgagaggaattcgcttctacctgccccgatgacgaagaaattgagctcgcttacgagcaggttgctaaggccttaaagtag

SEQ ID NO: 40962 - DNA, 726 bp, Artificial Sequence
  Description of Artificial Sequence: Synthetic coding sequence
atggccgaggagcagccccaggtggagctgttcgtgaaggccggctccgacggcgctaaaattgggaactgcccattcagccagagactgttcatggtgctatggctaaagggggtaacgtttaacgtgacgacagtggacacgaagagaagaacagagacagtacaaaagttatgcccgggcggtcagcttccattcctcctctacggtacagaggtccacactgacaccaataaaatcgaagaatttttggaagccgtcctgtgtccaccgcgttatccaaagctggcggcactgaatcctgagagcaacactgcaggattagatattttcgcaaaattcagtgcgtacatcaagaactccaatcccgccctaaatgataaccttgaaaagggcctgctgaaggcgttgaaagtactcgacaattatcttacctcaccactcccagaggaagtggatgaaacctctgccgaggatgagggtgtgtctcaacggaaattcctggacgggaacgaacttactttggccgattgcaatctcctacccaaactccatatagtccaggtcgtgtgcaagaagtacaggggcttcaccatcccagaagcattccgcggggtccacaggtacctctccaatgcgtacgctcgcgaggagtttgcctcaacctgtccagacgacgaagagattgaattggcctacgaacaggtcgcaaaagccctgaagtag

SEQ ID NO: 40963 - DNA, 726 bp, Artificial Sequence
  Description of Artificial Sequence: Synthetic coding sequence
atggccgaggagcagccccaggtggagctgttcgtgaaggccggctcagatggagctaagatcgggaactgcccgttctctcaacgcctcttcatggtgctgtggctgaaaggggttacgttcaacgtgacaactgtggacacaaagcgccggaccgagaccgtgcagaaactctgcccaggaggccaacttccattcctgctgtatgggacagaagtgcatacagacacaaataaaattgaggagttcttggaggccgtgctttgccctcccaggtatccaaagctggcagctttgaacccagagtctaatacagccgggctagacatttttgcaaaattcagcgcatatatcaagaactctaacccagccctcaatgataatttagaaaagggccttttgaaggccttgaaggtgctggacaattacctgaccagccccctccccgaagaggtcgacgaaacctctgcggaggatgagggcgtgtcacaaaggaaatttctggacggaaacgagctgaccttggctgactgcaatctgctgcccaaactccacattgtccaggtggtgtgcaaaaaatatcgaggcttcactatcccagaggctttcaggggcgtacatcgttatctatccaatgcatacgcccgggaagagtttgcaagcacctgtcccgacgacgaggaaattgaactggcatatgagcaagtggctaaggccctgaagtag

SEQ ID NO: 40964 - DNA, 726 bp, Artificial Sequence
  Description of Artificial Sequence: Synthetic coding sequence
atggccgaggagcagccccaggtggagctgttcgtgaaggccggcagcgatggcgcgaagataggaaactgcccctttagtcagaggctgtttatggtgttgtggttaaagggggtgacctttaatgtgaccaccgttgacaccaaaaggaggaccgagactgtgcagaaactgtgcccggggggccagttgccatttctgttgtacggcacagaggtacacaccgataccaacaagatcgaagagttcttggaggctgtcctctgcccgccccgatatccaaagcttgctgccctgaatcccgaaagcaatactgctggcctggacatcttcgcaaagttcagcgcctatattaagaattccaaccccgctctgaatgataacctagagaagggcctcctaaaggccctgaaggtgctcgacaactatttgactagcccactgcctgaagaggttgatgagacctctgctgaagacgaaggggtctcacaacgtaagttcctggacgggaatgaattaacactcgcagactgtaacctcctaccaaagctgcatatcgtgcaggtagtgtgcaagaaatatagagggttcaccatccctgaggcctttaggggggttcatcgttatctgtccaatgcttacgcaagggaggaatttgcgtctacttgcccagacgatgaagagatcgaactcgcatacgagcaggtggccaaggcactgaagtag

SEQ ID NO: 40965 - DNA, 726 bp, Artificial Sequence
  Description of Artificial Sequence: Synthetic coding sequence
atggccgaggagcagccccaggtggagctgttcgtgaaggccggctccgatggggccaagatcggcaactgccctttcagccaacgcttgttcatggtgctctggcttaaaggtgttaccttcaatgtgacgacagtagataccaagcggcggaccgaaacagtgcagaagctgtgccctggtggacagcttcctttcctgctttacggcaccgaggtacacacagacaccaataaaattgaagaatttttagaagcggtgctctgtcctcctcggtatcctaagctagcagccttgaaccccgagtctaacacagctggattagatattttcgcaaagttctccgcttacatcaaaaatagtaatcccgcactgaatgacaatctggaaaagggtttgttgaaggcactaaaagtgctggataactatctcactagtcccctccccgaagaagtcgacgaaacatccgcagaagatgaaggggtgtcccagcgtaaatttcttgatggaaacgaactcactttagccgactgtaatctgctgccaaagctgcatatagttcaggtggtttgtaagaaatatcggggattcaccatccccgaagcatttagaggcgtgcaccgctatctgtcgaacgcgtatgctagagaggagtttgcatctacctgccccgacgacgaagagatcgagttggcctatgaacaggtagccaaggcactgaaatag

SEQ ID NO: 40966 - DNA, 726 bp, Artificial Sequence
  Description of Artificial Sequence: Synthetic coding sequence
atggccgaggagcagccccaggtggagctgttcgtgaaggccggctccgacggggccaagatcggcaattgcccgttcagtcaaagactttttatggtgctgtggttaaagggagtgaccttcaacgtcaccaccgttgatactaaacggcggaccgagacagtgcaaaagctgtgtcccggagggcagctccccttcctgctctatggaacagaagtgcataccgacaccaacaagattgaagaatttctcgaagccgtgctctgccccccccgttaccctaagctggccgccctgaatcccgagtctaataccgcaggcctcgacatcttcgcaaagttttccgcctacattaaaaactcaaaccccgcgctgaacgacaacctggagaagggtctgctaaaggccttaaaggtcctggataactatctgacctcccctctgcccgaagaggtcgatgagacttccgctgaggacgagggcgtgagtcagagaaagttccttgacgggaatgaactgaccttagcggattgcaacctcctaccaaagctgcatatagtacaggtcgtctgtaagaagtataggggctttaccatccccgaggcattccggggagtgcatagatatctgagtaacgcctatgctcgcgaggagttcgcaagtacatgccctgacgatgaagaaatcgaactggcgtacgagcaggtcgcgaaggcgctgaagtag

SEQ ID NO: 40967 - DNA, 744 bp, Artificial Sequence
  Description of Artificial Sequence: Synthetic coding sequence
atgagcggcctgcggcccggcacccaggtggaccccgagatcgagttattcgtgaaagccggttcagacggcgagagtattgggaattgtccgttttgccagcgcctgttcatgattctctggctgaaaggagttaaattcaacgtgacaacggtggacatgacccgaaaacccgaggaacttaaagatctggcaccaggaaccaaccccccatttctggtctataataaggagctgaaaactgacttcattaagatcgaggagttcctagaacagactctagcacctccccgctaccctcatctgtcaccgaaatacaaagaaagttttgatgtcggttgcaacctgtttgcaaaattctcagcctatatcaagaacacgcagaaagaggccaacaaaaattttgagaagagcctcttgaaggagtttaaacgcctagacgattacctgaacacacctctccttgatgagatcgaccctgattctgccgaggaaccacctgtgtcacgtaggctgtttctggatggagatcagctgaccctggctgattgctccctcctacccaagctaaatataatcaaagtagccgccaaaaaatatagagacttcgacatcccggccgagttcagcggcgtgtggcggtatctccacaatgcttacgcccgagaggagtttactcatacctgtccggaggacaaggagatagagaacacctacgccaacgtcgcaaagcaaaagtcatag

SEQ ID NO: 40968 - DNA, 762 bp, Artificial Sequence
  Description of Artificial Sequence: Synthetic coding sequence
atggccctgagcatgcccctgaacggcctgaaggaggaggacaaggaaccattaattgagcttttcgttaaagctggatctgacggggagagtattggcaattgcccctttagtcagcgtctatttatgattttgtggttaaaaggcgtggttttttcagtcactacagtggacttgaagaggaaaccagccgacctacaaaacctggcgccgggcacccacccgccttttattaccttcaatagcgaagtcaaaaccgacgtgaacaaaatagaggagtttctggaagaggttctgtgtccccccaagtatctgaaactgtcacccaagcacccagagagtaataccgcaggcatggacatttttgctaaattttccgcctacatcaaaaattctcgacccgaagctaatgaggcacttgagcggggacttcttaaaacacttcagaagctggatgagtacctgaactctcctctgccagatgagatcgacgaaaacagcatggaagatattaaattttctacccggaagttcctcgatggaaacgagatgacccttgcagattgcaatctgttacccaaactacatatagtaaaggtagttgctaaaaaatataggaatttcgatatccccaaggaaatgaccggcatctggcggtacctgacaaacgcatattcaagggacgaattcaccaatacttgccctagtgataaagaagtggagatcgcttacagtgatgtcgctaaaagactcaccaaatag

SEQ ID NO: 40969 - DNA, 624 bp, Artificial Sequence
  Description of Artificial Sequence: Synthetic coding sequence
atggccctgagcatgcccctgaacggcctgaaggaggaggacaaggagcctctgatagagctctttgttaaagccggatctgacggcgagtcaattggaaattgccccttctcccagcggctgttcatgatactatggttaaaaggcgtcgtgttcagcgtgactaccgtagacctcaaaaggaagcctgcagacctgcagaatctggccccaggcactcacccacccttcatcacctttaatagtgaggtgaaaacagacgtgaataaaatagaggagttcctggaggaggtgctctgtcctcctaagtacctcaagttgtctcctaagcatccagaaagcaacaccgcaggcatggatatttttgctaagtttagcgcatacattaaaaacagtcgccctgaagcaaacgaggctctcgaaagaggactgctcaagaccctccagaagctggacgagtaccttaactcccctttgcctgatgagatcgacgaaaattccatggaggatataaagttcagcacacggaaattcctagatggtaatgagatgacactcgccgactgtaatttgttgcccaaactacatattgtaaaggttgtggcgaaaatcagccagctgtag

SEQ ID NO: 40970 - DNA, 762 bp, Artificial Sequence
  Description of Artificial Sequence: Synthetic coding sequence
atggccctgagcatgcccctgaacggcctgaaggaggaggacaaggagccgctgattgagttattcgttaaagcaggctccgacggggagtctataggcaattgtcccttttcacagcgattgtttatgatcctatggttgaaaggcgtcgtttttagcgtgactacagtcgatctcaaaaggaagcccgcagacctgcaaaacctggccccaggaacccaccccccatttatcacatttaattcggaggtcaagacggacgtgaacaagatcgaagaatttctagaggaggtgttgtgtccccccaagtacctgaagctatcccccaaacatcccgagtcgaacaccgccgggatggatatcttcgctaagttcagcgcttatataaaaaactctcggccagaagcaaatgaggcactggagcgagggttactcaagacccttcagaaactcgatgaatacctcaactcaccactgccggatgaaatcgacgagaacagcatggaggatattaagtttagtacacgaaagtttctggacgggaacgaaatgactctagcggactgtaacttgctcccaaaactgcacatagtcaaagtcgtggccaagaagtataggaactttgacatacccaaagagatgaccggcatctggagatatctcacaaacgcctactctcgcgacgagttcacaaacacctgtccctccgacaaagaagtggagatcgcttacagtgacgttgcaaagcgactcaccaaatag

SEQ ID NO: 40971 - DNA, 2061 bp, Artificial Sequence
  Description of Artificial Sequence: Synthetic coding sequence
atggccgaggccgccgagcccgagggcgtggcccccggcccccaggggccacccgaagtccccgctcccctggccgagcgccccggtgagcctggggccgccgggggggaagccgaggggcctgagggatctgaaggcgccgaagaagcaccccgtggagctgctgccgtcaaagaggctggaggggggggcccagatcgggggcctgaagctgaggctagggggacacgcggggcccacggcgaaacagaggccgaagagggggcgcctgagggcgccgaagtaccacaaggcggcgaagagaccagcggggcccagcaggtggagggggcttcaccagggaggggtgctcagggagaaccccggggcgaggctcagagagagcctgaggattcggctgctcctgaaagacaggaggaagctgaacagaggccggaagtgccggagggcagcgccagtggtgaagctggtgactcggttgatgcggagggtcctctaggcgataacatcgaggcggagggacccgcgggtgactcagtcgaggctgaaggcagagtgggtgattccgtggacgcggaaggcccggccggagattcagttgatgcggaaggaccccttggcgacaatatccaggccgaaggcccagccggtgactcagtcgacgccgaaggtcgagtgggcgacagtgtggacgcagaaggacctgcgggcgattccgtggacgctgagggccgcgtgggggatagtgtggaggccggcgatcctgcgggcgatggcgttgaagctggcgtccccgctggagattcagttgaggccgagggccccgcaggtgacagtatggatgctgagggccccgctggtcgcgcccgtagggtcagcggcgaaccacaacagagcggcgatggtagcctcagccctcaggctgaagctattgaagtagctgctggggagtcagccgggagaagccccggcgagttagcctgggacgcagccgaagaggctgaggtcccaggggtgaaggggagtgaagaggctgctccaggggatgcaagggctgatgccggcgaggaccgcgtcggggacggcccccagcaggaacccggcgaagatgaggagcgacgggaaagaagccctgagggtcctcgtgaggaagaagcagctggcggagaagaagaatcacctgactcatccccacatggcgaggcatcgcgcggagccgccgagcccgaggctcagctcagcaatcacctcgccgaggaaggccccgccgagggctccggtgaagcagcaagagtgaacggaaggcgcgaggacggagaggcgagcgagccacgcgccctcggccaggagcatgatatcaccctgtttgtcaaggccggctacgacggcgagtccatagggaactgcccattcagccagcgccttttcatgatactgtggctcaagggagtgatcttcaatgtgactactgtagatctgaaaaggaagcccgcagatctgcagaacctggctcccggtacaaatccacctttcatgacctttgacggggaggtcaagacagatgtgaacaaaatagaagaattcctcgaagaaaagctcgcgccccccagatatcctaagctggggacccagcatcctgaatccaattctgccggaaacgatgtcttcgccaaattttctgctttcattaaaaatactaagaaggatgccaacgaaatccacgagaaaaatttattaaaagccctccggaagcttgacaattaccttaactctccactgccagatgaaattgatgcatacagcacggaagacgtgaccgtgtcgggccgaaaatttctagatggagatgaattgactctggctgattgtaatctgcttccaaaacttcatatcattaaaatcgtggccaaaaagtatagggacttcgaattcccatcggaaatgactggaatttggaggtatctgaacaacgcttatgccagggatgaattcacaaacacgtgccctgctgatcaggagattgaacacgcctattctgatgtcgccaagcggatgaagtag

SEQ ID NO: 40972 - DNA, 2115 bp, Artificial Sequence
  Description of Artificial Sequence: Synthetic coding sequence
atggccgaggccgccgagcccgagggcgtggcccccggcccccaggggccccctgaggttccagccccactcgcagagaggcctggcgaacccggggctgcgggcggcgaagctgaaggccccgaagggtctgagggggcagaggaggcacccagaggagccgccgctgtgaaagaggccggaggaggtggtccagaccgcgggccagaggccgaggctaggggcacccgcggggcccacggcgagaccgaagccgaggagggagctcccgagggtgcagaagtgccccaggggggggaagaaaccagcggagcacaacaggtggagggtgcttctcccgggcgcggagctcaaggtgagccccggggtgaggcacagagggaaccggaagacagtgcagcccccgagcgacaggaggaagctgagcaacgtcctgaggttcccgagggatcggcatccggagaagctggggactctgtggacgccgaagggccacttggcgacaacatcgaggccgagggaccagccggcgatagcgtggaggccgagggccgcgtgggagactccgtggacgcggaagggcctgccggcgattctgtggatgctgaggggcctttgggcgacaacatccaggctgaaggccccgcaggcgatagtgtagacgcagaagggcgcgtcggagattccgtggatgccgagggaccagcaggggacagtgtagacgccgaaggacgggtgggcgactcagtagaggcgggcgatccagcgggggatggagtggaagccggggtccccgccggtgattcagtagaagccgagggtcccgccggtgactccatggatgctgagggcccggccggtcgcgcgcgccgcgtgagcggagagccccagcagtcaggcgatggaagcctctctccgcaggctgaagcgatcgaagtggctgcaggcgaatcagcaggcaggtcaccaggcgaactggcctgggatgccgctgaagaggccgaggtaccaggcgtcaagggctccgaggaagccgccccaggggatgcacgcgccgacgcgggcgaagatagggtcggagatggtcctcagcaggagcccggggaggacgaagagcgacgggagcggtctccagaaggaccaagggaggaggaggcggccgggggcgaagaagagtcgccagatagcagtccccatggcgaggcttctcgtggcgctgccgagccagaagcccagctgtccaaccatttagcagaggagggtcccgccgaggggtctggagaggccgcccgcgtgaatggtagaagggaagatggggaggcatccgagccaagggcactggggcaagagcatgacatcacccttttcgtgaaggtgaagttgacagctttaggctgttcaaggattgccatcaaaaagtacctgcgcgctgggtacgacggcgaaagtattggtaattgcccattcagtcagagactgttcatgattctttggttaaagggagtcatcttcaatgtcaccacggtagatctcaaaaggaagcctgcagatcttcagaatctggcacctggcaccaacccccctttcatgacctttgacggcgaagttaaaactgacgtcaataaaattgaagagtttctggaggaaaagctcgcaccacccaggtatccaaagttagggactcagcatccagagtcaaatagcgctggcaacgacgtatttgcaaagttttctgccttcatcaagaacactaaaaaagatgcaaatgagattcacgagaagaaccttctgaaagctcttcggaaattggacaattacctcaactctcccctgcctgacgagattgacgcatactccacggaggatgtgaccgtcagcggccggaaattcttggacggggacgaactgacactggccgactgcaatttgttgcctaagctgcatatcattaagattgtggccaaaaagtatcgtgactttgagtttccctcagagatgacaggtatctggcgctacttgaataacgcctatgctcgggacgaattcaccaacacctgccccgccgatcaggagatagaacacgcttactcagatgtggccaagaggatgaagtag

SEQ ID NO: 40973 - DNA, 1785 bp, Artificial Sequence
  Description of Artificial Sequence: Synthetic coding sequence
atgtggtgcctgctgcggggcctgggccggcccggcgccctggcccggggcgcccttggccagcagcagtctcttggagcccgcgccctcgcaagcgccggttccgaaagccgggacgagtatagttacgtcgtcgtcggtgccgggtccgccggctgtgtcctggctggccggttgacggaggatccagctgagcgggttttgctgctcgaagcggggccaaaggacgtcttggccggtagcaagcggctgagctggaagattcacatgcctgctgcactcgtagccaacctgtgtgatgaccgatacaattggtgctatcacacagaagtgcagcgcggccttgatggaagggttttgtactggcctagaggcagagtttggggggggtcaagttccctgaacgccatggtatatgtgcgggggcacgcggaagactatgagcgctggcagaggcagggggcgcggggttgggactatgcccactgtctgccttattttcgtaaggcacagggccatgagctcggggccagcaggtaccggggagccgacggacccctccgagtctcacggggaaagaccaatcatcccttgcactgcgcttttctcgaagctacccaacaggcgggctatccgctcacggaggacatgaatggctttcaacaggaaggatttgggtggatggacatgactatccacgaggggaagcgctggagcgccgcctgtgcctacctccatcccgcactatctaggactaatctaaaggctgaggccgaaacattggttagccgagtccttttcgagggaacacgtgctgtgggcgtagagtacgtgaagaatgggcagtctcatagggcatacgcgtccaaagaggtcattttgagtggtggcgccattaattccccacagctgcttatgctatctggcatcgggaacgctgatgatttgaagaagctgggaatccctgtcgtgtgccacttgccaggcgtgggacaaaacctgcaagaccacctcgagatctacattcagcaggcctgcacaaggcctatcaccttgcactctgctcaaaagcccttacggaaggtctgtatcggacttgagtggctgtggaaattcaccggcgagggggccacggcccacctggaaacgggagggttcatacgctctcaacccggtgtaccacacccagatatccagttccattttctcccctcgcaggtgatagatcacgggagggtaccaacacagcaggaggcttaccaggtgcacgtcggtcccatgagagggacgtcagtcggctggctgaagttgaggagcgctaaccctcaggatcatccagtcatccagcccaattatctgtccaccgagacagacatagaggattttaggctgtgtgtgaagctgaccagagagatttttgctcaggaagccctggctcctttccgaggtaaggagctccagcccggctcgcatattcaatccgacaaagagatcgacgccttcgtccgtgccaaagccgatagcgcttatcatccgagctgcacatgtaaaatgggccagccatcagaccccactgcggtggtggacccccagacccgcgtgttgggtgtagaaaatctgagggttgtggacgcctccatcatgcctagcatggtaagcgggaacttgaatgccccaactataatgatagccgaaaaagccgccgatattattaaggggcagccagcactgtgggacaaagacgtccctgtgtacaaaccccgcacgctcgcaacacagagatag

SEQ ID NO: 40974 - DNA, 381 bp, Artificial Sequence
  Description of Artificial Sequence: Synthetic coding sequence
atgtggtgcctgctgcggggcctgggccggcccggcgccctggccagaggtgcactcgggcaacagcagagtctcggcgcacgggcattagcttccgctggctcagagagcagagacgagtactcttacgtagtcgtgggcgccggttcagctggatgtgtcctggccggaaggttgaccgaagaccccgctgaaagggtgttgctgctggaagccggaccaaaggatgttctggccggatccaagagactttcttggaagatccatatgcctgcagcgctggtggccaacctttgcgacgataggtataattggtgttatcacacagaggttcagcgcggcctcgacggtcgggtgctgtattggccgcgggggcgttag

SEQ ID NO: 40975 - DNA, 468 bp, Artificial Sequence
  Description of Artificial Sequence: Synthetic coding sequence
atgtggtgcctgctgcggggcctgggccggcccggcgccctggcccgcggtgccctcggccagcagcagtcattgggggcccgagccttagcctccgccggctctgagagcagagacgaatatagctatgtggtggtgggggctggcagcgcagggtgtgtgctggccggccgcctcaccgaagatccggcagaacgcgtgctcctgctggaggctgggccaaaggacgtgttagccgggtctaagcggctgtcatggaagatacatatgcctgccgctctcgtcgcaaacctttgtgatgaccgctacaattggtgctaccacaccgaagttcagcgaggactcgacgggcgggtactgtactggccgcgggggcgcgtgtggggcgggagttccagcctaaacgcgatggtctatgtcaggggtcatgccgaagactacgagcgatggcaaagacagggggcgtag

SEQ ID NO: 40976 - DNA, 1023 bp, Artificial Sequence
  Description of Artificial Sequence: Synthetic coding sequence
atgggcgagatggagcagctgcggcaggaggccgagcagctgaagaaacagattgccgacgcccggaaggcatgtgcggacgtcacccttgctgagctggtttccggccttgaggttgtaggacgcgttcaaatgcgcacccgtaggacgcttaggggacacctggctaaaatctacgccatgcactgggccacagactccaaactgctggtttcagccagccaggatggtaaattgatcgtgtgggattcttataccacaaataaggttcatgctattccattgcggtccagttgggtgatgacatgcgcctacgctccgtctgggaattttgtcgcctgcggtggactggacaacatgtgctcgatctacaaccttaagtctagggaggggaacgtgaaagtgtcgagggaactgtctgcccataccggttatctttcatgctgccggtttcttgacgataataacatcgtaacatccagcggagatacaacttgcgccctgtgggacattgaaactggccagcaaaagacagtgtttgtgggtcatactggagactgcatgtctctcgctgtttccccagatttcaacctcttcatctcaggcgcctgcgatgcttcagcgaagctgtgggacgtgcgcgaggggacctgtcgccagacgtttaccggacatgaaagtgacatcaatgctatatgtttcttcccaaatggagaagcgatttgtacgggatctgacgatgcttcttgccgcctgtttgaccttagagccgaccaagaactgatttgcttcagccacgagagtattatctgtggaatcacctctgtagcgttctccctgtccgggagactgctctttgccgggtatgatgactttaattgcaacgtgtgggacagtatgaagagtgagagggttggaattctgtccggccatgataaccgagtgtcgtgcctcggcgtaactgcagacgggatggccgtcgccactggtagttgggattcctttctcaagatctggaattag

SEQ ID NO: 40977 - DNA, 696 bp, Artificial Sequence
  Description of Artificial Sequence: Synthetic coding sequence
atgttcgtgttctactgcgcccactggcagacctacgtgagcggcatgctccggttcggcaaagtcgatgtcaccgagattcaaattgccctcgtgatagtctttgtactatctgcattcgggggcgctaccatgtgggactataccatccccattctcgaaattaagctaaagatcctaccagtgctcggcttcctagggggcgttatcttttcatgttcaaactattttcacgtgattctgcacggaggggtgggaaagaacgggagtactatagcagggactagtgtcctgtctcctggtctacatatcggactgattattattctggctatcatgatctacaagaagtcagctaccgacgtgttcgaaaagcatccatgcctgtacatcttaatgtttgggtgcgtgtttgccaaagtttcccaaaagctcgtcgtagctcacatgaccaaatctgaactctatctccaagacacggtgtttctggggcctggtctcctctttctggatcagtactttaacaacttcatagacgaatacgtcgtgctttggatggcaatggtgatctcttccttcgacatggtgatttactttagtgcactttgcctccagatctcgcgccacctgcaccttaacatttttaagacagcctgccatcaggcccctgaacaagtgcataagcacatcgattag

SEQ ID NO: 40978 - DNA, 1251 bp, Artificial Sequence
  Description of Artificial Sequence: Synthetic coding sequence
atgagcggccaccggagcacccggaagcggtgcggcgacagccaccctgagtcaccagtggggtttggacacatgtccacaacgggttgtgtgctcaacaaactattccagctccctacaccccccctctcaagacaccagctgaaacgtctggaggaacacaggtatcaatcagccgggcgttcactcttagaacccttgatgcaagggtactgggagtggttggtaagacgcgtgccctcttggatcgctcctaatctgattacaattattggactgagtataaatatttgtactaccatactgctcgtcttttactgccctaccgccacagaacaggcacctctgtgggcctatatcgcctgcgcgtgcggtctcttcatttatcagtctctggacgctatcgacggaaaacaagccagaaggactaattcctcttcaccactgggcgagctatttgaccatgggtgcgatagtttgtccacagtctttgtggtgctcggtacatgcatcgcggttcagcttggaacgaaccctgattggatgttcttctgctgttttgccggtacttttatgttctactgcgcccactggcaaacatacgtgagtggcactctcaggtttggcattatcgatgtaacagaggtgcagatttttatcatcattatgcacctcctcgccgtgattgggggacctccattctggcagagcatgatcccagtactgaatattcagatgaaaatttttcctgccctgtgcactgttgcagggacaatattctcttgcactaattacttcagagtcatcttcacagggggtgtggggaaaaatggctccaccattgccggcacttctgttctcagccccttcctccacatcggctctgtcattactctggcagcaatgatttacaaaaagtcggccgtgcagttatttgagaaacatccatgtttgtacatcctgaccttcggtttcgtgtctgcaaagattaccaataagctggtcgtggcgcacatgactaaatctgagatgcacctgcatgataccgctttcatcggaccagcactgctattcttagaccagtactttaattcatttatcgacgagtatatcgtgctgtggatcgctctggtattttcttttttcgacttaattcgatattgtgtgtccgtatgcaaccagatcgctagccatcttcacattcatgtgtttcggattaaggtaagtaccgctcacagtaatcaccactag

SEQ ID NO: 40979 - DNA, 1251 bp, Artificial Sequence
  Description of Artificial Sequence: Synthetic coding sequence
atgagcggccaccggagcacccggaagcggtgcggcgacagccacccagaaagtcctgtcgggttcgggcatatgtctacgaccgggtgtgttctgaacaagctttttcagctgcccacaccacctctgtccagacatcagttgaagcgactcgaagaacatcgctaccaaagcgcaggcagatccctgctcgagccactgatgcagggctattgggagtggctagttcggcgggtaccttcctggatcgctcccaacctgatcactattatcggcctctccatcaatatatgtaccaccatcctgcttgtgttctattgccctaccgctacagagcaagccccactctgggcatatattgcctgcgcttgcggcctcttcatatatcaatcattggatgcgattgacggcaagcaggcccggaggacaaactcttccagcccgctgggagagctgtttgaccacggctgtgactccctcagcaccgtgtttgtcgtcctcggaacctgtatagcagttcagctgggcactaaccctgactggatgtttttttgttgtttcgcagggactttcatgttctattgtgctcactggcagacatacgtgtccgggactctgcgcttcgggattatcgacgttacagaagtgcagatcttcataatcatcatgcacctcctggcagtgatcggtggcccaccgttctggcagagcatgattcccgtgctgaacatccagatgaagatttttcctgcactgtgtaccgtggcaggaactatttttagctgcaccaattacttcagagtcatctttacaggaggggttggaaagaacggttctacaatagcagggacaagcgtgctgagcccttttctgcatatagggtctgtcatcacacttgcagcaatgatttacaagaaatctgccgtacagctcttcgagaaacacccttgtctttacatcctgacatttggattcgtgtctgccaaaatcacgaacaagctggtggtagctcatatgactaaatccgagatgcacctgcacgacaccgcctttattggacctgccctgttgttccttgatcagtattttaattcgtttattgacgagtatattgtgctctggatcgcattagttttctccttcttcgacctgatccggtactgtgttagtgtctgcaaccagatcgcatcccacctccatattcacgtgttccgaatcaaggttagcaccgcacattcgaatcaccactag

SEQ ID NO: 40980 - DNA, 1599 bp, Artificial Sequence
  Description of Artificial Sequence: Synthetic coding sequence
atgatgatggtgcggcggggcctgctggcctggatcagccgggtggtcgttctgctggtgttgctgtgttgcgccataagcgttctttacatgctcgcctgcactccaaaaggcgacgaagagcagctcgccctaccacgcgctaactcacccaccgggaaggaggggtaccaagctgtgttacaggaatgggaggaacagcacagaaactacgtgagttcattaaaacggcagatcgcccaactcaaggaagagctgcaagaaagatccgagcagcttcgaaacggacaatatcaggcctccgatgcagccgggctggggttggatcgcagtcctccagaaaagactcaggccgacttgttggcttttctgcatagccaggtggataaggctgaagtcaacgccggtgttaagcttgcaacagaatacgctgccgtcccattcgacagtttcactttacaaaaagtgtatcaactcgagaccgggttaacccggcaccccgaggaaaagcccgtgcgtaaggacaaacgcgatgaacttgtcgaagccatcgaatctgcgcttgaaacactcaatagccccgccgaaaatagccccaatcatcgcccctacactgcaagtgactttatcgaaggcatatatcgcacggagagggacaagggcaccctgtatgagttaactttcaagggcgatcataagcatgagtttaaaaggttgatcctttttaggccctttggtccaattatgaaggtgaagaatgagaagttgaacatggccaacacattaattaatgtgattgtgccgctagctaaaagagtcgacaagttccgccagttcatgcaaaattttcgagagatgtgcattgaacaggatggtagggtacacctgaccgtggtgtattttggaaaagaggagattaatgaggtcaagggtatccttgaaaatacaagtaaggccgcaaacttccgaaattttaccttcatccagttgaatggtgagttctctcggggcaaaggcctggatgttggagcgagattttggaagggaagtaatgttctgctctttttttgtgacgtcgacatctattttacgagcgagttcctcaatacgtgcaggttgaacacacagcccgggaaaaaggtgttctacccggtcctgttctcccagtacaatcctggtataatctacggacatcacgatgcagtgccgcccctcgagcagcagctggtgataaagaaagagacgggtttctggcgagactttggttttgggatgacatgccaatatcgaagtgattttattaacatcggaggatttgatcttgatattaagggttggggcggtgaggacgtgcatttgtatagaaaatatctgcatagcaatttgattgtggtacgtactccagtgcggggcctgtttcacctctggcacgaaaagaggtgcatggacgaactgactccggaacagtacaaaatgtgtatgcagtcaaaggccatgaatgaggcttctcacggccagctgggtatgttggtcttccgccatgagattgaagctcacttacgcaagcaaaagcagaaaaccagcagcaagaagacctag

SEQ ID NO: 40981 - DNA, 1599 bp, Artificial Sequence
  Description of Artificial Sequence: Synthetic coding sequence
atgatgatggtgcggcggggcctgctggcctggatcagccgggtggtcgtgctcctggtattactgtgttgtgctatttccgtgttgtacatgctagcttgtacacctaagggcgacgaagagcagctcgcactccccagggccaacagcccaaccgggaaggagggctaccaggccgtccttcaggagtgggaggagcagcaccggaattacgtctccagcctcaagcgacagattgctcaattgaaagaggagctacaagagcgttccgagcagcttagaaatggccagtatcaagcatcggatgctgcaggacttggtctggacaggtctccccccgagaagacccaggccgatcttctcgctttcctacactcacaggtagataaagccgaggtcaacgctggagtgaagctggcgacagaatatgcagccgtaccctttgattctttcacactgcaaaaagtttaccagttggagactggcctcacccgacatcccgaagagaagcccgtcagaaaggataagcgcgacgaattggtcgaggcaattgagtcagctctcgagacattgaactcccccgccgaaaattcacctaatcaccgaccatacacagcttccgatttcattgagggcatctaccggacagagcgcgataaagggaccctgtacgagctgacgttcaagggcgatcacaagcacgaatttaaacgtctgattctgtttaggccattcggtccaatcatgaaggttaaaaacgagaagcttaatatggccaacacactgatcaacgtcatcgtgcccttggctaagagggtggataaatttagacagttcatgcagaattttcgagagatgtgcattgagcaagacggccgggtccacctcacggtggtttactttgggaaagaagagattaatgaagtgaaaggaattctcgagaacacttcgaaggccgctaattttagaaattttacctttatccagttgaacggggaattttcacgcgggaaaggcctggacgtgggtgcccggttctggaaaggatctaacgtcttgctgttcttttgcgatgtggacatctactttacttcggagttcctcaacacttgccgactcaatacacagcccggtaaaaaggtcttctaccctgtgctgttttctcaatacaatcccgggatcatctacggacatcacgacgccgttccacccctcgaacaacaactggttatcaaaaaagagaccggcttctggagggattttggctttgggatgacgtgtcaatatcgtagtgactttatcaatatcgggggattcgacttggacatcaaaggctggggtggggaggatgtccacttgtatcgaaaatacttgcacagtaatctcatcgtggtgcggactcccgtgcgcggactgttccacctgtggcacgaaaagcgctgtatggatgagttaactccagagcagtacaagatgtgcatgcagtcaaaagcaatgaatgaggcctctcacgggcagttgggcatgctggtatttaggcatgaaattgaagcccacctgcggaagcaaaaacagaagacttcctcgaagaagacttag

SEQ ID NO: 40982 - DNA, 1599 bp, Artificial Sequence
  Description of Artificial Sequence: Synthetic coding sequence
atgatgatggtgcggcggggcctgctggcctggatcagccgggtggtcgtattattggtgctgctgtgttgtgcaatctcggtactgtacatgctggcatgtacaccgaagggggacgaagagcagctcgcactcccccgcgctaactctccaacgggcaaggagggctaccaagctgtcctgcaggaatgggaggagcaacaccgaaactatgtttcttcacttaaaaggcagattgcgcagctgaaggaggaactgcaggagcgtagcgaacaactcagaaacggtcagtatcaggcaagtgatgctgctggcctcggactcgataggagtcctcctgaaaaaacacaagcggatttactggctttcctccactcccaggtggataaggccgaggtcaacgcaggagttaagctggcgacagaatacgcggctgtccctttcgactctttcacacttcaaaaggtctaccagttagaaactggtctcacccgacaccctgaggagaaacccgtcagaaaggataaacgggatgaacttgttgaagccatcgaatctgcacttgagactcttaactccccagccgaaaacagccctaaccaccggccctatactgcaagcgatttcattgaaggcatctaccgcactgagagggataagggcactctgtacgagctgacctttaagggggaccacaaacacgagtttaagcgcctcatcctcttccggccattcgggccaattatgaaagtgaagaatgaaaaactcaatatggccaatacccttattaacgttatagtgcccctggcaaaacgggtggataaattccgacagtttatgcagaatttccgcgagatgtgcatagaacaggatgggcgcgttcatctaacagtggtgtattttggcaaagaggaaattaacgaggtcaagggcattctggagaataccagcaaggccgctaatttccgcaatttcacgtttattcagctgaacggggagttctcccgcgggaagggcttagacgtgggagccaggttttggaaagggagcaatgtgttgctctttttctgcgacgtggatatatatttcacaagcgagtttctcaatacgtgtaggcttaacacccagccaggcaagaaagtgttttacccagtgttgttctcacagtacaatcctgggataatatacggccatcatgacgctgtccctcctctggagcagcagctcgtgattaagaaggaaactggtttctggcgggatttcggattcgggatgacgtgtcagtacaggagtgatttcatcaacatcgggggtttcgatctggatattaaaggttgggggggcgaggatgttcacctatatagaaagtacctgcatagcaatcttattgtggtaagaactccagtgaggggcttgtttcacctgtggcacgagaaacgttgtatggacgaattgaccccagagcagtataagatgtgcatgcagtcaaaggcaatgaacgaggcctctcacggccagttagggatgcttgtgttcaggcacgaaattgaggcacacctgcgaaagcagaagcagaagacatctagcaaaaagacttag

SEQ ID NO: 40983 - DNA, 291 bp, Artificial Sequence
  Description of Artificial Sequence: Synthetic coding sequence
atgatgatggtgcggcggggcctgctggcctggatcagccgggtggtcgtgctgttagtgctcttgtgctgtgccattagcgtgctctacatgttagcctgtacgcccaagggagacgaagaacaactggcattaccccgcgccaatagcccaactggtaaggaagggtaccaggctgttctacaggagtgggaagagcagcaccgtaattatgtctcatccttaaagcgtcaaattgcccagctgaaggaggagttacaggagaggtccgagcaattgagaaacggctag

SEQ ID NO: 40984 - DNA, 162 bp, Artificial Sequence
  Description of Artificial Sequence: Synthetic coding sequence
atgatgatggtgcggcggggcctgctggcctggatcagccgggtggtggttctgctggtactcctgtgctgtgccatttccgtgctgtatatgttggcatgcacccccaagggtgacgaggaacagttggccctccccagggctaatagccctacaggctag

SEQ ID NO: 40985 - DNA, 1599 bp, Artificial Sequence
  Description of Artificial Sequence: Synthetic coding sequence
atgatgatggtgcggcggggcctgctggcctggatcagccgggtggttgtgcttctggtgctcctgtgctgcgccatctctgtcctgtacatgctggcgtgtacccccaagggcgacgaggagcagttagctctgccgcgggccaactctcccactggcaaggaaggctatcaggccgttctgcaggagtgggaagaacagcaccggaactatgtgagttcactgaagaggcagatcgctcagctcaaggaagagctgcaagagcgctctgaacaactgcgaaatggtcagtatcaggcaagtgacgcggcagggctgggccttgacagaagtccgcccgagaaaacacaggcagacttgctggcatttcttcattcgcaggttgacaaggccgaggtcaatgctggcgtcaaattagctacggaatatgccgctgtgccttttgactccttcaccttacaaaaggtttaccagctggaaacgggactgacacgccaccctgaggaaaagccggtgcggaaggataagagggatgaactggtagaggccatcgaatcagccttggaaacactgaacagcccagcggaaaacagcccaaaccaccgaccatacactgccagtgactttattgagggaatctatagaaccgaacgggacaagggtaccctctatgagctgacctttaagggtgatcacaagcacgagtttaagcgacttattctcttccgtccatttgggcccattatgaaggtcaaaaacgagaagctcaacatggctaacaccctgattaatgtgattgtcccccttgcgaagcgcgttgacaaattccggcagtttatgcagaattttagagagatgtgtatcgaacaggatggccgcgtgcacctcaccgtcgtctacttcggaaaagaggaaatcaacgaggttaaaggcatcctggagaacacatcgaaggctgccaacttccggaactttactttcatccagctgaatggcgagttctcaagaggcaaaggcctagatgtgggtgcgcggttttggaagggctctaatgtgctgctcttcttctgtgacgtggatatttactttacctctgagttcctgaacacatgtagactcaacacacagcccggcaagaaggtgttctatcccgtgttgttctcccagtacaatccggggatcatctatggacaccatgatgcagtgccacccctggagcagcaactggtgatcaagaaggaaacgggattctggagagattttggctttggaatgacctgccaatatcgcagcgacttcatcaatataggtgggttcgatttagacataaaggggtggggcggtgaagatgttcacttgtacaggaaatacctgcacagcaatctgattgttgtgcggacacctgtgcgcggactgttccatttgtggcatgaaaaacgttgtatggacgaattgacgcccgagcagtataagatgtgcatgcaaagtaaggccatgaatgaagccagtcatggccaactagggatgttggtgtttcggcacgaaattgaagctcacctgcgcaagcaaaaacaaaagacctcctccaagaaaacctag

SEQ ID NO: 40986 - DNA, 315 bp, Artificial Sequence
  Description of Artificial Sequence: Synthetic coding sequence
atgatgatggtgcggcggggcctgctggcctggatcagccgggtggttgtgctgctagtgctcttatgttgtgcaatttccgtactatacatgctggcctgcactccaaagggtgacgaggagcagttggctctgccccgcgctaacagccctaccggtaaggaggggtaccaggcagttctacaggaatgggaagagcagcatagaaattatgttagctccctgaagcgacagattgctcagctgaaggaagagctacaggagcgttccgagcagcttagaaacggtcagtatcaggcatccgacgctgcttag

SEQ ID NO: 40987 - DNA, 45 bp, Artificial Sequence
  Description of Artificial Sequence: Synthetic coding sequence
atgatgatggtgcggcggggcctgctggcctggatcagccggtag

SEQ ID NO: 40988 - DNA, 1599 bp, Artificial Sequence
  Description of Artificial Sequence: Synthetic coding sequence
atgatgatggtgcggcggggcctgctggcctggatcagccgggtggtagtcctccttgtgttactctgttgtgcaatctccgtgctatacatgctggcctgcacacctaagggcgacgaggaacagctcgccctccccagagccaacagccctacgggcaaagagggctatcaggcagtgttgcaagaatgggaggagcagcacagaaattatgtctcctccctaaagcgccagatcgcgcagctgaaggaggaactccaggagagatccgaacagttacggaacggccagtaccaggcgtccgacgctgccggcctgggcttagacaggagccccccagagaaaactcaggcggacctgctcgcgtttctgcatagccaggtcgacaaagcggaggtgaacgcaggtgtaaagctggccactgagtatgcagccgtcccctttgacagttttactctccagaaagtgtaccagttagaaacaggtctgactagacatcctgaggagaaacccgtccgcaaagataagcgggatgagctggtagaggccatcgagtctgccctagagaccctgaatagtccagcagagaactcacctaaccatagaccctacaccgcctcagactttatcgaggggatctacagaaccgaaagggacaagggcaccctgtatgagcttacttttaagggtgaccataagcacgagttcaagcgattgatcctttttcgccctttcggcccaatcatgaaggtgaaaaacgaaaaactgaacatggcaaacacgttgatcaatgtcattgtgcctctcgccaagagagttgacaaatttaggcagttcatgcagaattttagggaaatgtgcattgaacaggatgggagagttcatctaaccgttgtgtactttggaaaagaggaaatcaacgaggtgaagggtatacttgagaacacttccaaagctgccaacttccgtaattttacgttcatccaacttaacggggaattttcacgcggcaaaggactggatgtcggagcgaggttctggaaagggtccaatgtgttgttatttttctgtgacgttgatatatacttcacctcggaattcctgaacacatgtcgtctgaacactcagcctgggaagaaagtgttttacccagttctttttagccagtacaacccaggaatcatctacggtcaccacgacgctgtgcccccgctggagcagcaactggtcattaagaaggaaacggggttttggcgtgattttggctttggaatgacctgccagtacaggtccgattttatcaatatcggagggtttgacctcgacattaagggctggggaggagaagacgtccacttgtacagaaagtacctccatagtaatctgattgtggtgagaactcctgtccggggtttgttccacctgtggcatgagaagagatgcatggacgaattaaccccggagcaatacaagatgtgcatgcagtcaaaagccatgaatgaggcaagtcacggccagctgggcatgctcgtcttccggcacgaaattgaagcccacctgagaaaacaaaagcagaagacctcttcgaagaaaacctag

SEQ ID NO: 40989 - DNA, 1002 bp, Artificial Sequence
  Description of Artificial Sequence: Synthetic coding sequence
atgccccggcggggcctgatcctgcacacccggacccactggctgctgctcggtctggccctgttgtgttctctggtgctgttcatgtatctccttgagtgtgcaccccagacggacggtaatgcatcactgccaggagtggtgggagaaaactatgggaaggagtactatcaggcgctgctgcaggagcaggaagaacactaccaaactcgcgccacgtccctcaaaaggcagatcgcacaattaaaacaagagttacaggaaatgagcgaaaaaatgcgctctctccaggagcgccgcaacgttggagccaatggcatcggttaccaaagtaataaggaacaagcccccagtgatctcttggaatttctgcacagccaaatagataaggccgaagttagtatcggcgccaaactgccctccgagtacggggtcattccttttgagagtttcaccctgatgaaggtgttccagttggagatggggctcacgaggcaccctgaggaaaagcctgtcagaaaagataagcgagatgagctagtggaggtcatagaggccgggctcgaggtgattaacaacccagatgaggacgatgagcaggaagatgaagagggaccccttggagagaagctcatcttcaacgaaaacgacttcgtcgaaggttactacagaacggagagagacaaaggtacccagtacgagctattttttaagaaagcagacttaactgagtacagacacgtcacactgttcagaccatttggcccccttatgaaggtgaaaagtgagatgatcgatatcactcggagcataatcaatattattgtcccactggcggagagaacagaggccttcgttcaattcatgcagaacttccgtgacgtatgcattcatcaggataaaaaaattcacttgaccgtagtgtacttcggcaaggagggactgtcgaaagtgaagtctattctcgagtccgtgaccagactcgcttcctctacgtggtag

SEQ ID NO: 40990 - DNA, 1629 bp, Artificial Sequence
  Description of Artificial Sequence: Synthetic coding sequence
atgccccggcggggcctgatcctgcacacccggacccactggctgctgctcggcttggcgcttctctgctctctggtgctgtttatgtacctgctggagtgcgccccacagaccgatggaaatgcgtcgttgcctggcgttgtgggcgagaattacgggaaggagtactatcaagccctactgcaagaacaggaagaacactaccagactcgggctacctctctcaagcgccaaatcgcacaactcaagcaggagttgcaggagatgagcgagaaaatgcggtccctgcaggagcgccggaacgtgggagccaacggcattggttatcagagcaataaggagcaggccccctccgatctcttagaattccttcatagccaaattgataaagcggaagtgagcatcggcgccaaactcccctctgagtacggggtgatcccgttcgaatcctttaccctcatgaaggtgtttcagttggaaatggggcttacaagacatcctgaagaaaagcccgtaagaaaggataagcgcgatgagctcgtggaggttatcgaggccggtctggaggtgatcaacaatcccgacgaggacgacgagcaggaggacgaggagggcccgcttggtgagaaactcatctttaatgaaaatgattttgtcgagggctactataggacggaacgcgacaaagggacccagtacgaattgttcttcaagaaggcagatctcactgagtaccggcacgtgacacttttccgccccttcggtcctttaatgaaggttaagtcagagatgattgatatcaccagatctatcatcaacatcattgttcctctcgccgagcgaacagaagccttcgtgcagtttatgcagaatttccgcgacgtctgtattcaccaggacaagaaaatccatcttacagtggtgtacttcgggaaggaaggtctgagcaaggtcaagtcaatcctcgaatccgtcacttccgagagtaacttccacaactataccctggtctccctgaacgaagagttcaaccgcgggaggggtctcaacgtgggggcccgtgcctgggataagggcgaggtgctcatgtttttttgtgatgtggacatctacttctctgccgagttcttgaattcctgccggctcaatgcggaaccaggaaaaaaggtgttttatcccgtagtgttctcgctatataatcctgccatcgtgtacgctaatcaggaggtgcctcccccagtagaacaacagctggtgcacaagaaggactctggcttctggagagatttcggcttcggaatgacatgccagtaccgatccgatttcttaactatcggcggcttcgacatggaagtcaaaggttggggaggagaggatgtgcacttgtacaggaagtatttacacggggatctgattgtgattagaacccccgtaccggggctgtttcacctgtggcatgagaaaagatgtgcagatgaactgacacctgagcagtaccggatgtgtattcagtccaaggcaatgaacgaggcctcccatagtcacctcgggatgctggtgtttcgagaagaaatcgagacccatctccacaaacaggcctatcggacaaatagtgaggcagtgggatag

SEQ ID NO: 40991 - DNA, 1620 bp, Artificial Sequence
  Description of Artificial Sequence: Synthetic coding sequence
atgggccgggccggcggcggcggccccggccggggccccccccccctcctgctattcctgggggcagccctcgttctagcctccggagccgtacccgctcgggaggcaggatctgctgtagaagccgaggagctcgtgaaagggtcgccagcgtgggaacctccagccaacgacacccgggaagaagctggccctcctgctgccggggaggacgaggcctcatggaccgctccaggaggcgaactcgcgggcccagaagaagtcctccaggaaagcgctgctgtcactggcacagcatggctcgaggcagacagtccagggctaggtggcgtaacggctgaggccggctccggagacgcacaggccttgcctgcgacattacaggcgcctcatgaagtgctgggccagagcatcatgccaccggccatcccagaagccacagaagctagtgggccaccgtctccaacacctggggataagctgtctcctgccagcgagctccccaaagaatccccactcgaggtttggctgaatctagggggcagtacaccggaccctcagggtccagagcttacctatccattccagggcactctggagccccagcctgctagcgatatcattgacattgactactttgaaggtttggacggggaaggcaggggggccgatctcggcagcttccctggcagcccaggtactagcgaaaatcatcccgataccgagggagagacaccttcctggtccctactcgatctatacgatgatttcacacccttcgatgagtcagatttctacccaacaacatccttctatgatgacctggacgaagaagaggaggaagaggaggacgataaagatgctgttggaggcggagacctggaggacgaaaatgagcttctggtgcccacagggaagcctggactgggcccaggcaccggacagcctacatctcgatggcacgccgtgcctccgcagcacactctcggttccgtcccagggagctccattgccttgcggccaaggccaggcgaaccaggccgcgatcttgcttcatcagaaaacggtaccgagtgccggtccggctttgtgaggcacaatgggtcctgcaggagcgtatgcgacctgttcccaagctactgccataacggcggtcagtgttatctggtggagaatattggcgccttctgtaggtgcaatacccaggactacatctggcacaaaggcatgcgatgcgagagcataatcaccgacttccaggtcatgtgcgtagccgttggcagcgccgccttggttctgcttctccttttcatgatgacagtattcttcgctaaaaaattatacctacttaagaccgaaaacaccaaactcaggcggactaacaagttccgtactccaagcgagctgcacaacgataatttctcactctctactattgcagagggcagccaccccaatgacgacccttctgcgccacacaaaatccaggaagtgcttaagtcctgtctgaaagaagaagagtccttcaacattcagaacagcatgagtcctaagctggaggggggcaaaggcgatcaagctgacctcgatgtcaactgcctgcagaataacctaacttag

SEQ ID NO: 40992 - DNA, 1701 bp, Artificial Sequence
  Description of Artificial Sequence: Synthetic coding sequence
atgggccgggccggcggcggcggccccggccggggcccccccccccttctgttgtttttaggcgccgccctggttctagccagcggtgcagtgccagcccgggaagccggatctgccgtcgaggccgaagaattggtgaagggaagtcccgcctgggaaccacccgccaatgacactagggaagaggcgggccccccagctgccggcgaagatgaggccagctggacggccccgggtggggaacttgctggtcctgaagaagttctgcaggagtctgctgcagttactggtacagcctggctcgaggctgattcacccggactgggtggcgtcacagccgaagcaggaagcggagacgctcaggcgctgccagcaacactgcaagcacctcatgaggttcttggtcaatcaataatgccgccagccatccctgaggctacggaagcatcaggccccccgagccctacaccaggggataaattgagcccggcctccgagctccccaaagagagccctctggaggtttggttgaacctcgggggctccacgccagacccacagggtcccgagttgacatatccgtttcaagggaccctggagccccagccagcttcagatattatcgacatcgattacttcgaagggctggacggggaaggccgaggagcagacctgggctccttccctggttcaccggggaccagcgaaaatcatcccgacaccgaaggcgaaaccccttcatggtctctgctcgatttgtatgatgacttcaccccgttcgacgaaagcgacttttaccccacaacgtctttctatgacgacctggacgaggaggaggaggaggaagaagacgataaagacgctgtcggcgggggtgacttggaggatgagaacgagttgctcgtgccaactggtaaaccaggtctcgggccgggcacgggccagcccacatcccgctggcacgcagttcctccccagcatacccttggaagtgttccagggtcttctattgctctgcgccctcgtcccggggagcctgggcgtgacctggcttcctcggagaacggcacagagtgcaggtccggctttgttcggcataatgggagctgtcgcagcgtttgcgatctgtttccaagctactgccataacggcggacaatgctatctggtggaaaacattggtgctttctgcaggtgtaacacccaggactatatctggcacaagggcatgcggtgcgaatccattattacagatttccaggtcatgtgtgtggccgtcggcagcgctgcactggtgctgctgcttctcttcatgatgaccgttttctttgcaaagaaattgtacctactgaagacagagaatacaaagcttcggcggaccaataaatttcgaactccgagcgaactgcacaacgacaatttctctctgagcaccatcgctgagggatcccatcctaatgttcgaaaactttgcaataccccaagaacttcaagtccacacgccagggcgttggcccattatgataatgtcatttgccaggatgaccctagcgcgccccacaagattcaagaagtactcaagagttgtctgaaagaggaagagtctttcaacatccaaaattcgatgtcccccaaactagaggggggcaaaggggaccaggccgatctagatgtcaattgtcttcagaataaccttacatag

SEQ ID NO: 40993 - DNA, 1206 bp, Artificial Sequence
  Description of Artificial Sequence: Synthetic coding sequence
atgccccccgccatccccgaggccaccgaggccagcggcccccccagtcctacccctggcgacaagctgagccctgcctcagagctcccaaaggagtcacccttggaggtctggcttaacttgggaggtagtacgccggacccacaaggtcccgagctgacctacccattccaagggacactggagccccaaccagcaagtgacattatagatattgactatttcgaggggcttgacggggaaggccgcggtgccgacctcggctcgttccccgggagtcctggaacgtctgagaaccaccctgacacagaaggcgagacaccatcctggtccttactcgatctgtatgatgatttcaccccttttgacgaatccgatttttatccaaccacgagtttctacgatgatctggacgaagaggaggaggaagaggaagatgataaggatgccgtgggcggcggagacctggaggacgaaaatgagttgttagtccctaccggaaagccaggactaggacccggtactgggcagcccactagccggtggcatgccgttccccctcaacatacactgggcagtgtccctgggtcttccattgctctccgaccccgaccaggagagccaggccgtgatctggccagcagcgaaaatggcacagaatgcaggagtggtttcgttcgacataacgggagctgtcggtctgtctgtgatttgtttccttcctattgtcacaatggcggacagtgctaccttgtggaaaacatcggtgccttttgcaggtgcaacactcaagattacatttggcacaagggcatgcgctgcgagtccattatcacggattttcaggtgatgtgcgtcgccgtcggcagtgctgcacttgtcttactgcttctgttcatgatgacagtgttcttcgccaaaaaattatatttgttgaaaacagagaataccaagctccgacgaaccaacaaattccgaacaccttccgaactgcacaatgacaacttttcgctctctaccatcgcagagggctctcaccctaatgacgacccttccgcgcctcacaagattcaggaagtattaaagagctgcctgaaggaggaagaaagctttaacattcagaatagcatgtcacctaaactggaaggtggaaagggcgaccaggctgacctggatgttaattgcctccagaacaacttaacatag

SEQ ID NO: 40994 - DNA, 822 bp, Artificial Sequence
  Description of Artificial Sequence: Synthetic coding sequence
atgagccgggtggtgagcctgctgctgggcgccgccctgctgtgcggacatggagccttttgtcgccgggtggtgagtggacagaaagtgtgctttgccgatttcaaacacccttgctacaagatggcctatttccacgagctctcttccagagtctcctttcaagaagcaagactagcatgcgaaagcgaaggtggcgtcctgttgtccctggagaatgaagctgagcagaaactgatagagtcaatgttgcagaatctgactaagccagggaccggaatcagcgacggggatttctggatcggcctgtggagaaacggcgatggtcagacaagtggcgcgtgccctgacctttaccagtggtctgacggaagcaattctcaataccgcaactggtacactgacgagccgagctgcggcagtgagaaatgtgtggtgatgtaccatcagcccaccgccaaccccgggctgggcggtccctatctataccagtggaacgacgaccggtgtaacatgaagcacaactacatctgtaaatacgagcccgagattaatcccaccgctcccgttgagaaaccctatctgacaaatcaaccaggtgatacacaccagaacgtggtggtcactgaagcagggataattccgaatcttatctacgtggtcatccctactattccactcctcctactgatcctggtcgcatttggaacctgttgcttccaaatgctgcacaagtccaagggacggactaaaacctcacctaatcagagtaccctgtggatctcaaagtcgacaagaaaggagagcgggatggaagtatag

SEQ ID NO: 40995 - DNA, 711 bp, Artificial Sequence
  Description of Artificial Sequence: Synthetic coding sequence
atggcctacttccacgagctgagcagccgggtgagcttccaggaggcgaggctggcatgtgagagcgagggcggagtacttctgtctctcgaaaacgaagccgagcagaaactgattgaatccatgcttcagaacctgacaaagcctggtacgggaatctctgacggggatttctggatcggcctgtggaggaacggtgatggacaaacctcgggcgcatgccccgacttgtaccagtggtccgacggcagcaattctcaatatcggaattggtatacagacgagccctcatgcggctccgagaagtgcgtggtgatgtaccaccagcctacagcgaacccggggcttgggggcccttacctgtaccagtggaatgatgataggtgcaatatgaaacataattatatctgtaaatacgagccagagatcaacccgactgccccagtggagaagccctatctgactaaccagcccggagacacacaccagaatgtggtggtcacagaggctgtcaaagaagagcaaaaactcgtacaaacaagtctccactgcggctttcagagagttcccgagaaaaaagtggcatggaaatacaataactccctcacctggttccagaattttgtgattctcgacctctataaggaatggcaccagaacaactcactggagtggttggaaatcacgaaggacttgcaggacgagctgtag

SEQ ID NO: 40996 - DNA, 699 bp, Artificial Sequence
  Description of Artificial Sequence: Synthetic coding sequence
atggcctacttccacgagctgagcagccgggtgagcttccaggaggcacggctggcatgcgagagtgaaggaggggtgctgttatctctggaaaacgaggccgagcagaagctgatcgagagcatgcttcagaatttaacaaaaccgggcacgggcatcagcgacggcgatttctggatcggactgtggcgcaacggtgatggccagaccagtggcgcttgtcctgacctctaccagtggagcgacggcagtaatagccaatatcgcaactggtacacagacgaaccttcctgcgggagtgagaaatgcgtggtcatgtaccaccaacctacagcaaaccctgggctgggaggtccgtacctgtaccaatggaatgatgatcgatgcaacatgaaacacaactacatttgtaaatacgagcccgagatcaatccgacggccccagttgaaaaaccctatttgaccaaccaaccgggtgacacacaccagaacgtggtagtgactgaagccggaattatccctaatttgatatacgtcgtcatccccacaatccctctgctattattgatactggtcgcctttggtacttgctgctttcagatgctccacaagtccaagggacggacgaaaacatcccctaatcagtctactctttggatatcaaagtccactcgcaaagaatcaggtatggaggtctag

SEQ ID NO: 40997 - DNA, 699 bp, Artificial Sequence
  Description of Artificial Sequence: Synthetic coding sequence
atggcctacttccacgagctgagcagccgggtgagcttccaggaggcccggcttgcttgtgaaagcgagggcggggtcctactttctcttgagaacgaagctgagcagaaattgatcgagtccatgctgcaaaacctgactaaacccgggactggcatcagcgacggcgatttctggattggcctctggcggaatggcgatggacagacctcaggtgcctgtcccgacctgtaccaatggagtgatggatccaattcacagtatcgcaactggtacaccgatgaaccgagttgtggctcagaaaagtgtgtcgtgatgtaccaccagcccaccgcaaaccccggcctggggggaccgtatctgtatcagtggaatgacgacagatgcaatatgaagcataactacatctgtaagtacgaacctgagattaacccgacagcccccgtggagaaaccttatcttaccaaccagccaggcgacacccatcagaatgtcgtggtgacagaggctggcataatccccaacctgatatacgtggtcattcctaccattccacttcttttgttgattttggtggctttcgggacatgctgcttccaaatgctccacaagtctaaaggcagaacgaagaccagcccaaatcagagtactctgtggattagtaagagcacgcgcaaagaatcaggtatggaagtgtag

SEQ ID NO: 40998 - DNA, 711 bp, Artificial Sequence
  Description of Artificial Sequence: Synthetic coding sequence
atggcctacttccacgagctgagcagccgggtgagcttccaggaggctcgattggcttgcgagtcagaggggggagtgctgctgtcactagaaaacgaggcagagcagaaacttatcgagagcatgctccagaaccttacgaaacctgggaccgggattagcgacggggacttctggattggcctgtggagaaacggggacgggcaaacatcaggcgcctgtcccgacctctatcaatggagcgacgggtcaaattcccaatacagaaactggtatacggacgagccttcatgcgggtcagaaaagtgtgtcgtgatgtaccaccaaccgactgcaaaccctggcctggggggtccatatctgtaccagtggaatgacgaccggtgtaatatgaaacacaactatatttgcaagtacgagcccgagatcaacccaactgcacctgtggaaaagccttacctcacaaaccagcccggagatacccaccagaacgttgtggtgaccgaggcagtgaaagaggaacaaaagctcgtgcagacttcactccactgtggttttcaacgggtaccagaaaagaaggtggcatggaagtataataacagcttaacttggttccagaatttcgtaatcctggatctttacaaagagtggcaccagaataattctttggagtggctggagattacgaaggatctccaggatgagctgtag

SEQ ID NO: 40999 - DNA, 711 bp, Artificial Sequence
  Description of Artificial Sequence: Synthetic coding sequence
atggcctacttccacgagctgagcagccgggtgagcttccaggaggccaggttggcttgcgagagcgaaggcggtgtgctgctaagtctcgaaaacgaagccgaacagaagctcatcgagtccatgctgcaaaacctcacaaagccagggacaggcatctccgatggtgatttttggatcggcctgtggagaaatggcgatggtcagacaagcggagcgtgccctgacctgtaccagtggtccgacgggagcaattcccagtataggaattggtacacagatgagcccagttgtggctccgagaagtgcgtcgtcatgtatcaccagccaaccgctaacccaggactggggggaccatacctctaccagtggaacgacgacaggtgcaatatgaaacacaattacatttgcaaatatgaacctgaaatcaatccaacagccccggtcgaaaagccttatctcactaaccagcccggcgacacccatcagaatgtggtggtgacggaggccgtgaaagaggagcagaagcttgtccagacctcgttacactgtggtttccaaagggtgccagagaaaaaggtggcctggaagtacaacaattccttaacctggttccagaacttcgttattctcgacttatacaaagagtggcatcaaaataatagccttgaatggctagagattacaaaggatctgcaggatgaattatag

SEQ ID NO: 41000 - DNA, 141 bp, Artificial Sequence
  Description of Artificial Sequence: Synthetic coding sequence
atggcctacttccacgagctgagcagccgggtgagcttccaggaggccaggctcgcctgtgagtctgaggggggtgtgctactgtctctggagaatgaggccgagcagaagctcattgaaagtatgctgcaaaatctttag

SEQ ID NO: 41001 - DNA, 141 bp, Artificial Sequence
  Description of Artificial Sequence: Synthetic coding sequence
atggcctacttccacgagctgagcagccgggtgagcttccaggaggcacgcctggcctgtgaaagcgaggggggagttctgctgagcctcgaaaacgaagcagagcagaaactgatcgaatcaatgctccaaaacctgtag

SEQ ID NO: 41002 - DNA, 141 bp, Artificial Sequence
  Description of Artificial Sequence: Synthetic coding sequence
atggcctacttccacgagctgagcagccgggtgagcttccaggaggctaggctagcttgtgagagcgagggaggcgttctgctgagcctggaaaacgaggctgaacagaagcttattgaaagcatgctgcagaacctgtag

SEQ ID NO: 41003 - DNA, 765 bp, Artificial Sequence
  Description of Artificial Sequence: Synthetic coding sequence
atgaccgccggcagcgcccacagccagaaggtgtgcttcgccgacttcaagcatccatgttataaaatggcatactttcacgaactgagctccagagtgagttttcaggaggcgcgtctcgcctgtgaatccgaagggggggtgctgctgtctttagagaacgaagccgagcagaagctcattgagtccatgttacaaaacctcacgaaacctggcactggcattagtgatggagatttttggattggcctgtggaggaacggcgatgggcagacatccggggcttgcccagacttataccaatggtctgatggatccaattcgcagtaccgcaactggtataccgatgaaccaagttgcgggagcgaaaagtgcgtggtgatgtatcaccagccaaccgccaatcccggattagggggaccctatttataccagtggaacgacgataggtgcaatatgaaacacaactatatatgtaaatacgagccagaaattaacccaacagctcccgtcgaaaagccctatctgaccaaccagcctggcgatacgcatcagaatgtggtggtgacagaggccgggattattcccaacctgatctatgtggtaatccctactattcccctccttttgctgatcctggtagcctttggaacctgttgctttcaaatgctgcataaaagtaagggacggaccaaaaccagcccgaaccagagcaccctgtggatcagcaaatctaccagaaaggagagtgggatggaggtgtag

SEQ ID NO: 41004 - DNA, 1239 bp, Artificial Sequence
  Description of Artificial Sequence: Synthetic coding sequence
atgcagaagtactgcatctaccagcacttccagttccagctgctgatccagcacctctggatcgcagctaactgcgacattgccgatgagcggttcgacgcaaccttccacaccaatgtgctggtgaattccagcggacactgtcagtatctgccacctgggatttttaaaagcagctgctatatcgatgtacggtggttcccatttgatgtgcagcattgcaaactgaagttcggaagctggtcctacggcggctggtctctagacctccagatgcaggaggccgacatcagcgggtacatccccaatggggaatgggacctggttggcattccagggaagcgctccgaacgcttctatgagtgttgtaaggagccatacccagatgttactttcaccgtgaccatgcgaagacgtaccctgtactatggactgaacctcctgattccatgtgttctgatctcagctctcgcactcttggtgtttctgctgccagctgatagcggagaaaagatctctctgggcattacagtgcttctctccctcaccgtattcatgctgcttgtggctgagatcatgcctgctacaagtgacagcgtgcccctcattgctcaatatttcgcgagtactatgatcattgtgggtctctccgtcgtggttacggtcatcgtgctacaatatcaccaccacgaccccgatggggggaaaatgcccaaatggactagggtcatcctcctgaactggtgtgcatggtttctccgaatgaaaaggccgggcgaagataaggtgcgtccagcctgccagcacaagcagcgaaggtgctcattggcctccgtggagatgtctgccgtggccccccctcctgcctccaatggcaatctgctctatatcgggtttcggggtcttgatggcgtgcattgtgtgccaaccccagacagcggcgtggtgtgtgggaggatggcgtgttcccccacacatgacgagcatctgcttcatggtggacaacccccagaaggtgacccagatctggctaagattctcgaggaggtgcgctacatcgctaacagattccgctgtcaggacgaaagtgaggccgtgtgctcggagtggaaatttgctgcatgcgtcgtcgacaggctttgtctcatggcttttagcgttttcactattatctgcacaatcggaattcttatgagcgcaccaaatttcgtcgaagctgtcagcaaggattttgcctag

SEQ ID NO: 41005 - DNA, 966 bp, Artificial Sequence
  Description of Artificial Sequence: Synthetic coding sequence
atgcaggaggccgacatcagcggctacatccccaacggcgagtgggatctggttggcatccctggcaaacgctcggaacggttttatgaatgttgcaaggaaccgtatcccgacgtgacattcaccgtgacgatgcgccggcgcaccttatactatggcctgaatttgttaatcccatgcgtactcatctccgccttggccctgctcgttttcttgctgcctgccgacagtggcgagaagatcagcttaggtatcaccgtactccttagcctgaccgtgttcatgctgttggttgcagagattatgcccgctacctcggactcagtgcccttgattgctcaatactttgcttcaactatgatcattgttggtctgtctgtggtagtcactgttatcgtactccagtaccatcatcacgaccccgacgggggcaaaatgcctaagtggaccagagtcatcctgctgaactggtgcgcttggtttctcagaatgaagagaccaggagaggataaggtccggcccgcctgccagcacaagcagagaagatgtagcctggcttcagtggagatgtccgctgtcgcgccgcctccagccagcaatggcaacctgttgtatatagggttcaggggactggatggggtacattgtgtacctaccccagactctggtgtggtctgtgggcgaatggcgtgtagcccaacccatgatgaacatctgctgcacggcggacagcctcccgagggcgatccagatctggcgaagatcctcgaggaggttcggtacatagctaacaggttcaggtgtcaagatgagtccgaagcagtatgctccgagtggaagttcgccgcctgcgtcgtcgatcggctgtgtcttatggccttttccgtctttaccatcatctgtaccatcggaattctgatgagcgcccctaactttgtcgaagccgtttcaaaagattttgcatag

SEQ ID NO: 41006 - DNA, 966 bp, Artificial Sequence
  Description of Artificial Sequence: Synthetic coding sequence
atgcaggaggccgacatcagcggctacatccccaacggcgagtgggaccttgtaggaattcctggcaaacggagtgagaggttttacgagtgttgcaaagaaccctacccagacgtaacatttactgtgactatgcgccgacggaccctctattatggactgaatctcctgatcccttgtgttctcatatccgcactcgcacttttagttttcctgttacctgctgattctggcgaaaaaatcagcctggggatcaccgtgcttctaagcttgacagtgttcatgctgctggttgccgaaatcatgcccgcaacttcagactccgtgcccttaatagcacagtattttgccagcacaatgataatagtgggcctgtctgtcgtcgtcaccgtgatagtcctccagtaccaccaccacgatcctgacggtgggaaaatgcctaagtggacacgggtcattcttttaaactggtgtgcttggtttttgaggatgaaaaggcccggcgaggataaggttagacccgcttgccagcataaacagcggcggtgttccctggccagtgtggagatgtcagccgtggcaccgccccctgcaagcaacgggaatctgctctatatcggcttccgggggttggacggcgtgcactgtgttcccaccccagattccggagtggtgtgtggccggatggcctgttcacctacccacgatgaacacctccttcacgggggccagccaccggaaggggatccagatctggcaaaaatcctggaggaggtccgctatatcgcaaatcgctttcgctgccaggacgagtccgaagccgtttgctccgagtggaagtttgcggcctgcgtcgtggacaggctgtgcctgatggccttctcagtattcacaattatctgcacaatcgggattcttatgtctgcaccaaacttcgtggaagccgtctccaaagactttgcctag

SEQ ID NO: 41007 - DNA, 1626 bp, Artificial Sequence
  Description of Artificial Sequence: Synthetic coding sequence
atggccagccaggagttcgaggtggaggccatcgtggacaagcggcaggacaagaacggcaacactcaatacctcgttcggtggaaaggctacgataagcaggatgatacctgggagcccgagcagcatctaatgaattgtgagaagtgtgtgcacgacttcaatagacgtcagactgaaaaacaaaagaagctgacatggaccactacctcgagaattttctctaataacgcccgaaggagaaccagtaggagtacaaaagccaattacagcaagaactccccaaaaacaccagttacggacaagcaccatcgcagcaagaactgcaaactgtttgccgctagcaagaacgtccgacgcaaggccgcttccacgctgtccgacaccaagaacatggagataataaacagcactattgagaccctagcaccagacagcccttttgaccacaagaagacggtctcaggtttccagaaactagagaaacttgatcccatcgccgctgaccaacaggacacggtagtctttaaggttacggagggaaagttgctgagagaccccctctcacaccccggggccgagcagaccggcatacagaataagacccaaatgcaccctctgatgtctcaaatgtcagggagcgtcaccgcatctatggctacaggttccgcgaccaggaaggggattgtggtactgattgatccccttgcggcaaacggcacaacggatatgcacacgtccgttccaagggtcaaaggaggacagcgcaatatcactgacgactcgcggggccagccattcattaagaagatgcatttcacaatcagattaaccgagtccgccataacttacagagacattgtcgtgaaaaaggaagatggctttacacagatcgtgctgtcaaccaggtctactgaaaaaaacgcactcaataccgaagtgataaaagagatggtgaatgccctcaacagtgcggcagcagatgacagtaagctggtgctcttttctgccgccggaagcgtgttctgctgcgggcttgattttggctatttcgtcagacatctgagaaacgacagaaatacagccagcctggagatggtggatactataaagaactttgtgaacacgttcatccaatttaagaagcccatagtggtttccgtgaatggcccggcaattggtctgggtgccagcatacttccattgtgcgatctggtatgggccaatgaaaaagcatggttccagactccttacacaactttcggtcagtcccctgatggatgttcctctatcacatttcccaagatgatgggcaaagcctccgcaaacgaaatgcttattgccggccggaaacttactgccagagaggcctgcgccaagggcctagttagccaggtattcctgaccggtactttcacacaggaagttatgatacaaatcaaagagttggccagctacaacgcgatcgtgctcgaagaatgcaaagcccttgttaggtgcaacatcaagttggagcttgaacaggccaacgagcgggagtgcgaggtgctaaggaagatctggagtagtgcccagggcatcgagtccatgcttaaatatgttgaaaataagatcgacgaattctag

SEQ ID NO: 41008 - DNA, 1668 bp, Artificial Sequence
  Description of Artificial Sequence: Synthetic coding sequence
atggccagccaggagttcgaggtggaggccatcgtggacaagcggcaggacaagaatggcaacacgcagtacctggttagatggaagggctatgataaacaagacgatacctgggagccagagcagcatcttatgaactgtgagaagtgtgtgcatgatttcaaccggcgacagactgagaagcagaagaagctgacatggacaaccacaagccgaatcttcagcaataatgccagaaggcggacgtcccgctctaccaaggccaactactccaaaaacagtcctaagactcctgtaacagataagcatcacaggtcgaagaattgtaaattatttgcggcttcaaaaaatgtaaggagaaaggcagcaagcaccctttccgacaccaagaatatggagattatcaactctactatagaaacactcgcgcccgattcaccctttgatcacaaaaagactgtaagcggcttccagaagctggagaaactcgatccaatcgccgcagaccagcaggataccgtggtgttcaaggttactgaggggaagctgctccgcgacccattgtcgcaccccggggcagagcaaacagggatccaaaacaagacccagatgcatcccctgatgagtcagatgtctggctcagtgacagcctcaatggccaccggctccgccacaagaaaaggaattgtggtcctgatagatccactggctgccaatgggactacagatatgcacacatccgtgcctcgggtcaaaggcggccagcgtaacatcactgacgactccagggggcagcccttcataaaaaaaatgcatttcacgatcaggctcacagaatcagcaatcacctatcgggacatcgtggtaaaaaaggaagacggtttcactcagattgttctgtccaccaggagcacagagaaaaacgccctcaataccgaggtgatcaaagagatggttaatgcactcaattccgccgctgccgacgattccaagctggtgttgtttagtgcagctgggtccgtgttttgttgtgggctagattttggatacttcgttagacaccttcggaatgaccgtaacaccgctagcttggaaatggtggacactatcaaaaactttgtgaatacattcatccagttcaaaaagcccattgtcgtgtctgttaacggcccggccattgggctgggggctagtatactgccattgtgcgacctggtgtgggccaatgagaaggcctggttccagacgccttatacaacatttggccagtctcccgacggttgttcctctatcacattccccaagatgatgggaaaggcctctgccaacgaaatgctgatcgctggccggaagctgaccgcccgtgaagcctgtgctaaaggtctcgtgtctcaggtgtttctcacaggcactttcacccaggaagtgatgatacagattaaggagttagccagctataacgctattgttctagaggaatgcaaagctctggttcgctgtaatatcaaattggagctggagcaggctaatgaaagagagtgtgaggtactgcggaagatctggagcagcgcacagggaatagaaagcatgctgaagatccctttattgggctacaaggcagccttccctccacgaaagactcagaatgatcagaggtggtgcccatag

SEQ ID NO: 41009 - DNA, 2403 bp, Artificial Sequence
  Description of Artificial Sequence: Synthetic coding sequence
atggccaccctgggccagaagcccgtgatccacaccgtgctgaagcggaaggtttattcaagtaacgaaaagatgcgcagagggacatggcgcatcgtagtccctatgacaaaggacgatgcgctcaaggaaataagagggaaccaggtgacattccaagactgtttcatcgcagactttctaatcctgcttacattccccttgcttaccattcccgagatccctggatatttgcctatttctagccctcgaggctctcaactgatggctagctgggacgcttgcgtggtggcctctgccgtcctcgtgaccgacatggaaacatttcacacaactgactcatttaaaagttggactagaatccgggttccacccgacatcctgagtgacgatgagaggagaagcgttgcacacgtcatcctgagtcgagatgggatagtattcctcattaacggtgtgctgtatattaagtcatttagagggttcatccggctaggaggcatcgttaatctgccagacggggggatcacaggcatctcttcacggaaatggtgttgggtgaactatcttctcaaagcaaaaggacgcaggagtacattcgccgtgtggacagagaacgaaatctatttaggctccatcctcctgaagtttgctcgcctagtcactaccaccgagctcaagaatatcctgagcctgtcggtcaccgccaccttgaccatcgacagagtcgagtacaccggccaccctctggaaattgccgtgttcctgaactattgtacagtctgtaatgttactaagaagatctttctcgtcatctataatgaggacacaaagcagtgggtgtcccaggacttcactctggacgcacccatcgactccgtcactatgccacactttacattttcagccctgccaggtctactgctgtggaataaacattctatctactattgctatcacaactttacatttaccggaatcttacaaactcccgccgggcacggaaatctgagcatgctgtccaacgactccatcatccacgaagtgttcatcgattactacggggacatcctggtgaagatggagaacaacgtcatcttctactcgaaaataaacactcgtgacgccgtcaagctccatctgtggacgaattacacaacaagagcttttatttttttatctacttccgggcagacttattttctgtacgccctggatgacggtaccattcagattcaggactaccccctgcatctcgaagctcagtcaatcgcatttaccactaaggataagtgtccttatatggcttttcacaacaatgttgctcatgtgttctacttcctggacaagggcgaagccttgactgtctggacccagattgtctaccccgagaacacagggttgtacgttatcgtggaatcatatgggccaaaaatcctccaggagtcacacgaaatctctttcgaggctgcgttcggctactgcacaaaaacactgacccttactttttatcagaacgttgactacgagcgaatcagtgactattttgagacccaggataagcacaccggattagttttagtgcagttccggccatctgagtactccaaggcctgtccaattgctcagaaggtgtttcagattgccgtgggctgcgatgacaaaaagttcattgccataaaaggctttagcaagaaaggctgtcatcaccatgattttagctacgttatcgaaaagagctacctgcggcaccagcccagtaagaatctgcgcgtacgttatatctggggggagtacggctgccctctcagactggacttcacagagaagtttcagccagtggtgcagctcttcgacgacaatggctacgtgaaagacgtggaggccaacttcatcgtttgggagatccacggccgcgacgattactcattcaataatacaatggcccagtcaggatgtttgcacgaggcgcagacatggaaaagcatgatcgaactgaacaagcatctgcccctcgaggaggtgtgggggccagaaaactataaacactgtttctcatacgcaattggaaagccaggagatctcaaccagccttacgaaataattaactccagtaatggcaaccacatcttctggccaatggggcactcaggcatgtacgtatttagggttaagatcctagatcccaactatagcttctgcaacttaactgccatgttcgcaatcgaaactttcggactgattccctctcctagcgtgtatctggtcgcctcattcctgttcgttctgatgctgctcttttttacaattctggttctaagttactttcgatacatgcgaatctataggcgttatatttacgaacccctgcataagccacagcgcaagagaaagaaaaattag

SEQ ID NO: 41010 - DNA, 2499 bp, Artificial Sequence
  Description of Artificial Sequence: Synthetic coding sequence
atgagcgcccgggaggtggccgtgctgctgctgtggctgagctgctatggatccgcactctggcggtactcaaccaactctcccaactataggatatttagcactaggtctactatcaagctcgaatacgagggaacactgtttacagaatggagcgtaccggaaacttgcttcgtgcttaacaagtcttccccaaccacggagctgcgctgcagttcacccggggttcatgccataaagcccatagtgactgggcccgatgaagaggaaagatatcttttcgtggagtctagccacacctgcttcttatggtactacagggtgagacacttcttcaataacttcacgcagctgatcacagtctgggcttacgaccccgagagtgccgatcccgatgagctcctcgggaatgctgaagagcccagtattaactcaattgtgctctccacacagatggctacgcttgggcagaaaccagtaatccataccgtactcaagaggaaggtctattcaagtaatgagaagatgcggagaggcacttggaggatagtggttcccatgaccaaggacgacgcgttaaaagaaattagaggaaatcaggtcaccttccaagactgttttatcgctgattttttgatcctcctcacgttcccgctgctgaccatccccgaaatccctggctacctgcctataagttccccacgtggcagccagctcatggccagctgggacgcgtgcgtggtcgcttctgctgtgctggtcacagacatggagactttccacactaccgactccttcaagagctggacgagaattcgtgtccccccagacatcttatctgatgacgaacgccgcagtgttgcccatgttatcttgtcacgcgacggaattgtcttcctcattaatggcgtgctttacatcaagtcatttcgcggctttattagattgggtggaatcgtgaacttgccagacggcgggattaccggcattagcagccgcaaatggtgttgggtgaattatctcctcaaagcaaagggccgccgaagtactttcgccgtttggactgaaaacgagatctacctggggtccatcttacttaaatttgcaagactggtgaccaccacagaactcaaaaacatccttagcttgtccgtaacagcaaccttgaccatagaccgggttgagtatactggccacccgctggagatcgcagtctttcttaattattgtaccgtgtgcaatgtcacgaaaaagattttcctggtcatctataacgaggatacaaagcagtgggtcagccaggacttcactctggacgcaccaatcgactctgtgaccatgccgcattttacattttccgccctgcctggactgctgctgtggaataagcattctatttactactgttatcataactttacatttaccggtattttacagacgcctgcaggccacgggaatctatccatgctctcgaacgattcaattattcacgaggtgtttatcgactactacggggatatcctcgttaaaatggagaataacgtcatcttttatagtaaaatcaacacccgcgatgcagttaaactgcacctgtggaccaactatacgacacgagcctttatctttctgagcactagcggccagacttattttctttacgctcttgatgacgggaccatccaaatccaagattacccactgcacttggaggcacaatcaatagcatttaccaccaaggacaagtgtccgtatatggcgttccataacaacgtggcccatgtattttatttcttggacaaaggggaagcactgacagtctggacacagatagtgtatcccgagaatacgggactctacgttatcgtcgaatcttacgggccaaaaattcttcaggagtcacatgagattagcttcgaagctgctttcgggtactgcacaaagacgctcacgttgactttctaccaaaatgtggactacgaacgcattagtgactacttcgaaacccaggacaaacacactggactggtgctggtacagtttagaccctccgagtattcgaaggcatgtcccatcgctcaaaaagtgttccagatcgcggtgggttgtgacgacaagaagttcatcgcaatcaagggattctccaaaaaaggatgtcatcaccacgacttttcatacgtaatagagaagtcctatctgaggcatcagccttcaaaaaacctgcgagtccggtatatctggggcgagtacgggtgccccttgcgcttggacttcaccgagaaattccagccagtagtccagttatttgacgataatgggtacgtgaaggacgtggaagccaattttatcgtgtgggaaatccacggccgagacgactacagttttaacaatactatggcccagagcggctgcctgcatgaggcgcagacatggaaatccatgatagaactgaataagcatctgccgctggaagaagtctggggccccgagttcctgtag

SEQ ID NO: 41011 - DNA, 2856 bp, Artificial Sequence
  Description of Artificial Sequence: Synthetic coding sequence
atgagcgcccgggaggtggccgtgctgctgctgtggctgagctgctacggcagtgcgttgtggcgctattcaacaaatagcccaaattaccggattttttcgaccaggtctaccatcaagctcgagtacgaagggacactgttcacagagtggagtgtcccagagacctgttttgtgctgaacaagagctcacccactacagaattacggtgctccagtcccggcgtgcatgccataaagcccatcgtaaccgggccggacgaggaagaaaggtatctgttcgtggagagttctcatacctgtttcctctggtactatcgagtgcgtcacttctttaataatttcactcaattaattacagtgtgggcctacgaccccgaaagcgcggatcctgacgaactgctcggaaacgcggaagagccttccattaattcaatcgtactgtcaacccagatggccacactaggacagaagcctgtgatacataccgtgctaaaacggaaagtgtattcgtcaaatgaaaaaatgaggcgtggaacatggcgcatcgttgtgcctatgacaaaagatgatgcactcaaagaaatcagaggaaaccaggtcacctttcaggactgctttatagccgactttctcattctgctgacattccccctgctgaccattccagagattcctggctacttgccgatctcttccccaaggggctcccaactaatggctagttgggatgcttgcgtagtcgcctctgctgtcttggttacagatatggagacattccacaccactgactcgttcaagtcctggacaaggattcgagtgcctcccgacatcctatccgatgacgaaagacgttcagtggctcacgtaattctcagtcgagatggaattgtgtttttgattaacggagtgctgtatattaaaagcttccgcgggttcatcagacttggagggatcgtgaaccttcccgacggcggtattactggcatctcatcccgcaagtggtgttgggtaaattacctcttaaaggcgaagggaagaaggtctacgttcgctgtctggactgagaatgaaatatatctggggtctattcttttgaagtttgcccggctggttactactacggaattaaaaaatatacttagcctttctgtcacggctacactgacaatagacagagtcgaatacaccggacatcccttggaaattgccgtgttcctaaactactgcaccgtatgcaatgtcaccaaaaaaatttttctggtcatctataatgaagacaccaaacagtgggtctctcaggacttcactctggatgcgcctattgattctgtaacaatgccacatttcacatttagcgctctgcctggtctgcttctgtggaacaaacatagcatatattattgttatcacaacttcacattcaccggcatccttcagacccctgccggccatggcaatctgtcaatgctgagtaacgactcgatcattcacgaggtgttcattgattattatggcgacatattagtaaaaatggagaacaacgttatcttctattcaaaaatcaacacacgggacgccgtgaagctacacctctggaccaattacacaaccagggctttcattttcctgtctacatcggggcaaacctacttcttgtatgccctggacgacgggaccattcagatccaggattatccacttcaccttgaagcgcagtcaatcgcattcaccactaaggacaaatgcccatatatggcgttccacaacaacgtggcacatgtcttctatttcctggacaagggcgaagcactgacagtgtggacccagattgtgtaccctgagaatacgggattgtacgtgattgtggaaagctacggacccaaaatcctgcaggagagtcacgagatctcatttgaggcggcctttggctattgtacaaagactttgactttaaccttctaccaaaatgttgattacgaaagaattagcgactattttgagacccaggataagcacactgggctggtactggtgcagttccgccccagcgaatattctaaagcatgcccaatagcccagaaagtcttccagatcgccgtgggatgtgacgacaagaagttcattgccatcaagggctttagtaaaaaaggctgccatcaccacgacttctcttacgtgatcgagaaatcatacttacgccatcagccctctaagaacctccgcgtgaggtacatatggggggaatacggatgtcccctccgtctagatttcaccgagaaatttcaacctgtggtgcagctttttgacgacaacgggtatgtgaaagacgtggaggctaattttatcgtatgggagatccatggccgggacgactacagttttaacaataccatggcacagtcaggttgtctccatgaggcacagacgtggaaatcaatgatcgaattgaacaaacatctgccattagaagaagtctggggcccggagaattacaaacattgcttttcatacgctatcggcaaacctggggacctcaatcagccatacgaaatcataaattcctcaaacggaaaccacatcttctggccaatgggccattcaggcatgtatgtctttagagtgaagatcctcgatcccaactactctttttgtaaccttacggctatgtttgcgatcgagactttcggcctgattcccagtccaagtgtgtatttggtggcttcatttctgttcgtgttgatgctgttgttctttaccatcctagtgcttagttactttagatacatgcggatctatcgaaggtacatctatgagcccctgcacaagcctcagaggaagagaaagaagaattag

SEQ ID NO: 41012 - DNA, 2499 bp, Artificial Sequence
  Description of Artificial Sequence: Synthetic coding sequence
atgagcgcccgggaggtggccgtgctgctgctgtggctgagctgctacggaagtgcactgtggcgatactctaccaacagcccaaattatagaatcttctcgacgagaagtacaatcaagctggaatatgaaggaaccctcttcaccgaatggagcgtccctgagacttgctttgtcctgaataagtcctcaccaacaaccgaactgcgatgttcaagtcctggagtgcacgctataaaacccatcgtcactgggcctgacgaggaggaaagatacctgtttgtagaaagctctcacacctgctttctgtggtactaccgagtgcgacatttctttaacaatttcactcagctgatcacggtgtgggcatatgaccccgaatctgccgatcctgatgaactgttaggtaacgccgaagagccttccatcaactccatcgttctttcgacacagatggctactctcggtcagaaacctgtcatacacactgtcctcaaaagaaaagtgtattcaagtaacgagaaaatgagaagggggacatggcgtattgtagtgccaatgactaaggacgatgcacttaaggagatccgagggaatcaagtgacatttcaggactgcttcatcgccgactttttgatcctcctgaccttccctctccttaccattcccgaaattcccggatatcttccaatctcttccccgcggggatcgcagctcatggcctcctgggacgcctgtgtcgtcgcatcagccgtgctggtcactgatatggagacttttcacacaacagactcttttaaaagctggaccagaattcgtgtgcctccagacatcctgtctgatgacgagagacggagtgtggcccacgttattttgtctagagatggaatcgtctttcttatcaacggcgtcctgtatatcaaatcgtttcgaggctttattcgcttaggtggaattgttaacttgccagatgggggtattactggtataagctctcgaaaatggtgttgggttaactacctgttgaaggccaaaggccgaagatctactttcgccgtttggactgagaacgagatctacctgggctccattcttttgaaattcgcacgcctagtgacaacaactgagttaaagaatatacttagtctctccgtcacagccacgctgaccatcgaccgggttgaatacacggggcatcctctggaaatcgctgtgttcctgaactactgtactgtctgcaatgtgaccaagaagattttcctcgtgatctacaacgaggacaccaaacagtgggtgagtcaggattttaccttagacgcgcctatcgatagcgtgactatgccacatttcacattctcagccctccctgggctgctactctggaacaagcacagtatctactactgttatcataacttcacatttactggcatcctccagacccctgccggacacgggaacctctcaatgctgtctaacgactctattatccatgaggtgtttatcgactattatggagatatactagtcaaaatggagaacaacgtcatcttctattcgaaaatcaatacgagggatgctgtaaagctgcacctctggactaattacacaacccgcgccttcatattcctttccacgagcggacagacttattttctatatgccctggacgacggcactattcaaatccaggattatccactgcacctggaagctcaaagtatagcattcacgacaaaagataaatgcccctatatggcgtttcacaataatgtggcccatgtgttttactttcttgacaaaggtgaggccctgacagtctggacacagatcgtgtaccccgagaatactggcctgtacgtcattgttgaaagctatgggcccaagatcctgcaggagagtcatgagatctcctttgaagctgccttcggatattgtacaaagactctgacactaactttttatcagaacgttgattatgagcgcatcagtgactattttgaaactcaggacaagcatactggcctggtcctggtacagttccgaccgagcgagtacagcaaagcatgtccaatcgcccagaaggtcttccagattgccgttggatgtgatgataagaaatttatcgctatcaaaggcttctctaagaagggatgccaccaccatgacttcagctacgtcattgagaaaagctatctgcgccaccaacctagcaagaacctccgggtccgatatatctggggcgaatatggctgccccctaaggctggactttacagagaaattccagccagtggtccagctctttgacgataatggatacgtcaaggacgttgaggcgaactttattgtttgggaaatccatggccgagatgattactcctttaataacactatggcacagagtgggtgtctgcacgaagcccagacctggaaatcgatgatcgaacttaataaacatttgcccttggaggaggtgtggggaccagagtttctctag

SEQ ID NO: 41013 - DNA, 2616 bp, Artificial Sequence
  Description of Artificial Sequence: Synthetic coding sequence
cggcggcggagccggcggcacgtgagccccggcagcggccgggccgccgcggtggctgagctactgtggctaaggccactggagatcaaactcgagtatgaagggaccttgtttaccgagtggtccgttcccgagacctgttttgtgctcaataagtcatcccctactaccgaactgcgatgtagctctccaggggtgcacgcaatcaaacctatcgtcaccggaccggatgaggaggagcgatatctgtttgtggagagtagccacacatgctttctctggtattacagggtgcggacctggaggattgtggttcctatgaccaaggatgacgccttaaaggaaattcgaggaaaccaggtgacatttcaggattgtttcattgccgatttcctgatcctattgaccttcccactgctgactattccagaaatacccggctacctgccaatctcatctcctagagggtctcagttaatggcctcctgggacgcctgtgttgtggctagtgccgtcttagtgacagacatggagacatttcatacgactgactcctttaaatcatggacaagaattcgagtgccacccgatattttgtcggacgacgagcggcggtctgtagcacatgtgatcctgtcccgagatggaattgtcttccttattaacggggtactgtacataaaaagctttaggggttttatcagactcggcggtatcgtcaacctcccggacggaggaataactgggatcagttctaggaagtggtgctgggtcaattatctgctgaaggccaagggtcggcgatcaacctttgcggtgtggaccgaaaacgagatctaccttggttctatcctcttgaaattcgcacggctcgtcaccactactgagcttaaaaacatcctttccctttccgtgactgctactcttacaattgaccgggtggagtacacaggtcatcccctcgagattgcagtttttctcaattattgtacagtgtgtaatgtcacaaagaagatattcctcgtgatatacaacgaggatactaaacagtgggtctcgcaggatttcaccctggacgcaccaatagattctgtaacaatgccccacttcacattcagtgctttgccaggcttgctgctatggaataagcactcaatctactattgttaccacaatttcacattcacgggaatcctgcagacgcccgcagggcatggaaacctgagtatgctcagcaacgattccattatccacgaggtgtttatcgactactacggcgatattctcgtgaagatggaaaataacgtcatattttactccaagatcaatacccgtgacgccgtcaaactccacctttggactaactatacgacacgagcctttatttttctgagcactagcggacagacatattttctttatgccctggacgatggaaccatacaaattcaggactaccccttgcatctggaagcgcagtcaatcgccttcacgactaaggacaaatgcccttacatggccttccataataatgttgcccatgtgttctattttctcgataagggggaggccctcactgtgtggacgcagattgtctacccagaaaacaccggcctctacgtgatcgtggagtcctacggccctaaaattttgcaggaaagtcacgaaatctccttcgaggccgcctttggttattgcaccaaaacactaaccctcactttttaccagaatgtggactacgagaggatttccgattacttcgagacccaagacaagcacactggattagtgctggtccagtttcgtccatctgagtacagcaaggcctgccccattgcccagaaggttttccaaattgccgtgggctgcgacgataagaagttcatcgctatcaaaggattttccaaaaagggatgccatcaccacgacttctcctacgtgattgagaaaagctacctgcggcaccagcctagtaagaacttgagggtgcgttatatctggggagagtatggttgtcccttacgattagactttacagagaagttccagcctgtggtgcagctgtttgatgacaacggctacgtcaaagacgtcgaagccaactttatcgtttgggagatacacggccgcgacgactattcttttaataacactatggcacagtccgggtgtctccatgaagcccagacctggaaaagtatgattgagctgaacaaacacctgcctttggaggaggtatggggtccagaaaattataaacactgcttttcttatgctataggtaagcccggggacttaaaccaaccttatgaaatcatcaattcctctaatgggaatcacatcttttggccaatgggccactctggtatgtatgtttttagagtgaagattttggatcctaactattctttctgcaatctgacagccatgtttgccatagaaacgttcggcctcatacctagtccatctgtgtatttggtggcctcatttttgttcgtattaatgcttttgttttttacaattctggtcctctcctactttcggtacatgcggatttacaggcgttacatctatgagcccctccacaaaccacagcgtaagcgaaagaaaaattag

SEQ ID NO: 41014 - DNA, 309 bp, Artificial Sequence
  Description of Artificial Sequence: Synthetic coding sequence
atgaccaccgccacccccctgggcgacaccaccttcttcagcctgaacatgactactagaggagaagatttcctgtacaagtctagtggggcaatagtggcagcggtggtggtggtggttattataattttcacagtggttctgatactcctaaagatgtacaataggaagatgcgcacccggcgggaactggaacctaaagggccaaagcctactgccccgagtgccgtgggtcctaattctaacggttcccagcaccccgcaaccgttaccttctctcctgtggacgttcaggttgaaacacggtag

SEQ ID NO: 41015 - DNA, 1035 bp, Artificial Sequence
  Description of Artificial Sequence: Synthetic coding sequence
atggccctgcggcacctggccctgctggccggcctgctggtgggcgtggctagcaaatccatggagaatacagcgcagttgccagagtgctgtgtcgatgttgtgggggtcaacgcctcttgtcctggagcctcactgtgcggccccgggtgttatcgccgatggaacgccgacgggtccgcttcttgcgtcaggtgtggaaacggcaccctcccagcatataacggtagcgagtgtagatcctttgccgggcctggtgccccatttcccatgaatcgaagtagtgggacgcccgggcgtccccacccaggggcaccacgtgtcgccgcttccctcttcctagggacctttttcatatcttctggactgatcttgtctgtagctggcttcttctacttaaaacggagctccaaattaccccgggcatgctaccgtaggaacaaagcccccgcactgcagccgggagaggcagccgccatgattccgcctccccagtcttcaggaaactcctcctgtaggatcccactttgggggttcccaagtctgggacagtcgcagggggctctgtgggtgtgtccccagactgggctgcctggcagtggctctagacctcctctgccggggtctccaggagaccctcccacacgacagggccagggtcgaatctggcttgtccctccagccttagacctgagctggatatggccagctccgcctgcgagacccccccttatccccgtgacatctatgctgttcccagtgcccgagacttgggggcttcaggagcggcgcacacaccatgatagagccgatccccagtaccttctcttgctggaagttcagctccatcctcgtacggatgccgctgggttgcgccaggctctactgtcatcccatcgcttttccggtgctggcagcggcggtccgaagtcccaacctgtgagaaagccacgttatgtgcgtagagagcgccccctggaccgcgccacggatcccgccgccttccccggggaagctcgcatctcaaatgtgtag

SEQ ID NO: 41016 - DNA, 597 bp, Artificial Sequence
  Description of Artificial Sequence: Synthetic coding sequence
atggccctgcggcacctggccctgctggccggcctgctggtgggcgttgcatccaagtctatggagaacaccgcgcagctgccagagtgttgtgtcgatgtggtgggtgtcaacgcttcatgcccaggagcctcactgtgcggccctggttgctaccgaaggtggaacgctgatggatccgcttcctgtgttcgttgtgggaacggcacattgcctgcctataacggaagcgaatgcaggtcctttgcaggacctggcgctcctttccctatgaataggtcttctggaacacctggacgacctcaccctggtgctccaagggtcgctgcatcattgttcctcggcaccttttttatttcctctggtctaattttaagtgtggctgggttcttttaccttaagaggtcctctaaattgccacgggcatgctatagaaggaataaagcccccgctctacagccgggtgaagcggctgccatgataccccctccgcagagcagtgtacgaaaacccaggtacgttcgccgagaacgccccttggacagagctactgatcctgcggcctttccaggggaagcgagaatctcaaatgtgtag

SEQ ID NO: 41017 - DNA, 1143 bp, Artificial Sequence
  Description of Artificial Sequence: Synthetic coding sequence
atggccctgcggcacctggccctgctggccggcctgctggtgggcgtggccagtaagagtatggagaataccgttacaaggaatagtaccgctgtcatcaatacccaagccgagggcaccctgtcccctccaggcctgagctcattaccggtggtgagggagtgggccctcacacataccgctcagttaccagaatgttgcgttgatgttgttggtgtgaatgcctcttgcccaggcgccagtctctgcgggcctggctgctaccggagatggaacgcggatgggtccgcttcatgtgtgaggtgtggcaatggaacgctccctgcctataacggatccgagtgtcggtcattcgccggccctggtgctccatttccaatgaacagatcctccggcaccccagggaggcctcacccaggagctcctcgcgttgccgcctccctcttcctcgggaccttttttatttcttctggactgatactctcagtggcaggatttttctaccttaagcggtcttctaagttgccacgtgcatgttacaggaggaacaaagctcctgctcttcagccaggagaggcagcagccatgattcctcctccccagagcagcgggaactcctcctgtcggatacctctctggggattcccctcgctcggccagtctcagggggctctgtgggtatgcccacagaccggactcccggggtccggaagtcggcccccactgccaggttcaccaggcgacccccctacacggcaggggcagggtaggatttggctggtgccacctgcccttgatctcagttggatctggcctgcaccgccagcgaggccgcccctcatacctgtaacctcgatgctcttccctgtgcccgagacgtggggcctgcaggaacggaggacccaccacgacagagctgacccacaatatttgctgctgctcgaggttcagctgcacccacgcactgacgccgcaggtttgcgtcaagctttgctgtctagtcatagatttagtggagccggcagcggagggccgaagagccagcccgttaggaaaccgaggtacgtgcggcgcgaaaggccgttggatagggccaccgatcctgccgccttccccggagaagccagaatttcgaatgtttag

SEQ ID NO: 41018 - DNA, 597 bp, Artificial Sequence
  Description of Artificial Sequence: Synthetic coding sequence
atggccctgcggcacctggccctgctggccggcctgctggtgggcgttgcgtctaaatcaatggagaacaccgcgcagctgcccgaatgctgcgtggatgtggtcggggtgaatgcaagttgccctggggcatcactctgcgggccaggatgctaccgcaggtggaacgccgatggttcggcttcgtgtgtccgctgcggtaacggcacgttgcctgcgtacaatgggtccgagtgtagatcctttgctgggcccggtgcccccttcccaatgaatcgctcaagtgggacccctggacggcctcatcccggggcaccccgcgttgccgccagcctgtttcttgggacattcttcatctcctccggactgatcctctccgtggctgggtttttctacttaaaacggtcttctaaactgccacgggcatgctataggaggaataaagcccccgccctgcagcctggggaagctgccgcgatgatcccacccccacagtcttcggttcgcaaaccaagatacgtgagaagggagagacccctcgatcgcgctaccgatcccgcagcatttccaggcgaagctaggatcagcaacgtgtag

SEQ ID NO: 41019 - DNA, 558 bp, Artificial Sequence
  Description of Artificial Sequence: Synthetic coding sequence
atggccctgcggcacctggccctgctggccggcctgctggtgggcgtggcatctaagtcgatggaaaatacagcccaacttcccgagtgttgcgtggatgtcgttggcgtgaatgccagttgtcccggggcctcgctttgtggtcctgggtgctacaggcgttggaacgccgacggcagtgcaagctgcgtgcgatgcggaaacgggacactgcccgcctacaatgggagcgaatgtcggtccttcgctgggcccggtgcacctttcccgatgaatcggtcaagcggtacccccggcagacctcatcccggggctccccgggtcgccgccagtctctttctgggcaccttcttcatcagcagcggcctgatcttgtccgtcgcggggtttttttatctcaaaagaagttcaaaactgcctagggcatgctacaggaggaataagggacctgcgcctgctgggagcttacccgggcgctggtcttctcagcaatttggccctcaggctccagcgctccagcctggagaagcagtaagtaatccccatcaccctggctag

SEQ ID NO: 41020 - DNA, 174 bp, Artificial Sequence
  Description of Artificial Sequence: Synthetic coding sequence
atggccctgcggcacctggccctgctggccggcctgctggtgggcgtcgcgtccaagtcaatggaaaacacggctcagctgccagagtgttgtgtggatgtcgtgggggtgaacgcgtcatgccccggggccagtttatgcggaccgggctgttacagacgatggaacgcatag

SEQ ID NO: 41021 - DNA, 1143 bp, Artificial Sequence
  Description of Artificial Sequence: Synthetic coding sequence
atggccctgcggcacctggccctgctggccggcctgctggtgggcgttgctagcaagtcaatggaaaatacagttacccgtaacagtacagcggtgatcaatacccaggcagaggggactttgtccccacccggactctcatcattaccagttgtgagagagtgggctctcacccacactgctcaattgccagagtgttgtgtggacgtcgttggcgtaaacgcatcttgccccggggcgtcgctgtgcggacccgggtgttatagaagatggaatgccgatggttcagccagctgcgttagatgtgggaacggcactctgccagcttacaacggctccgaatgccggtcattcgccggtccgggcgcccctttccctatgaatcgtagcagcggaaccccaggacgacctcaccctggagccccacgcgtagcagcctcattgttcttaggaacatttttcataagttctggactgatcctgagcgtggccggcttcttctatttaaagcgctcctcaaaacttcctagagcctgttataggagaaataaggctccagctttacagcctggcgaagccgcagcaatgatcccaccaccacaaagttccggcaatagctcttgccgaattccactttggggattcccctctttgggacagtctcagggtgctctttgggtgtgtccacaaactggcctccccggtagcggaagccgcccaccgctcccaggctccccaggagaccctcccacacgacagggccaaggacgtatttggttggtgccaccggccctggacctgtcttggatctggcctgcacctcctgccagaccccccctgatacccgtcaccagcatgctcttccccgtgcctgagacatggggcctacaggagcgccgtacacaccacgacagggctgaccctcagtacctgctgttgctggaagtccagcttcatccacgcactgatgccgcagggttgagacaggccttgctgagctctcaccggttcagcggcgcgggatccggcgggcctaagagtcaacctgttcggaaaccacgttatgtgcgaagagagcggcctctagaccgggctaccgacccagccgcatttccaggcgaggctcggatcagcaatgtgtag

SEQ ID NO: 41022 - DNA, 603 bp, Artificial Sequence
  Description of Artificial Sequence: Synthetic coding sequence
atgagcgtggtgcccatcctggagggccaggccctgcggatctgcagttgttcttggctggccttttcttgggaaagcccagcctcaccatggagaactagaccctcttgccctagtgcggtgtggatgtggtgggcgtccacacctgcagcccaagcccaggtttgcgtggtccaggccgtgaccggagcaggcacaaggaccggggcacccgcggcaagtgcagtcggaacagaaccaagccagcccaccacagctcctagcgtcgaggccgtggtagcagggcccggcgcaccttttccaatgaacaggtcgagcgggacaccggggcgaccccacccaggcgctccgcgtgttgcagcctctttgttcctggggacctttttcatttcttctgggttgatcttatcagttgctggattcttttacctcaaaagatccagcaaattgcccagagcctgctataggagaaataaagcccccgccctgcaacccggagaggctgccgctatgatcccacccccccagtcttcagacgttggttccgcgggtaaggaggatcctcctaggcagggaaggccgcccattcccgccccaccctag

SEQ ID NO: 41023 - DNA, 468 bp, Artificial Sequence
  Description of Artificial Sequence: Synthetic coding sequence
atgggcggcaacggcagcacctgcaagcccgacaccgagcggcagggtacccttagtaccgccgccccaaccacgtcccctgcaccatgccttagtaatcaccataacaagaagcatctgatccttgctttctgtgcaggcgtgctcctgacactgctattaatagcctttatcttcctaatcatcaaatcctacagaaagtacagacgagagcggctacccatcagtccgggtcccctgttgcggtgggtgcccttactcagcggaactatggccgatcacagtaagcctcaggctcctgatccacactcggatcccccagccaagctctcttctatccctggtgaatcactgacatatgcctccacaacttttaagttatccgaagagaaatccaaccacctggccgaaaatcactctgccgatttcgaccccatagtttacgcacaaataaaagtcactaactag

SEQ ID NO: 41024 - DNA, 393 bp, Artificial Sequence
  Description of Artificial Sequence: Synthetic coding sequence
atgggcggcaacggcagcacctgcaagcccgacaccgagcggcagggtactctctctacagcagcccccacgaccagccctgccccatgcctgtcaaatcaccataataaaaagcacctgatcctcgctttttgtgccggagtattgcttacgctcttgcttatagcattcattttcttgatcataaagtcctatagaaaataccatagtaagccacaggcacccgatccgcatagtgacccccctgccaaactgtctagcattccgggggaaagcctgacctacgcatcgacaacatttaaactcagcgaagagaaatctaaccaccttgctgaaaaccattctgctgacttcgatcccatcgtgtatgcccagatcaaagtgactaattag

SEQ ID NO: 41025 - DNA, 600 bp, Artificial Sequence
  Description of Artificial Sequence: Synthetic coding sequence
atggccagccccaagggcttcttcaactacctgacctacttcctggcagctggtgcagtgaccttgggaataggattcttcgctctcgcgtcggccctatggtttttaatctgcaaacgccgggagatcttccaaaacagcaaatttaaggccatagatgaacgctgtagacagcggcccagtatggctaagattaagagtcacagtcagtgtgtctttatctccagaaacttccatactggcagatttcagctgcaggaggaacaaaggaaaaaggaggctgcacatattaaggccatcaaggatcacagtaaggacgaaccacaactggctactaagaacatcatctgtgaccctagcgagacttcaagcaccactaatcgatcaagcgtcacactgtccctttctacccttcccagtgatagctattacagccaatctatcgaagccgcagacgactggttttccgacgattccctggtgaagcggaactcgcccatgccatcactgggggagcctctaatggagaaagtgtttagttatcttagcaccatctctctggaggaggggacagaaagtgtcttaaacgatactctctag

SEQ ID NO: 41026 - DNA, 519 bp, Artificial Sequence
  Description of Artificial Sequence: Synthetic coding sequence
atgctgaccgaggtgatggaggtgtggcacggcctggtgatcgccgtggtgagtttgttccttcaggcctgtttcctgacggccatcaattacttactcagtcgtcacatggcccacaagagcgagcagatcctgaaggctgcaagcctgcaggtgcctcgtcctagcccaggacatcaccatccgccagccgtcaaggaaatgaaagagactcaaaccgagagagatatccctatgtccgacagtttatatagacacgattcagacacccccagtgacagtctggactcctcctgttcctcgcccccagcgtgtcaggcaacagaagatgttgattacacccaggtggtgtttagcgatcccggggaactgaaaaacgactcccccttagactatgagaatattaaggaaattaccgattacgtgaacgtcaatccagagaggcacaagcccagtttttggtactttgtaaacccggccctgtctgaacccgctgagtacgaccaggttgctatgtag

SEQ ID NO: 41027 - DNA, 342 bp, Artificial Sequence
  Description of Artificial Sequence: Synthetic coding sequence
atgaacgagaccaacaagaccctggtgggccccagcgagctgcccactgctagcgccgtggctcccggcccgggcaccggtgcacgcgcctggcctgtgctcgtgggattcgttcttggagcagtggttctgagcctgttgattgcgctggcggccaagtgccacctgtgtaggagataccacgccagttacaggcatcgcccactgcccgaaactggccgcggcggacgaccccaggtggcggaagacgaggatgatgatgggtttattgaagataactatatccagcccgggaccggggaacttggaacagaggggtccagggaccactttagcctgtag

SEQ ID NO: 41028 - DNA, 342 bp, Artificial Sequence
  Description of Artificial Sequence: Synthetic coding sequence
atgaacgagaccaacaagaccctggtgggccccagcgagctgcccacagcttctgctgtggcgcctgggccaggcactggggccagagcgtggccggttttggtgggctttgtcttaggggccgtggtgctgagcctgctcattgcattggcagctaagtgtcacctgtgtaggagatatcatgcctcctatagacacagacctttacctgagactgggagaggcggaagacctcaggtagcagaagatgaagacgacgacgggttcattgaggacaattacattcagccggggacaggcgaattggggaccgaggggtctcgggaccacttctccttgtag

SEQ ID NO: 41029 - DNA, 1365 bp, Artificial Sequence
  Description of Artificial Sequence: Synthetic coding sequence
atgggccggacctacatcgtggaggagaccgtgggccagtacctgtcgaacattaacctccagggtaaagcctttgtgagcgggctgctcattggacagtgctcgtcccagaaggactacgtgatcctagccactaggacaccccctaaggaagagcagtccgaaaatttgaaacacccaaaagccaagctggacaacctagacgaggagtgggcaacagaacacgcgtgtcaggtttcacggatgttgcccggaggactgctcgttctaggcgtgttcatcatcactactttagagctagccaacgacttccaaaacgcactaagacggctcatgttcgccgttgagaaatctatcaaccgcaaacgcctctggaactttaccgaggaggaggtcagcgagagggtaactctccacatctgtgcctctactaagaaaattttttgccgcacttacgacatacacgatcctaagtccagcgcacgccccgcggattggaaatatcaaagtggactcagcagttcctggctgtcacttgagtgcaccgtgcacattaacatccatatcccgctgtccgctacctccgtgtcttacaccctggaaaaaaatacaaagaacgggctcacccgttgggctaaagaaattgagaacggcgtctatcttatcaacgggcaggtcaaggacgaagattgtgacctgcttgagggtcagaagaagagctctcgagggaacacccaagccacctcgcattctttcgatgtgagggtgcttacgcagctgctgctcaattccgaccaccggtcgactgcaactgtgcagatctgtagtggatccgtgaatctgaagggggccgtgaagtgtcgcgcatacattcattcctccaaaccaaaggtcaaggatgctgtccaggcagtgaaacgggatattctgaatacagtcgccgatcgctgcgaaatgcttttcgaggacctgctgcttaatgagatccctgagaagaaggattccgagaaggagtttcacgtccttccatatagggtatttgtgcctctgcccggatcaaccgtgatgctctgtgactacaaattcgatgacgaatccgcagaggagattagagaccattttatggagatgctcgaccacacaatacagatcgaagacctagagattgccgaggaaactaacactgcatgtatgtcctcatcaatgaatagccaggctagtctcgataatacagacgatgagcaaccaaagcagcccatcaagactaccatgctgctgaagattcagcagaatataggagtgatcgctgcatttactgtagcggtgctggccgctggcatatcgttccattatttttccgattag

SEQ ID NO: 41030 - DNA, 1296 bp, Artificial Sequence
  Description of Artificial Sequence: Synthetic coding sequence
atgggccggacctacatcgtggaggagaccgtgggccagtacctgtcgaacatcaatctccagggtaaggcttttgtgtccggactgctcatcggtcagtgtagcagccagaaggactacgttattcttgccacaagaactcctcccaaggaggaacagtcggagaacctcaagcatcccaaggccaagttagataacctggacgaagagtgggcaactgaacatgcttgtcaggttagtaggatgctacctggggggctccttgtgctcggcgtgttcattattaccacattagaactggcaaacgattttcagaatgctctgaggcggctcatgtttgctgtcgagaaatcaatcaacagaaagcgtctgtggaacttcactgaagaggaggtcagcgaaagggttacgttacacatctgtgccagtacaaagaaaatattctgccgcacctatgacattcacgatccaaaatcctctgcgcggcctgccgattggaagtaccaatcgggtctctccagcagttggttatccctcgagtgcacagtccacattaatatacatatacctcttagcgctactagcgttagctatacgctggagaaaaacacaaagaatgggttgaccagatgggccaaagagattgaaaacggggtgtatctcataaacggacaggtgaaagatgaggattgcgacttgctggaaggtcagctcctcaattctgatcatcgcagcactgccacagttcagatctgctctggtagcgtgaatctgaagggtgccgtcaaatgccgcgcgtacatccattccagtaagccgaaggtaaaggatgcggtgcaggccgtcaaacgtgacatactgaataccgttgcggatcggtgcgagatgctcttcgaagacctcctcctcaacgagatccctgagaagaaggactcagaaaaagagttccatgtcctgccatacagagtctttgtaccattgcccggctcaaccgtcatgttgtgtgattacaaatttgatgatgaatctgctgaggaaattagagaccatttcatggaaatgctggaccatacgattcaaatcgaagatctggaaatagccgaagagactaacactgcatgtatgtccagctccatgaactcacaggcctccctcgataacactgatgatgagcagccgaagcagcctattaagaccactatgctcctgaagatccagcagaatatcggagtgattgccgcttttacagtggccgtgttggcagccggcatcagcttccactattttagtgactag

SEQ ID NO: 41031 - DNA, 1269 bp, Artificial Sequence
  Description of Artificial Sequence: Synthetic coding sequence
atgggccggacctacatcgtggaggagaccgtgggccagtacctgtcaaatattaacctgcaagggaaagccttcgtctctggtcttctgataggacagtgctcatctcagaaggactacgtcatcctggctacaaggaccccacccaaagaggaacagtctgagaacctcaagcacccaaaggctaaactcgacaatctggacgaggagtgggccacagaacacgcgtgccagttgatgttcgcagttgaaaaatccattaaccgtaagagactatggaattttaccgaagaagaggtgtcagagcgagtgactctgcatatctgcgctagcacgaagaagatcttctgtagaacctacgacatacatgaccctaagagctctgctcgccccgccgattggaaatatcagtctggcctgtccagcagttggttaagtcttgaatgtacggttcacatcaatatccatataccgcttagtgcgacatctgtttcatacacccttgagaagaatacaaagaacgggctgaccaggtgggctaaggaaatagagaacggggtttatttaatcaacggacaagttaaggatgaagactgtgacctgttggaaggccagaaaaagagttcccgtggaaacacacaagccacatcccatagtttcgatgttcgagtcctgacccagctgctgctgaactccgaccacaggagcacggccaccgtgcagatctgttccggttccgtgaatctcaaaggcgcagtgaaatgtagggcatacatacacagctctaagcccaaggttaaggatgccgttcaggcggtcaagagagacatcctgaacacagttgcggatagatgcgaaatgctctttgaagacctactcctgaacgagatccctgaaaagaaggacagcgaaaaggaatttcacgtcctgccctaccgagtgtttgtgcctctgccgggatccactgtgatgctgtgcgattacaagttcgatgacgaatctgcggaagaaatcagagatcatttcatggagatgttggaccatactattcagatagaagatctcgagatcgccgaggaaaccaataccgcgtgtatgtccagtagcatgaacagtcaggccagccttgacaataccgacgatgagcaaccaaagcagcccataaagactactatgcttctcaaaattcaacagaacattggggtgatcgcagcgtttaccgtggctgttcttgcagctggcatatcattccactatttttctgactag

SEQ ID NO: 41032 - DNA, 1008 bp, Artificial Sequence
  Description of Artificial Sequence: Synthetic coding sequence
atgggccggacctacatcgtggaggagaccgtgggccagtacctgagtaatataaatctgcagggcaaagccttcgtctcgggtctcctcattggccagtgcagcagccaaaaagactatgtcatcctcgccaccagaaccccacccaaggaggagcagtccgaaaatctgaaacatcctaaggcaaagctggataatttagacgaggaatgggctacagagcacgcctgtcaggtgagccggatgctgccaggaggactcctagttctcggggtgttcatcataaccacactggagctggccaatgacttccaaaatgcactaaggcgactaatgtttgccgtagaaaaaagtattaaccggaaaagactgtggaatttcaccgaggaagaggtatctgaacgagtgacactgcacatctgcgcatccacaaaaaagatattctgccgcacttatgatattcacgacccaaagtcctcagctagacctgccgactggaagtatcagtccggcctgagctcttcttggctgagcctggaatgcactgtccacatcaatattcatattccgctgtccgccacatctgtgagttatacactcgagaagaacactaagaatggtctgacgaggtgggcaaaggaaatcgagaatggcgtgtatctgattaatggacaggtaaaagacgaggactgtgacctgctggaaggccagaaaaaaagctctcgcggaaatacccaagcgaccagccactcattcgatgtaagagtcttaacacagttgctattaaactctgatcacagaagcaccgccacagtgcagatctgcagcggctctgttaacttgaaaggcgcagtgaagtgccgggcgtatatccactcgtcaaaaccaaaagtaaaggacgctgttcaggctgtcaaacgggatatacttaataccgtcgcggatcgatgtgagatgttgtttgaggatttgctgcttaacgaaatccctgagaagaaagacttttag

SEQ ID NO: 41033 - DNA, 240 bp, Artificial Sequence
  Description of Artificial Sequence: Synthetic coding sequence
atggccgcccccagcatgaaggagcggcaggtgtgctggggcgcccgcgacgaatattggaagtgcctggatgaaaatctggaggacgcttcacagtgcaagaaacttcgatcttcatttgagtcttcgtgcccacaacagtggattaaatacttcgacaaacggcgcgattatctgaaattcaaagagaaattcgaagctggacagtttgagccatctgagaccaccgcgaagtcatag

SEQ ID NO: 41034 - DNA, 378 bp, Artificial Sequence
  Description of Artificial Sequence: Synthetic coding sequence
atgggccccggcggccccctgctgagccccagccggggcttcctgttgtgcaaaacaggctggcattccaaccgacttctgggcgattgcggcccccacacacccgtgagtacagccctcagcttcatcgctgtaggcatggccgccccatcaatgaaggaacggcaggtctgttggggcgctcgggacgagtattggaaatgtctcgatgagaatctagaggatgcgagccagtgtaaaaagttgcgatcctctttcgagagcagttgcccacaacaatggatcaagtacttcgataagcgccgggactacctcaagttcaaagaaaaattcgaggcaggtcaatttgagccaagcgaaaccaccgcaaagagttag

SEQ ID NO: 41035 - DNA, 468 bp, Artificial Sequence
  Description of Artificial Sequence: Synthetic coding sequence
atggtggcccggaagggccagaagagcccccggttccggcgggtgagttgttttctgagactgggccggtctactctgctggagctagagcccgctgggcgcccatgtagtggccgtacacgacaccgcgccctccaccggcggcttgtcgcctgtgtgacggtgtcctcgaggcggcacagaaaagaggcgggaagaggcagggcggagagctttatagccgtggggatggcggcccccagcatgaaggaacggcaggtgtgctggggcgcccgcgatgagtactggaagtgtctggacgaaaacctcgaggacgcctcccagtgcaaaaaactgcggtcaagcttcgagtcctcctgcccacagcagtggatcaagtatttcgacaagcggcgcgactacctgaaatttaaggagaaattcgaggctggccagttcgaacccagtgagacaactgcaaaatcctag

SEQ ID NO: 41036 - DNA, 471 bp, Artificial Sequence
  Description of Artificial Sequence: Synthetic coding sequence
atggtggcccggaagggccagaagagcccccggttccggcgggtgtcatgcttcctgcgtctaggtcgctcaaccctcctggaactggaaccagccggccgcccctgtagtggtagaactagacatagggccctccaccgtagactggttgcttgtgttactgtctcgagcaggaggcaccgcaaggaagcgggtagaggtagggctgaaagctcattcatcgctgtaggtatggcagctccatctatgaaagagcgccaggtctgctggggcgccagggatgagtattggaagtgtctcgacgagaacctcgaggatgcctcccagtgcaaaaaacttagaagctcttttgaatcctcctgcccccagcagtggatcaagtattttgataagaggcgggactacttaaaatttaaggagaaatttgaggccggacagtttgagccttccgaaaccaccgcaaaatcctag

SEQ ID NO: 41037 - DNA, 660 bp, Artificial Sequence
  Description of Artificial Sequence: Synthetic coding sequence
atggccagcggcagcaactggctgagcggcgtgaacgtggtgctggtgatggcatacgggagcctggacctaaaggaggagatagacatcaggttatcccgcgtacaggatattaagtacgaaccacagctgctcgccgacgacgacgcacggctgctgcaactagagacacagggaaatcagtcgtgctataattatttgtaccgcatgaaagcactggatgccattaggaccagcgaaatccctttccactcggagggaaggcatccaagaagcctcatgggaaaaaactttagatcctatttattggacctgcgcaatacctccacgccattcaagggggttagaaaggccttaatcgacacactcctcgatggttatgagactgccaggtatggcactggagtcttcggacaaaacgaatatctgcgttaccaagaggcactatcagaactggcaacagcggttaaagcccgaatagggagctcacagcgacaccatcagagcgccgctaaagatctgacacagtccccagaagtttctcctacaactatacaggtgacctatctcccgagctcacagaagagtaagagggcaaaacattttttggaactgaaaagcttcaaggacaactacaatacattggagtcaacactttag

SEQ ID NO: 41038 - DNA, 606 bp, Artificial Sequence
  Description of Artificial Sequence: Synthetic coding sequence
atggccagcggcagcaactggctgagcggcgtgaacgtggtgctggtgatggcctacgggagcttggacctgaaggaagagatagatatcagactgtcgcgagtgcaggacatcaaatacgagccacagctgctggcagacgatgacgcacgcctgctgcaactcgagacgcagggcaaccagaagatccctttccacagtgaaggccgacaccctagaagtttaatgggtaaaaacttcaggagttacctactagacctcaggaatacgtccaccccctttaagggcgttcgcaaagcattaattgacacattgctggatggctacgagactgcacgttacggaaccggagtgtttggacagaatgagtatctcaggtatcaggaggctctatctgaattagccactgcagtgaaggctagaattggatccagccagcggcaccaccagagcgcggccaaggatttgacgcagagtccggaggtgagtccaacgacaattcaggtcacctatctgccttctagccagaaatccaagcgagccaaacactttttggagctgaagtccttcaaagacaactacaacacactggaatcaaccctgtag

SEQ ID NO: 41039 - DNA, 468 bp, Artificial Sequence
  Description of Artificial Sequence: Synthetic coding sequence
atggccagcggcagcaactggctgagcggcgtgaacgtggtgctggtcatggcatacggatcgctggatctcaaagaagaaattgacatccgcctaagccgagtgcaggacattaagtatgagccacagctcctggcagatgacgatgctagattattgcaactcgagacccaaggtaatcagagctgctataactatctttatagaatgaaggctctggacgccattagaacttctgaaatcccgtttcactctgagggcaggcaccctcgctcactgatgggcaagaactttagatcctatctgctggatctcagaaatacgtccaccccgttcaagggggtcagaaaggcactgattgacacgttattagacggctacgagacagccagatacggtaccggcgtatttgggcagaacgaatatctgcggtaccaggaggccctttcggaattggcaaccgcctag

SEQ ID NO: 41040 - DNA, 570 bp, Artificial Sequence
  Description of Artificial Sequence: Synthetic coding sequence
atggccagcggcagcaactggctgagcggcgtgaacgtggtgctggtcatggcctacggctccctagtgttcgtattactcttcatttttgtaaagagacagattatgcgcttcgcaatgaaatctaggagggggcctcacgtgccagtcggccacaatgcacccaaggacctcaaggaggagatagatattagactttcaagggtgcaagatatcaagtatgagccccagctcctcgctgacgacgacgcccgactcttgcagttggagacccaggggaaccaaagctgctacaactacctgtacaggatgaaagccctggatgctattcggactagcgagataccattccatagcgagggacgtcatcctcggagtctgatgggtaaaaattttcggtcgtatttgttggaccttcgcaatacttcaacccctttcaagggtgtgaggaaagccctgattgatacactgctcgacggctacgaaactgctaggtacgggaccggagtattcggccagaacgaataccttcgctaccaggaggctttgagcgagctcgccacagcatag

SEQ ID NO: 41041 - DNA, 708 bp, Artificial Sequence
  Description of Artificial Sequence: Synthetic coding sequence
atggccagcggcagcaactggctgagcggcgtgaacgtggtgctggttatggcttacgggagcttggtttttgtcttactgtttatcttcgtaaagcgtcagataatgcgcttcgcaatgaagtcaaggcggggcccacatgtccctgtgggccacaacgctcccaaagacctaaaggaggaaatcgacatccggcttagtcgagtacaggatattaagtacgaaccccagctgctggcagacgatgatgcaaggctcctccagctggagacgcaggggaatcagaagatcccattccactcagagggcaggcacccccgtagtcttatggggaagaactttcgctcttatctactggaccttcggaacacatccaccccctttaagggcgtgaggaaagccctcattgacaccctcctggacgggtacgaaaccgcccggtacggcacaggtgtgttcggacagaacgagtacctgcggtaccaggaagcactgagcgaactagcaactgcagtcaaagctcggatcggtagcagccagcgacaccatcagagcgccgccaaggacctcacgcaaagcccagaggtgtcccccacaacgattcaggtgacgtatcttccgtccagtcagaaaagcaaacgagccaaacattttttagaacttaaaagctttaaggataattataatacactcgagagcaccctttag

SEQ ID NO: 41042 - DNA, 762 bp, Artificial Sequence
  Description of Artificial Sequence: Synthetic coding sequence
atggccagcggcagcaactggctgagcggcgtgaacgtggtgctggttatggcctacggctctttagtgtttgttcttctgtttatattcgtgaaacggcagatcatgaggttcgcaatgaaatcaagacgtggaccacacgtacctgtgggtcacaacgctccaaaggaccttaaggaagaaatagacatcaggctaagtcgcgtgcaggacattaagtatgagccccaactgctcgctgatgatgatgcccgcctgctgcagctggagacacaaggaaatcagtcttgctataactatttatatcgcatgaaggccttggacgcaatccgcacctccgagataccgttccattccgaaggccgacacccaaggagtctgatggggaaaaatttcaggtcctacctcctggacttgagaaatacgtcaactccatttaagggtgtgcgcaaggctttgatcgacacactcctggatggttacgagaccgctagatacggaactggagtatttggccaaaatgagtacctgagatatcaggaagcattgagcgagctggccaccgcggtcaaggcacgcatcgggagttcccaaaggcatcaccagagcgcagcaaaagatctaacgcagagccctgaggtcagcccaactacaatacaagtgacctatttgccatctagccagaagagtaagcgcgccaaacactttctggagctgaaatcgttcaaggataattacaacactttagaaagcactctgtag

SEQ ID NO: 41043 - DNA, 1221 bp, Artificial Sequence
  Description of Artificial Sequence: Synthetic coding sequence
atgcggggcagcgtggagtgcacctggggctggggccactgcgccccatctccgcttttattatggaccctgcttctgtttgctgcacctttcggattgctaggggaaaaaacccggcaggtttctctcgaagtgatccccaactggctcggacctctgcagaaccttctgcacattagggctgtgggtacgaattcaacactgcactacgtgtggagctctctcggaccactagccgtggtgatggtggctaccaacactccgcactccaccctcagtgtgaactggagcttgctgcttagtccagagcccgatggtggcctcatggtcctgccaaaggatagcatccagttttcgtctgccttggtcttcactcggttgcttgaattcgacagcacaaatgtatcggatacagcagccaagccgctcgggcgcccgtatcctccgtacagcttagcagatttttcatggaacaacattaccgactctctggaccccgctaccttatcggccactttccaaggccacccaatgaacgacccgacaagaaccttcgcaaatggatctctcgcatttcgggttcaggcgttctcgagatcttctagacctgctcagcctccaagactcctccacacggctgacacctgtcagttggaagtggccctgatcggcgcatcgccccgaggaaacaggagcctattcgggcttgaggttgccaccctaggccagggtccagattgcccatcaatgcaagagcagcactccattgacgatgaatacgccccagctgtctttcagctcgaccagctactctggggatccctcccaagtgggtttgcgcagtggcgtcccgttgcttacagtcagaagccgggcggcagggaaagcgccctaccatgccaggccagtcccctgcatcccgccctcgcgtactctctgccccaaagtccgatagtgcgtgcattcttcggtagtcaaaataacttctgcgcattcaatctgaccttcggcgcctctacaggcccggggtactgggatcagcattatcttagctggagcatgctgctgggagtggggttccctcccgtagacggcctgtcacctttggtgttgggtattatggccgtagctttgggggctccggggttgatgttgcttggcggcggactagtcctcctgctccatcacaagaagtacagtgaatatcaatccatcaactag

SEQ ID NO: 41044 - DNA, 3765 bp, Artificial Sequence
  Description of Artificial Sequence: Synthetic coding sequence
atgaagaagcaccggcgggccctggccctggtgagctgcctgttcctgtgtagtcttgtgtggctgccatcttggagggtgtgctgtaaggaatcgagctctgccagcgccagttcttactatagccaggatgacaactgcgccttagagaatgaagacgtccagttccagaaaaaggatgaacgagagggacctattaatgcagagagtctcgggaaaagtggcagcaacctcccgatttctcctaaagagcataaactcaaggatgattcaattgtcgatgtccagaataccgagagcaagaagctgagtccccccgttgtagagaccttacctacagtggatctgcacgaagaatcaagcaacgcagtcgtcgacagcgagacagtcgagaacatctccagttcatcaacatccgaaattacccctatttccaaactggacgaaatcgagaaatcggggacaatcccaatagctaaaccgtcggagaccgagcagagcgagacggactgtgatgtcggtgaagcattggatgctagtgccccgatcgaacaaccaagcttcgtgagtccccctgacagcctcgtcggtcaacacatagaaaatgtgagttcttctcacggcaagggtaagatcacgaagagcgagttcgaaagcaaagtgagtgcctccgagcagggcgggggcgatcccaagagcgctctgaatgccagtgataatcttaagaacgagtcgtccgattacacgaagcccggcgatatcgacccaacctctgtggcctcgcctaaagaccccgaggacatacccactttcgatgaatggaagaaaaaagtgatggaggtagagaaggagaagtcacagtctatgcatgcgtcatcaaacggggggagtcacgccaccaagaaggttcagaaaaacagaaataactacgcctccgtggagtgcggggcaaaaatcctagcagctaaccctgaggctaaaagtacatctgccatcttaatcgaaaacatggacctatacatgctgaacccatgcagcaccaaaatatggtttgtcattgaactttgcgagcctatccaggtgaagcagctcgatattgcaaactacgaattgtttagcagcacccctaaggactttctcgtgagcatcagtgaccgctacccaacaaataagtggatcaagctgggcacctttcacggccgggacgagagaaacgttcagtcttttccattggatgagcagatgtatgccaagtatgtcaagatgtttatcaagtatatcaaagtggagctgctatctcacttcggtagcgaacatttctgcccgctcagccttattcgcgttttcgggaccagcatggtcgaggaatatgaggaaatcgccgatagtcagtatcactccgagaggcaggagttgttcgatgaggattacgactacccactagactacaatactggagaagacaagagctcaaagaatctgctgggcagtgccacaaatgcgatcctcaacatggtcaacatcgcagcgaatattctaggagccaagacggaggacctgacagaaggtaacaaaagcatctccgaaaacgccacagccaccgccgcaccgaagatgccagagagtacaccagtgagcacccctgttccgtcccctgaatacgtgacaactgaggtccatacacatgatatggaaccttcaacccccgacactcctaaagagagccccatcgtgcagctggtccaagaggaggaagaagaggccagcccttcaacagtaacattactgggatccggggaacaagaggatgaatcctcgccatggtttgagagtgagacacagatattttgttccgaactaacaacaatctgttgcatcagctctttcagtgaatacatctataaatggtgcagcgtgagggtagcactctatagacagagaagtcggacggcattgagcaaaggcaaggactaccttgttctggcccagccgccactcctcttaccagcagagtcggtggacgtctccgtgctccagcctctaagcggagaactcgagaataccaacatcgagagggaagcagagacagtggttttaggggacttgtctagtagcatgcaccaggatgatttagtcaaccacacagtagatgcggtcgagcttgaacctagccacagccagaccttgtcacagtccctgctgctggacattacccccgagatcaatcccctgcctaaaattgaggttagcgaaagcgtcgagtatgaagcaggccacattcctagccctgtaatcccccaggagagttccgtggagattgacaatgaaactgaacaaaagtctgagagcttctcttctattgagaagccttctataacttacgagaccaacaaggtgaacgaacttatggataatattataaaggaggatgtcaattcaatgcaaatttttacaaagttgtccgaaacaatcgtcccccctattaacaccgccaccgtaccagacaatgaggatggggaggcaaaaatgaacatcgcagacaccgccaaacagactctcatctctgtcgtggactcctcctcgctgccggaagttaaggaggaagaacagtccccggaagatgccttattacgcggtctgcagcgtaccgccactgacttttacgccgaactgcaaaattctacagacttggggtacgcaaatggcaatctggttcacgggtcaaatcagaaagaaagtgtgttcatgaggttaaacaaccgcataaaggcacttgaggtgaatatgagcctttcaggaaggtacctggaggagctgagtcagagatatcgaaagcagatggaagaaatgcagaaagcttttaataaaaccattgtgaagcttcaaaacacttccagaattgccgaagagcaggaccagcggcagaccgaggcaattcagctgttacaggcccagctgacgaatatgacacagcttgtgagtaatctgtctgcaacagtggcggaactgaaacgagaggtcagcgatcgacagtcatatcttgttattagcctagtgctgtgtgtagtgctgggcctgatgttatgtatgcagagatgccgaaatacaagccaatttgacggagattatatctcaaaactgcctaagtctaaccaatatccttcacctaaacggtgcttttctagctacgacgatatgaatctcaaacgccggacaagttttccattgatgcgaagtaagtccctgcagttgacaggcaaggaggtggatcccaatgatctctacatcgtagagcccctgaaatttagtccggagaagaaaaagaaacgatgcaaatacaaaatcgaaaagatcgagacgatcaagcccgaggaacctctgcaccctatcgccaatggggacatcaagggccgcaagccctttactaatcagagggacttctccaacatgggtgaggtataccattcatcatataagggacctcctagcgagggaagctccgaaaccagctctcagagcgaggagagctacttctgtggaatttccgcctgtaccagcctgtgcaatggtcaaagtcagaaaacgaaaactgaaaagagagccttgaaaagaaggaggagtaaggtacaggaccaggggaagttgataaaaaccttaattcagaccaaatccggtagtctgcccagcctgcatgacattattaaagggaacaaagagattaccgtcggcacatttggggtgactgcagtgtccggccacatttag

SEQ ID NO: 41045 - DNA, 4221 bp, Artificial Sequence
  Description of Artificial Sequence: Synthetic coding sequence
atgcggggcttcctggcccggcccttcctgagcaccaaccagcacctcgcacagtggggttctcccctgcctcagggaaaggggctcgtgcagctcccatcacagcacaccaggcactctcgtccatttcacgagctgtgtagcaaagaagagaattccgccaccgtccctaagttaatcagtctggtggtgtcatctgagacaatcgactttagcaataagaccatggacagccgccgagactgggagagagagaagcgcattctcgaaggaaagctgcagctacccaaggctttggccaggacccaaagagcgagagatgaaggtcgcagagcatggacaagtcgatggctccagcgccggcgtagtcccgaatcctgcgaagctccgctcagcgcccctctttggggcccacagcgggggcttccggggcgggaaccacttagatcaaggtcagcatcggccatagccttaagaactatagggcacatcctggccctcctactgaggctcttacatttaggtctggggagcggtggctgccgcgaagacgtccccccatcaggccggggaaagaaggaagaaaagatgaagaagcacaggcgcgccctggctctagtatcctgcctgtttctctgtagtctcgtgtggctcccatcatggcgagtctgctgtaaggagtcttcctcggcctctgcgtcttcttactattcacaagacgacaattgtgcgctggaaaacgaggacgtccaattccagaagaagaatactgagagtaagaaactgagcccacccgttgtggagactctcccgaccgtggacttgcacgaggagtccagtaacgctgtggtggactctgagacagtagaaaatatttcttcttcctcaacgagcgagataactcccatctccaagcttgatgagattgagaagagtggaactatcccaattgcaaagccctctgagacagagcagtctgaaaccgactgcgatgtcggtgaagcccttgatgcgtcagcaccgatcgaacagccgagcttcgtgtccccccccgactcactagtgggacagcatatagaaaatgtctcttcttctcacggtaaagggaaaattactaaatctgagttcgagtcaaaggtctcagccagtgaacagggaggtggtgatcctaagagcgctcttaacgcatccgataatctcaaaaatgaaagttcagactacaccaagcccggggatattgatccgaccagcgttgcctctcccaaagatcccgaagatattccgacattcgatgagtggaaaaaaaaagtgatggaggttgaaaaggagaaatctcagagtatgcatgctagttctaatggaggtagtcatgccacaaagaaagtgcagaaaaatcggaataattatgcttcggtggagtgcggtgcgaaaatccttgcggccaacccggaagcaaagagcaccagcgctattcttattgagaacatggacctgtacatgctaaacccatgttccaccaagatctggttcgtaattgagctgtgcgagcccattcaggtcaaacagctggacatagccaattacgagctgttctccagcactcccaaagatttcctggtatccattagcgaccgctacccgaccaataagtggattaaactggggacgttccatgggagagacgaacggaacgtgcaaagcttccctctagacgaacaaatgtatgccaagtatgtcaaagtggaattgcttagtcatttcgggtccgagcatttctgccctctctctttgatcagagtgtttggaacttccatggtggaagagtacgaggagattgccgactcacaataccatagtgaaagacaggagctattcgacgaagattacgactacccactcgattacaatacgggtgaagataagtcaagtaagaacttgctgggcagtgctactaatgccattttgaacatggtgaacatcgcagccaacatcctgggggccaagaccgaggacctcactgaaggaaacaagtccatttccgagaatgcaaccgcaactgccgctcccaagatgcccgaatctactcctgtgagtaccccggtcccatcacctgagtacgtcacaacagaagttcacactcatgacatggagccaagtacgccagatacccccaaagagtctcctatcgtgcagctagtgcaggaggaggaggaggaagccagcccatcaacagtgaccctcctggggagtggggaacaggaggatgaatcctctccttggttcgagagcgagacacagatcttctgttctgagttgacgaccatctgctgtatctcctcctttagcgagtatatttataaatggtgcagcgtgcgggtcgcgctgtaccgccagcggtcgcggacagcactcagcaaaggcaaggactacctcgtactggcacagccgcctctcctgctgcctgccgaaagcgtggacgtttcagtccttcagccgctgagcggcgagttagaaaatacgaacatcgaacgcgaggcggagactgttgtgctgggcgacctgagtagttcgatgcatcaggatgacctggtcaatcacaccgtggatgccgtcgaattggagccgagccatagtcagaccctctcccaatctctgctcctagacattacccctgaaatcaaccctctgccaaagatagaagtgtctgaaagcgttgagtacgaggcaggacacatcccgtccccagtcatcccccaagaaagctcagtcgagattgacaacgagacagagcagaaatctgaatcattttcttctatcgaaaagcctagcatcacatatgagacaaacaaggttaatgagttgatggataacattattaaggaggacgtgaattccatgcagatctttaccaaactgagcgagacaattgtccctccgattaacaccgcaaccgtgcccgataatgaggatggggaagccaaaatgaacattgccgacaccgcaaaacaaactcttatttccgtagtggactcttctagcttgccagaggttaaagaagaagaacaatctcctgaggatgctttactgagaggtttgcagcgtactgcgactgatttttatgctgagctgcagaatagcaccgacctgggatacgccaacggtaacttggtgcatggctctaatcagaaggaatctgttttcatgagactcaacaatcgaatcaaggctttggaggtcaacatgtccctatcagggcgttatttggaggaactatctcaacgctatcgtaagcaaatggaagagatgcagaaagccttcaacaagacgattgtaaagctccaaaataccagccgtatcgccgaggaacaggatcagaggcagacagaggcgattcaactgctgcaagcccagttgacaaacatgacacagttggtgagcaatctgtcagcgactgttgctgagctgaaacgagaggtgtcagatcggcaatcgtatctcgttatttctctggtcttgtgtgtggtgctggggctgatgctctgtatgcagagatgtcgcaatacatcacagtttgatggtgactacatcagcaaactgcccaaatccaatcagtacccctcacccaaacgttgcttcagctcgtacgatgacatgaacctcaagagacgcacctcgttccccctcatgcggtccaagagtctacagcttacagggaaggaagttgaccctaacgacctgtacatagtggaacctttgaagttttcaccagaaaagaaaaagaagcggtgtaaatacaagatagagaagatcgagacaatcaaaccggaagagccgttgcaccccattgcaaacggtgatattaagggaagaaaaccgttcacgaatcagcgcgacttcagcaacatgggcgaagtctatcactcgtcctataagggccctccaagcgagggctcgtccgagactagcagccagagcgaggagtcctatttctgcggaattagcgcctgcacctccttatgtaacggacagtcgcagaagaccaagacggagaaaagagccctcaagcggagacgtagtaaagtacaggatcaagggaaacttataaagaccctgatccagaccaagtctgggtcattaccatccctccatgacattataaaaggcaacaaagaaattactgtgggcactttcggcgtcaccgccgtgtccgggcacatctag

SEQ ID NO: 41046 - DNA, 1227 bp, Artificial Sequence
  Description of Artificial Sequence: Synthetic coding sequence
atgcccgtgatcagcagccggcaggactgcgacagcgccaccagcaccgttaccgacatcctttgcgcagcagaggttaagtcttccaaaggcaccgaggatcgagggagaatactcggcgactccaacttgcaagtgagcaaactgctgtcccagttcccactgaagtcaaccgagaccagcaaggtccctgacaataaaaatgtgctggacaaaactagggtcactaaagatttcctacaggacaatttattcagcggccccgggcctaaggagcccaccggactgtctcccttcctcttgctgcctcctcggcccccccctgctcggcctgacaagctgcccgaactgcccgcccagaagcggcagcttccggtttttgccaagatctgctccaaacccaaagcggaccccgctgtagagagacaccacctcatggaatggtcccccggcactaaggaacctaagaagggccagggctccttatttctgtcccagtggccacagagccagaaggatgcttgcggagaagaaggatgctgtgatgccgtcggcacagcttctctgacccttccccctaagaaaccaacatgtcctgccgaaaagaacttgctgtacgagttcctgggagcaactaagaacccatctggtcagccccggctcagaaacaaagtggaagtcgatggtccagagctgaagtttaatgcaccggtcaccgttgcagacaagaacaatccaaaatacactggcaacgtgttcacccctcacttcccgacagcgatgacttctgccactctaaatcaacccctatggctcaacttaaattacccccctcctcctgtgttcaccaatcactccacattcctgcagtatcaaggtctgtatccgcagcaggccgctcgaatgccttaccagcaagccctgcacccccagctaggctgttatagtcagcaggtgatgccctataaccctcagcaaatgggtcaacaaatattccgtagctcatacaccccactgctcagctacatcccttttgtgcagccaaactatccatatcctcaacgcaccccaccaaagatgagtgcaaaccctagggacccacctctgatggctggggatgggcctcaatatctctttcctcagggttatggatttggctccacttccggaggccccttaatgcattcaccttattttagtagctccgggaacggcatcaatttttag

SEQ ID NO: 41047 - DNA, 1797 bp, Artificial Sequence
  Description of Artificial Sequence: Synthetic coding sequence
atgcggggcggcggcggctgcgtgctggccctgggcggccagcggggatttcagaaggagagacgacgcatggcaagtggaaacggactccccagctcaagtgccctggttgcgaagggcccctgcgccctcggaccctttccgagatatatatggatacatcaggatactccccaagactctctggataaaacgtgtcatgagatctggaaacgcgttcagggcctaccagaagcctcacaaccatggacctctatggagcaactgagcgtgcccgttgtgggaacattgcgaggcaatgaattgtctttccaggaggaggcattagagctgtccagcggcaaggatgaaatcagcctgctggtggaacaagagtttctttcgctgaccaaggagcatagtatcctggtagaagagtcctccggcgaactcgaggtgccaggatcatctccggaaggtacacgggaacttgctccctgtatattggcaccgcccctggtggcgggatctaatgaaagaccaagagcttccataattgtgggcgacaagttactgaagcagaaagttgctatgcctgtaatcagtagtcgccaggactgcgatagcgccacctcgaccgtgactgacatcctgtgtgcagctgaagttaagagttccaagggaacggaagatagaggacgcattctgggcgatagcaatctgcaagtgagtaaactcctgtctcaatttccgctaaaaagcacagagacaagcaaggttcccgacaacaaaaacgtcctggacaaaacccgcgtcacgaaggacttcctacaggacaatctgttcagcgggcctggccctaaggagcccaccggcctctccccctttctcctgttgcctccccgcccgcctcccgctcggcctgacaaacttcccgagcttcctgcacaaaagagacaattgccggtgtttgctaagatctgtagtaagcctaaagccgatccagccgttgagagacatcacctgatggagtggtctccggggaccaaggaaccgaaaaaagggcaagggtcactgtttctctcacagtggccacaaagtcagaaagatgcctgtggcgaggaagggtgctgcgatgctgtggggaccgcatccctgacattgccccctaaaaagccgacatgccccgccgagaagaacctgctgtacgaatttctgggcgctactaaaaaccccagtggccagcccagactgaggaacaaagttgaggtcgacggacccgaactgaagttcaacgcccccgtgaccgtggcagataagaacaatcctaaatacaccggaaatgtattcacacctcatttccctactgcaatgacttctgctacacttaatcagcctttgtggcttaacttaaactatccgcctcccccggtttttaccaaccactcaactttcctccagtaccagggcctctaccctcaacaggccgcacgaatgccataccagcaggcccttcaccctcaattaggatgctattctcaacaggtgatgccctataatccgcaacaaatgggtcagcagatttttcgtagttcgtacactcctctgctgagctatattccattcgtgcagcccaattatccgtatcctcagaggactcctcctaaaatgtctgccaacccgagagatcccccattaatggctggggatggccctcagtacctgttccctcagggatacgggtttgggagcaccagtggcggaccactgatgcacagcccatacttctcatccagtggcaacggaatcaacttctag

SEQ ID NO: 41048 - DNA, 426 bp, Artificial Sequence
  Description of Artificial Sequence: Synthetic coding sequence
atggagcccagccacaaggacgccgagaccgccgccgccgccgccgcagtggccgctgcagacccacgtggggcgagctcctcatccggagtcgtcgtccaggtaagagaaaaaaaggggcctcttcgcgctgcaattccttatatgcccttccccgtggccgtgatttgtttattcctcaacacgttcgtcccaggtctgggcaccttcgtgtcggcattcacagtgttatgcggtgccagaactgacctaccagatcggcacgtgtgttgtgtcttctggctgaacatcgcagctgctctgatacaaattctaacggctatcgtgatggttgggtggattatgtctatattttggggtatggacatggtgatcctggccatcagccaggggtataaggagcagggaatacctcagcaactctag

SEQ ID NO: 41049 - DNA, 426 bp, Artificial Sequence
  Description of Artificial Sequence: Synthetic coding sequence
atggagcccagccacaaggacgccgagaccgccgccgccgccgccgcggtggcggctgccgaccctcgtggagccagttcatccagtggggttgtcgttcaagtccgcgagaaaaagggccctcttcgtgcagccatcccatacatgccctttccagtcgcagttatctgcctgtttctgaatacatttgtgccaggtctggggacattcgtctcagccttcacagtgttatgtggagcccggacagatctgccggaccgtcatgtctgctgtgtattttggctcaacatcgccgcggctctcatacaaatactgactgcaatcgtcatggtgggttggattatgtcaattttttggggaatggacatggtcatattggctacatcaaccgggtataaggaacaaggtatcccgcagcagctctag

SEQ ID NO: 41050 - DNA, 639 bp, Artificial Sequence
  Description of Artificial Sequence: Synthetic coding sequence
atgcggagccggctgctgctgagcgtggcccacctgcccaccatcagggaaacgactgaggaaatgctcctgggaggcccgggtcaggaaccccccccctcccccagcttggatgactatgttaggtcaatcagtcgtttggctcaacccacaagcgtgctggacaaagcaacagcccagggtcagccgcggccgccccatagaccagctcaagcatgcaggaaggggcgcccggctgtgtctctcagagacattacagccagattctccggccagcaacctaccctgcctatggccgacactgttgatccgctagattggttgtttggtgagtcccaggagaagcagcctagccagcgggatttaccacgacgcaccggcccctcagctggcctgtggggtccccatcgccaaatggactcttctaaacccatgggagctccacgaggtcgtttgtgcgaagcccgcatgccaggccattctttggccaggcccccacaagacggtcaacaatcctctgatcttcggtcatggacattcggccagagtgcccaggccatggcatcaagacaccggccaaggcctagctcagtcctcagaacactgtatagccatttgcctgtgatccatgaactgtag

SEQ ID NO: 41051 - DNA, 384 bp, Artificial Sequence
  Description of Artificial Sequence: Synthetic coding sequence
atgcggagccggctgctgctgagcgtggcccacctgcccaccatccgggagactactgaagaaatgctgctcggaggcccaggccaggagccgccaccctccccaagtctggatgactatgtgaggagcatttctagactcgcccagcccacatctgtgctcgataaagcaacggcccaaggccaacccaggcccccacatcgccctgcgcaggcctgtcgcaagggtcgcccggcggtgtcactcctggcaagcggagtccacattgacagatggaccgccgcctcaccatggggacctcctgaaggggggtctgttaaacccggctgtttgggaataccgtggcaggaccatcgtagaatgggttctagggctcttacgtag

SEQ ID NO: 41052 - DNA, 255 bp, Artificial Sequence
  Description of Artificial Sequence: Synthetic coding sequence
atgcggagccggctgctgctgagcgtggcccacctgcccaccatccgcgagactacggaagagatgcttctgggtggacccgggcaggaacctccaccatctccctccctggacgactacgttagatcaatctccagattggcacagcccactagcgttctggacaaggcaaccgcccagggacagccaaggcccccgcacagaccagcgcaggcatgcaggaaaggtcgccccgctgtgtccttgcgcgactag

SEQ ID NO: 41053 - DNA, 504 bp, Artificial Sequence
  Description of Artificial Sequence: Synthetic coding sequence
ctgggcctgctggtggagcggcaggagagcgagggcctgccccgggtgaggcccccagtgcatggaagaccccaggccaccgctgccggcataaccggagcgatgtctacagaaggcccttccctcgcatcctccccagccatctccccactcgctttcctgagtgcaccagtcacgcctgggacattggcagaggctacggacccactgcccatgttgatcgcattggcatgcatatttctgctgcttgctacctgcctgctgtttatgactctctgcaagccggctgccctggatccctcccggcggcgcgcacatgagtgcatgccacaccacccagggtctccttctgaaccacaactgagactctggaaaaggctgggaagtctccgactttcccttcactcatttcgtcatgggcggccaactgtgcctcgccagccgctgccagggcccgaggataaccgaagccactgcgactatatggagtccactaaaatgtag

SEQ ID NO: 41054 - DNA, 402 bp, Artificial Sequence
  Description of Artificial Sequence: Synthetic coding sequence
atgagcaccgagggccccagcctggccagcagccccgccatcagcccactggccttcctaagcgccccagtgacacccggcactctggccgaagccactgatccacttccgatgctgatcgccctggcctgcatttttctgctgctggcaacctgccttttgtttatgacactgtgtaaaccggccgctctggatcccagccgccgccgggctcatgagtgcatgccgcatcacccgggctccccctcagagccccagcttcggctctggaaaaggctcgggtcattgcgactaagtttacactcttttagacacggcagaccaaccgtccctcgccagccgcttccaggacccgaagataaccggagccactgcgactatatggaaagcaccaagatgtag

SEQ ID NO: 41055 - DNA, 402 bp, Artificial Sequence
  Description of Artificial Sequence: Synthetic coding sequence
atgagcaccgagggccccagcctggccagcagccccgccatcagcccactggcattcttaagcgctccggtcacgccggggacccttgccgaagctacagaccccctgcctatgctcatcgccctggcgtgtatctttttgctgttggcaacatgcctgttgtttatgaccttgtgcaagcccgccgctttggatccgtctaggcggagggcacacgaatgtatgcctcaccaccccggcagcccctctgagccgcaactccgcctctggaaacggttggggtccctcaggctcagtctgcatagctttaggcatggacgacccacggtgccaaggcagcctctgcccggtccagaagataaccgcagccactgcgactacatggagtctactaaaatgtag

SEQ ID NO: 41056 - DNA, 468 bp, Artificial Sequence
  Description of Artificial Sequence: Synthetic coding sequence
atggagagcctgcagaccccccagcaccgggagaaccaggacaagcgtgaaaaggagtatggtgttaagcatatgcctatgggcaacaatgctgggaatcttgaaccagagaagcgcaaggctgtgagggttgccctgagctctgccaccgctgctcagaatatcccaagctccgtgcactgtgggtgttctaagcagtggcgcttgcgcctgccgtcagaaagtttgcagtctcggggccaagtaatgaaaagacccaacaacattctgaaactgagaaacctggacctcctgatttacccctggcctgagctaagaagaaggcaagtggcgtccgatttgatgagtttgctcctgctgcctgcatttagcggcttgacttgggccccctttctgttcctatttacttacttgcctcccttcctgaatctcttgacggttggtttcgtgtcctacttccttgtttag

SEQ ID NO: 41057 - DNA, 1524 bp, Artificial Sequence
  Description of Artificial Sequence: Synthetic coding sequence
tgagagtgcccccggggccggagcgccctgctgaagggccccccccaggagaagcccaatcggaggagtgctctcctttctgtcggtgaaatttccgagttatgtcctgagataactgacttcctgtgtagagataagaaatgcatcgcttctcacttattatgcgactataagcctgattgtagcgaccgctccgacgaagcacattgtgctcactacacgagcaccaccggctcgtgcaacttcgaaacgtcaagcggcaactggaccaccgcatgttcccttacacaggactctgaagatgatctggattgggcaatcggttccaggatccctgccaaggccttgataccagactcggaccacaccccgggatctggccagcactttctatacgtaaactcaagcggctctaaagaagggtctgttgctagaataacgacttcgaaatccttcccagccagtctggggatgtgtacagtgagattctggttctatatgatcgacccaagaagtatgggtatcctgaaggtttatacaattgaagagtccgggctgaacattttggtgtggtccgtgatcggcaataagaggaccggttggacttacggctcggtgccgctgagttccaacagccccttcaaggtggcattcgaagccgatctagacggcaatgaggacattttcatcgccttagacgacatatcattcactcccgaatgtgttactggcggacccgttcctgtacaaccctccccttgcgaagccgaccaattttcttgcatctacacactgcagtgcgtgccactcagcggtaagtgtgacggtcacgaggactgtatcgatggctccgacgagatggattgccctctttcaccgaccccgccactctgtagcaacatggagttcccatgcagcaccgatgagtgcattccctctctgctcctgtgtgatggtgtgcctgactgtcactttaacgaggacgagttgatttgttctaataagagctgttcaaacggcgctctcgtctgcgcttccagcaattcttgcatccccgcgcaccaacgctgcgacgggttcgctgactgcatggatttccagctggacgaaagttcatgcagcgaatgtccactgaactattgtaggaacgggggaacatgcgtcgtggagaaaaacggtccaatgtgccggtgcaggcagggatggaaaggaaaccgctgtcatatcaagttcaatcctcctgctaccgacttcacctatgcacaaaacaatacatggaccctcctgggaatcggactggcctttttgatgacccacattactgtggcagtgctgtgctttcttgccaaccggaaagtgccaatccgcaaaactgaggggtccggcaattgtgctttcgtcaaccctgtctacggaaattggagcaatccagagaagacggagtcttcggtgtatagcttctctaaccctctttatggtacaacgagcggaagtttggaaactctcagccatcatctgaagtag

SEQ ID NO: 41058 - DNA, 4461 bp, Artificial Sequence
  Description of Artificial Sequence: Synthetic coding sequence
ccccgggaccacagcctgaacgccagccagggccacttcatgttcattctgaagaagtcaagctcgctgtggcaggtcgccaaattacagtcccctactttttctcagacgggacccgggtgtatcctcagcttttggttttacaattatggattgagcgtgggagctgccgaactgcaactgcacatggagaactctcatgactctaccgtgatctggcgagtcctctataaccagggaaagcaatggctggaggccacgattcagctggggcgcctgagtcaaccttttcacttaagcttagacaaagtgtcactgggcatttatgatggcgtctcggcaattgacgatatccgattcgaaaactgtactctccccctgcccgcagaatcgtgcgagggacttgatcatttttggtgccgacatactagggcatgcatcgagaaactgaggctctgtgacctggttgacgactgtggagacagaacggatgaagttaactgtgcacccgagcttcagtgcaactttgaaaccggaatctgcaattgggagcaagacgccaaagatgacttcgattggacaagatcccaggggcccaccccaactttaaacacaggccccatgaaggataatacactggggactgccaagggacactatctgtacatcgagagctcagagccccaggcctttcaggactcagctgccctactctcaccaattcttaacgccactgatacaaaagggtgcacttttcgcttctactaccatatgtttggaaaacggatctatcggctcgccatctaccagcgtatttggtctgacagcaggggacagctcctttggcagattttcgggaaccaaggcaaccgatggattcggaaacatctgaacataagctccagacagcccttccaaattttggtcgaagcatcagtcggggatggatttaccggagatattgctatcgacgacctctcattcatggattgcactctgtaccccgggaacctgcccgccgatctccctacacctcccgagacatccgtcccagtgaccctgcctccccataattgcacagataatgaattcatctgccgctccgatggccactgtatagagaagatgcagaaatgtgatttcaagtatgattgccctgacaaatcagatgaagcaagctgtgtgatggaggtttgctcgttcgaaaagcggtcactgtgcaaatggtaccaacccatccctgtgcacctgctgcaggactccaacaccttcaggtggggccttggaaatgggataagtattcaccatggagaggagaaccaccgcccatctgtcgatcatacccagaacactactgacggctggtatttatatgccgactcaagtaacggcaaattcggtgacacggccgatatcctcactccaataatcagcctgacaggccctaaatgtactttggtgttttggactcacatgaatggtgccaccgtgggaagcctccaggtgcttataaaaaaggacaatgtgacctcaaaactctgggcccagaccggccagcagggagctcagtggaagcgtgctgaagtttttctaggaatccgcagtcacacacagatagtctttcgtgcaaagcgtgggatttcttatatcggagacgtggctgtcgacgacattagtttccaagactgctcgcccttactttcgcccgaacggaaatgtacagaccacgagtttatgtgtgccaacaaacactgcattgccaaggataagctgtgcgattttgttaacgactgcgccgacaattcagatgagactacattcatctgtcgcacttcttctggccgatgcgacttcgaattcgacttatgttcttggaagcaggaaaaagacgaagattttgattggaatcttaaggcgagtagcatccccgccgccgggactgagcctgccgctgatcataccctgggcaattcttcgggacactatatctttataaaaagcctgttcccccaacagccgatgcgcgccgccaggatctccagtcctgtcattagtaagcgtagcaaaaactgtaagattatctttcactatcatatgtatggcaatggaatcggggccctgaccctcatgcaagtcagcgtgactaaccagaccaaagtccttttaaacctgactgtggagcagggtaacttttggaggcgcgaggaactgtctctctttggggatgaagactttcagctgaagttcgagggccgggttggcaagggacagcgcggggatatcgcgttagacgacatcgttctcacggagaactgcctaagcctgcatgattccgtacaggaagaactggccgtgcccctgccaacaggcttttgtcctttgggttatagggagtgtcacaatgggaaatgctacaggcttgaacagagttgtaacttcgttgataattgtggggataataccgacgaaaacgagtgcgggagttcctgcactttcgaaaagggctggtgcggctggcaaaatagtcaggcagataacttcgactgggtcctcggcgtcggctcgcaccagtctctgcggccccctaaggatcataccttgggcaatgagaacgccattctgcttatgagacggcacaaataccccattaggagtgtcaatctgcatacagtgaaacacgtcctgaaagcccagacagtagggaattgctcagtctctaaactggaggctcgcctcttggacttcctgtctgttcctaacgagaacacattcgggagcagtgatcatactaattggcattttatgtacctcgaggcaactgccgttggcctgcgcggtgacaaggctcactttagaagcactatgtggagagaaagctcagcagcttgcaccatgtcgttttggtactttgtgtccgccaaggctacaggatctatccagatcttgatcaagcggggcaggaggaggaggcgcgccccaaatcctgttttgtcgggctcccccactatcccccgccaaggatctcagcagctgggggggtggcgtggtggtagcgcaaggcaccgggctagggcatttcctgaacctgaatgcccgcggggacggagtgctctattaaaaggcccccctcaggaaaaaccaaatcggaggtccgccctgctcagcgtcggcgaaatctccgaactgtgccccgaaataaccgattttctgtgccgggataagaaatgtatcgcatcccacctgttgtgtgactataaacccgactgtagtgacagatctgacgaggctcattgtgcccactacacatccaccacaggcagttgcaattttgagaccagtagcggaaactggactaccgcatgttctcttacacaagattctgaagatgacctggattgggctataggcagcagaatcccagcaaaggcgcttatacccgatagtgaccacactccaggcagcggacagcattttctgtacgtgaactcctcaggttccaaagaaggcagcgtggcccggattaccaccagcaaatctttcccagctagtctgggcatgtgtaccgtacgtttctggttttacatgattgacccaagaagtatggggatattaaaagtgtacacaattgaggaaagcggcctcaatatcctcgtgtggtctgtgatcgggaataaacgaactgggtggacttatggcagcgttcccttgagttctaactcgccctttaaagtcgcgtttgaggccgaccttgacggtaacgaggacatctttatcgcactggacgatatttcctttacaccggagtgtgtcactgggggccctgttccagttcagccatccccttgcgaggctgaccagttcagttgtatctataccctacagtgtgttcctctgtccggaaagtgtgacggacacgaggattgcatagacgggtctgatgagatggattgccccttgtcccctacaccgcccctgtgttccaatatggaatttccctgcagtactgacgagtgcatcccctctcttctactctgtgacggggttccagactgccacttcaacgaagacgagcttatctgctccaataagtcatgttcaaacggtgctttggtgtgtgcaagctctaacagttgcatacccgctcatcagaggtgtgatgggttcgccgactgcatggatttccaacttgacgagtcttcgtgctctgacacatggacgctgctgggcattggcttggcctttctaatgacgcacatcacagtagcagtcctttgcttcctggctaatcggaaggtgcccattaggaaaaccgagggatcgggaaactgcgctttcgtcaatccggtgtacgggaattggtctaatccggaaaagaccgagtcctccgtgtattctttttccaatcctctttatggcacaaccagcggaagcctggagaccctctcacatcacctgaaatag

SEQ ID NO: 41059 - DNA, 777 bp, Artificial Sequence
  Description of Artificial Sequence: Synthetic coding sequence
ctgaagttcgagggccgggtgggcaagggccagcggggcgacatcgctctcgacgacatcgttctcactgagaattgcttatcgctccacgatagcgtacaggaagagctggcagtgccgcttccgacagggttttgtccgctcggatatagggaatgtcataacggaaaatgctatcgcctggagcagagctgcaattttgtcgacaattgtggggataacacagatgaaaacgaatgtggatccagttgcactttcgagaaaggatggtgtggatggcagaactcccaggccgacaatttcgattgggtccttggcgtaggctcacaccagagcctgaggccgcccaaggatcacacactggggaacgaaaacggacatttcatgtacctggaagctaccgcagtggggctgcggggcgacaaggctcacttcaggagcacaatgtggcgggaatcaagtgccgcttgtaccatgtccttctggtactttgtgtctgccaaagccactggctccatccaaatcctgattaaaaccgagaagggactctccaaggtgtggcaggaaagcaaacagaatcctgggaatcactggcagaaagctgacattctattgggtaagctgaggaatttcgaagtgatttttcagggaattcggacacgcgatctgggcggcggtgcagcaattgacgacattgagttcaagaattgcacaacagtgggggaaatctccgagctctgtcccgagatcacagattttctgtgccgagacaagtag

SEQ ID NO: 41060 - DNA, 4422 bp, Artificial Sequence
  Description of Artificial Sequence: Synthetic coding sequence
atgttcatcctgaagaagagcagcagcctgtggcaggtggccaagttgcaatcccccactttcagtcagaccgggcctgggtgcatcctcagtttttggttctacaactacggcctcagcgtgggggccgccgaactgcagttgcatatggaaaacagtcatgactccacagtcatttggcgcgtgctctacaaccagggtaagcagtggctggaggctactatccagttgggccggctgtcgcagccatttcacctgtcattagataaagtatctctgggcatttacgacggcgtctcagcaatcgatgatatccgcttcgaaaactgcacgctgccccttcctgccgaaagttgcgaaggacttgaccacttctggtgccgtcataccagagcctgtattgaaaagctcagactgtgcgacctcgtggacgactgcggggatcggacagatgaggtaaattgtgcgccagagctccagtgcaatttcgaaaccggaatctgcaattgggagcaggacgcgaaagacgattttgactggactcgctctcaaggaccaacccctaccctcaataccggtccgatgaaagacaatactctcggcacagcaaaggggcactatctctacatcgaaagttcagaaccccaggcattccaggactccgccgctttactgtctcctatactgaatgccacagacaccaaagggtgcacctttcggttttattaccatatgttcggcaagcgcatatacaggctggccatttatcagcgcatatggagcgatagtaggggtcagctgctctggcaaatcttcgggaatcaagggaaccgctggatacgtaaacatctcaatatctcctcgagacaaccattccagatcttagtcgaggcttctgttggggacggattcactggcgatatagctatagatgacctcagttttatggactgcaccctgtacccgggaaatctgcccgcagatctcccaacaccacccgaaacgtcagtgccagtgacattgcccccccacaattgtaccgataacgagtttatctgtcggtcagatggtcattgtattgagaaaatgcagaaatgtgactttaagtatgactgccctgacaagtccgatgaggccagctgcgtcatggaagtctgttcctttgagaagcgaagcttgtgtaagtggtatcagccaatccctgtgcacctcctgcaagattccaacacgttcaggtgggggctgggcaatggcatcagcatccaccacggggaggaaaatcatcgaccctcagtggatcacactcagaacacgacagatgggtggtacctttacgcagactcttctaacggcaagtttggagacacggcagacattcttacgcccataattagtctcaccggtccaaaatgcactttggtcttttggacacacatgaacggagccactgtaggcagcctccaggtgctcatcaagaaggacaacgttacatccaagctgtgggctcaaactggacagcaaggggctcagtggaaacgtgccgaagtcttccttggcatccgcagccacacgcaaattgtttttagggcaaaaaggggcattagctacatcggtgatgtggctgtggatgacatttcctttcaagactgtagccctctgctttccccggagcggaaatgcactgatcatgaatttatgtgtgctaataagcactgtatagcaaaagacaaactatgtgatttcgtcaatgactgtgccgataattccgacgagacaaccttcatttgccgaacctccagcggaaggtgcgatttcgagtttgatctgtgttcttggaaacaggagaaggatgaggattttgactggaacctcaaagcctcctctattccagctgcgggcaccgaaccggccgctgaccacacccttggcaacagctccggccattatatcttcataaaatccctgtttcctcagcagccgatgagggctgcccggatcagctcccctgtaatttctaaaaggtcaaaaaattgcaagatcatcttccactaccacatgtacggcaacggaattggtgccttaacactcatgcaagtctccgttaccaatcaaacaaaggtcttacttaatctgacagtagaacagggcaacttttggcggcgcgaagagctcagcctgtttggtgatgaggatttccagctcaagtttgaggggagggttggcaaggggcaaagaggcgacatcgccctggacgatatcgtgcttactgagaattgcttgtcgttgcacgattcagtgcaggaggagcttgctgtgccgctgcctacagggttttgccccctggggtaccgggaatgtcacaatggaaaatgctaccggcttgaacagtcttgtaatttcgttgacaattgcggagacaataccgatgagaacgagtgtggctccagttgcacctttgagaaggggtggtgtgggtggcaaaacagtcaggcagacaatttcgactgggtgttgggagtgggatctcatcagtctctgcgacccccaaaagaccataccctcgggaacgagaatgccattctcctgatgcgccgccataaatatcccattcgctctgtgaacctgcacactgtcaagcacgtgctgaaggcccagactgtggggaactgctcggtcagcaagttggaggctcggcttctcgacttcctctctgtgccaaatgaaaacacctttgggtcctctgaccataccaactggcactttatgtatctcgaagcaaccgccgtggggctcagaggtgacaaggcccattttcgcagcactatgtggcgtgagtccagtgccgcctgtacaatgtccttttggtatttcgtctccgctaaggctaccggttcaatccagatcctgataaaacgcgggcgtcgtagacgccgggctcccaacccggtgctgagtgggagtcctaccattccccgccagggttcgcaacaactagggggctggaggggcgggtcagccagacaccgcgctagggctttcccagagcctgaatgcccgagaggacggtctgcactcctgaaaggtcccccacaggagaaaccaaaccgcagaagcgctctgctgagtgtaggcgagattagcgaactctgcccggaaattaccgacttcctgtgccgagacaaaaaatgcattgcctctcatctcctgtgcgattataaaccagattgctcagatcgatccgacgaagcacactgcgctcattacacctctaccaccggatcttgcaactttgaaaccagcagcggtaattggactacagcctgttcccttacacaggacagcgaggacgatttggattgggcgatcggcagccgtatccccgccaaagcccttatccctgacagcgaccacactcctggctcaggccagcacttcctatatgtgaattcatccggctccaaagagggctccgttgctcggatcaccacttcaaagtcttttccagcctctttggggatgtgtacagtgcggttctggttttacatgatcgatcccaggagtatgggcatacttaaggtctacacaatcgaggaatcaggactcaatattcttgtgtggagcgttattggcaataagcggacggggtggacctatggctccgtaccactatcgtctaacagccccttcaaggtggccttcgaggcagatttggacggaaatgaggatatctttattgcactcgatgatatctcctttactcccgaatgcgtgacgggaggcccagtccccgtgcagcctagcccttgcgaggccgaccaattctcctgcatatatacgctgcaatgtgtgccactgtctggtaaatgcgatggccatgaagattgtattgacggctctgacgagatggactgtcctctctctcctaccccaccactatgttctaatatggagttcccatgctccactgatgagtgcatcccaagcctgctgctctgcgacggcgtgccagactgccattttaacgaagacgagctgatctgctcaaacaaaagctgcagtaatggtgcattagtttgcgcaagcagcaattcatgtattccagctcaccaacggtgtgatggttttgccgattgtatggatttccagctagacgaaagcagttgctctgatacctggactctcctcggaatcggactagcctttctgatgacccacataacagtcgctgtcttgtgttttctggctaacagaaaggtaccaatccggaagacggagggatccggtaattgcgcgttcgtcaaccccgtgtatggaaattggagtaaccctgagaagaccgagagtagcgtttactcattcagcaaccccctgtatgggactacctctgggagtcttgagactctttctcatcacttgaagtag

SEQ ID NO: 41061 - DNA, 1053 bp, Artificial Sequence
  Description of Artificial Sequence: Synthetic coding sequence
atgtgcaccgtgcggttctggttctacatgatcgacccccggagcatgggcattctaaaggtttatacgatcgaagaatctggccttaacatactggtgtggtcagttatcggcaataagagaacgggttggacatacgggtccgtgcccctgagttcaaacagtccattcaaagtggcatttgaggccgatctggacgggaatgaagacattttcattgcacttgatgacatatcatttactcccgagtgcgttaccggaggacctgtccctgtgcagccgagcccatgcgaggcagaccagttctcctgtatttacacgttgcagtgcgttcctctgtcagggaagtgtgatgggcatgaggactgtatcgacggctctgacgagatggattgtcccctgtctccaacccccccactctgcagtaacatggaatttccctgcagtacagatgaatgcattcccagcttgctcttgtgcgatggggtcccagattgtcattttaacgaggacgagctgatttgcagcaacaagtcctgctccaatggagctttagtgtgcgcgtcatcaaatagctgtattccggctcatcagcgctgcgacggcttcgccgattgcatggatttccagctggatgagtcaagttgttcggagtgtccactgaactattgccggaacggggggacctgtgtcgttgagaagaacggtcctatgtgtcgatgtcgacagggatggaagggaaatcgctgtcacatcaagttcaatccaccagctaccgatttcacgtatgcacagaacaacacctggacgctattggggataggccttgcctttttaatgactcacatcaccgtggcagtcctttgttttctggcgaatagaaaggtgcccattcgtaaaacagaaggctcaggaaattgcgctttcgttaaccctgtgtatggaaattggagtaatccggaaaagactgaatctagtgtgtactcattctctaatccactgtatggaactacctctggctctttagagactctctcccaccacttgaagtag

SEQ ID NO: 41062 - DNA, 318 bp, Artificial Sequence
  Description of Artificial Sequence: Synthetic coding sequence
atgaacctgggcgtgagcatgctgcggatcctgttcctgctggacgtcgggggagcacaggttctggctacagggaagactccaggagctgaaatagacttcaagtatgcgcttatcgggactgccgtgggcgtggccatatctgctggatttctcgcactcaaaatttgcatgatccgacgtcatctgttcgatgatgattcatctgatctcaaatccacacctggcggcctgtctgacacaattccgctgaagaagcgcgcccccaggcgcaaccataattttagcaaacgggatgctcaagttattgaattgtag

SEQ ID NO: 41063 - DNA, 1443 bp, Artificial Sequence
  Description of Artificial Sequence: Synthetic coding sequence
atgctgggccggttccagcccttcagcctggtgcggagcttccggttgggcttcgaagcttgttgctaccccaaccagaagtgtgctacgcagaccattcgaccccccgacagccggtgtctggtacaagccgtttcacaaaattttaacttcgccaaagacgtcttggatcagtggtctcagctcgagaaagacggtcttcgcggcccataccctgctttgtggaaagtttctgccaagggggaggaggacaagtggtcctttgagcggatgactcagctgtcaaagaaggccgctagcattctctcagatacttgcgcccttagtcacggcgataggttgatgataatcctaccccctacccctgaggcctactggatctgtctggcgtgtgtgagacttgggatcacatttgtcccaggatctccccagttgacagccaagaaaataaggtaccagctgcggatgagcaaggcccagtgcattgtcgccaacgaagccatggcccctgtcgtgaatagtgccgtttccgactgcccaacactcaaaactaagctgctcgttagtgataagtcctatgatgggtggctcgacttcaaaaagctaattcaggtcgctccaccgaaacagacatatatgagaaccaagtcacaggatcccatggctattttctttactaaaggaaccacgggtgcgcccaaaatggtggagtacagtcagtacggcctgggcatgggattttcccaggcctcaagacgatggatggacctacagcccactgacgttttatggagcttaggagatgctttcggcggttccctttccctgtccgcggtgcttggcacctggttccagggtgcctgtgtgtttttgtgccatatgcctactttttgtcctgaaaccgtcctcaacgttctgtcgcgcttcccaattacaacgctcagtgccaacccagagatgtaccaggaactgctgcagcataaatgcttcacttcttaccgattcaaaagcctgaaacaatgtgtagcagcaggaggccctattagccccggcgtcatagaggattggaagcgaataaccaaactggatatttatgagggctatggtcagacggagactggcctgctttgtgctactagtaagaccatcaagttgaagccttcttcacttggcaaacccctgccaccgtacatcgtccagattgtggacgagaattctaacctgctgcccccaggggaagaagggaatattgcaattcggataaagcttaaccaaccggcctctttatactgcccacatatggtgtcttgggaagagtacgcctctgcccgcggtcatatgctgtatctcacaggggatcgcggcatcatggacgaggacggctacttctggtggtcaggtcgggttgacgatgttgccaacgctttgggacagagactttag

SEQ ID NO: 41064 - DNA, 1443 bp, Artificial Sequence
  Description of Artificial Sequence: Synthetic coding sequence
atgctgggccggttccagcccttcagcctggtgcggagcttccggctcggcttcgaggcctgttgttaccccaatcagaagtgtgccacacagacgatccgacccccagacagccggtgtcttgtccaggctgtgtcccagaatttcaacttcgctaaagatgtcctcgaccaatggtctcagctcgaaaaagatggtctgagggggccctacccagctctgtggaaggtgagcgcgaagggggaggaagacaaatggtccttcgagcgcatgactcagctctcgaaaaaggccgcgagcatactgtctgacacatgtgctctctctcatggcgatcgcctgatgatcattctgcccccaacccccgaggcttattggatttgcctggcttgtgtcaggctgggcatcacctttgtacccggaagtcctcagctcacagccaagaagattcggtatcagcttagaatgagcaaagcccagtgcattgtggctaacgaagcaatggcccccgtagtaaattcggctgttagtgattgccccacactgaaaacaaagcttctggtctctgacaaatcttacgacgggtggctggactttaaaaagctgattcaggtggctcctccgaaacagacttatatgcgcactaagagccaggacccgatggccatcttctttacaaaagggactacaggagcccctaagatggtagagtattcgcagtacggtctgggcatgggattctcccaggctagcagacgctggatggatctccagcccaccgacgtattgtggagccttggcgatgcatttgggggttcgttatctctgtctgccgtgctgggaacttggttccagggtgcctgcgtatttctgtgccacatgcccactttctgccccgagaccgtgcttaatgttctgagcagattccctataacaacattatctgccaaccctgaaatgtatcaggagttgctccagcacaaatgcttcaccagctatcgcttcaagagcctcaaacaatgcgtggccgccggagggcccatttctccaggcgtcattgaggactggaagcgcataactaaactggacatatatgaagggtacggccagacagagacaggtctgctgtgcgccactagcaagaccatcaagctcaaaccgtcttctctgggaaagccactccctccctacattgtacagatagtcgacgaaaactctaacctgcttccacctggagaagaaggaaacattgctattcgaatcaagttgaatcagccagcttcactgtactgtccacacatggtttcttgggaagagtacgcttccgcgcgaggacatatgctgtatctgacaggcgatcgggggatcatggatgaggacggatacttctggtggtcaggaagggtcgatgacgtcgccaacgcccttgggcagcgtctgtag

SEQ ID NO: 41065 - DNA, 561 bp, Artificial Sequence
  Description of Artificial Sequence: Synthetic coding sequence
atgagcaaggcccagtgcatcgtggccaacgaggccatggcccccgtggtcaactccgctgtatctgactgtcctaccctgaaaaccaaattattggtcagcgataaatcttatgatggctggctagactttaagaagctgatacaggtggcccctccaaaacaaacttatatgcgtacgaagagccaagaccctatggccatcttcttcacaaaagggacaaccggagcccccaagatggtggagtactcccagtacggattgggaatggggttctcgcaggctagcagaaggtggatggatctccagccgaccgacgtgctatggtcccttggggatgcatttggcggaagcttgagcttgtcagcggtactcgggacttggttccagggcgcctgcgtcttcctctgtcatatgcccactttttgcccagagacagtgctgaatgtcctctctagatttcccattaccaccctgtccgccaaccccgaaatgtatcaggagctcctgcagcacaaatgttttacaagggtttattcagtgccactacccaaacagtag

SEQ ID NO: 41066 - DNA, 1521 bp, Artificial Sequence
  Description of Artificial Sequence: Synthetic coding sequence
atgctgggccggttccagcccttcagcctggtgcggagcttccggctaggatttgaggcctgctgttacccaaaccagaaatgtgccactcagacaatcaggcctcccgactcccggtgcctggttcaggccgtcagtcagaatttcaacttcgcgaaggacgtgctggaccagtggagccagcttgagaaagataacgggttgcagctgcacccatgctgttgcaagaggcaagatttcattctgtttcacgggtgcctgttctacattgacggcctgcgcggcccatatccagccctttggaaggtgtccgcaaagggtgaagaggacaaatggtccttcgaacggatgactcaactctcaaaaaaagccgccagcattctgtcagacacatgcgctctttctcacggagatagattaatgatcatccttcctcctacgcccgaggcctactggatctgcttggcgtgtgtgagattaggcattactttcgtgcctgggtcaccacaactgactgcgaagaagatacgctaccaactgcggatgtctaaagcccagtgcattgtggccaatgaggccatggctccggtggttaattctgcagtgagtgattgcccaacgttaaaaacaaaacttctggtcagtgataaatcctatgatggttggctagactttaagaagctcatccaggtcgccccgcccaagcagacatacatgcgcactaagtctcaagaccccatggccatcttcttcaccaagggcacaaccggcgcccccaagatggtggagtatagtcaatatggtttgggcatggggttcagccaggcttcaagacgatggatggacctccagcccacagacgttctgtggagccttggagatgccttcggtggcagtttgtcccttagtgccgtgctgggcacctggtttcaaggagcctgcgtgttcttatgtcacatgcctactttctgccccgagacagttctcaacgtcctcagtcgcttccctattaccacattgtccgcgaatccagagatgtaccaggagttgctgcagcataagtgttttacatcgtataggtttaaatctctcaagcagtgcgtcgctgctggtgggccgatcagccctggtgttatcgaagactggaagagaattacaaaattggatatctacgaggggtatggacagacagaaactggacttctttgcgccacttccaagacaataaagctcaagcctagtagcttgggcaaaccccttcctccctacatcgtccagattgtcgatgaaaacagcaatctcctgccaccgggggaggagggcaatatagccatccgtataaagctgaatcagcccgcaagcctttattgtccccacatggtgagctgggaagaatacgccagtgcgcgtggccacatgctgtacctgaccggcgacagaggtattatggatgaagatgggtacttctggtggtcaggcagagtggatgacgtggccaatgccctcggtcagcggctgtag

SEQ ID NO: 41067 - DNA, 366 bp, Artificial Sequence
  Description of Artificial Sequence: Synthetic coding sequence
atggtgcggatcctggccaacggcgagatcgtgcaggacgacgacccaagggtgaggacaactacgcagccgcctagggggtcgataccacggcagagttttttcaaccgggggcacggggcccctcctggaggacccgggccgcgccagcaacaagccggcgccagactgggggccgcccaatctccctttaacgatttgaaccgtcagcttgtaaatatggggttccctcagtggcatctggggaatcatgcagtggaaccagtcacaagcatactactgctctttctgttaatgatgctgggagtgaggggtctgctgctcgtcgggctggtgtacttggttagtcacctaagccagcgctag

SEQ ID NO: 41068 - DNA, 312 bp, Artificial Sequence
  Description of Artificial Sequence: Synthetic coding sequence
atgagccccgtgctgagcggcatccacagcatctacagcgcctgggtgactagcgtgaatatcactgactgtaaaccgccctccattagcggagccgcccaccagggccccacagcacccggcaggatggtgaggattttagctaacggcgaaatcgttcaggatgacgatcctagggtacggacaactacacagccccctagaggctcgattccgaggcagagcttctttaacaggggtcatggggcgcctccagggggccctggcccaagacagcagcaggccggcgcacggctaggagcggctcaatag

SEQ ID NO: 41069 - DNA, 924 bp, Artificial Sequence
  Description of Artificial Sequence: Synthetic coding sequence
gccagcccccggcggccccggcccgcccggagccccgcccccgaggtgcctttgagggtacggagaaggcacggaaggcctcacggtcccggggggcgtcagttagcactgggtatccccgcgctccgtagtttgcccgggtgcgtacctagactgctgggaccagtggacaaaggccacgatgtgaccttctataagacctggtatagatcctcaagaggcgaggttcaaacatgtagtgagcgccgcccaattagaaatcttacctttcaggacctgcaccttcaccacggtgggcaccaggctgcgaacacctcgcatgacctggctcaacgacatggtctggaatcggcatccgatcaccacggcaacttcagcattactatgcgcaacttaaccctgctggacagcggactgtactgctgtctcgttgtggaaatccgacaccatcatagcgaacaccgggtacatggcgcgatggaactgcaggttcagacaggaaaagatgctccttccaattgtgtggtctacccctctagctcacaagacagcgagaacatcacagcagctgccctcgccacgggggcttgcattgtcggaatcttatgcctgccgctaatactcctgctcgtctacaagcagaggcaggcagccagcaatcggctcgcacaagaattgctggcgcaggactctaacatacaggggattgaaaatcctggattcgaggccagtcccccagcgcagggcattccagaagctaaagtccgacatcctttgagctatgtagcacagcgtcaacccagcgagagcggccgtcacctgctgtctgagccatccacgccgttgtcccctcctgggccaggagatgtattctttccgagtctggatcctgtgccagattcccctaactttgaagtgatctag

SEQ ID NO: 41070 - DNA, 936 bp, Artificial Sequence
  Description of Artificial Sequence: Synthetic coding sequence
atgggcgtgcccaccgccctggaggccggcagctggcggtggggctcactgctcttcgcgctctttctagcggctagtcttggtccagtggccgcatttaaagtggccacgccatactctctttatgtgtgccctgaagggcagaatgtcaccctcacttgtagactacttggacccgttgataaaggacatgacgtgacattctacaaaacatggtaccgcagctcgcgcggagaggtccagacatgtagcgagcggagacccatcagaaatctcactttccaggacttacacttgcaccacggggggcaccaagctgccaacactagtcacgacctggcccagcgccacggcttggagtccgccagtgaccatcacgggaactttagcattacaatgcgaaacctgacactccttgactctggtctctactgctgcctggtggtcgagataagacatcaccatagtgaacaccgggtgcacggggcaatggagcttcaagtgcaaacaggcaaggatgcaccctctaactgcgtggtatacccctccagctcccaggacagtgagaacatcaccgcagcagccctggccacaggagcctgtattgtcggaatactatgcctccccctaatcctgttactggtgtataaacaacgacaggccgccagtaatagaagggcacaagagctggtgagaatggacagcaatatccagggaattgagaatcctggcttcgaggcttcccccccggcccaaggaatacccgaggctaaggtccgccatcctctgtcttatgtagcccagaggcaaccatctgaatcaggacggcaccttctgtcagaaccatccacccctctttctccgcctggtcccggggacgtgtttttcccctcactggatcctgtgccggatagccccaactttgaagtgatttag

SEQ ID NO: 41071 - DNA, 435 bp, Artificial Sequence
  Description of Artificial Sequence: Synthetic coding sequence
tgaaccgccggcgagctgcccgccaacagcgtgagcggcttcttcaagcgtatggttaagtcagaagcgtccaacgccgccactgcatactttagacccgcaagacctctgccatctctcgtaaccgtgctcgggcttgggtattttgcctgggtcgtgttctggccccagagcatcccctaccagaacctagggcctcttggaccctttacgcagtatctagtagatcatcaccacactcttctgtgtaacggctactggttggcatggttaatacacgtcggggaatcactgtatgcaatcgtgctctgcaaacataagggaattacgagcggtcgggcgcagttactgtggttccttcagactttcttctttgggatagcaagtctgaccattctgatcgcctacaagcggaagcgacagaagcagacgtag

SEQ ID NO: 41072 - DNA, 312 bp, Artificial Sequence
  Description of Artificial Sequence: Synthetic coding sequence
atggccaccgccgccggcgccacctacttccagcggggcagcctgttttggttcacagtgatcacactgagtttcggctactacacgtgggtggtgttctggcctcagagtattccttaccaaaacctgggtccactcggccccttcacgcagtatcttgtggatcaccatcacactttactgtgtaacggctactggctggcttggctgatccatgtaggggaaagcttgtacgccattgtgttgtgtaagcagaatgagttgagaatccgtatcaagatgcggaagctgatcctgcgagatagcgaatag

SEQ ID NO: 41073 - DNA, 255 bp, Artificial Sequence
  Description of Artificial Sequence: Synthetic coding sequence
atggccaccgccgccggcgccacctacttccagcggggcagcctgttctggttcaccgtgatcaccttgtcttttggatactatacctgggtagtcttttggccccagagcatcccctaccagaacctggggcccttaggcccctttactcagtatttagtggaccatcatcataccctcctttgcaatgggtactggctcgcttggctgatccacgtgggtgagtctttatacgctatcgtgctctgcaagtag

SEQ ID NO: 41074 - DNA, 312 bp, Artificial Sequence
  Description of Artificial Sequence: Synthetic coding sequence
atggccaccgccgccggcgccacctacttccagcggggcagcctgttttggttcaccgttataaccctctccttcggctactacacatgggtagtgttttggccccagagcataccttatcaaaacttaggaccccttgggcccttcacccagtacctggtggatcaccatcacacactcttgtgtaatggctactggttggcgtggctgatccatgtgggcgaatctttgtacgccattgtactctgcaagcagaacgagctgaggattcgcatcaaaatgcggaaactgattctacgcgacagcgagtag

SEQ ID NO: 41075 - DNA, 372 bp, Artificial Sequence
  Description of Artificial Sequence: Synthetic coding sequence
atggccaccgccgccggcgccacctacttccagcggggcagcctgttttggtttaccgtaattaccctctcttttggttactatacctgggtcgtgttctggcctcagtcaatcccataccagaacttgggacctttgggtccttttactcaatatctggtggaccaccatcacactctgctgtgtaacggttactggctggcatggctcattcatgtcggcgaaagcctgtacgcaattgtcctgtgcaagcacaaaggtattacatctgggcgggcacaactgctctggttcctacaaacctttttctttggcatcgcctcacttaccattcttatcgcctataagcgtaaaaggcagaagcagacttag

SEQ ID NO: 41076 - DNA, 306 bp, Artificial Sequence
  Description of Artificial Sequence: Synthetic coding sequence
tgagagttcctgcggagcgtgtgggtggtgttctggccccagagcattccgtaccaaaatttaggcccgttagggccctttacgcagtatctggtagaccaccaccataccctactttgtaatgggtattggcttgcttggttgatacacgtcggcgagtctctctatgccatcgttctttgcaaacacaaaggcatcacgtccgggcgggcccaattactctggtttctacagacatttttctttggaatagcctcattgaccattttgatcgcgtataagcgtaagaggcagaagcagacttag

SEQ ID NO: 41077 - DNA, 285 bp, Artificial Sequence
  Description of Artificial Sequence: Synthetic coding sequence
agcgtggagctgcccctggacgccgacgtgcagaccagcaacctgttaatcacctttttgaagtatagttccattgtgatgcaggacacaaaggacgaacatcggttacactctggaaagctatgtctgatcatattgacctgcatcgccgaaccgatgcgacatcggaaaaaagcagctgacaaaaatctgccatgtcggcctttggtgtgcgcagtacttgacctcatggtggaatttatcgtcacccatatgatgaaggaattccctatggacttatactag

SEQ ID NO: 41078 - DNA, 597 bp, Artificial Sequence
  Description of Artificial Sequence: Synthetic coding sequence
atggcccaggtggagaagcggggcggcctgctgcggaagagcagcgcctccaagaagccattgaaggagaaggtggtgctgatgtatgatgaaatattcatgaccgaagatccgtcaaagtgctcgcctcggttttgggaagaactttttctgatgaaggtgaacttagaatatctcgaaggaaaactcgaatccctcgacggcgaagaactgatgaaaatcaaagacaacattaattgcctgtttcagcattgtatccaggctctcggagaggaacacccgattcgggttgtaaatgccctacagacactatgtgccctgatacgtggggtgcaccagaagaacaagtctacatctgggtttgatattattaacatgctaatgggctttgacaaggccgaactatgcatgaaggtccggcataagctacaaatgtgcctgtggatggccgcctccgatagttgctcctggacacttagtgcagataaatgtacacagaggtttgggttgcggaaaattcagatgattgaattcggccttgcattccggtgcttctattttaccgacctcctctacctgaacaagggtaaattttag

SEQ ID NO: 41079 - DNA, 2070 bp, Artificial Sequence
  Description of Artificial Sequence: Synthetic coding sequence
atggcccaggtggagaagcggggcggcctgctgcggaagagcagcgctagcaaaaaaccgttgaaagaaaaagtggtactcatgtatgatgagatatttatgacagaggatcctagtaaatgttccccccgattttgggaggaattgttcctgatgaaagtaaatctggagtatcttgaaggcaaattggagtcattggatggagaagaactcatgaaaataaaggacaacatcaactgtctgtttcagcattgtatccaggcgttgggagaggagcatcctataagggttgtaaacgcactgcagacactttgtgctctcatccgaggggtgcatcaaaagaacaaatcaacttcaggcttcgatatcatcaacatgttgatggggtttgacaaagcagagctctgtatgaaaaatctgatggagagtcttgatagcctgctatgcgcagaaggcagcgagtctctgaaatccctgtgtttgaaactgttgctgtgcttggtgaccgtaacagataacatctctcagaacactatcttagagtatgtgatgatcaacagcatttttgaagcgatacttcaaatcctgagccatccaccctccagacgcgagcacggatatgacgctgtagtgctgctggcattactggtaaactaccgtaaatacgagtcagtaaatccttacatcgtaaagttgtctatcgttgacgacgaagcgactctgaacggtatggggctagtgatcgcccaggctctgtccgaatacaaccgtcagtataaagataaggaggaagagcatcaaagcgggtttttttcggcactgactaacatggttgggagcatgtttatcgccgatgcgcacgaaaagatctccgtgcaaactaacgaggctatattacttgctctgtacgaggccgttcacctgaaccgtaacttcataacagtcctggcacaaagtcaccctgaaatggggctggtaacaacaccggtgagccctgcccccaccacacccgttacccctttaggcactactcctccatcttccgatgtaatctcaagtgtggagctgcctctggacgctgacgtccagacctccaatctcttgattactttcttaaaatactcctcgatcgtgatgcaggacaccaaggatgagcaccgcctgcacagcgggaaactgtgtttgattattctgacatgcatcgccgaagatcagtacgcaaacgcattccttcatgacgataacatgaacttccgggtcaacctgcaccggatgccaatgcgccatcgcaaaaaggccgccgacaagaacctgccttgccgccccctggtctgtgcagtactcgatcttatggtcgaatttattgtcacacatatgatgaaggagtttcctatggatctctacatccgatgtatccaggtcgtgcacaagctcctatgttaccagaaaaagtgtagagttaggctccactatacctggcgcgaactgtggagcgctttaatcaacctactcaagttccttatgagcaacgaaaccgtgcttctagccaagcataatatctttacattggcactcatgatcgttaatttgttcaacatgttcattacgtacggtgatacatttctgcccacaccctcatcatatgacgagctatactatgaaattatcagaatgcatcagagcttcgacaacctatactcaatggtgctgcgactttcaacgaacgctggacagtggaaagaggccgcctccaaagttacccacgccctcgttaacattcgggccatcatcaaccacttcaatcccaagatcgaatcctatgccgccgttaatcacattagtcagctgtccgaagaacaagtcctggaggtagtgcgggctaactatgatactctgacgcttaagttgcaggacgggttagaccagtacgagaggtattctgaacagcacaaggaggcagccttttttaaagagctggtgcggagcataagcacaaacgtccggcgcaatcttgcattccataccctgtctcaagaggttctgctcaaggagttttctacaataagctag

SEQ ID NO: 41080 - DNA, 285 bp, Artificial Sequence
  Description of Artificial Sequence: Synthetic coding sequence
agcgtggagctgcccctggacgccgacgtgcagaccagcaacctgttgattaccttcctgaagtactcatccatcgttatgcaggacactaaggacgagcacaggctccatagtggcaagctgtgcttgatcatactgacatgcatagcagagcccatgcgccatcgcaaaaaagcagctgacaaaaatctcccatgtcgaccactagtctgcgccgtccttgatttgatggtggagtttatcgtgactcacatgatgaaggaattccctatggatttgtactag

SEQ ID NO: 41081 - DNA, 240 bp, Artificial Sequence
  Description of Artificial Sequence: Synthetic coding sequence
atggagctggaggccatgagccggtacaccagccccgtgaaccccgccgtgttcccccatcttactgtagttttgcttgccattgggatgttcttcactgcgtggtttttcgtctacgaggtgacctccacaaagtacactagagatatctacaaggaactgctgatttctctagttgcctctttgttcatgggcttcggcgtgttgttccttctgctgtgggtgggtatttatgtatag

SEQ ID NO: 41082 - DNA, 240 bp, Artificial Sequence
  Description of Artificial Sequence: Synthetic coding sequence
atggagctggaggccatgagccggtacaccagccccgtgaaccccgccgtattcccacacctgaccgtggtccttctggccattggtatgttttttacagcctggtttttcgtttatgaggtcacctctacaaagtacacacgcgacatctacaaagagctgctgatctcacttgtcgcttccctgttcatgggatttggggtcttgtttttattgctgtgggtaggaatttacgtatag

SEQ ID NO: 41083 - DNA, 2349 bp, Artificial Sequence
  Description of Artificial Sequence: Synthetic coding sequence
atggccgccgccgccgccgccggccccagccccggcagcggccccggcgatagccctgaggggcccgagggagaggccccggaacggcgacgcaaggcgcatggtatgctcaagctgtactacgggctgtcagagggagaagccgccggtaggccagccggccctgacccacttgacccaactgatctcaacggggcacatttcgacccagaagtgtatctcgacaaactgaggcgcgaatgtccactggcccagctgatggacagcgagaccgatatggtgagacagattcgggccttggatagcgacatgcaaacactggtctatgaaaattacaataagtttatcagcgctacagacaccatacgaaagatgaagaacgacttccgaaagatggaggatgaaatggatcgccttgccacaaatatggccgttattaccgatttctcagctaggatttccgcaactctccaagacaggcatgagagaatcacaaagctggccggcgttcacgccttgttgcggaaactgcaatttcttttcgagctgccaagcagattgaccaagtgcgtagaactcggggcctatggccaggccgttcgctaccaagggcgggcgcaggctgtgctgcaacagtatcagcatctgcccagtttcagggcaattcaggacgattgccaggtgatcacagctaggctggctcagcagcttcggcagcgctttcgggagggaggcagcggagctcctgagcaggcagagtgcgtggagctccttctcgctcttggggagcctgccgaagaactgtgcgaggagttcctggcccacgcccgggggcggctggagaaggagcttcgtaatctggaagccgaactcggccccagcccaccagctccagacgtcttagagtttactgatcatgggggatcaggattcgtgggcggtctgtgtcaggttgctgccgcctaccaggagctttttgcagcccaggggccagccggcgctgagaaactggcagcatttgcccggcagctggggtctcgctatttcgccctcgtcgagcgcagattggcccaggagcaggggggcggagataattctctacttgtgagagccctcgacaggttccacaggcggctgcgggcccccggtgctcttctcgccgcagccggtctggctgacgcagccactgagatcgtagaaagagtcgctagggagagactaggtcatcatctccaggggctccgagctgcttttctagggtgcctgacagatgtcagacaagcattggctgcacctcgcgtggccggtaaggaaggccctgggcttgccgaacttctggcaaatgtcgccagcagcattctgtctcacattaaagctagcctggctgccgtgcacttattcaccgctaaggaagtgagttttagtaataaaccttacttccgcggcgagttttgtagccagggagtcagagaggggcttatcgtaggcttcgtccattccatgtgtcagaccgcccagtcgttctgtgattcaccaggagaaaaaggtggagccaccccccccgccttactgctgctgctgagtcgactctgcttagattatgaaaccgccacaatctcatacatcctgacactcactgacgagcaattcctggtccaagaccaatttccggttactccagtgagcacactatgcgcagaagcccgggagacggccaggaggctgctgactcactacgtcaaagttcaagggctggtgatctctcagatgctacggaaatctgtggagactcgggattggctcagcacgttggagcctcggaacgtgagagctgtcatgaaaagggtcgtagaagatacaactgctattgacgtccaggtcggcctgctgtatgaggaaggagtcaggaaagcccagtcttccgatagcagcaagagaacattctctgtgtactcttctagccgccagcagggcaggtatgcaccgtcctacacgccttccgcccccatggataccaacctgttatccaatattcagaagttgttttctgaaagaatcgacgtattctctcctgtcgaattcaacaaagtgtccgtgctgaccgggatcataaagataagccttaagactctccttgagtgtgtgaggttaaggacgttcggcaggtttggcctccaacaggtgcaagtagactgccactttctccagttgtacctctggcggtttgtcgccgatgaagaactcgtgcacctgctccttgatgaggtcgtcgcatccgccgcactgcgatgccctgaccccgtacccatggagcctagtgtggttgaggtgatttgtgagcgcgggtag

SEQ ID NO: 41084 - DNA, 594 bp, Artificial Sequence
  Description of Artificial Sequence: Synthetic coding sequence
atgagcgcccgggcccccaaggagctgcggctggccctgcccccctgcctcctgaaccgcacattcgcaagtcctaacgcctccggcagtggcaacactggtgcccggggtcctggcgccgtgggctcagggacctgcatcactcaggtgggacagcaactgttccagagcttttcgagcacgttagtactgatcgtgctggtcactcttatcttttgtctcatagtgctgtcactctctacattccacattcataagcggcgcatgaaaaagcgaaagatgcaaagggcccaggaggaatacgagagggaccattgctccggcagtagggggggcggaggtctgcctcggcccgggcgccaggccccaacacacgctaaggagactaggctggagaggcagcctcgggatagcccattttgtgccccatccaacgcttctagtctgagcagttccagcccgggactgccttgccagggaccctgcgcaccccctccgcctcctcccgcttctagcccccagggagcgcatgcagcctcaagttgtctggacaccgccggcgaaggactgctccaaacggtcgtactatcttag

SEQ ID NO: 41085 - DNA, 1131 bp, Artificial Sequence
  Description of Artificial Sequence: Synthetic coding sequence
atgggccaccagttcctgcggggcctgctgaccctgctgctgcccccgcctcccctttacaccaggcatcggatgttaggacctgagagtgtgccgccgcccaagcggtcccgcagcaaacttatggccccaccgcggatcggaacacacaacggcaccttccactgtgatgaggcccttgcttgcgccttgctccgattgttacccgagtatagggatgcagagatcgtgcggacacgggaccctgaaaagctcgccagttgcgacatcgtcgtggacgttggaggagaatatgaccccagaagacaccgctatgatcaccatcaaaggtcattcaccgagacaatgtctagcctatcaccggggaagccttggcaaacaaagctctccagtgctggcctgatctacctacattttggacacaaactgctcgcacaactgctcgggacctcagaagaggactccatggtcggtaccctctacgacaaaatgtacgagaactttgtggaagaagtcgatgctgtcgacaatgggatttcccagtgggccgaaggggaaccccggtacgccttaactacgacgctgtccgccagagttgcacgactcaacccaacgtggaatcatcctgaccaggataccgaggctgggtttaaaagggccatggacctggttcaggaagagtttttacaacgactcgacttctaccagcatagttggctaccagctagagccctcgtcgaggaagccttggctcagaggttccaagtggacccgagcggtgaaatcgtggaacttgctaaaggtgcttgtccctggaaagagcacctctaccacctggaatctggactgtcacctccagtcgctattttcttcgtgatttacacggaccaggcaggacagtggcgaattcagtgtgtcccaaaggagcctcactcatttcagtcaagattaccgctccctgagccatggcggggtctccgcgatgaagccttggatcaggtatcgggcatcccaggctgcatttttgtccacgcgagtggatttactggcggacaccacacgcgagagggcgccttatccatggctcgggcaactctcgcccagagaagttatttgccccagatctcatag

SEQ ID NO: 41086 - DNA, 978 bp, Artificial Sequence
  Description of Artificial Sequence: Synthetic coding sequence
atgggccaccagttcctgcggggcctgctgaccctgctgctgccccctcctccactctacacccgacatagaatgctcggacctgagagtgtccccccccccaagcgatcccgttccaaactgatggccccacctaggatcgggacccacaatggcacctttcactgcgatgaggctcttgcttgcgcccttttacggctgctgcccgaataccgggacgctgagatagtccggactcgggatcccgaaaagctagccagctgtgacatagtggtggatgtgggtggggaatatgatcctcggcgacaccggtatgatcaccatcagcggtcattcactgagaccatgagctcactcagtcccgggaagccttggcagactaaactgtcttctgccggcctgatctaccttcattttggccataaactcctggctcaactgctaggaaccagtgaagaagactctatggtgggaaccctgtacgacaaggctgggtttaagcgcgccatggatcttgtgcaggaagaattcctgcagcgactggatttttatcagcacagttggctgcccgcacgagctttggtggaggaggccttagcccagcggtttcaagtagacccctccggagagatagtggaattggccaaaggcgcctgcccttggaaggagcatctttaccatttagagtccggcctgtctcctcccgttgccatttttttcgtaatttatacagaccaggctggccagtggcggattcagtgcgtgcccaaagaaccccattctttccagtcaagattaccgctgcctgagccgtggagggggctgcgcgacgaggctctggatcaggtctctgggataccaggttgcatattcgtccatgcctccggcttcaccggggggcaccacacacgagaaggcgccctgagcatggctcgagccacccttgcgcagagatcatacctcccgcagatatcctag

SEQ ID NO: 41087 - DNA, 351 bp, Artificial Sequence
  Description of Artificial Sequence: Synthetic coding sequence
atgaaccagaccgacaagaaccagcaggagatccccagctacctgaatgatgagccaccagaagggagtatgaaagatcacccacaacagcagcccggaatgctgagccgcgtgaccggcggaattttttcagtaaccaaaggagccgtgggagcaaccataggcggggtcgcctggatcggtggaaagtcactagaggtcacaaaaacagccgtgactaccgtgcctagcatggggattgggctggtgaagggaggcgtgtcagccgtcgcaggcggggtgactgctgtgggctccgccgtggtgaataaagttcccttgactggcaaaaaaaaggataagtctgattag

SEQ ID NO: 41088 - DNA, 351 bp, Artificial Sequence
  Description of Artificial Sequence: Synthetic coding sequence
atgaaccagaccgacaagaaccagcaggagatccccagctacctgaatgacgagcctccagaggggagtatgaaggatcacccacagcaacaacctgggatgctgtcacgagtgacagggggaatcttcagtgtgacaaagggggccgttggggcaacgattgggggtgtggcatggattggaggcaagtcactggaggtcaccaaaaccgccgtgactaccgtcccgagtatgggaattggactggtaaaggggggcgtgtcagcagtcgccggcggcgttacagccgtaggctctgccgtggtgaataaagtgccactcaccggtaagaagaaagataaatccgactag

SEQ ID NO: 41089 - DNA, 351 bp, Artificial Sequence
  Description of Artificial Sequence: Synthetic coding sequence
atgaaccagaccgacaagaaccagcaggagatccccagctacctgaatgatgagcctccagagggatcgatgaaggatcatcctcaacaacagcccggcatgttgagtcgcgtcaccggaggcatcttttccgttaccaagggggccgtgggcgccacaattgggggcgtggcctggatcggtggcaaatcactagaggtgacaaagaccgccgtgacaacggtgccatctatggggatcggcctggtgaagggaggggtgtcagcagtcgctggaggtgtgaccgcagtgggttcagctgtcgtgaacaaagtacctcttaccggaaagaaaaaagacaagtcagactag

SEQ ID NO: 41090 - DNA, 351 bp, Artificial Sequence
  Description of Artificial Sequence: Synthetic coding sequence
atgaaccagaccgacaagaaccagcaggagatccccagctacctgaatgacgagccacccgaaggttctatgaaagatcacccacagcagcagcctggcatgttatcgcgagtgactggaggtatctttagcgttaccaagggcgccgtcggggcaacaatcggcggagtcgcctggataggggggaaaagtctggaggtcaccaagaccgccgtgactacagttcctagcatgggtataggtctggtgaaagggggggtaagcgctgtagcaggaggggtcacagcagtgggaagtgcggtggtgaataaagtccccctgacaggcaagaagaaagataagtcagactag

SEQ ID NO: 41091 - DNA, 351 bp, Artificial Sequence
  Description of Artificial Sequence: Synthetic coding sequence
atgaaccagaccgacaagaaccagcaggagatccccagctacctgaatgacgagccacccgaggggtccatgaaagaccatcctcagcaacagcccgggatgctttcccgcgtgacaggggggatttttagcgtcaccaagggcgctgtgggggccacaatcggaggtgtcgcatggatcggcggaaagtccttggaggttaccaagactgccgtcaccaccgtgcccagtatggggatcggactggtcaaaggtggggtgagtgccgttgcggggggggtgacggcggttgggtcagcagtggtcaacaaggtgccactgacgggaaaaaagaaggataagtccgattag

SEQ ID NO: 41092 - DNA, 351 bp, Artificial Sequence
  Description of Artificial Sequence: Synthetic coding sequence
atgaaccagaccgacaagaaccagcaggagatccccagctacctgaatgatgaacccccggaggggtcaatgaaggaccatccacaacagcagcccggtatgctttcgagagtgactggcgggatattcagtgttactaagggggcagtgggtgccacgatcggaggcgttgcttggatcggcggtaagagtctggaggtaacaaagaccgcagtgaccactgtaccttcaatgggaattggactcgtcaagggcggcgtctctgcagtggccggtggggttaccgccgtgggcagcgccgttgtgaacaaagtcccccttacgggcaaaaagaaggataagagtgactag

SEQ ID NO: 41093 - DNA, 12741 bp, Artificial Sequence
  Description of Artificial Sequence: Synthetic coding sequence
atgggcctgctgctggtgttccccctgatccagagccagagccggaccgacccttcattatgcaatatcaccgccgaggtgttgctgaactgtctgcgtgactgtcaacccctgagtttaaccaaggagccagccgattgccttaatggtatagaaaccctcctgtgttcatggttagaggaaacaagcgataccggcagacatatcccacacaaacagaaggaaaacgcagcggccgcactcgtggccctcgcatgtgccagagggagtttgaagaccttcgtgcacacagtgcacctgctacaaaagcaaacggacctcggtagcctccctgtagccgacgtcctgtatcgcctgctcctgttggagggtgggcctggctctccgagctgcctactcggaggaaaacacattgtcagctggggctacgaagacatgctccctgctcccgactctaataccgggagttcctccgagaataaggacgcagacctggggcggtgcctgactgccgacggtctctatctgtacaccaccaacagcgtcggccgcggggtgtcgaagcttggcagcggcctgcacggaacgttgaggggattcgtttattgcagaaacgaagagctggaacccggttgggtcgcttttggttccggcagtctcctccacagacctgtgtccttcgataacaagccccacagtctgttccaggtgatcgaccagaatactctacaagtctgccaggtcgtgcctatgccggccaaccacctgcctattggcagtacgatgtccacggttcatttgagttctgacggtacctacttctactggatctggagtccagcatccctaaatgagaaaacccccaagggccacagtgtctttatggatatatttgagctcgttgtggagaacggggtgtttgtggccaatcctcttcaggagcggaccattttgatgcgcaaagaaggtgaatctgccaaaagcattaacgagatgctgctgagcaggctcagccgatacagggctagcccatccgcgacgctcgcagccctgactggatcaactatttctaatacactaaaggaagaccaggcggcaaacacatcttgcggcttacccctgaagatgctacggaaaactccaatctatacttgtggcacatatcttgtgatgctcgtcccacccccaggcggcagtgggagtagtgccacaaggtcacttttcggggggacatctgggttatcctcacttaagagggcctgttatgatacggtgaacaacatgctttggacgtgcagtaacgattatatcgaccagtggtgcaatccaggcaaccaggccttccactacgtgtgccagcgcctaggggttagccacattataaccgagcccaaggaagaagcaatcactacgaatgaagtcattaaccagctgctccaccacgtcggagcaatgtgtattcaccagctcaatttgctcgccacaaatcccaatctacccatcacttctgtgctcggtaagcagcatccaatcgaggctcaccacctgtccagtatctgtgatatcatggaaaaagctatggtaaacggcgatacatgcatcattaggtgcatcttagtggtgtttcaggtggtgtttaagtttttcttttcccctcagaccgagcgaaatcgcgatatcattcgacgctcaggcctgttgctttggcagcttcttatggccccaaaggaccagatctgccccgaaatacagaaggaggtatgcctggccatctcctctgggctgaatatactttacccaggagagaccgagatcaacaacttacttaagttggtcctgaccgaaggcgagcgcaattctgggctcagccagctgagagatgtcatactgactaaccttgctgagcagctccagaacaatcgttttgggtctgatgaggatgaccattaccgactgaacgatgaactacttcattatatcctgaaaatcgttgtgcgagagagttgtatccttatcaccaaatgtcagactgtgtccaaggatgacttccagaagctcctgtcgacggtgcctgctgcctccagctgtctcagatatcttatggcggtccaaaatcatctcctctctaacaccattctcatcaagcctgatgaaaacgatgactctgatagtagtttgcagggggagactcttaaagtacaggagctgaaagtgtcgattttggctttagccacccagatactgacaggttgcgatgaagttctggagatgctgcagcaggttaccaccgctctaatcaactccgacatcgctgacagggaacagcgattgaagggcctcgagcaggtcacgaaggctactatgctgggccaccttctccctgtgctcttgacctccttgatgcatccaaatctccaaactctgataatggcggacgcactaatgccccagctggtccagctggtgctgtacacctcccaaacagcgctgttacttaaaacgcagtgtcccgtgttcgccgaagtgggctgctccccttgcggcgctcctgatcagaagtgtcggctgttcccagacgaacggatgctagaggagaaggaagagcccggattcctgactggtctgaagatccctgccccctgggctgccggaaagacagttgaaacagttcaccctgtgcgtgacaattataagttcaaggagaccgtacatatcccaggtgcccggtgtctctatctgaggttcgactcgcggtgttcaagccagtatgattacgacaaactggtgatttacgcaggccccaatactaactcccgcaaggtagctgagtacggtgggaatactctaggctacgggtcccggtccgtgctgggaactggctggcctaaggatttagtgaaatgtatcagccctccctcactaaactttaaagtggagggcgataccgtgacattttcgttcgaaatgcgttccggtcgtgagcataacactcccgataaggcgatgtggggattcgcttgcacagtccgcgcacaggaatccagcgaagacgtcagcggcggcctcccattcctggtggatctggctttgggcctaagcgtgctggcatgctcaatgcttcggatcttgtataatggacccgagattaccaaggaggaagaagcgtgccaggaactgctcaggtctaagctcttgcagcgatgtcagtggcaggtagaggcaaatggcgtgatcagtcctgcacttacaccctcaccaagccccctccctcttactatcgaggaggatagggaatttacatacccgtctgatgtgcttgtgcccccggtaggcaactactttgatctccccagaatacgtctgcctccgggcattatgataaagcttcgcgagatctcgggacgcgcacgcccccagtttcggccaagcataaaggaggtgatccagccagatgtaatggaggagatggtagttagttgcgtgataaaacatctgaatctcgttgatgccctgcagtccctgatcaactttcagtatcaggaagagcatgccgaagagtacgatctcctatgcaagataatgggcgaaaccttcaagaaactgaatgctatggagcgacaactgcagtccgtcgcagaactcgaacagaagtggcaatccgaggtcgacgacgctatgcaggggaaactggagaataatatgccttttttttatgactaccacttcaatgaaaacaaaatgaaggagctcgagctactgtgttccatgaaggaagtatcttttgacggcaacgatcttgagaatatggttctgtcactcagggaaaagtttttgcaagaagtcaacagccttattcaaaaaccctcccatccactcgcaaagaccaagactctcgtcaagtccttaatgaatcgcgctgaactgcttcttcatgttactatcgcagcccaaagcggcttgaccagaagtatatcagggacccctgcagaaacacctgcctgtaaatctgctagtgaaacaaaggtcatatcacatgcagtccgtcagcctgttttccttcgttctatgtccgctcccagcgacctggagatgatcggaaatgaggatctcgagtttacccgcgcaaatcagcgtcgcagacatgttaccagccacagaagctctagctttactcttctccagtcactagcaattgaagacagtcgggataaacccacatatagcgttctgctgggccaactgttcgccttcattggcacgaacccagatcaggcagtgtcctctagcagtttccttctggctgcccaaactcgctggcgccggggaaatacgagaaaacaggcacttgtgcacatgcgggagttactcactgccgcagttcgggtcggaggggtgacgcatcttgttggacctgtgactatggtccttcaaggtggcccacggatagaagagcttacctgcggaggaatggtggagcaagtccaggaggcatttggcgaaaccatgacctctgtagtgagtctttgcgcaagatacccaatcgcatgcgcgaatagtataggattactctgcacgatcccatatactagaagcgaggagaaatgtctcgttaggtcggggttagttcaacttatggacaggctgtgttctctgtctaatcagacagagagttcatcttccgaaaaacagaccaagaagcagaaggtggctaccatggcctgggctgcttttcaggtgttagctaataggtgtgtcgagtgggagaaagaagagggcggctcaactgaagccgtgcattctggattggccaggcaggtctcctcactgctgaccaatcatttagcccgggcgactgagtgctgcggcaaccaggctgccggcaatgacgcgctccaagatgtgctgagtttgcttaacgatttatctaggtcccacatcggtaaggcgatactgtctcagcccgcctgcgtaagcaaattacttagcctgctgttagaccagaggccctctccgaagctggttttaattatcctccagttatgccgggctgcactaccactgatgagcgtcgaggattgtggcaatgtggagctgcctccttggtcctactctgtcccgtctctcaattcggagcaggaggacccctccgaccccgcgtccaagatcgcttccttgctccttgcaaagctggctgattacgtggtccctgggtgccagaccgtgttgagtcccaccgcaagcgagcctgatacaactctcaccaaaactagccccaagaattcactgaagggggacaaagatccaggcgaagaatctgaggctgtagacggtaagctgagcatcttcattcataaaagagaggaccagagctcccatgaagtgctccagccattgctgagcagcagcgaaggacgacccttcagactgggcaccggagctaacatggagaaagtggtgaaaatggaccgagatatgacaaagggcggctgttgcgaggtcatcacagaggaggctgccgccgccctgcgaaaggctaccaagtgggcgcagtcggggctgatagtgtctattggcccaccagtggagagtatcaatcctgaaacggtgagtggactgtctaccggagacaaaaaaaaaactgcccagacctccatctgcagggagcgaaactctgagctggcacgtaccgaccccgtgcgaccattcatctctggtcatgtcgcaaattccatggcggccgaggtaattgccctgttacactctttactgatggcgcctgagagtaacgccgctcagatctggacaacgactgcagagaaagtactgagcagagctctcatgtacatcccacagttgggcaagtatgccgagagtatcctcgagaatggcagcagttccggcaggaagttggcaaaattgcagcgaatcgctcgccaggccgttgcagcgctgtgtgcactcgggggctttaaagagacaatcaagatcgggagcgaagtgcaggtgctcggtagaggtatctcgggaagtataggggtcgtcgctagcattaacgaacaggaaggaatagctaccgtgcgcttccctcctattgactgcaggaagacttcacaagcgtcagatacactcaccataccgctgtcccggctttgtgtgccccggtccgaggctctgcctcttcacaaactcagcatcaccgagaaagttgtgcaggcagtgcaatcgatgctattgcctcaggaagggtccctctctatccacacttccctccctgcaaccggcgatgggtcggcaccagtgatggccgtggtacgtcttctggctgaaatcagaactagggcatgtctggttatggcccagctgcttgaagattctctcttttgcgaggagtttattcagcagtgccctgcagcagtcgaggttctgaacctggtggcgcaggaatgctcggctggagagcgtctggcggttgtcgaagtgcagtgcgaaaggctgagaatgttataccgcgactgtgcacggccgccaccccctcccttgcaggcagatcggcgccagcccaaagaaattacctggtctccgagcagagtgtttccaccagtcagggcttgtatgttcagcagccatctcacgtctgtgacatttctggcggacccctcagccgggggcggtcttcctagaggaacttttatttatgcaaccagcccgctgcccgtacaagcaccatctttctactgggagattgaaattgtatcttatggggatacggacgatgatactggaccgatagtgagctttggcttcaccacagaggcggaaaagagagacggcgcatggacgaaccctgtcggtacttgcctcttccacaacaatggaagagccgtccactacaatgggtcaagtctgctccagtggaaatccgtgaggcttgatgtcacactcagcccgggagacgttgctgggatcggctgggagcgcacagagggaactcccccacccccgggccagcccgcaaaggggagagtttatttcacctattgtgggcagcgcttgtccccttacctggaagatgttagcggcggtatgtggcccgttgtgcacattcagaagaaaaacactaagacacgggccaactttggctcacgcccattcgcctatgccgagggacaggcccacaggaacgcggcagacttatgtaccgacctggccgaagaaatatctgctaacttcgaggccctgcctttcgctatggcctccgattctgataacgacgcaggaactagtatcgcgagcgaccccgggactcatggccccccttgtcgcattgctgccgtcgcgacagcacagcaacagtatgactccgataccagctgccactacaaggtggagctttcatacgaaaacttcattacctcaggccccgacccccatccgccgcctatcgccgatgacgagtccgatgacgacgacgacgacgatatccctcaggaagaccactacgccctgctagtgaaggcatgggagacaaaagtgttccctacaatccggagacgctttcggaatgaagcagagagaaagtcgggactggatcagatcaaaggcgcgctgcaattaggtatggtcgacattgcccgacagaccgtggagtttctgtatgaagaaaatggcggaatacctcgcgatctgtacctgcctaccattgaggatatcaaggacgaggccaataaattcactatcgataaggtgcggaaagggctcacagtggtgacccgcagtccagattctaacaacgtcgcctcctctgctgtgggcaccgcgctgccgaaatttgccatcagaggaatgcttaagaccttcggactgcacggagtagtgcttgacgtggacagcgtcaacgagctggtgcaggtggagacatacttacgctccgaaggcgttctcgtgcgatattggtatcccattgacatgctggagcgacccccggcaggctaccggaggacagctacaaacgggttagtcactctggataacactaacctccagatacaccgcgaactattgagatgcgaagcggctctggcgaggttgtattgtcgcatggcgctgttgaatatctttgctcccaagctgcctcatttgtttactagattgtttcatatccccgcgatccgggacattactctggagcatttacagctcctcagtaaccagctcttggctccaccactccctgatggcactattagtagtagttcaatcctactcgcccaaagcctccagcactgtatccactcccagaactgctcagccacagaccttttttatcagggaaattcccagaccgtgcgcgaatggctgaacgtagcaatcacacgtacactccatcagggagaggagagcttgctggagctgacaaagcagatttgctccttcttgcagactgctccggagcagtttcccagtgaggagtttcctatctctgaatctaaggttaacatggatgtgaactttccaggagccgcattcgttgtggtctcctgtaaggagtctcagagtggctttcgcaaggactcttccctatataaggcaccttgggctcgtgttctcgtctacggtctggggcacaaagtaaaaaggaacggccagctcaacctgatcgaagccgcgtgctatcctagggatgcatctccggccaataccggactggccccccctccgaccgccgaccaatacccgtcagtggtgttgtccaccgatcgggtgcatattaagctcggagtcagtccgccgccaggcgccgttctggttctgcacagcctgcctctggagtttccgctcgccatggcctttgctgagcagttgctttcgtggaaatcagaggactccgagggaaagtcagaggacgagccagatacaattccaacatctgtgctgttacaagttgtggaactgctcgggaacttcctctggactaccgacatggccgcctgcgtgaaagagttggttttccaccttcttgccgagctcttacggaccgtccatacattggaacagcgccgccatcccgccgggttaagctcaagtattgccctgcagctgaatccatgcctggctatgctgatggcacttcaatcggaactccacaaactgtacgacgaggaaacacaaaattgggtttccggtggcgcgtgcggcggtagcggcggggcggccgcaggtgatcaagggcggtttagcacctactttcatgcccttatggaaggttgcttggccgttgccgaggtgacactccctacaaatatgtccgtgactgcctcaggcgtaacgtcggctaccgccccaaacttgagcgactcctcatcttcatcttcttcgtcgccaggacagaccccacagagccctagcctcttatctaagcgtaaaaaggtgaaaatgaaacgagaaaaggcttcttcctcaggaaaacgtcagagctctcgcacggtggatagcgatcctaccgtgctgtctatcgggggtagtaaacccgaagacatgctgtggttccatcgggctctcactctcctgatcattctgaggcacttgacaagaaaggacccgcagggactaggcgtgaccagcgatgccatcgctgacgcttgtcaggccttggtgggccccactgcccattcccggcttctggtcatcagcgggatccctacccatcttgacgagggcgtggtgagaggagccatcaggaaggcatgcaatgcacacggtggtgtctttaaggatgagatttatattccattgcaggaggaagacaccaagaaacctaaagacaaagctgagggcggcgacggcaaggtagagccagagaaaaccttggccttccctggaaccgacagcatggaggtttcaaccagttcatccctgaccccagcaatgtctatctctgcctcagcttccacgagccaggccagtatctgtagcagtcaaggaatctctcaaaccgtgtccgacttgtcggtggaccctttgccagcagggcttgagctgccgatcccacctggactcctggaaccacatgccgtatctagtcaagaaagcttggatatctctctgtgttctactggctctctgggctcacttgggtcactgggcgaacctctggacaatgcagagacggcatcagtctcggacatgggatcaatgtacactgttacatccctggacaatcagccccttgccgcacggcctatcaaggggttcgccgttgtggagattagatcgcgtgctaagatcgagaagatccgagcgtcattatttaacaataacgacctgataggactgtcctccctggacggcgaagacgagctcatggagatgtctactgaggaaattcttaccgtatctgtggtgaaccagagtttgttcgacacgcaagggagccctggtcttgaggactattttaacgacaaatcaatcaagggagaaaaacttgttccaggtgctcgcgaagttcttaccgagatcttcaaatcctgtgcccacagcgaacagacgctgagtctgactcccgccaagcccattagggtgtctgacatctacttaagcaaggagcaaatcaactcccagacccctgggaatctgctgcatctgttcttcacaaatgttagacctccaaagaaagttcttgaagatcagctcacacagattttgcgaaaatatggcgtgcccaagccgaagttcgataaatctaaatattccaaggcaggtaaggagcaacaccctgtaaaagtcgtctccacaaagcgccctattacaaagccacctgcaaaagataaagccgtgctcaactcagtcagccggactgctctttccgaaaagaaacctactgtgaagcctaaatctcccgagaaaagcaaacccgacgagaaggatcctgaaaagagccctactaagaaacaggaggtgccagaagaaaagtatctaaccctagagggattccacaagtttgtcatcgaccgcgcccgtcaggatataaggtcagtgtggagagcaatcctgtcttgcggctatgatctgcatttcgaacggtgcgcatgcatcgacgtacggcatgctcaaaaggcatcccgaaaatggactctggaaatggacgtggccctcgtccagtacatcaatcagctgtgccgccacttggcaataactcctgcacgtctgcaccctcacgaggtgtacctcgatccagcagacgctgctgacccccgcgtcgcctgtctgctgaacgtgccaatcgaatccctccgcctccgcttcgctctgctgcagagcctgaacaccaccttggaaacattcttcttgcctctcgtagagcttcgccagacccccatgtacactcattctatcgcagccctgctgaaggaagcaaaaggcttgatattttatgatacaaaagtgacagtgatgaatcgcgtcctgaatgccaccgtgcagagaactgcggaccacgccgcccccgagatcacacttgaccccctagagatcgttggaggggagattcgcgcgtcagagaacagctacttttgtcaggccgcccggcagttagcctctgttccaagttcacagctatgcgtcaaattggcttctgggggcgatccaacctatgctttcaatatccgttttacaggcgaggaggtacatggaacttccggcagcttcaggcacttcctttggcaggtgtgtaaagaactgcagagtagtagcctgtcgctgttactgctttgccccagctcggccgtgaataagaacaaagggaaatatatcctgacccccagtcctatcacctatggagaggagcagcttctccatttcctgggacaattactgggcattgctatccgcgcagacgtacccctgcccctggacttgctgccctccttttggaaaactctagtcggcgagcccctggaccccgagcaggacctgcaggaagcggacatcctgacatacaattatgtgaaaaagttcgaatccataaacgacgagactgagctcgaagccctgtgtgccgagattgcgagccagcacttggcaacggagtcccctgatagcccaaacaagccttgctgccggttcacttacctgactatgaccggtgaggaggtagagctctgttccaggggtcgtcacatcttggttgcctgggagaataaggacatttatgccgccgccatacggagtctccgcctgcgcgaacttcagaacgtggagtgcgttacagctgtgcgcgctggccttggcagcattatccctctgcagctcctgaccatgctgagtccgcttgaaatggaactgaggacatgcggtttgccatatattaacttagagttcctgaaggcacataccatgtatcaagtggggttgatggagacagaccagcatatcgagtttttctggggtgctctggagatgttcacccaagaggaactgtgcaagttcataaagtttgcttgtaaccaggaacggattcctttcacttgtccatgcaaagatggagggcctgataccgcccatgttcccccctaccctatgaagatcgcacctcctgacggaaccgctggcagccccgattctagatatattcgggttgagacttgtatgttcatgatcaaactcccccaatattcgtcactggagatcatgctggaaaagttgcgatgcgctatacattacagagaggacccactatccggctag

SEQ ID NO: 41094 - DNA, 11991 bp, Artificial Sequence
  Description of Artificial Sequence: Synthetic coding sequence
atgcccgccaaccacctgcccatcggcagcaccatgagcaccgtgcacttatctagcgacggcacttacttctattggatttggtctcctgcgtccctgaacgaaaaaacccccaaaggtcactccgtgttcatggatatttttgagttagtggttgaaaacggtgtattcgtggctaaccccctccaggaacgaactatcctaatgcgtaaggaaggagagtccgctaagagcatcaatgagatgctcctcagtcgtttatcccggtaccgtgcaagcccaagcgcaaccttggccgcgctgactggctccactatctcaaatacgctgaaggaggaccaagccgcgaatacaagttgtggcctacccctaaaaatgctgagaaagacgcccatctacacctgcggaacatatctggtgatgctcgtgccaccacccggagggtctggcagtagtgccacccgaagcctatttggaggcacctcaggcctgtcgagtttgaaacgcgcctgctacgacacagtgaacaacatgctttggacttgctcaaacgactacatcgaccagtggtgcaaccctggtaatcaggctttccactatgtctgtcaaaggcttggggtgtcacacattattactgaacccaaagaggaggccatcaccaccaatgaagtgatcaatcagctgctgcaccacgtaggagccatgtgcattcatcagctgaatttgctggctacaaaccctaacctccctattacctcagtactgggcaagcagcaccccatcgaggctcatcacctgagctccatctgcgacataatggaaaaggccatggtgaacggagatacgtgtatcataagatgtattttagtcgtatttcaggtagtgttcaagtttttcttcagtccacaaactgagaggaatcgcgacatcatacgaagatctggactgttgctctggcagcttctgatggccccaaaagatcagatttgtcccgaaatccagaaggaggtgtgcctggccatcagtagcggactgaacattctgtaccccggtgagacagaaataaacaatctgcttaagctcgtgctgacagaaggtgagcgcaatagtggcctatcccagctacgggatgtcattttaactaacctggccgagcagctgcagaacaaccggtttggatctgacgaggacgaccactaccggctgaacgacgagctgttgcactacatcctcaaaattgttgtgagagagagttgcatcctgatcactaagtgccagaccgtgagcaaggacgattttcaaaagcttctcagtaccgtcccagctgccagtagctgtctgcgttacctgatggcggtgcaaaatcatttgttaagcaacaccatcttaattaaaccagacgaaaatgatgacagtgacagctcactccagggggagacactgaaagtgcaggagttaaaggtcagcatactggcactggctacgcagatcctcactgggtgcgacgaagtgttggagatgcttcagcaggtgaccacagcgctgattaattcagacatcgcagatcgagaacagcgccttaaagggctggaacaggtgactaaggcaacaatgcttgggcacttgctgccggtgctgttgaccagcttgatgcatcccaatctgcagactctgattatggctgacgctcttatgccccagttagtgcagctggtcctgtacacatcccagaccgcactgctcctcaaaacccagtgcccagttttcgccgaagtcgggtgttcaccctgtggagcgccagaccaaaaatgccggctcttccccgacgaaagaatgcttgaagaaaaagaagagccggggttcctcaccggactgaagatccctgccccatgggccgctgggaaaacggtggagaccgttcacccggtgcgtgataattataaattcaaggagacggtacacattccgggcgctcggtgcttgtatttgcgcttcgatagccgctgttccagccagtacgattatgataagttggtgatctatgccgggcctaatacaaacagtcgcaaagttgccgagtacggcggcaatacgcttggttacggctccaggagcgtcctggggacggggtggccaaaggacctggtgaagtgcattagcccaccatctctgaactttaaggtggagggagatactgtgacattttctttcgagatgcgtagcggacgggagcataacacccccgataaagcgatgtgggggtttgcttgcaccgtgcgcgcgcaggaaagctcagaggacgtgagtggcggactgccttttttagtggacctggcactggggctgtctgtgctcgcctgctccatgttgcgcattttgtacaatggtcccgaaataaccaaagaggaggaggcgtgtcaagagctcctgcggtccaaactgctccagaggtgccagtggcaggtggaggctaatggcgtcatctcccccgccctgactccaagcccatcacctttacctctcacaattgaagaagaccgggagttcacatatccatcagatgtactggtcccccccgtgggcaattattttgacctgcccaggataagactccccccaggcatcatgatcaaactccgagagattagcgggcgcgccaggcctcagtttcggccgtcaattaaagaggtcatccagccagacgttatggaggaaatggtggtgtcatgtgtgataaaacatttaaacctggtggacgctctacaatctctcattaacttccaataccaggaggagcacgctgaagaatatgacctgctgtgcaagattatgggtgaaaccttcaagaaattgaacgccatggaaagacagctgcagtcagtcgccgagttagagcagaagtggcagtccgaagtggacgacgccatgcaagggaaactggaaaataatatgccctttttctatgattaccatttcaacgagaacaagatgaaagaactggaactgttatgttcgatgaaagaagttagttttgatgggaatgacttagaaaacatggttctttccctgcgggaaaaattcctgcaggaagtaaactccctcattcaaaaaccaagccaccctcttgcaaaaaccaagacccttgtcaagagtctgatgaatcgggctgagctgctcctgcacgttacgatcgcagcccagtcaggattaactcgcagcataagcggcacacccgcagagacacctgcgtgtaaatccgccagtgagactaaagtgatcagccatgcggtgcgccagcccgtgttccttaggagtatgagcgctccatcagacttagagatgatcgggaatgaagacctagagttcacccgggccaatcagaggcggaggcacgtcacttcccaccgctcttcctccttcacactcctacaaagtctggcaattgaagatagcagggataagccaacctactccgtactgctgggtcagttatttgccttcatcgggactaatcccgatcaagctgtgagctctagttcattcctgctcgcagcacagacgcgatggcggcgcggcaatacaaggaagcaggcccttgttcatatgagggaactcctgactgcagccgtgagagtggggggggtaacacacctcgttgggccggtaacaatggtgctgcaggggggacctagaatcgaggagctgacctgcgggggaatggtagaacaagttcaggaggccttcggcgaaacaatgacatcagtcgtttccctctgcgcacgataccctatcgcatgcgccaacagtatcggactgctgtgcactataccgtatacccgttctgaggaaaaatgtctcgttagaagcggacttgtgcagctgatggacaggctgtgtagcctgtcaaaccagactgagtccagttccagtgagaagcaaactaaaaaacaaaaggtggccaccatggcttgggcagcctttcaggtactggctaaccggtgcgtggagtgggagaaagaagagggcggaagcacagaggccgtacacagcggcctggcgcgccaggtgagcagcttactgactaatcacctcgcccgcgcaacggagtgttgtggcaaccaggcagcaggcaacgatgccctgcaggatgtgctgtctttgctgaatgatctctctcggtcgcatatcggtaaagcaattctcagccagcccgcatgtgtgagtaaattgctttcactgctcctcgatcagaggccatcccctaagctggtgctgattatcctgcagctgtgcagggccgcactccctctgatgtccgtggaggactgtggaaatgtggagctgcctccttggtcttattcagtgccgtccctgaactccgagcaagaagacccttccgaccctgcatccaaaatcgcaagtctgctcctggccaaactggctgactacgtcgtgccaggatgtcagaccgttctgtcccccactgctagtgaaccagatactaccttgaccaagactagtccaaagaacagcttgaagggcgacaaggaccccggcgaggaatctgaggctgtggacgggaagttatctattttcattcacaaaagagaagatcagtcttcacatgaggtactgcagccccttctgtcctcatcagagggccggccattccggctcgggactggagccaatatggagaaagtcgttaagatggatcgcgatatgaccaaaggcggatgctgtgaggtcatcaccgaagaggctgccgcggcattgcggaaggcaaccaagtgggctcaatccgggctgatcgtgagcattggaccacctgtggagtccattaatccagagaccgtgagcggcctgtctaccggagataaaaaaaagacagctcaaacaagcatatgtagagaacggaacagcgagctggctaggacagaccccgtgcggccctttatctctggccacgtggcaaacagcatggctgccgaagtcatcgccctgctgcatagcctgctaatggctcctgaatctaacgctgctcagatctggaccacgaccgcagaaaaagtcttgtcaagggccctgatgtacatcccccagttaggaaagtatgcggagagtatactagaaaacggctccagctccggccgtaagcttgcaaagctgcagaggatcgcccgacaagctgtcgctgccctttgcgcactcggggggtttaaagaaacaattaagataggaagcgaagtgcaggtgttggggcggggtatctctgggagcattggtgtggtcgctagtataaacgagcaggagggcatcgctactgtgcgcttcccccctattgactgccggaagacttctcaggccagcgatactctgaccatccctttaagcagactttgcgttccgcggagcgaagctttgcccttgcataagctcagcatcaccgagaaagtcgtgcaggcggttcagtcaatgctgttgccccaggagggaagtctgagtattcatacctccctgccggcaaccggcgacgggtctgcccctgttatggccgtggttcgccttctagccgaaattcgcacccgggcatgtctggtaatggcccagctacttgaagactccttattctgcgaagagtttattcaacaatgcccagctgccgtggaggtgttgaacttggtggcccaggaatgttctgccggcgaaagactggccgtggttgaagtgcagtgcgaaagattgcggatgctctacagagactgcgcgcgaccaccaccaccccccctgcaggccgaccggcggcagccaaaggagattacctggagtccatcacgcgtgttccctccagtgcgggcttgcatgttcagcagccatctgacatctgttacgttcctggccgatccatcggccggaggagggcttccacggggaacatttatctacgctacatcccctcttccggtccaggcccctagcttctattgggagatcgagatcgtgtcctacggggatactgacgatgataccggacccatcgtgagttttggctttacgactgaggctgagaagagagatggagcctggacaaatccagtgggcacgtgcctcttccacaacaatggcagagcagtgcactacaacggctcatctctgctccagtggaagtctgtgcggctggacgttacactatcccctggagacgtggcagggatcggctgggaacggaccgagggcactcctccccctccagggcagcctgccaaaggtcgcgtatattttacttattgtggacagcgcctctccccttacctcgaagatgtgagcggggggatgtggcctgtagtccacatccagaaaaagaacaccaagactagagccaattttgggtcaagacccttcgcatatgctgaaggtcaagcgcatcggaatgctgccgacttgtgcacggatctggctgaggaaatctctgcaaatttcgaagcccttccattcgccatggcatctgacagtgataatgatgccgggaccagcattgcctctgatcctggtacgcacgggccaccatgtaggatagcagcagtggctacggctcagcagcagtatgatagtgatacctcctgccattataaggtagagctgtcctacgagaatttcattaccagcggcccagacccccacccgcctccaattgcggacgatgagtccgatgatgacgatgatgacgatatcccacaagaggatcattatgccctgctcgttaaggcttgggaaaccaaggtgttccctaccattcgacgccgatttcggaatgaagccgaaagaaagagtggtttggatcagataaagggcgctctgcagctgggcatggtggatatcgcacgtcagactgttgagtttttatacgaagaaaatggcgggatccctagggatctgtacttacccacaattgaggatatcaaggacgaggcgaacaaattcaccattgacaaggtgaggaaaggactgacagtcgttacaaggagtccagactctaacaatgtcgctagcagtgctgtaggcacggcactgcctaagtttgccatcaggggaatgctgaagacctttggactgcacggggttgtgctggacgttgattcagtaaatgagctggttcaggtggaaacatatctacgcagcgaaggtgttctggtccgatactggtaccccattgacatgctagagagacccccagcaggctacagacggaccgcaaccaatggcctcgtcaccctagataatactaatctgcagatccatcgtgagctgttacggtgtgaggccgcactggcgaggctttattgtcgcatggcgctgctgaacatcttcgctcctaagctgcctcatctgtttacacgcttattccacattcctgcaataagagatattactctggaacatctgcaactgctctccaatcagctgctcgccccacccctccctgacgggactatctctagctcctctatcctcctggcccagtcactgcaacattgtattcattcccagaattgtagcgcgacagacctcttttatcagggcaattcccagactgtgcgcgaatggttgaacgtggctatcacccggactctccaccagggggaagaatcgctgctagagctgactaagcagatctgttcattcctgcagacggccccagaacagttcccaagcgaagagttcccgatctctgagtctaaagtgaacatggacgtcaacttcccgggagctgcctttgtggtggttagttgtaaggaatctcagtcaggcttcagaaaggactcatctctgtacaaagccccctgggccagggttctcgtatatggactagggcacaaggtgaaacggaatggacagctgaatctaatcgaagctgcctgctacccgagggacgccagtcccgcgaatacaggactcgctccaccacctactgctgatcagtacccttccgttgtgctatctaccgacagagtgcacattaagctgggcgtgagtccgccaccaggcgctgtgctggtgctacactccctgcctttagagtttcccctggcgatggcctttgccgagcagttgctttcgtggaaatcagaggattcggagggaaaaagcgaggacgagccggacaccatccccaccagcgtgctgctgcaagtcgttgagctcctcggcaactttttgtggactaccgacatggccgcctgcgtgaaagagctggtattccatctgcttgcggagcttttacggacagtgcatacattggaacagaggcgccacccagccgggctcagttccagcatcgccctgcagctgaatccttgcctggccatgctcatggctttgcaatctgaactacacaagctttacgacgaggagactcagaactgggtgtcgggtggcgcctgtggcggcagtggcggagccgctgctggggatcagggccgctttagcacttacttccacgcactgatggagggttgcctggccgtcgccgaagttaccctcccaacaaatatgagtgtaacagcctccggcgtcacaagcgcaactgctccgaacctgtcagacagctccagctcgtcatcttcgtcacccggacagaccccgcagtcaccctccctgcttagtaaaaggaagaaagtgaagatgaaacgggagaaagcttcttcttccggcaagcgtcagtctagccgcacagtcgacagtgaccccacagtgctgagcattgggggcagcaagcctgaagatatgctctggttccacagggccctgaccctccttatcatcctacgtcacctcacacgcaaggatccccaaggactgggggtaactagcgacgcaatagccgacgcttgtcaggccttagtgggaccaaccgcccactcacgattgctggttatctccgggatcccgacccacctggacgagggcgtcgtcaggggcgccattcgcaaggcatgtaacgctcacgggggggttttcaaggatgaaatctatattcccctccaggaggaggataccaaaaagccgaaagataaagctgaaggaggtgatgggaaggtagaaccggagaagaccctggcattccccggcacagactccatggaagtttccacaagtagctcccttacacccgccatgtccatctctgcttcagcaagcacttcacaggcctccatctgctccagccagggaatcagccagacagtcagtgacctgtcggtcgatcccctccccgccggactggaactgcctatcccacccggactgcttgagccccacgccgtgtcctcccaggaatccttagacatcagcctgtgctcaacggggagtttgggcagccttggatcactgggagagccactcgataacgccgagacggccagcgtgtctgacatgggctctatgtacaccgttacctccttggataaccagcccctggccgcccgcccgataaaaggctttgcagtcgttgagatccgctccagggctaagatcgaaaagattagggcttctctgtttaacaacaacgacctgatcggtctctccagtttagatggtgaggacgagttgatggaaatgtctaccgaggaaatacttacagtgtctgttgtcaaccagagtctgttcgatactcaagggagcccaggcctggaggactacttcaatgacaagagcatcaagggggaaaaattggtgcctggtgcccgggaggttctgacagaaatatttaaatcttgtgcacactccgagcagacactgtctctgactcctgccaaacctatcagagtgtccgatatttacttaagtaaggagcagatcaattcgcagacacctggaaacctcttgcatctgttctttaccaatgtgcgcccgcccaagaaggtactggaggaccaactgacacaaattctccggaaatacggggtgcctaagccgaaatttgacaaatccaagtatagcaaagcgggaaaggagcagcaccccgtcaaggttgtcagcacaaaacgacctatcaccaagcccccagccaaggacaaggccgtcttaaacagtgtcagcagaacagctttaagcgaaaagaagcccacagttaaaccaaagtcccccgagaagagcaagcccgatgagaaggacccggagaagtcaccgaccaaaaaacaggaggtgccagaagaaaagtatttaacgctagaagggtttcacaaatttgtcatcgatagggcgcgacaggacattaggagcgtctggagagctatcctgagctgcggttacgacctgcatttcgaaagatgcgcctgtatagacgtgaggcacgcccagaaggcttcgcgaaaatggaccctggagatggatgtggcgctggtgcaatacatcaatcaactctgccgtcatctcgctattactcccgctcgtctgcatccccacgaggtctatctcgatcccgccgacgctgctgatccccgggttgcttgcctgctgaacgtcccaattgagtcactccgtctgcggtttgccctcctgcagtccttgaataccacactcgaaactttcttcctgcctctcgtcgagctgcgccagacacctatgtatactcattctattgctgcattgcttaaagaagcaaagggactcatcttctatgacacaaaagtgacggtaatgaatagggttttgaatgccaccgtgcagagaaccgccgaccatgccgcgccagagattacccttgatccactcgaaatcgtgggaggtgaaatcagagcttccgagaactcttacttctgtcaggcagcgcgccaactcgccagcgtgccatctagtcaactgtgcgtgaagctcgcttccggtggggatcctacctacgccttcaatatccgctttaccggtgaagaggtacatggcacctcagggtctttccggcactttctgtggcaggtgtgtaaggaactgcagtcatctagcctgtctcttttgcttctatgcccatcatctgccgttaataaaaacaaaggaaaatatatcctgacaccaagtcctatcacctatggagaagagcagctgctgcacttcctcggccagctgttggggatagcaattcgcgccgacgtacccctaccgctggatctgctacctagcttttggaaaactttggtcggagagcccctggacccggagcaggacctgcaggaggctgacatactcacctacaattacgtcaagaagtttgaaagtatcaatgacgagacagaactcgaggctctttgcgcagaaattgccagccagcaccttgctactgagtctccagacagcccgaataaaccctgttgcaggtttacctatctgaccatgaccggcgaggaggtcgagctgtgttcccgcgggcggcacattctggtggcttgggaaaacaaagatatttacgccgccgccatccggtctctgcggctgagggaactgcagaacgtagagtgtgtgactgccgttcgagcaggcctcggcagcatcatcccgttacagctccttacgatgctctctcccctagagatggaactgagaacttgcggccttccatatataaacctggaattcctaaaagcccacactatgtaccaagtcggcctgatggagactgatcaacatattgagttcttttggggggccttggaaatgttcacacaggaggagctatgcaaattcatcaaatttgcttgtaatcaggagcgaattccatttacttgcccctgcaaagatggcggaccagatacagcccatgttcccccgtacccgatgaaaattgccccgcctgacggcactgctggttctccagactcacggtatatcagagtggagacctgcatgttcatgattaagctcccacagtactccagcctggagatcatgttggaaaagctacgatgcgccatacattaccgtgaagaccctttatcaggctag

SEQ ID NO: 41095 - DNA, 849 bp, Artificial Sequence
  Description of Artificial Sequence: Synthetic coding sequence
atggagagccggatgtggcccgccctgctgctgagccacctgctgccattgtggccattgctgctgctcccgctccctccacctgctcaggggtcttccagctcaccccggaccccacctgcgcccgcaaggccgccctgcgctcggggcggaccttctgcccctcggcatgtatgcgtgtgggagcgcgcgccacccccttcccgtagcccccgcgtgccgcggtcaaggagacaggtgctgcccggtaccgcccccccagccacaccctctggttttgaggaaggtccaccatcctcccaatacccctgggcaatcgtatgggggcccaccgtgagtcgcgaggacggtggcgaccccaattcagcgaacccagggtttctggactacggatttgccgcccctcatggtctggcgaccccacaccctaattcagattcgatgagaggggacggcgacgggttgatactgggagaggctccagcaactctcagaccctttctattcgggggtaggggtgagggtgtggatcctcagctgtacgttaccattaccattagcatcatcatagtactggtggctacaggaatcatatttaaattttgttgggacagaagtcagaagcgccggcggcccagtggacagcagggggccctccggcaggaggagtcccagcagcccttgaccgacctttcccccgcaggcgttactgtgctcggagcatttggggacagcccgaccccaactccggaccacgaagagccgcgaggcgggccacggccagggatgcctcatcccaaaggcgctccggccttccagttaaaccggatccccttggttaacttgtag

SEQ ID NO: 41096 - DNA, 771 bp, Artificial Sequence
  Description of Artificial Sequence: Synthetic coding sequence
atggagagccggatgtggcccgccctgctgctgagccacctgctgcctctgtggcctctactcctgctccccttaccaccagctccgcggcatgtctgcgtatgggaacgagcaccacccccttccagaagtcctcgggtccctagatccaggaggcaagtgctcccaggcacagccccccccgcaactccttctggtttcgaggagggacccccaagcagccaatacccgtgggctattgtctggggccctacagtgagtagggaagatggcggcgatcccaactctgctaacccgggctttttggactatgggttcgccgcaccacatgggttggccactccgcacccgaacagcgacagtatgcggggggacggggatggcctgatacttggagaagctccagcaacactacggcccttcctgtttggtggccggggggaaggcgtagatccccagctctacgtgactatcacaatttctattatcatcgtacttgtagcgaccgggatcatattcaaattctgttgggataggtcccagaagcgtcgccggccgagcggccagcagggggcattgagacaagaggagtcgcagcagcccctcactgatcttagcccagccggagttacagttctcggggcctttggtgactctcccacacctactccggaccatgaggagcccagaggcggccccagacctggtatgccacaccctaaaggagctcctgccttccagctaaacagaattcctctggtgaatctctag

SEQ ID NO: 41097 - DNA, 831 bp, Artificial Sequence
  Description of Artificial Sequence: Synthetic coding sequence
atggagagccggatgtggcccgccctgctgctgagccacctgctgccactgtggcctcttcttttgctgcctcttcccccacccgctcaggggtcaagcagtagtcccagaacccccccagccccggccaggcctccatgcgcaaggggaggcccctctgcaccacggcatgtgtgtgtatgggaacgcgcaccccccccgagtagaagcccaagagttccgcgcagcaggcgccaagtcctgccgggtaccgccccccccgctactcctagcggatttgaggagggtccaccttctagccaatacccctgggctattgtttggggaccaacagtctccagagaggacggaggtgaccccaattccgccaatccaggttttctcgattatggattcgcagctccgcacggtctcgcgacaccacatcccaactcagactctatgcggggggacggtgatggcttgattctaggtgaggcccccgccaccttacgcccatttctctttggcgggcgaggtgagggggtcgacccgcaactatatgtaaccattactataagcattataattgtactcgtagctactggtatcatatttaagttttgttgggaccggagccagaagaggcgacggccatcgggacagcaaggtgctctgcggcaggaagagagtcaacagcctctgactgatctcagcccagcgggagtcactgttttgggtgcgtttggggactcacctacccctacacccgaccacgaagagccgaggggtgggccaaggcctgggatgccacaccctaagggcgctcctgccttccagttgaatcggtag

SEQ ID NO: 41098 - DNA, 849 bp, Artificial Sequence
  Description of Artificial Sequence: Synthetic coding sequence
atggagagccggatgtggcccgccctgctgctgagccacctgctgccactgtggccactgcttctgctaccattaccgccaccggctcagggcagctcctcaagtccacgtaccccgccagctcctgccagaccaccctgcgcacgaggggggccttccgctccacgccatgtttgcgtgtgggagcgagcgccaccgccatcgaggagccccagggtaccaaggagcagaaggcaggtgctgcccggcacagcgcctcccgctaccccctccgggttcgaggagggcccgcctagttcccaatacccttgggctattgtgtggggacctactgtctcacgagaagacggaggtgacccaaactctgcgaatccaggattcctggactacggattcgccgcccctcacggactggctactccccaccccaattctgacagtatgagaggtgatggcgatggtctaatcctgggcgaggcccctgccacccttcgccccttcctgttcggcggacgtggggagggcgtggacccgcaactatatgtgacgatcaccattagcattatcattgtgttggttgctactgggatcatttttaaattttgctgggatcgttcacaaaaacggcggagacccagtggtcagcaaggggcattgcgacaggaggaatcacagcagcccctaaccgacctgtctccagctggcgtcaccgtcctgggggccttcggggattcccccactcctaccccggatcacgaggagccgagaggaggcccaaggccggggatgcctcatcccaaaggggccccggcctttcagctgaacaggattcccctggtgaatctgtag

SEQ ID NO: 41099 - DNA, 492 bp, Artificial Sequence
  Description of Artificial Sequence: Synthetic coding sequence
atgagctggcggccccagccctgctgcatcagcagctgctgcctgacaactgactgggtccatctttggtacatttggctgttagttgttataggagcgcttttgctgctatgtggactgacaagcctgtgcttcaggtgttgttgtctgtcgcgacaacaaaacggcgaggacggaggcccccccccatgtgaggttacagtgattgcatttgatcatgactcaacactccagtccaccatcacaagtctccaatccgtctttggcccagcggcaagacgaatcttggcggttgcccacagccattcttctctggggcaactaccgtccagtcttgacacacttccaggctacgaggaagccctacacatgagccgtttcactgtggccatgtgcggacagaaggcgccagatttgccccccgtacctgaggagaagcaattgcctcccacagagaaggaaagcacccgaattgttgattcatggaattag

SEQ ID NO: 41100 - DNA, 552 bp, Artificial Sequence
  Description of Artificial Sequence: Synthetic coding sequence
atgggcgtgcgggtgcacgtggtggccgccagcgccctgctgtactttatattgttatccggcacgcgctgcgaggagaactgcgggaaccctgagcattgtctgactacagactgggtgcatctgtggtacatctggctcctggtcgtgataggcgccctgctcctgctgtgtggccttacgtccctgtgcttccggtgctgttgtctgagcagacagcagaatggggaggatgggggacctcctccttgcgaggtgactgtgatcgcattcgaccatgattccacactgcagtccactataaccagcttgcagagcgtgttcggtccggccgctagacggattttggccgtcgctcatagtcactcgtccttggggcaattgccctcttccttggacaccctgccaggttacgaagaagctctgcatatgtcccggttcaccgtggccatgtgcggtcagaaggcgcctgatttgcctcctgtccctgaagaaaagcagcttcctcctacagagaaagaatctaccagaatcgtcgacagctggaattag

SEQ ID NO: 41101 - DNA, 552 bp, Artificial Sequence
  Description of Artificial Sequence: Synthetic coding sequence
atgggcgtgcgggtgcacgtggtggccgccagcgccctgctgtacttcattctgttgagcggcaccaggtgtgaggaaaattgcgggaaccccgagcattgccttaccacagactgggtgcatctctggtatatatggttattggttgtcatcggcgctctcctacttctgtgcggcctcacttccctgtgtttccgttgttgttgtctctcaaggcagcagaatggggaggatggaggcccaccgccttgtgaggtaaccgtcatcgcattcgatcatgattcgactttgcaatctacgatcacctccctccagagcgtgtttggccccgccgcgagaagaatcttggctgtggctcatagtcactcgtcactcggccagctgcccagctctctggacacccttccgggatatgaagaggccctgcacatgtcgcggttcaccgtagccatgtgtggacagaaagcacccgatctaccccctgtcccagaagaaaagcagcttccgcccaccgaaaaagaatctactcgcatcgtggattcctggaactag

SEQ ID NO: 41102 - DNA, 273 bp, Artificial Sequence
  Description of Artificial Sequence: Synthetic coding sequence
atgggcgtgcgggtgcacgtggtggccgccagcgccctgctgtactttattctgctttcaggcacccgctgtgaagagaattgcggtaatccagagcactgtctgaccacagattgggtgcatctgtggtatatctggttgctggtggttattggcgctcttctgctgctttgcggtcttaccagtctgtgcttcagatgttgttgcttgtccaggcagcagaacggtgaagacggggggccacctccatgtgaggttacagtcattgcctag

SEQ ID NO: 41103 - DNA, 174 bp, Artificial Sequence
  Description of Artificial Sequence: Synthetic coding sequence
atgcccaccggcaagcagctggccgacatcggctacaagaccttcagtacttccatgatgctcctgactgtttacggagggtacctgtgcagcgtccgggtgtaccattatttccagtggagacgggctcagcggcaggctgcagaagaacagaaaacaagcggaataatgtag

SEQ ID NO: 41104 - DNA, 174 bp, Artificial Sequence
  Description of Artificial Sequence: Synthetic coding sequence
atgcccaccggcaagcagctggccgacatcggctacaagaccttctctacctccatgatgctgctcactgtttacggagggtacctttgtagcgttcgggtctatcattacttccagtggagacgtgcgcagcgccaggccgcggaggaacagaagacatcaggtattatgtag

SEQ ID NO: 41105 - DNA, 174 bp, Artificial Sequence
  Description of Artificial Sequence: Synthetic coding sequence
atgcccaccggcaagcagctggccgacatcggctacaagaccttctccacatccatgatgcttctgacagtttatgggggatacctctgtagcgtgcgcgtttatcattattttcagtggagacgggctcaacgccaggcagccgaggaacagaagactagcggaatcatgtag

SEQ ID NO: 41106 - DNA, 174 bp, Artificial Sequence
  Description of Artificial Sequence: Synthetic coding sequence
atgcccaccggcaagcagctggccgacatcggctacaagaccttctcgacatctatgatgttacttacagtgtacggcgggtatctgtgttccgtgagggtgtaccattactttcagtggcggcgggcacagagacaagctgcagaggagcagaagacctccgggataatgtag

SEQ ID NO: 41107 - DNA, 678 bp, Artificial Sequence
  Description of Artificial Sequence: Synthetic coding sequence
atggcccagagcgacttcctgtaccccgagaaccccaagcggcgggaagaggttaacaggcttcaccagcaactgctcgactgcctgtccgattcatttgatgtcactaataagttaaccgaggtgctaaatatgcacttggggtgccgtctggcgagtattgagatgaagcgcgatggaacaatcaaggagaactgcgatctgataatccaagccataatgaagatacagaaggaactgcagaaagtggatgaggcccttaaagataaactagagcctaccctgtaccggaagttgcaggacataaaagagaaggagaccgacaaaattgctatcgtgcagaaagtgatcagcgtcatactgggcgaagcaacttcagccgcaagcgcggtagcggttaaactggtaggttctaacgtcacgacagggatcattaataaactggttaccgtgctcgctcagattggcgcctcgcttcttggaagtatcggagttgccgtgctaggtctcgggattgacatgatcgtgcgcgccatcctgggagccgtggaaaaaacgcaattacaggctgctataaaatcatacgaaaaacacctggtggagttcaagagtgctagcgagaaatacaaccacgcaattactgaggttattaacactgtgaagcatcagatgaagtag

SEQ ID NO: 41108 - DNA, 456 bp, Artificial Sequence
  Description of Artificial Sequence: Synthetic coding sequence
atggagtacgtgctggaggtgaagaacagcccccggcacctgctgaagcagtttacggtatgcgacgtcccgctgtatgacatttgtgattacaatgtcagccgggaccggtgtcaggaactaggatgttgcttttacgagggtgtatgttacaaaaaggcagtgcctatctacatccacgtcttcagtgctctgattgtcatcatcgcaggtgcgttcgtgataaccatcatttatcgcgtgattcaagagagcagaaaagagaaggctattccagtggacgtggccctcccgcagaaaagcagcgaaaaagccgaacttgcatcatcctcaagcaagctaggattaaaacctgcatctcccggcccgccaagcgccggaccttcaatgaagagtgatgaggacaaagatgatgtgacaggaactattaccgaggcagaggaaaccgaagactag

SEQ ID NO: 41109 - DNA, 258 bp, Artificial Sequence
  Description of Artificial Sequence: Synthetic coding sequence
atggaggccggcgagcggatcgacgccagccagctgccccaccgggttctggagacaaggggccatgctatctccattctctttggcttctggacatcattcatctgcgacacctatattgtcctggcatggatatcgaagattaagggatcgcctgatgtctccgcctcttcagatgaaccatatgcgcgcatacagcagagccgccggcagtgtcacgccgaagaggaccagtctcaggttcctgaggccggctag

SEQ ID NO: 41110 - DNA, 2124 bp, Artificial Sequence
  Description of Artificial Sequence: Synthetic coding sequence
atgagcccccacggcgacggccggggccaggcccagggccgggccgtgagggtggggctgcgacgaagcggcggaatccggggaggtgtcgctgtttttgccgcagttgctgcggtgtttacgtttacattacctccctcagtccctggcggcgattcaggagaactgatcacagctgcgcacgagcttggagttgcccatccgcccggctaccctttattcactctagtggccaagctcgctataacattgtttcccttcgggagcatcgcttaccgggtgaacctgctgtgtggccttttcggcgccgtcgctgcaagcctgctgttcttcaccgtctttcggctaagcggatcatcagcgggaggcatcctggcggcaggagtttttagcttcagccgactcacttggcagtggtccatcgccgcagaagtattctctctcaacaatctcttcgtagggcttctgatggctcttaccgtgcactttgaggaggctgccacagcgaaggagcgcagcaaggtggcaaagatcggtgccttttgctgtggactatctttgtgtaatcaacataccataatcctgtatgtactgtgcattatcccttggatactttttcagctgctgaaaaaaaaggagttatctctggggagcctgttaaagctctcactatacttttctgccgggctgttgccctatgtccatctgcctatatcctcttatctcaatcatgccaggtggacgtggggtgatcagaccacccttcagggctttctgacccatttccttagagaggagtatgggaccttctccctggcaaaatcagagatcgggagtagcatgtcggagatcctactgtcacaggtgaccaacatgagaacagaattgtcattcaacatccaagctctggccgtttgcgctaacatttgtctggccacaaaggacaggcaaaatccctcactcgtgtggctgttcaccggaatgttctgcatctacagccttttcttcgcatggcgggctaatctcgatatctctaagccgctgtttatgggcgtagtagaacgcttctggatgcagagtaacgccgtggtcgctgtactggccgggatcggattagctgccgtggtctctgagactaacagggttttaaacagtaacggactgcaatgtttagaatggctgtctgctaccctcttcgtcgtctaccagatttattccaactacagcgtgtgcgaccagcggactaactatgttatagacaagtttgctaagaatctactcacctccatgccacatgatgctatcattctgctgcggggagacttaccgggtaactcccttcggtacatgcactactgtgaaggccttcgaccagacatttcactggtagaccaggagatgatgacttacgagtggtacttgccaaaaatggccaagcacctgccaggggtgaattttcccgggaaccgctggaatcctgttgagggcatcctcccttctggcatggtgacctttaatttgtaccacttccttgaagtgaataaacagaaggaaacatttgtttgtattggtatccatgaaggagatccgacgtggaagaagaattactcgctttggccatgggggtcctgtgacaaactcgttcctcttgaaatcgtgttcaatcctgaagaatggatcaaactgacaaagtcaatttacaattggacggaggaatacggcaggttcgatccaagtagctgggaaagcgtggctaatgaggagatgtggcaggcccgcatgaagactccctttttcatttttaacttggctgaaacagcgcatatgcccagcaaggtaaaggctcagctctacgctcaagcctatgacctgtacaaggaaattgtctatctgcagaaggaacatcccgttaattggcacaagaactacgccatcgcttgtgagcggatgctcagattgcaggcacgtgatgccgaccccgaagtgttgctgtcggaaacaattcgccatttccggctgtacagtcaaaaagctccaaacgacccccagcaggcagacatcctgggggctctgaagcacctgagaaaggaactgcagtccctgcgaaatcggaagaatgtgtag

SEQ ID NO: 41111 - DNA, 726 bp, Artificial Sequence
  Description of Artificial Sequence: Synthetic coding sequence
atgatgacctacgagtggtacctgcccaagatggccaagcacctgccaggtgtgaactttccagggaacaggtggaacccagttgaggggatcctgccctcgggaatggtcacctttaatctttatcactttttggaggttaacaaacagaaagagacttttgtctgcataggaatccatgaaggagaccctacatggaaaaaaaactattccttgtggccttgggggtcctgcgataaattggttccactggaaatcgtattcaatcccgaagaatggatcaaactgacaaaaagcatctataactggacagaagagtatggacgtttcgacccctcctcctgggagtctgtggcgaacgaagagatgtggcaagcacgtatgaaaactccttttttcatattcaacctggccgaaacagctcacatgccttctaaagtaaaggcccagctgtatgctcaggcatatgacttatataaggagattgtttatctacagaaggagcaccccgttaattggcacaagaactatgcaatagcgtgtgaacgtatgctacgcttgcaggctcgagatgccgacccggaggtgctgctgtctgaaactattaggcactttcggctgtatagccaaaaggcgcccaatgacccccagcaggccgatattctgggtgcgcttaagcatctgcgcaaagagctgcaaagcctccgtaacaggaagaatgtctag

SEQ ID NO: 41112 - DNA, 1230 bp, Artificial Sequence
  Description of Artificial Sequence: Synthetic coding sequence
atgagcccccacggcgacggccggggccaggcccagggccgggccgtgcgggtggggttacgcaggtctggaggcattcgcggcggcgtcgctgtcttcgcagccgttgccgccgtgtttacatttaccctgcccccttccgtgcctggaggcgactccggtgagttaatcaccgccgctcatgaactgggtgtagcccacccacctggttacccgctcttcacgttagtggctaaactcgcaattactctgtttccttttggatctatcgcctatagggtgaatctcctatgcggcctgttcggagctgttgctgcctccttgctgttcttcacagtgtttagactttctggatccagcgccggagggattctggctgcaggagtgtttagttttagcaggctgacttggcaatggagcatagctgcagaggtgtttagcctcaacaacctgttcgttggactgctcatggctctgacagtacacttcgaggaggcagccacagccaaggagagatcgaaggttgccaagataggcgctttctgctgcgggctctcactgtgtaaccagcatactatcatcctgtacgtcttgtgcattatcccttggatcttgttccagctgttgaagaagaaagagttatctctgggttccctgctcaagctcagtctttacttctctgcgggcttgcttccatacgtgcacctgccaatatcttcctacctgaaccatgcccgctggacctggggagaccagacaacactccagggattcctgacacactttttgagggaggaatatggaacatttagccttgctaagtcagaaatcggttcgtcaatgagcgagatcttgctgtcacaggtcaccaacatgaggacggagttatcattcaacatccaagcacttgctgtgtgtgccaatatatgtctggccactaaggaccggcagaacccatccttagtgtggctgttcaccgggatgttttgtatctactcattgttttttgcgtggagagccaatcttgatatcagcaagccattgttcatgggcgtcgtggagcgcttttggatgcaatccaacgccgtcgtcgcggtgctggccggtattggcctggcagccgtggtgtcggaaaccaacagggtactgaacagcaacggccttcagtgcttagaatggctcagtgccacgcttttcgtggtctatcagatttatagcaattatagatag

SEQ ID NO: 41113 - DNA, 396 bp, Artificial Sequence
  Description of Artificial Sequence: Synthetic coding sequence
atgatgaacttccggcagcggatgggctggatcggcgtgggcctgtacctgctggcctcagcagcagccttttattatgtcttcgaaatctccgagacatacaataggctggcactggagcacatccagcagcatcccgaagagccgctggaaggaactacatggactcattccctgaaggcacagcttctctcactcccgttttgggtctggacagtcattttcttggtgccatatctgcagatgtttttgttcttgtactcttgcacaagagcagatccaaaaaccgtgggctattgcattattccaatttgtctggcggtgatctgcaacagacatcaggccttcgtgaaggccagcaatcagatatctcgactccaacttatcgacacctag

SEQ ID NO: 41114 - DNA, 510 bp, Artificial Sequence
  Description of Artificial Sequence: Synthetic coding sequence
atgctggccttcagcgagatgcccaagccccccgactacagcgagctgagcgactctctgacactggcagtcgggacaggccggttttccggaccgctgcacagggcatggcggatgatgaacttccgccagagaatgggttggattggtgtgggactgtacttgttggcaagcgccgcagccttctattacgtctttgagataagcgaaacatacaaccgcttggctctggagcacattcagcaacacccagaggaacctttagaggggacaacctggacacacagcctaaaagcccagctgctctctctgcccttttgggtctggactgtgattttccttgtcccttatctgcagatgtttcttttcctctactcatgtactagagctgaccccaagactgtcggatactgtatcatccctatttgtcttgctgtcatctgtaacaggcaccaggcattcgtgaaggcaagtaaccagattagccgcctccaactcattgacacttag

SEQ ID NO: 41115 - DNA, 522 bp, Artificial Sequence
  Description of Artificial Sequence: Synthetic coding sequence
atgatggcccagctgttcctgctgcaggccaacgccgtgctgcccctaagtcatgagattaaggtcaagcgacagatccggttaccggctcctctctatcctcccgaacggaacgacagtaggagcttccagatccctcaggacctgcgcgagaagggctgggaagaaggccagcaacactttgctggcaaggcagccgacgctttccccgcacccgttcagctggagggactcgaggctggccagactactctagcttctcccgaggtagggccctggaggcccaaacgcctgtccggcgtgtgccttttgtctgcccttctacctgacccttgcaagactaacggaacattcttattacagaaacaccacttgccttctcttctagccgtgatcctgttccccgtcatcatacttaccggggcctctttcgcccacctatttgtagcactgtttgtttcccacctgctgctgaagctccctttaggtgccgggatgaggatgcaaagagatgcgcgctag

SEQ ID NO: 41116 - DNA, 522 bp, Artificial Sequence
  Description of Artificial Sequence: Synthetic coding sequence
atgatggcccagctgttcctgctgcaggccaacgccgtgctgcccctgagtcatgagatcaaagtgaaaagacagatcagactccctgccccactgtaccctcctgagcgaaatgattcgcgttcattccagatcccccaggatctgagggaaaaggggtgggaagagggccagcagcattttgctgggaaagctgcggatgcttttcctgctcctgtccagttagagggcctcgaggccggtcagactactctcgcgagcccagaggtgggtccttggaggccaaaacgcctgtctggcgtgtgcctgctgagcgcactgctaccagatccttgtaagaccaacggtacatttctcctgcagaagcatcatctccctagtttgctcgccgtgattctcttccccgtgatcattttgactggcgctagtttcgctcacctgtttgttgccctattcgtcagccacctgctgttaaaacttcccctaggggcaggaatgagaatgcagcgcgacgccagatag

SEQ ID NO: 41117 - DNA, 2817 bp, Artificial Sequence
  Description of Artificial Sequence: Synthetic coding sequence
atgcccgccctggagcacatgaaccagatcctgcacatcctgttcgtgtttttaccatttttgtgggcattggggacgttgccccctccagatgcactgctcctgtgggctatggaacaggttctcgagtttggtctaggcgggtctagcatgagtacacacttgagactgcttgttatgttcattatgtctgccgggactgcgatcgcctcttacttcatacctagtactgtaggggtcgttctgttcatgaccggtttcggcttcctgctcagcctgaatctttccgatatgggccacaaaatcggcacaaagagcaaggacttacccagcggaccagaaaagcacttctcctggaaggagtgtctgttctatataatcattttggtgctggctctgttggagacaagcctgctccatcactttgccggcttttcccagatcagcaaatcaaacagccaagcaatcgtggggtatggactgatgattctactgattatactatggatactgcgggaaatccagagcgtgtacataattggtatctttcggaaccccttctaccccaaggacgtgcagactgtaaccgtgtttttcgaaaagcagacaaggctaatgaagataggaattgtccggcggatcctgttaacactggtgtctccgttcgcgatgatcgcctttttgagtctcgactccagcctgcagggcctccatagcgtctctgtgtgtatcggcttcacacgggccttcagaatggtttggcagaacactgaaaacgcactgctcgaaaccgtgatcgtctcgacagtgcacctgatcagtagcactgacatctggtggaacagatcattggataccggcctacgcctcctgttggttggtattatcagggatcgactcattcagttcattagcaaactgcagttcgccgttactgtcctactgacaagctggacagagaaaaagcaaagaaggaaaacgactgccacgctgtgtatcctcaatattgtgtttagcccatttgttctggttatcatcgtgttctccaccctgctgagcagtccactcttaccattgtttacactgccggtgttcctcgtgggctttcctaggccgattcagagttggcccggggcagccgggacaacggcatgtgtctgtgcagatacagtttattactatcagatggtcccacgcctgacagccgtgctccagacagcaatggcagccggctcgttaggtctcttactacctgggagccattatcttggccggtttcaggatcggttgatgtggatcatgattctggagtgcggatacacatactgctctattaacattaaaggcttggaacttcaggagacctcgtgtcataccgccgaggcccgacgcgttgacgaggtcttcgaagatgctttcgaacaggaatatactagggtgtgctcattaaatgagcatttcgggaacgtgttgactccgtgtactgtcctgcccgttaagctgtattcggacgcaaggaatgtcctctcaggcataatcgatagccatgaaaatctgaaagaattcaagggtgacctcattaaggtactagtctggatcttggttcagtattgctcaaagaggcccggtatgaaagaaaacgtgcacaataccgagaacaagggaaaagcaccattgatgctgcctgcactgaacactctgccccctcccaagtctcctgaagatatagacagtttgaacagcgaaacctttaatgactggtccgacgacaatatctttgatgatgagcctactatcaagaaagtcatagaggaaaaacatcagctaaaagacttacctggcacaaacctttttatccctgggtccgtcgaaagtcaacgcgtgggagatcatagcaccggtacagtgccagagaatgacctatacaaagccgtgctcttgggttatcctgccgtggacaaggggaaacaagaggatatgccctatattcctctgatggaattcagctgtagccattcacatctggtttgtctgcccgccgaatggagaacatcgtgcatgccgtcttctaagatgaaagagatgtcgtcccttttccccgaggactggtaccaatttgttctgaggcagctcgagtgttaccatagtgaggagaaagcgtcaaatgtactcgaggaaatagcaaaggacaaggtgctcaaggatttctatgtgcacacggttatgacatgctacttcagcctcttcggaattgataacatggcccccagccccggacacattctaagagtgtacggcggcgtgctcccttggtctgtcgctctcgactggctgactgaaaagccggaattgtttcagctggctcttaaagcgttcaggtacaccttgaaactaatgattgataaggcttctctcggacccattgaagactttcgggagctgatcaagtacctggaggagtacgagagagattggtacatcggcttagtgtccgacgagaagtggaaggaggcaatcctacaggaaaaaccatatttgttttcgttgggctacgatagtaatatgggcatctacaccgggcgggttctaagtctgcaggaattgcttattcaggtgggaaaactgaaccctgaagcagtgagaggccagtgggctaacctttcctgggaattgctgtacgctaccaacgacgacgaggagcgttatagcattcaggcccaccctttattgcttcgcaatctgaccgtgcaagccgccgaaccccctctcggctatccgatctatagttctaagcctcttcacatccatctgtactag

SEQ ID NO: 41118 - DNA, 3519 bp, Artificial Sequence
  Description of Artificial Sequence: Synthetic coding sequence
atgagccccgacgtgcccctgctgaacgactacaagcaggacttctttctgaaacggttcccgcagacagtgctgggaggaccgaggtttaagctgggttattgcgcccctccctatatctacgttaatcaaatcatcctgtttctgatgccttgggtgtggggcggagttggcactctgctctaccagctcggcatccttaaagactactatactgcagctctctccggcggtttaatgttgtttactgcgtttgtgatccagtttacctctctctatgccaagaataagagcacaacagtggaacgcattctgactacagacatactagcagaagaagacgaacacgaatttaccagttgtaccggcgccgaaacagtgaaatttttgattcccggaaagaagtacgtggccaacacagtcttccacagcatcctcgccggcctagcatgcggtctcggaacatggtacctattaccgaaccggattactcttctatatggctccacgggcgggaccgccctacttttcttcttcggctggatgactctatgcattgctgagtatagtttgatagtgaacactgccaccgaaacggctacttttcaaacccaagacacttatgagataatccccttgatgagacccctgtacatcttctttttcgtcagcgttgacctcgcccatagatttgtagttaacatgccggcacttgaacacatgaaccagattctccacatactgtttgttttcctaccgttcctctgggcactgggtactctaccaccgccggacgcacttctgttatgggccatggaacaggtactggagtttggtctgggcgggagcagcatgtcaacacacctgcgcctcctcgtaatgttcataatgtcagctggtacggctattgccagttactttattccaagcactgtaggcgtggttctcttcatgactgggttcggctttctcctgagtcttaacctgtccgatatgggtcataaaattggcacgaaatctaaggacctgcccagcgggcctgagaagcattttagctggaaggaatgcctattttacatcatcattctggtgctcgcactgcttgaaactagtttattgcaccactttgcaggcttttcacaaatctctaaatctaattctcaggcgattgtagggtacggcttgatgatactcctcatcatcctgtggatactcagggagattcaaagtgtgtacatcatcggaatctttagaaacccattttatcccaaggacgtccaaacagttacagtgttcttcgaaaagcagactcgactgatgaagattggcattgtgcggcggattttattgaccctggtctcgccgttcgccatgattgcgttcctctcactcgacagttctctgcaagggctgcatagcgtcagcgtctgcatcggatttactagagcgttcagaatggtttggcagaatacagagaatgccttgctagagaccgtcatcgtgagtactgtgcatttgatatcctcgactgatatctggtggaacagaagtctagacaccggtctcaggctcctcctggtgggcattattcgggacaggctcatccagtttattagtaagttgcagtttgcagtcaccgtgctgctgacctcctggacagagaagaagcagagacgaaaaacaactgccactttatgtatcttgaacatagtcttctctccctttgttctggtcattattgtcttctctacattgctgagctctcccctgctgccacttttcacccttcctgtgttcttagtgggcttccccagacccattcaaagctggccgggagctgccgggactaccgcctgcgtctgtgctgacaccgtgtactattaccagatggtgccaagactgacagcagtcctccagacagctatggctgccgggtctctgggcttactgctccccggcagccattacctaggccgttttcaggataggctgatgtggatcatgatcctcgagtgcgggtacacttactgctcaattaacataaagggcctggagctgcaggagacctcttgtcacacagccgaggccaggagggtagatgaagtgttcgaagacgccttcgagcaggagtatacacgtgtgtgctccctgaatgagcatttcggcaatgtgctgactccttgtacggtgctgccagtcaagctctatagtgatgcacgtaacgtgctcagtgggattattgactcccatgagaatctgaaagagtttaaaggcgacttaatcaaagtcttggtgtggattcttgtccaatactgcagcaaacgtcccggcatgaaagaaaacgttcacaacaccgagaacaaaggcaaggcaccattgatgctgccggctttgaataccctcccacctccgaagtcaccagaagatatagattccctaaactccgaaaccttcaatgattggtccgacgataatatcttcgacgacgaacctacgataaagaaggtcatcgaagagaagcaccaattgaaggatctgcctgggacgaatctcttcatcccaggatccgtggaaagccaacgcgtgggtgatcattctactgggaccgtcccggaaaatgatctttacaaagcagtgctcttgggttaccccgcagtcgacaaaggcaaacaggaggatatgccatacattccgctcatggaattctcctgttcgcattcccacctcgtgtgtctgccagcagagtggagaacaagctgcatgcctagctcaaaaatgaaagagatgtcctcgttgttcccggaggattggtaccagtttgtgttgcgccagcttgagtgttatcactctgaggagaaagccagtaacgtgctagaggaaatcgctaaagacaaggtgcttaaggacttttatgtccacactgtaatgacatgttatttttcactcttcggcatcgataacatggcaccctcccccggccacatactgagagtgtatgggggcgtactaccctggtctgttgccctagattggcttaccgagaaaccggagctgttccagttagcactgaaagccttccgctatacactgaaactgatgatcgataaggctagcctgggacctatcgaagacttccgcgagttgatcaaatacctggaagagtacgaaagagattggtatattggccttgtctccgacgagaagtggaaggaggccattctgcaggaaaagccctatttgttttccctggggtacgattccaatatgggcatttacacaggtcgggtgctctctctgcaggaactgctaatccaggtagggaagctaaatcccgaggccgtgagaggccagtgggcaaacctgtcatgggagcttctgtacgccaccaatgacgacgaggaacggtactctatccaggcacaccccttattgttgcgtaacttaacagtgcaggctgcagagcctccactgggataccctatatatagctcaaaaccccttcatatacacctctactag

SEQ ID NO: 41119 - DNA, 3519 bp, Artificial Sequence
  Description of Artificial Sequence: Synthetic coding sequence
atgagccccgacgtgcccctgctgaacgactacaagcaggacttcttcctcaaaagatttccccagactgtactcggagggccgcgtttcaagctcggctattgcgcccctccgtatatctatgtgaatcagattatcctcttcctgatgccttgggtgtggggaggcgttggaacacttctctaccagcttggtatcctcaaagactactacacagctgcccttagcggcgggctgatgcttttcacagcctttgtgatccagtttacatccctctatgctaaaaacaaatctaccactgtagagagaattttgacaacggacatcctagcagaggaagatgagcatgaatttacttcatgcacaggtgctgaaacggtgaagtttctaatcccgggcaagaaatacgttgcaaataccgtgtttcattcgatcttagctggacttgcctgtggcctgggcacctggtatctgctgcctaacaggattacattgttgtacgggtctaccggggggaccgctctgctcttcttctttggctggatgacattatgtatcgccgaatatagcctgatagtaaacacagccacggaaactgccactttccagacacaagacacctacgaaatcatcccgttgatgagaccactctatatcttcttttttgtcagtgttgaccttgcacataggtttgtggtgaacatgcctgctctggagcacatgaaccagatcctgcacatactcttcgtgtttctaccattcctctgggccctagggacactgcctccccccgacgccctcctgctgtgggccatggaacaggtgctcgaatttggcctgggtggctcttctatgagtacccatttgcgtcttctggtgatgttcattatgtcggctggtaccgccattgcatcctattttataccctcaacagtgggagtcgtcctgtttatgactggattcggtttccttttgagtctgaacctttctgacatgggccataaaattgggacaaagtctaaagatctccctagcgggcctgagaagcacttctcttggaaagagtgcttgttctacattatcatactggtgctcgcactgttggagacgtccttgctgcaccatttcgctggcttctcccagatttctaagagtaatagccaagctatagtgggatacgggcttatgatcctcctgattatcctctggatactaagagaaatccagagcgtgtacattatcgggatcttccgcaaccctttctacccgaaggatgtccagacagtgactgtgttcttcgaaaaacagactcggctgatgaaaattggcatagtgagacgcattttgctcacgctggtctccccattcgccatgatagcatttctctctttggatagttccctgcagggactgcactcagtgtcagtctgcatagggttcactcgggccttccgtatggtctggcagaatacggagaatgccctcctagaaaccgtcatcgtcagcaccgttcacctcattagtagcacggacatttggtggaaccgatccctggacacaggtctgcgtcttctcctcgttggaatcattcgagaccggttgattcagtttatttccaagctgcaatttgcggtaacagtcttgttgaccagttggactgaaaaaaagcaacggcgcaagacgaccgccaccttgtgcattttaaatattgtcttctcacccttcgtccttgtgataattgtcttctctacgctgttgtccagccccctgcttcctctgtttaccctgcctgtgtttctcgtgggtttcccaagacctatccagtcttggcccggagccgctgggaccaccgcatgcgtttgtgccgatacagtctactactaccaaatggtgccccggctcaccgcagtcttgcagaccgccatggcggcaggatctctggggctgctcctccctgggtcacactacttagggaggttccaggaccgacttatgtggattatgatcttggagtgtggttacacctattgtagcataaacatcaagggtttagaactccaggagacaagttgtcataccgcagaggctaggcgtgtcgatgaggtcttcgaagatgctttcgaacaggaatacacacgggtctgttccctcaatgaacactttggtaatgtcttgaccccttgcaccgtattgcctgtcaaattgtatagcgatgcacgaaatgtgctaagtgggataattgacagccacgagaacctaaaagagtttaaaggtgacctcattaaagtcctggtttggatcttagttcagtactgttctaaacgccccggtatgaaggaaaatgtccataatacagaaaataaaggcaaggctcctctgatgctgcctgccttaaatacactcccaccccctaaaagtcctgaggatatcgattctctcaatagcgaaacttttaatgattggtctgacgacaatatcttcgacgatgaacccaccataaaaaaagtgatcgaggagaagcaccaactcaaggatcttcccggcaccaacctcttcattccagggtccgtggagtcccagcgtgtcggagatcatagcaccgggactgttcctgaaaacgacttgtataaggcagttctgttgggttaccccgctgtggataaaggtaagcaggaagacatgccttacatccctctgatggagttctcctgtagtcacagccatctggtctgcctgccagcagagtggcgcacgtcttgtatgcctagcagcaaaatgaaggaaatgtctagcctgtttccagaggattggtaccagtttgtgctccgtcaattagagtgttaccacagcgaggagaaagcatccaacgtattagaggagattgccaaagataaggtcctcaaagatttctatgttcacacagttatgacatgctatttttcactgtttggtattgataatatggccccaagcccaggtcatatactgcgcgtgtacggaggcgtgctcccctggtctgtggcactcgactggctgacagagaaaccagaattatttcagctagccttgaaagccttccgctacacccttaagctgatgatcgataaggcgtctctgggtcccatcgaggatttccgtgagctgattaaatatctcgaggagtacgaaagggattggtatatcggacttgtatccgacgagaagtggaaagaggccatcctccaggaaaagccctacttattcagcctggggtacgattctaacatgggtatctacacaggtagagtccttagcctacaggaactgctcattcaggtgggcaagctaaatcctgaggccgtaagggggcagtgggctaatctgtcctgggaattactgtatgctacaaacgacgatgaagaacgctacagcatacaggcccatccgcttctactgaggaatctgacagtccaagcagccgagccccctttggggtaccccatctatagcagcaagccacttcatatccacctatattag

SEQ ID NO: 41120 - DNA, 897 bp, Artificial Sequence
  Description of Artificial Sequence: Synthetic coding sequence
atgctgcccgccctgaacaccctgcccccccccaagagccccgaggacattgacagcctgaacagcgagacctttaacgattggtccgatgataacatcttcgacgacgagcctaccataaagaaagttattgaagaaaagcaccaactcaaagacctgccgggcaccaatctgttcatccccggctccgtggaaagccagcgcgtcggggatcacagcaccgggaccgtacccgagaatgatctgtacaaagcggtgcttctgggctaccccgccgtcgataaaggcaaacaggaggacatgccttatattccccttatggaatttagttgttctcatagccacctcgtgtgtctacctgccgagtggagaacaagttgtatgccctccagcaaaatgaaggagatgagttccctgttccctgaagactggtaccagtttgtcctccgccaacttgaatgctatcactccgaggagaaggcttctaacgtgctggaagaaattgccaaggataaggtgctgaaggatttctatgtgcataccgtcatgacctgctatttttctctgttcggaatagacaacatggctccttctccgggccatatactgcgtgtgtatggcggcgtgctcccatggagtgtggccctggactggttgactgagaaaccagagctcttccagctggccctcaaggcgttccggtacacactcaaattgatgatcgacaaggcaagcttaggcccgattgaagacttccgcgaactcattaaatatctcgaagaatacgagcgagactggtacatcgggctagttagtgacgaaaagtggaaggaagccatcctgcaagaaaaaccctatctgttcagtctggggtacgatagcaatatgtatctgtag

SEQ ID NO: 41121 - DNA, 1584 bp, Artificial Sequence
  Description of Artificial Sequence: Synthetic coding sequence
ctgtgcatcctgaacatcgtgttcagccccttcgtgctggtgatcattgtcttctccacgctcctgagcagtcctctacttcccctgtttactctccctgtattcctcgtggggtttcccagacccatccagagctggcctggggccgccgggactacagcttgcgtatgtgcagacacagtatattactatcaaatggtccctaggttgactgccgttctacagactgctatggccgcaggatccttgggacttctgctccctggaagtcactacctcggcagattccaggatcgtctgatgtggatcatgatcctcgagtgcgggtacacctactgttctatcaatataaaggggctggagctccaggagacttcctgtcacactgctgaggcaagaagagtcgacgaggtgttcgaagacgccttcgaacaggagtatacccgagtgtgcagccttaacgagcattttggaaacgttctaacaccgtgtactgtgctgcctgtgaagctgtattctgatgcaaggaacgtgctgagtggtattattgacagccacgaaaacctgaaggaatttaaaggcgatctgattaaagtgctggtgtggatcctggtgcagtattgctctaaacgccccgggatgaaagaaaacgtgcacaatactgagaacaaaggaaaggccccactcatgctacctgctctgaacaccctgccaccccctaagtctccagaggatatcgattctcttaatagtgagacttttaacgactggagcgatgacaatatattcgacgacgaaccaaccattaagaaagtcatagaggagaaacaccagctgaaagatctgcccgggacaaacctgtttatacccggcagtgtcgagtcccagagggtgggcgaccactccacaggtactgttcccgagaacgatctctacaaggcagttctgctgggataccccgctgttgataagggtaaacaagaagatatgccttatattccactgatggaattcagctgttcccactcacacttggtctgtctgcccgcagagtggcgtacaagctgtatgccttcttcgaaaatgaaggaaatgtcatccctcttcccagaagattggtaccagttcgttctgcggcagctggagtgctaccacagtgaagaaaaggcctctaacgtgttagaggagatcgctaaggataaggttctgaaggacttctatgtccacacggtaatgacctgctatttctctctttttggcatagacaacatggccccctctccaggccatattctacgcgtgtacggaggtgtacttccctggtccgtagccctagattggttgaccgaaaagcctgagctgtttcagctagcactgaaggcatttagatacactctgaagctgatgatcgacaaagccagtctgggcccaatcgaggactttcgagaactgattaaatacctcgaagaatacgagcgcgattggtacattgggctcgtaagtgacgaaaaatggaaggaagccattttacaagaaaagccgtacctcttctcgctcggctatgactctaacatgtatctttag

SEQ ID NO: 41122 - DNA, 1866 bp, Artificial Sequence
  Description of Artificial Sequence: Synthetic coding sequence
atgcccttcaccctgcacctgcggagccggctgcccagcgccatcaggagtctcatcctacagaaaaagcctaatatcaggaatacaagctccatggcgggcgagctgagaccagcatcactcgtcgtacttccccgttctctggctccggcttttgaacgtttctgccaggtcaacaccgggcctttgccgttactcgggcagtccgagcctgagaagtggatgttgcctcctcagggagccatttcggaaacgagaatgggtcatccacaattttggaagtacgagtttggggcatgcacgggctctttggcctccctcgagcagtatagtgagcagctgaaggacatggtcgccttttttttaggttgttctttttcattggaggaagccttggagaaagctgggctgccgaggcgggaccctgccggccattctcaagccggggcctacaagactactgtgccatgtgtgacgcatgctgggttctgttgcccactagtagtgacaatgcgtcctatacccaaggataaacttgagggattggttcgggcatgttgcagcctgggtggcgaacagggacaacccgtccacatgggggatccagaactgctcgggattaaagagctgtccaagcccgcatacggggatgccatggtctgcccaccaggagaggtgcccgtcttttggccgtcacctctgaccagtctgggtgctgtgtcctcttgcgaaaccccactagccttcgccagcatacccgggtgtaccgtcatgaccgatctgaaagacgccaaagccccgcccggctgtcttaccccagaaagaatcccagaggtacaccatatcagtcaggatcctctgcactatagcattgccagcgtctcagcttcgcaaaagatacgtgagctggaaagcatgatcggcatcgaccctggtaacaggggaatcggacaccttttgtgtaaggacgagttacttaaggcctccctttcactctctcatgcacggtcagttttaattaccaccggctttcccacgcattttaaccacgaacctcccgaggagactgacggaccaccaggagccgtcgcactggtggcattcctccaagctttggaaaaggaggttgctatcatagtcgatcagcgcgcatggaacctccatcaaaaaattgtcgaagatgccgtcgagcagggcgtactcaaaacgcaaattcctatactcacttatcagggcgggagcgtcgaggctgcgcaggctttcttgtgcaaaaatggggatccccagacccctcggttcgaccacctggttgcgattgagagggctgggcgggctgccgatggtaattactacaatgcccggaaaatgaacattaaacatctggtcgatccaatcgatgatctgtttctggcagcgaagaagatccccggaatatcttcaacaggggtgggagacgggggcaacgagctaggaatgggcaaagtgaaggaagctgttagacgacacatccgacatggcgacgtcatcgcatgcgatgtggaggctgacttcgccgtgatagccggggtcagcaactggggcggctatgctctggcgtgcgctttgtatattctctactcctgtgccgtgcatagccagtatctgcgaaaggcagtgggaccttcccgagcacccggggaccaggcctggacacaagctctccctagcgttattaaggaggagaagatgttagggatcctggtccaacataaagttcggagtggcgtaagtggaattgttggcatggaagtggatggactgccctttcataatacccacgcagaaatgatacagaagctggttgatgttaccacggctcaggtgtag

SEQ ID NO: 41123 - DNA, 480 bp, Artificial Sequence
  Description of Artificial Sequence: Synthetic coding sequence
atgcccttcaccctgcacctgcggagccggctgcccagcgccatccggtcgctgatcctccagaagaagcctaacatacgtaatacgtccagtatggctggagagctgagacctgctagtttggtggtcctaccccgatcactcgctcccgcattcgaacggttttgccaggttaacactggcccgctgcctctgctgggacaaagcgagcccgagaaatggatgctgcccccacaaggagcaatcagcgagacatctcttagagacttgcactcagcctggcatagaacctcactcatgaccgtggctcaagaaagagctgccctgcccactgtcttaactcctagtcctattacatggcgcctttcctggcttcggtccctgcgaagctggaggaagtccagccctggcgagatccccttggccctacccagcgttcatagcatcgcacaagccaggaacccccccgttcaggactag

SEQ ID NO: 41124 - DNA, 1866 bp, Artificial Sequence
  Description of Artificial Sequence: Synthetic coding sequence
atgcccttcaccctgcacctgcggagccggctgcccagcgccatcagaagcttaatactacagaagaaacccaacatccgcaacaccagttccatggccggtgagctaaggcctgcaagtctggttgttctccctaggtcgcttgcccccgctttcgagagattctgtcaagtcaacaccggccctctcccccttctggggcagtcggaacccgaaaaatggatgctgccccctcagggagctatttcagagactcggatgggccacccccagttttggaaatatgagttcggtgcctgcactggatcactggcttccttggagcaatactccgagcaacttaaggacatggttgcttttttcttagggtgttctttctctctggaagaagccctggaaaaagccggcctgccaaggagggatcccgcaggccactctcaggccggggcgtataagactacagtaccctgcgtgacccacgccggcttttgctgccccctcgttgtgacaatgaggcctattcccaaagataagttggaaggtctggtgagggcctgctgcagtctgggaggagagcaagggcaaccagtgcatatgggcgatccagagttgctgggcatcaaggagctgtccaagccggcgtatggggacgccatggtctgtccgccaggagaggtgcctgtcttctggcctagccctctgacctctctgggagccgtgagctcttgtgagacgccgcttgcattcgcctctatacccggatgtactgttatgaccgatctgaaagacgctaaagcgccgccagggtgtctaacccctgaacgaatccccgaagtgcatcatatatctcaggatccactgcactattcaatcgcctccgtaagtgcctcacaaaagatcagggagctagaatccatgatcggtatcgaccccggtaatcgcggcataggccacctgctgtgtaaagacgaacttcttaaggcatccctatcgctcagtcacgcacgatccgtgctgatcaccaccggcttccccacccatttcaaccacgaaccccctgaagaaacagatggccctcctggcgctgtggccctggtcgcgtttctgcaggctctggagaaggaagtggccatcatcgttgatcagcgggcctggaacctccatcagaaaatcgtggaagatgccgtggaacagggggtactgaaaacacagattcctattctgacctatcaggggggaagtgttgaagcagctcaggctttcctgtgcaaaaatggagatccgcaaactccccgtttcgaccacttggtcgccatcgagcgtgccggtcgggcagccgacggtaattactacaatgccaggaagatgaatataaaacacctcgtggaccccattgacgacctcttcctggcggctaaaaaaatcccagggatctcatccaccggcgtcggggacggaggcaacgagctgggaatggggaaggttaaggaagccgttcgccggcacattagacacggtgatgtgatcgcatgcgatgtagaggctgacttcgctgtcatagccggagtcagcaattggggagggtatgccttagcatgcgctctatatatcctgtatagttgtgccgtccatagccagtatctgcggaaggccgtaggaccctcccgcgcccccggcgaccaggcatggacccaggccctgccttcggttattaaagaagagaaaatgctgggaattctggtacaacacaaagtccgaagtggcgttagcggcattgttggcatggaggtggacggactgccattccataatactcacgccgagatgatccaaaagctcgtggacgtgacaacagcccaggtctag

SEQ ID NO: 41125 - DNA, 1851 bp, Artificial Sequence
  Description of Artificial Sequence: Synthetic coding sequence
atgcccttcaccctgcacctgcggagccggctgcccagcgccatccgctcgttgatcttacagaaaaagcccaacatccggaatacaagctccatggcaggtgaactgagacctgcttctctggtcgtgctgcctcgtagcctcgccccggccttcgagcgcttctgccaagtgaacacggggcccctgcctctcctcggtcagtccgagcctgagaagtggatgctcccaccccagggtgctatatctgaaacccggatggggcatccccagttttggaagtatgaatttggcgcttgcacaggctcgcttgcatccctcgaacagtactctgagcaattaaaggacatggtggcattctttctcgggtgctccttcagccttgaggaagcactcgaaaaggcaggattacctcgtagagacccagctggacattctcagacgacagtcccttgcgtcacccacgctggcttttgctgccctctggtcgtcaccatgcggcccatccctaaggacaagctggaaggactggtcagggcctgctgttctttgggcggcgagcaaggtcagcccgttcacatgggagatcccgaactgctcgggatcaaggaactgtccaaacctgcctacggggacgctatggtctgtccgcccggagaggtgcccgtgttctggccctcgcccctgacgagcctgggtgccgtatcctcatgcgagactcccttggcctttgcaagcattcccggctgtaccgttatgaccgatctcaaagatgccaaagctccccccggctgtctgacacccgagcggatccccgaggtgcatcacatcagtcaggacccgctgcactactccatcgcatctgttagcgcttcacagaaaattagagagctcgagtcgatgatcggcatcgaccccggcaatcgcggaataggccatctgctctgtaaagacgaactgctgaaggcctccctgtccctgtcccacgcacgcagtgtgctgattaccacagggtttcctacccacttcaatcacgaaccccccgaggagacagacggccctccgggggccgtggccctggtggcctttctgcaggcactcgagaaggaggtggccataatagtggaccagagagcttggaatctgcaccagaaaatcgtagaagatgctgtcgaacagggcgtcctgaagacacaaatccccatcctgacctatcaaggcgggtcagtcgaagcagctcaggcgttcctatgcaagaatggcgaccctcagacaccacggtttgatcacctggtggcaatcgaaagagccgggagggcagccgacgggaattactacaacgcaagaaaaatgaatatcaagcatctcgtcgatccaatcgatgacctgtttctggctgccaagaaaatcccaggcatcagttcaactggtgttggggatggcggcaacgagctgggtatgggaaaggttaaggaagccgtcaggagacacattcgccacggcgacgtcatcgcctgtgacgttgaggctgacttcgcagtcatagccggcgttagcaattgggggggttatgccctagcctgtgccctgtatatactgtattcgtgcgccgtccactcccagtacttgcgcaaggctgtaggcccatcccgggccccaggagatcaggcatggacgcaagctctgcctagtgtcattaaagaagagaaaatgctggggatcttggtgcaacataaggtccggtctggggtgtctgggatcgtggggatggaggtcgatggcttgccattccacaacactcatgccgaaatgattcagaagctcgtcgacgttactactgcgcaggtgtag

SEQ ID NO: 41126 - DNA, 198 bp, Artificial Sequence
  Description of Artificial Sequence: Synthetic coding sequence
atgcccttcaccctgcacctgcggagccggctgcccagcgccatcaggagccttattttacagaaaaaacccaacatcaggaatacaagcagcatggccggcgagctccggcctgcatcgctcgtggtgcttccacgatcccttgctcccgcattcgagcgcttttgtcaggtcaacaccggaccccttcccttatag

SEQ ID NO: 41127 - DNA, 1296 bp, Artificial Sequence
  Description of Artificial Sequence: Synthetic coding sequence
atgcccttcaccctgcacctgcggagccggctgcccagcgccatcaggagtttgattctgcaaaagaagccgaacattcggaatacttcaagtatggcaggagagctccgtccggcctccttggttgtgctcccccggtcgctcgctcccgcgtttgaaagattctgccaggtgaatacaggtccattgcctctgctcgggcagtctgaacccgagaaatggatgttacctcctcagggggctatatccgagacacgtatggggcacccgcagttctggaagtatgaattcggcgcatgtactggctcgttggcatctctggagcagtattcagagcaattgaaggatatggtggcctttttcctcgggtgcagcttctcgcttgaagaagcgctcgagaaggcaggcctgccgcgtcgtgaccctgccggccattcgcaggctggggcatacaaaacaacggtaccctgtgttacccacgctggcttttgttgccctttagtcgttacgatgaggcccatcccgaaggacaagctcgagggcctagtccgtgcctgctgcagccttggcggtgagcagggtcagcccgtgcatatgggtgaccccgagctgctgggtattaaagaactgtcgaagccagcatacggcgatgcaatggtatgccctcctggggaggtgccagtgttctggcctagcccccttacgagcctgggggcagtgagttcctgtgaaacccccctggcattcgcgtctattcctgggtgcactgttatgacagacctcaaggacgctaaagcaccaccaggctgtttgacacccgagcggatccctgaggtccaccacatatcccaggacccactccactattctatagcatcggttagcgccagccaaaagatccgtgaactcgagtccatgattggtatcgatccggggaaccgcggcatcgggcacctgctttgcaaagatgaacttcttaaggcttccctgagtttgtcacacgcccgaagcgtgttaatcacaacaggatttcccacgcactttaaccacgaaccacccgaggaaacagacggccctccaggggccgtggctctggttgccttcctgcaggcactggagaaggaggtggcaatcattgtggaccaacgcgcttggaatctgcaccagaagattgtggaagatgcggtcgagcaaggggttttgaagacccagatccctatcttaacctaccaaggtgggtctgtggaggcagcccaagcctttttatgtaagaacggcgaccctcagaccccctag

SEQ ID NO: 41128 - DNA, 480 bp, Artificial Sequence
  Description of Artificial Sequence: Synthetic coding sequence
atgcccttcaccctgcacctgcggagccggctgcccagcgccatccggagtctaatcctgcagaaaaagccgaatatccgtaacacatccagtatggctggagagctccgtcctgcctcattagttgtgctccccagatcattagcccctgcattcgagcgattttgccaggtaaacacgggacctctgcctttgctgggacaaagtgagcctgaaaaatggatgctcccaccacagggcgccatcagtgagacgtctctgagggacctgcactccgcttggcatcgtaccagcctgatgacagtcgcacaagaaagggcagctctccccaccgtgttgaccccgtccccaatcacttggaggctgtcctggctaaggtccctgcggtcttggcggaaaagctcccccggcgaaattcctctggccctgccgagcgtgcactctattgcgcaggcccgaaacccccccgtccaggactag

SEQ ID NO: 41129 - DNA, 1866 bp, Artificial Sequence
  Description of Artificial Sequence: Synthetic coding sequence
atgcccttcaccctgcacctgcggagccggctgcccagcgccatcaggtctctaatcctccaaaagaagcctaatattaggaacactagctcaatggccggtgaacttcggcccgcaagcctggtcgttctcccaaggtcgctagcaccagcctttgagcgcttctgtcaagtaaacaccggccccttgccacttttgggccagtctgagccagaaaaatggatgctgccccctcaaggtgcaatttcagaaacaaggatggggcacccgcagttctggaagtacgaatttggagcctgtaccgggtcgctagcttccttagagcagtacagtgagcaacttaaggacatggtggcatttttccttggttgctccttttcgctggaagaggccctagaaaaagccggacttcctaggagagaccctgctggacatagccaggccggagcctataaaacaaccgtgccgtgtgtgacccatgcagggttttgctgtcccctggttgtcacgatgcggccaatcccaaaggataagcttgagggacttgttagagcttgttgtagcctgggtggcgaacaagggcaacccgtgcatatgggcgacccggaactgttaggcattaaggagctgagtaagcccgcatacggcgacgctatggtgtgtccccctggggaggtcccagtgttctggccctcacctctgactagccttggagctgtgtccagttgtgaaacaccgctggcgttcgcctccatccccggctgcactgtgatgaccgatttaaaggacgctaaagctccaccaggctgcctgacccccgagcggattcccgaggtgcatcacatttctcaggaccctttgcactatagcattgcctcagtctcagcgtcccagaaaatacgagagctggaatccatgattgggattgaccccggcaatcggggtattgggcacctgttgtgcaaagatgagttactcaaggctagtttaagcctttcacacgccagatctgtcttgataacgacagggttccccacacattttaaccacgaaccacccgaagaaacagatggaccccccggcgctgtggctctcgtggccttcctgcaggccctggagaaggaagtggcaatcattgtcgatcagagagcttggaatctgcatcagaaaattgtggaagacgccgtggaacagggcgtactcaagacccaaattccaatcctaacatatcagggagggtctgttgaggcggcgcaagcatttctgtgtaaaaacggtgacccacagacaccccgctttgaccacctcgtggccatcgaaagggcagggagggccgctgacgggaactactacaacgccagaaagatgaatattaagcacctggtagaccctatcgatgatctcttcttggctgccaagaaaatccccggcatctcttcgactggggttggggatggtggtaacgagcttggtatgggcaaggtgaaggaggctgtacgcagacatatacgtcacggtgacgttatcgcgtgcgatgtcgaagctgattttgccgttattgcgggtgtgtccaattggggaggttacgcgctggcgtgtgctctctacattctgtattcctgcgccgtgcactctcagtatctgaggaaggctgtgggaccatctagggcccccggagaccaggcctggacccaagccctcccgtcggtaattaaggaggagaaaatgctggggatattggtccagcataaagtgcggagtggtgtgtcagggatcgtgggcatggaggtggacggtctaccctttcataacacgcacgccgaaatgattcaaaagctggtagacgtgacaacagcccaagtctag

SEQ ID NO: 41130 - DNA, 330 bp, Artificial Sequence
  Description of Artificial Sequence: Synthetic coding sequence
atgcccttcaccctgcacctgcggagccggctgcccagcgccatcaggagcttgattctacagaagaaacccaacatacggaacacgagctccatggccggggaactgcgtccagcgtcgttagttgttctacctcggtccctggctcccgcctttgagcgcttctgtcaagtaaatactggccccctccctctgctcggacaatcagaacctgagaagtggatgctgccaccacagggggccatcagtgaaacacgtatgggccatcctcagttctggaaatacgaattcggggcgtgcacgggaagtctcgctagtctcgaacagtag

SEQ ID NO: 41131 - DNA, 606 bp, Artificial Sequence
  Description of Artificial Sequence: Synthetic coding sequence
atgcccttcaccctgcacctgcggagccggctgcccagcgccatcagatccctcatactccagaaaaagccaaacattcgcaacacatctagtatggccggtgagctgcggccggcatccctggtcgtgttacctcgttctttggcccccgccttcgagcgtttttgccaagtaaatacaggccccctgcctctcctagggcagtccgagcctgaaaaatggatgttacctccccagggggccatctcggaaacacgcatgggacaccctcaattttggaagtatgagtttggagcatgtactggttccttggcaagtctggagcaatactctgagcaattgaaagatatggtggcctttttcctcggctgttctttttcgctggaggaagccctggagaaggctgggctgccaagacgcgatcctgccggtcactcccaggctggcgcatacaaaacaacagtcccttgcgtcactcatgccgggttctgttgtcccctcgtggtgactatgcgaccaatccccaaagataagcttgaaggactcgtgcgggcatgctgcagcttgggaggggagcagggtcaaccagtgcacatgggagactag

SEQ ID NO: 41132 - DNA, 1695 bp, Artificial Sequence
  Description of Artificial Sequence: Synthetic coding sequence
atgcccttcaccctgcacctgcggagccggctgcccagcgccatccgcagcctgattctccaaaagaagccaaatattaggaacacttcttctatggcaggtgagctgcgcccggcgtcccttgttgtgcttcccagatcactcgcgcctgcatttgagagattttgtcaggttaacaccggccctctgccactgttggggcaatcagaaccagaaaaatggatgctgcctccccagggcgcgatatctgaaacgcggatggggcacccacaattctggaagtatgagttcggggcatgtactggttccctggccagtcttgagcaatattctgaacaactgaaagatatggtagccttcttcttgggatgcagtttcagcttagaagaggcgctagaaaaagctggacttccccggcgagatcccgccggccactctcagacgactgtcccctgcgtgacccacgccggattttgctgccctctcgtggtgaccatgaggccaatccctaaggacaaactcgagggactggtgcgcgcttgctgttccctcggcgaactgctcggaatcaaggagctcagtaaacctgcatatggtgatgctatggtttgtccgcccggcgaggtccccgtattttggccttcaccgctgacctcattgggcgctgtctcctcctgtgagaccccactggcctttgcgtccattccagggtgcacagtcatgacagacctgaaggacgccaaggcccccccagggtgtctgacccccgagagaattccagaagtgcaccacatctctcaggaccctttgcattacagtatcgccagcgtgagtgcaagccagaagattagagagctcgaaagcatgatcggcattgacccagggaaccgtggcatcggccatctgctgtgtaaagacgagctgcttaaggcatctctgtctctctcccacgctcgctcggtgttgattaccacgggtttccccactcattttaatcatgaaccgccagaggagacggatgggccccctggagctgtcgctcttgtcgcatttctgcaggcgttagagaaggaggtggcgattattgtagaccaaagagcttggaatctgcatcagaagattgtggaggacgcagtggagcaaggggtcttgaagacacagatccccatactcacatatcagggaggcagcgttgaggctgcccaagccttcctttgcaagaacggagacccacagacccctaggttcgaccacttggtggccatcgagagggcagggcgggctgctgatggtaattattataacgccaggaaaatgaacattaagcatttggtcgaccccatcgatgacctgtttttagccgccaaaaagatccctggcatctcctccaccggggtgagtaattggggcgggtacgccctggcttgtgccctgtatatcctgtatagctgtgctgttcattctcagtacctcagaaaagccgttggtccaagcagggcaccgggtgatcaagcctggacgcaagctctaccctccgtgatcaaggaagagaagatgctcggaatactcgtgcagcacaaggtacgaagcggagtttctgggattgtgggaatggaagtcgacggcctaccttttcacaacacacacgccgaaatgattcaaaagctagtagatgtgacgacagctcaggtgtag

SEQ ID NO: 41133 - DNA, 378 bp, Artificial Sequence
  Description of Artificial Sequence: Synthetic coding sequence
atgcccttcaccctgcacctgcggagccggctgcccagcgccatccgctctctgatacttcagaagaagcccaatattcgcaatacctccagtatggctggtgaacttcgacctgcctcactggtggtgttgcctagaagccttgctcccgcattcgagcgattttgtcaggtgaacactgggcccctgcctctactgggacagtcagaacctgagaagtggatgctgcctccccagggagccatatcagaaacccgcatgggacatccgcagttctggaaatatgagtttggcgcctgtactgggagtttggcaagtcttgagcagtactctgaacagttgaaagatatggtggctttctttcttggctgttcttag

SEQ ID NO: 41134 - DNA, 1746 bp, Artificial Sequence
  Description of Artificial Sequence: Synthetic coding sequence
atgcccttcaccctgcacctgcggagccggctgcccagcgccatcaggtccctgatcttacagaagaaacctaacatccgtaacacgtcctctatggccggtgagttacgccctgcttccttggtagtgctgccccggtccctcgcgcccgccttcgaaagattttgccaggtgaataccggaccactccctctgctcggccagagtgagcctgagaagtggatgctcccccctcaaggagcaattagtgaaactcgcatgggacacccgcaattctggaagtatgagttcggagcatgcaccgggtctctcgcttcactggaacaatatagtgaacaactgaaagacatggtggctttctttctgggatgtagtttttcactggaagaggccctagagaaagctggtctgcctcgtcgagatccagctggtcactcacaggccggggcctataaaacaacggtcccttgtgttacacatgctggattttgttgtcccttggtggtgacgatgaggccaattccaaaggataaactagagggtcttgtgagggcctgctgtagtctagggggcgagcagggccagccggttcatatgggggacccggagctgctgggcatcaaggagctgtccaagcccgcttacggcgatgccatggtgtgtccacccggcgaggtgcccgttttttggccatcaccgctgacgagcttgggggcagtttcatcgtgtgaaacccccttggcattcgcatccattcccggttgcaccgtcatgaccgacctcaaggacgctaaagcccctcccggatgcctcacgccagagcggatccctgaagtgcaccacatttcacaggatcccctgcattacagtatagcctctgtttcggctagccagaaaatccgggagcttgagagtatgattggaatcgacccaggaaaccggggtattggccacttgctctgtaaggacgagcttttgaaagcctccctttctttatcccatgcccgcagcgtgcttattactaccggattccccacccatttcaaccatgaaccgcctgaggagacagatggcccccccggggctgtagcactcgtcgccttcctgcaagccctagaaaaagaggtggctatcattgtcgatcaaagagcatggaacttacatcagaaaattgtagaagatgccgtggagcagggtgtcctgaagactcagatccccatcctgacctaccagggcggcagtgtggaggcagcccaagcgtttctgtgtaagaacggcgatccccagactccgcggttcgatcacctggttgcaattgagagggcaggacgagctgcagacggcaactactataatgccaggaagatgaacataaaacatctcgtggatcctatcgatgatcttttcctggctgctaagaagataccaggaatttcatccacaggagtttcaaattgggggggatacgcgctggcgtgtgcgttgtatattctctacagctgcgccgttcattcgcagtacctgagaaaggctgtggggccaagccgagcacccggggaccaggcctggacccaggctctgccttccgtgatcaaggaggagaagatgctaggcattctggttcaacataaggtccgcagtggagtgtcaggcattgtcggcatggaagtggacggactcccgttccacaacacacatgccgagatgatccagaaactggtcgacgtaactaccgcacaagtctag

SEQ ID NO: 41135 - DNA, 78 bp, Artificial Sequence
  Description of Artificial Sequence: Synthetic coding sequence
atgcccttcaccctgcacctgcggagccggctgcccagcgccatccggagcctcattctccagaagaaacccaactag

SEQ ID NO: 41136 - DNA, 459 bp, Artificial Sequence
  Description of Artificial Sequence: Synthetic coding sequence
atgcccttcaccctgcacctgcggagccggctgcccagcgccatccggtcactcatccttcagaaaaagcccaatatcagaaacaccagctctatggcgggagaactcagaccagcctctctggtagtgctgcctagatcactggcacccgctttcgagaggttctgccaggtgaatacagggccactcccactcctagggcagagcgagccagaaaaatggatgctgccaccacagggagctatttcggagacaaggatgggacatccacagttttggaagtacgagtttggtgcatgcaccggcagcctcgccagtctcgagcagtatagtgaacagctgaaggatatggtggctttttttcttggttgctcattctcactggaggaagccctggagaaggctgggcttccacgccgagaccccgcgggtcattcccaagctggtgcttacaaatag

SEQ ID NO: 41137 - DNA, 609 bp, Artificial Sequence
  Description of Artificial Sequence: Synthetic coding sequence
atgcccttcaccctgcacctgcggagccggctgcccagcgccatccggtctctcattctccagaaaaaaccaaatatccgcaacacctccagtatggccggagaactgcggccggccagtctcgtggtcctcccacggtcgcttgcccccgcattcgagcggttctgtcaggtaaacaccggcccccttcccttactgggacaatcagagcccgagaaatggatgctgccccctcagggagcaatctcggagacgcgtatgggacacccccagttctggaagtacgagtttggagcatgtactgggtctctggcatcactagagcagtatagtgagcagctcaaggacatggttgcgttctttttaggctgcagcttctccctggaagaagccctggagaaggcaggcctgccaagaagggatcctgccggacattctcaagcaggcgcctataaaactaccgtaccttgtgtgacacacgcgggcttctgctgtcctctggtcgtgacgatgcgcccgatccccaaagacaaactggaaggtttagtgagggcttgttgctcattggggggcgaacagggccagcctgtgcacatgggcgacccatag

SEQ ID NO: 41138 - DNA, 1851 bp, Artificial Sequence
  Description of Artificial Sequence: Synthetic coding sequence
atgcccttcaccctgcacctgcggagccggctgcccagcgccatcagatcactgatcctgcagaagaagcctaatattcgcaacacatcctccatggccggagaactacgcccagcttctcttgtagtgctgccgaggtcattggcccctgctttcgaacggttctgccaggtgaacacaggccccctacctctcctgggacagagcgaacctgaaaaatggatgttaccaccccagggtgctatcagcgagactcgaatggggcatccacagttttggaaatatgagttcggggcatgcactggctcgcttgcgagtttggaacagtattcggaacagctgaaggacatggtggccttctttctgggctgtagcttcagcttggaggaagctcttgagaaagctgggttgccacgacgcgacccagcagggcactcgcagactactgtgccctgtgttacgcacgccgggttttgctgtcccctggtagttactatgaggcccatccccaaggacaaacttgagggcctcgttcgtgcctgttgctcgctcggcggggaacagggccagcctgtacacatgggtgaccctgaactcctggggatcaaggagctcagcaaacccgcttatggggatgcaatggtctgcccgcctggagaagtgcccgtgttttggccctcccccctcacttccctgggggctgttagctcctgcgaaactccgctggcattcgcatctattcccgggtgtactgttatgacagacctgaaggatgccaaggctcccccaggctgtctgaccccggagcggattcctgaggtccaccacattagccaggatccactgcactatagcattgcaagcgtaagcgcctcgcagaagataagggaactcgaatctatgataggcatcgaccctggcaatcggggaattggccatctgctctgtaaagacgaactccttaaagcaagtctgtctctgagtcacgcccggagcgtgttgattacgaccgggttcccaacacattttaatcatgaaccgccagaagagaccgacgggcccccaggtgctgtcgctctagtcgcctttctgcaggccctggaaaaggaagttgcaattattgtcgaccagagagcctggaacctacaccaaaagattgtcgaggatgcagttgaacagggggtgctcaagactcagattccgatattaacgtaccagggaggaagcgtggaagcggctcaggccttcctttgtaagaatggcgacccgcagacaccgcgtttcgatcatctcgtggctatcgagcgtgctggtagagcagctgatggaaactactacaacgcaaggaaaatgaatattaagcacctggtagatcccatcgatgacctcttcctagccgctaagaagatccccggcatttccagcaccggggttggtgatggaggaaacgaactagggatgggaaaagtgaaagaggcagtaagacggcatatccgtcacggggatgtgatcgcgtgcgacgtggaggccgatttcgctgtcatcgccggcgtaagtaactggggaggatacgcgctcgcttgcgctctgtatatcctgtatagctgcgcagtccactcgcagtacctcagaaaggctgtcggcccttcccgagctcctggcgatcaagcctggacacaagctctgccgtctgtcattaaggaggagaaaatgctaggcattctggtacagcataaggtacgctccggggtctctggaatagtcggtatggaggttgatgggttgccatttcacaacacgcacgcagagatgatacaaaaacttgtggatgtgacgaccgctcaggtctag

SEQ ID NO: 41139 - DNA, 258 bp, Artificial Sequence
  Description of Artificial Sequence: Synthetic coding sequence
atgcccttcaccctgcacctgcggagccggctgcccagcgccatccgatcactgattcttcaaaaaaaacccaacatcaggaacacgagttctatggctggggaacttaggcccgcctcactggtggtgctgccccggtccttggcacctgccttcgagagattctgtcaggtgaatacaggtccactccctttgctcggtcaatcagagccggaaaagtggatgctccccccacagggcgctatctcagagacttag

SEQ ID NO: 41140 - DNA, 1851 bp, Artificial Sequence
  Description of Artificial Sequence: Synthetic coding sequence
atgcccttcaccctgcacctgcggagccggctgcccagcgccatcagatctctaattctacagaagaagcctaacatccgaaataccagctcgatggccggggagctccggccagcctctttagtcgtgctgcctagatcgttagcccctgcatttgagaggttttgccaggtgaacacaggacccctgcctctcctgggccagtcagagcctgaaaaatggatgctcccgccccagggcgctatcagtgagactagaatgggccatcctcagttctggaagtacgaatttggtgcttgtactggcagtctcgcaagcctggagcaatatagcgagcagcttaaggatatggtcgccttcttcctaggatgctcctttagcctagaagaagccctggagaaagcaggcctacccagaagggaccctgcaggccattcccagaccaccgtcccctgcgtcacacatgcgggcttctgctgtccactggtggttacaatgcggcctatccctaaggacaagctggaaggcctggttagggcctgctgctcgttggggggggagcagggacagccggtgcacatgggagatcctgagcttcttggtattaaagaattgtctaaacctgcatatggagatgccatggtctgtccacccggggaggtgcctgtcttttggcccagcccgttgacaagtctgggtgcagtgagctcctgtgagaccccgctggcattcgcatcaattccaggctgcacagtgatgactgacctcaaggatgccaaggcaccaccaggttgcctgacacccgaacgaattcccgaggtccaccacatcagccaggatcccctgcactactctatcgcttctgtgagcgcctctcagaagatcagagagttagagtctatgataggcatagatcctggtaatagggggattgggcacctgctgtgtaaagatgagctgctcaaggctagtctgtctttgtcccatgctcggtcagttcttattacaaccgggttccccacgcacttcaatcatgaaccccctgaggagaccgacggtcccccaggagcagtagccttggtggcttttctccaggcattagaaaaggaagtagcgatcatcgtggatcagagagcctggaatctgcatcaaaaaattgttgaggacgccgtggaacaaggtgtgcttaaaactcagattccaatcctgacatatcagggcgggtcggtggaagccgctcaggcatttctgtgtaagaacggtgatcctcaaactcctaggtttgaccatctagtcgcaatagagcgtgcaggaagggcggccgacggtaactactataacgctcgaaagatgaacatcaaacatctggtcgaccctattgatgacttgttccttgcagcaaagaagattcccggaatctcatcaactggtgttggggacgggggaaacgaattgggaatgggtaaagtcaaggaggcagtccgacgccacatccgtcacggggacgtgatcgcctgcgatgtggaggcagactttgcagtgattgccggtgtaagcaactggggtggatatgcacttgcttgcgccctgtatatactctacagctgtgcggtgcacagccagtatctccgaaaggccgtcggcccttcaagggccccaggcgaccaggcctggactcaggccttgccttctgttatcaaagaagagaagatgctcggcatcctggtgcaacataaagtccgctcaggtgtgtccggtattgtcggaatggaggtcgatggacttccctttcacaacacccatgccgaaatgattcagaagcttgtggacgttaccacagcgcaagtgtag

SEQ ID NO: 41141 - DNA, 1851 bp, Artificial Sequence
  Description of Artificial Sequence: Synthetic coding sequence
atgcccttcaccctgcacctgcggagccggctgcccagcgccatccgctctttgattcttcagaagaagccaaatatccgcaacaccagcagcatggccggggagctgcgccctgccagtcttgtcgtgctccccaggagccttgccccggccttcgaaaggttctgccaggtgaatacagggcccctgccactgttggggcagtctgagcccgaaaagtggatgcttccgccacaaggagctatttcggagacgcggatgggccacccccagttctggaagtacgagttcggagcctgtacaggctccctggcttctctggaacagtattcggagcagctgaaagatatggttgcattctttctggggtgtagtttcagcctggaagaggcccttgagaaggcaggattaccaagacgggatccggctggtcatagccagactactgttccatgtgttacccacgccgggttttgttgccctctggttgttactatgcgtccgattcccaaagataaattggagggcttagtgagggcatgttgctcattggggggcgagcaaggtcagccggtccatatgggggaccccgagctgctggggataaaagaactttctaaacctgcatatggggacgctatggtctgccccccaggagaggtaccggtgttctggccctcccccctgactagcttgggtgccgtgagtagttgcgagacaccattggccttcgcatctattcctggctgcacggtgatgacagacttaaaagatgctaaggcccccccaggatgtctcacacctgagaggatcccagaggtgcaccacatcagccaggaccctctgcattattccatcgcctccgtgtctgccagtcagaagatccgggagcttgagagcatgatcggtatcgacccaggcaatcgcggtatcggacatctcctttgcaaagatgaattgttgaaagcctcactgtccctatcccatgctaggagtgtgctgatcacaactgggttcccgacccacttcaatcatgaaccacccgaggagaccgatggcccaccaggggcagttgctctcgtcgcttttctgcaagctctggagaaggaggttgcgatcatagtagaccaacgcgcctggaacttgcaccagaagatcgtggaagatgccgtagagcagggcgtgttgaaaacacagatcccaatcctaacataccaagggggaagcgtggaggcggctcaggctttcctgtgcaaaaacggggatcctcagactccccgctttgaccacttagtggcaatcgagcgagcgggacgcgcggctgacggaaactattataatgcccgcaagatgaatatcaaacacctagtagacccaattgacgacctttttttggctgccaagaaaatccccggaatcagttcaaccggagttggtgacggcggaaatgagctgggaatgggcaaagtgaaagaagccgtgcgtcgacacatacgccacggagatgtcatcgcatgcgacgtcgaagcagactttgccgttatcgccggcgtgtccaactggggcgggtacgcattagcctgtgctctttatatcttgtattcctgcgccgtgcactcccaatatttgcgtaaggcagtaggaccttccagagctcctggagaccaagcttggacccaggcccttcccagcgtcatcaaggaagagaaaatgctcggcatcctggtacagcataaggtgagatcgggcgtgtctggtatcgttgggatggaagtcgacggtttaccatttcacaacacgcacgccgaaatgatccagaagctggtggatgtcacgacggcacaagtctag

SEQ ID NO: 41142 - DNA, 252 bp, Artificial Sequence
  Description of Artificial Sequence: Synthetic coding sequence
atgcccttcaccctgcacctgcggagccggctgcccagcgccatcaggtctctgattttgcagaagaagccaaatatccggaacacgtccagcatggcaggcgaactgaggcccgcctccctggtggtcttaccacggtccctcgctccggcctttgagcgattctgccaggtcaacaccggtcctcttcccctcctcggacagtcggagccagaaaagtggatgctaccacctcaaggcgcaatcagctag

SEQ ID NO: 41143 - DNA, 459 bp, Artificial Sequence
  Description of Artificial Sequence: Synthetic coding sequence
atgcccttcaccctgcacctgcggagccggctgcccagcgccatcaggtctctgatcctccagaagaagcccaacattcgcaacacaagctccatggcaggcgagctgcgtcccgcctccctcgtggtgctgcctcgcagtttggcacccgcctttgaacggttctgccaggtaaatacaggaccgctgccactgctaggccagagtgagcccgagaagtggatgctgccgccccagggagcaattagtgagacgaggatgggtcatcctcagttctggaaatatgagttcggcgcttgcaccgggtctctggccagtctggaacagtactcagaacagctgaaggacatggtcgcgttctttctgggatgcagcttcagcctggaggaggctctggaaaaggccgggctcccccgcagggatcctgcaggtcactcgcaggccggagcttataagtag

SEQ ID NO: 41144 - DNA, 159 bp, Artificial Sequence
  Description of Artificial Sequence: Synthetic coding sequence
atgcccttcaccctgcacctgcggagccggctgcccagcgccatccgatctctgatcctgcaaaagaagcccaacatcagaaacacctcctcaatggccggggaactccggcctgcaagcctggtcgtgttgcctcgcagcttagctcccgctttttag

SEQ ID NO: 41145 - DNA, 1479 bp, Artificial Sequence
  Description of Artificial Sequence: Synthetic coding sequence
atggtggccttcttcctgggctgcagcttcagcctggaggaggccctagaaaaggcgggagcctacaaaaccacggttccttgcgtcacacatgcgggtttctgctgccccttggtcgtaacaatgcggcctatcccgaaagataaactagaaggcctggtccgcgcctgctgctctctcgggggagagcagggtcagccggttcacatgggggacccggaacttctgggaattaaagagctctcaaagcccgcatacggcgatgcgatggtgtgcccgccaggagaggtgccggtgttctggccaagtcctctaactagtttaggcgctgtttcctcctgtgagactccgctggctttcgcatcgatcccaggatgcacagtgatgactgaccttaaagacgccaaggcaccacctggttgcctgacccccgagcgcatccctgaagtacatcacatttcgcaggatccacttcattattcaatagcatcagtcagtgcatctcagaagattagagaactggagtctatgatcggaatcgaccccggaaaccgtggcattggtcacctactatgtaaagacgaactactcaaggctagtcttagtctgtctcatgccagatcagtattgattaccacagggttcccaacccactttaaccacgagcctcctgaggagacagatgggcccccaggcgctgtggccttggttgcatttctacaggctctcgagaaagaggtcgccatcatcgtggaccagcgggcgtggaatctgcatcagaaaatcgtagaggacgccgtcgagcaaggagtcctcaaaactcagatcccaattcttacataccaaggcggatccgtggaggcggctcaagcctttctctgcaaaaatggagacccccagacccctaggttcgaccatctggtcgctatagagagagctgggcgggctgcagatggtaactattataacgcccgaaagatgaatatcaaacacctcgttgatcctattgacgatctattcctggccgcgaaaaagatcccaggtatttcctccaccggcgtgggtgatgggggaaacgagctcggaatgggcaaggtgaaggaagccgtaagacgccacatacgtcacggcgatgtgatagcttgtgacgtagaggctgactttgcagtgattgccggggtgagtaattgggggggctatgccctggcgtgcgctctctacattttatacagctgcgctgtgcatagccaatatctgcgcaaagcagtgggcccatctcgagcaccgggagatcaggcttggacccaggccctcccctccgttataaaagaagagaagatgctcggcatccttgtgcagcacaaagtcaggagtggcgtatcagggattgtgggtatggaggtggatggactgcctttccataacactcatgccgagatgattcagaagctggtcgatgtcacgaccgctcaggtctag

SEQ ID NO: 41146 - DNA, 483 bp, Artificial Sequence
  Description of Artificial Sequence: Synthetic coding sequence
atgcggaccgccgccggcgccgtgagccccgacagccggcccgagactaggagacaaactcgtaaaaatgaggaggctgcctggggtcctagggtgtgtagagcggaacgtgaagacaacagaaaatgtccccctagcatcctgaaacgttctaggcccgaacatcacagacccgaggccaagccacagcgaacctctcgccgagtttggttccgggaaccgccagctgtcaccgtccactatattgccgacaaaaatgcaacagcaacggtaagggtgccgggtaggccacggccacacgggggcagtcttctccttcagctctgcgtttgtgtgttgcttgtgctggctctcggtctatactgtggacgcgcaaaaccagtagccacggccctcgaagacttgagggccaggctcttgggcctcgtgctccacctgcgccacgttgccctgacatgttggcggggcctcttacggttgtag

SEQ ID NO: 41147 - DNA, 483 bp, Artificial Sequence
  Description of Artificial Sequence: Synthetic coding sequence
atgcggaccgccgccggcgccgtgagccccgacagccggcccgagacacggcgacaaacgcgcaagaatgaagaggcagcttggggtccacgggtctgtcgtgcagagcgcgaggataacagaaagtgtcctccatccatccttaaaagatcacgaccagagcaccacagaccagaggccaaaccacagcggacttcccggagagtctggttccgcgaacctcctgccgtgaccgtgcactatatcgccgataagaatgcgaccgccaccgtcagggtgccgggcaggccccgcccacacggaggatcgctcctcctgcagctgtgtgtgtgtgtgctgctcgtcctcgctttgggactgtattgcgggagagcaaaaccagttgcaactgctttagaagacctgcgcgcacgcctgctgggtttggttttgcacctgcgccacgtggccctcacttgctggcgtggattgctgcggctctag

SEQ ID NO: 41148 - DNA, 2325 bp, Artificial Sequence
  Description of Artificial Sequence: Synthetic coding sequence
atgcggggccccatcgtgctgcacatctgcctggccttctgcagcctcttactgttcagcgtggctacccaatgcttagcatttccaaagatagagagacgacgcgagatagctcatgtgcacgccgaaaagggccaatctgacaagatgaacactgacgatctggagaattcttctgttacttcgaagcagacaccacagctggtggtgtccgaggatcctatgatgatgtctgcagtcccctcagcgacgtcacttaacaaagccttcagtattaacaaagaaacccagccaggccaagcaggccttatgcagacggaacggcccggcgtcagcacacccaccgaaagtggggtgccatccgccgaggaggtgttcggaagttcccagcctgaaaggatctctcctgagtccggtctggccaaagcaatgcttacaattgccattacagccactcctagcctcacggtagatgagaaggaagaactgctgaccagcacaaattttcagcccatcgtcgaagaaattaccgaaacaaccaaaggcttcctcaagtacatggataatcaatcctttgctacagagtcccaggagggggtgggtctggggcactcaccatcatcttatgtaaacaccaaagagatgttgaccaccaatcctaaaaccgaaaagtttgaggcagatacagatcatcgtacaactagctttccaggagcagaaagtaccgctggcagcgaacctggatcgctaaccccagacaaggagaaaccttctcaaatgacagccgataacacacaagctgccgccacgaagcagccattggaaacatcagagtatacgctatccgtggagcccgaaaccgattccttgctgggggcaccggaggtcactgtgagcgtaagcacagcagtccctgcagcaagtgccctttcagacgagtgggacgacaccaagctcgaatcggtttctagaattaggacaccaaagctgggcgacaacgaggaaacacaggtgcggaccgaaatgtcgcaaaccgcgcaggtgagccacgaaggtatggaaggtggccagccctggactgaggcagcccaggtggccttgggactacccgaaggcgagactcatacaggcacagccctcctcattgcgcatggaaatgaacgctcccctgcctttactgatcagagtagtttcactcccacctcactcatggaggatatgaaagtttcaattgtcaatctgctgcaaagcactggagactttacggagtccacgaaggagaacgacgccctgttctttcttgaaactacggtcagcgtttcagtgtacgagagcgaagccgatcagctgcttggaaacaccatgaaggacatcataacacaggagatgactaccgccgtgcaggaacctgatgcaaccttatccatggtgactcaggaacaggtggccactctggaactgatcagggacagcgggaaaaccgaggaagagaaggaggacccctccccagtgtctgatgtccccggagtaactcagctgtcaaggagatgggaacccttggccaccactatctccaccacggtggtaccgctatccttcgaagtgacccccacagtagaggagcagatggacactgtgaccggcccgaatgaggagtttacgcctgtgctagggagtccagttaccccgcccggcatcatggtgggggagccctctatctctccagccctcccggcactcgaggcgtcctctgaacgaagaactgtggtgcccagtattacgcgcgttaacacagccgcaagctacgggctggatcagctggagtccgaggaaggacaggaggacgaggacgaagaagacgaggaggacgaagacgaagaggaggaagacgaagaggaagatgaggaggacaaagatgctgatagccttgacgagggcctagacggggatacggagttgccgggattcactcttcccggaatcactagccaggagccaggcctagaggaaggaaatatggatctgctggagggcgcgacttatcaagtccccgatgccctggagtgggaacaacagaatcaggggcttgtgaggagctggatggaaaaactgaaggacaaagccggttatatgtccgggatgctcgtacccgttggggtggggattgcaggcgctctgtttattcttggcgccctgtattcaataaaggttatgaataggaggcgcagaaacggcttcaaaagacacaagagaaagcagcgtgaattcaactccatgcaggaccgtgtgatgcttctggctgactcctctgaggatgagttttag

SEQ ID NO: 41149 - DNA, 729 bp, Artificial Sequence
  Description of Artificial Sequence: Synthetic coding sequence
atggccgccgccctgtggggcttcttccccgtgctgctgctgctgctgttgagcggagacgttcagtccagcgaggtgcccggagctgcagcagagggaagcggaggaagcggcgtggggataggggatagatttaaaatcgaaggccgggccgtagttcccggcgtgaagccccaggactggatctcggctgctcgggtactcgtcgacggagaagagcatgtgggtttcttgaagactgatggcagcttcgtcgtccacgatattccaagcgggtcctacgttgtggaggttgtgtcccccgcgtaccgcttcgatcccgtaagggtcgatattacatctaaaggaaagatgcgggcgaggtatgtaaattacattaaaacctctgaagtggtgcggctgccctatccattgcaaatgaagtcgtctggtcccccttcctatttcataaaacgcgaaagctggggttggactgactttctcatgaaccccatggtaatgatgatggttctgccactactcatattcgtgctcctgccaaaggtggtgaacacatctgaccctgatatgagacgcgaaatggaacagagtatgaacatgctgaactctaatcacgaactgccagacgtgtcagaattcatgactaggctattttcctccaagagtagtggaaagtcttcaagcggatcttccaaaaccgggaagagcggcgcaggcaagcgccggtag

SEQ ID NO: 41150 - DNA, 1596 bp, Artificial Sequence
  Description of Artificial Sequence: Synthetic coding sequence
atggccgtggcccccagcttcaacatgaccaacccccagcccgccattgaaggaggcatctctgaagtcgagataatttcacagcaggtggacgaagagactaaatccatcgctcccgtccagctcgtgaactttgcctatcgcgacttacccctggccgcagtggacttaagtaccgccggatctcagctcctttcgaatctggacgaggactaccagagagaagggtccaattggctcaagccctgttgcgggaagcgggctgcggtctggcaggttttcctcctgagcgcctcactcaattcatttctggtggcctgcgtgatcctggttgtgatcctccttaccctggagcttttaatcgatatcaaactgctgcaattttcgagcgcctttcagttcgcaggggtgattcactggatcagccttgtgatactgagtgtgttcttctctgaaacggttctcagaattgtggtgctgggtatttgggactatatcgagaataaaattgaggtgttcgacggcgctgtgatcattctgtcccttgcccctatggtagcatcaaccgtagctaacggaccgcgcagtccatgggatgcaatctccctgatcataatgctgcgcatctggcgtgtcaagagggtgattgacgcatacgtgttgcccgtgaagctggaaatggagatggtgattcagcaatacgaaaaagctaaggttatccaagacgagcagttggagcgcctaacacagatttgccaggaacagggcttcgagatcagacagctgagagctcatctggcacaacaggatcttgaccttgcagcagaacgggaagccgctcttcaagcacctcacgtcttgtcacagccccggagccgttttaaagttctcgaagccgggacctgggatgaggagaccgcagccgagagtgtcgtggaagaactgcagccaagtcaggaggccacgatgaaagacgatatgaattcgtacataagtcagtattacaatggcccgtcctccgatagcggcgttcccgagcccgccgtttgtatggttacgaccgctgctatcgacatccaccagcccaatatttccagcgacctctttagtcttgacatgcccctcaagctgggcggaaacggcacgagcgccactagcgagtcagccagccgatccagtgtcactagagctcaatcagactcatctcaaacactcggctcttcaatggactgcagcacggccagggaagagccttctagcgagcctggcccaagcccccctcccctaccctcccaacagcaggttgaagaggcaacggtccaagacttgctgtcctcactttccgaagatccttgtccatcacagaaagccttggatcctgctccacttgcccgtccttccccggctggttctgcacaaacctcaccagaattagagcaccgcgtttctctttttaaccagaaaaaccaagaaggctttacggtcttccagatcagaccagtgatccactttcagcctactgtcccgatgctggaggataagtttcggtctcttgagtcgaaggaacagaagctgcatcgagtcccagaggcttag

SEQ ID NO: 41151 - DNA, 252 bp, Artificial Sequence
  Description of Artificial Sequence: Synthetic coding sequence
atgagcttcttccagctgctgatgaagcggaaggagctgatccccctggtggtcttcatgaccgttgcggcgggaggggcttcaagctttgcagtgtattcactctggaagacggacgtgattctcgatcgtaaaaagaatccagagccctgggaaaccgtggaccccaccgtacctcaaaagctgataacaatcaaccagcagtggaagccaattgaggagttgcagaacgtgcagcgtgtgactaagtag

SEQ ID NO: 41152 - DNA, 252 bp, Artificial Sequence
  Description of Artificial Sequence: Synthetic coding sequence
atgagcttcttccagctgctgatgaagcggaaggagctgatcccccttgtagtcttcatgaccgtggccgctggcggagcgtcctcctttgcagtctacagtttgtggaaaacagatgtcattctggacagaaagaagaatcctgaaccctgggaaacggtggatccaacggtgcctcagaagttgattactattaaccagcagtggaaaccgattgaagagctccaaaatgtgcaaagagtcacaaaatag

SEQ ID NO: 41153 - DNA, 528 bp, Artificial Sequence
  Description of Artificial Sequence: Synthetic coding sequence
atggagacctggcggaagggcagcttccggaacgccagcttcttcaagcagctgagcctgggaagaccaagacgccttagaagacagtcaagcgtcctgagccaagccagtacagccgggggcgaccatgaagaatatagtaatagggaagtgattcgggagttgcagggtaggcctgatggtcggaggctccctttgtggggagatgagcaaccaagggcgacactcctggcgccccccaaaccacctcggctttatagagaaagctcttcctgccctaacatcctggaaccaccccctgcttacaccgccgcgtactcggcaactttgcccagcgcgctcagcttaagttctgcccttcatcaacattctgaaaaaggactcgtagacacaccttgctttcagcgcactcctacacctgatctttctgatccattccttagcttcaaagttgaccttgggattagtctcctggaggaagttctgcagatgctgagggagcagttcccgtctgagcctagtttttag

SEQ ID NO: 41154 - DNA, 528 bp, Artificial Sequence
  Description of Artificial Sequence: Synthetic coding sequence
atggagacctggcggaagggcagcttccggaacgccagcttcttcaagcagctctcactggggcgccctcgacgcctccggcgacagagtagtgtgcttagccaagcgagcacggctggtggcgaccatgaggagtacagcaatcgcgaagtgataagagaactccagggcaggccagatggccgtagattacccttgtggggggacgaacaacctagggcaacccttctggctccacctaagcccccccggctgtatcgcgaaagctcgagttgccccaacatcctggagcctcccccagcttataccgccgcctactccgcaaccctgccaagtgctctgtcacttagtagcgctttacaccaacatagcgaaaagggcctggtggatactccctgttttcagagaaccccaacgcccgatctatccgatccattccttagcttcaaggtcgacttgggcatttctctcctcgaagaggtgctgcagatgctgcgagaacagttcccttctgagccctcattttag

SEQ ID NO: 41155 - DNA, 675 bp, Artificial Sequence
  Description of Artificial Sequence: Synthetic coding sequence
atgcccctgacccccgagccccccagcggccgggtggagggcccccccgcttgggaagccgcaccatggccgagcttgccgtgcgggccatgcattcccatcatgcttgtattggccacacttgccgcattgttcattcttaccacagcggtgctggccgaacgtctgtttaggcgcgccctaaggccagatccctcccatcgagctcccaccctggtttggagaccaggcggagagctctggatcgaacctatgggaacagctcgcgagagatccgaggattggtacggatctgcagttcctctcctaaccgatagggcaccagaacctcctacacaggtgggcaccctcgaggcgagggccacggctccgcccgccccatcggccccaaatagcgcccccagcaaccttggccctcagaccgtgctggaagttcccgctcgcagtactttctggggcccacagccatgggaaggcagaccacctgcaaccggtttggtttcatgggctgagccagaacagcgaccagaggcatccgtgcaatttggttcacctcaggcgaggcggcagcgccctggaagtcctgacccagagtgggggctgcagccacgggtgacgctggagcagattagtgcattttggaaaagggaagggcgcacatcagtcggattctag

SEQ ID NO: 41156 - DNA, 1407 bp, Artificial Sequence
  Description of Artificial Sequence: Synthetic coding sequence
atggccgacgacgccggcctggagacccccctgtgcagcgagcagttcggcagtggagaggctcgtggatgcagagcagcagctgatggatccctacagtgggaagtgggcggatggcggtggtggggcttgagccgagcttttacagttaagccagagggccgagatgcaggtgaggttggggccagtggcgccccttcccctcccctctctgggctccaggccgtgttcctccctcagggatttccagattccgtgtcacccgactacttaccatatcaactgtgggacagcgtgcaagcctttgccagttccttgtccggaagtcttgctacccaagcagtgcttttgggcatcggcgtgggtaacgccaaggcgaccgtctctgctgccactgctacctggttggtgaaagacagtacaggaatgctgggacgtatcgtgttcgcctggtggaaagggtccaaattggattgcaacgctaaacagtggagactctttgcggatatccttaatgatgtggcaatgtttctggagatcatggcaccagtctaccctatttgcttcaccatgaccgtgtctacctctaacctggctaagtgtatagtgtccgtcgctggcggggccacaagggccgcccttaccgtgcaccaggcacgccgcaacaacatggccgacgtgtctgctaaggattcttcccaggagaccttagtgaatctggcaggactcctggtatcgctcctcatgctgccattggtgagtggctgccccggattctcactggggtgttttttcttcctgacggcattgcacatctatgcgaactatagagcggtacgcgctttggtcatggagaccttgaatgaaggccggttaagattggtgttaaagcattaccttcagagaggcgaagtgctggacccaactgctgcaaataggatggagcccctgtggaccgggttctggcccgcgcctagcctgagtctcggagttccgctgcaccgtttggtcagcagcgtgtttgagttacagcagttggtggaaggtcaccaggagagctacctgctgtgctgggaccagtcccagaaccaagtgcaggtcgtgctcaatcagaaggccggccctaagacgattctgcgggctgcgacacacgggctgatgctgggggctctccaaggcgacgggcctctgcctgccgagctggaagagctccggaacagggtcagggccggccctaaaaaagagtcatgggtggtggtcaaagagacccacgaggtgcttgacatgctcttcccaaagtttcttaagggtctgcaagacgctgggtggaagacggagaagcatcaactagaggtggacgagtggagagccacgtggttgctgtcgcctgaaaaaaaggtgttgtag

SEQ ID NO: 41157 - DNA, 585 bp, Artificial Sequence
  Description of Artificial Sequence: Synthetic coding sequence
atgctgggccggatcgtgttcgcctggtggaagggcagcaagctggattgcaacgcaaaacagtggagactattcgctgatatcttgaatgatgtagctatgttcttggagatcatggcacctgtctatcctatctgttttacaatgaccgtgtctactagcaatctggccaagtgtattgttagtgtggcaggcggtgcaactcgggccgccctgacagtgcaccaggcacggaggaataatatggctgacgtgagtgctaaggacagctcccaggagaccctggtaaacctcgctggactgctagtcagtctgctgatgctgcccctggtttcaggctgcccaggtttttcgctggggtgttttttcttcctgactgcactccacatctacgcaaactatagagccgtgagagcactggtgatggaaacactgaatgagggaagactccgcctcgtgttaaaacactaccttcagagaggcgaggttctggatccgacagcagccaatcggatggagcctctgtggactggcgatccggcccctggactgggttcctgtgtgtccaccagcccaacagcttag

SEQ ID NO: 41158 - DNA, 1269 bp, Artificial Sequence
  Description of Artificial Sequence: Synthetic coding sequence
atggccgacgacgccggcctggagacccccctgtgcagcgagcagtttggaagtggagaggcgcgaggatgtagggccgctgccgacgggtcattgccgcaagggttcccagattcggtttcacctgactacctgccctatcaactttgggacagcgtgcaggcctttgcttcttccctttcaggatcacttgccactcaagccgtgctgctcggcatcggtgtgggtaacgctaaggcgacagtctcagcagccacagcaacatggttggtgaaggattccaccgggatgttgggccggattgtgtttgcatggtggaaggggtcgaagctggactgtaacgccaaacagtggcgtctattcgcagacattctgaatgacgtggcaatgtttttggagataatggcgccggtctacccaatctgtttcacaatgacagtttctaccagtaatctcgccaaatgcatagtgagtgttgctgggggcgcgactagagctgccctaactgtgcatcaagctcggagaaacaacatggccgacgtgagcgcgaaggactcttctcaggagacactcgtcaatctagccgggctgctggtaagccttctgatgctgccactggtatctggctgtcctggattcagtttggggtgcttttttttcctgaccgcactgcatatctacgccaattatcgagccgtgagggctctggtcatggaaacgctgaacgaggggcgcctgcgcctggtattgaagcattacttacagcgtggcgaggtgctggatcctactgctgccaaccgaatggagcccctgtggactggattctggccagccccatcactctctctgggagtcccgttgcatcgtttagtgtcttcagtgttcgagcttcagcagctggtagaaggccatcaggaaagctacctgctgtgttgggatcagtcacaaaatcaggttcaggttgtcctgaatcagaaggccggtccgaaaaccatcctccgcgctgccacgcatggcctgatgctcggcgccctacagggggatggacctctccctgctgaactggaggagctccgcaatagggtccgcgccgggccgaagaaggaatcctgggtcgttgttaaagaaacccacgaggttcttgatatgctgttccctaagtttttgaagggattgcaagatgccggatggaaaacagaaaaacaccagctcgaggtggacgaatggagagcaacatggctactctctccagaaaaaaaggttttgtag

SEQ ID NO: 41159 - DNA, 471 bp, Artificial Sequence
  Description of Artificial Sequence: Synthetic coding sequence
atggccgacgacgccggcctggagacccccctgtgcagcgagcagtttggaagcggtgaagcaagggggtgccgggcagcagccgatggctccttacagtgggaagtggggggctggcggtggtgggggctgagtcgggccttcacagtgaaaccagagggtcgcgacgctggagaagtgggagccagtggagcaccctctcccccactcagtgggttgcaggcagtgtttcttccacaggggtttcccgattccgtctctccagattacttgccataccagttgtgggactccgtgcaagctttcgcatctagtctgtctggctcgttagccacacaggcagttcttttagggataggcgtaggcaacgcgaaagctacagtctccgccgcaacagcaacttggcttgtgaaggattccactggaatgctgggacggattgtcttcgcctggtggaaaggagcatcatag

SEQ ID NO: 41160 - DNA, 2892 bp, Artificial Sequence
  Description of Artificial Sequence: Synthetic coding sequence
atggccgtgttcccctggcacagccggaaccggaactacaaggccgagttcgcttcctgcaggttagaggccgtcccactcgaattcggtgactaccacccgctcaaaccaatcactgtcaccgagtccaagacaaaaaaggtaaaccgcaagggctccacatcttctaccagcagcagctccagctcaagtgtggtcgaccccttgagtagtgtgctggacggcaccgatcccctatccatgttcgccgctacagccgaccccgctgccctggcggctgccatggactcctctcgtcgaaaaagagacagagatgataactcagtggtaggctctgattttgaaccatggactaataaacgaggggagattctggcgcgctacacaaccactgagaagttgtctatcaacctgtttatgggctcagaaaagggcaaggctggcaccgccactctagctatgtctgaaaaggttaggaccaggctcgaggaactcgacgatttcgaggaggggtcacagaaagagctgcttaacctgacccagcaagattatgtgaatcggattgaagagcttaaccagtcccttaaagacgcttgggcatcagaccagaaagtcaaagccctgaagattgttatccaatgcagcaaattgctttccgacacgtcagttatacagttctacccatccaagtttgtattgataacagatattttagacaccttcggcaaactggtgtacgagcgaattttctccatgtgtgtagacagcaggtccgtcctcccggaccactttagtcctgaaaacgcaaatgatacggctaaagaaacatgtctcaactggttcttcaaaatcgcctctatccgggaattgatcccccgattctacgtagaggccagtatactgaaatgcaacaagttcctatccaaaactgggataagtgagtgcctgccacgcctcacttgcatgattcggggaatcggtgacccattagtatcggtttacgcgcgggcatacctgtgcagggttggcatggaggtggccccccacctcaaggaaacactgaacaaaaacttcttcgatttccttctcaccttcaaacagatccacggcgatacggtacagaatcagctggtcgtgcagggggtggagctcccgtcatacctccccctctatccaccggccatggattggattttccaatgcatttcataccatgcccctgaggctctattgacagaaatgatggagcgctgtaagaagctgggcaacaacgcactcttgttaaactctgtgatgtcagcctttcgggccgagttcatcgcgacaaggtctatggactttattggaatgatcaaggaatgtgatgagagtggctttcccaagcatctgttattccgcagtctgggactgaatctcgctttagccgatccccctgagagcgatcgtttacagatccttaacgaggcatggaaggtgattaccaaattaaagaaccctcaggactatatcaactgcgccgaagtgtgggtggagtacacttgtaagcacttcacgaaaagggaggtaaatacagtactcgcagacgtgataaaacatatgacccccgatcgggcctttgaagattcctacccccagctccagctaattatcaagaaggtgattgctcactttcatgatttttcggtgctgttctccgtggaaaaattcctgcctttcctggacatgtttcagaaagagtctgtgcgtgtagaagtgtgtaagtgtataatggatgccttcatcaagcaccagcaagagccgactaaggatcccgttatcttaaatgcgctgctccacgtgtgtaagacaatgcatgattctgtgaatgcactgaccctggaggacgaaaaaagaatgctgtcctacttgattaatggcttcatcaagatggtgtccttcggacgagatttcgagcagcagctttctttttacgtggaaagccgatctatgttctgtaatctcgagccggtcctcgtgcagctgatccattccgtcaataggctagccatggaaacgcggaaggttatgaaggggaatcatagtcgaaagacagcagcttttgtccgggcttgcgtggcctattgtttcataacaataccctctcttgctgggatatttaccaggctaaacctgtatttgcacagcggacaggttgccctggccaatcaatgtctgagtcaggcggatgccttcttcaaggctgccatcagtcttgtgccggaggtacctaagatgataaatatcgatgggaaaatgagaccctcagagtccttcctgttggaatttctgtgtaattttttttcaacgttgctcatagtacccgaccatcccgagcatggggtcctctttttggtacgtgaactccttaacgtgatccaggattatacttgggaggacaactccgatgaaaaaattcgaatttacacatgcgtcctgcacctcttgtcagccatgagccaggagacctatctctatcacattgataaagtagactctaacgactccctgtatgggggggatagtaagttccttgcagaaaataacaaactatgtgagacagtgatggcacagatcctcgaacacctgaagaccctggcaaaggatgaggctttgaaacggcagtcatccctcggcttgtccttctttaactctatcctggcacacggagatcttagaaacaataagctcaatcagctctccgtcaacttgtggcatctcgcacagagacacggttgtgccgacacaagaacaatggtcaagacccttgagtacattaaaaagcagagtaaacaaccggacatgactcacctcacagagctcgcactgaggttacctttgcagacgcgcacatag

SEQ ID NO: 41161 - DNA, 2613 bp, Artificial Sequence
  Description of Artificial Sequence: Synthetic coding sequence
atggccgtgttcccctggcacagccggaaccggaactacaaggccgagtttgcaagctgtcggctcgaagccgtgcccctggagtttggtgattatcacccccttaaacctatcaccgttactgagagtaaaaccaaaaaagtgaaccgaaaagggagtactagttctacctcatcctctagttcatcgagcgtggtagacccattgagtagcgtgctcgatgggaccgatcccttgtccatgtttgccgcgacagcagaccccgcagctttagccgccgccatggacagttcacgaagaaaacgagaccgggatgacaattctgtcgtgggcagtgactttgagccctggacaaataagaggggcgaaatcctggccagatacactaccaccgaaaaactctcaatcaatctctttatgggatccgagaagggtaaagccgggacagccaccctcgctatgagtgaaaaagttcggaccagactcgaagagctggacgactttgaagaaggctctcaaaaggagctgttgaacttaacccagcaggactatgtgaatcgcattgaggagcttaaccagtcactcaaagatgcttgggcctccgatcagaaggtaaaggccttaaagatcgtcatacaatgtagcaagttgttgagcgatacctccgtgatccaattctatccttccaagttcgttctgatcacagacatcctggacacatttggaaaattggtgtacgagcgaattttttctatgtgcgtggatagtagatcggtcctgccagaccacttctccccggagaatgcgaacgataccgcaaaggagacatgcctgaactggttttttaagatcgcttcaatcagagagcttattcccagattctacgttgaagcaagcatccttaagtgcaacaagtttctgtctaaaaccggcatctctgaatgtctgcccagactgacttgcatgatcagagggatcggtgacccccttgtgtcagtgtatgcccgagcttatttgtgccgagctctcctcactgaaatgatggagcgatgcaagaagctcggaaataatgctctactactcaatagcgttatgtctgcttttagagcagaatttatcgccaccagatcaatggactttattggcatgataaaggagtgcgatgagagtggatttccaaagcatctcctgtttcggagtctgggactgaatctcgcattggccgaccctcccgaaagcgatcggctccagattctcaacgaagcatggaaggttattacaaaactaaagaatccgcaggattatatcaactgcgcagaggtgtgggttgaatatacctgcaagcactttaccaagagagaagtcaacactgttctggctgacgttattaagcacatgacccccgatcgcgcttttgaagacagctatccacagttgcagttgataatcaagaaagtgatcgcccacttccatgacttctcagtattgttctccgtggagaagttcctgcctttcctggatatgttccaaaaagaaagcgtgcgcgtggaagtctgtaaatgtatcatggatgcctttatcaaacaccagcaagaacccaccaaggaccccgtgatactgaatgcactccttcatgtctgcaaaacaatgcacgatagtgtgaacgcactgactctggaagatgagaagcggatgttatcttaccttatcaatggcttcatcaaaatggtgtcattcggccgggacttcgaacagcagctgagtttttacgtcgagtctcggagcatgttctgtaatctcgaacctgtgctcgtgcagctgattcacgcctgtgtggcctactgctttatcaccattcctagcctggcaggaatctttactcggctgaacctatatcttcatagtgggcaggtcgcactggcaaatcagtgtctatctcaggctgacgccttctttaaggccgcaattagcttagtgcccgaggtgcccaaaatgatcaatatcgatgggaaaatgcgaccatccgagagtttccttctggaattcctgtgtaatttcttcagcacactcctgattgtaccagaccatcccgagcacggtgtgctatttctggttagagaactgctcaatgtcatacaggattacacttgggaggacaattcagacgaaaaaatacgtatctacacttgcgtccttcacctcctgagcgcaatgagccaggagacttacctttaccatatcgacaaggtggacagtaatgactccttgtacggaggcgatagtaagttcttagcagaaaacaataagctgtgtgaaacggtgatggctcagatcctggaacatctgaagacgcttgccaaggatgaggctttaaagcgacagtcaagtctgggtctgtcgttctttaattccatcctagctcatggcgacctgagaaataacaaactgaatcagctgtcagtgaatttgtggcatttagctcagaggcatggatgtgctgacactcgtaccatggtgaaaacattagagtacatcaaaaagcagtcaaaacagccagatatgacccacctaactgagcttgcactcagactacccctccaaaccagaacatag

SEQ ID NO: 41162 - DNA, 3159 bp, Artificial Sequence
  Description of Artificial Sequence: Synthetic coding sequence
atggcccccgccggcgtggtgacccgggccgtgcggagcggcgagcttccattgactagcatggcatcggctgaaaacgaagcttgtgcggtgcggtccgtagcctgtccctcccaagcttggcgcctccagaaggtattgtgcggacgctgtggcgccgcttcatgtccctcacaaacctggagaccgcgtggtgccggcagcgggggggtaaggatggggtctagggccgacggaccacggacttcaggccacgtgaccggcaaaatggcagtgtttccatggcacagccgaaataggaattacaaggcagagttcgcttcctgcaggttagaagctgtgcctctagagtttggcgattatcatcccctgaagcctatcacagtcacggagtcgaagacgaaaaaagtgaacagaaaggggtcgactagcagcaccagctccagctccagctcttccgttgtcgatcccctgagctccgtgctggatggaaccgatcctctgagtatgtttgctgctaccgcggatccagccgcactcgccgctgccatggatagcagtcggcgtaaaagggacagagatgataattctgtggttggatcggactttgagccctggaccaacaaacggggtgagatcctggctcgctatacaacaaccgagaaactttcgataaatctgtttatgggctccgaaaagggaaaggccggcactgcaactctagccatgtctgagaaagtgcggacaagactggaggaacttgacgacttcgaagagggatcccagaaggagctgcttaacctgacccaacaagattacgtgaataggattgaagagctcaaccagtctctgaaggatgcttgggcctctgatcagaaagtgaaagcactgaagatcgtgattcagtgctcgaagctgcttagcgatacgagcgtgattcagttttatccttcgaaatttgtgcttatcaccgatatactcgacacttttggtaaactggtgtatgagcggattttcagtatgtgcgttgattctcggtctgtgctgccggatcacttctctcctgagaacgcaaacgataccgcaaaggaaacctgtctaaactggttctttaaaatagccagcatcagagaacttatcccgcggttctatgtcgaggcctctattttgaaatgtaataaattcttgagtaagaccggcattagcgagtgtttacctcgtttaacttgcatgataagaggaattggtgatccactggtctccgtatatgcccgcgcctacctctgtcgtgtcggtatggaggttgctcctcacctcaaagagacccttaacaagaacttcttcgatttcctgcttacctttaaacaaattcacggggatacggtccagaaccagctcgtggtgcagggcgtagagcttcctagttacctgccactgtatcccccagctatggactggatctttcaatgtatcagctatcacgcacctgaagcactgctgaccgagatgatggaacgttgcaagaaactcggaaacaatgctctgctgttgaactccgtgatgagcgcctttcgtgccgaattcatcgcaactagatctatggattttattggtatgatcaaggagtgcgacgaaagcggatttccaaagcatttgctcttcagatctctcggtctgaacctggccctggctgatcccccagaatctgataggcttcaaatcctgaacgaggcctggaaagtcattactaagctcaaaaatcctcaagactacatcaactgtgcagaagtttgggtggagtacacatgtaaacatttcaccaagcgtgaggtgaatactgtactggccgacgtcatcaaacatatgacccccgacagagcgttcgaggacagctacccgcagctgcagcttattatcaaaaaggtgattgcacattttcatgatttttcagtgctcttttctgtggagaagtttttgccctttctggacatgttccagaaggaaagcgtgcgggtcgaagtgtgcaagtgcatcatggacgctttcatcaagcaccagcaggagccaaccaaagaccccgtcatcctcaatgccctgctgcatgtatgcaaaacaatgcacgattctgtgaacgcgttgactttagaggatgaaaagcggatgctgagttacctcataaacggatttataaaaatggtgagcttcggacgcgattttgagcagcagctgagtttctatgtagagtcccgctcaatgttttgcaacctggagcccgtgttagtccagctcatacacagcgtaaatcggctggctatggagacaagaaaagtcatgaaggggaatcactccaggaagacagccgcattcgtgagggcctgtgtggcatactgcttcattaccatcccttctctggctgggatctttactcgcctgaatttgtaccttcattccggtcaggtggcactggcgaaccagtgtctcagtcaggcggacgccttctttaaggcagcaatctctctcgtcccggaagtgcctaaaatgattaatattgatggcaaaatgcgaccaagtgagagctttttgctggaatttctctgcaacttcttcagcacgctgctcatcgtgcctgaccatcccgaacatggagttctgtttctagttagggagctgctgaacgtgatccaggactacacctgggaggataattctgacgaaaagattcgaatatatacatgcgtgctgcacctcctctctgctatgagccaggagacatatctgtatcacattgataaggtagattccaacgactcattgtatgggggcgattctaaattcctcgcagagaataacaaattatgcgagactgttatggcacagattctagaacatctgaaaaccctggccaaggacgaagcacttaaacgccagagcagcttggggctgagtttcttcaactccatcttggcccatggtgaccttagaaacaataagctgaaccaactcagtgtgaatctctggcatctggcacaaaggcatggctgcgccgatacccgaaccatggtgaagactcttgaatacatcaagaaacagagcaagcagcccgatatgacccaccttaccgaactcgctctgcggctgccactccaaacacgaacatag

SEQ ID NO: 41163 - DNA, 2442 bp, Artificial Sequence
  Description of Artificial Sequence: Synthetic coding sequence
atgccccccctgggcgtgctggtgcacgagaagagccacctgtgcgatgtgaattctttctgtctcggtaaagcgggaacggcaaccctggccatgtccgaaaaggtgcgcactcgattggaggaactcgacgacttcgaggagggctctcagaaggagttgctgaatctgacgcagcaagattacgtgaataggatcgaagaactcaatcagtcccttaaagatgcctgggcaagtgaccagaaagtaaaagcgttgaaaatcgtgatccaagcggaactggtgtacgaacggatatttagtatgtgtgtggactcgagaagtgtactcccagaccacttcagccctgaaaacgcgaatgacacagccaaagagacatgcctgaactggtttttcaagatcgcatcaatacgggagctcatcccccggttctatgtggaagccagcattttaaagtgtaacaaatttctgtcaaaaacaggtatttccgaatgcctccccagactgacgtgcatgattcgaggcattggggaccccctcgtgtctgtctacgctagagcttacttatgtcgcgtggggatggaggttgcaccccacttaaaagagacgttaaataaaaacttctttgactttctgttgacttttaagcagatccatggcgatacagtgcagaatcagttggttgtgcagggtgtcgagctgccgtcttacctccctctgtatccaccagccatggattggatattccagtgcatctcatatcacgccccagaggcgctactaaccgaaatgatggagagatgtaagaaactcggcaataacgcacttctcctgaacagcgtcatgagcgcattcagagccgagttcatagccactagatccatggattttatcggtatgatcaaagagtgtgacgaatcaggattcccaaaacacctgttgttcaggtcacttgggctgaacttggcgctggccgatccacctgaatcagatcgacttcagatcctgaacgaagcctggaaggtgatcaccaagctgaagaatccccaggactatatcaattgtgccgaggtgtgggtggaatatacgtgtaagcacttcacgaaacgtgaggtgaacacagttttagccgacgtgattaaacatatgacaccggaccgggcatttgaagactcttaccctcaactgcagcttataataaagaaagtcattgcccactttcatgatttctccgtcctcttttctgtggagaaattcctgcccttcctggacatgttccaaaaggagagtgtgagggtagaagtgtgtaagtgtattatggatgcatttataaaacaccaacaggagcccaccaaggatcccgtgattcttaatgccctactgcatgtgtgtaaaaccatgcacgatagtgtgaacgctctgaccctagaggatgaaaagcgcatgctttcttatctaatcaatggtttcatcaagatggtgtctttcggcagagacttcgagcagcagctttcgttttatgtcgaatcacgctcaatgttctgcaatcttgagcccgtgctggtccagctgatccactctgtcaatagactggcaatggagacccgaaaggtcatgaaagggaaccactctcgtaagacagctgcgtttgtgagggcatgcgtagcttattgcttcatcaccatacccagcctggctgggatatttacccgactgaacctgtatctacactccggtcaggtcgctctcgcaaatcagtgtttatctcaagctgatgccttttttaaagccgcaatatcgctggtgcccgaggtcccaaaaatgataaacatagatggtaaaatgcggccgtcagagagctttctgctcgaattcctgtgtaattttttctcaacattgctcatcgtccccgaccacccggagcatggagtactgttcctggtccgggagctgctgaatgtgatccaggactacacctgggaagacaatagtgacgagaaaattaggatatatacttgtgtgctgcatctgctttccgctatgagccaggagacatatctgtatcatatcgacaaggttgactccaatgactcgctgtatggcggagacagcaagtttctggcagagaacaataagctctgtgagactgtgatggcacagattcttgaacatttgaagaccctggctaaagacgaggccttaaaacgtcaaagctcacttgggctgagtttcttcaacagcatcctggcacacggtgacctccggaacaacaagcttaatcagttaagcgttaatctttggcacctggctcagagacatgggtgcgcagatacacgaaccatggtaaaaaccttggagtacatcaagaagcagagtaagcaaccagacatgacacacctaaccgagctggccttgagactcccccttcagaccaggacttag

SEQ ID NO: 41164 - DNA, 822 bp, Artificial Sequence
  Description of Artificial Sequence: Synthetic coding sequence
atggcccccgccggcgtggtgacccgggccgtgcggagcggcgagttgcctctgacatccatggcttcagctgagaatgaggcatgcgcggtgcggagtgtggcgtgtccttcccaggcctggagattgcaaaaggtactatgcgggcgctgtggtgccgccagttgcccgtctcaaacctggcgccctagaggagccggatctggtggggtgcggatgggcagcagagctgacggccctaggacatccggccacgtgaccgggaagatggctgtgttcccgtggcatagtagaaaccgaaactataaagccgaatttgcatcctgcagactggaggctgtcccacttgagtttggtgattatcaccctctcaagcccatcaccgtcacagagagcaaaactaagaaggtcaatagaaaaggaagcacttccagtacctcttcgagttcctccagcagtgtcgtggatcctctgtcttccgtgttagacgggaccgacccactcagtatgttcgccgccactgccgaccccgccgctctggctgcagcgatggattccagcagaaggaaacgggatagggatgacaactcggttgtgggttccgactttgaaccatggaccaataaacgcggtgagattttggctcgctacacgaccacggagaagctttctattaatcttttcatgggctcagagaaggacggggggtattcggaaccacgctctcgacataggactcccgcctggaccacagagcagtcatgggactgccacataggtaatgtgcgagagggagcagaccccgctggcggggccggatag

SEQ ID NO: 41165 - DNA, 2880 bp, Artificial Sequence
  Description of Artificial Sequence: Synthetic coding sequence
atggcccccgccggcgtggtgacccgggccgtgcggagcggcgagctccctttaacatctatggcaagtgctgagaatgaggcctgtgccgtacggtccgtggcctgtcctagccaggcctggagattgcagaaagtgttatgcggtcgctgcggggctgcttcgtgtcctagccaaacatggcgtccacgaggtgctgggtcaggaggcgtgaggatgggcagtcgggccgatggtccaaggacatccggccacgtcacaggaaagatggccgtctttccatggcacagcagaaatcgcaattataaggcagagtttgcatcttgcagacttgaagccgtgcctctcgaattcggcgattaccaccctctgaagccgatcacggtgaccgagtctaagacgaagaaggtcaatcgcaaaggctctacttcaagcacatcatcaagcagttcgagttctgtggtcgaccccctgtcctctgtcctggacggaactgacccactttccatgttcgcagctaccgctgacccagcagccctggctgctgctatggattcttcacgtcgtaaaagagaccgtgacgataattccgtggtggggagcgactttgaaccctggaccaacaagaggggagaaattctcgcccgctacaccacaaccgaaaaactcagtattaacttgtttatgggatctgaaaaaggcaaagccggaacagctaccctcgctatgagtgaaaaggtgcggactcgcttagaagaattggacgattttgaggaaggttcccagaaagagttgttaaatctgacgcaacaggattatgtgaatcgaatcgaggagctcaatcagagcctgaaggacgcctgggccagcgatcagaaagtcaaggctttgaagattgtcatacaatgctccaagttgttgtcagacactagtgtgattcagttttacccatctaaattcgtgctgattaccgatatcttagatacctttggcaaactggtgtatgaaaggatcttctcaatgtgtgtggacagccgatcagtgctacccgaccacttctctcccgaaaacgcaaatgacactgccaaggagacatgtttgaactggtttttcaagatcgcttccattagagaattaatccccaggttttacgtggaagcttccatcctgaaatgcaacaaatttctaagtaagaccggtattagcgagtgtctgccccgcctgacctgcatgataagagggatcggagatccactggtgagcgtgtacgcgcgggcgtatctctgcagggctctcctcactgaaatgatggagcgttgcaaaaaacttgggaacaacgctcttctcctcaattctgtcatgtcagccttccgtgcagaattcatcgccacgaggtctatggattttattggtatgatcaaggagtgcgatgagagcgggttccccaaacacttactgtttagaagcctgggactgaatttagcgctagccgaccctcctgagagcgataggctccagattctgaacgaggcatggaaggtgatcaccaagttaaagaatcctcaggactacatcaattgtgcagaagtgtgggtagagtacacatgtaagcactttacaaaaagagaagttaacaccgtcctcgccgatgtgataaagcacatgaccccggaccgcgctttcgaagacagttacccacagttgcagttaattattaaaaaagtaatcgcccatttccacgatttttccgtactcttttctgtggagaagttcctgccctttttggatatgtttcagaaggagtccgtgagagtggaggtttgcaagtgcattatggatgcctttataaagcatcaacaggagcccaccaaagatcccgttatcctgaatgctttgcttcacgtgtgtaagaccatgcacgactcagtcaatgcattgaccctggaagatgagaagaggatgctaagttatctgattaacggctttatcaaaatggtcagtttcggcagggactttgagcagcaactgtctttctacgttgaaagtcggtccatgttttgcaatttagagccggtgcttgtccaacttatccacgcatgcgttgcttattgttttattaccatcccaagtttggcaggcatctttactaggctgaatctgtatttacattccggacaagtggctcttgctaatcaatgcctttcccaggcggacgctttttttaaagccgctatcagccttgtgccagaggtccccaaaatgatcaacatcgatggtaaaatgagaccatccgagagctttctgctggagttcctgtgcaactttttcagtaccctgttgatagttccggaccatcccgaacacggagtattatttttggtaagagaactcctgaatgtcatccaggattatacctgggaggacaacagtgatgaaaagatcagaatctatacgtgtgtgctgcacctgttgagtgctatgtcacaagagacatatctgtaccatatagataaagtcgactctaatgattccctatatgggggagactccaaatttctggccgagaataacaaactgtgcgagaccgtgatggcacaaattctggagcacttaaaaacactagctaaggacgaagccttaaagaggcagtcaagcctcggtctctctttctttaactctattctggcccacggggaccttaggaacaataagcttaaccagctgtcagttaatctttggcaccttgcccaacgccacggctgtgcagatactcgcaccatggtcaaaaccctggagtatataaagaagcagagcaagcagcccgatatgacacatcttacagagcttgccttgaggcttccactacaaacacggacgtag

SEQ ID NO: 41166 - DNA, 759 bp, Artificial Sequence
  Description of Artificial Sequence: Synthetic coding sequence
atgggcagcgagctgatcggccggctggccccccggctgggcctggctgagcccgatatgctccgcaaagccgaggaatatctgcgattatctcgcgtgaagtgtgtgggcctgagtgcaagaactactgaaaccagtagcgcagtcatgtgtttggatctggcggcaagttggatgaaatgccccctggatcgcgcctatctgatcaagctgtccgggttgaacaaggagacttaccagagctgtctgaagtcctttgaatgtctgttgggcctgaattccaatattggaatcagagacctcgccgtccagttttcatgtatagaagccgtgaacatggctagtaagatccttaagtcctatgagtcctcccttccccagacacaacaagttgacctcgacctatcccgacctttgtttacatccgctgctttgctctctgcatgcaagatacttaagctgaaagttgacaaaaacaaaatggtcgctaccagtggggtcaaaaaggccatcttcgacagactgtgtaagcagcttgaaaaaatcggacaacaggttgaccgtgagcctggagacgtggccacaccacccagaaagagaaaaaagattgttgtcgaagcgcctgctaaggagatggaaaaagtggaggagatgccccacaagccccagaaagacgaggatcttacccaggactacgaggagtggaaacggaaaattctcgagaacgcagcaagcgcgcaaaaagccaccgcggaatag

SEQ ID NO: 41167 - DNA, 1071 bp, Artificial Sequence
  Description of Artificial Sequence: Synthetic coding sequence
atgggcctgatggtgcggggcggcgtgacctgccggagccaggagagattgttgggggtcgggactggcactgcatcggcccaacctcctgtgactgcatcaccttattgttcatttaccggtcggtctcgcgccgatgcccccgcaagggcagcagggaacggccagccgaggttacgggcccaagtagacttatccagcgcatcctcagtccttgtcacggtactcgatgctaaagcactaccactcaccctgctgagctggggcagtctgtgtgcaacagcccaaaaccataacaatcaagagggcgctcctgcccagccaaaaggcagtatggccaatcagagagccctgagatttccccctccatcaggctcaccacccggccttcacacacgcatgagactgacatcccccccccagcctcactttgaacctccacctcccaccaccgtgggcgctccaagatccctccagggcgattggttcggttccgactccagggccgttcgagctctgagattgattggttgggcctcacggtcactgcacccgctgcccggttccagggatcgtgcccatccggccgctgaagaagaggacgatccagatcgccctatcgagttcagttcgtccaaggccaatccccaccgatggtccgtgggccacaccatgggcaagggacatcagcgaccatggtggaaagtacttcctctgtcctgcttcctcgtcgctcttattatatggtgttacctccgggaagaatccgaggcagaccaatggctgcgccaagaggggtctagacaacctccctttggcttcgatgtaacatttgcacgtgattgccccgggtacgcatgtgttctctctactgaggggctggggtggtggatgggccacctcgcaatgctgattcgtgtcaaggcggagcagaatctatccaggagcgaaacggcccctaggctggccctcgacgttcaggggttccacagacaggatttctcagacccttggggtcgatttcagcttcactgcatgctgttggacttgccttcattgtgtattacctag

SEQ ID NO: 41168 - DNA, 399 bp, Artificial Sequence
  Description of Artificial Sequence: Synthetic coding sequence
atgaaccgggtgctgtgcgcccccgccgccggcgccgtgcgggccttgcgcttgataggctgggcaagtcgcagcctccaccccctacccggttcccgagatcgtgcccaccccgcagccgaggaagaagatgatcccgaccgtcctatcgagttttcttcaagcaaagccaatccacataggtggtcagtaggccataccatgggaaaggggcaccagcggccatggtggaaagtcttgccactttcatgtttcctcgtcgctctgatcatctggtgctatctgcgtgaggaatcggaagccgatcaatggctgcgccaagtgtggggcgaggtccctgagcctagtgatcgctcggaggaaccagaaactcccgcagcgtacagagcacgcacctag

SEQ ID NO: 41169 - DNA, 399 bp, Artificial Sequence
  Description of Artificial Sequence: Synthetic coding sequence
atgggcgccggcgtgggcgtggccggctgcacccggggccaccggaattgggttccttcccagctgcccccgcgcgaaattaaagccggggtatccctggcagtggtcacggagttcgcgtgggttcttgcccctcgccccaaacgcgcgacagcctctgcactcggtacagagtcacccagatttttggatagacccgatttttttgattatcctgattcagatcaagctcggctgcttgccgtagcccagtttatcggcgagaaacctatcgtgttcataaactcagggagttcaccagggctattccaccacatactagtggggctgctggtggtggcattcttcttcctactcttccaattttgcactcacatcaattttcagaagggtgcctag

SEQ ID NO: 41170 - DNA, 960 bp, Artificial Sequence
  Description of Artificial Sequence: Synthetic coding sequence
atggccccccagcggcgggccgccaccaaggcccccgagggcaacggggcagcggagaggcgcaatcggagttctacaaaaaaggacagagcccctagggaagttcaacggctgtggcagcgcccgtggctgcggacagctggtcttggcgccggattcgtgttgactgccctgttgctctggtcttcactgggcgctgatgatggagtggccgaagtgctggcacgacgcggtgaagtggtcgctggacgcttcattgaagtgccttgttctgaggattatgactcacacagacgctttgaaggttgtacaccaaggaagtgtggacgcggcgtaaccgatgtcgtgatcacaagagaagaagctgaaaggattagatccgtggcagagaaggggctctccttgggcgggtcagacggtggggcctccattctggacttacactccggtgcactatcagtggggaaacacttcgtgaacctgtataggtactttggggataagattcagaacatcttttccgaagaagactttcggctgtatcgcgaggttcggcagaaggtgcagttaacaatagctgaagccttcggaatctctgcctcctcactccatctgaccaaacccaccttcttctctcgcatcaacagcacggaagctagaaccgcccacgacgaatattggcacgcccacgtggataaggtcacctatgggtcctttgattatacctctttactctacctgtctaactacttagaagatttcggtggggggaggtttatgttcatggaagagggcgcgaacaaaacagtggagcctcgggcaggccgggtgtctttcttcacatcaggttccgaaaatctccaccgtgtggagaaggtgcactggggcacccgctatgccattaccattgcattttcgtgcaacccagaccacggaatcgaggaccctgccttcccctag

SEQ ID NO: 41171 - DNA, 996 bp, Artificial Sequence
  Description of Artificial Sequence: Synthetic coding sequence
atggccccccagcggcgggccgccaccaaggcccccgagggcaacggagccgccgaaaggcggaaccgaagtagtacaaagaaggacagggccccccgtgaggtgcagcggctatggcaaaggccttggcttcggacagctggactgggggcaggcttcgtgctgacagccctgttgctgtggtcatcattgggcgctgatgatggagtagctgaggttctagcaaggcggggtgaggtggtcgcaggccggtttattgaggtgccctgtagcgaggattacgacagccatcgcagatttgaggggtgcaccccccggaagtgcggccgtggagttactgacgtggttattactcgggaggaggcagagcggatccggagtgtggctgaaaaaggcctgagtctgggcgggtccgatggcggcgcaagtatcctggacctccacagtggagccctgagcgtgggaaaacacttcgtgaacttgtatcggtactttggagataaaattcagaatattttttccgaagaggactttaggttgtacagagaggtgcgacagaaggtccaacttactattgccgaagcatttggcataagcgcctcctcattgcatctgaccaagccgactttcttttcacggatcaacagcacggaagcacggacggcccacgatgaatactggcacgcccacgtggataaagtaacatacggaagctttgactacacttctctcctataccttagcaattatcttgaagacttcggcggaggaagattcatgtttatggaggaaggagcaaataaaaccgtcgagcctcgagcaggatgcttttgtttcaggatgatgagctgcggatttcaggaagtaaacggccccagggcctcggaagcagccggcgccaaagccggagtgcggtgcccacccggaacccatcacccacctgagcggggggagacccatgctattctggaagctgaaagcatcgcctactgctag

SEQ ID NO: 41172 - DNA, 234 bp, Artificial Sequence
  Description of Artificial Sequence: Synthetic coding sequence
atggccgccaccgacttcgtgcaggagatgcgggccgtgggcgagcggttacttctcaagctacagaggctgcctcaggcagagcccgtggagatcgtggcattctctgtcataatactgtttaccgccacagttctgcttctgcttctcatagcgtgtagttgttgctgtacacattgctgttgccctgaacgtaggggccgcaaggtccaagtgcaaccgacccccccatag

SEQ ID NO: 41173 - DNA, 1578 bp, Artificial Sequence
  Description of Artificial Sequence: Synthetic coding sequence
atggccgccgccccccccctgcgggaccggctgagcttcctgcacagattgcccattctgctgaaggggactagtgatgacgatgtgccttgccccgggtacctcttcgaagagattgcaaaaatctctcatgagagccccgggagcagccagtgcttgctggagtacctcttaagtcgacttcattcatccagtggtcatggaaaactgaaggtgttgaagatcctgctgtatttatgttcacacggctctagtttcttccttctgattcttaagaggaattcagcatttatccaggaagcagccgcattcgccggacctcctgatcccctccacggcaatagtctctatcagaaagtgagggcagccgctcaggatctcgggagtactttattctccgacaccgtgctgccattagccccttcccagcctctcggcacaccccccgcaaccggcatggggtcacaggcccgcccccattccactttgcaggggttcgggtactccaaagagcacgggagaacggctgtgcgtcaccagccggggcaagctggaggggggtgggatgagctggattcaggcccaagcagccagaactcttcgcagaacagtgatctatctagagtcagtgacagtggctcacattccggcagtgatagccatagcggggcctccagggaaccaggggatcttgctgaaagagtcgaagtcgttgcactgtccgactgccagcaggagctctccttggttaggaccgtcactagaggaccacgcgcttttctatctcgagaggaggcacagcatttcataaaagcttgtggactcctgaactgcgaagcagtgttgcagctgctgacgtgtcacttgcgcggcacttctgaatgtacgcagctgcgcgccctttgcgccatcgcttccctaggttcgtctgatcttctaccacaggaacacatactgttacgaacccggccctggctccaggagctgtctatgggcagccctggacctgtcacaaataaggccactaagatactgagacattttgaggcatcctgtgggcagctgtcgccagctaggggcacctccgctgaacccgggcctacagccgctctcccgggcccatccgatctgctaaccgatgccgtgcccctgccgggttcccaggtgttcttgcagccgctgagcagtacaccggtgtcaagtcggtctcccgctcctagcagcggaatgccctcttcgccggtgcccacccccccccccgatgcatcacccatcccggcccctggggaccccagcgaagccgaagcgcgtctcgccgaatctagaaggtggagacctgagcggattcccgggggcactgatagtcctaagcgaggtcctagctcgtgcgcttggtccagagactctctatttgccggtatggaattggtggcgtgcccacgcttagtcggggccggggcagcagcgggtgagtcttgccctgacgcccctcgcgcacctcagactagtagccagcggactgctgcaaaggaaccgccagggagcgaacccagcgctttcgcatttctgaatgcatag

SEQ ID NO: 41174 - DNA, 1326 bp, Artificial Sequence
  Description of Artificial Sequence: Synthetic coding sequence
atgggcagccaggcccggccccacagcaccctgcagggcttcggctactccaaggaacacggacggaccggttcagctggagaagcgtttctgagcacaatccagaaagctgctgaggtcgtcgcgtctgctatgcgacccggacctgaatcccctagtactcggagattgcttccacggggagacacctaccagcccgcaatgatgccgagcgcctctcacggtcctccaaccctaggaaatttgctgcccggtgccatcccgggaccgcgagccgtgcgccatcaacctggacaggcaggtggcgggtgggatgagctggattctggccccagcagccaaaattcatcccagaattcggacctgtcccgggtttcagacagcggaagtcactctggatctgacagtcactccggggcctcccgtgaacccggagacctggctgagcgtgtggaagtcgtggcactgagtgactgccagcaggaattgagtctggtgcggactgtgaccagaggcccccgggcgtttctgtctcgtgaggaggcacagcacttcatcaaggcatgcggcctgctgaactgcgaagctgtacttcagcttttaacctgtcatctcaggggaacatcagagtgcacacagctgagagccctttgtgcaatcgcctctctgggcagctcagacctactgccgcaggagcacatcttgctacgaacacgcccgtggctgcaagagttgtctatgggcagccctggaccggtgacaaacaaggctactaagattttgcgccactttgaggcatcttgtggtcagctgtcacctgctcgcggcaccagcgccgaacctggacctacagcagcactgccaggccctagcgatctgctcacggacgcggtccccctgccaggatcccaagtttttcttcagccccttagttcaacgcccgtgtcatcccggtcacctgcaccctcatcgggcatgccctcgagcccagtgcccaccccgccccccgatgccagtcccattcctgcccctggtgacccatcggaggccgaggcacgcctggctgagtccaggagatggagacccgaacgcatccctgggggaacagactctcccaaacgcggaccatcgagctgtgcttggtctcgggattccctgtttgcaggtatggaattggtcgcttgcccacgactggttggcgcgggcgcagcagcaggcgaatcatgtccagacgcaccaagagccccccagacaagttcacagaggaccgctgctaaagagcccccggggtcagagccatcagcttttgctttcctgaatgcttag

SEQ ID NO: 41175 - DNA, 1074 bp, Artificial Sequence
  Description of Artificial Sequence: Synthetic coding sequence
atggagagcagccggggccggcccggccccgagaccgacctgctggccgtggccgagcatcaggcactggtctttggggggggaccaggtcggacgagttccgaacccccggccggtctgcgcgtctcaggcgaagaggaaacagagaacgtcgggggagctaatcggcacccaaggacatcccccaaaacgagtagttgcggcgtcgtgcacaggccggaacgagaggcacttgaaaatgaaccgggccctcaggggactctgtcaggggccggaagcagacgaggagctccaggggccgaacatgagccctctctgtcctctcgccacaagaacccagcccccccagaaggaaaacctagctcaggcagagactgtcgccgaggtggaccaggtggagggatggacgtggagcagcaggaggaggaggataatgacgaggaagctgctgctggttctcgcgcagggaggagtttctcatccagacttcaggattccaggtccctggacgggcttagcgaagcctgtggcggggcaggctcctcaggcagcgccgagtcaggggcaggcggcggccggagggccacaattagttcaccactggaattagagggcacggtttcaagacatggcgatttgacacatttcgtggccaataatctgcagttaaaaatccgactgagtggggctccccctccaccaccttccgcccccgcccgcccttgcccggcaccagctccgacccctacaccagcgattcctccgattgacccggaggtgctacgcgacttggaaaggttgagccgcgaattgggcgggcgagtggacaggctactacgcggcctgggaggagccgtgcaagaactaacagccctgtccgtgggctgtattcaaacttacagagatgccgttgacagcttgggagaagctgtagatatgtctatcaagggtatgtacaccctgctcgcccgttgcgaggagctcgagcgcgcgctgcagcctgtgcaggggctggcccgccaggtgagggacatcaggcgtaccctcgaagtgctcgaggcactgtgtaagtag

SEQ ID NO: 41176 - DNA, 342 bp, Artificial Sequence
  Description of Artificial Sequence: Synthetic coding sequence
atggccggccccgccgccgccttccggcggctgggcgccctgagcggggccgctgctcttggcttcgcatcttacggggcacacggagcccaattccctgatgcctacggaaaggagttgttcgacaaggctaataaacaccactttttgcattctctggccttgctcggtgtgcctcattgtcgtaaaccattgtgggcggggctcctattggcctccgggactaccctcttctgtactagcttctactaccaggctctgtccggcgatccatcaatccaaactctcgcgccggcgggcgggacactacttctattgggttggctggccctagctttatag

SEQ ID NO: 41177 - DNA, 564 bp, Artificial Sequence
  Description of Artificial Sequence: Synthetic coding sequence
atgtacctgcaggtggagacccggaccagcagccggctgcacctgaaaagggccccaggtatccgctcctggtccctactggtagggatcctcagcatagggctggccgccgcttattactctggagacagcctgggttggaagttgttttacgtgaccgggtgcttgtttgtggcggtccaaaacttggaggactgggaagaggcaatcttcgacaagagcactggaaaggtggtgctcaagaccttttctctctataaaaagctgttaactcttttccgcgctggtcacgatcaggttgtcgtgctgctgcacgatgtccgagatgtgagtgtggaagaggaaaaagtgcgttattttgggaaagggtatatggtggtccttcgtttggccacaggcttctcacacccattgacccagtctgcggtcatggggcaccggagcgacgtcgaggctattgcaaaactgatcacatctttcctggaactgcactgtcttgagagtccgacagaactgtcccaaagtagcgattcagaagcaggcgaccccgcatctcaatcttag

SEQ ID NO: 41178 - DNA, 672 bp, Artificial Sequence
  Description of Artificial Sequence: Synthetic coding sequence
atgtggaagcccagccccagcagcagccccgccagctggagctgcacggcgcttagggcaccccagagctgcttgagggcagccactgttagacccgtcacgcttcaggcacgggcagacagtccgacagtaccagagcccgttcataggccgcaggacccctggcacatccctggagttccagaaccggtacaccgtccccaagacccctggcacattcctggggtacctgaacctgtgcatcgccctcaggatccatggcacatccctggtgtgccagagccggttcatcgcccccaggacccctggcacatccccggcgtacctgaacctgtccacaggccacaagacccatggccatggttgcagttagtgccgccggctgagttagcctattgtttgctgatgcttttgcttgctcattgcatgaagcagcaggctaggccaggccatcctgattttttacaccgcgaagcctgggcctgcctttctgccgcgggcggcctggcatctcctgggctcttactgtgggcaaccgcacgtcctcgcgcgagcggcgaggccggtcctggccgcgcactggtcggggctgacgcggcgtgctgcccacggcacagcgtgctcagcctggtggatatcccttctgggcaggtacttccacagggtcagtag

SEQ ID NO: 41179 - DNA, 786 bp, Artificial Sequence
  Description of Artificial Sequence: Synthetic coding sequence
gcctggcggcggcggcggagcggcaccagcggcaaggccacctggtggtgctccggtctgaggcgggcgtccccaaccccctcgcgaagagtgcagagctgggcaacagccgtaatgtggaaaccctctccctcctcttcccccgcgtcgtggagctgcacagccctgcgcgccccacagtcgtgtctccgcgcagctaccgtgcggcccgtgactttacaggctagagccgactctcccacagtgcccgagccagttcaccgccctcaagatccctggcacatcccaggtgtgcccgagcccgtgcatagaccgcaggatccttggcacatccccggggtcccagaaccggtgcaccgaccccaagatccatggcacattcctggggtccccgagcccgtgcaccgcccacaggacccgtggcatatccctggagtccccgagcccgtgcacagaccccaggacccctggccttggctgcaactggtgcctcctgcggagcttgcatactgcctactaatgttattgctggcacactgcatgaagcagcaggctcggccgggccacccagactttttgcaccgagaagcatgggcctgcttatctgccgcgggaggcctggcttcgcctggtttattgttgtgggccacagctagaccaagggcctccggcgaagccggacctgggagagcccttgtcggtgcagatgccgcatgttgtccccggcacagcgtgctgagtctcgtggatatccctagtgggcaggttctgccccaggggcaatag

SEQ ID NO: 41180 - DNA, 522 bp, Artificial Sequence
  Description of Artificial Sequence: Synthetic coding sequence
atgtacctgcaggtggagacccggaccagcagccggctgcacctgaaaagagcacctggcattagatcatggtcacttctcgtggactccttgggatggaagcttttttacgtcactgggtgtctgttcgtggcggtccaaaacctggaagattgggaggaagccatcttcgataaaagtacaggtaaggtcgttcttaagacattttcactgtataaaaagcttctgacactcttcagggccggtcacgaccaggttgtggtgctcttacatgatgtcagggacgtaagcgtagaggaggaaaaagtgagatacttcggaaagggctatatggtggtgctgagattggctacaggcttttctcaccccctcacgcaatcagccgtgatgggccatagatcagacgtagaggcaatcgcaaagctgatcacatcttttctcgagctgcattgcctcgaaagccctaccgaactgtcccagtccagtgacagcgaggccggggacccagcttctcaaagttag

SEQ ID NO: 41181 - DNA, 564 bp, Artificial Sequence
  Description of Artificial Sequence: Synthetic coding sequence
atgtacctgcaggtggagacccggaccagcagccggctgcacctgaagcgggcccccggcattcggtcctggtccctgctggtaggcattcttagcattggcctggctgcagcttattattcaggtgattctctcggctggaaacttttctatgtaaccggatgtctcttcgtggccgtccagaacttagaggactgggaagaagcaatttttgataagtcaaccggtaaggttgttcttaagacgtttagcctttataagaaactgctgacattgtttcgcgcaggccatgatcaggttgtcgtgcttctccatgacgttcgtgatgtgtccgtggaagaagagaaagttcggtattttggaaagggctacatggtagtgttgagacttgctacgggtttctcacaccccctgacccagtccgccgtgatgggacatagatccgacgtcgaggccatcgccaagcttattacttcatttctggagttacattgccttgagagcccgaccgaattgagccagtcttccgacagcgaggctggagatcctgcaagccaaagctag

SEQ ID NO: 41182 - DNA, 684 bp, Artificial Sequence
  Description of Artificial Sequence: Synthetic coding sequence
atgggccaccggagcgacgtggaggccatcgccagcagcagccccgcttcatggagctgtactgccctaagagcccctcagtcatgcctgcgagccgctacagtaagaccagtgaccttgcaggctagagccgacagccctaccgttccagagccagtgcacaggcctcaagacccttggcacattcctggagtacccgagcctgttcataggccccaagacccctggcatatacccggcgtccccgagcctgtacaccgaccgcaggatccttggcatatcccaggcgttcctgaaccggtgcaccgtcctcaggatccatggcatatacctggagttccagagcctgtccatcgcccacaagacccgtggccatggctgcagctggtgccccctgcagaactcgcatattgtctgctgatgctgctgctggctcactgcatgaaacaacaggctcgaccgggccaccccgatttcctgcatagagaggcctgggcatgtctgtcggctgccggcgtgtcccccgcactcgattcctgcttcggcccgcagcaggatctcgggcgggtggaaagacgagccagaccggcactggttggcgcagatgccgcctgctgcccacgccattcagttctgtcactggtggatataccttccggccaggttttgccccaaggacagtag

SEQ ID NO: 41183 - DNA, 828 bp, Artificial Sequence
  Description of Artificial Sequence: Synthetic coding sequence
atggacaccatcctggtgttcagcctgatcatcgccagctacgacgccaacaaaaaagatctgcgggattcttcctgcagactggaacagttacctggtatctttcctaaagatgtgcgctccatacgtgagctccagatgcaggagacacatactgagaccaagaggacaacgtttattcagaacagaactatcgctacattgcagtgtctggggagcgattctaaagtgaaggttaatcttgtgtatctagagagacgaccgaaggtgaagcacatactgaagaaccttcgaatcattgctgctcctcggaggaatagtagtgcttcctcctcttgccacctgatcccaacctccaagtttcagaccgggtcgcttcttaagggcaaagcctttctccccggtatttctcaatgtaaagttctgggagcatccagcgaaaccttccccaccactgccccatctataacacccgggaacaaagaaggcgaaaaaaccacttccaccgacaccgacgaaaatttagagaaacgacagaagtggtctatagtggtaaaaattttgatcgccgtaaccttactgctctccggagtcgcaattattgtgttcgttatcttcgaagtcccctgtccctaccagtgtctgggcgcaaggaagttatgtcagtgccagtggctttggaggtggcagaagaagggagggcaaccgccaggcaccgccgagagcaagccagacagccagccccagaaagtgggccaggacgcagctaactctagtaaccctaaaaaggcagccgagattacagttatccaccaaacctatttctag

SEQ ID NO: 41184 - DNA, 480 bp, Artificial Sequence
  Description of Artificial Sequence: Synthetic coding sequence
atggacaccatcctggtgttcagcctgatcatcgccagctacgacgccaataaaaaggatcttcgcgacagtagttgccggctagaacaattgccgggtatattccctaaggacgttaggtcaatacgggaattacagatgcaggaaacccatactgagaccaagcggactacctttatccagaaccgcacaatcgccacacttcagtgcctgggatcagattccaaagtcaaggtgaacctcgtgtacctggaacgacgtcctaaagtgaagcacatcctgaaaaacttgagaatcatcgccgcaccccgcagaaatagcagtgcctctagtagctgccatctaatccccacatcaaagtttcagacagggagcctgctcaagggcaaagtcagcatgcctagaagccaggaggcagtgccaatgcctgttgtggtcgaaatggctaaggaagggaggcccgccacttgggatagctag

SEQ ID NO: 41185 - DNA, 1644 bp, Artificial Sequence
  Description of Artificial Sequence: Synthetic coding sequence
atgagcgacaaccccccccggatggaggtgtgcccctactgcaagaagccattcaagaggcttaaaagccacttgccttactgtaagatgatcgggccaacgataccgaccgatcaaaaggtttaccagagcaaacccgctacgcttccccgtgctaagaaaatgaagggaccaattaaggacttgatcaaagcaaaaggaaaagagctcgagacagaaaacgaggaacgaaatagtaaactggtggtcgacaaacctgagcagacagtcaaaacctttccgctgcccgcggttggactagaacgagctgctactaccaaggccgacaaagacatcaagaatccaatccagccttctttcaaaatgctcaaaaatactaaacccatgacgacattccaggaagaaactaaagcacagttttacgccagtgagaaaactagtccgaaacgggagctcgcaaaggacctcccaaagtccggcgagtcccgctgtaatccttcagaggctggggcctctcttcttgtcggtagcatagagccgtctctgagtaatcaggatcgaaagtacagttcaaccctgcctaatgatgtacagacaaccagtggtgatttgaaactggacaagattgacccccagcgacaggagctcctcgtcaagctcctggacgtcccaactggtgattgccacataagtcccaagaatgtgtcagatggcgtcaaacgggtgcggacgctccttagtaatgagcgggatagcaagggtagagatcacctctctggtgtcccaacagacgttacggtgacagaaacaccagaaaagaatactgaaagcctgatcctttcattgaaaatgagcagcttgggcaagatccaggtaatggagaaacaagagaaaggccttacccttggagttgaaacttgcgggagcaagggcaacgctgaaaaaagtatgtcagccacagaaaagcaggagcgtaccgtgatgtctcatgggtgtgagaattttaacacgcgggatagcgtgacagggaaggagtcacagggcgagcgacctcacttgagtttgtttattcccagggagaccacctatcagtttcactccgtcagtcaatcaagctctcagtccctggcaagtctagccactacatttttgcaggagaagaaagctgaagctcagaatcaccactgtgtgcctgacgtgaaggcccttatggagtctcccgaaggccaattaagcctggaaccaaagagcgactcccagttccaagcctcacatacggggtgccagtcgcccctgtgtagtgcacaacgtcacactccccagagcccattcacaaaccacgctgctgccgcaggccgtaaaactctcaggtcatgtatgggcctcgagtggtttcctgaactttatcctggttacctagggttgggggtcctacccggtaaaccgcagtgctggaacgctatgacccagaagcctcaacttatttccccgcagggggagcgcctgtcccaggggtggatacggtgcaacaccaccattcgaaagtctggcttcggaggtattacgatgctatttaccggatactttgtcctttgctgcagctggtcatttcgccgtcttaagctccaacgctggcgaaagtag

SEQ ID NO: 41186 - DNA, 1722 bp, Artificial Sequence
  Description of Artificial Sequence: Synthetic coding sequence
atgagcgacaaccccccccggatggaggtgtgcccctactgcaagaagcccttcaagaggctcaagagtcatttgccatactgcaagatgatcggcccaacgatacccactgaccagaaagtgtatcagtccaagccggcaacccttccaagggccaagaaaatgaaaggacccataaaggacttaataaaagctaagggtaaagaactagaaaccgaaaatgaggagagaaatagcaaattggttgtcgacaagcctgaacagaccgtgaagacgttcccgctacccgcagttggactggaaagagccgctactacaaaggcagacaaagatataaaaaatcctatccaacccagttttaagatgctcaagaataccaagcccatgaccacattccaggaagagaccaaggcgcagttctatgcctcagaaaagacctcgcccaaacgggagctggcgaaggaccttccgaagtctggcgaatcccgttgtaacccctctgaggccggcgctagcctgcttgtgggttcgattgagccttccctatcaaatcaggaccgaaagtacagtagcacgctgcccaatgatgtgcaaacaaccagtggtgatctaaagctggataagattgacccacagcgccaggagctgctggtcaaacttcttgacgtgcctacgggtgattgtcacatttcacctaagaatgtgtccgacggtgtgaagagggtgaggacactactgtcaaacgagagagatagcaaaggccgggaccacctaagtggcgttcccacagatgtcactgtcaccgaaacccctgagaagaacacagaaagcctgattttaagcctaaagatgtcaagcctggggaaaatccaggtgatggaaaagcaggaaaagggtctgacactgggagtggaaacttgcggatctaaggggaacgctgagaagtccatgtcagcaactgagaaacaggagcgaacggtcatgtctcatgggtgcgaaaattttaatacgcgggacagtgtgaccggaaaagaatcacagggcgagcgcccgcacctgtccctgttcatcccaagggagactacctatcagttccactctgtgtcacagtcgagtagccagtcgctggcctccctggcaaccacctttctccaggaaaaaaaagctgaggcccaaaatcaccattgcgtgccagatgttaaggcattaatggaatccccagaaggacaactgtctcttgagccaaaatcagactcccagtttcaggcgtcccatacgggctgccagagtcctctgtgtagcgctcagaggcacactccccaaagcccatttactaatcatgctgcagcagcgggcagaaagacccttcgatcctgtatgggcctggaatggttcccagagctttaccctggatatctgggcctgggagttcttcccggcaagccccagtgctggaacgccatgactcagaagcctcaactcatctctccccaaggtgagagactgtctcagggatggatccggtgcaatactactataaggaagtcagggttcggcggcattactatgctgttcactggctattttgtgttatgctgctcctggtccttccgcaggttaaaaaagctctgtcgtcccttgccatggaagagcactgttccaccctgcatcggggtggccaagacaacgggcgattgccgcagcaagacctgcctggactag

SEQ ID NO: 41187 - DNA, 1830 bp, Artificial Sequence
  Description of Artificial Sequence: Synthetic coding sequence
atgagcgacaaccccccccggatggaggtgtgcccctactgcaagaagccctttaaacgtttgaaaagccatctgccctactgtaaaatgataggtcctacgattcccaccgaccaaaaagtttatcaaagcaagccagccaccctgcctcgcgcgaaaaaaatgaaagggcctattaaagacctgatcaaagccaaaggcaaagaattggagacggaaaatgaagagagaaactcaaagctcgttgtcgataaacccgaacagacggtcaaaaccttccctctccctgccgtgggactggagagagctgctacaacaaaagctgataaagacattaagaaccctattcagccctctttcaagatgctgaaaaatacaaaaccaatgactactttccaggaggagactaaagcccagttctacgctagtgaaaagacttctcccaagcgcgagctggcaaaggatctgcctaaaagcggcgaaagtcgctgtaacccctccgaagctggagcatcattgctggtgggctcaatcgaaccctcattgtcaaaccaagacaggaaatattccagcacactgcccaacgacgttcagaccacttcaggagacctgaagcttgacaaaattgatccccagcgccaagagttgctagtgaagctcctggatgtaccaaccggagattgtcatatttcgcccaagaatgtgtctgacggagtgaagcgggtgcggactctgcttagcaacgagcgcgactcaaaaggaagagatcatctgtctggtgtgcccacagacgtaaccgtgaccgagacccccgagaagaataccgaaagcttaattctgagcctgaaaatgtcaagtctgggtaagatccaggttatggagaaacaggaaaagggcttaacactcggggtagaaacatgtggatctaagggtaacgccgaaaaatctatgtccgcgaccgagaagcaagagagaaccgtcatgtcccatggttgcgaaaacttcaacaccagggatagcgttaccggcaaggagtcgcaaggagagagacctcatctatcactgtttattccgcgcgagaccacttaccaatttcacagtgttagccagtccagttctcaatctcttgccagtctggccacaaccttcctgcaggagaaaaaggctgaagcccagaatcaccactgtgtcccggatgtgaaggcactgatggagagccctgagggtcagctgagcttagaacccaagtctgattcgcagttccaggccagccacacaggctgccagagccctctctgcagtgcacagaggcataccccacagagccccttcacgaaccatgcagctgcggcagggcggaaaacacttcggagctgcatgggccttgagtggttccccgaactataccccggttacctcggtttgggggtgctgcccggtaagcctcagtgttggaatgccatgacccagaagccacagctgatttccccacagggcgagaggttgagtcaggttagtctgctcgagaggtctagcacgcacattagaagcctcgagcctccagctggactcacaaccagcaacttcagtttgatgcgactgctgggcgccgttcagaagggttggattaggtgtaacacgaccattcggaagtcagggttcggtggcattaccatgctattcacaggctacttcgtcctgtgttgctcatggtcctttcgcaggttaaaaaagctctgtcgacccctcccatggaagagcacagttccaccttgtataggggttgctaagaccactggggactgccggagcaaaacctgtctcgattag

SEQ ID NO: 41188 - DNA, 1752 bp, Artificial Sequence
  Description of Artificial Sequence: Synthetic coding sequence
atgagcgacaaccccccccggatggaggtgtgcccctactgcaagaagccctttaagcgcctgaaatcacatctgccttattgcaaaatgatcggtccgaccattcccactgaccagaaagtctaccagagcaaaccggctacccttccacgggcgaaaaaaatgaaaggccctattaaagatcttattaaagccaaagggaaagaactggaaaccgaaaacgaagagcggaattcaaagcttgtggtcgataaaccagaacagaccgtgaagacttttcctctgcccgccgtcggtctggaaagagccgcaacgacaaaagcagacaaggatattaagaaccccattcagcccagcttcaagatgctgaaaaatactaagccaatgaccacattccaggaggaaacaaaagcacagttttatgcgtccgagaaaactagccctaaacgggagcttgcaaaggacctccccaaaagtggcgagtcccgttgcaatccatctgaggccggcgcctctctcctggtcggatccatagaaccaagtttatcaaaccaagatcgcaagtattcatctacactgccaaatgacgtgcaaaccaccagtggagacctaaagctggataagattgatccgcaacggcaggagctgctcgtcaagttgctcgatgtccctacaggcgattgccacatttcacccaaaaatgtctcagatggggtaaagcgggttcggacactcctgtctaatgaacgtgactctaaaggaagggatcacctcagcggcgttcctacagacgtgaccgtgacagaaaccccagaaaagaacaccgaatccctgattcttagcttgaagatgtcgagtctgggtaagatccaggtaatggaaaaacaagaaaagggcctgaccctgggcgtcgagacttgtggatctaagggaaatgccgaaaagtctatgtctgcaaccgagaagcaagagcgcacggttatgtcccacggctgcgaaaactttaacactcgcgacagcgtgaccggaaaagagtcgcaaggggagcgcccccatctgtcactctttattccacgggagaccacttaccagttccattcagttagccagagttcctctcaatctctggcttccttagcaacaacattcctgcaggagaagaaggccgaggcccagaaccatcactgcgtcccggacgtcaaagctctgatggagtctcctgagggccagcttagcttggaacccaagtcagattcacagttccaagccagccataccggttgccaatctcctctctgttccgctcagcgacatacaccacaaagcccattcacaaatcacgccgccgctgctggtcgcaagaccttaagaagctgtatgggtttggagtggtttcccgaactgtatcctggatatcttggcctgggggttttacccggtaagccacaatgttggaatgctatgactcaaaaaccacaattgatcagtccccagggggaacggcttagccaagtctcactgctggagcgttcgtctacacacattcgctccttagaaccaccagcgggccttacaaccagcaatttctctttgatgcgtttgctgggagccgtccagaaaggctggattagatgtaatacaaccatacggaagagcggcttcggaggaatcacaatgctgttcaccggctattttgtgctctgctgttcctggtcctttaggagactgaaattacaacgatggcgtaaatag

SEQ ID NO: 41189 - DNA, 1740 bp, Artificial Sequence
  Description of Artificial Sequence: Synthetic coding sequence
atgagcgacaaccccccccggatggaggtgtgcccctactgcaagaagcccttcaaacggcttaagagccatttgccgtactgcaagatgattgggcccactattccaactgaccaaaaagtgtaccagagcaagcctgctacactgccacgcgcgaagaagatgaaaggtcccattaaagacctcataaaggctaagggcaaagagctagaaacagagaatgaggagcggaactccaaactggttgtggacaaaccagaacagacggttaagacctttccccttccggccgtgggtctggaacgcgccgccactaccaaagccgacaaggacattaaaaacccaatccagccctccttcaagatgcttaaaaatacaaagccaatgacaaccttccaagaggaaacaaaggcccagttttatgctagcgagaaaacttctcccaaaagggagcttgctaaagatcttccaaaaagtggtgagtctagatgtaatccttctgaggctggggcttccttactggtcgggagtatcgagcccagtctctccaatcaggatcgcaagtattcttctaccctgcccaatgatgtccaaactacgagtggtgacctgaaattagacaagatcgatccgcagaggcaagaactgctggtgaaactcctggatgtgccaaccggagattgtcacatatcccctaagaatgtcagcgacggtgttaagagggtgcgtacactcctgtctaatgaacgggactcgaaaggacgcgatcatttgagtggagtgcccacagacgtgacagttacagaaacccccgagaagaacaccgagtccttaatcctgagcctgaaaatgtccagccttgggaaaatccaggtgatggaaaaacaagagaaagggctgaccctgggcgtggaaacatgcggatctaagggcaacgccgagaagagtatgagtgcaaccgagaagcaggagaggactgttatgtcacacggctgcgaaaactttaacacaagagattctgtgaccggtaaagagtctcaaggagaacggcctcacttgagcctgtttatccctcgtgagactacttatcagttccatagcgtgagccagtcatcatcacaaagtctcgcttcgctcgctaccacatttctccaggaaaagaaggctgaagcacagaaccatcattgcgtgcccgatgtgaaggcattgatggaatccccagagggacagttgtctctggagcccaagagtgatagccagtttcaagcgagccacacagggtgtcagtctccactgtgcagtgcacaaagacacactccgcagtcccccttcaccaatcacgctgctgcggcggggcgcaaaaccctgagatcatgtatgggcctggagtggttccctgagctctaccccgggtatctgggtctcggagtgcttcctggtaaaccccaatgctggaatgccatgacgcaaaagccccagctgatttctccacagggggagaggctctctcaggtctccctgctggagcgatcgagcactcacatcagatccctcgaaccccccgccggcttaaccacatctaacttttctctgatgcgcctgttgggtgccgtgcaaaagggttggatcaggtgcaacactacaatcaggaagtcaggctttggtggcattacaatgctgtttaccggctattttgtgctctgttgctcttggtcattccgcagattaacgctgcagtag

SEQ ID NO: 41190 - DNA, 225 bp, Artificial Sequence
  Description of Artificial Sequence: Synthetic coding sequence
atgagcgccaacggcgccgtgtggggccgggtgcggagccggctgcgggctttcccagagagactggccgcctgcggcgccgaagcagctgcttatggaagatgtgtgcaggccagcacagcacctggtggacgcttatctaaggacttctgcgctagagagttcgaggccctccgtagctgcttcgcagctgccgcaaagaaaacactggagggcgggtgctag

SEQ ID NO: 41191 - DNA, 444 bp, Artificial Sequence
  Description of Artificial Sequence: Synthetic coding sequence
atgctgctgcggcgggtggtggagggcggccgggccgtggccgccgctgttcgtggcagtggggcgaggagatttagcagccccgactgttgccagcggctcccaggtggaggctcatttctgcaaaggcaccatccgggagcccaagcccccgatggtagaagaaagttcggcacggatcacgtagaagtcggaagccaggcaggtgcggacggaactagaccgccaaaagcctccctaccacctgagttgcaacctcctacgaactgctgtatgagcggatgtcccaactgcgtttgggtagagtacgctgatcgccttctgcagcactttcaagacggcggtgaaagggcccttgccgcacttgaggagcatgttgccgacgagaatttaaaggcatttttgaggatggagatccgtctgcacacgcggtgcggggggtag

SEQ ID NO: 41192 - DNA, 633 bp, Artificial Sequence
  Description of Artificial Sequence: Synthetic coding sequence
atggtggccgacatcaagggcaacgagcagatcgagaagtacagctggagggaagcctgtgacaccggatcttctcgcatggacagaaaacacggcaagtacatcttgaacgttgagcatagcgaaaaccagccccctattactcacccaaatgatcaggaagcccatagttctatttgctggtgcttgccatccaacgacataacatcggatgtttcacccaatcttacaggggtttgcgtgaaccctggcatcctggcgcactcccgatgtctgcagtctgagagttgcaacacacaggttaaggaatactgcaggaacgactggtctatgtggaaggtgttcctggcttgtcttctggcatgtgtcatcatgacagccatcggagtgctgattatctgcctcgtgaataacaaggggagcgccaatagctccattgtgattcagttatcaactaacgacggagaatgcgtgacagttaagccggggacccccagtccagcgtgtccccccaccatgacaacgacctccacagtgcctgcttccaccgcaaccgaatctaccacatctacggcgaccgctgcgactacatccactgagcccatcactgtggccccaactgaccacctttag

SEQ ID NO: 41193 - DNA, 306 bp, Artificial Sequence
  Description of Artificial Sequence: Synthetic coding sequence
atggaccagtacgtgagcaccgcccccccccggttccccatcgcccaacttggcacgtttaagcaggactcagctggcatgggtagaatattcaagggaaatctactccagaaaaaagcgctgaccacgtttgagaatgagcaccacatccgattcttcacccttctggtgctttttcacgttatggttctcctcaggaatcattctaggatacagggtgttagtgaagattggaaacgcgctaactcaatctttaggaactttctccgactgaagagttcacgaaatactgctgaggcagaatag

SEQ ID NO: 41194 - DNA, 306 bp, Artificial Sequence
  Description of Artificial Sequence: Synthetic coding sequence
atggaccagtacgtgagcaccgcccccccccggttccccatcgcccaactgggaactttcaagcaggacagcgccggaatgggaaggattttcaagggaaatctgttacagaaaaaagcactgacgactttcgagaatgaacaccatattcgttttttcacattactggtgctgttccatgtaatggtgctgttgaggaatcattcgcggatacagggggtgtccgaagactggaaacgggctaattcaatctttagaaacttcctgagattgaagtcaagtagaaataccgccgaggccgagtag

SEQ ID NO: 41195 - DNA, 648 bp, Artificial Sequence
  Description of Artificial Sequence: Synthetic coding sequence
atggacaaggtgcagagcggcttcctgatcctgttcctgttcctgatggagtgccagctgcacttatgcctcccttatgctgacggcctgcatcccaccggcaacatcactggcctccctgggtcgaagcgttctcagcctccaaggaacatcacgaaggaaccaaaggtcttcttccacaaaacacagctgcctggcatacaaggcgccgcctcccggagcaccgctgcctctcctactaacccaatgaaatttctgaggaataaggctatcattaggcaccgccctgcgctcgtcaaagtaatactgataagttccgtggctttttcaattgcactcatctgtggtatggcaatcagttacatgatatatagattagcccaggccgaggaacggcagcagcttgagtcactctacaagaacctccgaataccccttctgggcgacgaagaggagggttctgaggacgagggcgagagtacacacctcctgcccgagaatgagaacgaattggaaaaatttattcattctgttatcatatccaaaagatcaaaaaacatcaaaaagaagctaaaagaagagcagaacagcgtaacagaaaacaagaccaaaaacgcctcccataatggaaagatggaggatctgtag

SEQ ID NO: 41196 - DNA, 2178 bp, Artificial Sequence
  Description of Artificial Sequence: Synthetic coding sequence
atggccaccgccgccaccaccaccaccaccaccaccgccaccgtggcattgactaccagttgggataacgctacaggaagaccgactgccgagcccgatcccatccttgacaattatgttctgttagttgttgtgatgtcgctgttcgtgggtgggactctggtcgtgttaagcggcgtactgctgctttgtaagaggtgttgggacgttcaccagcgactcaaccgtgcgatggaggaagcagaaaaaacaaccacaacatatctggataatggtacacacccggcccaggaccctgatttccgcggggaagatccagaatgccaggacgcagagacagagaggtttctttccacttcttccactgggagacgcgtctcctttaatgaagccgccttgttcgaacaaagcaggaaaacacaggacaaaggtcgtcagggtggatggcagtctacggctgctggtgcaagcggaatgggtggcggaagagcccttatggcacggtgttgtcgccgctacacgctgaccgaaggagacttccatcacctgaaaaatgcacgtctgacacacctgcatctgcctccgttaaagattgtgactatccacgaatgcgactcgggagaggcctcctctgccaccacacctcatccggcaacgagcccaaaggccacactagccattttccaacctccaggcaaagcgcttacaggaagaagtgtaggaccgtcgtctgcactgcctggagacccgtacaactcggccgcaggtgcaaccgattttgccgagatttcccccagtgcctcttctgattccggtgagggcacatccttagatgccggcaccaggtctaccaaggccggcggacctggggcagcggcagggcccggcgaggctgggccagggtctggggcgggcactgtacttcagttcctgactagactgaggcgtcacgcaagcctggacggcgcctccccctattttaaagtgaagaaatggaaactggagccaagccaacgggcagcaagcctggatacacgcggctcacctaagcggcatcacttccagagacagagggccgcatctgagagcaccgagcaggaggagggcgacgctccccaggaggacttcatccagtacattgcccgagctggggacgccgtggccttcccacatccacggcctttcctcgcctcaccacccccagcgcttgggcgccttgaagccgctgaggcagcaggaggtgcttcaccagactcccctccagaacgcggggctggatccgccgggccagagcagcagcagcctcccctggaacccgacgctgaacgcgacgccggccccgagcaggctcagacatcttacagagatctttggtctctgcgagccagcttggagttgcatgcagccgctagcgaccattcatcctccgggaacgaccgtgacagcgttaggtcaggcgacagcagcggttctggttcagggggtgccgcgcccgcattcccccccccaagtccccccgctcctaggcccaaagatggcgaggcccgtagacttctgcagatggacagtgggtatgcaagcatcgaagggcgcggcgccggagacgataccgagcccccagccgcccccgcccggcctcggtctcctagagcctggccaaggaggccacgccgcgactatagtatcgatgagaagaccgacgccctgttccacgagtttctgcggcatgacccccacttcgacgacacgccagccgcagcgagacacagagcgcgagcacacccacacgcgcgaaagcagtggcagagaggaagacaacactcagatccaggggcgcgggctgcccctgccctcgctggaacaccggctccacccgctggagcagcccgcccagctagagctcccttaagacgcggcgactctgtagacggaccacctgatgggagaaccttggggggcgccggagacgatcccgccattcccgtaattgaggaggagccagggggcggggggtgtcctggaagcgggctgtgcgtcctccccagcgggtcagtcttggacaaacttgccgcaggtctggatgaacgccttttcccaccccgcctggcagagccagttgtggcgacacccgccctcgtggctgccgctcccacaagccccgaccactctccagcctag

SEQ ID NO: 41197 - DNA, 693 bp, Artificial Sequence
  Description of Artificial Sequence: Synthetic coding sequence
atgccctggaccatcctgctgttcgccgccggcagcctggccatccctgctcccagcataaggctcgttcccccctatccatccagtcaggaggaccctatacacattgcctgcatggcccccgggaacttcccgggcgccaattttaccctgtatcggggcggacaggttgtgcagctcctgcaggccccaaccgatcagcggggagtgacttttaatttgtctgggggtagttccaaagccccagggggccctttccattgtcagtatggggtgctgggcgagctgaaccagtctcagctgagcgacttgtctgaacccgtgaatgtttctttccctgtgccaacatggatactggtactttcccttagcttggctggggcccttttcctgttagctggcctggttgctgtggctctggtagtacgcaaagtgaaactgagaaaccttcagaaaaaacgggacagagagtcatgctgggctcagatcaactttgactccacggatatgtcgttcgataatagcctctttactgtttcggccaagacaatgcctgaggaagaccctgccaccctggatgatcactcgggaacgaccgccacaccttctaactcccgtacgaggaaacggcccacaagcacctcctctagtccagagacccccgaattctctacctttagggcttgccagtag

SEQ ID NO: 41198 - DNA, 1215 bp, Artificial Sequence
  Description of Artificial Sequence: Synthetic coding sequence
atggccctgagcctgcccctgggcccccggctgggcagcgagcccctgaaccatcctcctggggcccctagggaagcagacattgttggatgcaccgtttgtcctgccagcggggaagaaagtacgtccccggagcaggcacaaacactagggcaggacagtttggggcctcccgaacactttcagggtggcccgaggggcaatgagcctgctgctcacccacctagatggagtacccctagctcctacgaggaccccgccggcggcaagcattgcgaacaccccatctctggattagaggtgctggaagctgagcagaacagcctccacctgtgtctattgggcctcggtcgtagattgcaagatcttgaacaggggctcggacactgggcccttgcacaaagcggcatggtgcagctgcaggccctacaagtggatctgagaggggctgctgagcgggttgaggcgctgctggcctttggtgagggactcgcccagcgttcagagcctcgggcttgggccgcactcgaacagattttacgggcactgggtgcttatagagacagtatctttaggaggctctggcagctgcaagcccagctcgttagttactccctagtgttcgaagaagctaacaccctggatcaagacctggaggtagagggcgactcggactggccgggccctggaggcgtgtggggcccgtgggcccccagcagcctgcccacgtctaccgagctggagtgggaccctgccggggatattggggggctgggacctctgggacagaaaactgcccggaccttgggtgtaccctgtgaactctgtggtcagcgcgggcctcaagggcgggggcagggcctggaagaggcagatacatctcactctcggcaggatatgctggagtcgggcctgggccatcagaaacgccttgcccgacaccaaaggcatagcctcctgagaaagccccaggacaagaaacggcaggcttctccacatttgcaagacgtgaggcttgagggcaatcctggcgctcctgatccagccagtcgtcagccattgacattcctccttattctgttcttgctgtttctgctgcttgtgggagccatgtttctccttccagcaagtggaggtccatgctgctcgcacgctcgaatccctcgcaccccctacctggtgctcagctacgtgaatggcttgccgcccgtttag

SEQ ID NO: 41199 - DNA, 876 bp, Artificial Sequence
  Description of Artificial Sequence: Synthetic coding sequence
atggccctgagcctgcccctgggcccccggctgggcagcgagcccctcaatcacccacccggagctccgcgagaagcagacattgtgggatgtacagtctgtccagcatctggcgaagagtctacatctccagaacaggcccagacactggggcaggacagtctgggtcctcctgaacacttccagggcgggccgcgaggcaacgaaccagcggcccacccacctcgctggagcaccccaagtagttacgaagatccggctggagggaaacactgtgaagtgttcgaagaggccaatactttagaccaagacctcgaagttgagggcgacagtgattggccagggccagggggagtctggggaccatgggcgccaagctctcttccgactagtacagaactggagtgggatcctgctggcgatatcggcggtttgggacctcttggacagaagacggcaagaacactgggagtaccatgcgaattgtgtggacaacggggacctcaaggtcggggccagggcctggaagaggccgatacctctcactcaaggcaagatatgctggaatctggcctagggcatcagaagcgcctcgcccgccaccagcggcactcactactgagaaaaccccaggataagaagcggcaggccagcccgcaccttcaagatgtgcgcctcgaagggaaccccggagcaccagatccagcttcaagacagccgctgacatttctgctgatcctgttccttctattccttctcctggtgggggccatgttcctcctccctgcatccgggggtccctgctgttcccacgctcggatacctcgtacaccctatttggtgctctcgtacgttaatggactccctcctgtgtag

SEQ ID NO: 41200 - DNA, 564 bp, Artificial Sequence
  Description of Artificial Sequence: Synthetic coding sequence
atggaggtggaggagatctacaagcaccaggaggtgaagatgcaggctccagccttccgggacaagaaacaaggtgtgagcgccaaaaatcaaggggctcacgaccccgattatgaaaacatcacactggcattcaagaatcaggatcacgctaaaggcggacattcccgtccgacaagccaggttcctgcgcagtgtcgcccaccatcagacagtacccaggtgccatgctggctgtaccgggctatcctgtccctgtatatcctcctagccctcgctttcgtcttgtgcattattctctcagctttcattatggtcaagaatgctgaaatgtcgaaagaactgttaggatttaagcgcgagctgtggaacgtgagtaattccgtccaggcatgtgaggagagacaaaagagaggatgggattccgtacagcaaagcatcaccatggtgaggtccaagattgatcgattagaaaccaccctggccgggatcaagaacattgacaccaaagttcagaaaattctcgaagtgcttcaaaaaatgcctcagtcatcaccacagtag

SEQ ID NO: 41201 - DNA, 357 bp, Artificial Sequence
  Description of Artificial Sequence: Synthetic coding sequence
atggtggcccgggtgtggagcctgatgcggttcctgatcaagggcagcgtggcaggaggcgctgtatatctcgtgtacgaccaggaactgctaggaccatctgataagagtcaggccgcacttcagaaggcaggtgaagtcgtgccacccgccatgtatcagttttcacagtacgtttgccagcagaccggactgcaaatcccccagcttccagcccccccgaagatctacttcccaatcagggattcctggaacgctggaatcatgaccgtgatgtctgccctgagtgtcgccccaagcaaagctagggaatattccaaggagggctgggagtatgtgaaagccaggaccaagtag

SEQ ID NO: 41202 - DNA, 594 bp, Artificial Sequence
  Description of Artificial Sequence: Synthetic coding sequence
atgctgcccctgctgcagctggtgcccgccaagctgctgaacagcagctgctcacttgagaaaacattacaatgctcatgtagctttcatgggatccctacaccttcagtgcagtggtggatgggcggggtacccgtgggggtggatggcatggacggaagtcttcaggtcaccagcactatgctcggtccttgggcaaactccaccatatccctgaccgaggaaccggagatgggaatgcgcttgctctgtgagggcaaaaaccagaatggcacacacgcccttagcattctgcttatgtctaggaagagctcacttgctgcacaagccttcgtcaaaggactgattcagggagccatctatgctggaattgtgatcgctcttctgttcctgtgtctcctgccactcatagtgaagcatatcaggaagaagcaggcaaagaaggccgccgcaatcagggcaaaaaaatcatctaaggtgcgggcatcccaggaactcgagatgagcctcaaacccgaggaaccgggcaaaccagtcgtcgccacctttagtgagtcacggatactcgagaagcaagacaagagggccagctag

SEQ ID NO: 41203 - DNA, 513 bp, Artificial Sequence
  Description of Artificial Sequence: Synthetic coding sequence
atgcggcggcggctgtggctgggcctggcctggctgctgctggccagagcgcctgacgccgccgggacaccgagcgcatcaagaggaccacggtcctatcctcatctggagggtgacgtgagatggaggagattgttctcctctacgcatttctttttgcgggtagaccccggaggtcgcgtacagggaacccgatggcgccatggtcaagattctatactggaaatacgcagcgtgcacgtcggagttgtggtcatcaaagctgtatcctctggcttctatgtggcaatgaacaggagaggtagactgtatggatcaagattgtacactgtcgactgcaggttccgggagcggattgaagaaaacgggcacaacacctacgcctctcagagatggcgccggcggggtcagccgatgtttctggctctggatagacgtggtggtcctcgacctgggggccgaactaggcggtatcacctcagcgcccactttctccccgtattagtaagctag

SEQ ID NO: 41204 - DNA, 1116 bp, Artificial Sequence
  Description of Artificial Sequence: Synthetic coding sequence
atggcctggaccaagtaccagctgttcctggccggcctgatgctggtcaccgggtccatcaacacattgtccgcaaagtgggcagataactttatggcagagggctgcggagggagtaaagaacattctttccagcacccctttttgcaagccgtgggcatgtttctgggcgaattcagttgtttggctgccttctatctgttgaggtgccgcgctgcaggacagtccgattctagcgtggatccacagcagccatttaatcctcttctgtttctaccgcctgcgctgtgcgacatgacaggaacctcactgatgtacgtggctctgaacatgacttctgcttcctcctttcagatgcttcggggcgccgtgataatctttacaggactcttttccgtggcctttctggggaggcgactggtgctgtcccagtggctggggatcctggccacaatcgccggcctcgtcgtggtcgggctggcggacctcttgagtaagcacgatagccagcacaaactcagcgaagttatcactggcgatctactgatcattatggctcaaattatcgtggctattcagatggtcctcgaggagaagtttgtctataagcataacgttcaccctctgcgggctgttggaacagagggcctttttgggttcgtgattctcagccttctactggtgcccatgtactacatcccggcaggatcctttagtggcaaccctaggggaacactggaggatgcacttgatgctttctgtcaagttggacaacaaccactgattgctgtggctctactaggcaatattagctctattgcctttttcaattttgctggcatctcagtgactaaggagctgtctgcgaccactcgcatggttctagactctctgagaacagtggtcatttgggcattgtccttggctctcgggtgggaagcgtttcacgccctgcagatcctcggctttttgattctgctcattggaaccgcgctatataatgggctgcaccggccattgctggggcgcctttcccgggggagacccctagctgaggagtctgaacaagagcgcctgttgggagggacacgcacccctattaacgatgcaagctag

SEQ ID NO: 41205 - DNA, 867 bp, Artificial Sequence
  Description of Artificial Sequence: Synthetic coding sequence
atgggcggccagttccacggccggggcctgtggcgggagcagggcgcccagcttcctgccagtctgcctccagcattaaacatgacatccgcctcctcattccaaatgttaagaggtgcggtgatcatcttcactggactcttctctgtggcattcctggggagacgattagtgttgtcccagtggcttgggatcctggctaccatagctggactcgtcgttgtgggcctcgcagatctgctgtcaaagcatgattcccagcataagcttagtgaggttatcacaggcgaccttctcattatcatggcacagattatcgtggccatacagatggttctggaggaaaagttcgtgtacaaacataatgtgcaccccctccgcgctgttgggactgagggcctgtttggctttgtgatccttagtctgctattggtgccaatgtattatatacccgcaggttccttcagcggaaacccacggggcactctggaggatgccttagatgccttctgccaggtcgggcagcagccgttaattgctgtggcactgttgggcaacataagctccattgcgtttttcaattttgccgggattagtgtgactaaggagctgtctgccacaacgagaatggtgctggattccctacgaaccgtggtgatctgggccctgtcactcgctctaggatgggaggctttccacgccctgcagatcttgggattcctcatacttctgatcggcacggcactttacaatggcctccaccgccccctactgggacgccttagccgaggacgacccttagctgaggaaagtgagcaggagcgactgttgggcgggactaggacacctattaacgatgcttcctag

SEQ ID NO: 41206 - DNA, 855 bp, Artificial Sequence
  Description of Artificial Sequence: Synthetic coding sequence
atgaagaccagcgccgagctgcacgagcaggagaagccccccagcagccctcgtgcgaccgggcccggccgcctgggccacgctcgcggtcgaggccctgatgccctcagaggtggtgcagccgggcctggccgggcctcatccggggcccctcgcgaacgcaagatggcaccacatgatccagggagtctgaccaccctcgtgccatgggcggctgcactgctccttgcgctgggggtggaaagagccctcgctttgcccgagatttgtacccaatgtccaggctccgtgcagaatttatccaaagtggcgttttattgcaagactacccgggagttgatgctccatgcacgttgctgtctgaaccaaaagggaaccatccttggtctggaccttcagaactgctcactggaagacccaggaccaaacttccaccaggcccacacgacagtgatcatagaccttcaggccaaccctctgaaaggtgacctggccaacacgttcagaggatttacacagttgcagactctcatcctgccccagcacgtgaactgcccaggagggattaatgcctggaataccattacctcctatatcgataatcagatttgccagggacagaagaatctctgtaataatactggggatcctgagatgtgtccggagaatggctcctgtgtgcctgatggacccgggcttctgcagtgtgtatgcgccgacggcttccacggctacaaatgtatgcggcaggggtccttcagtttgctgatgttcttcggaattttgggcgctactaccctgagcgtctctatcttgctttgggcgactcagcggcggaaggccaaaacctcctag

SEQ ID NO: 41207 - DNA, 516 bp, Artificial Sequence
  Description of Artificial Sequence: Synthetic coding sequence
atgctgcacgcccggtgctgcctgaaccagaagggcaccatcctgggcctggatctgcagaactgctctctggaggaccccgggccaaatttccaccaagcccatactaccgtgattattgatctgcaggcaaatccattaaaaggtgatctcgccaacacgtttagggggttcacccagttgcagacactcatattaccccagcacgtcaactgccccggcgggattaatgcctggaacacgattacgtcctacattgacaaccagatttgtcagggccagaagaatctgtgcaataataccggagatcctgagatgtgcccagaaaacggatcttgcgtcccagatggccctggtttacttcaatgtgtatgtgctgatgggttccatggatataaatgtatgcgccagggatcattctcacttctgatgtttttcggtatactcggagctaccacccttagcgtatctatcctcctctgggctacccagcgccgaaaggcaaaaacaagctag

SEQ ID NO: 41208 - DNA, 228 bp, Artificial Sequence
  Description of Artificial Sequence: Synthetic coding sequence
atgctgcacgcccggtgctgcctgaaccagaagggcaccatcctgggactggatttgcagaactgctccctagaggatccagggcctaacttccaccaagcacatacaacagtcattattgacttgcaagcaaatccactaaagggcgaccttgccaatacattcagaggctttacccagctgcagacattgatccttccacagcacgtcaactgccctgggggatag

SEQ ID NO: 41209 - DNA, 876 bp, Artificial Sequence
  Description of Artificial Sequence: Synthetic coding sequence
atggccctggccgcccggctgctgccccagttcctgcacagccggtcattaccatgtggggccgtcaggctccgcacccctgccgtggcggaagtgcgtctgccctccgcgacgttgtgctacttctgcaggtgtcgactcggactcggggccgcactattccctcggagcgcacgggccctggctgccagtgccctgcctgcacagggatcccgctggcccgttttgagctctccaggccttcctgccgccttcgcctccttccccgcgtgcccccagagaagttattccactgaagaaaaacctcagcagcatcagaaaacaaagatgattgtgctcggcttcagcaatcctatcaactgggtaagaacccgtatcaaagccttcctgatttgggcctacttcgataaagaatttagcatcacagagttctccgaaggtgctaaacaggctttcgctcacgtctccaagctgctgtcccagtgtaaattcgatctgcttgaggagctagtggccaaagaagtcttgcacgccctcaaggagaaggtcacctccctgcctgataaccataagaatgctctggctgctaatattgacgagatcgtttttacatcaaccggagacattagcatttattacgatgaaaaaggccggaaatttgttaatattttaatgtgtttctggtacctgacttccgcaaatattccctcagagaccctgaggggggcttccgtgttccaggtgaaacttggtaatcagaatgtggagaccaagcagctattgagcgcttcttatgaattccagcgggagttcactcagggtgtgaaacccgattggacaatagcccgcattgaacactcaaagctgctggagtag

SEQ ID NO: 41210 - DNA, 876 bp, Artificial Sequence
  Description of Artificial Sequence: Synthetic coding sequence
atggccctggccgcccggctgctgccccagttcctgcacagccggtctcttccatgtggcgccgtgaggctgcgcacaccggcagttgctgaggtgcgtctgccttcagcaaccctgtgctatttctgtcggtgtcggctgggcctgggggctgctctgttccctagaagtgctagagcactagcagcaagcgctcttcccgcacagggatctcggtggccagttctttcgtctcccggcttgcctgccgctttcgccagtttccctgcctgcccacagcgctcatactccacagaagaaaagcctcaacagcatcaaaagactaaaatgatcgtactggggttttccaacccaatcaattgggtccggactagaattaaggcattcctgatctgggcctattttgacaaagagttctctattaccgagtttagtgaaggcgccaagcaagctttcgctcacgtgtccaagctcctctctcaatgtaaattcgatctcctggaggagctcgtcgccaaggaggtgttacatgcccttaaagagaaagtcacctccctaccggataaccacaagaatgcccttgctgcaaacatcgacgagatcgtatttacctccactggcgatatctctatttattacgatgagaaggggcgcaagtttgttaatatcttaatgtgcttttggtacctcacaagtgcaaacattccaagtgaaacactgagaggcgcgtccgtattccaagtgaaactcggcaaccagaatgtggagactaaacagctgttgtcggcatcatatgaattccaacgggaatttacacagggggtgaagcccgattggacaatcgccagaatagaacattcaaagttgttggagtag

SEQ ID NO: 41211 - DNA, 1326 bp, Artificial Sequence
  Description of Artificial Sequence: Synthetic coding sequence
atgagcgtgctgctgcggagcggcctgggccccctgtgcgccgtggccagggccgccatccctttcatttggagaggcaaatacttctccagcggcaatgagcccgcggaaaatcccgttacaccaatgctcaggcacctgatgtataaaattaagtcaaccggcccaattactgttgctgagtatatgaaagaagtgctgacgaaccctgccaagggctactacgtatatagggatatgctaggagagaagggcgatttcataacctccccagaaatcagtcagatctttggggaacttttgggaatctggtttatttcagaatggatggctactggaaaaagtacggcttttcagctggttgagctgggacccggccgaggtacactcgtgggagacatcttgcgcgtgttcactcagttgggttcagtgcttaagaactgtgatatcagcgtgcaccttgtcgaggtgtcccagaagctcagcgagattcaagcgctcacgctcactaaagagaaggtacctctagagcgtaatgccggcagcccagtttacatgaaaggcgttacaaagagcggcatacctataagctggtaccgtgacttacatgatgtgcctaaaggctattctttctacttagcccacgaattctttgatgtcctacctgtgcacaaattccagaaaacaccgcaagggtggagagaggtgtttgtggatatagacccgcaggtttccgacaagcttagatttgtgctggccccaagcgcaaccccagcagaggccttcattcagcatgatgagacccgggaccacgtggaggtgtgtcctgatgccggcgtaatcattgaagaactcagccagcggatagctttgaccggaggcgctgcccttgtcgccgattatggtcacgacgggactaagacggatacctttcggggattttgcgaccacaagcttcacgatgtactcattgcgccaggcaccgcggatctgactgcagatgttgattttagctacctcaggagaatggcccagggcaaagtggccagcctgggccctatcaagcagcacactttcctgaaaaacatgggaattgatgttaggctgaaggtactgcttgataaatccaatgagccatcggtccgccagcagctcctgcagggttacgatatgctgatgaaccctaagaaaatgggtgagaggttcaatttcttcgctctgctgccacaccaacgcctccaaggcggcaggtatcaaagaaatgccagacagagcaagcctttcgcctctgtggtggccggattcagtgagcttgcctggcagtag

SEQ ID NO: 41212 - DNA, 1593 bp, Artificial Sequence
  Description of Artificial Sequence: Synthetic coding sequence
atgcaccccggccggaccaccggcaagggccccagcacccacacccagatcgaccagcagccgccaagactgctgatcgttcatatcgccctcccttcgtgggctgatatctgtacaaatctgtgcgaagccctgcagaattttttcagtttggcatgttctctgatgggcccttcccgaatgtctttgttttccctctatatggtccaggaccagcacgaatgtatattgccgtttgttcaagtgaagggcaacttcgctcggctacagacgtgcatcagcgagctacgtatgctacaacgcgaagggtgttttcggtcccagggcgcatctttgcggctggccgtggaggatgggctccagcagtttaagcagtactctagacatgtgacaacacgggcggcacttacctatacatcactggagataaccattctgacgagccagcctggcaaagaagtcgtgaaacaactggaagaagggttgaaggacactgatctagcacgcgtccgacggttccaggtggttgaggtcacgaaaggcatcttagaacacgtggatagcgcatcgccagtggaggacacctccaacgatgagtccagcatcctggggaccgatattgatctgcagaccattgataacgatatcgtgtcgatggagattttctttaaagcttggcttcataatagtgggaccgaccaggaacagatccatctgctgctgtctagccaatgcttttcgaacatttcgagacctcgtgacaatccaatgtgcctcaagtgcgatctccaagagcggctcctgtgccctagtctgctggcaggtacagctgacgggtcgcttcgcatggacgatccaaagggagactttattaccctctatcagatggcatcccagagcagcgcttctcattacaaacttcaggttattaaagccttgaaatcttctggtctttgcgagagcctgacctacgggttgccttttatcctgcggcccaccagttgttggcagctggactgggacgagctggaaaccaaccagcagcacttccacgctctttgccactccctgctgaagagagaatggctgctgttggcaaagggcgaacccccgggcccaggacattctcagaggataccggccagcacgttctacgtcatcatgcctagtcatagcctcactctattagtgaaggctgtcgccacacgagagctaatgctgccgagtacttttcccctcctccccgaggatccccatgacgactctctgaaaaacgtagaatccatgctcgactcactggagctggaacctacatacaacccactgcacgtgcaatcccatctgtattcacacctgagttcaatatacgcaaaaccgcaggggcggctgcatccccattgggaatcccgcgcacctcgcaagcatccttgcaagacagggcagctgcagactaacagggccagagctaccgtagcgcctcttccaatgaccccagtgcccggcagggcttcaaagatgccagccgcctctaaatccagtagcgacgcctttttcctgccatccgaatgggagaaggatccttctaggccatag

SEQ ID NO: 41213 - DNA, 540 bp, Artificial Sequence
  Description of Artificial Sequence: Synthetic coding sequence
atggacgaccccaagggcgacttcatcaccctgtaccagatggcctctcagtccagtgcctcccattataagctccaagtaattaaagctttaaaaagcagtggcctgtgtgaatccttgacttacgggctgccatttattctgagacctacctcttgctggcaactggactgggatgagctggagacaaatcagcaacatttccacgccctgtgtcattccctgttgagcatgcttgactcccttgagctggaacccacatataaccctcttcatgtgcagtcacatctctattctcacctgagcagcatttatgctaagccacagggccgcctgcatcctcactgggagtctcgggctccacgcaagcacccctgtaagactggccagttacagactaatagagcccgtgccactgttgcacccctgccaatgaccccagtccctggtagagcctcaaaaatgcctgcagcgagcaaaagctcttctgatgccttctttttaccttctgagtgggagaaagaccccagccgcccctag

SEQ ID NO: 41214 - DNA, 429 bp, Artificial Sequence
  Description of Artificial Sequence: Synthetic coding sequence
atgcaccccggccggaccaccggcaagggccccagcacccacacccagatcgatcagcagccccctcgcctactcatagttcatattgcgctgcctagctgggctgatatttgcactaacctatgcgaggccttgcagaactttttcagtttagcgtgtagtttgatgggaccaagccgcatgtcgctcttctccctgtatatggtgcaggaccagcacgagtgtatactaccctttgtgcaggtcaagggaaatttcgctagattgcaaacatgcatttccgaactgaggatgctgcaaagagaaggatgctttcggtctcagggggcaagcctccgtttggccgtggaggacgggctgcagcagttcaaacagtacagcaggcacgttaccacgcgtgcagcactcacctatacaagcctggaatag

SEQ ID NO: 41215 - DNA, 1581 bp, Artificial Sequence
  Description of Artificial Sequence: Synthetic coding sequence
atgcaccccggccggaccaccggcaagggccccagcacccacacccagatcgaccagcagcctcccagattgcttatcgtccatattgctttgccttcatgggctgacatatgcacaaacctgtgcgaggctctgcagaatttcttttctcttgcttgcagccttatggggcccagccgtatgtccctcttctccctatacatggtccaagaccagcatgagtgtatactgccattcgtgcaggtgaagggtaattttgcccggctccagacctgcattagtgagctccgaatgctccaacgggaaggctgcttccggagtcaaggagcctcactgcgactggcagtggaagatgggcttcagcagttcaaacagtactcccggcatgtgaccacgagagccgctctgacatacacgtctctggagataaccatcctgacaagccagcctggcaaggaagtagtgaagcagctggaggaggggttaaaagatacggatcttgcccgggtgagacgcttccaagttgtagaagtcaccaagggtattctagagcatgtggactcagcctcccctgtggaggatacgtctaatgatgagtcctcaatcctggggactgacattgacctccaaaccatagacaacgatatagtttcgatggagatctttttcaaagcctggctacataattctgggacagaccaggaacagattcatcttcttttaagctcccaatgtttctctaacatctccaggccacgcgacaacccgatgtgcctgaaatgtgatctgcaggaacgcctgctgtgcccttcgctgcttgcgggaacagcagacggatccctgaggatggacgacccaaagggggatttcattactctgtatcagatggctagtcagtcgtccgcgagccactataaattgcaggtcattaaggccctgaagtcgtctggcctctgtgagtctctgacctatggtctgccctttattctgcgaccaacttcgtgctggcagctggactgggacgagttagagacaaatcagcaacatttccacgctctttgtcacagtctcctgaagcgagaatggctgcttctcgccaagggggagccccctggaccgggacatagtcagcggatccccgcctccaccttttatgttatcatgccgtcacactcactgacactacttgtaaaagctgttgctactagagagctcatgctgccgagcaccttcccacttctaccagaggacccacacgatgactccctgaaaaatgtggaatccatgctggatagcctggagcttgagccaacttataatcctctccacgtacagtcccacttatacagccacctgagttcaatctatgcgaagccccaaggtcggctccaccctcactgggaaagccgggcgccccgtaaaacaggacagcttcagaccaaccgcgcccgggctactgtggctccattacctatgaccccagtccctggtagggcatcgaaaatgcccgctgctagtaagtcaagttctgacgcattttttctgccctccgagtgggaaaaggatcctagccgaccatag

SEQ ID NO: 41216 - DNA, 864 bp, Artificial Sequence
  Description of Artificial Sequence: Synthetic coding sequence
atggaggagaaggaggacaagcaccagcagcacaagatcgaggacgccgcaatcacatacgtaagcgagaatgaggaaattaaacatgaggagaaacctggaaagtccattcaccattctaagagccacgtaggtaggggccggatttactatgctaagtttattaataccaacgcacgaacttacaacgagccgttcccgtatattgacccaaagaaggggccggagatccagggtgactggtggtcgcacggcaaggccctggaacccgtgttcctacccccctatgactcaaagtcaacccagagaagtgattttcaaaagccttcatgtcccctggtgctcccagtcaaacacagcaaaatgcagaagccttcctgtggcatcgtgcccctggctagtccgggcacctccgccgaactccaaaacaactttatcgagtatatctcatttatacaccagtacgatgcgagaaaaacccccaacgagcccttgcaaggcaagagacatggcgcctttgtccaaagagaaataaagccgggctcacggcctaccgtgcccaagggagcggaggtgttgctgaataccccaggcagcaggtcatctgaacagtccaaaaagacggagaagggtaactccgccgagagcaggatgatttcgcccggactttgtcagcaaaacagtcaagaactcctcgagccaaaaacacatctcagcgagactgacgttaggcaggccgcaaaggcctgcccctccacgcctgagtctcgcgagaaaacaagcggggcgacacaaaccaccgtaggtgatgccctgtttacacgccataagccactgaatcctccaattaaaaagtcggaatag

SEQ ID NO: 41217 - DNA, 366 bp, Artificial Sequence
  Description of Artificial Sequence: Synthetic coding sequence
atggccagctgcctggccctgcggatggccctgctgctggtgagcggggtactcgctcctgcagttcttactgacgatgtcccccaagaacccgtgcccactctatggaatgagcctgccgagcttcctagcggggaggggcccgtagagtctacaagtcccggacgagagcctgtcgataccggccccccggcccccactgttgcccctggccccgaggactcaaccgcccaagagagactagatcagggtggtggctctcttggccctggcgctattgcagctattgtgattgcagccctgctagcaacttgtgttgtactggcactggttgttgtggctttaagaaaatttagcgcctcatag

SEQ ID NO: 41218 - DNA, 366 bp, Artificial Sequence
  Description of Artificial Sequence: Synthetic coding sequence
atggccagctgcctggccctgcggatggccctgctgctggtgagcggcgtcctcgcacctgccgtcttaacggatgacgtgccacaagaacctgtccctaccctatggaacgagcctgctgagcttccctccggagaggggcccgtggagagcacttcacctgggcgcgaacccgtcgacacagggcctcctgctccaaccgtggctccaggaccagaagacagtaccgcacaggaaaggctagatcagggcggtggtagtttgggacctggggccatcgctgccattgtgattgctgccctactggctacttgtgttgtgctggccctcgttgtcgtagctttgcgaaagtttagcgcatcttag

SEQ ID NO: 41219 - DNA, 366 bp, Artificial Sequence
  Description of Artificial Sequence: Synthetic coding sequence
atggccagctgcctggccctgcggatggccctgctgctggtgagcggagttctggctcccgcggtcctgactgacgacgtcccccaggaaccagtgcctacactgtggaatgaacctgccgagctcccatcaggcgagggcccagttgaaagcacctcaccaggacgcgaacccgtggatactggccctcctgccccaaccgtggcacccggacccgaagattcgacagcgcaggagaggttggatcaaggcggggggagcctcgggccaggggccattgcagctatagtaatagcagccttactagccacgtgcgtggtgctggctctcgtcgtggtagcacttcggaagttcagcgcctcctag

SEQ ID NO: 41220 - DNA, 1371 bp, Artificial Sequence
  Description of Artificial Sequence: Synthetic coding sequence
atgagcccctggagctggttcctgctgcagaccctgtgcctgctgccaaccggcgcggctagtcgcagaggagcccccgggaccgctaattgtgagttgaagccccagcaatctgagctgaatagctttctctggacaatcaagcgggacccgccgtcctatttcttcggaacgattcatgtcccttacactagagtctgggattttatcccggacaatagtaaggaagctttcctccaatctagtatagtatacttcgagttagatctgacggacccctataccatctctgccctgacaagttgtcagatgctgccgcagggagaaaatctacaggatgtcctcccaagggacatttattgcagacttaagagacacttagagtatgtgaagttgatgatgcccctgtggatgacaccagatcagagaggtaagggattatacgctgactaccttttcaatgcgatcgctggaaattgggagcgtaaacggccagtgtgggtaatgctgatggttaattctcttaccgaagtggatatcaagtcgaggggcgtccccgtgctggatctgtttcttgcgcaggaggccgaaagactacgaaagcagaccggggctgtggaaaaagtggaagagcagtgccaccccttgaacgggctcaacttcagtcaagtacctaattttattaatgcaaccctgcctccacaagaacgtattacagctcaggagatagatagttatctccgacgagagctgatatataaacgcaatgagagaatcggaaagcgcgtgaaagctctgctggaagagttccccgacaagggcttcttctttgcttttggtgccggccacttcatgggcaataacactgtcctggatgttctgaggcgcgaggggtacgaagtcgagcatgcccccgccgggcgtcctatccataaaggcaagagcaaaaagaccagcacacggccaaccttgagcacaatttttgcccccaaagtgcctacgctggaagtccctgccccagaagccgtcagcagcggacacagcaccctgcctccccttgtatcgcgccctggttccgccgatactccttctgaagcagagcagcgttttaggaagaagcgtaggcgcagtcaaaggcggcctaggctgaggcagttttccgacctgtgggtgcgactggaggagtccgacatcgtcccccaactgcaggtccctgtgttagaccggcacatctcgacagagctgaggctaccacgccgcgggcattctcaccactcacagatggtcgccagttctgcgtgcctatccctgtggacccctgtcttctgggtactcgttttagcgtttcagacggagacgccccttctgtag

SEQ ID NO: 41221 - DNA, 1518 bp, Artificial Sequence
  Description of Artificial Sequence: Synthetic coding sequence
atgagcccctggagctggttcctgctgcagaccctgtgcctgctgcctaccggcgcagcctctaggcgcggcgccccaggcaccgcgaattgtgagctaaaaccccagcagagcgagctgaatagttttctctggacgattaagcgtgatcccccctcttatttttttgggactatccacgtgccctacaccagggtgtgggactttatccccgacaattcaaaagaggctttcttacagagctctattgtctatttcgaacttgacctgacggacccatataccataagcgcccttacgtcctgtcagatgttaccacagggcgagaatctgcaggacgtactcccacgtgacatttattgtagacttaagagacatctggagtacgtgaagctgatgatgccactctggatgactcctgatcaacgaggcaaggggctctatgccgattatctatttaacgctatcgccggaaattgggagcgtaagagaccagtttgggttatgctaatggttaactccctaactgaggtcgatattaagtctagaggggtccccgtgcttgatctttttttagcgcaagaggcagaacgtctacggaaacagactggagcagttgaaaaggtcgaagaacagtgccacccactcaatggcctcaacttctcacaggtgatattcgcacttaatcagacccttctgcagcaggagagcttgagagcgggttcattgcagataccgtatacaacagaggatttaatcaagcactataactgcggcgacttgagctccgtgattctgtcccacgacagcagtcaagtccctaacttcatcaatgccaccctacctccccaggaaagaatcacagcccaagagattgattcctatctaagaagggagcttatctacaagaggaacgagagaatagggaaacgagtgaaagctctgctcgaggagtttcccgacaaaggattcttcttcgcctttggcgcaggacattttatgggcaataacaccgtgctggatgttctgcgccgggagggttacgaggttgagcacgctcccgccggtaggcctattcataaaggtaagtctaaaaagaccagtacacgacctaccttgagtaccattttcgctccaaaagttcctactttagaagtacccgccccagaagccgtctctagcgggcattcaacactgcctccactcgtgtccaggcccggcagcgctgatactccttcagaggcagaacaacgattccggaaaaaaagacgccgcagtcaacgccggcccagacttaggcaattttctgatctgtgggtgagactggaagaatcagatatcgttcctcagctccaggttcccgttctggatcgccacatcagcaccgagttgaggttgccgaggaggggccattctcatcacagtcagatggtggcctcttcagcatgtctctcgctgtggacgccagtattctgggttttggtactcgcttttcaaacggagactcctttactctag

SEQ ID NO: 41222 - DNA, 1878 bp, Artificial Sequence
  Description of Artificial Sequence: Synthetic coding sequence
atgtgcgagaccagcgccttctacgtgcccggcgtggcccccatcaactttcaccagaacgaccccgttgaaatcaaggccgtcaagctaacgagcagtagaacacaactcccctatgagtactacagtttgcccttttgccagcccagcaagattacctataaagcggagaacctgggggaagtcttaagaggcgataggatagtgaatacgccgtttcaggtcctaatgaacagcgagaagaagtgtgaagtgctgtgcagccagagcaacaagccagtgacccttaccgtggagcaatcaaggttggtcgctgaacgaatcactgaagactactacgtgcacctgatagctgacaatctcccggttgccacccgactggagctgtacagcaaccgcgactccgacgataaaaaaaaggagaaggacgtccagttcgagcacggctatcgtttaggattcacggacgtcaacaagatttatctgcacaaccatctcagttttattttatactaccatagggaagacatggaagaggatcaggagcacacttatagagttgttcgcttcgaggttatcccccagagtattcgtctggaggacttgaaggccgacgaaaagtctagttgtaccctacccgaaggtacaaattcgtccccgcaggagattgatcccacaaaggagaatcagctctatttcacctatagcgtgcactgggaagagtctgatattaaatgggcaagtcgctgggacacttatcttaccatgtcagacgtccagatccactggtttagtataatcaatagtgtggtggtcgtgtttttcctgtcaggcatcctcagcatgatcattataaggactctgcgaaaagacattgctaattataataaggaagatgatattgaggacacaatggaggaatcagggtggaaactagttcatggagatgtgtttcggccaccccagtatcccatgattctatcttccctgttgggttccggaattcaactcttctgcatgatactaattgttatctttgtggccatgcttggcatgctctcaccttcatcccggggcgcgctcatgaccacagcttgttttctgttcatgtttatgggcgtcttcggtggatttagcgcaggcaggctgtacaggaccctgaagggtcaccggtggaagaaaggagccttttgtacggcaactttataccccggagtcgtttttgggatatgttttgttctcaattgtttcatctggggaaagcatagttctggcgcagtgccctttcctaccatggtggcactgctttgtatgtggtttggcatctccttacccctggtgtatctagggtactattttggcttccggaagcagccatatgacaatcccgtcagaacaaaccaaatcccaaggcaaattcctgagcagcgttggtatatgaatcgtttcgtgggcattttaatggccggaatcttaccatttggagcaatgtttattgaactatttttcatcttcagcgcaatctgggagaaccagttttactatctgtttggatttttgttcctggtattcatcatcttggtcgtgtcttgcagtcagataagcatcgtgatggtatacttccagttgtgcgcggaggactacaggtggtggtggcgaaactttttggtgagcggaggaagtgccttctatgtactagtgtatgctatcttctactttgtaaacaagcttgacatcgtcgaattcattccatcgctgctgtactttggttacaccgccctaatggtgctgtcattctggcttcttaccggaaccattggattctatgctgcctacatgttcgtgagaaaaatctacgccgccgttaagattgactag

SEQ ID NO: 41223 - DNA, 1701 bp, Artificial Sequence
  Description of Artificial Sequence: Synthetic coding sequence
atgcccggccaccccggcgccgccgagcagctggtgaagaccggctggcgaagctggcatttaggcttctggaaggccctcgcccctctccaggcagcctgggacgcatttagtcagcccgtgcccgccagttgcggacagttgctcacccagctactgttgtgcgctagtttggctgccgccgccgccggcctggtgtatcactggttggccagtcttctgttgtacccacccggaccttctgccatggttgccactgtgtgcggcctccttgtcttcttgagccttggattggtgcctcctgtcagatgtctgttcgccctatctgtcccaaccctcgggatggagcaggggagacgtcttcttctttcctatagtactgccacattagccatcgccgtggtgccaaacgttctggcaaacgtcggtgctgccggccaggtcctacgatgcgtgacggagggatcgttggagtctctgttgaacacaacacaccagcttcatgctgccagccgtgcattgggccctactggtcaggccgggagtaggggcctcaccttcgaggcccaggacaacggctctgccttctacctgcatatgcttcgcgtgactcaacaggttctcgaagacttcagtggcctggagagcttggctcgcgcggcggcgctgggtactcaacgggttgtcacaggactcttcatgctcggcctcctcgttgagagcgcctggtacctgcactgttatttgaccgatctgcgcttcgacaacatctacgcgacccagcaactgacacagaggctcgcccaagcgcaagccactcatttgctcgcaccaccaccaacttggctgctacaggctgcccagttgaggctctcgcaagaagaactcctcagctgcttactgcgactcggactcttggcattattgctggtggctacagccgttgccgttgctacagatcatgtagctttcttgttggcccaggcgaccgttgactgggcccaaaagctgccaacagttccaatcaccttgactgtgaagtatgacgtggcttatacggtgctaggtttcatcccctttctgttcaaccagctcgctcccgagtcccctttcctgagtgtgcactcctcctaccaatgggaacttagattgacatccgcgcgatgtcctctgctccccgcccgccggccaagagccgctgctcctctcgcagcgggcgctctgcagctgttggctggctcaactgtgctgttggaagcctacgccagaagactgcgacatgccatcgccgcttccttcttcaccgcacaggaggccagacgggtccggcacctacacgcccggctacagcggagacatgacaggcaccaggggcagcagctgcctctgggagacccctcctgcgtgcccacgcctcgccctgcctgtaagcctcccgcatggattgactatcgtctggacgctctacgaaccgaatcatcggaaggtgagggcaaggagctgtggtcctgtcgtgatctgtcctgcaatctgggccccgtccctccgccttgtgtgaccttaggcaagagcctgcatttgtcagagccaaggttcttgcacctgcataatgacagcatctttacgatcgatgtcacttacttccctagacgagatgtcgtcagaatggaaggtaacaccggccatgatagaccaggctag

SEQ ID NO: 41224 - DNA, 432 bp, Artificial Sequence
  Description of Artificial Sequence: Synthetic coding sequence
atgagcggcggccggcggaaggaggagcccccccagccccagctggcaaatggagctttaaaagtgagtgtctggagcaaagtgctcaggagcgatgccgcctgggaggataaggatgagtttctggatgtgatttactggtttcgccagataatcgcggtggttcttggggtgatctggggggtcctgccacttcgtggcttccttggcatagcggggtcattcggctcttcgttcactctgccctctataatgacagatggagtgcagctcccctctgccccataccctgttcagcgtacattgcttataaccgctcaggagctggatagatggggaacgcccgcaccctggaatctggaggatccctgttttctggatcgggagagcgtctgttgggccagtgtgtttagcgcacgcgtggttacttag

SEQ ID NO: 41225 - DNA, 390 bp, Artificial Sequence
  Description of Artificial Sequence: Synthetic coding sequence
atgagcggcggccggcggaaggaggagcccccccagccccagctggctaatggggcactgaaggtgtccgtctggtccaaggtcctcagatccgatgctgcatgggaagataaagacgagtttctcgacgtgatttactggtttcggcagattatagcagtagtgcttggggtcatttggggcgtgctgcctctgcggggcttcctgggcattgccggattttgtcttattaatgcaggggtgctgtacctctacttttctaactatctgcagattgacgaggaagagtacggcggcacatgggaactgacaaaggaggggttcatgacatcttttgcacttttcatggtcatctggatcatcttttacacagcaatacactacgactag

SEQ ID NO: 41226 - DNA, 414 bp, Artificial Sequence
  Description of Artificial Sequence: Synthetic coding sequence
atgagcggcggccggcggaaggaggagcccccccagccccagctggcaaatggagccttgaaggtgagtgtatggagcaaggtgttaaggagtgatgcagcatgggaagataaagacgagttcctggatgtgatctattggttccgtcagatcatcgctgttgttctgggagtcatatggggggttctgcccctgagaggctttctggggattgctggcttctgcctgatcaacgcgggagtgctgtacttgtatttcagtaattacctccagatcgacgaggaagagtatggcgggacatgggaactgaccaaggaggggtttatgacaagttttgcattatttatggtctgcgtcgcagactcttttaccaccgggcatctggaccacttgctccactgccaccctctgtag

SEQ ID NO: 41227 - DNA, 960 bp, Artificial Sequence
  Description of Artificial Sequence: Synthetic coding sequence
atgagcagcccccaggcccccgaggacggccagggctgcggcgaccgcggagatcctccaggcgatctccggtccgttttagtcactaccgtcttaaacttggaacccttggacgaagacttattccgaggacgacactactgggtgcctgccaagcgattatttggaggacagatagttggacaagcattggtagcagcagcaaaaagtgtttctgaagatgttcacgtccacagccttcactgttacttcgtccgggcgggagacccgaagttgcccgtgctgtaccaagtggaacgaactcgaactgggtccagcttctcagtgaggtctgtcaaagccgttcaacatggcaaaccaattttcatttgtcaagcttcgtttcaacaggcccagcccagccctatgcagcatcaattctctatgccgaccgtgccaccgcccgaggaactcctggattgcgagaccctgatagaccagtatctcagagaccctaatttgcaaaagcgatacccgttagccctgaaccgtatcgctgctcaggaggtccccatagaaatcaagcctgtgaatccaagcccactcagtcagctgcagagaatggagcccaaacagatgttttgggtcagggcccggggctacattggggagggcgacatgaagatgcactgttgtgttgcagcctacatttccgactacgccttcctgggcacagccctcctcccgcatcaatggcagcacaaagtacacttcatggtgagcctcgatcacagcatgtggttccacgctccatttagggctgatcactggatgctctacgagtgcgagtcgccgtgggctggcggcagtcgtgggctcgtccacggtaggttgtggaggcaggacggcgtgctagcggtcacgtgcgctcaagagggtgtcatcagagtcaagccacaggtatccgagtctaaactttag

SEQ ID NO: 41228 - DNA, 870 bp, Artificial Sequence
  Description of Artificial Sequence: Synthetic coding sequence
atgagcgaggccgacggcctgcggcagcggcggcccctgcggccccaggtcgtcacagacgatgacggtcaagcaccagaggcgaaggacggcagctctttctccggacgagtattcagggtgacttttctgatgctggcagtttccctcaccgtgcctctgctcggagccatgatgctcctcgaaagccccatcgacccccagcccctctcatttaaggaaccaccactgctcttgggtgtccttcaccctaataccaagctacgccaggcggaacggcttttcgagaaccaattggtggggcccgagtccattgcccatatcggggacgtcatgttcaccggcaccgcggatggtcgcgttgtgaagcttgagaacggtgagattgaaacgattgccagattcggctcgggcccttgtaaaacccgggacgacgagccagtttgcggaagacctctaggcatccgtgcaggaccaaatgggacattgttcgttgctgacgcctataagggcttgttcgaggtgaacccttggaaacgggaagttaagttactcctgtcttctgaaacaccgattgaagggaagaacatgtcattcgtgaacgacctgaccgtaacgcaggatgggcggaaaatctactttacagatagttccagcaagtggcaacgtcgtgattacctgctgctggtgatggaaggcactgacgacggcaggctgctggagtatgacactgtgactcgggaagttaaggtgctcctcgatcagctgcgcttcccaaatggggtacagctttcacccgctgaggattttgtcctggtggccgagactacgatggccaggatcaggtctagcctcgtgaaacgacgttag

SEQ ID NO: 41229 - DNA, 1230 bp, Artificial Sequence
  Description of Artificial Sequence: Synthetic coding sequence
tgagtggtgaccgacgacgacggccaggcccccgaggccaaggacgggtccagtttctcgggtagggtatttcgggtcaccttcctgatgctagctgtctcattgacggttcctctattaggagctatgatgctcctggagtcccccattgacccgcagccgttatcctttaaagaaccaccactgctccttggcgtacttcaccctaataccaaactccgtcaggccgaaaggctgtttgagaatcagcttgtgggccctgaatccatcgcgcacattggtgacgttatgtttactggcacagccgacgggagggtagttaagctggagaacggcgaaatcgagacaattgcccggttcggttcaggaccatgtaaaactcgagatgatgagcccgtgtgcggccggcctttaggtatacgggccgggcccaacggcaccctcttcgtcgcagatgcgtacaagggcctgttcgaggtgaacccatggaagcgggaagtcaaactgctgttgagttccgaaacccctatagagggcaagaatatgtccttcgttaatgatttaaccgtgacgcaggatggacgcaagatctactttactgacagtagctcaaaatggcagcggcgagactatctgttgctggtcatggagggaaccgacgacggtagacttctcgagtatgataccgtgacccgcgaagtgaaggtactcctcgaccagttgagatttccaaacggagttcagctatccccagccgaggatttcgtcttggtggcagagaccacaatggccaggatcagaagagtgtacgtctcaggcctgatgaaaggcggcgccgacctattcgtggagaatatgcccgggttccccgataacatcagacccagttcctcggggggatactgggttggcatgtctacgatccgtcccaatcccggcttttctatgctagatttcctttcagagaggccctggataaagcgtatgatatttaaaggttcttgtgcaggttgtgaccttctgttctctcaagagaccgtgatgaagttcgtgccacgatactctttggttctggaactgagtgattctggggccttcagacgttcccttcatgaccctgatggtctcgtggcgacgtacatatccgaggtccatgagcatgacggtcacctgtacctggggtctttcaggagcccttttctgtgtcgattgtcattgcaggcggtgtag

SEQ ID NO: 41230 - DNA, 363 bp, Artificial Sequence
  Description of Artificial Sequence: Synthetic coding sequence
atgatgcccagccggaccaacctggccaccggcatccccagcagcaaagtaaagtactcgaggctgtccagcaccgatgacggatacattgatttgcagttcaaaaaaacccccccgaaaattccttacaaagctatagcactcgccaccgtcctgttcctgatcggagcattcttgatcatcatcggatccctcctgttgtctggatacatctctaaagggggggcggaccgcgctgtgccagtgctgatcataggcattctggtgtttctccctggcttctatcatctccgcatcgcttactatgcctcaaagggatatcgaggatatagctacgatgacattccagacttcgacgattag

SEQ ID NO: 41231 - DNA, 552 bp, Artificial Sequence
  Description of Artificial Sequence: Synthetic coding sequence
atgcagccctgggccctgcccaccgtgggcgagctgtgggtgtgcggccgtcctggagccgctctccgctggtcattggtgctgagcccccggttagaaccgtctggcgtgatatccgcacactgcaatctgcacttactcgcctcctctgacagtagcgcctccgctagccgcctctgtcaacgggtgatgatgccttcaaggaccaatctggccaccggaataccctcctctaaggttaaatatagccgactctcttccaccgatgacggctacattgatctgcagtttaagaagacaccgcctaaaataccttacaaggccatcgccctggctactgtcctattcctgatcggggctttcttgatcatcataggctccctcctgctgtcagggtacatttccaaaggcggggctgatagagctgtgcccgtgctcattattggcatccttgtatttctgcctggcttttatcatttacgcatagcctattacgcaagcaaaggctatagaggctactcttacgacgacatccccgacttcgatgactag

SEQ ID NO: 41232 - DNA, 225 bp, Artificial Sequence
  Description of Artificial Sequence: Synthetic coding sequence
atgatgcccagccggaccaacctggccaccggcatccccagcagcaaggttaagtattccagattgagctccaccgacgacgggtatatcgacttgcagttcaagaagactccccccaaaattccatataaagctatcgcactcgctacggtgctgttccttatcggagccttcctgattattatcggatctctcttgctctccggatacatcagtaagggttag

SEQ ID NO: 41233 - DNA, 363 bp, Artificial Sequence
  Description of Artificial Sequence: Synthetic coding sequence
atgatgcccagccggaccaacctggccaccggcatccccagcagcaaggtgaagtatagccgactttcatctaccgacgacgggtatatcgacctgcaatttaagaagacccctcccaagataccgtacaaagcgattgcgttagctactgtgctgtttctaattggggcattcctgataattataggtagtctgcttctcagtggctatatttctaagggtggcgctgatagggccgtgccagtgctaatcatcgggatcctcgtatttctcccggggttttaccatctaagaatcgcatactatgcgagtaagggctacaggggatatagttacgacgacattcccgatttcgacgactag

SEQ ID NO: 41234 - DNA, 363 bp, Artificial Sequence
  Description of Artificial Sequence: Synthetic coding sequence
atgatgcccagccggaccaacctggccaccggcatccccagcagcaaggtaaaatattcacgcttatctagtaccgacgatggttacatagacctgcagttcaaaaagaccccaccaaagataccctacaaagcaattgctctggctacagtgctgttcttgattggggcctttttgatcatcatcggaagcctgcttctgtctgggtacatatccaaagggggtgcagacagggccgtcccagtcctgatcattgggattctggtgttcctgccaggcttttaccatttgcgcatcgcttactatgccagtaagggataccgcgggtattcctatgatgacatccccgactttgacgattag

SEQ ID NO: 41235 - DNA, 363 bp, Artificial Sequence
  Description of Artificial Sequence: Synthetic coding sequence
atgatgcccagccggaccaacctggccaccggcatccccagcagcaaggttaagtacagccggctctcctctaccgatgacggatatatcgatctgcaatttaaaaaaaccccccctaagattccctataaggccatcgccctggcaaccgtactcttccttatcggcgctttcctgattatcattggatcactgctactgagtggctacatctcgaaaggtggtgccgatcgcgcggtccctgtgttgatcattggcatactggtctttctcccaggtttctatcacttgcggatcgcgtattacgcctccaaaggctacagaggttatagctatgatgacattcccgacttcgatgactag

SEQ ID NO: 41236 - DNA, 363 bp, Artificial Sequence
  Description of Artificial Sequence: Synthetic coding sequence
atgatgcccagccggaccaacctggccaccggcatccccagcagcaaggtgaagtacagcagactcagctctacagatgacggttatattgaccttcaatttaaaaagacccctccaaagataccctacaaggctattgctctcgccactgtacttttcctcatcggtgcattcttgattatcatcggttctttgctcctttcgggatatatatcaaaaggtggagccgatcgagctgtgcccgttctgatcatcgggatactggtttttttgcccggcttctatcacctccggattgcctactacgccagcaagggttacagaggatactcttatgacgacatccccgactttgatgattag

SEQ ID NO: 41237 - DNA, 363 bp, Artificial Sequence
  Description of Artificial Sequence: Synthetic coding sequence
atgatgcccagccggaccaacctggccaccggcatccccagcagcaaagtgaaatactcacggttgtcatctactgacgacgggtacatcgatcttcagtttaagaagacccctcccaaaataccctataaagccatcgcgctcgccaccgtcctgttcctgatcggggctttcctcatcatcatcggatcccttctactatcgggatacattagcaaagggggtgctgatcgggccgtccctgtcctgatcatagggattctggtgttccttcctgggttttaccatctgcggatagcttactacgcttccaaggggtacagggggtattcatacgacgacattcccgactttgacgattag

SEQ ID NO: 41238 - DNA, 759 bp, Artificial Sequence
  Description of Artificial Sequence: Synthetic coding sequence
atgaagatgaagctgttccagaccatctgccggcagctgcggagcagtaaattcagcgttgaaagtgcagcattagtcgcatttagtaccagctcctacagttgtggcagaaaaaaaaaggtgaacccttacgaggaagttgaccaggaaaagtattctaacctggtgcaatctgtgctgagctccaggggggtcgcgcagactcctggatccgttgaggaagacgccctgttgtgcggacccgttagcaaacataaactccctaatcagggggaggatagaagagtcccccaaaattggttccctatcttcaaccccgagcggagcgataaacctaacgcatccgatcctagcgtgcccctcaagatcccgctccagagaaacgtgattccgagcgtcacaagagtcctacagcaaactatgacaaagcagcaggtcttcttgctggaacgttggaaacaacggatgatcctcgagttgggagaagatggtttcaaggaatatacgtcctcctccatgtggttaaattgtggcgggttgcagcgctggattacgtgccccccaacgttccacgggtgtagagcacttttcccagtgctggatcaggtagcaagctccactaggcgcatctacgggaaggaaaaagagccagagtatagtgaaactaggatctttcggataggctcaaagcttcttttcggaaatattcagcatctgctcacagtgtgggagcatattctcctgtttactcccgtgtag

SEQ ID NO: 41239 - DNA, 795 bp, Artificial Sequence
  Description of Artificial Sequence: Synthetic coding sequence
atgaagatgaagctgttccagaccatctgccggcagctgcggagcagtaagttttcagttgaatcggccgctcttgtggccttttcgaccagctcgtattcatgcgggcgcaaaaagaaggtgaacccttacgaagaggtggaccaggaaaaatacagtaacctggtgcaatctgtgctgagctctcggggagtggcacaaacacctgggtcagtggaagaggacgcactactttgtggcccagtctctaagcacaaactacccaatcaggatgtcttcctccaggggaaaaggttccatgaggcattggagtctatcctttccccccaagagaccttgaaggagagagatgaaaatctgttaaagagcggatacatagaatctgtgcagcacatcctgaaagatgtttcaggtgttagagccctggagagtgctgttcagcatgagaccctgaattacatcggtctactggattgcgtggcagagtaccaagggaaactgtgtgtgattgactggaagacaagcgaaaagcctaagccgtttatccagagcacctttgataatccactgcaagtggttgcgtacatgggagccatgaatcatgacactaattactcttttcaagtgcagtgcggacttattgtcgtggcttataaagacggaagccccgcgcacccacatttcatggacgccgagctgtgctcccagtactggaccaagtggcttcttcggctagaggagtacacagaaaaaaagaagaaccagaatatacaaaagcccgaatacagcgagtag

SEQ ID NO: 41240 - DNA, 1035 bp, Artificial Sequence
  Description of Artificial Sequence: Synthetic coding sequence
atgaagatgaagctgttccagaccatctgccggcagctgcggagctccaagttttctgttgagtcggccgcactcgtcgctttttctacttcgtcttacagctgcggtaggaagaaaaaagtgaatccttatgaggaggttgatcaggaaaaatacagtaatctggtccaaagcgttctatcttcccggggtgttgctcagacgcctggcagcgtcgaggaggatgcactgctgtgtggtcccgtaagcaagcacaagctgccaaatcagggcgaagacagacgggtgccacaaaactggttccccatattcaacccagaacgcagcgataaacccaacgcttcagatcccagcgtgcccttaaaaatcccacttcaaaggaacgtcattccgtcagtgacccgcgtgctgcaacaaacaatgacaaagcagcaggtgtttctcctcgagcggtggaagcagcggatgatcctcgagctgggagaagatggatttaaagagtacactagcaatgtatttttacagggcaaacgattccatgaggccttagaatccattttgagcccacaggaaacgctgaaagaacgcgatgagaatttactgaagtctgggtacatagagtctgtccaacacattctcaaagacgtgagtggtgtgcgggcgctcgagtcagccgttcagcacgagacactgaactacatcggcctgctggattgcgtggcagagtatcaaggcaaactctgcgtgattgactggaagactagtgagaaaccgaaaccattcattcaaagcacattcgacaaccctcttcaggtggtggcgtacatgggcgccatgaatcatgacacgaactattcttttcaggtgcagtgcggacttatcgtcgtcgcctacaaagacggaagtccagcacaccctcatttcatggacgcagaactctgctctcagtactggactaaatggttgctgaggctcgaagagtacaccgagaagaaaaaaaatcaaaacatacaaaaacctgagtatagcgaatag

SEQ ID NO: 41241 - DNA, 1326 bp, Artificial Sequence
  Description of Artificial Sequence: Synthetic coding sequence
atgctgctgcccggccgggcccggcagccccccaccccccagcccgtacagcatcctgggctccggcggcaggtggaaccacctgggcagctattacgcctgttctattgtactgtgctggtgtgtagtaaagagatcagtgcactcacggacttctcaggatacctgacaaaattgctccaaaatcacacgacttatgcgtgtgacggcgattatctgaaccttcaatgcccgagacactccacaattagcgtgcaatctgcattctacggacaggactatcagatgtgcagtagccagaagcccgcttctcagagagaggattccttgacatgtgttgctgccactacatttcaaaaggtcctcgacgagtgccagaatcagagagcgtgtcacttgctggttaacagcagggtattcggacccgacctatgtccgggatccagcaagtacttgctggttagctttaaatgccagcctaatgagctgaagaacaagacagtttgcgaggatcaagagttgaaactgcattgccacgaaagcaaattccttaatatctactccgccacctatggccgacgtactcaggaacgggacatatgcagctctaaggcagaacggctgccaccctttgactgcctcagctacagcgcactgcaggtgctctcaagacgctgctatggcaagcagcgctgcaagattattgtcaataatcaccactttggcagcccttgtctacctggcgtcaaaaagtatctcacagtgacatacgcatgtgtgccaaaaaacatacttacagccattgatcccgctatcgctaatctgaagcccagccttaaacagaaggacggcgagtacggaatcaactttgatccgtctggcagcaaggtcctccggaaggatggcattctggtctccaactccctggccgcgttcgcatacatccgggctcaccctgagcgcgcagccttgctgttcgtgtcttccgtatgcattggactggcactgaccctctgcgctctggtgattagagagtcatgtgccaaggacttccgtgacctgcaattggggcgagaacaacttgtccccgggtctgacaaggtcgaagaagacagtgaggacgaagaagaagaagaagatccttctgagtccgacttccccggcgagctgtcgggattctgccgaacaagctatcctatatattcaagcatcgaggccgcagagctggcagagagaatcgagcgcagggagcaaataatacaggaaatttggatgaattcgggccttgatacatcccttcccagaaacatggggcaattctactag

SEQ ID NO: 41242 - DNA, 615 bp, Artificial Sequence
  Description of Artificial Sequence: Synthetic coding sequence
atgggctgggactgccggcggaccaccgtggagaaccccagccccataagaaactgcgtcaaccaggagtggcctgagggatcaagccctggcctgaccgaagggaatacagggctggtgagagacctgcggcccgcacaccaggatcgcagcggaacgagggaagatcctgccgggcaggaaaccaccgccatcaccaatcctagccctagcttggcagctgatctggccggcgacgcactccctggatgtctgggcgcagccgctcaccaggggccactgctcgaccggtctagtgagtccaccttaggacctcaggcactagagctggagcattgccacgagaggggctgttgtcgcggatgtgccagtttttcaccattccccgcccccagatgtccgtcagaacgcctgggcgcccactcctctcgttgggctatcagggggcggtctaagattaatccacctccctgggctcccgcatgccttccaggagggttccccgcatgtttgcccgccccaaagtctagcacagactcagcttcctcttgcttcaaaggaggtcgtgagttctctgacccgctcgatattcccggcgcaggtgcgatggggtag

SEQ ID NO: 41243 - DNA, 249 bp, Artificial Sequence
  Description of Artificial Sequence: Synthetic coding sequence
atgggctgggactgccggcggaccaccgtggagaaccccagccccattcggaactgtgtcaatcaggagtggcccgagggttcttcaccgggcttgacggagggcaacacggggctggttagagatttgaggccggctcaccaggatcggagtgggactcgggaggacccagcaggacaggagaccacggcaatcaccaacccctcaccctcctgcactagcggagcctccgctggccagaaattatag

SEQ ID NO: 41244 - DNA, 483 bp, Artificial Sequence
  Description of Artificial Sequence: Synthetic coding sequence
atgaccacccaggaggacaccaccggcctgcaccagaagaccagcctgtggaccatgtcccgccctggggccaagaaggttatgaactcttactttattgcaggctgcggtccagccgtctgttactacgcagtgtcctggttacggcaggggttttcgattaacctcactagctttggacggattccttggcctcacgccggagtcgggacgtgtcccagcccacagagctggatcagtcctttccttcagagtcatcgcgagcaccattacgcaaagaccagcagtcactcccagcctagtcctcagtcactggctttgtgtctggcctattctcggtgtagcattaacatttgtcaaatgaccgagtgtatctccctggcgagcggttgtcaccaggctttaagagaacctgggcgctcagaagaaagtttctggatacccgctaccccctacatctcaaatatcttctctgagtcctag

SEQ ID NO: 41245 - DNA, 684 bp, Artificial Sequence
  Description of Artificial Sequence: Synthetic coding sequence
atggtgcccaccggctgggccggcctgggcggcgccgtggtgcacggccccggtaagctggagaaagcagtgccttctccaagagcgcttgatttcctgtcagtaaagtgggaagctgccatgatgaatggtaaggtcccctttttcttttcgtctgagtcgctaggctactttgctactggcagacccgccgataatgtgatgacaacccaggaagacactactggcctgcaccagaaaacaagcttgtggaccatgtctcggcctggggctaagaaggtgatgaacagttactttatcgcaggctgcggtcccgctgtgtgttactatgccgtgtcttggctgaggcagggtttctcgattaatctcacaagttttggtcgaattccttggcctcatgctggcgtgggcacttgtccctcgccacaatcgtggatctccccatttctgcagtctcaccgcgaacaccactatgctaaaacttcctctcattcccagccttctcctcagtccctcgctttatgtctcgcttattcaaggtgttcaataaatatttgccagatgaccgaatgcattagcttggcctccggatgtcaccaagctttaagggaaccaggacgctccgaagaaagtttttggatccccgctaccccctacatctcaaatatttttagtgaatcttag

SEQ ID NO: 41246 - DNA, 831 bp, Artificial Sequence
  Description of Artificial Sequence: Synthetic coding sequence
atgtgcatcatcttcttcaagttcgacccccggcccgtgagcaagaacgcctataggctaatcctggctgccaatagggatgagttctactccagacctagtaaactcgccgatttttggggaaataataacgaaatcctatccggtctggacatggaggaaggcaaggagggaggcacttggctcgggatctcaacgagaggcaagcttgctgcgctcacgaactatctgcagccccagttggattggcaggcacgtggacgcggcgaactcgtaacccactttctgacaacagatgttgacagcctgtcttacctcaagaaagtaagcatggaagggcacttgtataacggttttaacctgattgctgccgatctgagcacagccaagggggacgtaatttgttactatggtaaccgtggtgaaccggatcctatagtgttgacacctgggacctacgggctgagcaatgctctgcttgaaaccccttggcggaaactgtgtttcggtaagcagctcttcctggaagcggtggagagatctcaggccctccccaaggacgtgctgattgcaagcctcctggacgtgctaaataatgaggaggctcagctccccgatcctgccatcgaagatcaagggggcgaatatgtccaacctatgctcagtaaatacgccgcagtatgtgtccggtgtcccgggtatggcacacggaccaatacaatcattctcgtggacgccgacggccatgttaccttcaccgagcggagcatgatggataaggacctgagccactgggagaccagaacctacgaattcaccttacagtcctag

SEQ ID NO: 41247 - DNA, 645 bp, Artificial Sequence
  Description of Artificial Sequence: Synthetic coding sequence
atgtgcatcatcttcttcaagttcgacccccggcccgtgagcaagaatgcatatcgactgattctggcggcaaatagggatgaattctactcacgaccttcgaagctcgcagatttctggggcaataataacgaaattctgtctgggctcgatatggaggaaggaaaagagggaggcacatggctgggaatttccacaagaggcaaattggccgcgcttacaaactacctgcagccacagctcgattggcaggctcgggggcgcggaacctatgggctctcgaatgctttactagagacgccgtggcgtaaactttgcttcggcaaacagctgttcctcgaggctgtcgagaggagccaggcattgcctaaagacgtactgattgcgagtttgttagacgtgctgaacaacgaagaggcacagcttcctgacccagccatagaggaccaaggcggggagtatgtacagcctatgctcagcaagtatgctgcagtctgcgtgaggtgtcctgggtacggaactaggaccaatactatcatcttggtggatgctgatggccatgtgacctttacggagcgctccatgatggacaaggacctgtcccattgggagacacggacttatgagttcaccctccaaagttag

SEQ ID NO: 41248 - DNA, 645 bp, Artificial Sequence
  Description of Artificial Sequence: Synthetic coding sequence
atgtgcatcatcttcttcaagttcgacccccggcccgtgagcaagaatgcctaccggttaattctagcagcaaaccgagacgagttctactctagaccaagcaaactcgcagatttctggggaaacaataatgagattttgtccggactggacatggaggagggtaaggaaggcggaacctggctgggaatcagcacaaggggcaaactcgcggctctaactaattaccttcagccacagctcgattggcaggctagagggcgcggcacgtatgggctgtcaaatgctcttttggaaacaccatggaggaagctgtgctttgggaagcaactctttctagaggccgtcgagcggagtcaggcccttcctaaagacgtcctgatagccagcttattggatgtcctcaataacgaggaggcgcagctgccagatcctgccatagaagaccagggtggcgaatatgtgcagcctatgctgagtaagtacgcggcagtgtgtgtcaggtgcccaggctacggcaccagaacaaacacaatcatcctggttgacgccgatgggcacgtgactttcacagaaagatctatgatggacaaggatcttagccattgggagactcggacatatgaatttactctgcaatcttag

SEQ ID NO: 41249 - DNA, 537 bp, Artificial Sequence
  Description of Artificial Sequence: Synthetic coding sequence
atggccggccaccagcacacctggcaggccggcagcacccaccagctgccagctgccgctgcagggcttgcaggcccaagggcctctaccgccaaaggggacgtgatttgctattacgggaacagaggggagccagacccaattgtactgacccccggaacttacgggctaagcaatgcactgctcgagactccttggagaaagctgtgctttggaaagcagttatttctggaagctgttgaacgttcccaggctctgccaaaggatgttctcattgcatcacttttggacgttctgaacaatgaggaggctcagctgccagaccccgcaattgaggaccaggggggcgaatacgtgcagccgatgctctctaaatatgctgcggtgtgcgtcagatgtcctggctatggcacaaggacaaacactatcatcctggtggatgctgatggacatgtgacttttactgaacgctctatgatggacaaagatctgtcccactgggagaccaggacctatgagtttacgcttcagtcctag

SEQ ID NO: 41250 - DNA, 267 bp, Artificial Sequence
  Description of Artificial Sequence: Synthetic coding sequence
atgtgcatcatcttcttcaagttcgacccccggcccgtgagcaagaacgcgtatagattgatcttggccgctaatcgcgatgaattctatagtcggccttctaaacttgccgatttctggggaaataataacgaaatcctctccggactggacatggaggaagggaaagagggcgggacgtggctgggcatcagcaccaggggaaaactcgcggctttaacaaattacctgcagccccaactggattggcaggcccgcggcaggtag

SEQ ID NO: 41251 - DNA, 645 bp, Artificial Sequence
  Description of Artificial Sequence: Synthetic coding sequence
atgtgcatcatcttcttcaagttcgacccccggcccgtgagcaagaatgcctaccgtttaatcctggcagccaaccgcgacgaattctactcacgccctagcaaactggccgatttttgggggaataacaatgaaatcttgagcggcctcgatatggaggagggcaaggaaggcggaacctggctcggcatatccaccagagggaagttggccgccttgaccaattacctccaaccacagctggattggcaagccaggggccgagggacctacggactgtccaacgctttattagagacgccctggcgaaagctgtgctttggtaaacagctcttcctggaagccgttgagaggtcacaggccctccctaaggatgtgctcattgcttcactgctcgacgtgctcaacaatgaggaggcccagctgcctgatccagccatcgaagaccaggggggggagtatgtccaacctatgctttccaagtatgctgctgtgtgtgtccggtgtccgggctatgggacaaggacaaacacgatcattttggtagatgcggatggtcacgttacctttactgagcgttcaatgatggacaaagacttatctcactgggaaacgagaacctatgagtttaccctgcaatcttag

SEQ ID NO: 41252 - DNA, 681 bp, Artificial Sequence
  Description of Artificial Sequence: Synthetic coding sequence
atgtgcatcatcttcttcaagttcgacccccggcccgtgagcaagaacgcatatcggctgatcctggcggccaaccgtgatgaattctactctcggcccagcaagctggctgacttctggggcaacaataacgagatccttagcggactcgatatggaagaagggaaagaagggggaacttggctgggcatctccacgcgggggaaactggctgcccttactaattacctgcagccacaactggactggcaggctagggggcggggtgagctagtgactcattttttaactactgacgtggattctcttagctacttaaagaaggtaagcatggaaggacacctgtacaacggtttcaacttgattgccgccgacctctctacagccaagggggacgtgatttgctattacggaaatcgcggcgagcctgatcccatagttctcacacccggtacttacgggctgtctaatgcgcttttggaaactccctggagaaagctctgtttcgggaagcagctcttcctggaggcagtagagagaagtcaggcactccccaaggacgtacttattgcctctctattggatgtgttgaataacgaagaagcacagctgcctgacccagctatcgaggatcagggaggcgaatacgtgcagccaatgctgtcgaaatacgccgcctag

SEQ ID NO: 41253 - DNA, 597 bp, Artificial Sequence
  Description of Artificial Sequence: Synthetic coding sequence
atgccccccaagctgctgtgcgccggccggtgcgtgggccaggacggggccgcgcaggcttggcattgcccccccgggcaaggccactctgtgtgggatgccgtgcggatgcctctgggagccggcacacccgtaaatgtgcagaggagggaagatagcgccacggagggatcgcacagattgatcctcgcggccaatagggatgagttttattctaggccgagtaagcttgccgacttctggggcaataacaacgagatcctgtctggcctcgatatggaggagggaaaagagggcggcacgtggcttggaatcagcacccgaggtaaactagcagcattgaccaactacctacaaccacagttggactggcaagcacgaggcaggggggagctcgtgacccacttcctgaccactgacgtcgacagcctgtcctacctaaagaaagtttccatggagggtcatctctacaatgggtttaatctgatcgcggctgatcttagcaccgccaagggcgacgtgatctgctattacggcaacagaggagagcctgatcccatcgtactcactcccgaacctaccttgtcttcgtggtag

SEQ ID NO: 41254 - DNA, 831 bp, Artificial Sequence
  Description of Artificial Sequence: Synthetic coding sequence
atgtgcatcatcttcttcaagttcgacccccggcccgtgagcaagaatgcgtaccgactgatcctggctgcaaatcgggacgaattctactcacgccctagtaagcttgctgatttctggggcaataataacgaaattttgagcggtttggatatggaagagggcaaagaagggggcacctggttagggatctcaacacgcggtaagctggctgcccttacgaattatctgcaaccacagcttgactggcaggctcggggaagaggagagcttgtgactcactttctcacgaccgacgtcgacagcttgagctatcttaagaaagtgagcatggaaggccatctgtataacggcttcaacctgatagcggccgacctttcgacggcaaaaggggatgttatttgttactacggtaatcgcggcgagcctgaccccatcgtgctgacccctggcacctacggcctgtccaacgctctgcttgagacaccctggaggaagctgtgtttcggaaagcaactctttcttgaagccgtagagcgatcacaagcgcttccaaaggatgtactcatcgcgagtctgctggacgtgttgaacaacgaggaggcccaactccctgatccagctatcgaagaccaagggggagagtatgtgcaacccatgttatccaagtacgccgcggtgtgcgtcagatgtcctgggtacggaacacgcaccaatacgatcatactggtggacgctgacggtcatgtcacatttacggagaggagtatgatggacaaggacctttctcattgggaaacccggacctatgaatttaccttgcagtcatag

SEQ ID NO: 41255 - DNA, 498 bp, Artificial Sequence
  Description of Artificial Sequence: Synthetic coding sequence
atgtgcatcatcttcttcaagttcgacccccggcccgtgagcaagaatgcataccgcctgattctggcggctaatagggatgaattttactcacgcccatcaaagctggctgatttttggggaaacaacaatgagattctctcagggctggatatggaagaaggaaaggaagggggcacatggctcggaatcagcactaggggaaaactggctgcactgaccaactacctgcaaccccagctcgactggcaggccagggggcggggagagctcgtgactcattttctcaccacagacgtggattctctgtcttacctgaaaaaagtaagtatggaagggcatctttacaacgggtttaatctcatcgccgcagacctctcaaccgctaagggggacgtgatatgttactatggaaaccgaggggaacctgatccaatagtattgacgcctgggacctatgggctctctaacgccctgctggaaacgccttggaggtag

SEQ ID NO: 41256 - DNA, 846 bp, Artificial Sequence
  Description of Artificial Sequence: Synthetic coding sequence
atgcccctgggcgccggcacccccgtgaacgtgcagcggcgggaggatagtgctaccgagggatcccatcggttgatccttgcggccaacagagatgagttctattccaggccgtcgaagctcgccgatttctggggtaacaacaatgagatcctttcaggtttggatatggaagagggcaaggaaggaggcacgtggctgggaatctctacccgagggaagctcgcggcccttaccaattatctacagcctcagctcgattggcaggctcgcggacgcggcgagcttgtgacacactttctcaccacagacgtggattctctgagctatctgaaaaaggtttcaatggaaggccacttgtacaatgggtttaatttgatcgctgccgatctgtccaccgcgaaaggcgacgtcatttgttattatggcaaccgcggtgaaccagacccaatagtcctgacgcctggcacgtacggactgtccaacgccctcctggagacaccctggcgcaagctttgtttcggaaaacagctgtttcttgaagctgtggagcgcagtcaggctctgccaaaagacgtactgattgcaagtctcctcgatgtcctgaataacgaggaagctcaactgccggatccggccatcgaagaccaaggtggggagtacgtccagcccatgctgtctaagtatgccgctgtgtgcgttagatgccccggctatggcactaggacaaatacaattattctggtcgatgctgacggtcatgtcacctttaccgaaaggtctatgatggacaaggatctttctcactgggagacaagaacgtacgaattcaccctgcagtcttag

SEQ ID NO: 41257 - DNA, 324 bp, Artificial Sequence
  Description of Artificial Sequence: Synthetic coding sequence
atggccagcggcgccgcccggtggctggtgctggcccccgtgcggtcgggagcactcaggagcgggcccagcctgcgcaaggacggcgatgtcagcgcggcatggtcaggctcaggtcgttcgctggtgccttcaaggtctgttatcgtgacacggtcaggagcgatcctcccaaaacctgtgaaaatgtcatttggtctgttacgggtgttctccatcgtcattcctttcctgtatgtgggaaccctgattagcaagaatttcgccgcgctgctggaggagcacgacatttttgttcccgaggacgacgacgacgatgattag

SEQ ID NO: 41258 - DNA, 1704 bp, Artificial Sequence
  Description of Artificial Sequence: Synthetic coding sequence
atgatggccgccgtgccccccggcctggagccctggaaccgggtgcgcatacctaaggctggcaaccggagcgccgtgaccgtgcagaacccaggtgccgctctggatctttgtattgcagccgtgatcaaggagtgccatttggtgattctttctctgaaaagtcagactctcgatgccgaaacagacgtgctgtgcgctgtactttacagcaatcataaccggatgggaagacacaaaccacatctggcactgaaacaggtggagcaatgcttaaagaggttgaaaaacatgaacctcgaaggaagcatacaggacctgtttgagcttttctccagtaacgagaatcagcctttgacaactaaggtttgcgtagttccgtcgcaaccagtggtggagttggttctcatgaaggtgcttggcgcctgtaaactcttgctgcgcctcctggactgctgttgcaaaaccttcctgctgacggtgaagcatctgggacttcaggagtttataatcctaaacctcgttatggtcggacttgtgtctagactatgggtgctttataagggggtgctgaagagactgattctgttgtatgaaccattgttcggcctgctccaggaggtagcacgtattcagccaatgccatattttaaagatttcacttttcccagcgacattacggaattcctggggcagccatacttcgaagcgtttaaaaagaagatgcccattgctttcgccgcgaaaggcatcaacaagctgttaaataagctgttcctgatcaatgagcagagtcctcgagcttcagaggagaccctgctgggtatctctaagaaagctaagcagatgaaaatcaatgtgcagaacaatgttgacctcggtcaacccgtcaagaataagcgggtttttaaagaggagtccagcgagttcgatgttcgggcattctgtaaccagcttaaacataaggcaactcaagagacaagctttgactttaagtgtagccagtccagactgaaaacaaccaagtacagctcccaaaaagtgattggcacacctcacgccaagtcattcgttcaacgtttcagggaggcagagtcttttacccagttgtctgaggagattcagatggccgttgtttggtgtaggagtaagaagctgaaggcccaagctattttcttgggcaataagctattgaaaagtaatagattaaagcacctggaagcccaggggacctcacttccgaagaagcttgagtgtatcaagacttctatttgcaatcatcttctcagggggagtgggatcaaaacctcaaaacatcacctgaggcagcgacgcagtcagaacaaattcctgagacggcagaggaagccacagcgcaagctgcaatccactcttttgcgcgagatacagcagttttcccaaggtacaagaaagagcgctaccgacacaagtgccaaatggcgcctctctcactgtacagtgcataggacagatctctatcccaacagtaaacagctgctaaacagtggggtctctatgcctgtcatccagaccaaggaaaaaatgatccacgagaatctgcggggtatacacgagaacgaaaccgacagttggaccgttatgcagatcaataagaactcaacaagcggcaccatcaaggagacggacgatatcgacgatatctttgccctgatgggcgtctag

SEQ ID NO: 41259 - DNA, 1494 bp, Artificial Sequence
  Description of Artificial Sequence: Synthetic coding sequence
atgatggccgccgtgccccccggcctggagccctggaaccgggtgcgtatccctaaagccgggaaccggtctgctgtgaccgtgcagaatcccggggctgcactggatctctgtattgccgccgtcattaaagaatgtcacctggtaattctgagtctcaagtctcagaccctggacgcagaaacagatgtcctctgtgccgtcctctattctaaccataatcgtatggggagacataagccacacctggctcttaaacaagtggaacagtgcctgaagagactcaaaaatatgaacctggaaggatcaatccaggacctcttcgagctgttttctagcaaggtgttatacaagggggtactcaaacggctaatcctattatatgaacctctattcggtctgctacaggaggtggctaggattcagcctatgccctattttaaggattttacatttccctcagacattaccgagtttttgggccaaccttatttcgaggcgttcaagaaaaaaatgccaatcgcctttgccgctaagggaataaacaagctgctgaacaagctctttttaatcaatgaacagtcccctagggcaagtgaggaaaccctgctggggatatctaaaaaggcgaaacaaatgaagatcaatgtccagaacaacgtcgacctgggacagcccgtgaaaaataagcgcgtgtttaaagaggaatcctcagaatttgatgttagagctttctgcaaccaactgaagcacaaggcaacgcaggagacctcattcgactttaagtgtagtcaaagtcgcttaaagacgaccaagtacagcagtcagaaggtcatcggcaccccccacgccaaatcgtttgtccagcggttcagggaggccgagagcttcacccagctgtctgaagaaattcagatggcagtggtctggtgtcggagcaaaaagctgaaggcacaggccatttttctaggcaataaattattgaagagtaatagactgaagcacctggaagcgcagggtacctcgctacctaaaaagcttgagtgtatcaagacctcaatttgtaatcatttactgcgcgggtcaggtattaagacatctaaacaccacctccggcagcggagatctcaaaataaattcctccgcagacagagaaagccgcagagaaagctccagtcaaccctgctgagggagatccagcagttttcacagggcactcgtaagtccgccacggatacgtcagctaaatggcggctgtcacattgcaccgtccatcgcaccgatttatatccaaactcaaagcagctcctgaacagtggcgttagcatgcctgtgatccaaaccaaggagaaaatgattcacgagaatcttagaggcatccatgaaaacgagactgactcatggactgtgatgcagattaataaaaattctacctccgggactattaaagaaactgatgacatagacgatatcttcgccctgatgggagtgtag

SEQ ID NO: 41260 - DNA, 1296 bp, Artificial Sequence
  Description of Artificial Sequence: Synthetic coding sequence
atgaaggtgctgggcgcctgcaagctgctgctgcggctgctggactgttgttgtaagacatttctgctgacggtgaaacatctcgggctccaggagttcattatactgaatttggtaatggtcggcctcgtttcccgcctctgggttttgtacaagggggtcctcaaaaggctcatcctgttgtatgaacctctgttcggtctgctccaggaagttgctcgtatccagcctatgccgtatttcaaggatttcaccttcccttccgacatcaccgaattcctcggccaaccctactttgaggcatttaaaaagaagatgccgattgcctttgcagccaagggtatcaacaagctcctcaacaagctgttccttataaatgagcagagcccaagagcttccgaagaaactcttctcggcatcagtaaaaaggccaagcaaatgaagatcaatgttcagaacaacgtggacctgggtcagccagtaaagaataaacgggtctttaaagaagagagttccgaattcgatgttagagctttttgcaatcaactgaaacacaaagcgacccaggagacaagttttgactttaaatgttctcagtctcggctgaagacgacaaagtattcatctcaaaaggtgattggtacaccacacgctaaatctttcgtgcaacgcttccgcgaggcagagagctttacacaactgagtgaggagatccaaatggcagtggtgtggtgcaggtccaaaaagctgaaagcccaagcgattttcctggggaataagttactgaagtccaaccgactcaagcacctggaagcccagggcacctcactgccaaaaaaactggaatgcatcaagaccagtatttgcaaccacctgttacgggggtctggaattaaaacaagcaagcaccatctgcggcaacggaggtctcagaacaaatttctgcgccgccaacgcaagccgcagaggaaactgcagtctaccctcctgagagaaattcagcaattcagccaaggcaccaggaagtctgcgactgatacaagcgccaagtggcggctaagtcactgtactgtccatcgcacggatctgtacccaaactcgaagcagctgttgaacagcggcgtgtcaatgcccgtaattcagactaaggaaaaaatgatccacgaaaacttacggggaatccacgaaaatgaaactgattcatggacggtaatgcagatcaacaagaattccacatcagggaccattaaagaaaccgatgacattgacgatatttttgccctcatgggcgtctag

SEQ ID NO: 41261 - DNA, 645 bp, Artificial Sequence
  Description of Artificial Sequence: Synthetic coding sequence
atgcccaaggtgctgtgcaaggacagcgagcggctgagccccagccacaattttttaaaaaagagcagatggcaattgtatggagcaggcaaaaaactaaaggcccaggccatattcttgggcaacaagcttctaaaatctaatcgactgaagcacctggaagctcaagggacaagcctgcccaaaaagcttgagtgtataaagacctctatatgtaatcacctgcttcgtggcagcggcattaagacaagcaagcatcacctccgtcagagacggtctcagaataagtttctgcgccgtcagagaaaaccacaaaggaaactacagtccactctgctgcgggaaattcagcaatttagccaaggcaccagaaagtctgcaacggatacttccgccaaatggcgtcttagccattgtaccgttcacaggactgatctgtatcccaacagcaagcagctcctgaatagcggggtgtccatgccagttattcagacgaaagagaagatgatccacgagaatctgagaggcatccacgagaatgagactgacagttggacagtgatgcagattaacaagaactctacctcaggcactatcaaagaaactgacgacattgatgacatatttgcgttgatgggcgtttag

SEQ ID NO: 41262 - DNA, 489 bp, Artificial Sequence
  Description of Artificial Sequence: Synthetic coding sequence
atgaacagccggaccgccagcgcccggggctggttcagcagccggccaccgacttccgaatctgacctcgaacccgctaccgatggtcccgcctccgagactaccacactctcgcccgaagcaacaacctttaatgacactaggattccagacgctgcagggggtacggccggtgtgggcaccatgctgctgtcttttgggataattacggtgattggactggcagtggccttggtcctctacatcagaaagaagaaaagactggaaaagctccgccatcagctaatgcccatgtacaacttcgaccctacagaggaacaggacgagcttgagcaggagctgttggagcacggtagggacgctgcaagtgttcaggccgctacatctgtacaggcgatgcagggaaaaacgacgttgccatctcagggaccattgcaacgcccttcacggttggtatttactgatgtggctaacgccattcacgcttag

SEQ ID NO: 41263 - DNA, 489 bp, Artificial Sequence
  Description of Artificial Sequence: Synthetic coding sequence
atgaacagccggaccgccagcgcccggggctggttcagcagccggcctcctacatcagaatccgatctggagcctgccactgatggacccgctagcgagactaccacacttagtcccgaggccacgacatttaacgatacccgaatacctgacgccgccggtggaacggcaggggtggggacaatgcttctgtcttttggcattatcactgtcatcggcttggccgtagcactcgtgctgtatattaggaagaagaaacggttagagaagctgcgccaccagctcatgccaatgtataacttcgacccaaccgaggagcaggacgagcttgaacaagaattactggaacacggaagggacgcagcaagcgtccaagcagctacttctgtccaggcaatgcagggaaagactaccctgcccagccaagggcccctccagagaccctccaggctcgtctttaccgatgtggccaacgcgatacacgcatag

SEQ ID NO: 41264 - DNA, 429 bp, Artificial Sequence
  Description of Artificial Sequence: Synthetic coding sequence
atgaacagccggaccgccagcgcccggggctggttcagcagccggccacccacctcggaatctgatctggagccagccaccgatggccctgcctccgaaactaccacgctgtccccggaagctacaacctttaacgatacacgaattccagatgctgctggcggtaccgccggcgttttatatatcaggaagaagaaaaggttagagaagttgcggcaccagctcatgccaatgtataattttgaccctaccgaggaacaggacgagcttgagcaggagctattagagcacggaagagacgccgcatccgttcaggccgcgacttccgtgcaggccatgcagggtaaaacaactctgccctcccagggtcctctccagaggccatcaagattagtcttcactgatgttgcaaacgccattcacgcttag

SEQ ID NO: 41265 - DNA, 489 bp, Artificial Sequence
  Description of Artificial Sequence: Synthetic coding sequence
atgaacagccggaccgccagcgcccggggctggttcagcagccggccaccaacctctgagtccgacctggagcccgcgaccgatggacccgcctctgaaacgacgacactaagcccggaggcaactactttcaatgacacccgtattccagacgctgccggaggaacagcaggggtaggtacaatgttgctttcatttgggataatcacagtgatcggcctggccgtagctctggtgctgtacataagaaagaaaaaacggctcgagaagcttagacaccagttgatgcccatgtataattttgatccaaccgaggaacaggatgagctcgagcaggaactcctggaacacggacgagatgcagcctccgttcaagcagcaacgagtgtgcaggcgatgcaggggaaaaccacacttccctctcaaggcccactccagaggccatcccgacttgtgttcacagacgtagccaatgcaatccacgcctag

SEQ ID NO: 41266 - DNA, 2715 bp, Artificial Sequence
  Description of Artificial Sequence: Synthetic coding sequence
atgagctacatcaagagcaacctggagctgtaccagcagtacaccgccatggctcctaaattgctggcaaggataagtaagttgctgatgatttgtcagaacgccggcatcagtgtcccgaagggaatcagaaacatctttgagtttacatgggaagagctcatatcggatccttccgtcccaacccccagcgacattttgggactcgaggtttcattcggagctcccctggtggtgctgatggagccaacattcgtgcaagtccctacattaaaaaagcctcttccccctcccccaccagccccaccgagacccgtactactagcaactacaggggcagctaagaggtctactctcagtcctactatggccaggcaagtaagaacccaccaggagacattgaatagattccagcaacagtcaattcaccttctgaccgagctactgcggctcaagatgaaagccatggtcgagtccatgtcggtgggcgcaaatccactggatatcactcgcaggttcgtggaggcctctcagctcttgcacctgaacgcgaaagagatggcattcaactgcctcatttctacggcagggcgcagtgggtactcaagcggccagctgtggaaggagagcctcgccaatatgtccgcaatcggagtgaactcgccctaccaactaatataccactcgagcacggcctgcctgagtttctcattaagcgccggaaaagaggctaagaaaaagatcggcaagtccaggaccacagaggacgtttcaatgcctccccttcaccgcggagtgggcactccagctaactcgctggagttctcggacccctgtcctgaggctcgggaaaaattacaagaactctgcagacacatcgaggctgaaagggccacctggaaaggaaggaatatctcttatcccatgatcctacgtaactacaaggctaagatgcccagccatctaatgcttgccaggaagggagactcacaaacccccggtctacactacccccccacagctggtgcacagaccctatcacccacttctcacccatccagtgcaaaccaccacttttctcaacattgtcaagaaggtaaggcgcctaaaaaggcatttaaattccactatactttttacgacggaagctcttttgtttattatccttctgggaacgttgccgtgtgtcagatacctacctgttgtcgggggcgtactatcacatgcctcttcaatgatatccccggttttagcctgctggccctgttcaataccgaaggccagggttgtgtgcactacaacctaaaaacatcttgtccttatgtcctgattctagatgaggaaggaggtacaactaatgatcagcaagggtatgtggtgcataagtggtcatggacgtcaaggacagagactttattgtctttggagtataaagttaatgaggagatgaagcttaaggtcctgggccaggactcgatcaccgtgacctttacctctttgaacgagaccgttactctcaccgtttcggcaaataactgccctcacggaatggcttatgataaacggctgaatcggcgcatctccaacatggacgataaagtctataaaatgagccgcgctctcgctgaaatcaagaagagatttcagaagaccgtgacccagtttatcaattctattctcctagccgcgggcctgttcaccatagagtacccaaccaagaaagaagaggaggagttcgtgcgctttaagatgcgttcacgaactcatcctgaaagactgccaaagctgtctctgtacagtggcgagtcgctgcttcgatctcaaagcggccaccttgaatcttctatcgctgagacgttgaaggatgagccagagtcggccccagtaagccctgtgcgcaagaccaccaagatccatacaaaggccaaagtgacctccagaggaaaggctagggaaggtcgtagccctacaagatgggctgctttgccttctgactgtccccttgtactcaggaaactgatgttgaaggaggatacccgcgccggatgtaaatgcctggtgaaagctcccctggttagcgatgtggagctcgaacgattcctgttagctcccagggatcccagtcaggtgttggtttttggcatcatctctagtcaaaactatactagcaccggccagctgcaatggttacttaatactctatataatcatcagcaacgtggaagggggagcccttgtattcagtgccggtatgacagttaccggcttcttcagtacgatctggattcacccctgcaagaggatcctcccctgatggtgaagaagaactcagttgtacagggtatgatcttaatgtttgccggtggaaaactgatctttggagggagggtcttgaacgggtatgggctgtccaagcagaacctactgaaacaaatttttcgatcccaacaggattacaaaatgggttattttcttccagacgattataaattcagcgttccaaattcagttctgtccctcgaggactcggagagcgttaaaaaagctgaatccgaagatatccaaggttcatcatctagcctggcgctagaggactacgtggagaaggagttgtctttagaagctgagaaaacacgcgagccagaggtggagctacacccattgagccgcgattccaagattacgagttggaagaaacaggcatccaaaaagtag

SEQ ID NO: 41267 - DNA, 2349 bp, Artificial Sequence
  Description of Artificial Sequence: Synthetic coding sequence
atggcccggcaggtgcggacccaccaggagaccctgaaccggttccagcaacagagtatccatctgttaactgagcttctgagactgaagatgaaagccatggtggagagtatgtccgtcggagctaaccccctggacatcacgagacggtttgtcgaggcgagtcagctgctccatttgaacgccaaagaaatggcctttaactgcctgataagtacagcagggagaagcggttactctagcggacagttgtggaaggaatcactggcgaatatgagtgctataggcgtgaacagcccatatcaactgatctatcattcttccactgcttgcctttcgttctcactgagcgcaggcaaggaagccaagaagaagatcgggaagagtcgcaccaccgaggacgtctctatgcctcctctccacaggggagtgggaacccctgcaaatagcctcgagttctccgatccttgccccgaagctagggagaaattgcaggaactatgtaggcacattgaagcagaaagggccacgtggaaaggtagaaacatcagttatcctatgatcctgcggaactataaagctaagatgccttctcatctcatgttggcccgtaagggagacagtcaaaccccgggcttgcactacccacctactgcgggtgcccagacacttagtcccacaagtcatcctagctcagctaaccaccatttctcccaacactgtcaggaagggaaggctcccaagaaagccttcaagttccactatactttttatgacggaagcagctttgtctactacccttccggcaacgttgctgtttgccagatcccaacctgctgccgggggagaaccataacatgtctgtttaacgacatcccggggttctctctgttagccctgttcaacaccgaaggacaggggtgtgtacactataacctcaagactagctgcccttacgtattgattctggatgaagagggtgggaccactaacgatcaacaggggtatgttgtacacaaatggtcgtggacttctcgaaccgaaacactgttgtcgttggagtacaaagttaacgaggagatgaagctgaaagtgcttggccaagacagtattacagtgactttcacaagccttaatgaaaccgtcactcttaccgttagcgccaacaattgtccccacgggatggcttacgataaaaggttgaatagacgaatctctaatatggatgacaaagtgtataaaatgagcagagctttagcagagattaaaaagaggtttcagaagaccgttactcagttcattaattccatcctgcttgccgctggtttatttaccattgagtacccaaccaagaaagaagaggaagagttcgtgcggttcaaaatgagatccagaacccaccctgagcggctccctaagctctccctttactctggagaatccttgctacgttcccaaagcggccatcttgagagcagcatcgcagaaacactgaaagacgagccggagtcagcccccgttagccccgttagaaaaacaaccaaaatccacacaaaagcaaaagtgacctcaagaggaaaagctcgggaaggtcgtagtcctacgcgctgggccgccttaccctctgactgccccttggtgctgagaaaactgatgctgaaggaggatacacgcgccggctgtaaatgtctggtgaaagcccccctggttagcgacgtcgaattagagcgctttttgcttgcaccacgggacccttctcaagtgctggtctttggcattatctcctcgcagaactacacctccactgggcagttgcagtggttactaaacacattgtataatcatcagcagcggggcaggggtagcccttgcatccaatgcaggtacgatagttaccggctcctgcagtatgacctcgactctcccctgcaagaggacccacccctaatggtgaagaaaaattcagtggtgcagggcatgatcctgatgttcgcgggagggaaactgatttttggtggaagggtgctgaatgggtacggtctgtcaaagcagaatctactgaagcagatcttccgctctcagcaggattacaaaatgggctattttttgccagatgactacaagtttagcgtcccaaatagcgttctgtccctcgaggactctgagtcagtcaaaaaggccgaatctgaggacatccagggatcttcgtctagcctggccttggaggattacgtggagaaggaacttagcttggaggcagagaagacacgagaacctgaggtcgaactgcatccgttgtctcgagacagcaaaattacaagctggaaaaagcaggcctctaagaaatag

SEQ ID NO: 41268 - DNA, 2349 bp, Artificial Sequence
  Description of Artificial Sequence: Synthetic coding sequence
atggcccggcaggtgcggacccaccaggagaccctgaaccggttccagcagcaatcaattcatttattaaccgaattgctacgtttgaagatgaaagctatggtggaatcaatgtctgtgggggccaatcctctggacatcacgaggcggttcgtggaggcctcacaacttctgcatctgaacgctaaagagatggcatttaactgcctgatttcaactgcgggtagatcaggatacagctcaggccagctttggaaagaatctctggccaatatgtctgccatcggagtgaactcaccctatcaactcatatatcactccagcacagcgtgtctgtcattttccctatcggctggcaaagaggctaagaaaaaaattggcaaatctaggaccactgaggatgtaagtatgccaccccttcaccgtggagtaggaacaccagccaacagtttggaatttagcgacccttgtcccgaagcaagagagaagcttcaagagctctgcaggcatatagaggccgagcgcgccacatggaagggccgcaatatcagttatccgatgattctgcggaactacaaggctaagatgccctcccacttgatgctggcgcgcaagggcgatagtcagactcccggtctgcactatcctccaaccgctggggctcagacactgtctccaacaagccacccctcaagcgcaaaccaccatttcagccagcattgtcaggagggaaaggccccaaagaaagcattcaaatttcattacactttctacgatggatcatcatttgtgtactacccaagtggcaacgttgctgtctgccagatccccacctgttgtaggggtaggactatcacatgtctgttcaacgacatccccggatttagtctgctggctctgttcaataccgaggggcagggatgtgtgcactataacctcaaaacctcatgcccttacgtactgatcttggacgaagagggcggcaccacaaatgatcaacaagggtatgttgtgcataaatggagctggactagcaggaccgaaaccttgctgagcttggaatacaaggtcaatgaagaaatgaagctgaaggtactagggcaggatagtattaccgtgacctttacgagcctgaacgagaccgtgaccctaaccgtgtctgctaacaattgcccccacgggatggcttacgacaagaggcttaataggaggatctctaatatggacgataaggtttacaaaatgtcccgcgcacttgctgaaataaagaagcggttccagaagactgtaacccagttcatcaactcgatcctcttggcagcgggattgtttacaattgagtaccccactaagaaggaagaggaggagttcgtacgcttcaaaatgaggagtaggacacatcccgagcgcctgcccaagctgagtctgtatagtggtgagagccttctcaggagccagagcgggcatctggagtccagtatcgctgaaacactcaaggacgagcccgagtcagctccagttagccccgtcagaaagactacaaaaatccacaccaaagctaaggtgacatctcggggaaaagccagggaaggaaggagccctaccagatgggcagcactgccctctgattgcccgctcgttctgaggaagttaatgctgaaggaggacacgagagctgggtgtaaatgtctggtgaaggctccactcgtgagcgacgtggaactggagcgattcctactcgcccctcgcgatccgtcacaagtgcttgtttttggcatcatatcgtctcagaactatacgtccaccggacagctccagtggctccttaacacactctacaatcaccagcagaggggccgcggttccccatgtattcagtgtcggtacgatagctatcgactgctccaatacgacctggattcacctttgcaggaagacccgcctcttatggtgaagaaaaattctgtcgtgcagggcatgatattaatgtttgctggcgggaaactcatttttggggggagagtcctcaacgggtatggcttgagtaaacagaatctcctgaaacaaatctttcggtcacagcaggattacaagatggggtatttcctgcccgacgattacaagttttccgtccccaactcagtgctgtcactcgaggacagcgagagtgtgaaaaaggctgagagtgaggatatacagggcagctcttcaagtctcgcacttgaggattatgtagaaaaagaattgtccctagaagccgagaagaccagagagcctgaagtggagcttcatcctctgtctcgcgactctaaaattacaagctggaagaagcaggcatccaaaaagtag

SEQ ID NO: 41269 - DNA, 1491 bp, Artificial Sequence
  Description of Artificial Sequence: Synthetic coding sequence
atgttctgccacctgcggcccatgcggcggctgtgcctggagaagattttcccacactggttccctttctcaagggctctcagtggtgccgaagccgtcaatgccctgagacccttctattttgctgtgcacccagatttttttggacagcacccggtggagagagagatcaacgaaaactctttgaagagactctccgtctacctggagaatctgcagaaaccaggtttcaagtctttaaagccaacccagctgaccttttacgtgcgggaaaccgatcaatcttcctccgacgggcaggaacctttttcaacctctggattccgcgccgtgaagtttactctgcacactagggaccttctatctacagtcctatacatcctgaactcctgctcgctctctgtagagcacatccagagcctcaacactaatatgcatactcagccactgaaagaggcgaagcggatgccagacagaccaatcaaatgggacaagtcatactacagcttcaccggattcaaggacccagatgaggacctcgagcaggtaagtcgcgttgaaacaacccttacaagttggctcgacaacaacggcaaatcggccgtcaagaaactgaaaaactcgctgcccctgagaaaggagctcgaccgtctgaaggacgagcttagtcatcagctccagttgagtgatattcggtggcagaggagctgggggatcgcccatcgttgctcccagctgcactccctgagtcgcctggcccagcagaacctcgaaaccttgaaaaaggctaagggctgtactattattttcaccgacaggagtggcatgagtgccgtggggcacgtgatgctgggtaccatggatgtgcaccatcattggaccaagttattcgagcgtctgccatcctactttgatctccaacggaggctgatgatcctggaggaccagatatcttacctgctcggcggtatacaggtggtgtatattgaagagctgcagcctgtgcttacgttagaagagtattattctttactggacgtgttttacaaccgcttactgaaaagtagaatcctgttccacccccgatcgctgcgggggctgcaaatgatcctcaactctgacagatacgcgccctccttgcatgaactgggccacttcaacatcccgaccctgtgcgatccagccaacctgcagtggttcatcctgaccaaggcacaacaggctcgagagaatatgaagcggaaggaggagctcaaggtgatcgaaaacgaactgattcaggcttccacgaaaaagttctctttggagaagctctacaaagaaccttccatttcaagcatccagatggtggactgctgtaaaagattactcgaacagtccctaccttacctgcatggcatgcacctgtgtatttctcacttttactccgttatgcaagacggtgacttgtgcattccatggaattggaagaacggggaggccataaaatag

SEQ ID NO: 41270 - DNA, 213 bp, Artificial Sequence
  Description of Artificial Sequence: Synthetic coding sequence
atgttctgccacctgcggcccatgcggcggctgtgcctggagaagatcttcccacactggttcccattcagtcgtgccttgtctggcgccgaagccgtgaacgccctgcgccctttttacttcgctgttcatccagatttttttgggcagcacccagtcgaacgggatgacacctggaaatcgttccaatgtccctccgattttagcctctag

SEQ ID NO: 41271 - DNA, 213 bp, Artificial Sequence
  Description of Artificial Sequence: Synthetic coding sequence
atgttctgccacctgcggcccatgcggcggctgtgcctggagaagattttcccccactggtttccgttctcccgggccctgagtggcgcagaagcagtcaacgcactcaggcccttctactttgccgtgcatcctgatttttttggccagcaccccgtggaaagagacgacacttggaaatcttttcaatgcccttccgacttcagtttatag

SEQ ID NO: 41272 - DNA, 1491 bp, Artificial Sequence
  Description of Artificial Sequence: Synthetic coding sequence
atgttctgccacctgcggcccatgcggcggctgtgcctggagaagattttccctcactggtttccctttagccgcgcgctgagtggggccgaggccgtcaacgccctgcgacccttttacttcgctgttcatcccgatttcttcggtcagcatcccgtggagagagaaatcaatgaaaactccctgaaacggctgtcggtgtatctggaaaacctgcagaaacctggatttaagtcattgaaacctactcagttgacattctatgttcgggaaacagaccagtctagctctgatgggcaggaaccttttagcacctccggctttagagctgtgaagtttaccctccatacacgagacttgctctcaacagtgctgtacatcctaaactcctgcagtctgagcgttgagcacatacagagcctcaacacgaatatgcacactcagcctttaaaagaggcaaagcgcatgcccgatcggccgattaaatgggataaatcctattattcctttacaggctttaaggatcctgacgaagatctggaacaggtatctcgagtggagacaacgctgaccagctggttggacaataatggcaagtcagccgtgaagaagctaaaaaacagcctccctctgcgcaaggagctcgatcggttgaaagatgagctgtcgcatcagctgcaactttccgacattcggtggcagaggagttggggcatcgcccatcggtgctcgcagttgcattccctcagccggctggcacagcagaacctggagactctgaagaaggcaaaggggtgtactatcatcttcaccgaccgctctggcatgagtgctgtgggtcacgtgatgttaggcaccatggatgtgcatcaccactggacgaagctctttgaacgacttccatcttatttcgatcttcaacggaggcttatgatcctggaagatcagatctcgtacctgctgggcggaatccaggtcgtgtatattgaggagctccagccagtccttacacttgaagaatactactctcttctcgacgtcttttataaccgattgctgaaatcccggatactgtttcatcctaggtcactgcggggcctgcagatgatcttaaacagtgaccgttatgcaccctctctgcacgaattgggacacttcaatattccaacattgtgtgatccagcaaatctacaatggtttatccttaccaaggcccaacaagcaagggaaaatatgaagcgcaaggaggaactgaaggttatagagaacgagttgatacaggcatcgactaagaaattttccctggagaaactctacaaggagccttccatctcgagcatccaaatggtggactgttgtaaacgactgctggagcagtcactgccatatcttcacggcatgcacctgtgcatctctcacttctatagcgtgatgcaggacggcgatctttgtataccatggaattggaagaatggggaggccattaagtag

SEQ ID NO: 41273 - DNA, 885 bp, Artificial Sequence
  Description of Artificial Sequence: Synthetic coding sequence
atggccggccagcccgccgccaccggcagccccagcgccgacaaggatgggatggagcctaacgttgtggcccgcatttctcaatgggcggatgatcacctgcgcctggtgcgaaatatcagtaccggaatggcaatcgccggtatcatgctgttgctgcgctccatcagacttactagcaagttcaccagtagctccgacatcccggtggaatttattcggagaaatgtcaagctcaggggacgcctgagaaggattaccgaaaacggacttgaaatagagcatattcccattaccctgccaattattgcttcgttacgcaaggaaccaagaggagccctgctggtgaaactggccggggtcgaactagcagagactggcaaggcctggctccaaaaggagctaaaaccaagccagttactgtggtttcagctgctcggaaaagaaaacagtgctttgttttgttatctgttagttagtaaaggaggctatttctccgttaacctgaatgaagaaatcttaaggagaggtcttgggaaaacagtgctcgtcaagggccttaagtatgactcaaagatatactggactgtgcatcgcaatctcctcaaagctgaattgaccgctctgaaaaaaggcgaaggcatatggaaggaggacagcgagaaagagtcataccttgaaaagtttaaggactcatggcgtgaaatctggaaaaaggactcatttctgaagactaccggcagtgattttagtctcaaaaaggagagctactatgaaaagctgaagcgcacttacgagatctggaaggataacatgaataattgctcacttattcttaagttccgagagctgatcagccgaatcaacttcaggaggaaggggtag

SEQ ID NO: 41274 - DNA, 756 bp, Artificial Sequence
  Description of Artificial Sequence: Synthetic coding sequence
atggccatcgccggcatcatgctgctgctgcggagcatccggctgacaagcaagtttacaagtagctccgatatcccagtcgaatttattcgaagaaacgtcaagctgaggggaagattgaggagaatcactgaaaacggccttgaaattgaacacatccctatcacccttcctatcatcgccagcctaagaaaagagccacgcggagccctgcttgtcaagctagctggtgttgagctggcagagacgggaaaggcctggctgcagaaggagctcaagccgagtcagctgctgtggtttcagttgctgggtaaagagaacagcgcgctcttctgctacctgctcgtgagcaagggtggctacttcagcgtgaatctgaatgaagaaattctgcggcgcgggctgggcaagactgtgttagtgaagggtctcaagtacgactctaagatttattggacagtgcaccgtaacctactgaaagctgagttgactgcattaaagaaaggggagggtatctggaaggaggactctgaaaaagagtcctacctcgagaagttcaaagactcgtggcgcgagatctggaagaaagactccttcttaaagactaccggctccgatttctccctgaagaaagagtcttattacgagaagctgaaaaggacatatgagatttggaaggacaacatgaataactgcagccttatcctgaagttccgcgagctaatctcgagaattaatttcaggaggaaagggtag

SEQ ID NO: 41275 - DNA, 885 bp, Artificial Sequence
  Description of Artificial Sequence: Synthetic coding sequence
atggccggccagcccgccgccaccggcagccccagcgccgacaaggacgggatggagcccaacgtcgtggcacggatctcacagtgggccgatgaccaccttcgactggttcggaacatatctactggaatggccatcgctgggatcatgctactccttcggtccatacgcttaacaagcaagttcacttcatcatccgatattcctgtggagttcattaggcgaaacgtgaaacttcgaggccgtttgagaagaatcacagagaacggtctcgaaatcgaacacatacctataacgctgcctatcatagcctcactccgaaaagagccccggggcgccttactcgtgaaacttgcaggtgtggaactagcggagactgggaaggcctggttacaaaaggagctgaagccatctcagctgttgtggttccagcttctgggcaaagagaatagtgcactgttttgctacctgctggtcagtaaaggcggttatttctccgttaacctgaatgaggagatcctccgtcgcggactggggaaaaccgtcctggtgaagggtcttaagtatgactccaagatttattggaccgtccatagaaatctgctcaaagccgagctgacggcacttaagaaaggtgagggcatttggaaagaagactctgaaaaggagtcttacctggagaaattcaaggactcctggcgcgaaatttggaagaaagactcctttcttaaaaccactgggagcgatttttctctgaagaaagagagctattatgagaagctaaagcggacgtacgagatctggaaggacaatatgaacaactgtagcctcattctcaaattcagagagcttattagccgcatcaactttcgcaggaagggctag

SEQ ID NO: 41276 - DNA, 513 bp, Artificial Sequence
  Description of Artificial Sequence: Synthetic coding sequence
atgaagaccatggccacccggaagcggtgcaagctgagccggaccgggcctgagtttgagaacgttattaagcgccttctctgcgccaggacctttcacacacgaatcggaggcgacttgacacatggtatcataaaccgcggaaggcgggcaaacgcagagcaaatgggcctccaggggagtgcacagcactttaatatattcccccttgacctctggacgcagggcaagaagaccgaagtgcagaaacgcgaaggaacagatagcataccggccgccggtaggagtggcaccgccaatcagccatctatcgcccctcacaggtgtttattctcacgaggcattacagccctggacgggctgaagaggggacgaggctgtaacggggccgcgcacctcgttcgcggggacgcctggaaaacaaaactcggagaaccttgggtgagcattgcgctcgcactggccggccctggagctatcctgatccttgaattaagttggtttctcggttag

SEQ ID NO: 41277 - DNA, 360 bp, Artificial Sequence
  Description of Artificial Sequence: Synthetic coding sequence
atgaagaccatggccacccggaagcggtgcaagctgagccggaccggtccagaattcgaaaacgtgatcaagcggttgctctgtgctaggaccttccacacaaggatcggcggggacctgacgcatgggataataaatcggggcaggcgcgctaatgccgagcagatgggccttcagggctctgcccagcacttcaacatttttcccctagacctgtggacccagggtgattgcatgctggtgagcctggcaaaaaacaaggtcaatgtattcggggcaataatcaatatggctgcatcagtgagcggggtgattggcgggctcaagttctcacgaacttactacgtgaaggggatctag

SEQ ID NO: 41278 - DNA, 360 bp, Artificial Sequence
  Description of Artificial Sequence: Synthetic coding sequence
atgaagaccatggccacccggaagcggtgcaagctgagccggaccgggccggagttcgagaacgtgattaagagactgctgtgtgctagaacattccatactcgaatcggcggtgacctgacacacggaatcattaatagggggaggagggccaacgccgaacagatgggactgcaggggagtgcccagcatttcaatatcttcccactggatctgtggacccaaggagactgcatgctggtttcattggccaagaacaaggtgaacgtgttcggtgctatcattaacatggccgcatccgtaagtggcgtaattggaggtcttaaattttcaagaacgtactacgttaaaggaatttag

SEQ ID NO: 41279 - DNA, 360 bp, Artificial Sequence
  Description of Artificial Sequence: Synthetic coding sequence
atgaagaccatggccacccggaagcggtgcaagctgagccggaccggccctgagttcgagaacgttatcaagaggctactctgcgcaaggaccttccacacacgcatcgggggggaccttactcatgggattattaatcgcggtagacgggcaaacgcggaacagatggggctccaaggcagcgcacagcacttcaacattttcccactggacctatggacccagggtgattgtatgctggtcagtctcgcaaagaataaggtgaatgtgtttggtgctatcatcaacatggctgccagcgtgtccggcgtaatcggcggccttaagtttagtagaacttattacgtcaaggggatttag

SEQ ID NO: 41280 - DNA, 237 bp, Artificial Sequence
  Description of Artificial Sequence: Synthetic coding sequence
atgaagaccatggccacccggaagcggtgcaagctgagccggaccggaccggagtttgagaatgtgattaagaggttattgtgtgctcggaccttccacactcgaataggaggggatcttacacatggcatcattaaccggggcagacgggctaacgcagagcagatgggcctgcagggcagtgcccaacattttaacatttttcctttggacctttggacccagggtaagaagtag

SEQ ID NO: 41281 - DNA, 645 bp, Artificial Sequence
  Description of Artificial Sequence: Synthetic coding sequence
atgaacaacgagaccaccaccctgatcagcctgaaggaggccatgaagcgggtggatcacaagctccaggccctggaaacgcagttcaaagaactggatttcaccaaagacaatctgatgcagaagtttgagcaccattctaaggccctggcctcccaggccgcccaagatgagatgtggaccgcagtgagggcactgcagctgacgtcaatggaattaaacatcctttacagctatgttatagaggtgctcatctgtctgcataccagagtcctagaaaagctacccgatctagtgagaggcctgcccaccctggcatcggttctgcgtcggaaggtgaaaaataaaagggtgcgcgtggtctgggagtccatcctcgaagaatgtggactgcaagagggagatatcacagcgctctgcacatttttcatagcccgtggaaacaaggcggagcattacactgcaaaggtgcgacagatgtatattagggatgtgacatttttgatcacaaacatggttaagaatcaagcactgcaggacagcctgttaagggccgttcaggtgatagagaaggggaaggcagtgcggacgcctgagaaacagaagagcagtcttgaagaattgattccgagcgtcaaaaactag

SEQ ID NO: 41282 - DNA, 495 bp, Artificial Sequence
  Description of Artificial Sequence: Synthetic coding sequence
atgcccagcctggcccccgactgccccctgctggccatgcccgaggagacacaggaagacagtgtggccccaatgatgccaagccagaggtctagaggcccgctcgctcccaatcatgttcacgaggtgtgtctgcaccaagtggagtctatatccgaccttcattctggggccggaaccctccgaccgtaccttaccgaggaagcacgcccctgggatgaacttctgggtgtcctgcctccaagcctttgcgcccaagcaggctgctctcccgtatatcgaagaggcggatttctgctactgctcgcactgctggttctgacatgcctcgtgctggctctgctcgccgtctacctgagcgtactgcaaagtgagtcgctgaggattctagcccataccttgagaacacaggaagaaaccttgctgaagctcagactggccagtctctctcagttgcgccgcctgaattcttctgaagcccaagccccatcttag

SEQ ID NO: 41283 - DNA, 219 bp, Artificial Sequence
  Description of Artificial Sequence: Synthetic coding sequence
atgaaggtggtgggcaactaccgggtgaacaccgccaacagcagcactgatacgagtggcgagcatctgacctgcctgaggagtcagttgtttgttgcgtacaggaacgggagggtagatgaggccgtatccttaggcttcctggactgctggatcgggggcgaccttacaaacttcaaaggctgttatctgacaaatcagctgccaatccagttctag

SEQ ID NO: 41284 - DNA, 873 bp, Artificial Sequence
  Description of Artificial Sequence: Synthetic coding sequence
atgctgggccagcgggccggcgacggcgagcggcccggcctgcccggcgacggggaaggcggcgttcctgccagacccgggcgacgagccgagcgccccccacagaggcccgcaaaggtgaacaaggccgttacatgcgccgcacacctgcccggtgctgctgctagccgcccactgagcccaaataaaccagatcgggtccgcccaggtcaacgtgacaggattggcgcgaaacggcagagaagacggcgcgccgatgctggtcaggctcgcgccgcaagtagcagacgggtggtcccaactgcccccgaggttttgggcgcagtggcctctcttccggaccgcggacgacctactgtcgcaagggtggccacaggctctagactggaaggacttttttcagctgcctcgctgaagctgagcgccctgacacaatccctcacccgggttcggcaggctccaacagcctcgggtgcaacaatcagattgcctgcaagtccagtggagatgttcctcactagcgcattcctgacggggttcagctttcactgtctgtactccggcatcggccacggggaggacattctcgccagcgttgaacagataaccatcgtaagcagaccgctttctggccaacgaggggcaggccctggtaacagtgcttacaccccccgtcgctctcagggaggcccccgtgccgctacgaccccggggtttcgcttcccgtgccgggggttggtgagaagagccgtgttgaggctgaccgtcacggtgcaggattgcatactgaccgctctcctggctgtcagtttccactcaataggtgtggtcatcatgactagctcctatcttcttgggccagtggtgaagtag

SEQ ID NO: 41285 - DNA, 213 bp, Artificial Sequence
  Description of Artificial Sequence: Synthetic coding sequence
atgttcacccgggcccaggtgcggcggatcctgcagcgggtgcccggaaaacaacgatttggcatttaccgctttctcccctttttctttgtgttaggcgggaccatggagtggattatgattaaggtgagggtgggacaggaaactttttacgacgtgtatcgaaggaaggccagcgaacgtcaataccagcgccggctggaggacgaatag

SEQ ID NO: 41286 - DNA, 3189 bp, Artificial Sequence
  Description of Artificial Sequence: Synthetic coding sequence
atggagagccaggagttcatcgtgctgtacacccaccagaagatgaagaagagcaaagtttggcaggatgggattctcaagattacccacctcggaaacaaggcaatactgtacgacgacaaaggggcttgtcttgagagtttgtttctgaaatgcctggaggtaaagcctggagatgacctggaaagtgatcggtacctcatcacagtagaggaagtgaaggtggctggggcgatcgggatcgtgaaacaaaacgtcaacaaggaagctccagagcttaactcaaggaccttcatctcttcgggccgctctttgggctgtcagcctagcggcctcaaaaggaaatttaccgggttccagggacctcgccaggtgcctaagaaaatggtgattatggagtcaggcgagtctgctgcctctcatgaagctaagaagacagggcctactattttcagtcctttttgtagcatgccgccactcttcccaacagtcgggaagaaggacgtgaacaacatcctggcagatccagagaacattgtaacatacaagaatcgcgagaggaacgctatggacttttcaagcgtgtttagtccatcgtttcagattaatccggaagtgttatgcgaggagaactacttctgtagcccggtgaattcggggaacaagctctcggatagtcttcttactaatgaaccagtgaaaagggatagtcttgcctcacactattcaggcgtctcccagaacatccgatcgaaggcacagatcttggccctgctgaaaagcgagagtagctcctcttgtgaggagctgaattctgagatgaccgagcatttcccccagaaacagccccagggtagcttaaaaattgctacaaaaccaaaatacctcatccagcaagaggaatgtgccgaaatgaagagcacagagaatttgtattatcagcaccagagcgagaataccatgagaaacaaatcaaggtgggccatgtacctgagcagtcagtcaagcccaatacattctagtacggttgatgggaacgacaccgaacggaagccaaaggcccaggaggacgacgtgaattccaacctgaaagacctgagtctccagaagataattcaattcgttgaaacttacgccgaggaacgaaagaagtacaatgtcgaccagtccgtcggcaacaacgatccttcctggaaccaggaggtcaagctggagatcccctctttcaacgagagctcaagtctgcaggtgacttgcagcagcgcagaaaatgatggcattctatctgagagcgacatacaggaagacaacaaaatccccttcaaccagaatgacaaaggatgtattaaaggttcggttctgatcaaggaaaacgcacaggaagtaaacacatgcggaacactggaaaaagaatacgaacaatcagaaagttccctccccgagctgaaacacctccagattgaaagcagcaataacagccgcatcagtgacgacattacagacatgatcagcgaaagcaagatggacaacgagtcgcttaattcaatccacgagtccctgagcaatgtaacgcagcccttcctcgaggtgacgtttaatctaaacaatttcgagactagcgacaccgaggaggagtctcaagagtccaacaaaatttcccaagatagcgagtcgtgggttaaagatattctggtgaacgatgggaacagctgtttccaaaagagaagcgaaaacaccaactgtgaggaaattgaaggcgagcacctcccatttttaacctccgtctccgataagccgacagtgacattcccagtgaaagagaccctaccttcgcagttctgtgacaaaacctacgtgggattcgacatggggatctgcaagacagaaaatacagggaaagaaatcgaagagtactctgataccctcagtaacttcgagtcttttaaatggacagatgccgtgtacggcgacaacaaggaggacgcaaacaagcccattcaggaggtgcgcattaattacgattttgcactgccccccaacaaaagcaagggtatcaatatgaacttgcatattcctcatatccagaatcagatagcggagaactctaatctctttagcgaagacgcccagccacaaccatttatcttgggcagcgacctggacaagaatgacgagcacgttctgccatccaccagttcatctgacaatagcgttcagttgctcaacacgaaccagaaccactacgagtgtatcgcccttgataaatctaatacgcacatcagcaattctttgttttaccccctgggcaagaaacatcttatatccaaagatacggaggcacatatttccgaaccagaggacctcggtaaaataagaagtccccccccagaccatgtcgaggtggagaccgcaagagagggaaaacagtactggaaccctaggaactcatccgaactctccggactggtgaatacaattagcatcctcaagtccctgtgcgagcatagcaccgcccttgactccctggaaatcttaaagaaaaaaaacacggtctttcagcagggcacacagcaaacatatgagcctgattcgccccccgaggtccggaaaccgttcattacagtcgtgtctcccaagagtccgcacctccataaagattcacagcagatactgaaggaggatgaagtcgaactatccgagccgctgcaaagcgtccaatttagctcctcagggagtaaggaagaaaccgcgttccaagcagtgatccctaaacagatcgaaaggaaaacctgtgatccaaagccagttgagttccaagggcaccaggtgaagggcagtgcaacatccggagtcatggttcgcggccactcctcacaacttggctgttcccagtttcccgacagcaccgaatacgaaaacttcatgaccgagacacctgagctaccttccacctgcatgcagatcgattttctccaggtgaccagcccggaggagaacatctccactctctccccggtgtcaaccttcagcctgaatagcagggacgaggacttcatggtagagttctcagagacgtcactcaaagcccggactcttcctgacgatctgcactttcttaacctcgaaggctccaggtaccacatcgctctgatttctgtttattcattcaagatgaaattcttcatctag

SEQ ID NO: 41287 - DNA, 2748 bp, Artificial Sequence
  Description of Artificial Sequence: Synthetic coding sequence
atgttccaggccatcctgtacgacgacaagggcgcctgcctggagtcattattcctgaagtgcctcgaagttaaacctggcgatgatttggagtccgaccgatacctgattaccgttgaggaggtaaaagtggcaggcgcaatcggcatagttaaacaaaacgtcaataaggaagccccagaactgaatagtagaacctttatctcaagcggtagatctttaggctgccagccctctgggctaaaacgcaaattcacaggtttccaaggaccccggcaggtgcccaagaagatggttatcatggagagtggggaaagcgctgctagtcacgaagccaaaaaaacgggacctactattttctccccattctgtagtatgccacccctattcccgactgtgggaaagaaagatgtgaacaacatcctggctgatccagagaacattgtgacatataaaaacagagagcggaacgcgatggatttctcctccgtattcagtccgtccttccagatcaaccccgaagtgctctgcgaggaaaactacttttgtagccctgttaattctggcaataagcttagtgactcacttcttaccaatgaacctgttaagagggattcgcttgcctctcactactccggcgtttcgcagaatattcgtagcaaagctcagatcctggcccttttgaagagcgagtccagctcctcctgtgaagagttgaattcagagatgacagaacattttccccaaaaacaaccccagggctcacttaaaatcgctacgaaacccaagtatctgatccagcaggaagagtgtgccgagatgaagtctacggagaatctctactaccagcaccagtcagagaatacaatgaggaataagtcccggtgggcgatgtacctgagttctcagtcatcacctatacattcttcaaccgtggacggaaacgatacagagcggaagcctaaggcccaggaagacgacgtgaattcaaatctgaaggacctttcgctgcagaagatcatccaattcgttgagacatacgccgaagagagaaaaaaatacaatgtggatcagtctgtgggtaacaacgaccctagttggaatcaagaggtcaagctggaaatacctagctttaatgagtcctcctccctccaggtgacctgctcttcagccgagaatgacggcatcctgtctgaaagcgacattcaggaagataacaaaattcccttcaaccagaacgataagggctgcattaagggcagcgtgctcatcaaggagaacgcacaggaagtgaatacttgcggcacactggaaaaggagtatgaacaaagcgagagcagtctgcccgagctcaagcacctccagattgaaagcagcaacaacagtcgcatcagcgatgatataactgacatgatttccgaatccaagatggataacgaatcactcaacagcatacatgagagcttgagcaacgtgacgcaaccatttctcgaagtcacattcaacttgaataatttcgagacctccgatacggaagaagagtctcaagagagtaacaaaatttcgcaggatagcgaatcctgggtgaaggacatcctcgtgaatgatggaaactcttgttttcagaagaggtcggagaataccaattgtgaggagatcgagggagagcacctgcctttcctcacctccgtctcagataagcccacagtgacatttcccgtaaaggaaacgctcccctcacaattctgcgacaaaacatacgtcggctttgacatggggatctgtaagactgagaataccggcaaggagattgaagagtactcggatacactctccaatttcgagtccttcaaatggaccgatgctgtatacggagacaataaagaagatgcgaacaaaccaatccaagaggtcaggatcaactatgatttcgctctgccaccaaataagagcaagggaatcaacatgaatctgcacatccctcacatccaaaatcaaatcgccgaaaatagcaacctgttttccgaagacgcccagccacagcccttcatcctgggcagcgacctcgacaaaaatgatgagcatgtcctgccatccacttcctcgtccgacaatagcgttcagttgcttaacacgaatcagaaccactacgaatgcatcgcactcgacaaatccaatacacacattagcaacagtttgttctaccccctaggcaagaaacacctgatctctaaagacacagaagcccacatcagcgagcccgaggacctggggaaaattcgatccccgcctcctgatcacgtggaggtggaaaccgccagagaagggaaacagtactggaacccacgcaactcctcggagctgagcgggctggtcaacaccatcagcatcctgaagtcgctgtgcgaacattcgaccgctcttgattctctcgaaatcctgaagaagaaaaatactgtgtttcaacagggtacccaacaaacctatgagcctgactccccccccgaggttcggaaacccttcataactgtcgtgagcccaaaaagtccacatctccataaggattcccagcagaaaacagtgaagaaaaagatcaagcccaccctgcccctgcgaattttcattaacgtttcccgattcttttgtgttcaattgaaaaaaatggtccggcttatgtatattaactcatttatttcttttcccctgaatattgttgtactgagctacatcatcaacaactccagctag

SEQ ID NO: 41288 - DNA, 525 bp, Artificial Sequence
  Description of Artificial Sequence: Synthetic coding sequence
atggagagccaggagttcatcgtgctgtacacccaccagaagatgaaaaaatctaaggtctggcaggacgggatcttgaaaattactcacctgggtaataaggccattctgtacgacgacaagggagcttgcctcgagagcctgtttctcaagtgcctggaggtgaagccaggcgatgacctagagtcagaccgatatctgattaccgtggaagaagtgaaagtggccggcgcaattggcatcgtcaaacagaacgtaaataaagaagcgccagaactcaattcgaggactttcatctctagcggaaggtcattaggctgccagcctagcggcctgaagcgtaaattcactggattccagggcccacggcaggtgccaaagaagatggttataatggagagtggggagtccgctgcctctcatgaagcaaagaaaaccggccctacaattttttcacctttttgctctatgcccccgctgtttcccactgtcggtaagaaagatgtcaacaacattctggcctag

SEQ ID NO: 41289 - DNA, 600 bp, Artificial Sequence
  Description of Artificial Sequence: Synthetic coding sequence
atgaccagcctgatcaacagccccatcaaccggcggcccctgcagaatgtcgaagggaacaataggtgccagcgtaaggcaaagaactatggaaataagtacttcatccactgtttggacctggagaagattaccctctcaccacgcaggaaacatgatatcgaaggaggtgacaagctcaacgtaaagttcagccagctgagaagcagacgccagagaaaagcagagccaggcgcctgcgcgttgggacgggtcggctccgagtgtattccagagcctggagcacgtaggaccgctcaagcagctggactgcggtccgtctctggcgcagctaacacgaaagtgcgagaactgaaacacttcagattcttgggtctgctacggagttgcagatccgaaatggaggtcgatgcgccaggcgtagatggaagagatggactgagagagcgcaggggtttcagcgagggaggcagacagaactttgacgtcaggcctcagagtggagctaatgggctcccgaagcactcttactggttagacctttggctttttatcctgttcgatgtggtggtgtttctgttcgtgtacttcctgccatag

SEQ ID NO: 41290 - DNA, 201 bp, Artificial Sequence
  Description of Artificial Sequence: Synthetic coding sequence
atggaggtggacgcccccggcgtggacggccgggacggcctgcgggaaaggcgcggcttttcagagggcgggcggcagaactttgacgtccggccacagagcggcgccaacgggctccccaaacactcatactggttggacctctggctttttatcttgtttgacgttgtggtgtttttatttgtttatttcctgccatag

SEQ ID NO: 41291 - DNA, 399 bp, Artificial Sequence
  Description of Artificial Sequence: Synthetic coding sequence
atgtgcagcgccggcgagctgctgcggggcggcgacggcggcgagcgggatgaggacggagacgccctagcagaacgggaagctgccggcactgggtgggatcctggggcttctcccagacgtcggggccaaagacccaaggagtctgaacaggacgtagaagacagccagaaccacacaggggagcccgtcggcgatgattacaagaagatgggtaccttattcggcgagctaaacaaaaacctcattaacatgggatttacacgaatgtactttggggagcggatagtggaacccgtcatagtgattttcttctgggtcatgctgtggttccttggactgcaggctctcggcctggtagccgtactgtgcttggttatcatttatgtgcagcagtag

SEQ ID NO: 41292 - DNA, 300 bp, Artificial Sequence
  Description of Artificial Sequence: Synthetic coding sequence
atggccgagggcggcttcgacccctgcgagtgcgtgtgcagccacgagcatgcaatgaggcggctgattaacctcctgcgacagtctcagtcttattgcactgacactgagtgtctccaggagctcccagggccctccggcgacaacggcatcagtgtgactatgattctggttgcgtggatggtgattgcccttatcctgtttttactaaggccgccgaatctgcggggcagcagcttgcctggtaaaccaacttcaccccacaacggtcaagaccctcccgcgcccccggtggattag

SEQ ID NO: 41293 - DNA, 270 bp, Artificial Sequence
  Description of Artificial Sequence: Synthetic coding sequence
atggccgagggcggcttcgacccctgcgagtgcgtgtgcagccacgaacatgccatgcggcgcctaattaacctgctccgccagagccagtcttattgtacggataccgaatgtctccaggaactgcctggacccagcggtgacaacggcatcagcgtgacaatgatccttgtggcctggatggtcatagcactcatactttttctgcttagaccaccgaatctgagaggcagctcgctgcccgggaagcccacaagccctcataattag

SEQ ID NO: 41294 - DNA, 723 bp, Artificial Sequence
  Description of Artificial Sequence: Synthetic coding sequence
atgtacctgcggcgggccgtgagcaagaccctggccctgcccctgcgggccccgccaaaccctgcaccccttgggaaggacgcctctctcagaagaatgagtagcaaccgctttcccgggagtagtggttccaatatgatatactatttggtagtgggtgtcaccgtctctgccgggggatactatgcctataaaactgtgacatcagaccaggccaagcacacagagcacaagactaacctgaaggagaagacgaaagccgagattcacccttttcagggagagaaggaaaatgtcgctgaaacagaaaaggctagctccgaggcccccgaggagctcattgtcgaggcagaggtggtcgacgcggaagagtctccctccgccactgtggttgtgatcaaggaggccagtgcatgccccggtcacgtagaggccgcccctgaaacaaccgcggtctccgctgagaccgggcccgaggttaccgatgccgctgcaagggagacgacagaggtcaacccggagaccactcccgaagttaccaacgcggcccttgacgaagccgttacaattgacaatgataaggacaccacaaagaatgagacatcggatgaatatgccgaactggaggaggagaatagtcccgcagagtctgagtccagcgccggagatgatctccaggaggaggcttccgtaggctcagaagcagcctcggcccaggggtag

SEQ ID NO: 41295 - DNA, 2337 bp, Artificial Sequence
  Description of Artificial Sequence: Synthetic coding sequence
atggacagcaaggagagcctgacccccggccgggaggagaaccccagttccgttttagcccaagagcgtggagatgttatggatttctacaagactttgcggggcggcgccacagtaaaggtctccgcctccagcccatctctcgccgtggcctctcagtcagatagtaagcagcgccgcctactagttgacttccccaaaggctccgtctctaacgctcagcagcctgacttgtcaaaagccgtctccctgtctatgggcctctatatgggtgaaacagaaaccaaggtgatgggcaacgacctgggcttcccacagcagggtcaaataagcctctctagcggggagaccgacctgaagttgctcgaagaaagcattgctaacctgaaccgctccactagcgtgcctgagaatcctaaatcttccgcgtcaaccgctgtctccgcagctccgacagagaaggagttccccaaaactcattcagatgtttcttcggagcagcagcatttgaagggccagacgggcacaaatggcggcaacgttaaactctataccacagatcagtctacatttgacatcttacaagacctcgagtttagtagcggctcccctggcaaggaaactaacgaatccccctggaggagcgatttattaatcgacgaaaattgtctgctctcccctttggctggtgaagacgactctttcctgctggagggcaatagtaacgaggattgtaagcctctgatcttgccggatacgaaacccaaaatcaaggataatggcgaccttgtgctatccagcccctcaaatgtgacactgcctcaggttaagaccgagaaggaagatttcattgaactttgcactcctggcgtaatcaaacaggaaaaattaggcaccgtgtactgccaggcgtctttccccggagccaatataattggtaataaaatgagtgctatttctgtgcatggggtgtctaccagcggcggccagatgtaccactacgacatgaataccgccagcctttctcagcagcaggatcaaaaacccattttcaatgtcataccgccaattcccgtcggtagcgaaaactggaataggtgtcagggatccggcgacgacaatctaacctccctaggcactctgaatttccccggaaggactgtttttagtaatgggtacagcagcccaagcatgaggccagatgtgagcagtccaccctcgagctcttccacggcgactaccggtccccctcccaagctgtgcctggtctgttccgacgaagccagcggatgccactacggggtgctaacttgtgggagctgtaaggttttctttaagcgcgcagtggaagggcgacagcacaattacctctgcgcagggagaaacgattgcattattgacaagattcgaaggaaaaattgcccagcctgtcgatacagaaagtgtcttcaagccggaatgaacttggaggcccgaaagacgaaaaaaaagattaaggggattcaacaggctactactggcgttagccaggaaacgtcagagaatcctggtaacaaaaccatagtacctgcgacgctgcctcagctcacaccgacgttagtctccctgctcgaagtgatcgaaccagaggttctttatgccgggtacgattcttccgttccagacagcacttggaggatcatgacaacgcttaatatgctggggggacgtcaagtgattgccgcagtcaagtgggcaaaggcgattcccggcttcaggaacctgcacttagacgatcaaatgacactgctgcaatattcctggatgtttctgatggcgtttgccttgggttggaggtcatataggcagagctcagctaacttactctgcttcgccccggacctaatcattaacgagcaaagaatgaccctgccttgcatgtacgaccagtgcaagcacatgctgtacgtgtcaagcgaattgcaccgactgcaggtgtcctatgaggagtacctgtgtatgaagactctgttgttactgtcatctgtcccaaaagacggcctgaaatctcaggagctgttcgacgagatcagaatgacttatattaaagaactgggcaaggccattgtcaagcgtgaggggaattcctcgcagaattggcaacgcttctatcagctcacgaagctgcttgactccatgcacgaagtcgttgagaatctgttgaattactgtttccagacatttttggataaaaccatgtctatcgagttccccgagatgctcgcagaaattatcacaaatcagattccaaaatactcaaacggtaatattaagaaactgctatttcaccaaaaatag

SEQ ID NO: 41296 - DNA, 498 bp, Artificial Sequence
  Description of Artificial Sequence: Synthetic coding sequence
atgaagaccaagcccaacctgctgttccccaagagcgcccccccctctcttcctagacgggtcccacggaaagtggaggaagatttactgatgctgaactcatccccctccacagcaaaggataccctagacaacggcgattatggagaacccgattacgattggacgacagggcctagagacgacgatgagtccgatgatacactagaagagaacaggggctatatggaaatcgagcagagcgtgaagtcttttaaaatgccaagttctaatatcgaggaggaagattcccatttctttttccacttaattattttcgcattctgcatcgccgtcgtctacatcacctaccacaacaagagaaagatttttttacttgtgcaatctaggaagtggagggacgggctgtgcagcaagaccgttgagtatcataggctcgaccagaatgtcaatgaggccatgccatctttgaagattacgaatgattatatcttctag

SEQ ID NO: 41297 - DNA, 648 bp, Artificial Sequence
  Description of Artificial Sequence: Synthetic coding sequence
atggccagcgagaccgagaagacccacgccctgctgcagacctgctctaccgagagcttaatatcgtcacttggcctgggagctttctgccttgtcgccgatcggctgcttcagttctccacgatccagcagaacgactggttgcgggcgctaagcgacaatgcagtacattgcgtcataggcatgtggtcatgggccgtggtgacaggcataaagaagaagactgatttcggcgagattattctggcaggctttctagcttccgtcatagatgtggaccacttttttctcgccgggtccatgtctctgaaggctgctctgacgttgccgaggcgaccatttctgcactgttcaacagttatccctgttgtcgtgcttacattgaagtttactatgcacttgtttaagctgaaggattcctggtgttttctgccttggatgttgttcatttcctggacctcccatcatatcagggatggtatcaggcacggactttggatttgcccattcggcaaaacgagccccctccctttctggctgtatgtgatcatcacatccagtctcccccacatttgcagctttgtgatgtatctgaccgggacgcgccagatgatgagcagtaagcatggagtgcggatcgacgtttag

SEQ ID NO: 41298 - DNA, 648 bp, Artificial Sequence
  Description of Artificial Sequence: Synthetic coding sequence
atggccagcgagaccgagaagacccacgccctgctgcagacctgctctacggagtcactcattagctccctcggccttggggcattctgcttggtggctgaccgactgttgcagttttctactatccagcagaacgattggctgagagctctgagcgataacgcagtgcattgcgttatcgggatgtggtcctgggccgttgttaccggcattaagaagaaaacagattttggcgaaattattctggctggattcctggcctcagtgattgatgtggaccatttctttctggctggaagtatgtccctgaaggcagctctcacactgccaagaaggccatttttgcattgctctactgtgatcccggtcgtcgtactaactctgaagtttaccatgcatctgtttaagttaaaagactcctggtgtttcctaccttggatgttgtttatctcctggacttcacatcatatcagggatggcattcggcacggtctttggatttgcccctttggcaagacctcaccacttccattctggctttacgtgattatcacatcctcactgccccacatctgctctttcgtgatgtacctgactgggactcgccagatgatgtcgtccaagcatggtgtcagaatcgatgtttag

SEQ ID NO: 41299 - DNA, 531 bp, Artificial Sequence
  Description of Artificial Sequence: Synthetic coding sequence
atggccagcgagaccgagaagacccacgccctgctgcagacctgcagcaccgagtctctaattagtagtctggggcttggggccttttgtctggttgccgaccgcctgttgcaattctccaccatacagcagaatgattggctgcgggccctgtcagacaacgcagtgcactgcgtgattgggatgtggtcttgggcagtggtgactggtataaaaaaaaagacagatttcggcgagattatactggccgggttccttgcaagcgtcatcgatgtggaccacttttttttggctggaagcatgtcactcaaggctgctctgaccctccctagacggccgttccttcactgttccaccgttataccagttgtggttctgacattgaaatttacgatgcacctgttcaaattgaaggacagttggtgctttctgccttggatgctgttcatttcatggacctcccatcatatacgagacggcatacgccacgggctctggatttgtccttttggaaaaacctcccccctttag

SEQ ID NO: 41300 - DNA, 648 bp, Artificial Sequence
  Description of Artificial Sequence: Synthetic coding sequence
atggccagcgagaccgagaagacccacgccctgctgcagacctgctccactgaaagtttgatctcctctctgggcctgggagcattctgtctcgtagccgatcggctgttgcagtttagtaccatccagcagaacgattggctgcgcgccctttctgataatgctgtgcactgtgtcattggtatgtggtcctgggctgtggtgactgggattaaaaagaaaaccgatttcggtgagattatcctggccggcttcctggctagcgtgatcgacgtggatcacttttttttagcgggtagcatgtcgctgaaggcagctctgactttgcctaggcgaccattcttgcattgctccactgtcataccagtagtggtgctgacactgaaatttactatgcatctgttcaagttgaaggacagttggtgcttcttgccctggatgctgtttataagttggactagccatcatatcagagatggaattcggcatggattatggatctgtccgttcggaaaaacatcacccctgcccttttggctctatgtcatcatcacaagttcacttccacatatctgcagcttcgtgatgtacctgactggcaccagacagatgatgagcagcaagcatggagtgcggattgacgtctag

SEQ ID NO: 41301 - DNA, 255 bp, Artificial Sequence
  Description of Artificial Sequence: Synthetic coding sequence
atgcacctgttcaagctgaaggacagctggtgcttcctgccctggatgctttttatttcatggacctcacaccatattcgagacgggatccgacacggcttatggatttgtccattcgggaagacctcccccttacctttttggttgtacgtaatcatcaccagcagcctgcctcatatctgcagcttcgttatgtacctgactggaacccggcagatgatgtcttcaaagcatggagttcggatcgatgtgtag

SEQ ID NO: 41302 - DNA, 1002 bp, Artificial Sequence
  Description of Artificial Sequence: Synthetic coding sequence
atgaagggcgaggccggccacatgctgcacaacgagaagagcaagcaagagggacacatatggggatctatgcgcaggaccgctttcatcttgggctctggactgctcagctttgttgccttctggaactctgtcacttggcaccttcaacgtttctggggcgcttcaggctatttctggcaagcccagtgggagcgtctcctgaccacttttgagggaaaggaatggatcttgttcttcatcggggcaatccaggttccctgtcttttcttctggagcttcaacggcttgcttctagtcgtggatacaacggggaaacccaattttattagtcgataccgcatccaggtggggaagaatgagcctgtggacccagtaaagctaagacaatcaatcagaaccgtcctgttcaatcagtgcatgattagttttcccatggtggtgtttctgtacccattcctgaaatggtggcgagatccctgtagaagggaacttcccacatttcactggtttttacttgagttagccatcttcactctcatagaggaggtgctattctactacagccacaggctcctgcaccacccgacattctataaaaagatacacaaaaagcatcacgagtggacagcgcccatcggcgttatcagtctttacgctcatccaatcgaacacgcagtgtccaatatgctcccagtcatcgtagggccattggttatgggctctcatctgtctagcataaccatgtggtttagtctggccctgatcattacgaccatatcccactgtggataccatttacccttcctgccctcaccagagttccacgattatcaccatcttaaatttaatcagtgctacggtgtgctcggtgtgctagatcaccttcacggcacagacacgatgttcaagcagactaaagcttatgagcgacacgtactgctattgggatttacacccctaagcgaatccattcctgactcccctaaaagaatggagtag

SEQ ID NO: 41303 - DNA, 933 bp, Artificial Sequence
  Description of Artificial Sequence: Synthetic coding sequence
atgcggcggaccgccttcatcctgggcagcggcctgctgagcttcgtggcattttggaactctgtcacatggcatctgcagcgattctggggcgccagtggttacttctggcaggcccagtgggagcggctgttgacaacctttgagggtaaagagtggattctttttttcatcggcgccatccaggttccgtgtctttttttttggtcatttaacggattgctgctggtggtggacactaccggaaagcccaattttatatctcgttaccggatccaggtcggaaagaacgaaccggtcgaccccgtaaaactgcggcagtccatacgaaccgtgctcttcaaccaatgcatgatttctttcccaatggtcgtatttctgtacccgtttctgaaatggtggcgcgacccatgtagacgggagctgcccactttccattggtttctattggagctagccattttcactttgatcgaagaagtgctgttttactattctcatcgcctgctccaccacccaacattctataaaaaaatacacaagaaacaccatgagtggactgcccccattggggttatctctctctatgctcaccctatcgagcacgctgtgtcaaacatgctgcccgttatagtgggcccattagtcatggggtcgcacctgagctcaatcacaatgtggtttagtttggcgttgattatcactacgatctcccactgtggctatcacctgccattcttacctagccccgagtttcatgactaccatcaccttaagttcaatcagtgttacggcgtgctcggggttctggaccatttgcacggcactgataccatgtttaagcagacgaaggcatacgaaagacatgtcctattgcttggattcacacctctctctgaaagcatacccgacagtccaaagcgcatggaatag

SEQ ID NO: 41304 - DNA, 441 bp, Artificial Sequence
  Description of Artificial Sequence: Synthetic coding sequence
atgcggcggaccgccttcatcctgggcagcggcctgctgagcttcgtagcgttttggaactccgtaacatggcacctccagcgcttctggggggcctccggctacttttggcaggctcaatgggaaaggctgttgaccactttcgaagggaaggagtggattctgtttttcataggggctatccaggtgccatgtctcttcttctggagctttaacggcctgctgttagtggtggataccactggaaagcccaatttcatctcccgctacagaattcaggtgggcaaaaacgaacccgtcgaccccgtgaaactgcgtcagagcattagaacagttcttttcaatcagtgtatgattagctttccgatggtcgtttttctgtatccttttttgaagtggtggagggacccctgcaggcgggagctgcctacatttcattag

SEQ ID NO: 41305 - DNA, 99 bp, Artificial Sequence
  Description of Artificial Sequence: Synthetic coding sequence
atgaagggcgaggccggccacatgctgcacaacgagaagagcaagcaggaaggtcacatttgggggtccatgaggagaaccgcctttatcttaggttag

SEQ ID NO: 41306 - DNA, 225 bp, Artificial Sequence
  Description of Artificial Sequence: Synthetic coding sequence
atgttcgacatcaaggcctgggccgagtacgtggtggagtgggccgctaaagacccctatggctttttgacaaccgtaatcctagcgctaacgcccttgtttctcgcgagcgcagtcttgtcttggaagctggccaaaatgattgaggctagagagaaggaacaaaagaagaaacagaaaagacaagaaaatattgccaaggcgaaacgcctgaaaaaagattag

SEQ ID NO: 41307 - DNA, 225 bp, Artificial Sequence
  Description of Artificial Sequence: Synthetic coding sequence
atgttcgacatcaaggcctgggccgagtacgtggtggagtgggccgctaaggatccatatggcttcttaacgactgtcatcctggctctgacccctttgttcctcgcttcagccgtgctctcctggaaactggcaaagatgatcgaagctcgcgagaaagagcagaagaagaagcagaagagacaggaaaacatcgcaaaggcaaagcggctcaagaaggactag

SEQ ID NO: 41308 - DNA, 183 bp, Artificial Sequence
  Description of Artificial Sequence: Synthetic coding sequence
atggacgccgtgagccaggtgcccatggaggtggtgctgcccaagcacatcctggatatctgggtcatcgtgctgataattctggcaaccatcgttatcatgaccagtttgctgttgtgccctgcaacagccgtcatcatttaccgaatgcgtacccacccgattctctctggtgctgtgtag

SEQ ID NO: 41309 - DNA, 1683 bp, Artificial Sequence
  Description of Artificial Sequence: Synthetic coding sequence
agcgtgctgaagatcaccctggccgtgatcctgaccctgctgggcctcgccattttggccatccttttgacacggtgggctaggtgtaagcagtcagagatgtatatcagcagatattcatccgagcagagcgctagactacttgattatgaagatggccgcggcagcaggcacgcctattccactcaatccgatacttcctatgacaatcgcgcccggtatgaggcaccattttctcccaaaatcgagaagcttgcaatctcaaagagtagcctcgcattgccacagggctctatgtctagtattaagtgcctgcagaccactgaggagccaccgtgcattccttgcgtcatgattctgatattttacaatgtgcctgctacgcgtggaatggggaaagtggtgaggaagcacatcatgcagacccccggacccatcggtaagcttccagtattctctgtacgctcgcacccacacaccatcaccggccccccctcggctccgagaggcaaacccgtaagcactctcctgatatccaatagcgtctgtagctatctgacgcaaagctttcagttccccgaggttcgtaccatcgctactaaaaaaagggcaacaacacagggcagcgttattttaactggatatatggatgaagagctcgcaaagaagtcctgtagcaagatccagattctgaaatgcggcggaaccgcgcgcagccagaactcaagagaggaaaataaagaagcactgaaaaacgatatcatttttacgaactccgtcgagagccttaagtccgcgcacattaaggaaccggaacgggagggcaagggcaccgatctggagaaagacaaaatagggatggaagtcaaagtggattcagacgccggcattccaaaacgccaggagacacagctgaagatatctgaaatgagcattcctcagggccagggggcccagataaaaaagagcgtctcagacgtgcctagagggcaggagtctcaggtgaaaaagtccgagtcaggggtaccaaaagggcaggaggcccaggtgaccaaatctggactagtagtactcaagggccaagaagctcaggtggaaaaaagtgagatgggggtgcctcgtaggcaggagtcccaggttaagaagtcccagtcaggtgtgtcaaagggacaggaggcacaagtgaagaaacgcgaaagtgtggtgctgaaaggccaagaagctcaggtggagaagtccgagctaaaggtgccaaagggtcaggaggggcaagtggaaaagacggaggccgacgtgccaaaggagcaggaagttcaggagaaaaaatccgaggcaggagttcttaaaggcccggaatctcaggtaaaaaataccgaggtgtccgtacctgaaacattggagagccaggttaagaaaagtgagagtggggttctaaaaggccaagaagcacaggagaagaaagagagtttcgaagataagggaaataacgacaaggaaaaggagagggacgcggagaaagatcccaataaaaaagagaaaggcgataagaatactaaaggcgataagggcaaagacaaggtgaagggaaagcgcgaaagtgagatcaatggagagaagtcaaagggttctaagagagccaaagccaacacggggcgcaagtacaacaagaaggtggaagagtag

SEQ ID NO: 41310 - DNA, 1704 bp, Artificial Sequence
  Description of Artificial Sequence: Synthetic coding sequence
atgaccgtgctggagatcaccctggccgtgatcctgaccctgctgggactcgcaatcctggccatcctactcacccggtgggcgcgctgtaaacagtctgaaatgtacattagcagatattccagcgaacagtccgcaaggctcctcgactacgaggacggtagagttgagtgtcatcatggacagcagaaggaaacaagccaccgcaaaacggagagaaagttgcgaagagagagaaagcggattactaatgagcggagactgatcggaacagagaaatcccttccacagggcagtatgagctccatcaagtgcttacaaacaaccgaggagcctccatgcaaaggtatgggcaaagtgatccaggcaaagcagcttctcaatatcagctggcctctcgccgtgtcgttgtcaaaacctctgtgtatcattcacgacgtactggagtcattcaagactatcaatctgcagagccccgccggattccaggccgtcaccagtcactgtaaaaaggggagggacaagttcaggaaaatcctggtgtacaagaagggcacctcgattaagggcaagaagatcgaaattaagagaaaatacctcatcagcaagagccggcccttcgtggtttgctcagtcattctcaccgggtatatggacgaagaactggctaagaagagctgtagtaaaatccaaatcctgaagtgcggaggcactgctcggagtcagaattctagggaagagaacaaagaagcattgaagaacgacatcatcttcactaattccgtcgaatctctcaagtccgcgcatatcaaggagcccgaacgagagggcaaaggcaccgatttggagaaggataagataggaatggaagttaaggttgatagcgacgcagggattcccaaaaggcaagagacccagctgaaaatcagcgacgagtacacgacccgcactggcagccccaacaaagagaaatgtgtcaggtgtaccaagcggaccggtcaggtgaagaagtctgagagtggagtacctaagggacaagaagcccaagttaccaagagcgggctggtcgtccttaaaggacaggaggcgcaggtggagaagtctgagatgggcgtgccacggaggcaggaatcccaagtcaagaaatcccagtctggggtctccaaaggtcaagaggcacaagtgaaaaagcgagagtctgtggtcctgaaaggccaggaggcccaggtggaaaaaagcgagttgaaagtgccaaaaggtcaggagggccaggttgaaaaaacagaagccgatgttccgaaggagcaggaggtgcaagagaagaagtccgaagcaggggtccttaaaggccccgagtctcaagtcaagaacaccgaagtcagtgtacctgaaactcttgaaagccaggttaagaagtctgagagtggtgttctaaaaggccaagaggctcaggaaaagaaagagtctttcgaagataaaggcaataatgataaggaaaaggaacgcgatgctgaaaaagaccccaataagaaggaaaaaggcgacaagaataccaagggggataagggaaaggataaggtcaaaggtaagcgggaatctgagattaacggggaaaaaagtaagggatcaaagaggcgtcagatccaggagggaagcactacaaagaagtggaagtccaaggacaagtttttcaagggcccatag

SEQ ID NO: 41311 - DNA, 1686 bp, Artificial Sequence
  Description of Artificial Sequence: Synthetic coding sequence
atgaccgtgctggagatcaccctggccgtgatcctgaccctgctgggacttgcgatcctcgctattcttctgactcggtgggcccggtgcaagcaaagtgaaatgtacatatccagatacagcagtgaacagagtgccagacttttagactatgaagacggacgaggctcacgccatgcgtactcaacacagtccgggaacttgtgctttcagaggtccaaacgcgattatacaccatctactaactcgttggtatcaatggcctcaaagttctcactcgggcagaccgagttaattctgctgcttatgtgttttatactggccctatcgcgctccagtattgggagcattaagtgtcttcagaccactgaggagcctcccagccgaaccgccggcgctatgatgcagttcactgcaccaatccccggggcaaccggaccaatcaagctctctcagaaaaccattgtgcagacacccggccctatcgtgcaataccctggtagtaacgccggcccaccatctgccccacgcgggccgcctatggcgcccatcattatctcgcagcggaccgcgagaattccccaggtccataccatggattcctcgggaaagatcacccttacaccagtggtcatcctgaccggctacatggatgaggaattggccaaaaaaagctgtagcaagatacagatcctcaaatgcggcggtaccgctcgttcccagaactccagagaagaaaataaggaggccttaaagaatgatatcatctttaccaactccgtcgagagccttaagtctgcacacattaaggaacctgagagggaaggaaaaggaacggatctcgaaaaagataagatcggtatggaagtaaaagtggacagcgatgccggaattcccaaaagacaagagactcaactgaaaatctccgaaatgtccatcccacagggccagggagctcagattaagaagtctgtgagtgatgtgcctcggggccaggaaagtcaggtgaagaagtcagaaagtggagtcccaaaaggccaagaagctcaggtgactaaatctggtctggtagttcttaagggccaggaggctcaggtagaaaagtccgaaatgggtgtcccaagaagacaggagtcccaggtgaagaaaagtcagtctggtgtgagcaaaggccaagaagcacaagtaaaaaagcgcgagtctgttgtgcttaagggtcaggaggcacaggttgaaaaatcagagctgaaggtaccaaaggggcaggagggtcaggtagagaagaccgaggcagacgtgcccaaagaacaggaggtccaggagaagaaaagcgaagccggtgtgttaaaaggccccgagtcacaggtgaagaacaccgaggtatctgtgccggagaccctcgagagccaggtgaagaagtctgaatctggggtgctgaagggccaagaggcacaggagaaaaaagaatctttcgaggacaaggggaacaacgataaggaaaaagagagggatgccgagaaagatcctaataagaaggagaaaggggacaaaaataccaaaggagacaagggcaaagataaagtgaaaggaaaaagggagtccgaaattaacggtgaaaaaagcaagggatccaagcgggcaaaggccaacactgggagaaagtacaataagaaagtggaagaatag

SEQ ID NO: 41312 - DNA, 1692 bp, Artificial Sequence
  Description of Artificial Sequence: Synthetic coding sequence
atgaccgtgctggagatcaccctggccgtgatcctgaccctgctgggtttggccattctggctattctgctgacccggtgggcccgatgcaaacaatccgaaatgtatatttcacgttatagctctgagcagtcggctcgcctgctcgattatgaggacggccgaggatctcgtcatgcctatagtacccagtccgatacttcttacgacaacagggagaggagcaagagggattatacccccagcaccaattcattagtgtctatggcgtcaaagttttctcttggtcaaaccgaactgatactgctgctgatgtgctttatcctcgccctgtctagatccagtatcggttccataaaatgcctgcagactaccgaggagccacccagccggactgctggtgcaatgatgcagttcactgcacccatcccgggcgcgaccggcccaatcaaactgtcgcaaaaaaccatagtgcagacccccggccccatagtccaatatccaggctcaaatgcgggtccgccgtctgcaccacgcgggcccccaatggcacccattattatttcacagaggactgcgaggattccacaagttcacacaatggatagcagcgggaaaatcaccctgacccctgtggtgatcctcacaggctatatggacgaggagctcgcgaagaagtcttgtagcaagattcaaatactcaaatgcggtgggacagcaaggagtcagaactccagggaggaaaataaggaagctctcaagaacgacataatttttaccaacagcgtcgagagcctgaagtccgctcatattaaggaaccagagcgggaagggaaaggtacagatctagagaaagataagatcggcatggaggttaaagtggacagtgatgcagggatccctaagcgccaggagactcaactgaaaatatcagagatgtccataccccagggtcagggggcacagatcaagaaaagcgtctcagacgtcccacgagggcaagaaagtcaggtaaaaaaatccgagagtggcgtgccaaaaggccaggaagcccaggtcactaagtccgggctggtggtcctcaaagggcaagaagcccaggtggagaagagcgaaatgggtgtgcctagacgccaggaatctcaggtaaagaaatcccagtctggcgtgtctaagggacaggaagctcaggtaaagaagagagaatccgtggtgttgaaggggcaagaggcccaggtggaaaagtctgagttgaaggtaccaaagggacaggaagggcaggtggagaagacggaagcagacgtgcctaaagagcaggaagtacaggagaagaaaagcgaggcaggagtgttaaagggtcccgagtcacaggtgaagaatactgaggtgagtgtgcccgagactctcgagagccaggtcaaaaagtccgagagtggggtcctgaaaggccaagaagcccaggagaagaaagagagctttgaagataaggggaataacgacaaggagaaggagagagacgcagaaaaagacccaaacaaaaaggaaaaaggggacaagaacacaaagggtgataaggggaaagataaggtgaagggcaaacgcgagagcgagatcaacggcgagaaatctaagggatctaagcgtgccaaggccaataccggaaggaagtacaacaagaaggtggaggaatag

SEQ ID NO: 41313 - DNA, 1692 bp, Artificial Sequence
  Description of Artificial Sequence: Synthetic coding sequence
atgaccgtgctggagatcaccctggccgtgatcctgaccctgctgggcctggcaatacttgccatactactcacccggtgggctcgttgcaaacaaagcgaaatgtatatttcccgatactccagtgagcagtctgcgcggctgctggactacgaggatgggagggggtcgcgccatgcctactcgacgcagagcgatacaagctacgacaacagagaaagaagcaaacgcgactacacaccatcaaccaatagcctggtatcaatggcttcaaaattttcccttggccagacagaactcatcttgctcctcatgtgttttattttggccctctcgcgttctagcatcggctctattaagtgtttgcaaacaaccgaggagccacctagtaggaccgccggcgctatgatgcagttcactgcccccatccctggtgcgaccggccctattaaattgtctcagaagactattgtacagactcccggtcctatcgttcagtatccgggatctaatgccggcccgccatcagcacccaggggaccgcccatggccccaatcatcatttcccagcggacagcccgtattccccaggttcacacaatggacagctctgggaagatcaccctgacccccgtggtgatcctaactggctacatggatgaagaactcgccaaaaagtcttgcagtaaaatccaaattctaaagtgcggcggcactgccaggtcccagaacagtagagaggagaacaaggaagctctgaaaaatgacatcatattcactaactcagtggagagtctgaaatctgcacatatcaaagagcctgaacgcgaaggtaaaggaacagatctggagaaggacaagattggtatggaggttaaagttgactccgatgccgggattccgaagaggcaggaaacacagcttaaaatttcagagatgagtatacctcagggccagggagctcaaattaaaaagtctgtcagcgacgtgccgaggggacaggaatcgcaagtaaaaaaatccgaatccggcgtacctaaaggacaggaggcacaggtgactaagagtggactcgttgttttaaaaggccaggaagcacaggttgagaagtctgaaatgggggttccgcgccggcaggagagccaggtgaaaaagagtcagtccggggtttctaaagggcaggaagcccaggttaagaagagagagtcagtggtgctgaagggccaggaggcccaagttgagaagtctgagctcaaagtgcctaagggacaggagggacaggtggagaaaaccgaagctgatgtgccaaaggagcaggaggtacaagaaaaaaaatcagaggccggcgttttaaaggggccggagtctcaggttaaaaatactgaagtgtctgtgcctgaaaccctggagagccaggtgaagaagtctgagtctggagtgctcaagggacaggaagcccaggagaagaaagagagtttcgaggacaagggcaataacgacaaagaaaaagagagggacgcggagaaggacccaaacaagaaggagaagggggataagaatactaaaggagataaagggaaagacaaggttaagggtaagcgggaatctgagataaacggagagaaatctaaaggatccaagcgagccaaggcgaacactggacgtaagtataacaagaaggtggaggaatag

SEQ ID NO: 41314 - DNA, 1689 bp, Artificial Sequence
  Description of Artificial Sequence: Synthetic coding sequence
atgaccgtgctggagatcaccctggccgtgatcctgaccctgctgggtttggctattctggcaattcttctcactaggtgggctagatgcaagcagtctgagatgtacataagtcgctactcctccgaacaaagcgctcgactgctggattacgaggacggcaggggatccagacatgcctatagcacgcaaagtgacaccagctacgacaaccgggagcgctctaagcgagactacacacccagcaccaactccctcgcactgtcacggagttccatagccctaccacagggttctatgtcgtctatcaagtgtttgcaaacaaccgaagaacccccatcacgtaccgcgggggccatgatgcagttcactgctcccatccctggggcaactgggccaatcaagctgagtcaaaaaaccatcgtgcagacaccaggtccaatcgtccagtatcccggttctaacgtcaggagccacccacatactattaccggtccacccagcgcacccagaggacctcccatggccccgataattataagccagcgtacggcatcacagctggctgctccaataaggatccctcaggttcacaccatggactcctctggtaagattacactgacccctgtggtcatattaaccggctatatggacgaggagcttgccaagaaaagctgttccaaaatccaaatcttgaagtgtggcggtaccgctcggagccagaactcaagggaggaaaacaaggaagcattaaaaaacgatattatatttaccaatagcgtagaaagcttaaaatccgcccatattaaggagcccgaaagggaagggaaaggaactgatttggagaaggataagattggtatggaggtgaaggtggattccgacgccggaatcccaaaacggcaagagacccagctcaaaataagcgaaatgtccattccccagggacagggagcccagatcaagaaaagcgtaagtgatgtaccacgagggcaggaatcccaagtgaaaaaatccgaaagcggagtccctaagggtcaggaggctcaggttactaaaagcggactggtggtgctcaagggccaggaagcccaggttgagaaatcagagatgggcgtgcctcgaaggcaagaaagccaagtgaagaagtctcagagcggagtgagtaaaggacaagaagcgcaggtgaaaaagagggagagcgtagtgctgaaagggcaagaagcccaggtagagaagagcgaactgaaagttcctaagggacaggaagggcaagtggagaaaaccgaagcagatgttcctaaagagcaggaggtgcaggaaaaaaagtcagaagccggcgtgctgaagggccccgagagccaggtgaaaaatacggaagtcagcgtgcccgaaaccttggagtcacaagtcaagaaatctgagtctggagtgcttaagggacaagaagcacaggaaaaaaaggagtctttcgaagacaaaggaaacaatgacaaagagaaagagagagacgctgagaaggatcccaataagaaagagaaaggcgataaaaacacgaagggcgacaaaggtaaagataaagtgaagggaaagagggagagtgaaatcaatggggaaaagtctaaggggagcaaaagagccaaagccaatacaggccggaaatacaataagaaggtggaagagtag

SEQ ID NO: 41315 - DNA, 1686 bp, Artificial Sequence
  Description of Artificial Sequence: Synthetic coding sequence
atgaccgtgctggagatcaccctggccgtgatcctgaccctgctgggtttagctatcctcgctatattgctgacacgctgggcacggtgtaaacaatctgagatgtacatttcacggtactcatccgaacagtcagctcggctgctggactatgaagatggacgagggtctcggcacgcttattccacccagagcggcaatctgtgttttcagagatctaagcgggactacaccccctcaactaatagcctcgttagcatggcctccaagtttagtctgggacagacggagttgatcctcttactcatgtgttttatcttggccctcagtaggtccagcattggcagcatcaagtgtctgcagaccactgaagagcccccttcaaggacggcgggcgccatgatgcaatttacggcacccattcccggggcaaccggtcccattaaactgtcccagaaaacaatcgtgcagacccctgggcccatcgtccagtatccaggttccaacgcgggcccccctagcgctcctcggggtccccccatggcaccgatcatcatcagccaaaggacagctagaatcccacaggtgcatacaatggattctagtggtaagattaccctgacacccgtggttattctgacaggctatatggatgaggagctagccaagaagagttgtagcaaaatccagatcttgaaatgcggtggaacagctcggagtcagaactccagagaggagaacaaggaggccctgaagaatgatatcattttcactaatagcgtcgaaagcctgaagtcagctcacataaaagaacccgagcgggaaggaaaaggaaccgacttggagaaggacaaaataggtatggaggttaaggtcgatagtgacgcaggaatccccaaaagacaggagacccaactcaagatctccgaaatgagtatccctcaggggcagggcgcacaaattaagaaaagcgtctccgatgtgcctcgagggcaggagagccaggtgaaaaagagtgaatctggcgtcccaaagggccaggaggcccaggtaaccaagagtgggttggttgtcttgaaaggccaggaggcgcaggtggagaaatcagagatgggtgtgccgagaaggcaggagagccaggtaaagaagagtcagagtggggtcagcaagggccaggaagcacaagttaagaagagagagagcgtggtactcaaaggccaagaagcgcaagtagagaaatcggagctcaaagtgccaaagggccaggaggggcaggtggaaaagactgaggctgatgtgcctaaagaacaggaggttcaagagaaaaagtccgaagctggtgttttgaagggcccagaatcacaggtcaaaaacacagaagtctcagtccccgagaccctggagagccaggtcaagaagagcgagtctggggtgctcaaaggccaggaagcgcaggagaagaaagagtcatttgaagacaaaggcaacaatgacaaggagaaagaacgggatgccgagaaagatcctaataagaaggaaaaaggcgacaagaatacaaagggagacaaagggaaagacaaagtgaagggcaagagggagtccgaaataaatggtgagaaatctaagggctccaagagggctaaggccaacaccggacgaaagtataacaaaaaggtggaggaatag

SEQ ID NO: 41316 - DNA, 1683 bp, Artificial Sequence
  Description of Artificial Sequence: Synthetic coding sequence
agcgtgctgaagatcaccctggccgtgatcctgaccctgctgggcttggctattttggcaattttgcttactaggtgggcccgttgcaagcagtctgagatgtacattagtaggtactcttccgagcagtccgcaaggcttcttgactacgaggatggtcgggggagccggcacgcctacagcacacagtctgacacctcgtatgataaccgagccagatacgaggccccttttagcccaaaaatagagaagctcgccatatccaagtccagcctggctcttcctcaaggcagtatgagttccatcaaatgcctacagactacggaagaaccaccctgcatcccctgcgtgatgattctgatcttctataacgtgccagctactcgaggaatgggtaaggtggtgaggaagcatatcatgcagacaccagggcccattggcaagctccccgtgttctctgtgcggagtcacccgcataccattactggacccccgagcgcccccaggggaaagccagtgagcaccttattgatatctaactctgtgtgcagctatctcacccagagcttccaatttcccgaggtgagaacaatcgccacaaagaaacgcgccaccacacaaggctccgtcatcttaaccgggtatatggatgaagaactggctaagaaatcctgctctaagatccagatcctgaaatgtggaggcacagccaggtctcagaattcgcgtgaagaaaacaaagaggctttgaaaaatgacataattttcaccaattcagtggagtcgctgaaatctgctcatataaaggaaccagagagggaggggaagggtactgatttagaaaaagacaagattggaatggaagtgaaggttgactcagacgcgggcatccccaagaggcaggagactcaactcaaaatctcagagatgtcaattccccaggggcaaggagcccagatcaaaaaaagcgttagcgacgtaccgcgtggacaagagagccaagtgaaaaaaagcgagagcggagtccctaaaggccaggaagctcaagtcacgaagagcggattggttgtcctgaaaggacaggaggcccaagtggagaaatctgaaatgggcgtccctaggagacaggaaagccaggtgaaaaaatctcagagcggcgtgtccaagggacaggaagcccaggtgaagaagcgcgagtctgtggtgttgaaaggacaggaagcacaagtcgagaaatctgagctgaaggtgcctaaggggcaggaagggcaggtggaaaagaccgaagcagacgttcctaaagaacaggaggtgcaggaaaaaaaatctgaggccggagtcttgaaaggccccgaatcccaggtgaagaatacggaggtatcagtcccagagaccctggaatcccaagtgaagaaaagcgagagcggggtactgaagggacaggaggcacaagagaaaaaggaaagctttgaggacaaaggtaacaatgacaaagaaaaagagcgggacgcggagaaggatcccaacaaaaaggaaaaaggggataagaatacgaagggagataaggggaaagacaaggtgaaagggaaaagagagtccgagattaatggagagaaaagcaagggcagcaagcgggcaaaggcaaatactggtcgtaagtataataagaaggtagaggaatag

SEQ ID NO: 41317 - DNA, 1704 bp, Artificial Sequence
  Description of Artificial Sequence: Synthetic coding sequence
atgaccgtgctggagatcaccctggccgtgatcctgaccctgctgggcctggcaatcctcgccattctgttaacaagatgggcccggtgcaaacaaagtgagatgtacatctctcggtattccagcgaacagtccgcacgactcttggactatgaggatggcagagtagagtgtcatcacgggcagcaaaaggagacctcccataggaagactgaacgcaagttacgtcgcgagcggaaaaggatcacaaacgaacggcggctgattgggacggaaaagtccctgccacagggcagtatgagtagtataaagtgtctgcagacaaccgaagagcctccttgtaaaggcatgggtaaggtgattcaggcaaagcagctcttgaacatctcctggccgctggccgtcagcctttcgaaacccctgtgcatcatacatgatgttctcgaaagcttcaagactataaaccttcagagtccagcgggattccaggccgtgactagtcactgcaagaaggggcgagacaagttcagaaaaattcttgtatataagaagggaacatctattaagggaaaaaaaattgagatcaaaaggaagtatctaatctccaagagtaggcccttcgtcgtctgttctgtgatcctaaccgggtatatggacgaggaactggcgaaaaaaagctgcagcaagattcagatcctgaagtgcggcggaaccgcccgatcacagaatagtcgagaggagaacaaggaggctttgaagaacgacatcatatttacaaacagcgtggaaagcctgaagtctgctcatataaaggagcctgaacgggaaggaaaggggaccgacctcgagaaggacaagatcggcatggaggtgaaggttgactccgatgccggcattcctaaaagacaggagacccaacttaaaattagtgacgagtacactaccaggacaggctctccaaacaaggaaaagtgcgtaaggtgcacgaaaagaacagggcaggtgaagaaatcagaatctggcgtcccaaagggccaggaggctcaagttacgaagagtggccttgtagtactgaagggccaggaagctcaggttgagaagagtgagatgggcgtgcccaggaggcaagagtctcaggttaagaagtctcagagcggcgtgtcaaaaggccaggaagctcaagtaaaaaagagggagtccgtcgtacttaagggtcaggaggcacaggttgagaaaagcgaattgaaagtgcctaagggccaagaaggacaggtggagaaaactgaggccgacgtgccgaaggagcaagaggtgcaggagaagaaatccgaagctggcgtgcttaaggggcccgagagtcaggtgaaaaataccgaagtgagcgttccagagactctcgaaagccaagtgaagaaatcagaaagcggcgttttgaaggggcaggaggcacaggaaaagaaagaatcctttgaggacaaaggaaataatgataaggagaaagagcgtgatgccgaaaaagatccgaataaaaaggagaagggagataaaaacacaaagggtgacaaggggaaagacaaggtgaagggaaagagagagtcagaaattaatggggagaagtcaaaaggcagcaagaggcggcagattcaagagggctccacaacaaagaagtggaaaagtaaggataagttttttaaaggtccctag

SEQ ID NO: 41318 - DNA, 1644 bp, Artificial Sequence
  Description of Artificial Sequence: Synthetic coding sequence
atgaccgtgctggagatcaccctggccgtgatcctgaccctgctgggacttgcgattttggcaatcttgttgactagatgggcaaggtgcaagcagtctgagatgtacatttctaggtatagtagtgaacaatccgccaggttgctagattatgaggatggtagaggctctagacacgcgtattcaacacagtccgaacgcagcaagcgcgattatacccccagcacaaactcgctcgccctcagtcgttcgtctatcgccctgcctcaaggaagtatgtcgagcatcaaatgcctgcaaacaaccgaagagcccccttcccgcaccgccggcgctatgatgcagtttacagcccctatccccggagctaccgggccaattaaactgtctcagaagacaattgtgcaaacccctgggcctatcgttcagtatccagggtcaaacgctggcccaccctccgccccaaggggtccacccatggccccaatcatcatttcccaacggaccgctagccagttagcagcccctattcggataccccaggtacatactatggacagctcgggcaaaatcaccctcacccctgtagtcatcttgaccgggtatatggatgaagaacttgccaagaagtcctgtagcaaaatacagattttgaagtgtgggggaacagctcggtctcaaaatagccgagaggaaaataaggaggccctgaagaatgatatcatctttacaaacagcgtagaatcactcaagtccgcacacatcaaagagcccgagcgggagggtaagggaactgatttggagaaggacaagattgggatggaggtgaaggtcgattccgatgcagggatcccaaaacgtcaagaaactcagcttaagatatccgaaatgtccatacctcagggacagggtgcccagattaaaaagagtgtttccgacgtacctcgtggacaggagtcacaggtgaaaaaatctgagagcggggttcccaagggccaggaggcacaggtgaccaagtcgggcctggtggtcctgaaggggcaggaggctcaggtcgaaaagtccgaaatgggggtcccccgccgacaggagtcccaagtgaaaaaatcccaatcaggagtgagtaaggggcaggaggcacaagtcaagaaaagggaatctgtggtgctaaagggacaggaagctcaagttgagaaatctgagttgaaagtgccaaaaggacaggagggtcaggtggagaaaaccgaggcagatgtgcccaaggaacaagaagtccaagagaaaaagtctgaggctggggttctgaaaggtcctgaatcccaggtaaagaacactgaagtgtccgtgcccgagacactcgagtctcaagttaagaaatcggagtcaggcgttctaaaggggcaggaagctcaggagaagaaagagtcatttgaagataaggggaacaacgataaggagaaagaacgagacgctgaaaaggaccccaacaagaaagagaaaggtgataaaaatactaagggcgacaagggtaaagacaaagtgaaaggcaagagggaatcagagataaacggggagaaatctaagggcagtaaaagagcgaaggcaaacaccggacgaaagtacaacaagaaagtggaagagtag

SEQ ID NO: 41319 - DNA, 306 bp, Artificial Sequence
  Description of Artificial Sequence: Synthetic coding sequence
atggccgccagccggtaccggcggttcctgaagctgtgcgaggagtggcctgtagatgaaacaaagagagggcgcgatctgggagcctatctccgtcagagggtagcacaggcttttagagaaggcgaaaatactcagtatccaaggcccagagatacttcattttctgggctatccttagaagagtataaactaatcctctctacagatacacttgaagaacttaaagaaatcgataagggtatgtggaagaagctgcaggagaaattcgctcccaagggaccggaagaagatcataaggcttag

SEQ ID NO: 41320 - DNA, 381 bp, Artificial Sequence
  Description of Artificial Sequence: Synthetic coding sequence
atggccgccagccggtaccggcggttcctgaagctgtgcgaggagtggcctgtcgacgaaaccaagcgggggcgggatctcggggcctacctaagacagcgggttgcccaggccttccgggaaggagaaaacacgcaggtggccgaaccagaggcctgcgatcagatgtacgaatctctcgcacgactgcactccaactactacaaacataagtaccccaggccccgagatacttctttctccggcctgagtcttgaggaatacaagttgattctctccactgatacactggaggagctcaaagagattgacaagggtatgtggaaaaagttacaggagaagttcgcccctaaaggcccagaggaggaccacaaggcctag

SEQ ID NO: 41321 - DNA, 1491 bp, Artificial Sequence
  Description of Artificial Sequence: Synthetic coding sequence
atgtaccagcccagccggggcgccgcccggcggctgggcccctgcctaagagcctatcaggctaggccacaggtgtctggtggtgaggagggtgggaggagaggcggcggcgaaaggccgtcaagcaaacccgtcagaggagcggaacgtgccctcgggtctgctcaagcccagagacatccaccacccctgcccacctgtgcactgcaaagagttgaccgcctgggggtagctggggccggaggccgacggtgccgcgcttgccgagcccgtaccagcgtgcttccagggcttcgagctgtgcgcaggggacagggtcaagccgctggaagagtgtgtgtcgcccccgattccccccgcctacccgtcccacgcggagacttaaagggaaggggcagagaaatacgatctcccgctgctgccccatcgcgcagctctcccgcccagaccagacctgctggacgaccccagcaaccagccagattggcactcggcgagcgctcctggcaggaagggcgtcctgtctgtacaaggtttggtccccttcgccccggctggcaggatggccatgccccatcccgagatggcgcgagtcgcacaccttccgggacagaggatcagctttatcctggcacattaccctttccaccactgtggccccacagcactaccaccacctctccttcatcaccacttttttggtcgccactccctccgagactaccaactcagaggttgccccaggtcccacctcttcccctgcctcaaatccaagcattaagctctgcttgggtcgtcctacctcccggcaaaggtgaagaaggacctggtccagagctgcactccggctgtctagatgggcttcgatctttgttcgaggggccaccctgcccctaccccggtgcatggattccattccaggtgcccggaactgcccatccctccccagcaactccaagcggagaccccagcatggaagagcaccttagtgtaatgtacgagcgactgaggcaagagttgcctaagctgtttttacagagccacgattattctctgtattccctggacgtagagttcatcaacgaaatcctcaacatccgtaccaagggacgcacctggtatatcctgagtctgactctttgcaggtttctcgcatggaactactttgcacatctgcgactggaggtgctccagttaacacgccatcctgaaaattggactcttcaggccaggtggcgcctggtaggcctgccagttcaccttttgttccttcggttttacaaacgcgacaaagatgaacactatagaacatacgacgcttattcgacattctatctgaatagtagtgggctcatctgtaggcaccgtctagataagcttatgccaagccactcaccacctactcccgtcaaaaaactgctcgtcggcgcactggtcgccctgggattatcagagccggagccagatctgaacctgtgcagcaagccctag

SEQ ID NO: 41322 - DNA, 546 bp, Artificial Sequence
  Description of Artificial Sequence: Synthetic coding sequence
atgtaccagcccagccggggcgccgcccggcggctgggcccctgccttcgcgcttaccaagccagaccccagctacccaagctgtttttgcagagccacgactactctctgtacagtctcgacgtagaattcatcaacgaaatcctgaacatcaggaccaaaggtaggacctggtatatactgagcctaaccctgtgccgcttcctggcctggaattactttgcgcatttgaggctggaagtgttgcagcttactcggcaccccgaaaactggactctgcaggccagatggaggctcgtgggacttcccgtgcatttgcttttcctacgattctataagagagacaaagatgagcattaccgcacctatgacgcgtattccacgttttatctgaactcgtccggactgatttgcaggcaccgcttggacaaactgatgccatcccatagccccccaaccccagtgaagaagctattggtcggcgcgctggtcgcgctgggacttagcgagccagagcctgacctgaatctgtgctctaaaccttag

SEQ ID NO: 41323 - DNA, 948 bp, Artificial Sequence
  Description of Artificial Sequence: Synthetic coding sequence
atgtaccagcccagccggggcgccgcccggcggctgggcccctgcctgcgtgcctaccaggccaggcctcaggatcaactatatcctgggaccctccccttccctcccctgtggccccacagtaccactaccacgtctccatcttcccctttgttctggtcccctctgcccccccgcttgccaactcaacgcctccctcaggtcccgcccctgccattgccacagatccaggccctctcatccgcttgggtagtcctccctcccggtaaaggtgaagaaggacctggtcccgagctgcactcagggtgcctagatgggctgcggtcattattcgaaggccccccctgcccatatcctggagcgtggatccccttccaggtgcccggaaccgcccatccctctcctgcaaccccttctggagacccatctatggaggaacatctgtctgtgatgtacgaacggttgcggcaagaactaccgaaactgtttctgcagagccacgactacagcctgtactcgcttgatgtagagttcattaacgagattttaaatatcaggaccaaaggtaggacatggtatattctcagcttgaccttatgtagattcttagcttggaattacttcgcccatttaaggctagaggtactgcaactgactagacaccctgagaattggactctgcaggctagatggcggttggttggtctgcccgtgcatctgctcttcctgaggttctataagcgagataaggatgaacactataggacttatgatgcatatagtaccttttatctgaactccagtggactgatttgtagacaccgcctggacaaactaatgcccagtcatagcccgccgactcccgtcaaaaaactcctggtgggcgcactcgtggccctcggcctgtccgaaccagagcccgacctcaacctttgtagcaagccttag

SEQ ID NO: 41324 - DNA, 519 bp, Artificial Sequence
  Description of Artificial Sequence: Synthetic coding sequence
atggaggagcacctgagcgtgatgtacgagcggctgcggcaggagctaccgaagctattcttgcaaagccacgattatagcctgtactctttggatgtcgagtttatcaatgagattctgaatatcagaacaaaaggaagaacttggtacattctgagcttgaccttgtgccgctttctggcctggaattatttcgcccatctacgtctcgaagtactccaattgacacggcatccagaaaattggaccctgcaggctagatggcgattggtggggctgccagtccatctgctcttcctccggttttacaagcgcgacaaagatgagcattatcgcacatacgatgcttattctactttttacctgaactcttcagggctgatctgtaggcatcgattagataagctcatgccctcgcattccccaccaacaccggtcaaaaagctcctagtcggcgccttagttgctctgggactgagtgaaccagagccagatcttaacctttgcagtaaaccttag

SEQ ID NO: 41325 - DNA, 2541 bp, Artificial Sequence
  Description of Artificial Sequence: Synthetic coding sequence
atgtgcttcctgcggcggcccggcgcccccgccagctggatctggtggaggatgcttcgacaggtcctgcgaagagggcttcagtccttttgtcacagactggggctttgcgtgtcacgccacccggttttctttctgactgtccccgctgtcctcaccatcacatttgggctgagtgccctgaacagatttcagccagaaggtgaccttgagagactagtggccccgtctcactctttagctaaaattgaaagaagtctcgccagctccctctttcctctggaccagtccaaatcacagctttattccgaccttcacacccctggcaggtatggcagggtcatccttctatcaccaactggcgacaacatactgctccaagccgaaggtattctccagacacatagggcggtactcgaaatgaaagatggccggaacagtttcataggccaccagttaggcggtgttgtcgaggtgccaaactccaaagatcagagggtgaaatcagctagggccattcagataacatactatctgcagacatacgggtcagctacgcaggacttgattggcgagaagtgggagaatgagttctgcaagcttatcagaaagctccaagaggagcaccaggagctccagctctactcccttgcatctttctcgctttggcgggacttccacaagacttccattttggcgaggtctaaggtcttggtgagtctggtgcttatcctcactacagcaaccctgtccagctctatgaaagactgtttgcgctctaagcctttcttaggattgttaggcgtactgactgtctgcatttctattattactgccgctgggatttttttcataaccgatggaaagtacaacagcactctgttgggcatcccattcttcgccatgggtcacgggactaagggagtgtttgagctactatctggttggagaagaactaaggagaaccttcctttcaaagataggatcgccgatgcgtattccgacgtgatggtcacatacactatgaccagctccctgtatttcattacttttggcatgggcgcttctcccttcacgaacattgaggcagtgaaagtgttctgccaaaacatgtgcgtctccatcctgttgaattatttctacattttctcattcttcggtagttgtctggtttttgccggccagttagagcagaaccgctaccattcgatcttctgttgtaaaatcccatctgcagagtacctggacagaaagcctgtttggttccaaacagtaatgagtgatggtcatcagcagacaagccatcacgagaccaacccctatcagcaccattttatccaacatttcttgcgagagcactataatgaatggattacaaacatctacgttaagccattcgtagtgattctctatcttatctacgcttctttcagtttcatgggctgcctgcagataagtgatggagctaacatcattaacctcctagcatctgattcgccgtccgtgagttacgccatggtccagcaaaagtattttagcaattacagccctgtgattggcttctatgtttatgaaccactggaatactggaattcgagcgttcaggatgatctgaggcgcctgtgtagcgggtttaccgctgtgagctgggtggagcagtattaccagttcctgaaagtgtcaaatgtttcagccaacaacaagtccgattttatatctgtacttcagagttcgtttctgaagaagcctgaatttcagcacttcaggaatgacatcattttctctaaagctggcgacgagagcaatattatcgccagcagactatacctggtggcacgtacgagccgcgacaaacagaaggaaataacagaggtgttggagaagctgcggcctctcagcctgtcaaaatcgatcagatttattgtcttcaatcccagctttgtctttatggatcactattccctctctgtaaccgtgcctgtcctcattgcagggttcggcgtgctgcttgtgcttatcctcaccttctttttagtgatccatccattgggaaacttctggctcatcctcagcgtgacttcaatcgaactaggggtcttgggattgatgactctctggaatgtcgatatggactgtatctccatcctgtgtctcatttatacactgaacttcgcaatagatcactgcgcgccgctactgtttacgtttgtgcttgccacagaacatactaggacccagtgcatcaaatcctccctgcaggatcacggtactgcaatcctgcagaatgttaccagcttcctgatcgggcttgtccctctactgtttgtcccatcaaacctgacctttaccctgtttaagtgcctccttctgactggtggttgcaccttattgcactgcttcgtgattttgcctgttttccttacatttttcccaccttccaagaaacatcataaaaagaaaaaacgcgctaagcgtaaagagcgtgaagaaattgagtgcattgagatccaagaaaacccagaccacgtcactactgtatag

SEQ ID NO: 41326 - DNA, 936 bp, Artificial Sequence
  Description of Artificial Sequence: Synthetic coding sequence
tgatgcttcctgcggcggcccggcgcccccgccagctggatctggtggcgcatgttgcgccaagtcctacgcaggggacttcagtcattctgccataggcttggactttgcgtgtcccgacacccggtgtttttcctcactgtccctgctgtgctgactatcacattcggccttagtgctctgaacagatttcagcccgagggcgacctggagcggctggtggctccatcccacagtttagcgaagatagagcgcagcttagcaagttccctttttccactcgatcagagcaagtcccagctttacagtgacctgcatacccccggcagatacggaagggtgattcttctcagcccaacaggcgataacatcctgttgcaggccgagggaattttacaaacccatagggccgttctggagatgaaggacggcagaaactcgttcataggccaccagctaggaggggtggtggaggtcccgaatagcaaggaccaacgagtgaagtcagcaagggccattcagatcacatattaccttcagacatacggctctgccacgcaggatttaattggtgagaagtgggaaaatgagttttgtaaactgatccgcaagctgcaagaagaacatcaggaattgcaattgtattccctggcatcattctccctgtggagggactttcacaagacctccatcctagccaggagcaaggtcctggtgtcattggtgctgattctgactacagccacactgtccagttcaatgaaagattgccttcgatccaagcctttcctgggactcctgggtgtcctgaccgtgtgcatttcgataattactgcggccggaattttcttcattacagacggcaagtataactcaacactgctggggatccccttttttgccatgggaatttctaccgaattcacaagtagctag

SEQ ID NO: 41327 - DNA, 885 bp, Artificial Sequence
  Description of Artificial Sequence: Synthetic coding sequence
atgctgcggcaggtgctgcggcggggcctgcagagcttctgccacaggctcggtctctgcgtatcccgtcaccccgttttcttcctgaccgtacctgccgtgcttacaatcacctttggactttctgcgttgaaccggtttcagcctgagggtgacctggaaagactggtcgcacccagtcactctctcgcgaaaatcgagaggagcttagccagcagtctttttcctttggatcagtctaaaagccagctatattccgacttacacacccccgggaggtacgggcgcgtgatactgttatctcctaccggagacaatatactactgcaggccgagggcattctccagactcaccgggctgtgttggagatgaaggatgggcgcaactcttttatcgggcaccagctgggtggtgtcgttgaagtaccaaacagtaaggatcaacgcgttaaaagtgcgagagccattcagattacctactatttacagacttatggaagcgcaacccaggatctgattggggaaaagtgggagaatgaattttgcaagctcattaggaaattgcaagaggaacaccaagaactgcaactgtactctcttgcgagtttttccttgtggagggatttccataagactagtatactggccagaagtaaagtactggtaagcctggtgttgatcttgaccaccgctactctttcgtcgtcaatgaaagattgcctaaggtctaaaccattcctaggcctgcttggcgttctcactgtttgcatatctatcatcaccgcggccgggatctttttcataacagacggcaagtataattccacactgctcgggattccttttttcgctatggggatcagtaccgaatttacgagcagttag

SEQ ID NO: 41328 - DNA, 339 bp, Artificial Sequence
  Description of Artificial Sequence: Synthetic coding sequence
atgcaggacaccggcagcgtggtgcccctgcactggttcggcttcggctacgcagctctggtggccagtggaggtatcattggctacgtaaaggctggttcagtcccaagtctggccgccggcctgctctttggatctcttgctggactgggcgcctaccagctgagccaagatccacgcaacgtttgggtgtttctggctacgtcgggaacattggccggaatcatgggcatgcggttctatcacagcggcaaattcatgcctgcagggctgatcgccggagcctctcttctgatggttgccaaggtgggtgtgtccatgttcaatagaccacattag

SEQ ID NO: 41329 - DNA, 294 bp, Artificial Sequence
  Description of Artificial Sequence: Synthetic coding sequence
atgagcagcgcccccgagccccccaccttcaagaaggagccccccaaagagaaggaattccaaagccctggccttcgcggggtacgcactaccactctcttcagggcggtcaaccccgagctttttattaagcccaacaaacctgttatggcctttggcctagttacactgagcttgtgtgttgcttacataggctatctgcatgcaatccaagagaataaaaaagacttgtatgaagccatagattccgaaggacactcctatatgagaaggaagacatctaaatgggactag

SEQ ID NO: 41330 - DNA, 2844 bp, Artificial Sequence
  Description of Artificial Sequence: Synthetic coding sequence
atgagccagccccccatcggcggcgccgcccccgccaccgccgccgcgtctcccgccgccgctgcaactgaggcccggctccatcccgaaggtagtagccgaaaacaacagagggcccaatctcctgcacggcctagggatagctctctacggcagacaatagccgcaaccaggagcccagtaggagctggcacaaagctcaacagcgtgcggcagcagcagcttcagcagcaacagcagcagggcaataagactggctctcgaaccggtcctccagcctcgattagaggaggcggtggtggcgctgaaaaggccaccccattggcccccaagggtgctgctccaggagccgtccagcccgtggctggtgcagaagcagcgcccgctgctacactggctgctctggggggccgaagacctggacccccggaggaacccccaagggaactcgaatctgtccccagtaaactgggggagcccccaccccttggggagggtggggggggcggaggagaggggggtggcgccggaggcggctccggtgaacgggaaggaggagctccacagccgccgccccctagaggttggcgggggaagggtgtgagagctcagcaacggggtggctccggcggggaaggggccagcccaagccccagtagttcctctgcaggtaagacgcctggtactggctccaggaacagcggaagcggggtcgctggcggtggaagcggaggaggtggatcttattggaaggagggatgcttgcagtccgagctaattcagttccatctcaaaaaagagagggcagcagccgccgccgcagcagctcaaatgcatgctaagaatgggggaggctcatccagccgctcctcccccgtctcgggaccaccggccgtttgtgagacactggccgtggccagcgcgtcacccatggctgccgccgcagaggggccacagcagagcgctgaaggctccgcgagcggggggggtatgcaggccgccgctcctccgagttcgcagccacatccccagcagctgcaggaacaggaagagatgcaagaagagatggaaaaattgcgtgaagaaaacgagacactgaaaaatgaaattgatgaactaaggactgagatggacgagatgagagataccttttttgaggaggacgcttgtcagttgcaggagatgcgacacgagctggagcgggcaaacaaaaattgcagaatcttacagtacagactgagaaaggccgagcgcaagaggctgcggtacgcgcagacaggcgagattgacggagaactcctgaggtctctggaacaggatctcaaggttgccaaggatgtttcggtgcggctccatcacgagttagaaaacgtggaggagaagcgaaccaccaccgaggatgagaacgagaaactgaggcaacaactcatcgaggttgaaatagccaaacaggctctccagaacgagctggagaagatgaaggaactctcccttaaacgcagggggagcaaagatctgccaaaatcagaaaagaaagctcagcaaacgccaaccgaggaagacaacgaggacttgaagtgccagttacaatttgtgaaggaggaggccgctctcatgagaaagaaaatggctaaaattgataaagaaaaggaccgattcgagcacgaactgcaaaagtatcggagtttctacggcgacctcgattcacctctgccgaagggggaggctggcggaccaccatcaacccgggaggccgagctcaagctgaggcttcgtctggtcgaagaggaggccaacatcctaggccggaagatcgttgagctcgaagtggaaaacaggggtcttaaagccgaactagacgacctccgcggtgacgatttcaacggctccgccaaccctttaatgagggagcagagtgagagcttgagcgagttgcggcagcacctgcagctcgtggaagatgaaacagagctcctccgcaggaacgttgccgacctggaggagcaaaacaaacggattactgcagagctcaacaagtataagtacaagtcagggggtcacgatagtgcacgacatcacgacaacgccaaaaccgaagctctgcaggaagagttaaaggcggcccggctacagatcaatgagttgtctggcaaggtgatgcaactgcagtacgaaaatagagtcctaatgagcaatatgcagcgttatgatctggcctcccatcttggcatccgaggctcacctcgcgacagcgatgcagaatcagatgctgggaaaaaggagtccgacgacgactcccggccgccacatcgaaaaagggagggcccaataggaggggagtccgatagtgaagaagtgaggaacatccggtgtttaacaccaactagatctttctacccagctccaggcccttggcctaagtcctttagtgataggcaacagatgaaggacattcgcagcgaagccgaaaggttaggcaaaactattgaccggctgatcgccgacacctcgactattatcactgaagcgcgaatttatgtcgccaacggggacctgtttggcctgatggatgaggaggatgatggctctaggatccgcgagcacgaactgctgtaccgaataaatgcccagatgaaagcttttcggaaagagctacaaacctttattgataggctggaggtgccgaagagcgcagatgatcggggggcggaagagcctatcagtgtgtcccagatgttccagcctattatcctgttaatcttgattctcgtgctgtttagcagtctcagctacacaaccattttcaaattggttttcctcttcacgctttttttcgtcctgtag

SEQ ID NO: 41331 - DNA, 33 bp, Artificial Sequence; identical to SEQ ID NO: 17367
  Description of Artificial Sequence: Synthetic coding sequence

SEQ ID NO: 41332 - DNA, 2844 bp, Artificial Sequence
  Description of Artificial Sequence: Synthetic coding sequence
atgagccagccccccatcggcggcgccgcccccgccaccgccgccgctagtcctgccgccgcagccaccgaggcaagactgcatcctgagggctcttcgcggaaacaacagagggctcagtctcccgcccgcccaagagactctagcctcaggcaaaccatagctgcaactcgcagtcctgtgggagccggcaccaagctgaactctgttcgtcagcaacagctgcagcaacagcagcagcagggaaacaaaacgggaagcaggacaggaccccccgctagcatcagaggcggcggcgggggcgcagagaaagcaaccccactggcccccaagggcgccgctccaggtgctgttcagcccgtagccggtgctgaggcagctcctgcagcgactctggcagctctcggagggcggcggcccggtccgccagaagaaccgcccagagaactcgaatccgtgcccagtaagctcggtgaaccgccccccctgggcgaagggggggggggcgggggtgaaggaggtggggcaggcgggggatctggggagagagagggcggtgcacctcagcctccaccccccagaggatggagaggcaaaggcgtaagagcacagcagcggggtgggtcgggcggggagggagcaagcccgtctcccagctccagctcggctggaaaaacgcccggaaccggttcacgtaatagcggtagcggcgtggcaggcggggggtctggaggaggaggctcttattggaaggaaggatgcctgcagagtgagctcatacaattccacttaaaaaaggagcgagcggctgcagcagccgctgctgcacagatgcacgccaaaaacggtggggggtcaagctctcggagctcccctgtatcaggaccgcctgctgtgtgcgaaacactggccgttgcctcagccagcccgatggccgccgccgctgaaggaccccagcagagtgctgagggatctgcctctggcggtggcatgcaggcagctgctcccccttcatcccagccgcaccctcagcagctgcaggagcaagaagaaatgcaggaagagatggaaaaactgcgcgaggaaaatgagaccctgaagaacgaaattgacgaacttcgcaccgaaatggacgagatgagagacactttctttgaggaggacgcgtgccagctgcaggagatgcggcatgagctcgaaagagccaataagaattgtaggatcctgcagtataggctgcgaaaagctgagcgcaagaggcttcggtatgcccaaactggggaaattgatggtgagctgctcagaagtctggaacaggacctgaaggtggccaaggacgtcagcgtcagactgcaccatgagttggaaaatgtagaagagaaaaggacaaccaccgaagatgagaatgagaaactacgccaacagctcatcgaagtcgagatcgccaaacaggccctccagaacgagctcgagaagatgaaagaactgtcacttaagcgacggggatccaaggatctgccgaagagcgagaagaaggctcagcagactccgaccgaagaggataatgaagaccttaagtgtcaactacagttcgtcaaagaggaggctgccctcatgcgaaagaagatggcgaagatcgataaggaaaaggaccgattcgagcatgagctccaaaaataccgttcattctacggcgacctggatagcccgcttccaaaaggcgaagcgggagggccaccctccacccgggaggccgaactaaaactgcgactccgtctggtggaggaggaggcgaacatcttgggaaggaagatcgttgaactagaagtggaaaataggggcctgaaggcagaactagatgatctacgcggagacgatttcaacggctctgcgaaccctctcatgcgagagcaatctgaatccctgtcagagctgcgtcaacacttgcaactggtggaagatgagacagaattactgcgacgaaacgtggctgacctagaagaacagaataagcggattacagcagagttgaataaatataaatacaaaagtggtggccatgactcagcgcggcaccatgacaacgctaagacagaagcactgcaagaggagctcaaagccgcgcgattgcagattaatgagctgagcggtaaggttatgcaattgcagtatgagaaccgagtgttgatgtcaaacatgcaaagatatgatctggccagccatcttggaattagaggcagtccaagagactcagatgcagagtctgatgccggcaaaaaggaaagcgatgatgactctaggccaccccaccggaaaagggaggggccaataggaggggagtctgacagcgaagaagtacgtaacatccgatgcctgacccccacaaggtcattttatccagctccaggcccctggccgaagtccttctccgacagacagcaaatgaaggacatcagatcagaggcagagcgattgggtaaaacaatagatcgactcatagcggacaccagcaccattatcactgaagcgcgaatctacgttgctaacggcgatctctttggactcatggacgaagaggacgacggatccagaatcagagagcatgaactgctgtaccgcattaacgctcagatgaaagcattcagaaaggaactccagacctttattgaccgcctcgaggtgccgaagagcgccgatgatcggggcgcggaagagcccatcagtgtctcccagatgttccaacccattatcctgctgatactcatcctcgtgttgttctcatccttatcgtacacaaccatatttaagctggtgttcctgttcactctcttttttgttttatag

SEQ ID NO: 41333 - DNA, 2844 bp, Artificial Sequence
  Description of Artificial Sequence: Synthetic coding sequence
atgagccagccccccatcggcggcgccgcccccgccaccgccgccgccagccctgccgctgctgcgacagaggcacggctgcaccccgagggatcaagtcggaaacagcagcgggcacagtctcctgcaaggcccagggattcttccctgaggcagacaattgccgcaactcgctccccagtgggcgccggaactaagctgaactcagtccgacagcagcagctgcaacagcagcagcaacaggggaacaaaactggttctaggacaggcccgcctgcctctatccgcggaggaggcggcggagccgaaaaggcgactccactggcccccaagggggcagcaccaggcgctgtgcagcctgtggccggggccgaagccgctccagcagccacactggcagcactcgggggcaggcgtccaggcccccctgaagagcccccccgtgaattggaatccgtccccagtaagctgggtgagccaccacctctcggagaaggcggcggcggtgggggggaaggaggcggtgcggggggcggctcaggcgaacgagagggaggagcaccacagcccccaccgcctcggggatggcgcgggaaaggtgttcgcgcacagcagaggggaggatcaggcggggagggcgcctccccatccccaagttcttcatccgccgggaagacccccggcactggcagtcggaattctggctctggggtggctggtgggggttccggtggagggggttcatattggaaggaaggttgcttacaaagtgagttgattcaattccacctgaaaaaagagcgggctgcggccgccgccgctgctgcccagatgcatgcaaaaaatggggggggcagctcgagtaggagttctcccgtgtcaggtccgccagcggtctgcgaaactctggccgtagctagcgcgtcacctatggccgctgccgcagaggggccgcagcagtccgccgaaggaagtgctagcggcggcggaatgcaggcagcagctcccccatcgtcccagccacacccgcagcagctccaggaacaggaggaaatgcaagaggaaatggagaagctgcgcgaagagaatgaaacactgaaaaacgaaatcgacgagctgcgtacggaaatggacgagatgagagacactttttttgaagaggacgcatgccaactgcaggaaatgcgtcacgaactggagcgagccaacaagaactgccgtattctgcagtaccgcttaaggaaggccgaacggaaacgcctaagatatgcccaaaccggcgaaattgacggcgagctgctcagatccctcgaacaggatctcaaggtggccaaggatgtgtctgtaaggcttcaccatgagctggagaacgtggaagaaaagcggaccaccaccgaagacgagaacgaaaaacttcgacagcagttgatcgaagttgagattgccaaacaggctctgcaaaatgagctagagaagatgaaggagctctctctgaaaaggagaggatctaaggacttgcctaaatcagaaaagaaggcacagcagacgccaaccgaagaggataacgaggacctcaagtgtcagctacagttcgttaaggaagaagctgctctgatgagaaaaaaaatggctaagattgataaagaaaaagacagatttgaacacgagctgcagaagtaccggagtttttatggagatctggactcgcctctccccaagggagaggccggcgggcctccgtctaccagagaggctgagctcaagttacgactgcgactggtggaagaagaggcaaatattcttggtcgcaagattgtggagcttgaggtggagaatcgtgggctgaaggccgagttggacgatcttagaggggacgacttcaatgggtcggctaatccgctgatgcgggagcagtctgaatctctgagcgagttgcggcagcatctgcagctggttgaggacgagactgagctcctccggcggaacgttgctgatcttgaagaacagaataaaagaatcacagccgaactaaacaagtataagtacaagtccggcggtcatgattcagcgaggcaccacgataacgcgaagactgaagccctgcaggaggagctcaaggccgctcggctgcagataaatgaattgagtggaaaggtgatgcagctgcagtacgagaatagggttctgatgtctaatatgcagagatacgatttggcaagccacctggggatcagaggcagcccacgagactcggatgctgagagcgacgccgggaagaaagagtccgatgatgactcgcgccctccacaccgaaaacgcgaagggcccatcgggggggaatccgacagtgaggaagtgaggaacattcggtgtctgacacccacaaggagcttttacccagcccctggcccttggcccaagagcttctcggaccggcaacaaatgaaggacattcgctccgaagctgagcgactagggaagactattgacaggttaatcgccgacacctccacaattataaccgaagctcggatttatgtggccaatggggatctgtttggccttatggatgaagaagacgacggctcgcggattagagaacatgagctgctttataggatcaatgctcagatgaaagcctttagaaaagagctacagacttttattgataggctggaagttcctaaaagcgcagacgaccgcggcgctgaggagccaatatcggtgagtcagatgttccaaccaatcatcctattgattctaatccttgtgctcttctcaagcttgagctacaccaccatcttcaagttggtgttcctctttacacttttcttcgttctctag

SEQ ID NO: 41334 - DNA, 387 bp, Artificial Sequence
  Description of Artificial Sequence: Synthetic coding sequence
atggccctgcaggtgcgggtggcccccagcaaggtggtgctgcagaaatttttactctgtgttatcctcttctacacagtgtactacgtctccctgtctatggggtgtgtgatgtttgaggtgcatgagcttaacgtgctggcccctttcgactttaagaccaaccccagctggttgaacattaattacaaagttctgcttgtcagtactgaagtgacttatttcgtttgtgggctgttttttgttcctgtagtggaagaatgggtatgggactatgccatctccgtgaccattctgcatgtggccattacctctactgtgatgctagagtttcccctgacctctcattggtgggctgcgctggggatttctaaactgctggtttag

SEQ ID NO: 41335 - DNA, 387 bp, Artificial Sequence
  Description of Artificial Sequence: Synthetic coding sequence
atggccctgcaggtgcgggtggcccccagcaaggtggtgctgcagaagtttctgctatgtgtgatcttgttctatacggtatattacgtcagtctctccatgggttgtgtgatgttcgaggtacatgagctgaacgttctcgcgccattcgactttaaaacaaacccctcttggctgaatatcaactacaaggttctcttggtatctaccgaagtcacatattttgtctgtggtctttttttcgtgccagtcgtcgaagagtgggtttgggactacgccatctcagtgactatactgcacgtggccattacctccacagtgatgctagagttcccattaactagtcactggtgggccgctctgggaatctcaaaattgttggtgtag

SEQ ID NO: 41336 - DNA, 723 bp, Artificial Sequence
  Description of Artificial Sequence: Synthetic coding sequence
atggccatggccagcgtgaagctgctggccggcgtgctgcggaagcctgacgcatggatcggcctgtggggtgtgcttaggggtaccccttcttcttacaagctatgcactagctggaaccggtacctgtattttagcagcacgaagctgagggcacccaactacaagaccctgttctataacattttcagcctacgcttgccaggactgctgttgagtccggagtgcatctttcctttctcagtacggttgaaatccaacatccgctcaacaaaatctacgaaaaagtctctgcagaaagtagacgaggaggattccgatgaggaaagccatcacgatgaaatgagtgaacaagaagaggagttggaggacgatcctactgtggtgaagaactacaaggatcttgagaaagctgtgcagagcttccggtatgatgtggttttaaagactggcctggacattggcaggaacaaggttgaggatgccttctataaaggagagctgcgcttaaatgaggagaaactgtggaaaaaatccagaaccgtcaaggtcggagatacgcttgatctcctaatcggcgaggataaagaggctggcacggagacagtaatgcgcattttattgaaaaaggttttcgaggagaaaactgagtccgaaaagtatcgggtggtgttacggaggtggaaatctctgaaattgccaaaaaagagaatgtctaaatag

SEQ ID NO: 41337 - DNA, 723 bp, Artificial Sequence
  Description of Artificial Sequence: Synthetic coding sequence
atggccatggccagcgtgaagctgctggccggcgtgctgcggaagcccgatgcatggattggattatggggcgtccttagaggcactccgagctcttataagctctgcacgtcgtggaacagatatctgtatttttcttccactaagctcagggccccgaactacaaaacgttgttctataacatcttctctttgagactcccggggttattgctgtcgccagagtgtattttcccctttagtgtgaggctcaaatcaaacattcggagcactaagagcaccaaaaagtcactgcagaaggtggatgaggaggacagcgatgaggagagccaccatgacgaaatgagcgaacaggaagaggagctcgaagacgacccgacagtggtcaaaaactataaggatctagagaaagctgtccagtccttccggtatgacgtagtgcttaaaacaggcctagatatcggtaggaacaaagtagaagatgcattctataaaggcgaattacggttgaacgaagagaagctctggaaaaaatcccgcaccgtcaaagtcggggacaccctcgatttactgatcggcgaagataaagaagccggaacagagacggtgatgcgcattttgctaaagaaagtgttcgaagagaagaccgagagcgagaaatatcgagtcgttcttaggcggtggaagtcgttaaagcttccgaagaaacgtatgagtaaatag

SEQ ID NO: 41338 - DNA, 738 bp, Artificial Sequence
  Description of Artificial Sequence: Synthetic coding sequence
atgatcatcagcgccatggccatggccagcgtgaagctgctggccggagtgttgcggaaaccggatgcctggataggcctgtggggggtccttagggggaccccctcctcgtataagttgtgcaccagctggaaccgatatttatatttctcatccacaaagttgcgcgcccccaactataagacactcttctacaacatctttagtttgcggctacccggccttctgctttctcccgaatgtatcttcccatttagcgtgcgactgaaaagtaatataaggagcacgaagtccacaaaaaagtccctgcagaaggtggacgaggaggactctgatgaggaatcccatcatgatgagatgagcgaacaagaagaggaactggaggacgaccctacagtggtcaaaaattataaagatctggaaaaagctgtacagtcttttaggtacgatgtcgtcctgaaaacaggcttggacataggacggaacaaagtagaagatgccttctacaagggagagttgcgattaaacgaagaaaagctgtggaagaagagtagaacagttaaggtaggggacaccttagatctcctcattggagaggataaagaggccggaactgaaaccgttatgaggatcctgctaaaaaaggtttttgaagaaaaaaccgaatcggaaaagtatcgggtggttctaaggagatggaaatctctaaaactccctaaaaagagaatgagtaaatag

SEQ ID NO: 41339 - DNA, 582 bp, Artificial Sequence
  Description of Artificial Sequence: Synthetic coding sequence
atggccgtgttcctgcagctgctgcccctgctgctgagccgggcccaaggtaatcccggtgcgtctctagacggccgccctggggaccgcgtgaacttgagttgtggcggcgtttcccatcctattaggtgggtttgggctccttcattcccagcctgtaagggcctgtcgaagggccggcgtcctatattgtgggcttcctcttctgggacccctaccgtgcctcccctacagccctttgtgggccgcctgagaagcctggattccggcataagacgtctggagctgcttctcagcgccggagacagcgggaccttcttttgcaagggtaggcatgaggatgagtcgaggaccgtactgcatgtcctgggagataggacatactgtaaagctcctggcccaacgcacgccctgtcccctccccattcgagcacttgcgaaaatcgcgccccagaagctagcaagggcggaagagcccaggattccaggggaccagggccaggcactgagcccgccctctgtggaagcggcccttccagcccacagcaggctccccctgctgttcacagcggaccatgctag

SEQ ID NO: 41340 - DNA, 654 bp, Artificial Sequence
  Description of Artificial Sequence: Synthetic coding sequence
atggccgtgttcctgcagctgctgcccctgctgctgagccgggcccaaggaaacccaggcgcttccctcgatgggcggcccggagacagggtcaacctctcttgcggaggcgtgtcacacccaatacggtgggtctgggcgccctccttccccgcttgcaagggcctgtcaaagggccgccggcctatcctgtgggcttcatcttcgggcacaccgacggtccccccactgcagccgttcgtcgggcgcctgcggagccttgactccgggattagacgtcttgagttgctgctgagcgctggggactcagggacatttttttgcaaggggcgacacgaggatgaaagcagaaccgtgctgcacgtactaggggatcggacatactgcaaggcccctggtcccactcacggtgcttgcccgcggaaccgtttcgatcattcacttgacctgctgtgccctcctcacatcgcaccattggtgaagacggagccacagcggccggttaaagaagaagaaccaaagatccctggcgatctcgaccaggagccctctttactatatgctgacctcgatcacctggctctctctagaccccgaaggctatcgacggctgaccccgcagatgcaagcaccatttatgccgtggtcgtctag

SEQ ID NO: 41341 - DNA, 726 bp, Artificial Sequence
  Description of Artificial Sequence: Synthetic coding sequence
atggccgtgttcctgcagctgctgcccctgctgctgagccgggcccaaggcaacccaggcgcatcactggatgggagaccaggtgatcgggtaaatctgtcctgcggaggtgtgagtcatcctattaggtgggtatgggcaccatcattccccgcctgtaagggcctgtccaaaggtcgccgacccatcctgtgggcctcctcgtcgggaacacccaccgtgcctccactgcagccttttgttgggcggctgcggtcactcgattcaggcattcgcaggcttgagttgctcctgtccgctggggacagtgggactttcttttgcaagggccgacatgaagacgagagccgcaccgtgttacacgtgctgggagataggacgtactgcaaggctcctgggccaacacatggctccgtatatccgcagcttctgatccctcttcttggagccggcctcgtgttagggttaggcgccctggggttggtgtggtggctgcataggaggcttccaccacagccaatccgaccattgcctcgatttgctcctctggtcaagaccgaaccccagagacctgtgaaggaggaggagccgaaaatccccggggacttggatcaggaaccttctttactctatgcagatctggatcaccttgccctgagtcgccccagacgactgtccaccgctgatccagcagacgcatcaacgatctatgctgtcgtggtttag

SEQ ID NO: 41342 - DNA, 714 bp, Artificial Sequence
  Description of Artificial Sequence: Synthetic coding sequence
atggccgtgttcctgcagctgctgcccctgctgctgagccgggcccaggggaatccaggggcctcccttgacggtaggccaggtgatagagtaaacctatcctgcggtggcgtgagccacccaatcaggtgggtctgggcaccatcctttccagcatgcaaaggactatctaagggccgccgccctatcttgtgggcgagttcaagcggaacgcccaccgtccccccgctgcagcctttcgttggtaggctgcggagtctcgactcaggtatccggagactggagcttctgcttagcgcgggtgactctggaacgttcttttgtaaaggccgtcatgaagacgaatcgcgaacggtgttacacgtgttaggtgaccgaacttactgtaaagccccaggaccaactcacggaagtgtatacccccagttgctgattccactcctgggtgccggcttagtgctgggcctaggagctctaggcctggtgtggtggcttcacaggcggttgcctccacagcccattagaccgttgccccgttttgctctttcccccccccactccagcacatgcgaaaatcgggctccagaggccagcaagggtggccgagctcaggattcccgaggccccggtccaggaacagaacccgctttatgtggctctgggccatctagcccacagcaggctccacccgctgtacacagcgggccatgttag

SEQ ID NO: 41343 - DNA, 669 bp, Artificial Sequence
  Description of Artificial Sequence: Synthetic coding sequence
atggccgtgttcctgcagctgctgcccctgctgctgagccgggcccaagggaaccctggggcatccctggatggccgtcccggagaccgggtgaacctgtcctgtggcggtgtgtctcatcccatccgctgggtctgggctccatctttccccgcctgtaaagggctgtccaaagggcgccgtcctatactttgggcctctagctccgggactccaactgtgccaccccttcaaccttttgtcgggaggcttagatccctggacagcggaatccgccgacttgaattgctgctttccgcgggcgactctgggacattcttttgcaaggggcggcatgaagatgagtccagaacggtcctgcatgtactcggagataggacatactgcaaagcaccaggacccacgcatggaagcgtgtatcctcagctgttgatccccctgctgggagcaggactggtactaggtttgggagcactcggtctcgtgtggtggctccatcgaaggctgcctcctcagccgattagacccctgcccaggttcgccctctcacctccccactcctccacttgtgagaatcgggcccccgaagcatctaaaggggggagggcccaagattcccggggtccaggtcctggtaccggtaagggtatggggatggggcgcggctag

SEQ ID NO: 41344 - DNA, 594 bp, Artificial Sequence
  Description of Artificial Sequence: Synthetic coding sequence
atggccgtgttcctgcagctgctgcccctgctgctgagccgggcccagggtaatccaggcgcctccctggacggaagaccaggcgacagggtcaatctctcctgtgggggcgtgagccatcctattagatgggtgtgggcacctagctttcccgcttgcaaaggactgagcaagggccgccggccgatcctgtgggcaagctctagtggtacaccaacggtgcctccgctccaaccgttcgtgggccgtctgcgatcactcgactctggtattcggcgcctcgaactcctgcttagcgcaggggatagtgggacgtttttctgcaagggcagacacgaagatgaatcccggaccgtgcttcacgttttgggagatcgtacatactgcaaggctcccggcccaacccacgctcctcttgtgaaaacggagccccagcgccctgtgaaggaagaggagcccaagatacctggcgacctcgatcaagaacccagccttctttacgcagaccttgatcatttggcactgtcacggccccggcggcttagtactgcggaccctgctgacgcttctacaatatacgccgttgtggtttag

SEQ ID NO: 41345 - DNA, 594 bp, Artificial Sequence
  Description of Artificial Sequence: Synthetic coding sequence
atggccgtgttcctgcagctgctgcccctgctgctgagccgggcccaagggaaccctggggcatccttagatggacgacctggagacagagtaaacctttcctgtgggggagtgtctcatcctatacggtgggtttgggctcctagtttcccagcctgcaaaggcctgagcaaagggcggcgccctatactgtgggcgagttcaagcgggacacccacagttccgcccctgcagccgttcgtgggaagactgcgatccctggattcagggattcggcgcttagaacttttgctcagcgctggcgattctggtactttcttctgcaagggacgccacgaggacgaatcccgtaccgtgcttcacgttctaggagacagaacatactgtaaggctcctggacccactcatgcccctctggtgaagaccgaaccccagcggcctgttaaggaagaggagccaaagatcccaggtgacttagaccaggaaccttcactgctttatgcggacttggatcacctggctcttagcaggcccagaaggctctccaccgcagaccccgccgatgctagcacgatttatgccgtcgtcgtgtag

SEQ ID NO: 41346 - DNA, 654 bp, Artificial Sequence
  Description of Artificial Sequence: Synthetic coding sequence
atggccgtgttcctgcagctgctgcccctgctgctgagccgggcccagggaaatccgggtgctagcctggacggaaggccgggtgacagagtgaatttgtcctgtggtggggtaagccaccccatcagatgggtctgggccccgtcattcccagcctgcaagggactgtctaagggtcgtcggcccattctctgggcctcaagctctggaaccccaacagttccacccctccagccatttgtcggtagattgcggtctctggacagcggtatcagacgcctggagttgctgttgtccgccggcgattctggcacattcttctgcaaaggccgacacgaggacgaaagtcgaacagtactgcacgtgctcggggatcggacatattgtaaggctcctggcccaacacacggggcctgtccccgaaatagatttgaccactcactcgatttactgtgtcctccacacattgctcctttggtgaaaaccgagcctcagcggcctgtgaaggaagaggaacccaagatacccggcgacctcgatcaggaaccttctttgctctacgccgatctggatcatctcgccctgtcccgcccccgccggctgtccacagccgacccagctgacgcctccactatttacgccgtcgtcgtgtag

SEQ ID NO: 41347 - DNA, 714 bp, Artificial Sequence
  Description of Artificial Sequence: Synthetic coding sequence
atggccgtgttcctgcagctgctgcccctgctgctgagccgggcccaaggaaaccccggcgcctcactggatgggaggcccggcgatcgtgtaaatctctcatgtggaggagtgagccatccaattagatgggtgtgggcaccttcgtttcccgcctgtaaaggcctgagcaaaggtaggaggccaattctgtgggccagttcttcggggacccctacggtcccccccctgcagccgttcgtgggtcgtctcaggagtctcgattctgggattcggcgactggagctcctcctttctgctggagattccggcacctttttctgtaaaggaaggcatgaagatgagagccggaccgtactgcatgtgctgggtgacagaacttactgcaaagccccaggcccaacccatggctccgtgtacccgcagctcctgattccattgctgggtgccgggcttgtgctgggcctgggggccctcgggcttgtgtggtggctgcatcgccggttaccacctcaaccaatcaggccgctcccacggttcgcattgagccccccccatagttctacttgcgagaatagggcaccagaggcatccaaagggggcagggcccaggactcacggggccctggacctgggacagagcccgccctctgtggcagcggaccatcctcgccccagcaggcgcctcctgccgtccatagcggtccttgctag

SEQ ID NO: 41348 - DNA, 582 bp, Artificial Sequence
  Description of Artificial Sequence: Synthetic coding sequence
atggccgtgttcctgcagctgctgcccctgctgctgagccgggcccaggggaatccaggcgctagcttagacggccgacccggtgatcgagtgaacctgagctgcggcggggtatcccaccctattcggtgggtctgggcaccatcgtttcctgcgtgtaaaggcctgtcgaaaggacggcgcccaatcctgtgggcttccagttccgggacaccaacagtgcctcctttgcagcctttcgtgggtcgtctccggtctctggactcggggatacgccggctggagctgctgctatccgcgggtgactctggaacattcttctgtaagggcaggcatgaagatgagagcagaaccgtactccacgtgttgggagatcggacttactgcaaagcccctggccccacacacgctttatcgccgccacactcttcaacctgtgaaaatagagctcccgaggcttccaaaggcggcagggcgcaggattcccgcggcccaggtcctggtacagaacctgccttgtgcgggtccggcccatccagcccccagcaggctcccccggctgttcattctggcccttgttag

SEQ ID NO: 41349 - DNA, 726 bp, Artificial Sequence
  Description of Artificial Sequence: Synthetic coding sequence
atggccgtgttcctgcagctgctgcccctgctgctgagccgggcccagggaaatcccggcgctagcctcgatggtcgcccaggcgaccgtgtaaacctatcatgtggaggcgtgagccaccccattagatgggtttgggctcctagctttccagcgtgcaaaggtctctcaaaggggcgtcgaccaattctttgggcctccagctcaggaactcccactgtgcctccactgcagccattcgtgggccggctgcgctccctggactcaggtatccgacggctcgagctgctgttgtctgccggcgactctggcaccttcttttgcaaggggcggcacgaagatgaaagtcggaccgttctacacgtcttgggcgacaggacctactgtaaggctcctgggcccactcacggatccgtttacccacagctactgatacccctcctcggtgccggcttggtgctggggctgggtgctctggggctggtatggtggctccatcgccggctgcccccccagcccatcaggcccttgcccagattcgctcctctggtgaaaacggagccgcaaagacccgtcaaggaagaggaacctaaaatccctggtgatctggaccaagagccttcgctgctgtatgccgatttagatcacctggcactttctaggcctcgccgtctgtccacggccgatcccgcagacgcctcaacgatatatgctgttgtcgtctag

SEQ ID NO: 41350 - DNA, 726 bp, Artificial Sequence
  Description of Artificial Sequence: Synthetic coding sequence
atggccgtgttcctgcagctgctgcccctgctgctgagccgggcccaggggaatccaggagcttcgctcgatggacgtccaggagatagggtcaacctaagctgtggcggcgtttctcacccaattcgatgggtttgggctccaagctttcccgcctgcaagggtttgtcaaaagggcggcggcctatcctatgggctagctcatccggaacacccacagttccaccactccaaccgttcgtggggcggctgagaagtctggatagcgggattcgtagactggagctgctgctgagcgccggcgatagtggcacctttttctgcaaggggcggcacgaggacgagagtcgtacagtgctccatgtactgggcgaccgcacctattgtaaagcccccgggcccacgcacggcagcgtctacccacagctgctgattccactgctgggagccggcttggttctaggtctgggcgctcttggcctagtctggtggctacacagaaggctgcctccgcagccgatcaggcctctgccccgcttcgcccctctggttaagactgagccccagcggcctgtgaaggaggaggagcctaagatcccaggagatttggatcaggagccctccctgctttacgcagacctcgatcatcttgctctaagccgaccacggcgactcagtacagctgacccggcagatgcctcaaccatatatgcggtggtggtttag

SEQ ID NO: 41351 - DNA, 594 bp, Artificial Sequence
  Description of Artificial Sequence: Synthetic coding sequence
atggccgtgttcctgcagctgctgcccctgctgctgagccgggcccagggaaatcctggtgctagtctggacggaaggcctggagacagagttaacttgtcctgcggaggcgtatcccatcctatcagatgggtctgggcgccaagcttccctgcctgcaagggattgtcgaaaggccgcaggcccattctgtgggccagctccagtggtacccccaccgtgcccccgctccagccgtttgttggccgcctccgctcactggatagcggcataaggcgattggagctgctgctgtctgccggagactccggaaccttcttctgcaagggacgacacgaggacgagagccgcaccgtgttgcatgtactgggcgacagaacatattgcaaggctccaggccctacacatgcccccctggtgaaaacagagccacagagacctgtgaaagaggaagaaccaaaaattccaggcgaccttgaccaagagccctcccttctgtacgctgaccttgaccatctagccctctcacgaccgagacggctctctacagccgaccccgccgacgccagtactatttatgccgtagttgtgtag

SEQ ID NO: 41352 - DNA, 582 bp, Artificial Sequence
  Description of Artificial Sequence: Synthetic coding sequence
atggccgtgttcctgcagctgctgcccctgctgctgagccgggcccagggaaatccaggagccagcctggatggtagacccggcgatcgtgttaacctgagctgtggaggagtttcccaccctatccggtgggtctgggctccttctttccctgcatgtaagggcctgtctaaaggtcggcgcccgattctgtgggctagttcatctgggacccctactgtgccgcccctccagccctttgtgggacgcctgcgatcccttgatagcggcatcagaaggttagagttgctgctgagcgcaggcgatagcgggaccttcttctgtaagggtcgtcacgaggacgagagcaggactgtcctgcacgtgctgggcgacaggacgtattgtaaggctccagggccaacacacgcactcagcccgccccattccagtacctgcgagaatcgagcgccagaagcaagcaaggggggccgcgcgcaggactcccggggccccggtcctggcacagagccagccctctgtggaagcggtccttcttcaccccagcaagcaccacccgcagtccacagcggaccttgctag

SEQ ID NO: 41353 - DNA, 654 bp, Artificial Sequence
  Description of Artificial Sequence: Synthetic coding sequence
atggccgtgttcctgcagctgctgcccctgctgctgagccgggcccagggaaaccccggtgcctccttagacgggcgtcccggagatcgggtcaacctgtcgtgcggcggtgtctcacaccccatccggtgggtgtgggctcccagctttcctgcttgtaagggattatcaaaagggcgccgcccaattctgtgggcaagctcctcggggaccccgacggtcccgccgcttcagccttttgtcggcagattacgctctctggacagcgggatacgacgcttggagctcttgctgtctgccggagacagtggaacgttcttctgcaaaggtcgccacgaagatgagagtaggaccgtgctccacgtgctcggcgaccgaacctactgtaaagccccaggacctacacatggagcatgccctaggaatcggtttgatcatagtctggatcttctttgtccccctcatatcgcccctctggtcaaaaccgagccacagagaccagttaaagaggaagagcctaagattccaggagacctggaccaagagccaagtctcctatatgcagatctggatcatctggcactttcaaggcccagaagactgtctacagcagacccagccgacgcctcaactatctacgcagttgtggtatag

SEQ ID NO: 41354 - DNA, 582 bp, Artificial Sequence
  Description of Artificial Sequence: Synthetic coding sequence
atggccgtgttcctgcagctgctgcccctgctgctgagccgggcccaggggaaccccggagccagtttggatggacgccccggagacagggttaacctaagctgtgggggcgtctcacacccaatcagatgggtatgggccccttctttccccgcttgcaagggcctttcgaaagggagacggcctattctttgggcttcttcgtctggaacacctacagtcccaccgctgcagccctttgtgggacgtctccgatccctggatagtggaatacgaagattggagcttttgttgtccgctggcgactctggaacctttttttgtaagggccgacacgaagacgaatctagaacagtcctgcacgtgctgggcgatcgaacttattgcaaggcgcctgggcctacgcacgcgctctctcccccccattcctctacgtgcgaaaatcgtgctcccgaggcatctaaaggaggacgagcacaggacagtaggggaccggggccgggcaccgaacccgctctctgtggctccggtccctctagcccacagcaagcaccccctgccgtgcactctggtccttgctag

SEQ ID NO: 41355 - DNA, 714 bp, Artificial Sequence
  Description of Artificial Sequence: Synthetic coding sequence
atggccgtgttcctgcagctgctgcccctgctgctgagccgggcccaggggaatccgggggcatctctcgacggccggccgggggatcgggtgaatttatcttgcgggggtgtgagtcatccaattcgctgggtgtgggccccttcgttcccagcttgtaagggcctttcgaaagggcgcagacctatcctgtgggcttcctcatcaggtacgccgacagtcccacccctgcagccgttcgtgggtcgcttgcgctccttggattccggaatcagaagactggagctgctcttgtcggcgggcgattccgggaccttcttttgtaaaggacggcatgaggacgaatctaggactgtcctgcacgtgttgggtgaccggacttactgtaaagctccaggacccacgcatggcagtgtgtatcctcagttgctgatccccctgctgggagcaggcctagtgcttggcctgggcgctctcgggctggtctggtggcttcacagaagactgcccccgcagcccatccgtcctctcccaaggttcgccttatcccctcctcatagtagcacctgtgaaaacagagcccccgaagccagtaaagggggcagggcccaggacagccgcggtcctggtcctgggactgagcctgctctctgcggcagtggtccctcatcaccacagcaggccccgcccgccgtacattcaggcccatgctag

SEQ ID NO: 41356 - DNA, 714 bp, Artificial Sequence
  Description of Artificial Sequence: Synthetic coding sequence
atggccgtgttcctgcagctgctgcccctgctgctgagccgggcccagggcaacccgggggcatctcttgacgggagacccggcgacagagtgaatctcagctgtgggggagtctcccacccgatccgatgggtgtgggcccctagttttccagcatgcaaaggcctgtccaaaggacgacggccaattctctgggcgtccagcagcggcacaccaacggtccccccgttgcagccctttgtcggccgcctgcggtctctcgacagtggcattcgaaggctggaactgctgctgtctgcaggcgatagtggcacctttttctgtaaagggcgccacgaggacgagagtcgcacagtgttgcacgtcttaggcgatcgtacatactgcaaggcaccaggcccaacccacggcagtgtatatccccagctgctgattccactgctgggcgctggattagtactgggcctcggcgccctgggccttgtgtggtggttgcatcggcggttgcctccacaacctatcaggccactgcctcgattcgcccttagccctccacactcaagtacatgtgaaaatagagctccagaggccagtaaaggcggtcgagcacaggactcaaggggtcccggtccagggaccgagcccgccctgtgcggcagcggtccctcctctccacagcaagctccccctgcggtgcatagcgggccttgttag

SEQ ID NO: 41357 - DNA, 594 bp, Artificial Sequence
  Description of Artificial Sequence: Synthetic coding sequence
atggccgtgttcctgcagctgctgcccctgctgctgagccgggcccagggtaaccccggcgccagcctggacgggaggcccggggatcgagttaacctcagttgtggaggggtatcccatcccatcaggtgggtgtgggctccctctttccccgcctgtaaaggactcagcaaaggacgtcgccccatactgtgggcatcatcctcaggaacacccaccgttcctcccctccagcctttcgtgggtcgtctaagatccctggacagcgggatcaggcgccttgagctgctattgtctgctggcgactctggcacctttttttgcaagggtcgacatgaagatgagtctcggaccgttttacacgtgctgggggatcgtacatattgcaaggcgccgggccctacacatgcccccctcgtaaagactgagccacagagacccgtcaaagaggaagagccgaagatccccggtgacctagaccaggaaccctccctactgtacgcggatctcgaccacctggctttgagccggccacggcgcctgagtacagctgatccagccgacgcatccaccatatatgcagtggtcgtatag

SEQ ID NO: 41358 - DNA, 654 bp, Artificial Sequence
  Description of Artificial Sequence: Synthetic coding sequence
atggccgtgttcctgcagctgctgcccctgctgctgagccgggcccaaggcaacccgggcgccagcttggacgggcgtcctggcgaccgcgttaatctgagttgcggcggcgtttcccacccaatccgatgggtgtgggctccaagcttccccgcatgcaaaggcctgtccaaggggagaaggccaattctttgggcttcaagctcaggtacgcccactgtcccaccactgcaaccttttgtgggcaggcttaggagcctagactccggcatccgccgtctcgaattgttgctgtccgctggggacagtggcacattcttttgtaaggggcggcatgaggatgaatccaggaccgttctgcatgtgctaggcgaccggacctattgtaaagctccaggaccaactcacggtgcctgtccgcggaataggtttgaccattctctggatctgctttgccctccacacattgcaccactggtgaagactgaacctcaacggccagtaaaagaggaggagcccaaaatcccaggggacctggaccaggagccgtctttgctgtatgctgacctggaccatctggccctgtcacgcccccgtcggttgtcaaccgcggacccggccgatgcatcaaccatatacgccgtggtggtctag

SEQ ID NO: 41359 - DNA, 726 bp, Artificial Sequence
  Description of Artificial Sequence: Synthetic coding sequence
atggccgtgttcctgcagctgctgcccctgctgctgagccgggcccagggcaaccctggtgcctccctggatgggcggccgggagaccgtgttaatctgtcttgcggcggcgtgtcacacccaatcaggtgggtctgggccccctcttttcctgcctgtaagggactgagcaaaggccggcgccccattctctgggcctcaagcagcggtacccctactgttccccccctgcagccatttgttgggcggctccgaagcctcgactctggcattagacggctagagctcctcctgtcagccggagattcgggaacattcttttgtaaaggtagacacgaagacgagtcccgcacagtgcttcatgtcttaggtgatcggacttactgcaaagctcccggtcctacccacggaagtgtctatccacagctcctgatccctctgctgggtgccggcctggtgctggggctgggtgctttggggctcgtctggtggctgcaccgcagactgcctcctcagccaatccgaccgcttccccgctttgcccccttggtgaagaccgaaccccaaagacctgttaaggaagaggaacctaagattcctggagatctcgatcaggagcctagtctgctgtatgcagatttagaccacctggcgcttagtagaccccggagactatcgaccgccgacccagccgacgcctctaccatttatgcggtggtggtgtag

SEQ ID NO: 41360 - DNA, 582 bp, Artificial Sequence
  Description of Artificial Sequence: Synthetic coding sequence
atggccgtgttcctgcagctgctgcccctgctgctgagccgggcccagggtaaccctggcgcatccctggacgggcgccccggcgatagagtgaacctaagttgtggcggcgtgtctcaccccatccgttgggtttgggctccttcattcccagcatgtaaaggtctatcaaaaggcaggaggcccatcctctgggcctctagcagtggtacgcctacagtgcctccgttgcagccatttgtcggccgactgagatccctcgattcaggcatacggagactcgagttactactgtccgccggcgacagcggtacattcttttgtaagggacggcacgaggacgaatcccggaccgtgctgcacgtattgggtgacagaacgtactgcaaagcccccggaccaacccacgcactgtcaccacctcactcatctacctgtgagaaccgggcccccgaagccagcaagggaggcagggcccaagactcgcgcggcccaggcccgggtaccgagccagcgctgtgcggtagcggtccttctagtccgcaacaggctccccctgcagtgcactccggaccatgctag

SEQ ID NO: 41361 - DNA, 582 bp, Artificial Sequence
  Description of Artificial Sequence: Synthetic coding sequence
atggccgtgttcctgcagctgctgcccctgctgctgagccgggcccagggaaaccccggggcttcactagatggaaggcccggagatcgcgtcaacctctcttgcggcggcgtgtcccatcccatccggtgggtgtgggctccgtccttccctgcgtgcaaaggtctgagtaaagggcgacgaccaatactctgggcttcttcttctgggactccaactgtaccccccctgcaaccttttgtcggacggctgagatctctggactcagggatcagaagactggaattgctgttgtcggccggcgattcagggaccttcttctgtaagggccgccacgaggacgagagcagaactgttctgcacgtgctgggtgaccgtacctactgtaaggcccccgggcccacacacgctctgtctccaccacattccagtacctgcgaaaatcgagcgccggaggcctccaaagggggcagagcacaggattcaaggggtcccggcccgggtacagagcccgccctctgcggcagcgggccctcgagccctcaacaagccccccccgccgtgcacagcggaccgtgttag

SEQ ID NO: 41362 - DNA, 714 bp, Artificial Sequence
  Description of Artificial Sequence: Synthetic coding sequence
atggccgtgttcctgcagctgctgcccctgctgctgagccgggcccagggcaaccctggcgcaagcctcgatggtcgccccggcgacagggtgaacctgtcttgcgggggcgtctcacatccaatcagatgggtgtgggcaccgtcttttccagcctgcaaggggctctcaaaaggacgacgccccattctttgggcgtcttcaagcggcaccccaaccgtccctccgctccagccatttgtcggccgactccggagtcttgactcgggcatcagacgactcgagttgctgctttcggctggtgacagtggcacctttttctgcaaagggaggcatgaagatgagagtaggacagtcctccacgtgctgggggaccgtacctattgtaaagcccccggcccgacccacggcagcgtttaccctcagctgcttatcccacttctcggcgccggactagtgttgggtctgggtgcattgggtttggtgtggtggctgcatcggcgactgccaccacaaccaattagacctctgccgcggttcgccctaagtccccctcacagttccacatgcgagaatagggcacccgaggcgtctaaaggcgggagagcacaggattcacggggacccggacccggcacagagccggctctgtgtgggtcaggaccgagttccccccaacaggctcctccagcggtccactccgggccttgctag

SEQ ID NO: 41363 - DNA, 654 bp, Artificial Sequence
  Description of Artificial Sequence: Synthetic coding sequence
atggccgtgttcctgcagctgctgcccctgctgctgagccgggcccaaggcaatcctggagcctcactagatggtaggcccggagaccgggtgaacctgtcctgtgggggagttagtcatccgatccgctgggtctgggcaccctctttccccgcctgtaagggcctaagtaagggccgcagacctattctttgggcctccagcagcggcacacccacagtgcctcctctacagccatttgttggccgcctgagaagtctggattcaggcatcagacggctggagctgttactgtccgctggagatagtggcacctttttctgcaagggacggcacgaagatgaatctcgcaccgtcttacacgttctgggtgacagaacctactgtaaggcccctggaccaacgcacggcgcctgccctcggaatagattcgaccacagccttgaccttctctgcccgccacacatcgccccgctggtgaaaacagagccccagaggcccgtgaaggaggaggaacccaagattccaggagatttggatcaggagccatccctcttatacgccgacctggaccacctggccttgagcagaccaaggcgcctgagcactgcagaccctgccgatgcgtcaactatctatgccgtggtggtatag

SEQ ID NO: 41364 - DNA, 726 bp, Artificial Sequence
  Description of Artificial Sequence: Synthetic coding sequence
atggccgtgttcctgcagctgctgcccctgctgctgagccgggcccaaggaaatccaggggcctccctggacgggcgcccaggcgacagagtgaacctgagctgtggcggggtgagtcatccaataaggtgggtttgggcccccagctttccggcatgcaaaggcttgtcgaaaggacggagacccatcttgtgggcatctagcagcggcaccccaactgttcctcctcttcagccgtttgtgggccgtcttcgaagtctggattctggtatccgacgactcgaacttctcctgagcgctggggattccgggactttcttttgtaagggccgtcatgaggatgaaagtcgaaccgtgctccacgtgttaggcgatagaacatactgtaaagcgccggggccaacccacggaagtgtctatccacaattgctcataccattgctaggcgcggggctggtgctaggattgggagcacttggactggtttggtggctgcatcggagattaccgcctcagcccatcaggccactccccagattcgcacccctggtcaagaccgaaccacagcgacccgtaaaagaggaggagccaaaaatccccggtgacctcgaccaggagccttcccttctgtacgccgatttagaccatctggctctgagtaggcctcgacgtctgagcactgccgaccccgctgacgctagcaccatctatgccgttgtagtttag

SEQ ID NO: 41365 - DNA, 594 bp, Artificial Sequence
  Description of Artificial Sequence: Synthetic coding sequence
atggccgtgttcctgcagctgctgcccctgctgctgagccgggcccaggggaatcctggggccagccttgacgggcgcccaggggaccgggtgaacttatcatgtggcggcgtctctcacccaatccggtgggtgtgggcgcctagctttccagcttgcaaaggcctctcaaagggtaggcggccaattctttgggccagtagtagtggcacccccaccgtgcccccgctgcagcccttcgtgggcagactgcggtccctggatagcggtattcgccggctggaactgctccttagcgcaggagactcaggcaccttcttctgtaagggccggcatgaagacgaaagcaggacggtgttgcacgtcctcggggaccggacgtattgcaaggcacccggtccgacacacgcacccttagtgaaaactgaacctcagcgccctgtgaaagaggaagagccgaaaatcccaggcgacctggatcaggagccctctctgctctacgccgacctggaccatctagctttgtctaggccccgtcggctgtccaccgccgacccagctgatgcttcgaccatttacgcagtcgttgtttag

SEQ ID NO: 41366 - DNA, 714 bp, Artificial Sequence
  Description of Artificial Sequence: Synthetic coding sequence
atggccgtgttcctgcagctgctgcccctgctgctgagccgggcccagggtaatcccggggccagcttggatgggcgaccaggagaccgggtgaatctctcctgcgggggtgtgtctcatcctattcgttgggtctgggctccatcatttcctgcttgtaaaggcctgtccaaaggcaggagaccaatcctgtgggcgagcagcagtgggacccctaccgtacctcctctccagcccttcgtgggccgactgcgatccttggacagcgggatcaggcgcttggagcttcttctgagcgctggtgatagcggcactttcttctgcaaggggcgtcacgaggacgagagtagaaccgtgctccacgtactgggggatcggacatattgcaaggcaccaggccctacccacgggagcgtgtacccacagctgttaatcccccttcttggcgcaggactcgttctgggcctcggagctctgggcctggtgtggtggctgcacagacggctacctcctcaacctatcaggcctctaccgcggtttgcgctcagtccccctcactcttcgacctgcgaaaatagagcacccgaagcctccaagggcggcagggcgcaggattcccgtgggcccgggccagggactgaaccggccctgtgcgggagcggcccctctagcccacagcaggcgcctcccgcagtgcacagtggcccttgttag

SEQ ID NO: 41367 - DNA, 594 bp, Artificial Sequence
  Description of Artificial Sequence: Synthetic coding sequence
atggccgtgttcctgcagctgctgcccctgctgctgagccgggcccaagggaatccgggtgcatctctggacggtagacctggcgaccgtgttaacctgtcctgtggcggcgtttcacaccccattagatgggtgtgggccccatcttttcctgcctgtaagggtctgtccaaagggagaagacctatcctttgggccagtagtagcgggaccccgaccgttcctcctctgcagcccttcgttggaaggctgcgcagcctggactccggcataaggcgcctggaattgttgcttagcgcaggagacagtggcaccttcttttgtaaagggcgccacgaggatgaatcccggaccgtactgcacgtactaggggacagaacctactgcaaggcccccggacctacgcacgcgcccttggtcaaaacagagcctcagcgtcccgtcaaagaagaagaaccaaaaattcctggggatctcgatcaggaaccgtcgctactctatgccgaccttgaccacctcgcattgagccgtccaagaagactgtcaaccgccgatcccgccgatgcaagcacaatttacgccgtcgtggtgtag

SEQ ID NO: 41368 - DNA, 654 bp, Artificial Sequence
  Description of Artificial Sequence: Synthetic coding sequence
atggccgtgttcctgcagctgctgcccctgctgctgagccgggcccaggggaatccaggtgcttctctcgacgggaggcccggcgaccgggtcaacctgtcttgcggaggtgtgtctcacccaattaggtgggtctgggccccatcattccctgcttgcaagggactgtccaaggggagaaggcccatcctgtgggccagtagcagtggaacccctacagtgcctcctctacaaccattcgttggtaggcttaggtccctagatagtggaataaggcggttggagctgctcctgtctgccggtgactccggcacttttttttgcaaaggacgtcacgaggacgagagtcggaccgttctccacgtcttgggagacagaacctactgtaaagctccaggtcccacacatggagcatgccctagaaaccgctttgaccacagcctagatcttctttgtccacctcacattgcaccgttggtaaaaactgagccacagcgccccgtgaaggaggaggagcctaaaatccccggtgatctcgatcaggagcctagtctgctgtacgctgatttggaccatctggccctttctcggcctagacggctgagtacagctgatcccgcagatgcttctaccatctatgcagtggtggtgtag

SEQ ID NO: 41369 - DNA, 726 bp, Artificial Sequence
  Description of Artificial Sequence: Synthetic coding sequence
atggccgtgttcctgcagctgctgcccctgctgctgagccgggcccagggaaacccgggtgcctcgctcgatggacgtcccggtgaccgggttaatctgagctgcgggggggtatcccatcctatccgatgggtgtgggctccgtctttcccagcatgcaagggcctgtccaagggaaggagaccaattctttgggctagttcatccggtacccctaccgtgccgccactccagccatttgttggaagactcaggagtttagattcagggataagaagactggaactgctacttagtgctggtgatagtggcactttcttttgtaagggccggcatgaggacgagagccgaaccgtgctgcacgttctgggtgaccgcacttactgcaaagccccaggaccgacccacgggtctgtgtaccctcaactcctgatccctttacttggagccggtcttgttctggggttgggagctttgggccttgtatggtggctgcacagacgcctgcccccccagcccatccgacctctcccgcgcttcgcccccctggttaagaccgagcctcagcggcccgtcaaagaggaggagcccaaaatccctggagacctggaccaggaacccagcctactctacgccgacttggatcatctcgcgttgtctaggccacgtaggctcagcacggccgatccggccgacgcctctaccatctacgcggtcgtcgtttag

SEQ ID NO: 41370 - DNA, 981 bp, Artificial Sequence
  Description of Artificial Sequence: Synthetic coding sequence
atggagttcctgtgggacttcctgaaccaccaggagggcccccggatacgggatcacctttctcatggcgagattaacctgcatgagttcagtaaagaaaccaccaaccaactactggccttctcattggtccttcttctgcgttttgtcgatgactgtctgttgtcagtgtttaaggagaagtcagccgtggagctactcatttccctcgcggaagggtatagcagtagatgtcaccccgtgttccagctgaagaagcaagtattgtcttgcgaggagtctatacgggtctgggctctcttgccatttcccgaggaattgacaagacaagccgtccgcttagaagataatagcgaaacgaacgcgtgtcactccctcatcactaaaatgacagatgaactataccaccatatgccggagaataggtgtgttctgaaggacctggataggctgcctaccgaaacgtggccacagttattgagagagctctgctcaaccccagtgcccacactcttctgtccccggatcgtgctcgaagtgttggtcgttcttagatctattagcgaacagtgccggcgcgtgtccagccaggtgaccgttgccagcgagctccgccaccggcagtgggtggaaaggacactcagatcacgacaacgacagaattacctgcgtatgtggtccagcatcaggctgctgagtccagttctgagtctgattttgctactgatcgcattagaactggtgaacattcatgctgtctgcggcaaaaatgcacacgagtatcagcaatacctcaaattcgtgaaatcaattctacaatacaccgaaaacttagtggcatacacctcttacgaaaaaaacaagtggaatgagaccattaacctaacccacaccgcgctgttgaagatgtggacgttctctgaaaagaaacaaatgctgatccacctcgctaaaaaatccacctctaaggtcctcttgtag

SEQ ID NO: 41371 - DNA, 1896 bp, Artificial Sequence
  Description of Artificial Sequence: Synthetic coding sequence
atggaggtgctgatcggcgaccccatcaccacctgcctgagcccctccgtctatgacatcatatgcaacctgggctttcagttacgcgagaactgcgacattaacagcatcgttactcagaacggggaagtgtgttggaagacaattacggattgtgtgtcctatactgaaagtgaacaaggcttggactactgggggagcgtgaggttgctgggtcctgtttgtgaggccgtccattcccacttcctttccctgacgaagggccagtttgaaatcaggtacgccccatggttccagtggacttcgttcccagagctcttcccagaaattttcgacgctctcgagtccctgcagtctcctgctattagtctcagcttgatgaaactgacatcctgcttggagcgcgccttgggagatgtgtttctcctcattggcaaggagtgtcccttccttctgcgggatctgctctcatcagaggaactcgcccaggtcttttctcagagcgttatgaacgtgttaaaagtgttcgtagggagcccttgtggcttgaacctgcgaaatgtactctggcacggcttcgcctctcccgaagagataccacctaaatactgtagtatgatgatccttctgaccgcgggtcttggacagttgttgaaatcatacctgcagaataccaaactgactctcgcgcacaggagcttcatctccctaaccaacttggaagatctgattgtgtttcccgacgtgacctacgaggtgctgtccgttctggaagaagtcatgatgaagagtgccttcatactgaagataatgctcccctactgggaggttgcactcgttaagttcaaaagccacaggttcgccgattgtgcaattctcctactgactcagttagagactgggctgcgcaacgtctttgctactctaaacagatgtcctaagcgcctgctgaccgcggaatcaaccgctctgtacacaaccttcgaccagatcctcgctaagcatttaaacgacgggaagatcaaccaactgcccctgtttcttggggaaccagcaatggaatttctgtgggatttcctgaaccatcaggaaggcccccgcatcagggaccacctgagccacggcgaaattaacctgcatgagttctcaaaggaaactaccaatcaattgctcgctttctccctcgtgctgctcttacgatttgttgacgattgtctgttgtcggtgtttaaagagaagtcagcagtcgagctgctgatttctctggccgaagggtactcctctagatgccaccccgtgttccagctcaaaaaacaggtgctgtcttgcgaggaaagcataagggtctgggctctcctcccatttcctgaggagctaacccgacaagctgtgcgtctggaggacaattctgagaccaatgcatgccactctctgattactaaaatgaccgatgagctgtaccatcacatgcctgaaaaccgctgcgtcttaaaagacctcgacagactaccgactgagacgccaacaagcgacactcccctcgctctggcacccaggaaacctcagccttgcagatgcaggcggcgtgtccgtccctcaatcagactgctgagtcccgtgctttccctcatcttacttttaatagctttagaattggtcaatatccacgcagtttgcgggaaaaacgcccacgagtaccagcagtatctcaagtttgtgaaaagcatcttgcagtatacagagaacctggtcgcatatacctcctatgaaaagaataagtggaatgaaacgatcaacttgacacacacagccctgctgaagatgtggaccttcagcgagaaaaagcagatgcttattcatctcgccaaaaagagtacatcaaaagtgctcctgtag

SEQ ID NO: 41372 - DNA, 2037 bp, Artificial Sequence
  Description of Artificial Sequence: Synthetic coding sequence
atggaggtgctgatcggcgaccccatcaccacctgcctgagccccagcgtctacgatataatctgcaacctggggttccagctacgggagaactgcgatatcaattctattgtcacgcaaaatggcgaggtctgttggaagaccatcaccgattgcgtcagctataccgaaagtgagcaggggctcgactattggggcagcgtgcggctgctcggcccagtatgcgaagcagtgcattctcatttcttgtctctgacaaaaggccaatttgaaatccggtacgctccttggtttcagtggaccagctttcctgaactgttccccgagatcttcgatgctcttgaatccctgcaatcacctgcaatttcactgtctctcatgaagctgacttcatgtctggagcgagcgctgggcgacgtgttcttgttaattggtaaagagtgtccattccttctgcgcgatttgctcagtagcgaagagcttgctcaggtgttcagccagtccgtgatgaatgtactcaaggtgtttgtggggtctccctgtggcttaaacctgcggaacgttttatggcacgggttcgcttcccccgaggagatccctcccaagtactgctcaatgatgattctgctcaccgcaggactggggcagctgctcaagtcctaccttcagaacaccaagcttactctagcacatagaagtttcatatctctcaccaacctggaagatctgattgtcttcccagacgtaacatatgaagttctgtctgtccttgaggaggtgatgatgaagagtgcctttattctgaaaatcatgttaccttactgggaagtcgctcttgtaaagttcaagtcccatcgatttgccgactgcgccatccttctgctgacccagctggagactggactaaggaatgtctttgctactttaaatcgctgccccaaacgcctgctgaccgctgaatccaccgccctgtatactacattcgaccagattctcgccaaacacctgaatgatggcaaaatcaatcagctaccactctttttgggagagcccgctatggaattcctgtgggacttccttaatcaccaggaaggacctcgcatccgtgaccatctttcccacggcgaaatcaacctccatgaattcagtaaggagacaacaaaccaactcctcgccttcagtttggtgctccttcttcgattcgtggacgattgcctgctatcagtgttcaaggagaagagtgcagtagagttgctgatcagtctagcggaaggctactcgtcacgatgccatcccgtgtttcagcttaaaaagcaagtgctgtcctgtgaagaaagtattcgtgtgtgggcactgctgcctttccctgaggaactgacccgtcaggctgtgcggttggaagacaactcggagaccaatgcatgccacagccttattacaaagatgacagacgaattatatcaccacatgcctgaaaaccgctgtgtcctgaaggaccttgacagactgccaactgaaacttggcctcaactccttcgggagttgtgctcaaccccggtgccaacactcttctgccctcggatagtactggaagtgctcgtagttctccggagtatcagtgagcagtgtcgccgcgttagctcccaggttaccgtagccagcgaacttcgccaccggcagtgggtcgaacgcacgctgaggtcccgccagcgacagaactatctccgcatgtggtcctcgatccgactgctcagtcccgtcctttctttgattctactcctgattgcattggagttggtcaatatccacgccgtttgcgggaagaatgcccacgaataccagcagtacctgaaattcgtcaagagtatcctgcagtacactgaaaatctggtcgcctacacctcatacgagaaaaacaaatggaatgaaacaattaatcttacgcacacagccctgctgaagatgtggacgttttccgaaaaaaagcagatgctcatccatctggccaagaagtcaacatccaaagtcttactctag

SEQ ID NO: 41373 - DNA, 1659 bp, Artificial Sequence
  Description of Artificial Sequence: Synthetic coding sequence
atgaagctgaccagctgcctggagcgggccctgggcgacgtgttcctcctcattggaaaagagtgcccttttttgttacgggaccttctctcctcagaggaactagcacaggtctttagccaatctgtaatgaacgtgctcaaagtgttcgtgggctccccctgcggactgaacttgagaaacgttttgtggcacgggttcgctagccctgaggagatccctcccaaatattgctcaatgatgatcttgctaactgctgggctcggacagcttcttaaaagctacctacaaaataccaagctgacactcgctcacagaagcttcatttctcttacgaacttagaagacctgattgtttttcccgatgtgacctacgaggtgctctccgtcctggaggaggtgatgatgaagagtgccttcatactgaaaattatgctcccttattgggaggtggccctggtcaagttcaaatctcacagatttgctgactgcgccatcttgctattgacccagctggaaaccggcttgaggaatgtcttcgccacactcaacagatgtcctaagcgcctgctgactgccgagagtacagcattatacaccacttttgaccagatcctggcgaaacatttgaacgatggtaaaatcaatcaactgcccctgttccttggcgagcctgcaatggagtttctctgggatttccttaatcaccaagaaggcccgcggataagggatcacttgtcacacggggagatcaatcttcacgagtttagcaaggagacaacaaatcaattactggccttcagtttagtgctcttgttgagatttgtcgacgattgcctgcttagcgtgtttaaggagaaatcagcagtggagttgcttatttctttggccgagggctacagttcccggtgccatcccgtttttcagctgaaaaagcaggtgctatcttgcgaggagtcaattagagtgtgggcactgcttccattcccagaagagctcacaaggcaggccgtgcgtctggaggataattccgagaccaatgcatgtcattctctgattacgaaaatgacagatgagctgtatcaccacatgcctgaaaacaggtgcgtgcttaaagacttggatcgtctgcccacggagacctggccccagctcctgcgcgaactttgctcaacgcctgtccccactctgttctgtccccgtatagttctcgaggttttggtagtgcttagatccatctctgagcagtgtcgcagggtgtccagccaggtcactgtcgcgtccgaattacgtcaccgccagtgggttgagcgcactctacgatctaggcaacggcagaactacctccggatgtggagctctattcggctcctgtcccccgtgctgtctctgattctcttgctcatcgccctggagctggtgaatatccacgccgtgtgtggcaagaacgcccacgaataccagcagtacttaaagtttgtcaagtccatcctccagtatactgagaatttggtggcctacacatcgtacgagaagaacaagtggaacgagaccataaatctcactcacacagcccttctcaaaatgtggacattttcagaaaagaaacagatgctaatccacttggcgaagaagagcactagcaaggtactgctgtag

SEQ ID NO: 41374 - DNA, 1818 bp, Artificial Sequence
  Description of Artificial Sequence: Synthetic coding sequence
atggaggtgctgatcggcgaccccatcaccacctgcctgagccccagcgtctatgatataatatgcaatctgggatttcagctccgggagaactgtgacatcaattcaatcgtcacacagaatggggaagtctgttggaagacaatcacagactgtgtatcctacacagagtcagagcagggcctggactattggggttcagtccgactgctgggccctgtgtgtgaggccgtccattcgcacttcctatccctgaccaagggccaattcgagattagatacgccccttggtttcagtggacgagctttccagagcttttccctgaaatttttgatgcactcgagagcttgcaaagccctgcaattagcttgagcctgatgaagctgactagctgtctggagcgagcacttggtgacgttttcttgctcataggtaaggaatgcccttttttgctgcgcgatctgctatcaagcgaggaactcgcccaagtgttcagtcaaagcgtaatgaatgtgctgaaggtttttgtcggcagcccatgcggactgaacctgcgtaacgttctctggcacgggttcgcatccccagaggaaatcccaccaaagtactgcagtatgatgatcctgctgacagcgggcctcggtcagctacttaagtcatatctacaaaataccaagcttactttggctcatcggtcttttatctctctgacgaacctggaggaccttatagttttccctgacgtgacttatgaagttctctccgtgttggaagaggtcatgatgaagagcgcatttattttaaaaatcatgctgccgtattgggaggtcgcacttgtgaaatttaagagccatcggttcgctgactgcgccatcctgctcctgacccagttggagaccggtctgagaaacgtcttcgcgaccctgaaccggtgtcctaaacgcctccttacggcagaatctaccgcactatacacaacttttgatcagattctcgccaaacacctgaacgacgggaagatcaatcaattgccactcttcctgggggagccggctatggagtttctctgggactttctgaaccaccaagagggcccgaggatcagggatcacctgtcccacggagagatcaacctccatgaattctcgaaggagacaacaaatcagctgctagccttttctctagtgctgctcctccgcttcgtggacgactgcctccttagtgttttcaaggaaaagtcagccgtggaactcctgatatcgttggcagaaggttattcatctcgatgtcacccagttttccagcttaagaagcaggtcttatcctgtgaggaaagcatcagggtgtgggcactgctgccattcccagaagaactgacaaggcaagcagtgcgcttggaggacaattccgaaacaaatgcctgccatagcctaatcaccaaaatgactgatgagctttaccaccatatgcccgaaaacaggtgtgtgctcaaagatttagatcgcttgcccaccgaaactataagacttttgagtccagtcctttctcttatcttgttgctcattgcgctggagttggtgaacatccacgctgtgtgcggtaagaatgctcacgagtaccagcagtacctaaagtttgtgaagagtatactgcagtacaccgagaatctggtggcttacacgtcttatgagaagaacaagtggaacgagacaatcaatttaacacatacagctttgctcaagatgtggacattctctgagaaaaaacagatgcttatacacttggctaagaaatcaacctctaaagttctactgtag

SEQ ID NO: 41375 - DNA, 993 bp, Artificial Sequence
  Description of Artificial Sequence: Synthetic coding sequence
atggagggcgccccccccggcagcctggccctgcggctgctgctgtttgtagcgcttcctgcaagtggttggctcacgactggtgcacctgaaccgcccccactaagtggagctccccaggacggaatccggataaatgtcactactctgaaggatgacggagacattagcaagcaacaggtggtgctcaacattacgtacgagtcaggccaggtttatgtgaacgacttgccggtgaatagtggggtcacacggatctcttgccagacactgattgtcaaaaacgaaaacctggaaaatctggaagagaaggagtacttcgggattgtaagcgtcaggatacttgtacatgagtggcccatgacatctgggtcaagcttacagctcattgttattcaggaagaggtcgtggagatagacggcaagcaggttcaacagaaggatgtgaccgagattgacatcctggtaaaaaaccgtggcgtattaaggcactctaactacacgcttcctttagaagagtctatgctgtatagcataagtcgcgattcggatattcttttcaccctacccaacttgtctaaaaaggaatccgtgtcttctctacagaccacctcacagtacctgatccggaatgtcgagaccaccgtcgatgaagatgttctgcctggaaaactgcctgagacccccctgagggctgaaccgcctagctcctataaggttatgtgccagtggatggaaaagttccgtaaagatctttgcaggttttggagtaacgtatttcccgtgtttttccagtttttgaacatcatggtcgtggggataacaggcgcggcggtcgtcattacaatactcaaagtgtttttcccagtttccgaatataaggggattttgcagctcgataaggtggacgttataccagtaacagccataaatctctacccggacgggccagagaagagggctgaaaacctcgaagacaagacatgtatatag

SEQ ID NO: 41376 - DNA, 396 bp, Artificial Sequence
  Description of Artificial Sequence: Synthetic coding sequence
atgaccagcggcagcagcctgcagctgatcgtgatccaggaggaggtagtggagatagatggcaagcaagttcagcagaaggacgtcaccgagattgatattcttgtgaagaatcgcggtgtactgcgccacagcaactacactctccctctggaagagtcaatgctctacagcatctcacgagactcagacatacttttcactcttcccaacttatcaaaaaaagagtccgtgtccagtcttcaaacaaccagtcagtacctcatcaggaacgtggaaactacagttgacgaagacgtactgccagggaagctccccgagacccctctcagagctgaaccaccctcctcgtacaaggtgctggagacggtagatagcgctcccttccgtctgtag

SEQ ID NO: 41377 - DNA, 378 bp, Artificial Sequence
  Description of Artificial Sequence: Synthetic coding sequence
ctgcagctgatcgtgatccaggaggaggtggtggagatcgacggcaagcaggtgcagcagaaggacgtcacagaaatagacattttggttaaaaaccgtggagtacttcgacatagcaattacacgcttcccctggaggagtccatgctttactcaatctctagggactctgacatcctgttcacgttacccaacctgagcaaaaaagaatccgtgagcagcctgcaaacaacatcccaatacctgattcgaaatgtggagaccacagtggatgaagacgtgctgcccggcaagctgccagagacacctctgagggccgagcctccatcatcatacaaggttttagaaaccgtagactccgctccttttaggctgtag

SEQ ID NO: 41378 - DNA, 1065 bp, Artificial Sequence
  Description of Artificial Sequence: Synthetic coding sequence
atggacttcatcctggaggacatggacctggccgccaacgagatctctatctacgacaaacttagtgagacagtagatttggtccgtcagacaggtcatcaatgtggcatgtcagagaaagccattgagaaatttattaggcagctcctggagaagaacgagccacagagacctccaccccagtaccccctgctgatcgtggtgtacaaggttctggccacactggggctgatccttctgactgcatactttgtgatacagccttttagcccgttagctccggagcctgtgctttcaggagcccacacctggcgcagtctcattcaccacatcagactcatgagtctccccatagcaaagaagtatatgtccgaaaataaaggtgtccccctgcatggcggagatgaggatcggcccttccctgactttgacccctggtggaccaacgactgtgagcagaacgaatcagagcctattcctgccaattgtactggttgtgcacaaaagcatctgaaggtgatgctgcttgaggacgcccctcggaagttcgagaggttgcaccccttggtcataaagactggaaaacctttgctggaggaagaaatccagcactttctttgccagtatcccgaggccacggagggcttttccgaggggttttttgccaagtggtggagatgtttcccagaaaggtggtttcccttcccttatccatggcgcagacccctcaatcggtcacagatgctccgggagctgtttcccgtcttcacccacctgccatttcccaaggacgcttccctgaacaagtgttcatttctacatccagagcccgtagtgggatcaaaaatgcacaagatgcctgacctgtttatcattggttcgggagaggccatgcttcagctgattccaccattccaatgtaggagacactgccaaagcgtggccatgcccatagaaccaggagatatcgggtacgtcgacactacgcattggaaagtttacgtgattgcaagaggggtccagccactcgtgatttgtgacggtaccgctttttccgagttatag

SEQ ID NO: 41379 - DNA, 726 bp, Artificial Sequence
  Description of Artificial Sequence: Synthetic coding sequence
atgagcctgcccatcgccaagaagtacatgagcgagaacaagggcgtgccccttcatgggggcgacgaggaccgccccttcccagactttgacccttggtggaccaacgactgcgagcagaatgagtccgaacctatccctgccaattgcactggttgcgcacagaagcatctgaaagtgatgttgcttgaagacgctccaaggaagtttgaacggctacacccattggtcattaaaacaggaaaacctttgctcgaggaggaaattcagcactttctttgccagtaccccgaggcaaccgaggggttttctgaaggattttttgccaagtggtggcgatgcttcccagagaggtggttcccctttccatacccctggagacggcctttgaacaggtcccaaatgctaagagagctcttccccgtcttcacgcatcttcccttccccaaggatgcctccctcaacaaatgctcttttctccatccagagcctgtagtcggttccaaaatgcataaaatgcctgatctctttattatcggatcgggcgaggctatgctccagttaatccctccctttcaatgcaggaggcattgtcagtccgtagccatgcctatcgagcccggcgacatcggatatgttgacacgacccactggaaggtgtatgttattgcccggggggttcagcccctggtgatctgtgacggcaccgcattcagcgagctctag

SEQ ID NO: 41380 - DNA, 1044 bp, Artificial Sequence
  Description of Artificial Sequence: Synthetic coding sequence
atggacctggccgccaacgagatcagcatctacgacaagctgagcgagacggtggacctggtccggcagacagggcaccaatgcggtatgtctgagaaggcgatcgagaaatttataaggcagctcctggagaaaaatgaaccccagcgcccccctccccagtaccccctgctaatcgtcgtgtataaagttctggccactctaggtcttatactcctaaccgcatactttgtgatccaacctttttcccctctggcccccgagccagttctctccggagcacacacgtggcggagtcttattcatcatatccggctgatgagcctgcccattgccaaaaaatacatgtctgagaataagggtgtgcctctccacgggggcgatgaggatcgcccctttccagatttcgacccatggtggaccaacgactgtgagcagaatgagtcggaacctatccccgcaaactgtaccggctgcgcccagaaacacttgaaggtcatgctgctggaggacgctccgcgaaaattcgaacgcctacacccattggtcataaagaccggtaaacccctcttagaagaggaaatacagcactttctgtgtcaataccctgaagctacagagggatttagcgaggggttcttcgctaagtggtggcgctgttttcccgaacgttggttccccttcccctacccatggcgacggccgttgaacaggtctcagatgctgagggagctgtttcctgtctttacacacttgcctttcccaaaggatgccagcctgaataagtgctctttcctgcaccctgagcccgttgtgggctcgaaaatgcataagatgccggacctttttattatcggctcgggcgaggcgatgttgcagctgattccaccgttccagtgtcgccggcactgccaatccgtggcgatgcccattgaaccgggagacattgggtatgtggacacaacccattggaaagtttacgtgatcgccaggggtgtgcaacctctggtcatttgcgacgggaccgccttttccgaactgtag

SEQ ID NO: 41381 - DNA, 708 bp, Artificial Sequence
  Description of Artificial Sequence: Synthetic coding sequence
atggacttcatcctggaggacatggacctggccgccaacgagatctccatctacgacaagttatccgagactgtagatcttgtacggcagaccggacatcagtgcggaatgagcgaaaaggctattgagaagttcataaggcagctgctagaaaaaaatgagccacagcgcccccccccccagtaccctttgttgatcgttgtctacaaggtcttagccacgctgggcttgatattgctcaccgcctattttgtcatccagcccttttccccacttgcccctgagcctgtcctgtcaggtgctcatacctggagatcactgatacaccatataaggctcatgtccctgccaattgctaaaaagtatatgtcagagaacaagggggttcctctgcacggcggcgatgaggacaggcccttccctgacttcgacccatggtggaccaacgattgcgagcagaatgaatctgagcccatccccgccaactgcaccggatgcgcccagaagcaccttaaggtgatgctgttagaggatgcgccacgcaagtttgagaggttgcatccactcgtgatcaaggagatcgagctttgtactggaaccgcatctcgcgcagagaaccaggtcgagaggggaaagatcaagactaagaccatgaaactcctctcaggcggctggttgctgtcgtatttgcccttcgcatgtatgtag

SEQ ID NO: 41382 - DNA, 726 bp, Artificial Sequence
  Description of Artificial Sequence: Synthetic coding sequence
atgagcctgcccatcgccaagaagtacatgagcgagaacaagggcgtgcccttgcacgggggagatgaagacaggccctttcctgatttcgacccatggtggacgaatgactgtgagcaaaacgagagcgagccaatacctgccaattgtaccggctgcgctcagaagcacctgaaggtcatgctgctggaagatgcgccaaggaagttcgagcggttacatcccttggtgataaaaaccgggaagccattactggaggaagaaatacagcattttctttgtcaataccctgaggcaactgagggcttctccgaagggttctttgccaagtggtggaggtgttttccagaacgttggttccccttcccatatccatggaggcggccgttaaaccgatcccaaatgctcagagagctgttccccgtattcactcatctgcccttcccaaaggatgcatcccttaacaagtgtagctttctgcacccagaacctgtcgtaggaagcaagatgcacaagatgccagatctattcatcattggctccggagaagccatgctccagctgatccccccattccagtgtcgtcggcactgccagtctgtggctatgcccattgagccaggggacatcggatatgttgatactacccactggaaggtctatgttatcgcccgcggcgtacaacctctggtgatatgtgatggtactgcctttagtgaattatag

SEQ ID NO: 41383 - DNA, 705 bp, Artificial Sequence
  Description of Artificial Sequence: Synthetic coding sequence
gacttcatcctggaggacatggacctggccgccaacgagatcagcatttatgacaaacttagcgaaacggtggatcttgtcaggcagacgggtcatcaatgtgggatgtccgaaaaggcaattgagaagtttataagacagctgctcgagaagaacgaaccccaaaggcctccacctcagtatcctcttctgattgtcgtgtacaaagtgctcgccactcttggtctaattctactgactgcatatttcgttattcagccatttagtcccctggcccctgaaccagttctgagcggcgcccacacttggcgatcactcatccatcacatccggctcatgtccctgccgatcgctaaaaaatacatgagtgaaaataaaggcgtgccgttgcacgggggagatgaagataggccatttccggacttcgatccctggtggactaacgactgtgagcagaatgagtctgagcctatcccagctaattgtaccggctgtgcccaaaagcacctcaaagtcatgttgctagaagatgccccgcggaaattcgagcgcctgcatcctctggtgatcaaggagatcgagctctgtaccgggacagcttccagggcggagaatcaagtcgagagaggaaagattaagactaagactatgaaactgctcagcggggggtggctactttcctacttgccttttgcctgcatgtag

SEQ ID NO: 41384 - DNA, 651 bp, Artificial Sequence
  Description of Artificial Sequence: Synthetic coding sequence
atgctggccagccccgcccggcccaccctgcggatgctggccaaccacgcactctctacccctcattgcgcctgcagtcctgcccccgctccacggacagcgtcggcctcccgaagaagatgcgtgccagttgaagctcgtgctgctggggttttcggtgaccggctagccggtgtctttggatctcgcggactgaagcacggcggggtgcaggctccacgaccccgtgttgtacgcgccgaacctagagcaggatttgctgtggtaaggtcgcctaggcggctatgtggaaggagccacgcaccacaaccaccagctcaccttgggctcggaccaggctgttttccagccgtcgctgtggttgtacctgttcctgggagccgggctcaccggccatttgccgccttactggttgaagggagctttctcggcgatccacccatccctccacggaggtctggagtgctagctagaggctccgccggcgccgactgtcttgcctcctccgttactcccggcccatctctgtggattcctctgctgctagtcgccggctgcgtcagctgctttgtgggactggccgtatgcgtctggatgcaagcccgcgtttcacctgcgtggcccgctggcttgtttttgctcccacggtag

SEQ ID NO: 41385 - DNA, 357 bp, Artificial Sequence
  Description of Artificial Sequence: Synthetic coding sequence
atggaggacttcgccacccggacctacggcaccagcggcctggacaatcgacctttgttcggcgagacatcagcgaaggaccgcataattaacctggtagttgggtcgttaactagcctattgatcctcgtgacccttatcagtgcttttgtgttcccacagctgcctcccaaaccactgaacatcttcttcgcagtgtgtatttcgctgagcagtatcactgcatgcatcctgatttactggtaccggcaaggagatcttgagcccaagttcaggaagctgatatactacatcatattctcaatcataatgctctgcatttgtgcaaacctgtactttcatgatgtgggcaggtag

SEQ ID NO: 41386 - DNA, 357 bp, Artificial Sequence
  Description of Artificial Sequence: Synthetic coding sequence
atggaggacttcgccacccggacctacggcaccagcggcctggacaatcgtccactgttcggagaaacctcggcaaaggaccggattatcaacctcgttgtggggagtctgacaagccttctgatcctggtcacccttatcagcgctttcgttttccctcagctacctccaaagccactgaatatatttttcgctgtgtgtatctcactcagctcaatcaccgcttgcatactgatctactggtaccgccaaggtgatctagaacctaaattccgaaagcttatctactacatcatcttctcaattattatgctgtgcatctgcgccaacctctatttccacgacgttggtagatag

SEQ ID NO: 41387 - DNA, 18 bp, Artificial Sequence
  Description of Artificial Sequence: Synthetic coding sequence
atggaggacttcgcctag

SEQ ID NO: 41388 - DNA, 705 bp, Artificial Sequence
  Description of Artificial Sequence: Synthetic coding sequence
atgggccccggcggccgggtggcccggctgctggcccccctgatgtggcgacgagcagtgtcttcggttgcggggagcgcagtaggtgccgagccagggctaagactgctggctgtacagcgtttacccgtaggggctgccttctgcagagcctgtcagacacctaactttgtgagggggctgcactccgagccaggcttggaggagcgggccgagggaactgtgaacgaaggccggcccgagtcagatgctgctgaccacaccggacctaaattcgacatagacatgatggtgtccctgctacgacaggaaaacgcacgcgatatctgtgtgatccaggtgcctcccgaaatgcgttataccgactactttgtcattgttagcggtaccagcacccgccacctgcacgccatggcattctacgttgttaagatgtacaaacatctgaagtgcaaaagagatcctcatgtgaagattgagggaaaggacactgacgattggctctgcgtcgattttggcagtatggtcatccatttaatgttgcctgagaccagggaaatatacgagctggaaaaactctggaccctccggtcttacgatgaccagctggcacaaattgcgcctgaaaccgtgcctgaagatttcatcttgggtatagaggacgacacctcatctgtgactccagtcgagctgaagtgcgaatag

SEQ ID NO: 41389 - DNA, 945 bp, Artificial Sequence
  Description of Artificial Sequence: Synthetic coding sequence
atgttcagcatcaaccccctggagaacctgaaggtgtacatcagcagccgtcccccgctagtagtcttcatgatttcggtgagcgctatggctatagctttcctgactctcggatactttttcaagattaaggaaattaagagtcctgaaatggcagaagattggaatacctttctgctgaggtttaatgacttggatctgtgcgtatccgagaatgagacccttaaacatcttactaacgacacaactacacctgagtccactatgacctccggacaggctagggcctcaactcaaagtccacaggcattggaggactccggtccggtaaatatatcagtgtccatcaccttaaccctagacccacttaagccttttggaggctattcacgtaatgtcacacatctatatagcactatattaggccaccagattgggttaagcggaagggaggctcatgaagagataaacatcaccttcacccttcctaccgcctggagtagtgatgactgcgcactgcacggccattgcgagcaggtcgtttttactgcctgtatgaccctgactgcctcacctggtgtgttcccagtgaccgtgcagccaccccactgtgtgcctgacacctactccaacgccacactctggtataaaatattcaccactgcgcgggatgcaaatactaagtatgcgcaagattacaatcccttctggtgctataagggcgccattggtaaggtgtaccacgccctcaatcccaagctgaccgtaattgtgccagatgacgacagaagtctaattaacctccatttaatgcacaccagctacttcttgttcgtcatggtgattacaatgttttgctatgcagtaatcaaaggcaggccgtctaagcttcgtcaatcaaatcctgaattctgtcctgaaaaggtggccctggccgaagcttag

SEQ ID NO: 41390 - DNA, 219 bp, Artificial Sequence
  Description of Artificial Sequence: Synthetic coding sequence
atgttcagcatcaaccccctggagaacctgaaggtgtacatcagcagtaggcccccactggtggttttcatgataagtgtgtccgccatggcgatcgcatttctaaccctcggctacttttttaagattaaagagataaagtccccagagatggcggaggactggaacacctttctgctgcggttcaatgatttggatctctgcgtatccgagaattag

SEQ ID NO: 41391 - DNA, 285 bp, Artificial Sequence
  Description of Artificial Sequence: Synthetic coding sequence
atgttcagcatcaaccccctggagaacctgaaggtgtacatcagcagtagaccaccgttggtcgttttcatgattagcgtgagtgcaatggccattgcattcctcacacttggctacttcttcaagattaaggagataaaaagccctgaaatggctgaggactggaatacgttccttttgaggttcaatgacttggatctgtgcgtgtctgagaacgaaacactgaagcacctcacaaatgataccacaactcctgagtctaccatgaccagcggccaggcatag

SEQ ID NO: 41392 - DNA, 420 bp, Artificial Sequence
  Description of Artificial Sequence: Synthetic coding sequence
atgttcagcatcaaccccctggagaacctgaaggtgtacatcagcagtaggcccccactcgttgtgttcatgatctccgtgagtgcgatggcaatcgctttcctgacacttggctacttcttcaaaatcaaggagattaaatcccctgaaatggcggaagactggaatacctttctgttgagattcaacgatttagacctgtgcgtgtccgagaatgagaccctgaagcacctaaccaacgatactaccaccccagaaagtactatgacctctggtcaggccagggctagtacccaaagcccccaagccctggaggacagcggtccggtgaacatctcagtctcaattactctcacgctggaccctttaaagcccttcgggggctacagcagaaatgtgactcacctgtacagtacctag

SEQ ID NO: 41393 - DNA, 567 bp, Artificial Sequence
  Description of Artificial Sequence: Synthetic coding sequence
atggccctggccatgctggtgctggtggtgagcccctggagcgccgctcgtggagtgcttaggaattactgggagcggctgttgcgcaaacttcctcagtcgcggccagggtttccctctccaccctgggggcctgccctcgccgtgcagggaccggctatgtttaccgagcccgccaacgatacttcagggagtaaggagaacagtagtttactagacagcattttctggatggctgcccccaaaaacaggaggacaattgaggtgaacaggtgccgaagacgaaatcctcaaaaactgataaaagtcaaaaacaatattgatgtttgtcctgaatgcggtcatctgaagcagaaacacgtgctgtgcgcctattgttatgaaaaagtgtgtaaggagacagctgaaatccgacggcagatcggtaagcaggaggggggtccctttaaagctcccacaatagagacggtggtgctgtatactggcgaaacaccttcagaacaggaccagggaaagcgcatcatcgagagagatagaaaaagaccatcatggtttacgcagaattag

SEQ ID NO: 41394 - DNA, 441 bp, Artificial Sequence
  Description of Artificial Sequence: Synthetic coding sequence
atgatgtggcagaagtacgccggcagccggcggagcatgcccctgggggcgcgaatcttgttccatggtgtgttttatgccggcggctttgccatcgtatactacttgattcagaaatttcatagtcgagccttgtactacaagctggctgtggagcaactgcagagccaccccgaggcccaagaagccctgggccccccactcaacattcattatcttaagctgattgaccgagagaattttgttgacatagtggatgccaagcttaaaatcccagtgtccggaagcaagagcgagggcttattatacgtgcattcatctcggggtgggccattccagaggtggcatcttgacgaggtgttcctggagctgaaagacgggcagcaaatccctgtttttaaactctccggagagaacggagatgaagtaaagaaggaatag

SEQ ID NO: 41395 - DNA, 441 bp, Artificial Sequence
  Description of Artificial Sequence: Synthetic coding sequence
atgatgtggcagaagtacgccggcagccggcggagcatgcccctgggcgccagaattttatttcacggagtattttacgcgggaggcttcgctattgtttactatctgatccagaaattccacagcagagccctttactacaaactggcagtggagcagctgcagtctcatcctgaggcccaggaagctctgggtcctcctctgaacatacattatctcaaactgattgacagagagaacttcgtggacatcgtagatgccaagctaaagatcccggtcagtggctcaaaatcagagggcctgctgtacgtccattcttctaggggcggcccttttcagcggtggcacctggacgaagtgtttcttgagcttaaagatggccagcagatccctgtgttcaagttatctggggagaacggcgacgaggtaaagaaggagtag

SEQ ID NO: 41396 - DNA, 441 bp, Artificial Sequence
  Description of Artificial Sequence: Synthetic coding sequence
atgatgtggcagaagtacgccggcagccggcggagcatgcccctgggggcgcgaatcctgttccacggggttttctacgcgggtgggtttgcaatcgtgtattatttaattcagaaattccacagtagggcactttactataagttggcggtcgagcagctgcagtctcaccccgaagctcaggaggctcttggaccccccctcaacatccactatctgaagctgatagatagggaaaactttgtcgacatcgttgatgccaagctgaagattcccgttagtggcagcaaatctgagggactcctctacgtgcattccagccgtggtgggcccttccaaaggtggcacttggacgaggtgtttctggaattaaaggatggccaacagatcccagtgttcaagctctctggggaaaatggcgacgaggtcaagaaggaatag

SEQ ID NO: 41397 - DNA, 441 bp, Artificial Sequence
  Description of Artificial Sequence: Synthetic coding sequence
atgatgtggcagaagtacgccggcagccggcggagcatgcccctgggggccaggattctcttccacggcgtgttctacgccgggggatttgccatcgtctattatctaattcagaagtttcattcccgcgccctctactacaagttggcagtggagcagttgcagtctcatcctgaggctcaggaggcgctcgggccgcctttgaacattcactacctgaagcttatcgacagggagaattttgtcgacattgtggatgcaaagttgaaaatcccggtgagtgggagcaaatccgaggggttactatatgtgcattcatcacgaggcggtccttttcaacgctggcacctcgacgaagtcttcttggagctaaaggatgggcagcagattccagtgttcaagctctccggtgaaaatggtgacgaggtaaagaaagaatag

SEQ ID NO: 41398 - DNA, 342 bp, Artificial Sequence
  Description of Artificial Sequence: Synthetic coding sequence
atgatgtggcagaagtacgccggcagccggcggagcatgcccctgggggcccgcattttgtttcatggagtgttttacgctgggggctttgcgatcgtgtactacctgatacagaagttccactcacgggccctttattacaaactcgccgttgagcagctgcagtcccacccagaggcccaagaagctctggggccccctcttaatatccattatcttaaactgatcgaccgggagaatttcgtggatattgtcgatgctaagctcaaaatccctgtatctggcagcaagtcggaagggctgttgtacgtacactcctcacggggggggcctttccaatag

SEQ ID NO: 41399 - DNA, 267 bp, Artificial Sequence
  Description of Artificial Sequence: Synthetic coding sequence
atgatgtggcagaagtacgccggcagccggcggagcatgcccctgggggcccgaattctgttccatggagtgttttatgctgggggttttgctattgtgtattacctgattcagaaattccattcacgtgcgttgtactataaactagccgtggaacaactgcagtcacacccagaggcccaagaagcccttggtcctccgttaaatatccactacctgaaactgattgatcgcgagaacttcgttgatatcgttgatgcaaaatag

SEQ ID NO: 41400 - DNA, 441 bp, Artificial Sequence
  Description of Artificial Sequence: Synthetic coding sequence
atgatgtggcagaagtacgccggcagccggcggagcatgcccctgggagcaaggatactgtttcacggagtgttttacgcaggtggcttcgccatagtctattatcttatccagaaattccattcaagggccctgtattataagttagccgtggaacagcttcagtctcaccccgaggcgcaagaggctctgggaccccccttaaacatccattatttgaaactaattgaccgagagaactttgtggacattgtggatgcaaagctcaagattccggtctccggctcaaagtcagagggtcttctgtacgtgcacagtagtaggggaggaccatttcaacgctggcacctggatgaggtctttttagaactcaaagatggacaacaaatccccgtgtttaagttatccggggaaaacggtgatgaggtcaagaaggaatag

SEQ ID NO: 41401 - DNA, 441 bp, Artificial Sequence
  Description of Artificial Sequence: Synthetic coding sequence
atgatgtggcagaagtacgccggcagccggcggagcatgcccctgggagcaaggatcctgtttcacggcgttttctacgcagggggctttgccatagtgtactacctgatccagaagttccactctagggcactgtactacaaactggccgtggagcaattacaatctcaccctgaagcacaggaggctcttggcccccccctaaacatccattatctcaaactgatcgatcgggaaaactttgtggatattgtggatgccaagctcaaaatccccgtgagtggatctaagtctgaagggctcctttatgtgcatagttcacgaggcggtccttttcagcgttggcacttggatgaagtgtttttggaactgaaggacgggcagcagataccagtgtttaagttatccggggaaaacggagatgaggtgaaaaaagaatag

SEQ ID NO: 41402 - DNA, 441 bp, Artificial Sequence
  Description of Artificial Sequence: Synthetic coding sequence
atgatgtggcagaagtacgccggcagccggcggagcatgcccctgggcgctaggatcctctttcacggggtattctacgcagggggattcgccatcgtgtactaccttatccagaaatttcatagccgtgctttgtactataaactagctgttgagcaactgcagtcacatcccgaggcccaggaagctcttgggccacccctcaacatccattatctgaaattgatcgaccgggagaattttgtagacatcgttgacgcgaaattgaagattcctgtgtcaggatccaagtctgagggcctgctgtacgtacattcgagccgggggggaccattccagcggtggcacctggatgaagtcttcctggagctgaaggacggacagcaaatcccagtgttcaagttgtccggcgagaatggcgatgaggtgaagaaagagtag

SEQ ID NO: 41403 - DNA, 735 bp, Artificial Sequence
  Description of Artificial Sequence: Synthetic coding sequence
atgggcgacctgttcagcctgttctgggaggtggaccccccccccatacctgtaaattgtgcaattccaaatcaagactatgaatgctggaaggacgattcttgtggtacgatcggttcattcttactctggtatttcgtaatagtgtttgtcctcatgtttttctctcgagcctctgtgtggatgtcagaggataaaaaagatgagggctccgggaccagcacttcagtgaggaaagctagcaaggaaacctcatgcaagcggcagtctaaggattctgcctgggatccttctcaaacgatgaaaaaacccaaacagaatcagctgaccccggtcaccaactccgaagtggccctggtcaacgcgtaccctgaacaaagacgcgcgagaagacagtctcaatttaacgaggtgaaccagaatcagcacgattccgatactactgagtacggaagtgaagagtctaattccgaggcatcctcttggaaggagtcagaaagcgagcatcatcccagcccggacagcatcaagcgtagaaagatggcccagagacagagaaacctcgggtcgtaccagatgtctgagagacactgtctccactgcaaggcgctgcgaacaaatgagtggctagcccatcattcaagacaaaagccatctgtcacgcccccaatgaagcgggactcacaggaggagagctcaatatccgacattaacaaaaaattcagcaaattttag

SEQ ID NO: 41404 - DNA, 396 bp, Artificial Sequence
  Description of Artificial Sequence: Synthetic coding sequence
atgacccacagcagccaggacaccggcagctgcggcatccaggaggacggtaaactatatgtggtggacagcatcaacgatcttaacaaattaaatttgtgcccagccggctcacagcacctcttcccgcttgaggataaaatccctgtgctcggcaccaactccggtaatggatcccgttctttattcttcgtcggcttgttaatcgtactcattgtttcactggccctggttttttttgtaattttcctgattgtacaaactggtaacaagatggacgacgtgagccgaaggttgacagctgagggcaaagacattgatgatttgaagagaataaacaacatgatcgtgaagagacttaaccagctgaatcagcttgactctgaacagaactag

SEQ ID NO: 41405 - DNA, 180 bp, Artificial Sequence
  Description of Artificial Sequence: Synthetic coding sequence
atgacccacagcagccaggacaccggcagctgcggcatccaggaggacggaaagttgtatgtagtcgacagcattaacgatctcaataaactgaacctctgccctgccggtagccaacatctatttctgctaagacaatcctctaagaactttcccaagcgttcgaaggagatcgcttag

SEQ ID NO: 41406 - DNA, 396 bp, Artificial Sequence
  Description of Artificial Sequence: Synthetic coding sequence
atgacccacagcagccaggacaccggcagctgcggcatccaggaggacggcaaactgtacgtggtcgatagcatcaacgatctgaataagctgaacctgtgccctgccggttcgcagcacctcttccccctggaagacaaaatcccagtcctgggcaccaatagtggaaacgggtcccggtcactcttcttcgtgggccttttaattgtcttaattgtctccctggccctggtttttttcgtgatttttctcatcgtccaaactgggaacaaaatggatgacgtgtccaggcgccttacggcagagggaaaagatatcgacgatctgaaacgcatcaacaacatgatcgtaaagagattgaaccagttaaaccagcttgatagcgaacagaactag

SEQ ID NO: 41407 - DNA, 342 bp, Artificial Sequence
  Description of Artificial Sequence: Synthetic coding sequence
atggccgccctgggcagccccagccacaccttccggggcctgctgcgagaactaaggtacttgtccgccgccacgggcagaccgtaccgtgacaccgcagcctaccgctatttagttaaggctttccgcgcacacagagtcaccagtgaaaagctgtgtcgcgcccaacacgagctgcattttcaagcagcaacttacctctgcctgctccgtagtattcgcaagcacgtcgccctgcaccaggaattccacggtaaaggcgaaagaagcgtggaggagtctgcaggactggtgggcctcaaactcccccaccaaccagggggcaaagggtgggaaccttag

SEQ ID NO: 41408 - DNA, 3081 bp, Artificial Sequence
  Description of Artificial Sequence: Synthetic coding sequence
atggtgtgccggcccgtgttcccctgccggcggcggttctgcccccgaccgttcctggtcgggctcgtggtagctatatgtttattctaccagacacttacccttcggggctctcggaagctcactgctgccgccccaggcgccgtgccacatacttcaactgaaacgcaagcttcccggtgcaaaaaaggcttctctcaagacaaacaatgtttccttctgtcagggaacgcacaagagactcggaaagtgaaagaatctatggaaacccacttcggaagccacggccgcagagctatcctgtacaggcctcccttttattcaaaaaccgagctgcagttacaccaacacatcctgacacagcacggttacactgtcgtgattgctgaggaaaggcttaacgctggcctgggacccggccttctggagcagggcgacctgggttcctgggaccttttaatatgcttgagttccaagaaggcagaaggaaccccttgtatctccaaagaagtgatgtgtcaattaggactacaccagaaagcaaatcgcctccccgaaatccaacaacccctgtgtcgcaaagaggggttatgccagattgtgaggcggtttcctgaattgcagctgcccgtctctccaagtgtctgtctggaccaaggtatgcagctgaagcctagcactagctctcatctgcttaaaacagtgaaaccaagagtttggaaacccggggactggtccagagagcagcttaatgaaaccaccgtgctagcgccccatgagaccatatttagggcagaggacttgagtgtgatactgaaagcctacgtcctggtgaccagtctgacacccctccgcgcctttatacacagtacagggaccgtgtggaacccccctaagaagaagcggttcaccgttaaactgcagacttttttcgagaccttcttaagggcatcatccccacagcaggctttcgatatcatgaaagaggcaatcggcaaactgctgttagctgctgaagtgttcagcgagacaagcactttgggaccaaagacctttcatcgctgtagattttgtttccagctgcttacctttgatatcggatatgggtccttcatgtatccggttgtcttacaagtccacgagcacctgaactttcaggactatgacaacatggactttgaggatcagaacactgaagagtttctcttgaatgatactttcaatttcctgtttcccaacgagtcttcattatctattttcagcgagatttttcagaggctatacagaagtgatgttttcaagggcgaaaactaccagaaagaactcaaccagtgtctcagccttgaggaaataaactctataatgactttcataaaggagctcgggagtctgggccagtttcagctcttgttcccgagtaccacaccaggcatccagagtctgatgcatgaattttacgacgtggcgaatcccgtaggcaacccaggcagcgtgcttacgcagtactggagcttgctaaatgtcttcgaacagttccagttcatgaataagaagacccagccccaccctctggaatggaactcatttacagaagataagaacattgagaaaccccaggttcccttcgacgctatcgaaaacaaaaaagccgcagtaccacagatcaaaaatgagaataaagaaatacactgttcagatgatgaaaacacaccctgccacattaagcagatatttacacaccctcatctggaactgaatcctgatttccacccaaagatcaaggattattattgcgaggtcccatttgatgtcgtgactgtgaccatcggcgtggagacacctaagtgcctgtgcaaggtacacttgtacgaacaggcaggccctagctttgcaagctaccccctgggcttgggcatgaataaaatatccatcttcgtcgtggatgaaagtcccgctcacggcgagacactcatcacgtacaagctcactatctacagagaagatcgcccatcacttccccttttcgaagcgtttacagcctgtgggttcgttcaggactgtggtcttttaatccaccctgaagagacctgtggtctgcagcctattagctctgactatattgaagcaatccttcagagtgaacttaagagatgtccaagcggcgacatgaagggccagtggatcgtgccctgtcttagttgctctgacaaccggacttgcgattggcgcgagatcacatggcaaccgcataattgccagtacggcgtcctgacaaaaccccagttacagcagtgtcttggcggtcgcaaaatcctgttcatcggagatagtacaaatcggggcatcatgtattaccttatcgagcgcttgaacgagaccctgcaggaatggcagaaggtgcatgggacaaaattttatcacaatgtgaacggtggcaaaacactaattagctattcttactacccgcagttctggataagtccctcattgagacctacctttgagaacgccctggaacaccttctacaaaggagtaggcccctggagaatacagggcagactgtcctggtggtaggtggagtacagtggctcaattctaatcacctgcagataatccacaaagtgctgaagcgggaaaatctcctcaacatccttgtaataattaagactttaggtatcggattccacctacccgtggacggggtccattttctcacccaatctgaagtccagaatctctggaaggaaaatctgatcatactggataccgcaaaaaagcacggctatgaggttgtggataccttcaccatcaccatgggaaggtacaaggaattccttcagggtaagtgcggctgccactttcacgaggtggttaagagtaaactctcaaaagagtacaactttatcaaaatgaaaaggtcacggaatcatattatggggcgatacttcagtaatcagagcaaactgcagcaggggacagtgactaattttagatccccatatcacgtgagggggcctattaaccaggtgtgctccgagatcctgctctcaagaatgtgtgctaacaaacgcacaatgtag

SEQ ID NO: 41409 - DNA, 609 bp, Artificial Sequence
  Description of Artificial Sequence: Synthetic coding sequence
atggtgtgccggcccgtgttcccctgccggcggcggttctgcccccgccctttcctggtgggtctcgttgtcgcaatttgcctgttttaccagactctcacactgaggggatctaggaaactgacagctgctgctcctggggcagtgccacacacttcaacagaaacacaagcttccagatgcaagaaggggttctcacaagacaaacagtgcttcttgctgtctggcaacgctcaagagacacggaaggtgaaagaaagcatggagacacattttggctcccatggaaggcgtgctatcctgtatcggccgccattctatagtaagactgaacttcagttacaccagcacattctgactcagcatggctacacagttgtgatagcagaagaacgattaaacgcaggattgggccccgggctgctggaacagggcgatctaggttcttgggatttgcttatctgcctatcttcaaagaaggctgagggtactccctgcatttccaaggaagtcatgtgccaactgggcctccaccaaaaacagctccgtcgccgcgaggagcggcagagacctggttcacccgcttcccgcagactgtctgtgcggtag

SEQ ID NO: 41410 - DNA, 1650 bp, Artificial Sequence
  Description of Artificial Sequence: Synthetic coding sequence
atggtgtgccggcccgtgttcccctgccggcggcggttctgcccccgtccctttctggtgggattggtcgtagccatctgccttttctatcagaccctcacgcttcgcggtagccggaagctgacagccgcggctcctggagccgtgccgcacacatcaacagaaacgcaggcttccaggtgtaaaaaggggttttcacaagacaaacagtgcttcctgctgagtggaaacgcccaagagactcgcaaggtgaaggagtccatggaaacccattttggatcacatggccgaagggcaattctttatcggcctccgttctactccaaaaccgagctgcaactccatcagcacattctgacacagcacgggtatacagtcgtaattgcagaggaacgccttaatgcaggcttgggccccggtcttctggagcagggcgacctgggaagttgggatctgctgatctgtctgtccagtaaaaaggcggaagggacgccttgtatttccaaggaagttatgtgtcagctcggcctacaccagaaggctaaccgactgcccgagattcagcagcccctctgccggaaggaaggactgtgtcagattgtaaggaggtttcccgagcttcagttaccagtaagcccatctgtctgccttgaccaaggcatgcagctcaagccttctacttccagccatctcttgaagaccgtgaagcctagagtgtggaagcccggcgattggtctagagaacagctcaacgagacaacagtgctcgccccccatgagactatctttagggccgaggacctgtctgtgatactcaaagcctacgtgcttgttacgtcactaacacccctgcgcgcatttatccattctaccggaaccgtatggaacccccctaaaaagaagcggttcaccgtcaagctccagacatttttcgaaacattcctacgcgctagcagcccccaacaagccttcgacatcatgaaggaggctataggtaagcttctgctcgccgcagaggtgttttccgagacaagcacactcggccctaaaaccttccacagatgccgattctgctttcagctgttgacatttgacatcgggtacggatccttcatgtacccggtggtgctgcaggtgcacgaacacctgaactttcaggactacgacaacatggactttgaagaccagaataccgaggagttcctgcttaacgataccttcaactttctgttccccaatgaatcaagcctgtctatctttagtgagatctttcagagactttatcgttccgacgtgtttaagggggaaaactaccaaaaggagctaaatcagtgtttgtcactggaagagattaattctattatgacgtttatcaaggagctgggatccttgggccaattccaactgctgttccccagtaccaccccgggaattcagagcctgatgcacgaattttacgacgtagccaacccagtcggtaatcctggctcggtcctgacccagtattggtccttattaaacgtgtttgaacagttccagttcatgaacaagaagacgcaaccccacccgctcgagtggaatagtttcaccgaggacaagaacattgaaaagccccaagtaccctttgatgccattgagaacaaaaagtag

SEQ ID NO: 41411 - DNA, 2352 bp, Artificial Sequence
  Description of Artificial Sequence: Synthetic coding sequence
atggtgtgccggcccgtgttcccctgccggcggcggttctgcccccggcccttcctcgtggggctcgtcgtggctatttgcttgttttaccagacattgaccctgcgggggtctaggaaacttacagcagctgcaccaggagcggtgccacacacatcaacagagacgcaggccagtagatgcaaaaaggggttcagccaggacaagcagtgctttctgctaagtggcaacgcccaggaaacacgcaaggtgaaagaaagtatggagactcacttcgggtcacacggcagaagagccatcttgtatagacccccattttactcgaagacagagctccagcttcaccaacacatacttacgcaacatggttacaccgtggtgatcgccgaggaacgactaaacgccggcctgggaccaggcctgctggagcaaggagatctcggttcttgggacctactaatctgcctttcctccaaaaaagccgagggtactccctgcatctctaaggaggtgatgtgtcagctcggactgcaccaaaaggctaacagactgccagaaattcaacagcctctgtgcaggaaggaaggactgtgtcagattgtgagaagattcccagaactgcagctccctgtgtcaccatccgtgtgcctggatcagggcatgcagttgaagccatccacaagtagccacttgctgaagacagtgaagccccgagtgtggaaacccggagactggtcccgcgagcagctcaatgagacaaccgtgctggcacctcatgaaaccatattcagggccgaagatctgtctgtgatactgaaagcatatgtgctcgtaactagcctcacacccctgagggcattcattcactcaacaggcactgtctggaatccacccaagaagaagcgattcaccgtaaaacttcaaacgttctttgaaacattcttaagagcatctagtccgcagcaggccttcgatataatgaaggaggcgatagggaagctgctgcttgctgccgaagtattctcagagactagtaccctcgggcccaagactttccaccggtgtaggttttgttttcagctgctgacattcgatataggatacgggagttttatgtatcccgttgtcctgcaagtgcacgaacatctcaacttccaggattacgacaacatggactttgaggatcagaacactgaagagttcctgctgaacgacacgtttaattttctgttccctaacgagtcttcgctcagcatattttccgaaatcttccagcgactgtatagaagcgacgtctttaaaggtgagaactaccagaaggagttgaatcagtgtctgtccctcgaagaaatcaactccatcatgacctttataaaggaattgggctccctggggcagttccagctgctgttcccatccacaacgccaggaatacagtccctgatgcacgaattctatgacgtggcaaatccagtcggcaacccaggttcagtcctcacccaatattggtcactgttgaatgtttttgaacagttccaatttatgaataagaaaactcaaccacatccgcttgagtggaacagtttcaccgaggacaaaaacatcgaaaagccgcaagttcccttcgacgccatcgaaaacaaaaaagccgccgtgccccaaataaaaaatgagaacaaggaaattcactgctctgacgatgaaaataccccttgccatataaagcaaattttcacccatccacatctggaactgaatccagattttcaccccaagatcaaggattattattgcgaggtgcccttcgacgtggtgaccgtgaccattggtgtagaaactccaaagtgcttgtgcaaagttcacctttacgaacaggccggtccgagtttcgcttcatacccccttggactgggcatgaacaaaatttcaatattcgttgtcgacgagagcccggctcacggggagacattgataacctataagcttacaatctatcgtgaggaccggccttcattgccgctatttgaagcttttaccgcttgcggattcgtgcaggactgcggcctgctgattcaccccgaagagacttgcgggttgcagcctatctcctcggactacatcgaagccattctgcaaagcgagcttaaaagatgtccatcaggcgatatgaaaggacagtggattgttccatgcctgtcttgcagcgataatcgcacatgcgattggagagaaatcacctggcagcctcataactgtcagtatggtgtgctgacaaaaccacagctgcagcagtgtttaggtggacgcaagttgggcgtagatgtgcagagggtgcctagatcacgcaactag

SEQ ID NO: 41412 - DNA, 348 bp, Artificial Sequence
  Description of Artificial Sequence: Synthetic coding sequence
atgatggccgtgatgacccccagcgacggcctgagccagctgagcgtaccacatctgacacaccaacgtctgtggtccctctcctgcctcgccatgctgttccaggcagttctgatcctatccgccccccaaatgagctgtctgctgaagtgcttctatgctcttgatcccctccacccagttatgtccgaagaattttcagcccagtacaggcacatgatggaccagagatacagaactaggatacacgagggatacattagtcaggttaagggcgcatacctgcgcattgtgcacaagaaacccatctcctatgcgaagagcttcccgaaggagatgggaaactag

SEQ ID NO: 41413 - DNA, 300 bp, Artificial Sequence
  Description of Artificial Sequence: Synthetic coding sequence
atgggcgagtgcccccacctggtggacgtgcggctgggccaccggagcctggccacaggacctgagcagtccgacatctgccacacagggtccgaggccagatggaccaccacatggtatgggtccctctccttcagtcgccataagtacaagatgctggccgacctcacccctggggtggaaatgagctgccgccactgggcgcggtggctcacacctgttattcccgctctgtggaaagccgaggctggcggcctccccgagttgaggtccagtagacccgcttggacaacgtggtag

SEQ ID NO: 41414 - DNA, 324 bp, Artificial Sequence
  Description of Artificial Sequence: Synthetic coding sequence
atggccggcggctacggcgtgatgggcgacgacggcagcatcgactataccgttcatgaggcatggaacgaggccactaatgtgtatctgattgtgattttggtgagcttcgggctctttatgtatgccaagaggaacaaaagacgcatcatgagaatcttctcagtgcctcccaccgaagagacattgtcagagccaaacttttatgatacaatctcaaaaatccgcttacggcagcagcttgaaatgtacagcatctctaggaagtacgattaccagcaacctcagaatcaggctgacagcgtccagctgagcctggagtag

SEQ ID NO: 41415 - DNA, 324 bp, Artificial Sequence
  Description of Artificial Sequence: Synthetic coding sequence
atggccggcggctacggcgtgatgggcgacgacggcagcatcgactatacggttcacgaggcctggaacgaggctaccaacgtgtacctcattgtcatcctggtgagtttcggactgttcatgtacgcaaagaggaataaaaggaggataatgcgaatcttcagcgtgcctccaacagaggagacgttgagcgaacccaatttttacgatactataagcaaaatccgcctgcgtcaacagcttgaaatgtattccatcagtaggaaatacgattaccagcagccccaaaaccaggcggactcagtccagctgagcttagagtag

SEQ ID NO: 41416 - DNA, 324 bp, Artificial Sequence
  Description of Artificial Sequence: Synthetic coding sequence
atggccggcggctacggcgtgatgggcgacgacggcagcatcgactatactgtgcacgaagcctggaatgaggccaccaacgtttacttaatcgtcattctggtctcttttggccttttcatgtacgcaaaacgtaataagcgccgcattatgcggattttctctgtgccccctacagaggagacccttagtgagccgaacttttacgacacaatatccaaaattaggctgcggcagcagctcgaaatgtattccatttccaggaagtatgactaccaacagcctcagaaccaggctgactccgtccagctgagtctggaatag

SEQ ID NO: 41417 - DNA, 324 bp, Artificial Sequence
  Description of Artificial Sequence: Synthetic coding sequence
atggccggcggctacggcgtgatgggcgacgacggcagcatcgactacaccgtgcatgaggcctggaacgaagccactaatgtgtatttaattgtcatcttagtttccttcggcctgttcatgtatgccaagagaaacaaacgccggattatgaggatcttctctgtcccacccaccgaagaaacgctgtcagaacctaacttctacgataccatttctaagatccgactaaggcagcagctggaaatgtactcaatttctcgtaagtatgactaccagcagccccagaatcaggccgactctgtgcaactaagcctggagtag

SEQ ID NO: 41418 - DNA, 324 bp, Artificial Sequence
  Description of Artificial Sequence: Synthetic coding sequence
atggccggcggctacggcgtgatgggcgacgacggcagcatcgactacaccgtccatgaggcttggaacgaagcaacaaacgtctatctgattgttattctagttagtttcggccttttcatgtacgccaagcgaaacaagaggaggatcatgaggattttcagcgtgccacccaccgaagagaccctgagcgagcctaacttttatgatacaatatccaagatacggctccgccagcagctcgagatgtactcaatttcacgcaaatatgactaccagcagccccagaatcaggccgattcagttcagctgtctctggagtag

SEQ ID NO: 41419 - DNA, 651 bp, Artificial Sequence
  Description of Artificial Sequence: Synthetic coding sequence
atgtggcccccctgcggcaccctgcggaccctggccctggcccggtcgcggggggctcgtgcctgttcaggcgacggaggcgtgagctatacacaagggcaaagccccgagccacgtacacgtgaatatttctattacgtggaccatcagggccaattgttcctcgacgattctaaaatgaagaactttatcacatgcttcaaagatccacaattcctcgtgacgttcttttctaggctccggccaaatcgcagcggacgctacgaagctgcattccccttcctctcaccctgtgggagagagcgcaattttctgcgatgtgaggacagacctgtggtgttcacccacctgttgactgctgatcacggtcctcccagactctcgtactgcggtggaggcgaggcattggccgtgcctttcgagccagcccgcctactccctcttgccgctaacggcaggctgtatcatcctgcgccagaacgcgccggaggtgtcggcctcgtgaggagtgcactggccttcgagctgtcagcctgtttcgagtatggccccggcgctcctgccctgcctagccacgtgcgctggcagggtcgacggctggccctgacaatggatttggctccattgttgcttgcagcgcggtctccctag

SEQ ID NO: 41420 - DNA, 261 bp, Artificial Sequence
  Description of Artificial Sequence: Synthetic coding sequence
atgggccggaaggacgccgccaccatcaagctgcccgtggaccagtaccgaaagcaaattgggaaacaggactataaaaagaccaaaccaatcctcagagccaccaaacttaaagcagaggccaaaaaaacagctatcggcatcaaggaagtgggactggttttggctgccattctagctctcctgctcgctttctatgcctttttttacctccgccttacgaccgatgtcgaccccgatctagatcaggatgaagactag

SEQ ID NO: 41421 - DNA, 228 bp, Artificial Sequence
  Description of Artificial Sequence: Synthetic coding sequence
atgggccggaaggacgccgccaccatcaagctgcccgtggaccagtataggaagcaaattggcaaacaggactacaagaaaacaaagcccatactgcgagcaactaagttgaaagcagaggcgaagaaaacggcgattggcatcaaggaggtcgggcttgtactagccgccatcctggcactgttgctcgcattctatgcatttttctacctcagactgactacatag

SEQ ID NO: 41422 - DNA, 261 bp, Artificial Sequence
  Description of Artificial Sequence: Synthetic coding sequence
atgggccggaaggacgccgccaccatcaagctgcccgtggaccagtaccggaagcagatcggaaaacaggattataaaaagacaaagcccattctgcgggctacgaaactgaaggcagaagcaaaaaagacggctattggtatcaaagaagtggggctggtcctggcagccattctagcgctcctcctggccttttacgccttcttctatttaagactgactactgacgtcgatcctgatctcgatcaggacgaagattag

SEQ ID NO: 41423 - DNA, 261 bp, Artificial Sequence
  Description of Artificial Sequence: Synthetic coding sequence
atgggccggaaggacgccgccaccatcaagctgcccgtggaccagtaccggaagcagattggaaagcaggattataaaaagactaagcccattctgagagcaactaagctcaaggctgaagccaaaaaaaccgctattggtatcaaggaggtgggcctggttttagcggctattttagcactgttactggcattttacgcatttttctacctgcggctgactaccgacgtggaccctgacctagaccaagatgaagactag

SEQ ID NO: 41424 - DNA, 261 bp, Artificial Sequence
  Description of Artificial Sequence: Synthetic coding sequence
atgggccggaaggacgccgccaccatcaagctgcccgtggaccagtaccggaaacagatcggaaaacaagactacaagaaaaccaagccaattcttagggctacgaagcttaaagctgaggcgaagaagactgccatcggaatcaaggaggtgggcttggtcctggccgccattctcgccctgctcctggccttttacgcctttttttacctgcgtctcactaccgacgtcgatccagacctcgatcaggatgaggattag

SEQ ID NO: 41425 - DNA, 261 bp, Artificial Sequence
  Description of Artificial Sequence: Synthetic coding sequence
atgggccggaaggacgccgccaccatcaagctgcccgtggaccagtaccgaaagcagattgggaaacaagactataaaaaaacaaagcctatcctgcgggcgacgaaactcaaagctgaggccaagaagacggccattggcattaaggaggtgggtcttgtcctcgctgctatactggctctgctactggctttttacgcgttcttttacttgagactgaccactgatgtcgatcctgaccttgaccaggacgaagactag

SEQ ID NO: 41426 - DNA, 261 bp, Artificial Sequence
  Description of Artificial Sequence: Synthetic coding sequence
atgggccggaaggacgccgccaccatcaagctgcccgtggaccagtataggaaacagataggcaaacaggactataagaagacaaagcctattctccgcgcaacaaagctcaaagccgaagcgaagaaaacagctatcgggatcaaagaggtgggactggtgctggcagcaattctggccctacttctggccttttatgcttttttctacctgagactgaccactgatgttgatcctgatcttgaccaggacgaggactag

SEQ ID NO: 41427 - DNA, 261 bp, Artificial Sequence
  Description of Artificial Sequence: Synthetic coding sequence
atgggccggaaggacgccgccaccatcaagctgcccgtggaccagtacagaaagcagatcggaaaacaggactacaaaaagacaaaaccaatcctgagagcaacgaagcttaaagcggaggccaagaagaccgccattggtatcaaagaggtgggacttgtcctggccgccatactggcccttctgttagccttctacgcttttttctacttgcgcttaactaccgacgtggatcctgacctggaccaagacgaggactag

SEQ ID NO: 41428 - DNA, 27 bp, Artificial Sequence
  Description of Artificial Sequence: Synthetic coding sequence
atgggccggaaggacgccgccacctag

SEQ ID NO: 41429 - DNA, 261 bp, Artificial Sequence
  Description of Artificial Sequence: Synthetic coding sequence
atgggccggaaggacgccgccaccatcaagctgcccgtggaccagtatagaaaacaaatcggaaaacaggattacaagaaaacgaaacccattctgagagcaactaaacttaaggctgaagcaaagaaaacggccatagggataaaagaggtgggcctggtactggccgctatattggcccttctgctggcattttatgcttttttttaccttcgactgaccacggacgttgatccagatctagatcaagacgaggactag

SEQ ID NO: 41430 - DNA, 261 bp, Artificial Sequence
  Description of Artificial Sequence: Synthetic coding sequence
atgggccggaaggacgccgccaccatcaagctgcccgtggaccagtatcgcaaacagattggaaagcaggactataaaaagactaagcctattctgcgggccaccaaactgaaagccgaggcaaaaaagactgctatcggaataaaagaggtcggactagttcttgctgcaatactcgctcttctgctggcattttacgccttcttttatctccggctgaccactgacgtcgatccggatctcgaccaggacgaggattag

SEQ ID NO: 41431 - DNA, 384 bp, Artificial Sequence
  Description of Artificial Sequence: Synthetic coding sequence
atgaacttcatcctgttcatcttcatccccggcgtgttcagcctgaagagttccactcttaagcctacaatagaggccctgcccaacgtgctgccactaaatgaagacgttaataaacaggaggagaagaacgaagaccatacgcctaactacgccccagccaacgagaagaacgggaattattacaaagatataaaacagtacgtgtttaccacccagaacccaaacggaacggaaagcgagatttctgtcagggcgaccactgacctcaattttgcattgaagaacgacaaaactgtcaacgctaccacttatgaaaagtccactatcgaggaggagacaacaacttcagagccgtcccataaaaacatccaatctatctag

SEQ ID NO: 41432 - DNA, 885 bp, Artificial Sequence
  Description of Artificial Sequence: Synthetic coding sequence
atgaacttcatcctgttcatcttcatccccggcgtgttcagcctgaaatcttcaacactgaagccgacaattgaagctttgcccaacgttctaccactgaatgaggacgtgaacaaacaggaggagaaaaacgaggaccatactccaaactacgcgccagccaacgaaaaaaacggcaattattacaaggatatcaaacagtatgtgttcacgacccagaaccccaatggcacagaatccgagataagcgttcgagctactactgacctgaatttcgccctgaagaacgacaagaccgtgaacgcgactacttacgaaaaaagtactatcgaagaggaaacaactacttctgagcccagtcacaaaaatattcagaggagtaccccaaatgtgccggcattttggacgatgctcgcaaaggccataaacggcaccgcagtcgtcatggatgataaggaccaactctttcatcccattcctgaaagcgatgtgaacgccactcaaggggaaaaccaacccgatctagaggatcttaaaataaagatcatgttaggcataagcctgatgaccctgcttctcttcgttgtgttactggccttctgttctgccacactctacaaactccgccacctctcctacaaaagctgtgagtcacagtacagcgtaaacccagagctcgccacgatgagctactttcaccctagtgaaggcgtgtccgatacctccttctcgaaatcggccgagtccagcacctttctcgggaccacctcttcagatatgcggcggtctggaactcgcacttctgaatcgaagatcatgactgatatcatatctattggctcagacaatgaaatgcacgaaaacgatgaatccgttacccgatag

SEQ ID NO: 41433 - DNA, 798 bp, Artificial Sequence
  Description of Artificial Sequence: Synthetic coding sequence
atgaacttcatcctgttcatcttcatccccggcgtgttcagcctgaaatcatccaccctaaagccgactatcgaagcgttgcccaacgtcctgcccctgaatgaggatgttaacaaacaggaagagaagaatgaagatcataccccgaactacgcacctgccaatgagaagaatggcaattactataaagacattaagcagtatgttttcaccacccaaaacccgaatggtacagagtctgaaatatctgttcgcgccaccactgacctaaatttcgctctgaagaacgggtctacaccaaatgtccccgcgttttggactatgcttgccaaggccattaatggtactgctgtcgtgatggatgataaagaccagctcttccatcccattcctgaatcagatgtgaacgccacacagggtgagaaccagcccgaccttgaggacctcaagatcaaaattatgttgggcatttcacttatgaccttattgctgttcgtcgtcctgctggctttctgcagtgccactttgtataagctgcggcatctttcatacaagagctgtgagagccaatactctgtgaatccggagctcgccaccatgtcttattttcatcccagcgaaggtgtaagcgacacatccttctccaaaagtgccgagtctagcacgttcctagggaccacctcaagcgacatgcggaggtcagggacccggactagtgaaagtaagatcatgaccgatattatatccataggctcagacaatgaaatgcacgagaacgacgaatctgtgactagatag

SEQ ID NO: 41434 - DNA, 339 bp, Artificial Sequence
  Description of Artificial Sequence: Synthetic coding sequence
atgggcagccggctgagccagcccttcgagagctacatcaccgcccctcctggaactgccgccgccccggcaaaacctgctccaccagctacacccggagcacctacttctcccgccgagcacaggttgctaaaaacttgctggtcatgccgggttctctctggcctggggctaatgggggcagggggttacgtgtactgggtcgcaagaaaaccgatgaagatggggtacccccccagcccctggactatcacccaaatggtcatagggcttagcattgctacctggggaatagtggtgatggctgatcccaaaggtaaggcctatagggtggtgtag

SEQ ID NO: 41435 - DNA, 1212 bp, Artificial Sequence
  Description of Artificial Sequence: Synthetic coding sequence
atgagcaccagcaccagccccgccgccatgctgctgcggcggctgcgacgcttaagctggggtagcaccgctgtccagctcttcatccttaccgttgttaccttcggactcctggcgccgttggcttgccaccgcctgctacactcttatttttacctacggcattggcatctcaaccaaatgtctcaggagttcctgcaacagtctctgaaagagggggaggccgccctgcattattttgaggagctgcctagtgccaatggctccgtgccaatcgtgtggcaggctacgccccgcccttggctcgtcattaccattatcaccgtggacagacagcccggatttcattacgtgctgcaagtggtaagccaattccacaggctcctgcaacagtgcggaccccagtgtgaaggccaccagctgtttctgtgcaacgtggaaaggagcgtcagtcactttgacgcaaaacttctgtccaagtatgtgcccgtcgctaatcggtatgaggggaccgaagatgactatggagacgatccttccaccaatagctttgaaaaggagaagcaggattacgtatactgcctggagtcttcccttcaaacttataaccccgactatgtgctgatggtggaggatgacgctgtcccagaagagcagatctttccagttctggagcatttactgcgcgctagattctcagagccacatctgcgcgacgcactttatttgaagttgtatcatccagagcgcttgcagcattacattaacccagaaccaatgagaattctggaatgggtcggggttgggatgctgctagggcctcttctcacatggatctacatgagatttgcaagcaggcccggcttttcatggccagtgatgctcttcttttccctatactccatgggactcgtggagctcgtcgggaggcattacttccttgaactgcggagactgagtccatctctgtactccgtcgttcccgcgagccaatgctgcaccccagctatgctcttcccagctcctgccgcccggcgcaccctgacttatttgtcacaggtgtactgccacaagggctttggcaaggatatggccctatattcccttctgcgggcaaaaggagagcgggcatacgttgttgagccaaacctggtaaaacacattgggctgttcagtagtctgcggtacaattttcacccatccctgctgtag

SEQ ID NO: 41436 - DNA, 1212 bp, Artificial Sequence
  Description of Artificial Sequence: Synthetic coding sequence
atgagcaccagcaccagccccgccgccatgctgctgcggcggctgagacgcctttcctggggctctacagccgttcagctgttcatcctaacagtggtgacattcggactcctggcccctttagcttgtcatcggctcctgcatagttatttctacctcagacactggcacctcaatcagatgtctcaagagtttctgcagcagtcactgaaagagggggaggccgcactccattatttcgaagaattaccttcagctaatgggagcgttccaatcgtttggcaagcgacaccgagaccctggttagtcattaccatcatcaccgtggatcgacaacctggctttcattatgtgctgcaggttgtgtcccagtttcacagactgctgcagcagtgcggcccacagtgtgaaggacatcagttatttttgtgcaatgtagaaagaagcgtatctcactttgatgcgaagctcctatcaaaatatgtgcctgtggccaatcgatacgaagggacagaggatgattacggtgacgatccttctaccaacagctttgagaaggaaaagcaggattacgtttactgtctagaaagcagcttacagacatataatcctgattacgtattaatggtcgaggatgatgcagtgccggaggagcagatcttcccggtgcttgagcatctgctgagggcccggtttagcgaacctcaccttagagatgcactttaccttaaattgtaccaccctgaacgattgcagcactatatcaatccagaacctatgaggatcctcgagtgggttggtgtcggtatgctactggggccattactgacctggatctacatgagattcgcctcacggcctggtttttcttggcccgtgatgttgttctttagtctgtattctatgggactggtggaactcgtcgggagacattatttcctggaactccggcgtctcagtccctccctgtatagtgtggtgccagcatcccagtgctgcacaccagcgatgctctttccagcccccgctgccaggagaaccctgacgtaccttagccaggtgtactgccataagggtttcggcaaggacatggcgctctacagccttctgcgcgccaagggtgagagggcctatgtcgtggagcccaatctggtgaagcacatcggcctcttctccagcttgcgatacaatttccacccgtcgctgctgtag

SEQ ID NO: 41437 - DNA, 1212 bp, Artificial Sequence
  Description of Artificial Sequence: Synthetic coding sequence
atgagcaccagcaccagccccgccgccatgctgctgcggcggctgagacgcttgagttggggcagcacggctgtgcagctctttatactcactgtggtgacgttcggcctactcgcccctcttgcctgtcacaggctgctgcactcctacttttatctgagacattggcatctcaatcagatgagtcaggaattcctccagcagtctctgaaagaaggggaagcggccttgcactacttcgaggagctgccgtccgctaacgggtctgtgccaatagtctggcaggctacacctagaccatggctagtcatcaccattattaccgtggaccgacagcccggctttcactacgtgctccaggttgtttctcaattccacaggcttctgcaacaatgtggaccccagtgcgagggacaccagcttttcctgtgcaacgttgagcgtagcgtgtcacactttgacgctaagctcttaagcaagtacgtgcccgttgccaatagatatgaaggaaccgaggatgactacggggatgacccctccactaatagtttcgaaaaagaaaagcaagactacgtctactgtctcgagtcatctctccagacatacaatcccgactacgttctgatggtggaagacgacgccgtgcccgaggaacagatcttcccagtgctcgaacacctcctcagggcccggtttagcgagccgcacttacgagacgccctgtacctgaaactttaccatccagaacggctgcagcactatataaacccagagcctatgagaatcctggagtgggtgggcgtggggatgctgctaggccccctgttaacttggatctatatgcgatttgccagtaggcctgggttctcttggccagttatgctattcttcagcctgtatagcatgggccttgtggaattggtgggccgacactatttcctggagctccgacgcctctctccctctctctatagcgtcgtgccagcaagtcagtgttgcacgcctgctatgctgttccctgcccccgccgcgcgaaggaccttaacctacttgtcccaggtttattgtcataaaggcttcggtaaagatatggctttatatagtctcctgagagccaagggggaacgggcgtacgtggtcgaacccaatctggtaaaacacatcggccttttctcaagcttgcgatacaactttcacccctcattgctgtag

SEQ ID NO: 41438 - DNA, 690 bp, Artificial Sequence
  Description of Artificial Sequence: Synthetic coding sequence
atggacagcctggaccggagctgccaggactggtgcgaccggaagcagcactggctcgagattggacccccggatttggtggaaaggaaagggtccttgacacttagatcgcatcacaaaaaatacagcaagcctgtgctcgtatattcctggcaccgcgaccgggaggcctttcctaagggctatgatattgagggacccgaaaaagtgaaaaagctttgtaatagcacttatcggcgacttggcaccgatgaatcacccatctggaccagcgagacccatgaaaagttgagccagatgtgtctgaatactgaatgggtggaaatgaaatccaaagccttgctgaatgaagagaccgtgtcatccggcataatcgaaagggtgaccggtctgccggccactggattcggagccgtgttcccgcgacacccgcctgattggtccaaaatgtgtgcgctgactacttattctgaggactacgtgcctccctatgattatcagcctcacgcttacccctgccaggatgattactccattgtgcaccggaaatgcagatcgcagttcacagatttgaacggcagcaagaggtttggtataaacacgtggcatgacgagagtggaatctatgctaactcagatgtgaaacagaagctgtaccctctgacttccggcccaatcgtgcccatttag

SEQ ID NO: 41439 - DNA, 1272 bp, Artificial Sequence
  Description of Artificial Sequence: Synthetic coding sequence
atggaccggggccagcccagcctggagcccgccgccgccgcccccagagcctcgggccggtgtgtcatcgcccccgtgcgggccgtgctgagactaagacgacgcgtgtgcgtcttgaggaaaaggcggcttctccagcccggaggcggtccggatgttggtacaggggctccccggcctggctgcagcccgcgcgccccacgggccgacttggaccaacctaagttcttcacattcgattccccagccgagctcccatcaaggaccccccggaaaaagcggaggcgatcacgcctggtactctaccccgagacttcccggaaatatcgacctcgagtggaacaccggtcccgagctcagcgatgtcttctactgttggtcgcaatcgtggggttccaggtgctgaacgcaatagagaacctcgacgacaacgcccagcgttacgacctcgatggattggagaaggccttgcagcgggcagtctttggccagccggccgccgtctcccggatcgtcgctctgatgagagactacctggctacccacgttcatagtaggccactccttcttgccctacacggtccctcgggcgtgggcaaaagtcatgttggccgcctgctcgccaggcatttccgaagtgtgctggaggattcagccctggtgctccaatatcacgcccgccatcactgtcccgaggcccgggcagctcaggactgcagagaagagctggcgcggcgtgtggcagacgtggtcgcgcgagcggaggccgaggagaagacacctctgcttgtgctggacgatgtggagctgatgccccgacccctcctggatgagctccacggattcctacagccccagagatctcaccacttccacaatgccatctatgtgttactgtctggtgctggcggagcagaggtgaccaggttcgtcctccagaacgctagtcgcgcactccccctgagacccgacggattccggagcgctgaggctgccgcagcgcaggcagaggaggacctccgggcctcgcttctggccgtgttgagccgcgaacatcccttgtggcaagccgcagccattgtcccctttctactcttggacaagagggacgtcgtgagctgttttagggatgaaatggctggcgaagggtttttcccggatcaagctcgcgccgagaatcttgctgcacaattgtccttctaccgcgtcgctggccgcgaatttgccgtgaccggctgtaaacaagtggtggccacagtgaatctgctgtag

SEQ ID NO: 41440 - DNA, 4941 bp, Artificial Sequence
  Description of Artificial Sequence: Synthetic coding sequence
atgtggcacggcaaccacgtgcagcccggcgccacccaccggcccaatcagggtctcgaaatgctccagggcctcggaataggaatgaaggcatttcacaactttaactatttcctgtttttctacaacgtcctgcttggtctcggcgcgtgtctgtcccggctcctgatctcctgtctgctagggatgtggttgatcgcgcgaatcgataggacaatcatgcagtccggatacgagggagcggatatgggattctcagcatggattggcatgctctacatggaccactatcacattaatcctgtcctcgtgtctttctgccacatcctaatcacaaatcacagggaaaagaagttacagcagtctacaaagtactggtgtctgaatcaatctgctgagagcctgcggatctgtgccatgaggggcggtgagaacagaccccccgccagggtgcagagttccagcgaggagcttgaactgaggcatcagtcactcgacgcgtttcctgggcgtagactgcccggccggggtatccaaccggccgccaaaatgagttctgtgggcaaagtgacccaggttccgaatgggaaggcctaccagcagatcttccaggctgaggtgcagctggtccatagcttggctgccaccagaaaacgcgcagccgagagatcagtgacacttaagagtggtagaatccctatgatgaagaaagtcgagactccagaaggtgaagtgatgagcccccgacagcagaagtggatgcacagtctgcccaacgactggattatggaaaatcccgttctgcaccgtgagaaggaacgggcgaaaagggaaaaagctcgggaatccgagaataccatcgcggctcgagaggtgcgcggactgatggacaccatcgtgccagagaagatttcaaccagtacatttcaacgacaagccgagcacaagcggaaaagttatgaatcagctctggcctccttccaggaggaaatcgcccaggtcggcaaggagatggagcccctgatcgttgataccggcggcttgtttttgaagaaacttacagagagtgatgaggagatgaaccgtctgtttctcaaggtggagaacgacacaaacctggaggactacaccatacaggccttgctcgagctatgggataaggtcgccggaagactgcttttgcgaaagcaggagatcaaggaactggacgaagccctgcatagtttagagttttctcgaacagacaaattgaaatctgtccttaagaagtatgccgaggtgattgagaagacgtcctacctaatgcgtcctgaagtgtacaggcttataaatgaagaagcaatggtgatgaattatgcattgctcgggaatagaaaggccttggcccagctatttgttaaccttatggagtctacactccagcaggaactcgactctcgccatagatggcagggactggtggatacttggaaggccctgaaaaaagaggctctattacagagtttttccgagttcatggcttccgagtccatccataccccacctgccgtgacaaaagaactggaagtgatgctgaaaactcagaatgtcctgcagcaacggaggctcaagcacctttgcaccatttgcgaccttctgcccccctcctactcaaaaactcagctgaccgaatggcactcctccctgaactcactcaacaaggagctcgatacttatcatgtggattgcatgatgcggattcgccttttgtatgagaaaacttggcaggagtgcctgatgcacgtgcagaactgtaaaaagcagctgctggactggaaagcattcacggaagaagaggccgaaactctcgtgaaccagtttttctttcagatggtcggagctctccaggggaaggtggaggaagacctcgagctgctggacaaaagctttgaaaccctggcagatcaaacagaatggcaatcttcacacctgtttaaatacttccaggaagtggtgcagctgtgggaggcccatcaaagtgaattgctggttcaggaactggagctcgaaaagaggatggagcagcaccgccaaaagcactccctggaatcgcaggtacaagaggcacacctggatagactgctggaccagcttcgacagcagtccgacaaggagactctggcttttcatcttgaaaaggtgaaagattacctgaagaacatgaagagccgctacgagtgcttccacactctcctgactaaggaagtcatggagtatcccgcaatcatgcttaaagagctaaattcgtactcctccgcattatcacagtacttctttgtcagggagatctttgagcagaacttggccggagaggtgatttttaaatttcggcagccggaggctcacgagaagccttcccagaagcgagtcaaaaaactcagaaaaaagcaaggctcaaaagaggacatgacccggagtgaagagagtatttcttcaggaacaagtactgcccggtcggtggaggaagtggaagaagagaacgaccaggagatggagtcctttatcactgaagaggtcctgggccagcagaaaaaatctccactgcacgcgaaaatggacgaatccaaagagggctctatccagggcctggaggagatgcaagtggaacgcgagggatccttgaatccatctttaaacgaggaaaacgtaaagggccagggagagaagaaagaggaaagcgaagaggaagacgagaaggaagaggaggaggaagaagaaaagcttgaggaggagaaggaggagaaagaggcgcaggaagagcaagagtcactgagcgtcggcgaggaggaagacaaggaggagggtctggaggaaatctattacgaggacatggagagctttacaatatcatccggcaacacgtattttgtttttgtccctctggaggaagagcactgtcggaaatcccactcaacatttagtgcaatgttcattaatgatacaagctcggcaaagttcatcgaacaggttacgatcccctcccgactcatattagagatcaagaaacagctgttcagcgaggggggaaatttctcacctaaggagattaactccttatgctcaaggcttgagaaggaggcagccaggatagagcttgtagagagcgtcattatgcttaatatggaaaagctggagaacgaatacctcgatcaggccaacgacgtaattaataaattcgaaagcaaattccacaatctgtcggtggatcttatctttatcgaaaagattcaaagactactcacgaatttgcaggtaaagatcaagtgtcaggttgctaagtctaacagccagaccaatggactgaatttctccctccagcagctgcagaacaagatcaaaacctgccaggagtcaagaggggagaagacaacagtcaccactgaggaactgctctcatttgtgcagacgtggaaggagaaactatcccagcgcattcagtacttgaattgctccttggaccgcgtaagtatgacagaacttgtgttcaccaacacaatcctgaaggaccaggaggaagacagcgatatactgacatcctctgaagcactggaggaggaggcgaaactcgatgtcgttacaccagagtcgttcacgcagctgtcccgggtgggtaaaccacttatcgaggatcccgccgtggatgtaattaggaagttgctgcagctgccgaatacgaagtggcccactcaccattgtgacaaggacccgtctcagaccgggttcaagcgccaccgatgtcaacctgagaattctgggaaaaaggccgtcccttccgcctctgctacctctgccggttctttgcaaacgactcatccccctctttcacattcattcacaccacatcccaaaccaaataagatggagcgtaagtatcgcgtgttgggagacaagccccctccggctgcagaagactttaaggggattattcttactctgctatgggaatcctccgagaacctcctcactgttgctgaggagttctacaggaaggagaaaagacccgtaaccaggcctgattgcatgtgcgatacgtttgatcaatgcgccgaaaatatttccaagaagattctggaataccaaagtcaggctaacaagtatcacaattcctgtcttattgaactacgtatccagatccgtagatttgaagagctgttgcctcaagtgtgttggctggtgatggaaaatttcaaggagcaccactggaagaaattcttcacatccgtgaaagaaatcagaggccagttcgaggagcaacagaagaggcttgaaaagcgtaaggacaaaaacgctcagaagctgcatctgaatctgggccaccctgttcacttccaggagatggagagcctgcacctcagtgaggaggagcgccaagaagagctcgattccatgatccggatgaataaagagaagttggaggaatgtacgagacgtaacgggcaggtcttcatcaccaacctggcgaccttcacggaaaagttcctgctccaactcgacgaagtagtaacgatcgacgacgtacaggtggcaaggatggagccgccaaaacaaaagctctccatgttgattagaaggaagttggcgggattgtcgctgaaagaggaatcggagaagccattgattgagcggggttctaggaaatggcctgggatcaaaccaacagaagttactattcaaaacaaaattctgctgcagccaacttcctcaatctcgactactaaaacgacgctcggtcatctggctgctgtcgaggctcgggatgcagtgtaccttaaatacctggcatctttcgaagaagaactgaagaggatccaagatgattgcacgagtcagatcaaggaagctcagagatggaaggacagctggaaacagagcctgcacaccattcagggcctatacgtgtag

SEQ ID NO: 41441 - DNA, 5106 bp, Artificial Sequence
  Description of Artificial Sequence: Synthetic coding sequence
atgcggggcggcgagaaccggccccccgcccgggtgcagagcagctccgaggagctcgagctccgtcaccagagcctggatgcgtttccaggacggcggctgcccggccggggcatccagcccgccgccaagatgtcttctgtcggcaaggtgacgcaagtaccaaacggcaaggcttatcagcagatcttccaggcagaggttcagctggtccattccctcgccgccacccggaagcgggctgcagagagatccgtgaccctaaagagtggccgcatccctatgatgaaaaaagttgaaacccccgaaggggaggtgatgtcacctcgccagcagaaatggatgcacagcctccctaatgactggattatggaaaaccccgttctccaccgggagaaggaacgtgctaagcgcgaaaaagcccgcgagtctgagaacaccatcgccgccagggaggttcgggggctgatggatacaatcgtcccagaaaagataagcacttcaacttttcagagacaggccgaacataaacggaagtcctatgaatcagccctggcttctttccaggaagaaatcgctcaggtgggtaaggagatggaaccccttattgtggatacaggggggctgttcctgaagaagttgaccgagagcgacgaagaaatgaacaggctgttcctgaaagttgagaatgacaccaatctcgaggactacacaatacaggctttgttagaattgtgggacaaggtggccggacgcctgttactccgtaagcaggagataaaggaactcgacgaagcgctgcattcactggagttctcacgcactgacaagctaaagtcggtcctaaagaaatatgccgaagtcatcgaaaagacttcctacctgatgcggcccgaagtctatcgcctgattaacgaggaagccatggtgatgaactacgctctgctgggaaacaggaaggcactcgcccaacttttcgtgaatctcatggaatccacgctgcagcaggagttggactcccggcatagatggcagggtctcgtcgatacctggaaagccctcaagaaagaggctctgctgcaatccttttcggagttcatggcctcagagagcatccacacacctcccgcggtgaccaaagaactggaggtcatgctcaagacacaaaatgtgttgcagcagcggagacttaaacacctttgcacgatatgcgacctcctcccaccatcatatagcaagacccagcttacagaatggcactccagcctgaatagtctgaacaaagaactcgacacttatcacgtggattgtatgatgaggatccgcctgctctacgagaaaacctggcaggagtgcctcatgcacgtccagaattgcaaaaaacagttgctggattggaaggcctttactgaagaggaagctgagacactcgtgaatcagttcttcttccagatggtaggggcactccaggggaaggttgaggaggatctggaactcctagataagtcgtttgagaccctggcagatcagactgaatggcagagctctcacctttttaagtatttccaggaagtggtgcagctatgggaggctcaccagtccgagcttctggttcaggaattggaactcgagaagaggatggaacagcatagacaaaaacatagcctagagagccaggtacaggaggcccacctcgacaggctattggatcagctgcgtcaacagagcgacaaggaaactctggcattccacttggaaaaggtcaaggactacctgaaaaacatgaaatcacggtacgaatgttttcatacgttacttacaaaagaggttatggagtaccctgctattatgctgaaagagctgaatagctactcctcagccctaagccagtatttcttcgtgcgggagatcttcgaacaaaacctggccggagaagtgatttttaagtttagacaaccagaagctcacgagaagccatctcaaaaacgagtgaagaagctgagaaagaagcaaggctctaaagaggatatgacgcggtctgaagagagtatcagttccgggacctctactgccagaagtgttgaggaagtggaggaggagaatgatcaagagatggagtcatttatcactgaggaagtcctgggacagcagaagaagtctcctctgcacgcgaagatggatgaatccaaggagggatccatccagggtttggaggagatgcaggtggaaagagagggatccctgaaccctagtctgaatgaagaaaacgtgaaagggcagggagagaaaaaagaagaatctgaggaagaggatgagaaagaggaagaagaagaagaagaaaaactggaagaggagaaggaggaaaaggaagcccaggaagagcaggagtctctgagcgtgggcgaggaggaggataaagaggaaggcctggaagagatctactatgaggatatggagtcctttacaatttccagcggcaatacatacttcgtcttcgtgcctctggaggaagagcactgtaggaagagccactctactttctcagccatgtttatcaacgatacaagctcagctaagtttatcgaacaggtcaccatcccaagcaggctcatcctcgaaattaagaaacagttgcgggcaggattcttcgagcatctggagaagtggtttgaccagtgctccctgaacaccagggtaacggtggcaaccaagataaacgagttagattccgaattggagctacacctgcatctgcaccagcccagggctcagcagattgaaaaagatattcacaatgtgagagccgctgaactgcttctccatcaggagcaactggattcacattgtgctggggtgacagagactctcaagaaaaagcgcctgatgttctgccagttccaggaagaacagaatgtcaggagtaaaaacttccggctgaagatatacgatatggagcatatctttttgaatgctaccagatctcagaaattggtcactctgtcaaacactcttcatcaggaattgttgagctacgttgacgtgacacaggtgtcattgcgttcctttagacagtatcttgaggagagtctgggcaaactccgatattccaatatagagtttatcaagcattgccgcctgtttagtgagggggggaacttctctccaaaggagatcaatagtctctgtagccgactggaaaaggaggcagcgcgcatcgaactggtcgagtcagtgattatgctcaacatggagaagctggagaacgagtacctcgatcaagcaaacgatgtgatcaacaagttcgaaagtaagttccacaacctaagtgtagacttgatttttatcgagaagatacagcgccttcttacaaacttgcaagtcaaaattaaatgccaagttgcaaagtcaaatagccagactaatgggctgaacttctcccttcaacagctgcaaaacaagatcaagacatgccaggaatccaggggcgagaagacaacagtaaccaccgaagaactcctctccttcgtgcagacatggaaggagaaattgtcccagcgcatacagtacttgaattgttcactcgacagggtcagtatgactgaactggtcttcactaacaccattctgaaggaccaggaagaggattccgatatcctgacatcctcagaagcgttggaagaagaggccaaactcgatgtggtgaccccggaaagtttcacccagttgagccgtgttggcaaacctttgattgaagaccccgctgttgatgtgatacggaaacttctccaactgcctaacaccaagtggccaacacatcactgtgataaggatcccagccagactggacgtggagcttgggcctgtggcagtagggggagtagcgaggccggagccggtggtgccgtctgttctcccccagtgctatgttcctgccccggtccaagcagtcctaagggatttaaaaggcataggtgccagccagagaacagcgggaaaaaggccgtcccttccgcatccgccacaagcgcagggtcctttactcctcatcccaagccgaacaagatggagagaaaatatcgagtgctgggagataaacctccccccgccgccgaggacttcaagggcataatcctcacactgctctgggagagcagcgagaacctgctcaccgtggctgaggaattctatcgcaaggaaaaaaggccagtgacccggccggactgcatgtgtgacaccttcgatcagtgcgctgagaatatcagcaagaagatcctcgagtatcagagtcaagcaaataagtatcacaattcatgcttgatagagcttaggattcagattagacgttttgaagaactgctaccacaggtgtgctggctcgtgatggagaacttcaaagaacatcactggaagaagttttttacctcggtgaaggaaatacgagggcagttcgaggagcagcagaagcggctggagaaacggaaagacaaaaacgcacaaaagctacatcttaacttggggcacccagtgcactttcaggagatggaatccttacatctgagtgaagaggaacgccaggaggagcttgattctatgatacggatgaacaaggaaaagttagaggaatgcactaggcgcaacggtcaggtctttattaccaatctggccacgttcaccgagaaattcttactgcagcttgacgaagtcgtcacaattgatgatgtgcaagtcgctagaatggagcctcccaagcaaaaactgagtatgctgatccgccgtaaactggccggcctgagtctgaaagaagaatctgaaaaacccctcatcgaacgggggtcgagaaaatggccaggcatcaagcccacggaagtgacgatccaaaacaaaattctgttacagccaacctccagcattagtactacaaaaactacgctggggcatctggcagctgtggaggcaagagacgcagtgtaccttaaatacttggcatcctttgaagaggagctcaagcgcatccaggatgattgtacgtctcaaatcaaggaggcccaacgctggaaagattcttggaaacaaagcctgcacacaatccagggcttatacgtttag

SEQ ID NO: 41442 - DNA, 663 bp, Artificial Sequence
  Description of Artificial Sequence: Synthetic coding sequence
atgtggcacggcaaccacgtgcagcccggcgccacccaccggcccaatcagggcctggaaatgctccagggcctcggcattggaattctgacaatcagcatagttgtgggcctgatgatcctacagatgtgcattgctgcatccttttttctacaacctaagcttggcacagctgacaagcagaaaccacttgctcttaacaatcggaaagcttttcacaactttaactactttctctttttctacaacgtccttctgggtctcggcgcttgcctaagccgactcctcataagctgtcttctggggatgtggttgatcgcacgcattgacaggaccattatgcagagcggctatgaaggggcagatatggggttttccgcctggattgggatgttgtacatggaccactatcatattaaccccgtgctggtgtctttttgccatatcttgatcacgaatcatcgcgaaaaaaaactgcagcagtccactaaatactggtgtctgaaccagagcgctggcccgcacgtatccgcccgatcgaggacgcgatggttcctgttacaaacacttatagacaatcccaggctgaccatgcatcgcaagcttaaactgggccacagtagccaggagtcacaaattttgatggcctgttccgagtcatag

SEQ ID NO: 41443 - DNA, 2049 bp, Artificial Sequence
  Description of Artificial Sequence: Synthetic coding sequence
atgtggcacggcaaccacgtgcagcccggcgccacccaccggcccaaccaggggctggagatgctacagggactgggcattggcatgaaagcgttccataattttaattacttcttatttttctacaatgtgttgctgggcctcggggcctgtctgtcgcggttgctgatctcctgcctgctcggcatgtggctcatcgctcggatagacaggaccataatgcagtccggctatgagggtgccgacatgggcttcagtgcctggatcggaatgttatatatggatcactaccatatcaatccagtcctggtgtctttctgtcacatcctcatcaccaaccaccgcgaaaaaaagttacagcagtccactaaatactggtgcttaaatcagagtgcagaaagtctacggatttgcgccatgagaggaggtgagaaccgacctcccgcgcgcgtgcagtcttcaagtgaggagttagaactgagacatcagtctctggacgccttccctggcaggagactaccgggccgtggaattcagcccgcagcgaaaatgtctagcgtggggaaagttacacaagtgcctaatgggaaggcctatcaacagattttccaggccgaggttcagttagtgcactctctcgcagctacaagaaagcgggcggccgaacgcagcgtgaccctaaaatcagggagaatcccaatgatgaaaaaggtggaaaccccagagggtgaggtgatgtctcctcgccagcagaagtggatgcattcattacctaacgactggattatggaaaatcccgtgctgcacagggaaaaggaacgggcaaagcgcgagaaggctagggagtcggagaatacaattgcagcccgcgaagtacgggggctcatggacacgattgtccccgagaagatttctacatccacatttcaacgccaggccgaacacaagaggaaatcttacgaatctgccctggcttcctttcaagaggagatcgcccaggtggggaaggaaatggaacccttgatagttgacactggcgggctctttctcaagaagctgacggaatccgatgaggaaatgaatagactcttcctcaaagtggaaaacgataccaacctcgaggattacacaattcaggccctactggagttgtgggacaaggtggctggcagactgctcctgcgcaaacaggaaattaaggagttggatgaagcgctgcacagtcttgagttctccagaaccgacaagctgaaatccgttctgaagaaatatgccgaagttatagaaaagaccagctacttgatgaggcctgaggtatatcggctgataaacgaggaggccatggtcatgaattacgctcttctgggcaataggaaggcattggcccaactctttgttaacctcatggaatctacactccagcaggagcttgactcacgccaccgatggcagggtctggtcgacacttggaaggctctcaagaaggaggctttgctccagagctttagcgacctgttgcctcccagttactccaaaacacaacttacggagtggcattcttcactgaactcactgaacaaggaattagacacatatcacgttgattgcatgatgcgcattagattactttacgaaaagacttggcaggaatgtctgatgcatgtacaaaactgtaaaaagcagttgctggattggaaagcttttacggaggaagaagcagaaactttggtcaaccaattcttcttccagatggtgggcgctttacaggggaaggtggaagaagatctagagctgctagacgtgagagctggcgattgtagcactggtgagctgcggaatccatccagactttggcaaatcagacagagtggcagggttcacacgagtagtagcatcagtcgtcggtggtataattgcggaaggcatactagggcctcttgctggtgccgatcatggtcgtggcgcagggggtggtcctccactgggcgatctaccgcgtggagggccagatgcagaaggcctacctccatcgggtcttggactaactag

SEQ ID NO: 41444 - DNA, 2712 bp, Artificial Sequence
  Description of Artificial Sequence: Synthetic coding sequence
atgcggggcggcgagaaccggccccccgcccgggtgcagagcagcagtgaggagctggaactgaggcaccagtcgctagacgcctttccaggaaggagactgccaggccgtggtatacaaccagccgcgaaaatgtcttcagttggcaaggtgacccaggtcccaaacggaaaagcttaccaacagatctttcaagcggaagtgcagttggttcactcacttgccgcgacgcggaagcgagcggctgagaggtccgttactctgaagagcggcagaatccccatgatgaaaaaagttgagacaccagaaggcgaagtgatgagtccccggcaacaaaagtggatgcactctctgccaaacgattggattatggagaatcccgttctccatcgcgaaaaggaacgggccaaacgcgagaaagcccgcgagtccgaaaacaccattgcggctcgggaggtcaggggcctgatggatactattgttcccgagaaaatctccacttcaacctttcagcgacaggcagagcacaagagaaaaagttatgagagtgcgctggcatcctttcaggaagaaatcgcccaggagatggagcccttgattgtggacacaggcggattgtttcttaaaaaactcacagagtccgacgaggagatgaatcggctcttcctgaaagtggagaacgacactaatttagaggactacactatacaggcgctcctggaactgtgggataaggtcgccggtcggcttctgttgcgtaaacaggagataaaagaattagatgaagccctccactcgttagagttctcccgaaccgataaattgaagagcgtactgaagaagtatgcagaggtaatagagaagacatcctacttgatgcggcccgaagtctaccgcctcattaatgaagaggccatggtgatgaattatgcgctgctgggaaatcgaaaggctttagcccagctgttcgtcaacttaatggaatctacactccagcaggagctggactctcgccaccggtggcaaggcctagtcgatacttggaaagccttaaagaaagaggcgctgctgcagagtttctccgagttcatggcttcggagagcatccatactccgcctgccgtcaccaaagaattggaagtaatgctgaagacccagaatgttctccaacagagacggctgaaacatctgtgcacaatatgcgatctgctgcctccttcctacagcaagacacagctcacggagtggcattcatcactcaactcccttaataaggagctggacacttaccacgtggattgcatgatgcggattaggctcctctacgaaaaaacatggcaggaatgcctgatgcatgtccagaattgcaaaaagcagctgctcgattggaaagcatttacagaggaggaagctgaaactctggttaaccagttctttttccagatggtgggagcactgcagggtaaagttgaagaggaccttgagctcctggataagtcctttgagaccctggcggatcagacggaatggcaatcctcccacctattcaaatacttccaagaagttgttcaattgtgggaggcgcaccagtccgaattgcttgtccaggagctggaactggagaagcgcatggaacaacacaggcagaagcattctctcgagagccaggtgcaagaagcacatctcgaccgcctgcttgaccagcttcggcaacaatcggacaaagaaacactggcttttcacttggaaaaggtgaaggattacctgaaaaatatgaaaagcagatatgagtgttttcatacgcttctaactaaagaagtcatggaatacccggccataatgctgaaagaactgaattcttactcctccgccctcagtcaatacttcttcgtgcgagagatattcgagcagaacttagcgggcgaggtgatcttcaaatttcggcaaccagaagcccatgaaaaacccagtcagaagcgtgttaagaagcttaggaaaaaacagggaagtaaggaagacatgacacgcagtgaggagtcaattagttccggcacctctactgctagatctgtggaagaagtggaggaggagaatgatcaggaaatggagtctttcataacggaagaagtgttgggccaacaaaaaaagagtcccctacatgccaaaatggacgagtccaaggaaggtagtatacagggtctggaagaaatgcaggtcgaaagggagggtagtttgaaccccagcctgaatgaggaaaatgtcaagggacagggcgagaaaaaggaggagtcagaggaggaggacgagaaggaagaagaggaagaggaagagaaactagaagaagagaaggaagaaaaggaagctcaggaggaacaggagtctctcagcgttggagaagaggaagataaggaagagggtctggaagagatttattacgaagatatggagtcttttaccattagtagcggaaacacatacttcgttttcgtgccgttagaggaagagcattgtcggaagtcacacagtactttcagcgcgatgttcattaatgataccagctcggctaagtttatcgagcaagtgacaattccatctaggcttatcttggaaattaaaaagcacagggcttggtggtgtgtacccgtgattccagccacgcaagaggccgaggcaggcgagtcccctgaaccacgccgccgcagactgcagtag

SEQ ID NO: 41445 - DNA, 5106 bp, Artificial Sequence
  Description of Artificial Sequence: Synthetic coding sequence
atgcggggcggcgagaaccggccccccgcccgggtgcagagcagcagtgaggaattggagctgagacatcaatctctagatgcattcccaggtaggcgtttgcctggacgtggcatccaacccgctgcgaagatgtcatcagtggggaaggtgacacaggtcccaaatggcaaagcgtaccagcaaatttttcaggcagaagttcagctcgtgcatagtctggccgccacccgcaaacgagctgcggagagaagcgtgacactaaagagcggtcgcatccctatgatgaaaaaagtggagacgcctgagggagaggttatgtcaccgagacagcagaagtggatgcattccctgcccaacgactggatcatggaaaacccggtccttcatagggaaaaggagcgcgcgaaacgggagaaagccagagaatccgagaatacaattgctgctagagaggtgaggggtctgatggacaccattgtcccagagaaaatctcaacgtcaacattccagagacaggcggagcacaagcgcaaaagctacgagagcgctctcgcgagctttcaagaggagattgcacaggtgggcaaggaaatggaacctttaattgtggacaccgggggactgttcctgaagaaattaacagaatcagatgaggaaatgaatagactgttcctgaaagtggaaaatgacacaaacctcgaagattataccatacaggccctcctcgaattatgggacaaagtggctggccgtctgctcttaagaaaacaggagataaaggagctcgatgaggccctccatagcctcgagttctctcggaccgacaaactgaagtccgttctcaaaaagtacgcagaggtcatagagaagaccagctatttaatgcggccggaggtgtatagattgattaacgaagaagcaatggtgatgaactacgcactactaggtaaccgtaaagctctcgcacagttgtttgtaaatctcatggaatccactctccagcaggagctggactctcgccatagatggcaggggctggtggatacgtggaaagctcttaagaaagaggcgcttctgcagagcttcagtgagtttatggcttcggaatctatacacacccctcctgcagtgacaaaagagttggaagtgatgcttaaaacccaaaatgtattgcaacagcgcagattaaagcacctgtgtaccatctgcgacctccttcctccaagctatagcaagacacagttgaccgagtggcactctagccttaactccctaaataaagagctggatacgtatcacgtcgattgtatgatgagaatccgccttctgtatgagaagacctggcaggaatgcctgatgcatgtgcagaattgtaagaagcagctgcttgattggaaggctttcacagaggaggaggctgaaaccctggtaaaccaatttttttttcaaatggtgggagcactccaggggaaagtggaagaagacctggagttactcgacaaatctttcgagaccctggccgatcagactgagtggcaaagttcccacctctttaaatacttccaggaggtggtgcaactgtgggaagcccatcagtctgagctgctggtgcaggagctggaactggagaaaaggatggaacagcacagacagaagcactcactggagagtcaggtgcaggaggcccatctggaccgcctgttggatcagttacggcagcagtccgataaagagactttagccttccacctggaaaaagtaaaggactatctgaagaatatgaagtcccggtatgagtgttttcatacccttctgactaaagaggtcatggaatatcctgccattatgctgaaagaattgaatagttattctagtgctttatcacagtatttttttgtgagagaaattttcgaacagaacctggcaggcgaagtgattttcaaattccgacaacctgaggcacacgaaaaaccatcccagaaaagagtcaaaaagctgcgaaagaaacaaggaagcaaagaagatatgaccaggagtgaagagtctatttcctctgggacttcgactgcacgctccgtggaggaggtggaggaggagaacgatcaggagatggagagtttcatcacagaagaagttttggggcaacagaagaaaagtccattgcacgctaagatggacgaatccaaagagggcagcatacaagggctcgaggagatgcaagtggaaagggagggatccctgaacccctcacttaacgaggagaacgtgaaggggcagggtgagaagaaagaggaatccgaggaggaggatgaaaaggaagaagaagaggaggaggagaaacttgaggaggagaaggaagagaaggaggcccaggaagaacaggagtctctcagtgtgggcgaggaggaggataaggaggaaggcctagaagaaatttactacgaagacatggagtcatttacaattagctcaggaaatacctatttcgtcttcgttcctctggaagaagaacactgtagaaagagtcacagcaccttcagcgctatgttcatcaacgacacttctagcgctaaattcattgagcaggtgactatcccctcgagactgatcctggaaatcaaaaaacagctgcgcgccggttttttcgagcacctggagaaatggttcgaccagtgttccctgaatactcgcgtaaccgtggcgactaaaatcaatgaactcgacagtgaactggaactgcatcttcatctgcaccagccccgggcccagcaaattgaaaaggatatacataacgtccgcgctgctgaactcctgttacaccaggagcaacttgatagccactgcgccggcgtgacagaaaccctgaagaaaaagcggttgatgttctgtcagtttcaggaagaacaaaacgttagatcaaaaaattttagattgaagatttatgatatggaacacatcttcctgaatgccacacgctctcagaaacttgtaaccctatctaacactctgcatcaagaacttctttcatacgttgacgtgacccaggtgtcactccgctcattccgccagtacctcgaagagtctttaggcaagctacgttattccaacattgagtttatcaagcattgtaggctgttctcagaaggagggaacttcagtccaaaggagatcaactcactgtgctctagactggagaaagaagcagctagaatcgaacttgtggaatccgtgataatgctgaacatggagaagctcgagaacgaatacttagaccaggccaacgacgtaatcaacaaatttgaatccaaattccataatcttagcgtcgacctgatatttattgaaaagatacaaaggcttctgaccaacctccaggtcaaaatcaaatgtcaggttgcaaaaagtaacagtcagaccaacgggctgaatttcagccttcaacagctgcagaacaagatcaagacgtgtcaggagtccaggggcgagaagaccacagtgactacagaggagctcctgtcctttgtacagacctggaaggagaaattatcccaaaggattcagtacctgaactgttccctcgatcgcgtgtcaatgacagagctggtgtttactaacacaatcctgaaagaccaagaagaggattcagacatcctgaccagctctgaggcactcgaggaggaagccaaattagatgtggtcacaccagaatcgttcacccagctctcccgggtgggcaagcccttgattgaagaccctgccgtggacgtgattaggaaattactccagcttcccaatactaagtggcccactcaccattgcgacaaagatccatcacagaccggccgcggagcctgggcctgcgggagcagagggtccagtgaagccggcgccggaggcgctgtgtgttcgccccccgtcctctgtagttgcccaggaccaagcagcccaaaagggttcaagcggcataggtgccagccagagaattccgggaagaaggccgtgccatctgcctcagcaacttctgcgggatctttcaccccccatcccaaacctaataagatggaacgcaagtatagggtcttgggcgacaagcccccacctgccgcagaggacttcaagggtataatccttaccctgctgtgggaatcttctgaaaatctgctgaccgtagccgaagaattctacaggaaagaaaagcgacctgtaacccggcccgactgcatgtgcgacacatttgatcaatgtgcagagaacatatccaaaaaaatccttgagtaccagtcacaagctaacaaatatcacaactcttgtttgatcgaactcaggatccagatccggagattcgaagagcttctgccacaggtatgttggttggtgatggagaatttcaaagagcatcactggaaaaagttcttcacgagcgtgaaagaaatacgaggccagtttgaggaacaacaaaagagactcgagaagaggaaagacaagaatgcccagaagctgcatctgaacctcggacatcctgtccactttcaggagatggaatcgctacacctgtccgaggaagagcgacaggaagagctggacagtatgatcagaatgaacaaggagaagctggaggagtgtacaagaagaaacgggcaggtcttcatcacaaacctggctaccttcacagaaaagttcctactccaactggatgaggtcgtgacaatcgacgacgtgcaggtggctcgaatggagcccccgaaacagaagctcagtatgctgatacggaggaaactggctggccttagcctgaaagaggagagcgaaaagccgctgattgaacggggcagccggaagtggcccggcatcaagccgactgaggttaccatacaaaataagattcttttgcaaccaacatcatctatcagcactactaaaaccacgctggggcacttggccgccgtggaggccagagacgcagtttacttaaagtacctcgcctcatttgaggaagagctcaaacgcatccaagatgactgtacatcccagatcaaggaggctcagcgatggaaggacagctggaagcagagcttgcatactattcaggggttgtacgtttag

SEQ ID NO: 41446 - DNA, 2700 bp, Artificial Sequence
  Description of Artificial Sequence: Synthetic coding sequence
ggccggcccgccgccgtggtggccggccccgccctggccgccctgagagagagcctgcgcatatgcgccatgcgcggaggagaaaacagaccccctgccagagtgcagagctcttctgaagagttagaactgaggcaccagagcctggacgcgtttccagggcggagacttcctgggaggggcatacagcctgcagcaaagatgtcttccgtgggaaaggtcacgcaagtgcccaacggcaaagcctaccagcagattttccaagctgaagtgcaactcgtccacagcctagcggcaactagaaagcgcgccgcagaacgctctgttactttgaagagcggccgtattcctatgatgaaaaaagtggagacaccagagggggaagttatgtctccccgacagcagaagtggatgcattcactgccaaacgactggatcatggagaaccctgtgctgcacagagagaaagaaagagctaaaagagagaaggcccgagaatcagaaaataccattgcagccagggaagtgcgcggcctcatggatactatcgttccagaaaagatttctacttcaacattccagcgacaggcagaacacaagcgaaagtcctacgaatctgccctagctagttttcaagaggagattgcccaggtgggtaaggaaatggagcccctcatcgtggacactggcggcctgttcctcaaaaaactgacagagagcgatgaagagatgaacagactctttcttaaagtggagaatgataccaatctggaggactataccatacaggccctcttggagctgtgggacaaggtggctggtaggttgctcctgaggaagcaagagatcaaagaactcgatgaggctctgcactctctggagttttctcgaactgacaagttgaagagtgtcttgaagaaatacgcagaagtcatcgaaaagactagctacctgatgagacctgaagtgtaccgcctaattaacgaagaggccatggttatgaattatgctctactgggaaatcgcaaggcactggcccaattattcgtgaatctgatggaaagtacactacagcaggaactggattctagacaccgatggcaggggctggtagacacatggaaggcactgaagaaggaggctcttctgcaatcattcagtgagtttatggcctctgaatccatacatactcctcccgcagtcacaaaagagctggaggtgatgctgaagacacagaacgtgctgcagcaaagacgcttaaagcatctgtgtaccatttgtgacctcctgcccccaagctattccaaaactcagcttactgagtggcactccagtctgaactccttgaacaaagaattagatacttaccatgtggattgcatgatgcgaattcggttgctgtatgagaaaacatggcaggaatgcctgatgcatgttcaaaattgcaaaaagcagcttttggactggaaggcattcactgaggaggaagcagagacactagtgaaccagttttttttccagatggtgggtgcactgcagggaaaggttgaagaggacctcgagctgcttgacaagtccttcgagacattggctgatcagactgagtggcagtcttcgcacctgttcaaatactttcaggaggtcgtacagttgtgggaggcgcaccagtcagagctactagtccaggagctggaattggaaaaacgaatggagcagcatcgccagaagcactccctggaatctcaggtgcaggaagcccatctcgatcgcttgttggaccagctacggcaacaaagcgacaaggagaccttggccttccacctcgagaaagtgaaggattacttaaaaaacatgaaaagtagatatgaatgcttccacacactgctgactaaggaggtgatggagtatcctgctatcatgctcaaggaactgaattcatactcttcagccctgagccagtatttctttgtgagggagatttttgagcagaacctggctggcgaggtgatctttaagtttcggcagccagaggcccacgaaaaaccttcccagaagagggtgaagaagttgcgtaagaagcagggtagtaaggaggacatgactcgcagtgaggagagcatttcttcaggtacgtctaccgctcggagtgttgaagaagtggaagaagagaacgaccaggagatggagtcgttcattacagaggaggtgctgggccagcagaagaagagtccactgcacgcaaagatggacgaaagcaaggaaggcagcatccagggcctggaggagatgcaagtggagcgggaggggtcgctgaatccatccctgaacgaggagaacgttaagggacagggcgagaaaaaggaggagtcagaggaagaggacgagaaagaagaagaagaggaggaagagaaacttgaggaagagaaggaggaaaaggaagcccaggaagagcaggagtctctttccgtgggcgaagaagaagataaagaggaagggctagaggaaatctattacgaggacatggagtctttcaccatctcttcaggcaacacctacttcgtgtttgtgccactggaggaagaacattgtagaaagtctcatagtactttctcagccatgtttatcaatgatacctccagtgccaagtttatagaacaggtcaccatccccagcaggttgatactggaaattaaaaagtag

SEQ ID NO: 41447 - DNA, 585 bp, Artificial Sequence
  Description of Artificial Sequence: Synthetic coding sequence
atggccaagcggcgggccgccgagcccgtgaccttccacgtgccctggaagaggcttctcctgtgtgacttcgcagaacagcctccccctccaccgctctggattagacccccgggggtggcccacgccggtcagttgctgggagtgcctgagcagcatagaaaacgtaaaattgatgctgggactatggcagaaccatccgcgtcaccgtccaagcgtcgcgattcaggagacaatagcgcaccgtccgggcaggagagagaggatcacggtctggaaaccggagaccctcccctccctccacctccagtccttccgggaccaggcgaggagctacccggcgccaggctcccgggaggcgggggagacgatggagcaggacgtgcggggccaccaagaggagattggggagtcgcaagcaggcaacacaacgaagaattctggcagtataacacattccaatattggcggaatccccttcctccaattgacctagccgacatcgaagatctctccgaagatacccttaccgaagccaccctgcagggacgcaacgaaggagccgaagtggatatggagtcatag

SEQ ID NO: 41448 - DNA, 558 bp, Artificial Sequence
  Description of Artificial Sequence: Synthetic coding sequence
atgccccggctgttcctgttccacctgctggagttctgcctgctgctaaatcaattctcccgcgccgtcgctgcaaaatggaaagatgacgtgatcaaactctgcggacgggagctcgtgcgcgctcagatcgcaatttgtggaatgagcacatggtctaaacggagcctgtcacaggaagatgcgccccaaacccctcggcctgtcgccgagatcgtcccgagttttatcaataaagataccgaaacaatcatcattatgctggaattcatcgctaatctgccccccgaattaaaagcggcactgtccgagcggcaaccctccctgcccgaactgcagcaatatgttccagcactcaaagattctaatctgagctttgaggaattcaagaagcttatacgtaacagacagtcagaagctgccgactccaatccctcggagctgaaatatcttggactggatacccacagccagaaaaaacgacggccctacgtggcgctatttgaaaaatgttgccttattggctgcaccaagagatcactggcaaagtactgctag

SEQ ID NO: 41449 - DNA, 486 bp, Artificial Sequence
  Description of Artificial Sequence: Synthetic coding sequence
atgaagaagatcgagatcagcggcacctgcctgagcttccacctgctgtttgggttggaaataagaatgcggagaattgtttttgccggcgtcatcctgttccgcttactgggggttatactattcagattgctgggggtgattttatttgggcgtctgggtgacctcgggacctgccagacgaaaccaggacagtactggaaggaagaggtgcatatccaggatgtaggcggcctgatctgtcgggcctgcaatctcagtctcccgttccatggatgtctgctggacctgggcacctgtcaggctgaacctgggcagtattgcaaagaagaagtgcacatccagggggggatccagtggtattcggtaaaaggctgcacaaaaaacacttctgaatgcttcaagagcacattagtcaaaaggatcctccagctccacgagctcgttactacacactgttgcaatcatagtctgtgcaacttttag

SEQ ID NO: 41450 - DNA, 384 bp, Artificial Sequence
  Description of Artificial Sequence: Synthetic coding sequence
atgggcgtgggcttcaccgagctggagtacctggccccctggctgagaccccctttctcagacctaggaacctgtcaaacgaaacccggccagtattggaaggaggaggtccacattcaagatgtgggcgggctcatctgccgcgcctgcaatctgtcccttccattccacgggtgcctcctggacctgggtacatgtcaggcggaaccaggacagtattgtaaagaagaggtgcatatacaaggcgggatccagtggtatagcgtcaagggctgtaccaagaacacgagcgaatgcttcaagagcacacttgtgaagagaattctgcaactccacgaactggtgactacacactgctgtaaccatagcctatgcaacttttag

SEQ ID NO: 41451 - DNA, 513 bp, Artificial Sequence
  Description of Artificial Sequence: Synthetic coding sequence
atgcagaaccggaccggcctgatcctgtgcgccctggccctgctgatgggattcctgatggtgtgtcttggagccttctttatctcatggggcagcatatttgattgtcagggctctctcattgcggcatatctactgctgcctctcggttttgtcattctgctgtccggcatcttctggtcaaactatcgtcaggtaacagaaagcaagggtgttctccggcacatgctccgccagcatctggcacatggagcgctccctgtcgctacagtcgatagacctgatttctaccccccggcctacgaagagtccctcgaagtggaaaagcagtcttgtcccgctgaaagagaggcctccggaattcctccccctctctacacggagactggtctggagtttcaggatggaaacgactcacacccagaagcccctccctcataccgggagtctattgccggcttggttgtgaccgccattagtgaggacgcccaacggcgggggcaagagtgttag

SEQ ID NO: 41452 - DNA, 4338 bp, Artificial Sequence
  Description of Artificial Sequence: Synthetic coding sequence
atgggcaacctggtgatccccctgggcaagggccgggccggccgggtcgagagtggacagcgcattcctccacccgcaccccgcccaagcgtcgagtgcacgggagatgatattgcactccaaatggaaaaaatgttattcccactgaaatctccaagcgctacctggttgagtccctctagtacaccatggatgatggactttatacttacgtctgtttgcgggctagtgcttctatttctcctgctgctgtatgtccattcagacccaccctctcctccaccgggtagaaaaagatcctctagagagccacaacgggagcgctccggaaggagcaggagccggaagatatctgcgctaaaggcttgccggatactgcttcgcgagttggaagagacccgcgatttaaattatcttctggaaagtcatctacgtaagctagctggggaaggatcatctcacttacccctcggaggagatccactaggtgacgtgtgcaagcccgtgccagctaaggcacatcaaccacacggaaagtgcatgcaggacccatctcctgcatccctgtccccacctgcgccccctgcccctctggcctccaccctttctcccggtccaatgacgtttagcgagcccttcgggcctcactctaccttgagcgcctccggcccgcccgagccactgttaccgctcaagtgcccagcaacccagcctcacgtcgtttttccaccctccccccaaccacatgggccacttgccagttccccgccccctcccgatagttctttggctggcctgcagtgtggcagcaccacttgtcccgtgccacagtcttctccattgcacaatcaagtcctgcccccccccaccagggtgatttcaggcctcggctgcagtagtgatcccatttgggacctgtattgttggagggaagctgcaactacatggggcctgagcacctacagccatgggaagagtcagcctagacatttgccggaccacaccagcgaagcatcattctggggcgaccctacccccaagcatatggaggtggggggctgtacttttatccacccagatgtccagaaactactggagactctcattgctaagcgggccctgatgaaaatgtggcaggaaaaggagcgtaagcgtgccgatcacccccacatgacctccttggggaaggaatgggatattaccacactgaatcctttttggaatgtttctacacaacctcaacaactacctagaccccagcaagtgagtgatgccaccacggtggggaatcatctgcagcagaaaagaagccagctcttctgggatttgcctagccttaactccgaatcacttgccactaccgtgtgggtaagccgcaaccccagtagccagaacgcacattctgtcccgctggacaaagcctcaaccagtttacctggagaacctgaagtggaagccagctcacagctctcgcaggcacccccacagccacaccatatggctcagcctcagcacttcaccccggcctggcctcagtctcagcccccacccttagcggagatccagacccaagcccacttatccccccccgtgccctccttaggttgctcctctcctccccaaatcaggggctgcggcgcgagttaccccacctcccaggaacgtacccagagcgtaatcccaactggaaaggaatatctggagtggcctctgaagaagagaccgaaatggaagcgtgtcctgccatctctgctgaaaaaatcccaggctgtgttatcccagcctaccgcacatctcccccaagagaggccagctagctggtcacctaagtctgcaccaattcttcccggcgtggtcaccagcccagagctgcccgaacattggtggcaagggaggaatgcaatacatcaagagcagtcatgtggcccaccaagcaggcttcaagcctctggcgacctactgcagccagatggtgaattccccggacgccctcaatcccaggccgaagacactcagcaagccctcctaccatcccagccttcagactttgctggtaagggccgcaaagacgtgcagaagactggcttcagatcaagcggccgattcagcgacaagggatgtctgggatcaaagctcgggccagatccctcccgggaccagggtagcggacgtactagcgtgaaagctctggacgaagacaaggaagccgagggagacctccgccgcagttggaaatatcagtccgtctcaagcaccccaagggacccagacaaagaacacctcgagaacaaactgcagatacatctggctaggaaagtgggggaaatcaaggaaggctggattccaatgcctgtgcggaggtcatggctgatggcgaaatgtgcagtcccgaaatcagatacccataggaagccgggcaaactggctagctggcgaggtggaaaggctcatgtaaacacgtcgcaggaactgtccttcctccacccatgcacccagcagatcctcgaggttcacctggtcaggttctgcgtacgacactcatggggtacggatctccagtctttagagcccatcaatgtctggagtggggaagctcaggctccccccttcccacagagcacattcaccccatgggccagctgggtctccagagtcgagtcagtgcctaaagtgccgattttcctcggcaagcgtccccagaacggtccaggcgataatcggaccactagcaaaagcgtgcccactgtgagcggcccattagccgctccaccacctgagcaggagggcgtgcagaggccgcctcggggttcccaatccgccgatacccatggccggagtgaggccttccctaccggtcataaagggagaggttgttcacagccaccaacctgttcgctggttggccggacttggcaatcacggacagtgctggagagcggaaagccaaagcctcgcttagagggcagtatgggaagcgagatggccggcaacgaagcatggcttgagtctgagagtatgtcccctggcgacccctgttcatcacgtgcactgcaggtgctgtcaatcggatcgcagtgggctcgtgccgaggacgcactccaggcactgaaggtgggcgaaaaacccccaacttgggaagttaccctcggcgcgagcgtgagggcaagttcaggctcagtccaagaggatctacgctccacaggagccctggggaccacaggcaatcctagcgcctcttccgtgtgtgtggctcaggatcccgaacagctgcatctgaaagcccaagttgtaagcgagatcgccctgattgttcaggtcgatagcgaggagcaactcccaggcagagcgccagggatcttgcttcaagatggggccactgggctgtgtctgcccggccggcatatggacatgctgactgccgccgatcgtttgccgacgcaggctcccctatccacctcacaatcggtctcaggtaagaacatgactgcttctcagggcccatgtgctctcctatggaagggaggcgattcccccggacagcaagaacctggcagtcccaaagcaaaggcccctcagaaaagccaaaaaaccctcggctgcgctgacaagggtgaagcccatcgccgcccaagaacaggcgagcagggacataggtcaaagggacccaggacctctgaggcttccggcagatctcacccggcccaggctcgggaaattggtgataagcaagagaggaaatacaatcagctccagctagagaagggccaaacgccgcccgaaagccactttcaacggaagatttctcaccacccccaaggcctgcacccccggaaaggagggacccgatgggaggatgtgttgcaaaaaggaaagccaggtgcagacgcttttcagtcttggggatcgggtcccccccgccaatttatggattgcatggctgataaagcttggacaatttcaagggtagtaggccaaatactggtggataaattgggacttcagtggggacgtggcccatccgaagtgaacaggcataaaggagacttccgggctcaggaaaatgtccctagctgttgccatcgcgggcattgccaccaggagcgatcaagggagatgcgagccctggcctgctcccccaaggcaacgcccaaaggccatcactgccccgttaaaaaccgcggcatccgggatagagatagcagctgggctccacccccccgcgagcccgtttcgcccgctgggcctcaccaccaccgccctcgcatggcctctacctctggcggaccccatccccagctgcaggaactgatgtcagctcagaggtgccttgcaagctag

SEQ ID NO: 41453 - DNA, 1761 bp, Artificial Sequence
  Description of Artificial Sequence: Synthetic coding sequence
atggaggtgggcggctgcaccttcatccaccccgacgtgcagaagctactcgagacactcatcgccaagagagcgctgatgaagatgtggcaggagaaggaacgaaagagggcagaccatcctcatatgacttcgctggggaaggaatgggacatcacaacgctgaatccattttggaatgtatcaacccagccccaacaactgccacgccctcagcaagtttctgacgccaccacagtgggcaaccatttgcagcaaaaacggagccaactattctgggatttacctagtcttaactctgaatctctcgccaccactgtatgggtgtccaggaatccctccagccagaacgcccactccgtaccgctggacaaggcgtccacctccctgccaggggagcctgaggtggaggcctcttcccaactatcgcaggctcccccccagcctcatcatatggcacagcctcagcactttacacccgcttggccacaaagccagcctcctcctctggccgagatccaaacgcaggctcatctgagcccccccgtgccatcgttgggctgcagctcaccgccacaaattcgcgggtgcggcgcgtcataccctacctctcaggagcgcacacagtccgtcatcccaacaggcaaggagtatctggaatggcccttgaaaaaacggccaaagtggaagagagtccttccctcattactcaagaagagtcaggccgtgctatctcagccaacagcgcatctgccccaggagcgtccggcctcctggagtcccaagtcagcgcctattcttccaggagtggtgaccagtccagagctgccagaacactggtggcaagggcgaaatgctattcatcaggagcagagctgtggacctccctcacgactccaggcctctggagatttactacaacctgatggagagttccccggaagaccccagagtcaggctgaggacactcaacaagcgcttctgccatcacagccttctgacttcgctggcaagggcaggaaagatgttcagaaaaccgggtttagaagctcaggcaggttcagcgacaagggctgtttagggagtaaacttgggcccgatccctcaagagatcagggatcagggcggacttctgtgaaggcattggatgaagataaagaggccgaaggcgacctgaggaggtcttggaaataccagtctgtgagttctacccctagggacccagataaggaacacttggaaaacaaactgcaaattcatctggcccgtaaggtcggcgagatcaaagaaggctggatccccatgcccgtacggcggtcatggttgatggcaaagtgtgctgttcctaaatcagatactcataggaagcccggtaagctcgcaagctggcgcggcgggaaggcacatgtgaataccagccaggaactctcttttctacatccttgtacccaacagattttggaggtgcatctcgtacgattttgtgtgaggcactcatggggcacggacctgcaatcactcgagccgatcaacgtgtggtccggcgaagcccaggcgccaccatttccacaatctacctttactccgtgggcaagctgggtctcaagagttgagagtgtgccgaaagtgcctatcttcctggggaagcgcccacaaaacggccctggcgacaaccgcaccacttctaaaagcgtgccaactgtgtctggcccattggcagcgacgggggtaactgctacaaagaatgttgccgagagatag

SEQ ID NO: 41454 - DNA, 1029 bp, Artificial Sequence
  Description of Artificial Sequence: Synthetic coding sequence
atggcctgcgagccccaggtggaccccggcgccaccggccccctgccacctagcagtcccggatggtctgctctgcccggcggttcccccccaggctgggggcaggagctgcataatggacaggtgctgactgtcctccggatcgataacacatgcgctcctatctccttcgacttgggagctgccgaagagcaactgcagacatggggaattcaagtgccagccgaccagtatcgaagtctggccgagtccgcactgttagagccccaggttaggcggtacatcatctacaattccagacctatgcgtttggctttcgccgtagtgttctacgtggtcgtttgggctaatatctattctacaagtcagatgtttgctcttggcaatcactgggcaggaatgctgctcgtcacacttgctgcagtttccctcaccttaacactggtactggtgtttgaacgccatcagaagaaagccaataccaacactgatttgcgcctggctgccgctaatggagcccttctgcgccatagggttcttttgggagtcaccgacaccgtggagggttgtcagtccgtgatccagttgtggttcgtttatttcgaccttgagaactgcgtgcagtttctctccgaccacgtccaggagatgaaaaccagtcaggaatcactcctgagatctcggctgtcgcaactgtgtgtggtaatggagaccggggtatcgccagccaccgctgaaggcccggaaaatctcgaggacgcacccctgctgcccggcaactcatgtcccaatgagagacccctgatgcagactgagttgcaccagctggttccggaggcggagccagaggaaatggcgcgccagctgctggcagtttttggagggtattacatcaggctgctggtgacttcacagctgccccaggccatgggaacaagacatacaaatagcccccgcataccgtgcccatgccagctgatcgaagcctatattttgggcaccggatgctgccccttccttgcacggtag

SEQ ID NO: 41455 - DNA, 1032 bp, Artificial Sequence
  Description of Artificial Sequence: Synthetic coding sequence
atggcctgcgagccccaggtggaccccggcgccaccggccccctgcccccatccagtcccggctggtcggctcttcccggcggatccccacctggatggggacaggagctgcataatgggcaggttttaacagtgctcagaatcgacaacacttgtgcccctatcagtttcgatctgggtgccgcagaagaacagctgcagacgtggggcattcaacaagtccccgcagatcaataccggtccttagccgagagtgctctgttggagccccaggtgagacgatacattatttataatagccggccaatgcgcctggcattcgcagtcgtgttttatgtggtcgtgtgggccaatatctattccacgagccagatgttcgctcttggaaaccactgggcagggatgctgttggttactttggccgccgtcagcctcacgctcacattggtgttggtgttcgagcgacaccaaaagaaagccaacacaaacactgatcttagactggctgccgctaatggggccctgctgcgccaccgcgtactgctgggggtgacagacacagtcgaaggctgccagtcagtgatccaactgtggttcgtctattttgatctcgaaaattgcgtgcaattcctgtcagaccacgtgcaggagatgaagacctcacaggaatcactccttagaagcagactgtcgcagctgtgcgtagtaatggagacaggagtgagcccggccacagctgaaggtcccgagaatctagaagatgcacctctgctacccggaaatagttgtcctaatgagcgaccactcatgcagactgagctgcaccagctggtccctgaggctgagccagaagaaatggcacggcagctgctggcagtgtttggtggatattacattcggctgctggttacctcacagttgccccaggccatgggcacacgacacaccaactctccaagaatcccatgtccctgccagctgatagaggcgtatatcctggggacgggttgctgtccctttctggcccgctag

SEQ ID NO: 41456 - DNA, 2136 bp, Artificial Sequence
  Description of Artificial Sequence: Synthetic coding sequence
atggcccggagccggagccggagcccccggtggaagcaccggagcctgtctcccgtccccagaaacgccgagcactacaaacagcgtcactcccacggacattatggatgtgagtatcggaaggatccaaagagacctgtcgcctggcgaatggattctgagaaacacggccagagtaagcccaggattccatccaggggcaatatttattatcaatcatacgagcaccgatcaccctcgccaaacattcgtaactccctggaaaatgtgtatatgtataagccacaccgaggatacagtcccggacgcggcgactcaaatcggagggcccagtatatgcccaaatactctgagggtattccatacaaggagcacgagcgaaactcttacccacagaaagtgcagggaggccactcccctgacgaccacagggtgagaggctccggcaaaggcgggaaaccaccccagaggtctatcgcagactccttccggtttgaaggtaagtggcatgaggatgagctacggcatcaacgaattcaggaggagaaatattcacagtccacccgccggggctcagaggacttcgagactcgatcaagtttccaaaagcgatatccagaggatcgcgacttccggaagtacgggcacacaagcaaacgtcccaaggacgtggagagatacgaaagccgcgagccggcccggaatccaaaatggaagcccgaacactctctccctccttaccaggaggacacagatcagtggaacttaggcccccagacctacaggcacgcagaaagagaacatcccgagacgagcagcgccaccaaggtgtcctacgattatcggcataagcgcccgaagctgctggatggtgatcaggatttttccgacggaaggacccagaagtactgcaaagaagaggacagaaaatattcatttcaaaaagggcccttgaatcgcgaactcgactgttttaacaccggacgtggccgggagacccaggatggccaagtgaaggagccatttaaaccctcaaagaaggacagtatagcgtgtacgtactctaacaaaaacgacgttgatctgagatcatccaatgacaagtggaaagagaaaatcaagaaggaaggcgactgtagaaaggaaagcaacagtagctcaaaccagctggataaaagccagaagctaccagacgtgaaaccaagtccaattaacctgaggaagaagagcctaaccgtgaaagtggatgtgaagaagaccgtcgatacgtttcgcgtggccagcagctacagtactgaaaggcagatgagtcacgatctcgtggcagttggtcggaaatccgaaaattttcacccagtcttcgaacacctcgacagtacacaaaacacagaaaacaagcctacaggggagttcgcacaggagatcattacaataattcatcaagtgaaagctaattactttccctcgcccggtataactttgcacgaaaggttctctactatgcaggacatccacaaagccgatgtgaacgaaattccgctcaattccgacccggagatccatcggcgcatcgacatgtcactggcagagcttcaatctaaacaggccgtgatctacgagtcagaacagactttgattaagattatcgaccctaatgacctgaggcacgacattgagcgaagaagaaaggaacgcctgcagaacgaagacgaacacatatttcacattgcatctgccgccgagagggatgatcagaactcctccttctcaaaagtgaagaacgtgcacaccgacggcttccagaagcccacacatttcatcaagtccaactttaggaagtgcattgagaagccctacatgaactacacgactcagaggaaggacatcataacacacaaaccctttgaggttgaaggtaatcaccgaaatacgagagtgcgtccctttaaatctaatttcaggggcgggaggtgccagccaaattacaaaagtggcctcgtccagaagtcattatatatccaggctaagtaccaaagactgagattcactgggcctaggggcttcatcacccacaagtttcgcgagagactgatgaggaaaaagaaagaatacacagatgtcgcaactggtatatag

SEQ ID NO: 41457 - DNA, 1509 bp, Artificial Sequence
  Description of Artificial Sequence: Synthetic coding sequence
atggccatccacctggacaagcagaacatcatcctgaagaacgacaaggacgagtatttaaagaagacacgggatggggttttacctccctatcaggatgccaagccgccttccccagcaagcatcaaaaagacatataccacatctaaattcaatgatgccgaaccagccaaaggaaatttatttattggagtcgaagtcttgcctgagaacctccatctggacgaatccgaaacatctgaggaggaccacggcagcctggagaaggagaaatatgagcagtttctctccctggaagagggcactaaggcccattatttcttcgagaaggtcgtgaacgccgctcaaacctggttctccctgttcggttggcctgaggggccacacagtttcagcattccagagacaatccggagagatgtgtacaaaatgcagttttattcaagtacctcgccccctcaaaagtttagtcgccagaacgactttagtaaatacaataagaccatctatgacgtcctgctccatctcagtgggaaaatgccgcctggtataaactctagccagtccctccctgtagataaccatgaaaaaagagtgattcaactgcaccttcaacactccagtttactggacttcctcaacgctcaaggcggttgtatttcacacgtcctgccagaattcctcctcgagcccgaggactacaagcggtggatagagatcatgtcctcaacaaataccatgcccgtttcctcatgcacccccaaaaagaaatgtagcattgttatagaaatgagcaagtttgaggcctggtctaaaagggcttggactgatgtcttcttgcagatctacaaggtgctcgtcctgagcagggtagtgccttattgttcgaataatatgcccccaatatgtgttcaaaatacacccaaggtgaatccatgcttcgcctcttcaaatatttatagcgactcagaacggatccttctctcatggatgaatataaactacgaaaatacccggcatgtgatctggaagaattgtcacaaagatgtgataccatctgaacggtggatcgtgaatttcgataaggacctgtcagatggcctagtctttgccactcaactgggggcgtactgtccctttctcattgaaagccattttatcaacatgtatacaaggcccaagagtcccgaggaatatcttcacaattgcctcattattgtgaacactctgtacgaaattgactttgacgtggagatccaggtgtgtctgcgcgtttttcccaaggaaatggacgcaggagtttctggactgaggaaagaggacatgccgagcgtttgggtggtgacgattcgcctggcagttgctgtcgccaggacaaagcgccagaagaaaggagatatccagtttgcttgctttttcgtatgtctgtttttctttatttttgtggtgatctcctttagtctgtggtcccgcatgcattttttcttactgttacctctggatatctag

SEQ ID NO: 41458 - DNA, 1509 bp, Artificial Sequence
  Description of Artificial Sequence: Synthetic coding sequence
atggccatccacctggacaagcagaacatcatcctgaagaacgacaaggacgagtacttaaaaaagacgcgggacggtgttctgcctccctaccaagatgcgaagcccccaagcccggcatctatcaaaaaaacctataccacatccaaatttaatgacgctgagcccgcgaaggggaatctcttcatcggcgtggaagtgcttcccgagaatctgcacctcgacgagtcggagacaagtgaagaggatcacggctccctggaaaaggaaaaatatgaacagtttctttcattagaggaaggtaccaaggcccactatttcttcgagaaagtcgtaaacgccgcgcaaacatggttcagtctgttcggttggcctgaaggcccacacagcttcagtatccctgaaactatacgccgtgacgtttacaaaatgcagttttattcctctacaagtccaccccagaagttctccagacagaatgacttcagcaaatataacaagacaatttacgatgtcctcttgcatttatcagggaaaatgccccccggaatcaactcttctcagtccctgcccgtggacaatcacgagaaacgggtgatacaacttcacctgcagcattcctccttgctggattttctcaacgcccaggggggttgtatatctcatgttcttcctgaattcctcctagagccagaagattacaagcgctggatcgaaattatgagctcaacaaatactatgcccgtctcaagctgtacccctaaaaagaaatgctctattgtgatagaaatgagtaaatttgaagcctggtcaaaacgcgcctggactgatgtttttttacagatttacaaggttcttgtactcagccgggttgttccctactgtagcaataacatgcccccgatctgcgtccaaaatacaccaaaggtcaacccttgctttgcttctagcaacatctacagcgattctgagaggatcctgctgagttggatgaatatcaactacgagaataccagacacgtcatttggaagaactgccacaaggatgtgatacctagcgagaggtggattgtcaattttgacaaggatttgtccgatggtctagtattcgctacccagctgggcgcttattgtccatttctcatcgagagccatttcatcaacatgtatactagacccaagagtccagaggagtatctgcataactgtttaatcatcgtgaacaccctctatgagattgactttgatgtggagatccaagtgtgcctcagagtgtttcccaaagaaatggatgccggggtgtccgggctgaggaaggaagatatgccaagtgtgtgggtggttaccatcagactagccgtggctgtggccagaaccaaacgccaaaagaaaggagatattcaatttgcctgctttttcgtgtgtttgtttttttttatctttgtggtgatctcctttagcctatggagcagaatgcacttcttcctgttgctcccactggacatctag

SEQ ID NO: 41459 - DNA, 471 bp, Artificial Sequence
  Description of Artificial Sequence: Synthetic coding sequence
atgctgctgaactacatccccgtgtgctacaagatcctgcacctgactggcgaagttaaatctccagaacttctgttcgacccacctttcatatttttcacccccgtgcccttggatatcactactgtaatggacatcaatattctgccacaaaactacttcagaaatagtacattgtgtgtccagatacctactgtccgtctgctcgatggcgaggaaattcaccccttgagcgtgaagttccctaagggaagagttatacctggcagtcactctgggattaacaataaactgacttgtcatctgtcctttaaatccagtaaacccgtctcattttttacaaatctgctcttttgcgatgaccgaaagaactggtgttttcattttcagttgcttcagcaacaaaagaccgcattccttctcttcacccatatctggcagttcatctggatttccaagacccttttctag

SEQ ID NO: 41460 - DNA, 462 bp, Artificial Sequence
  Description of Artificial Sequence: Synthetic coding sequence
atgctgctgaactacatccccgtgtgctacaagatcctgcacctgacgggcgaggtcaaaagccccgaactgctgttcgatccgccttttatctttttcacaccagtgcctttagatattaccacagtgatggatatcaatatcctgccacagaattacttcagaaattcgacactctgcgtacaaatcccaacggttaggttgctagacggggaggaaatccaccctctgtctgttaagttccccaagggccgggttataccggggtctcattccgggatcaacaataagctcacctgccacctgtcctttaaaagttctaaacccgtgtcattttttaccaacttgctgttttgtgacgacagaaaaaactggtgcttccactttcagctgttgcagcagcaaaagacggccttcctcctcttcacccacatctggcagtttatctggatttcaaagtag

SEQ ID NO: 41461 - DNA, 1086 bp, Artificial Sequence
  Description of Artificial Sequence: Synthetic coding sequence
atgaacctggtgatctgcgtgctgctgctgagcatctggaagaacaattgcatgaccacgaatcagacaaatggatcctctacgaccggagacaaaccggtggaatctatgcagactaagctaaactacctccggaggaatctccttatcctagtggggataatcatcatggtgttcgtgttcatctgtttttgctatctgcactacaactgccttagcgacgacgcgtccaaggccgggatggttaagaagaaaggcattgcagcaaaatccagcaagactagttttagcgaggctaaaacggcatctcagtgcagccccgaaacacagcctatgctcagcacagccgacaaatcaagtgacagttccagccctgagcgagcctctgcacagagctcaaccgaaaaactgattaggccatccagcctgcagaaacctagcatacctaattccgccggaaaactaacacggccatcctacccaaagcggagttctaaaagcagctgttcaaagaagttgagtaagtcaagtcacctggagaaggctcataagaaggggtcactggaaaagctctgcaaacttgactatgcctgcaaactggcaagctctgataaaccggttcggcctccacagctctttaagcctctctatagcagccacccgcaaaacgagatctccccttcgaaaccttttggtccacaagagctggcaaaacctccgaaacactttaatccaaaaaggtcagtttccctcggacgcgcagctcttcttagcaacagcgagctggctgagacgtgccaaccatataagaagaagcacctggtggccaagacgtataggcctctcgttaatgatatctcagaggctaaagaaaagaatacccagaatctccacgtgagttctaaggtaaagtcgtccagccgctcatttcgcaagctggatagtcgaaacaacgcctacggagatcacgtgaatgacagtgacaccatgaaatactactctgaggtagactcagacaaagtcattatcattacctgtgatagagggtacaaccaggtgacatctgaagttacactaaacgattag

SEQ ID NO: 41462 - DNA, 300 bp, Artificial Sequence
  Description of Artificial Sequence: Synthetic coding sequence
atggagccccagaagctgctgatcatcggcttcctgctgtgcagcctgacatgcctcttgcttgaaaccgtggcttccagccccttaccgctgtccgctctaggaatccaggagaaaactgggtccaaacctaggagtggcggcaatcatcgcagttggctgaataattttcgagattacttgtggcagcttattaagtcagctcttccccctgccgcaatcgttgcgtttctcctcacatctgcactgatgggcatcttgtgctgtttcaccatcttagtggtggatccagttcattag

SEQ ID NO: 41463 - DNA, 6054 bp, Artificial Sequence
  Description of Artificial Sequence: Synthetic coding sequence
atgagcctgggcctggcccgggcccaggaggtggagctgaccctggaaacggtaattcagactttagagtcttccgtgctgtgtcaggagaaagggctgggagctagggacctagcacaggacgctcagattacgagtttacctgctttgatcagagagattgtaactcgcaacttaagtcaacccgagagcccagtattgctgccagcaaccgagatggcttctttactgtcactacaagaagagaaccagttgctccagcaagaattatccagagtagaagacctgctcgcacagtctcgagctgagcgggacgagctagcaattaaatacaatgctgtgtctgaaaggttggagcaggcactgagactcgaacccggggaactcgaaactcaggaacctcggggactcgtgcgacagtctgttgagctacgacggcagctgcaagaggagcaggcttcctataggaggaagctgcaggcctatcaggaaggacagcaacggcaggctcagttagtgcagcggctgcaagggaaaatcctgcagtataagaagcggtgcagcgagctcgagcagcagttactggaacggtctggagagctcgagcagcagagattgcgcgacaccgagcattcacaggatctcgagagcgccctgattcggctggaggaagagcagcaaaggtctgcttctctggcgcaggtaaacgcaatgctccgtgaacagcttgatcaggccgggtccgcaaaccaggccctgtcagaagacattcgaaaggtcaccaacgactggactcgatgtcgaaaggagctggaacaccgcgaggcagcctggcgacgagaggaagaaagtttcaacgcgtattttagtaatgaacactctcgccttctcctcctctggcggcaggtcgtgggcttccgcaggctcgtgagtgaggtgaaaatgtttaccgaaagagacctgttgcagctcgggggagaactggcgcggacatccagggctgtgcaggaggccggactgggtctcagtaccgggcttagacttgccgaatcaagagctgaggctgcattggagaagcaggcattgctccaggcccagttggaggagcagctcagggacaaggttctcagagagaaggatcttgcacaacagcagatgcagtctgacttagataaagccgatttgtctgctagagtgactgagctcggcttggccgtgaagcggctcgaaaaacagaacttggagaaggaccaggtcaacaaagacttgaccgagaagctggaggcgttggagagtctgcgcctgcaagagcaggcagcactggagactgaggacggggaagggctccaacaaaccctcagagaccttgcacaagcagtgctgtctgattcagagagcggtgtacagttgtctggctcggaacggacagctgacgcaagcaacggctctctgcgcggactgagtggacagaggactccttctccgccacgccgcagctctcccggtagaggaagaagtccccgtcgtggcccttctccagcatgttcagacagttccactcttgccctgatacatagcgccttgcacaagcgccagttgcaggtgcaggacatgcgcggtaggtatgaggctagtcaggatcttctggggactttgcgtaaacaattgagtgattctgaatcagaacggcgggccctggaggaacagctgcagagactaagggataagacagacggagcaatgcaggcccatgaggacgcccagcgcgaggtacaacgtctgcgcagtgcaaatgaactccttagccgggaaaagtcaaacctggcccattcattgcaggtagcacagcagcaagccgaggaactgagacaggagcgcgagaagctgcaggctgcccaggaagaactaaggcggcagagggatcgtctggaggaagaacaagaggatgctgtgcaggatggggctcgggtgagaagggagctggaaagaagccaccgccaattggaacagctggaaggaaaaagatctgtattagctaaggaactggtggaagttagggaggccctgtctcgggctactctccagcgtgatatgctccaggcagagaaggccgaggttgcagaagcccttacaaaagccgaggctggaagggttgagctggagctctctatgactaagctacgagccgaggaggcctccttgcaagatagcttatccaagctcagtgcactcaatgaaagtttagcccaggacaaattggatttgaatcgcctggtggcccagttggaagaggaaaaatctgctctgcagggacgtcagaggcaagctgaacaggaggccacggtcgctcgggaggaacaggagaggctggaagagctgagactcgaacaggaagttgctcgacagggattagaaggctcgctgcgcgtggcagagcaagctcaggaagccctagaacagcagctgcctaccctgagacacgaacgcagccagctgcaggaacagctggctcagttgagtaggcagttaagcgggcgggaacaggagctggaacaggcccggcgggaggcccagcgtcaggtggaagcccttgagcgagcagctagagagaaagaagccctagctaaggagcacgccggcctggccgtacagctggtcgccgcggagcgagaggggagaacgctgagcgaggaggccacaagactccgtctggagaaagaggccctcgagggctccctgttcgaggtccagcggcagcttgctcagctagaagccagaagagagcaactggaggcagagggccaagccctcctgttggccaaagagacattaacaggcgagctcgctgggctccggcagcagattatcgcaacgcaggagaaggccagcttggataaagagctcatggcccagaagcttgtgcaggcagaacgcgaagctcaagcctcccttcgggagcagcgtgctgctcacgaggaggacctacagagattgcagagagagaaggaggcggcctggagggaacttgaggcagaacgagcacagcttcagtctcaactgcaacgagagcaggaggagctgctggctagactcgaggcagagaaggaggaactgtccgaggaaattgcagccttgcagcaagaaagggacgaaggtctgttactggccgagtcggagaagcaacaggcactctcactaaaagaatccgaaaagaccgcactgagtgagaagctcatgggcacccgccattctctggcaactatttcactggagatggagaggcaaaaaagagacgcgcaaagtcgccaggaacaagatagatcaacggttaacgccctgacatcggaactcagagacctgcgggctcaacgagaagaggcggccgccgcccatgctcaagaggtgcgccgattgcaggaacaagctagagacctgggtaaacagcgtgatagttgtctgagagaagccgaagaactgaggacgcaactgcggcttctggaagacgctagggatgggctgaggagggagctcctggaggcacagcgaaaactcagggaatctcaagagggaagggaagttcagcggcaagaggctggcgaactaaggaggagccttggcgaaggggccaaagagagagaagcacttcgtaggtccaatgaggagctgcgatccgcagtgaagaaggccgaatctgaaagaatttctctgaaactcgccaatgaggataaagagcagaagctggccctgctggaggaagcgcggactgcggtgggcaaggaggcgggagagcttaggacagggttacaggaagtggaaaggagtagactggaggctcgcagggaactgcaggaacttagaagacaaatgaagatgctggactccgagaacaccaggttagggagggaactggccgaactgcaagggcgcttggccctaggagagcgtgctgagaaggagagccgaagggagaccttgggactaaggcagaggctgctcaagggtgaggcctctctcgaagtcatgcgacaggagcttcaggtggcccaaaggaagctgcaggagcaggagggagaatttaggacacgggaacgtagactactgggaagtttagaggaggcacgcggcacggagaaacagcaactggaccacgcacgtggcctggagctgaagttggaggctgcacgcgccgaagcagccgagctcggcctgcgcctgtccgctgcagaaggccgggcccaagggctggaggcagaattggccagagtagaagtgcagcggcgcgccgccgaggcgcagcttggaggcttaagatccgctctgagacgaggattgggactgggtagggcaccctctcctgcccccaggcccgtgcccggtagtccagctcgggacgctccagccgaaggttccggcgaggggcttaattctccttctaccctcgagtgttctccagggagtcaacctccaagtcctggacctgctacttctccagcttcccctgacctggaccctgaggctgtaagaggcgccttgagagagttcctgcaggaactccgcagcgcccagagagagcgggacgaattgagaactcagacctctgccctgaacaggcaactggcggaaatggaggctgagcgcgactcagcaacatctagagcgcgccagctgcagaaagccgtggctgaatccgaagaagcaaggcgcagtgtggatggccgcttgtcgggggtgcaggccgaactagcgttgcaggaggagtctgtgcggagaagcgaacgggagcggcgcgcaaccctagaccaagtggcaacgttggagcgtagtttgcaggccactgagagtgaattacgcgcctctcaggagaagatttccaagatgaaagccaatgagaccaagctggagggcgacaagcgacgactgaaagaagtgttggatgcgtccgagtctaggaccgttaaactggaactccagcggagatccctcgagggtgagcttcaacgttcgcggttgggcctctccgaccgagaagctcaagcccaggcacttcaagatcgggtagactcactccagcgccaggtggcagactccgaggtcaaagcaggcactttgcaactaacggtcgagcgcctcaacggcgccctcgctaaagtggaagagagcgagggcgctctccgggataaagttcgcggccttaccgaggccctggctcagagcagcgcctccctaaattccacccgtgataaaaacttgcacctgcagaaagctctcactgcatgtgaacatgatcgccaagtcttgcaagagcggctagatgctgcccggcaggcactcagcgaagcgcgcaagcagagttcctctcttggggagcaggtccagaccctgagaggcgaggttgctgacctggagttacaaagggtggaggctgagggccagttgcaacagctccgcgaggttttgcgtcagcgccaggagggcgaggctgctgcattgaatactgtgcagaagctccaggacgagagaaggctactgcaggaacgcttgggaagtttgcagcgggccctggcccaacttgaggccgaaaaacgggaggtcgaaaggtctgcacttcgcctcgagaaagatcgcgtcgcacttaggagaacactcgataaagtagaaagagagaaacttcgtagtcacgaagataccgtaaggctgtcagctgagaaggggcggcttgaccggaccttgaccggcgccgagttggagttggctgaggcccaacgacagatccagcagctggaggcccaagtcgttgtccttgaacagagtcactcacctgctcaactcgaggtcgatgcgcagcaacagcagctcgagctgcagcaggaggtcgaaaggttgaggtctgcccaggcacagactgagcggactctggaagcaagggagcgcgcacatagacaaagagttagaggactggaggaacaggtgtcgactctgaaaggacagctccagcaagagctgcggcgctcttccgccccctttagcccaccttccgggccgccggagaaatag

SEQ ID NO: 41464 - DNA, 5697 bp, Artificial Sequence
  Description of Artificial Sequence: Synthetic coding sequence
gagaagggcctgggcgcccgggacctggcccaggacgcccagatcacctcacttcctgctctgatacgggagatcgtaacacggaacctgtctcagcctgagtccccagtgctgcttccggccacagagatggcatccctgctgagtcttcaggaggaaaaccagttgttgcaacaggagttgtcgcgcgtggaggacctcttagcacagagccgggctgaacgcgacgaactggcaatcaagtataacgcagtatctgagcgagacaccgagcattctcaagatctggagtccgcactcatacgattagaggaagagcagcaacggagtgcctccctagcccaagttaatgccatgttacgagagcaactggatcaggctggtagcgccaatcaggctctgtccgaggatattcgcaaggtgaccaacgattggacgaggtgtaggaaggagttggagcacagagaggccgcctggcggagggaagaggaaagcttcaacgcctacttttcgaacgagcattcacgtctgttgctcctttggcgacaagtcgtgggattcaggcggttggtgtctgaagtgaaaatgtttacagaaagagacctgttacagctcggtggagagctcgctcgcacatcccgggccgtgcaggaggctggactgggcctttccaccggccttagactggccgaaagtcgagccgaagcagccctggagaaacaggctcttctgcaggctcagctcgaagaacagctgcgcgacaaggttctgcgagagaaagaccttgcccagcagcaaatgcagtccgatctcgataaggccgatctatcagcacgcgtgaccgaactgggcctggcagtcaagcgcctcgaaaagcagaacctggagaaagaccaggtgaataaggatctaaccgaaaagctcgaagccctagaaagcctgagactgcaggagcaagccgctcttgagaccgaagacggggagggtctgcagcagaccctacgcgaccttgcccaagccgtgctgagtgactcagagagcggagttcagctatccggctccgagagaactgctgatgcttctaacggaagcctcagggggttaagcggacaaaggactcctagcccacccagacgctctagcccaggtagagggcgctctccaaggcgggggccttcgcccgcatgcagcgactcctcaaccctcgctctgatccactctgcccttcacaaaagacagctccaggtccaagacatgcgcggccgatacgaagctagccaggatctgttaggaacccttcgcaagcagctgtctgactccgagtcagagaggcgcgcgcttgaagagcagctgcagcgcctaagagacaaaactgacggtgccatgcaggcccatgaggatgcccaaagggaggttcagaggctgcgaagtgcaaatgaactgctgtccagggagaaatctaacctggcgcactcactgcaagtcgcgcaacagcaagcagaggagttgagacaagaacgagagaaactgcaggccgcacaggaagaattgagacggcagcgggatcgcttggaggaagaacaggaagatgctgtgcaggatggcgcccgggtacgaagagagctggaacgatctcacaggcagttagagcaactcgagggcaaacgctcagtccttgccaaggagctggttgaggtaagggaggctctgtcacgtgccactttacagcgagacatgctacaagcagaaaaggccgaggtggccgaggctctgacgaaagcggaagccggacgcgtcgaactcgagctgtctatgaccaaattaagggcagaagaagcgagcctgcaggatagtttgtcaaagctaagcgctctaaacgaatcacttgctcaggacaagctcgacctgaatcgcttggtggcacagttagaagaagagaaaagtgccctgcaaggcaggcagcgccaagccgaacaagaggctaccgtggcacgggaggagcaggaaagacttgaagaactgcgactcgagcaagaagtggcccggcaagggcttgaagggtctttacgagtggcggagcaagctcaggaggccttggaacaacaattgcctacactgcggcatgagcgtagccagctgcaagagcagctggcgcagctctcaaggcagctttctggccgtgagcaagagttggagcaggcgcggcgcgaggcacagcggcaggttgaggcgttggaaagggctgccagggaaaaggaagccctcgctaaagaacacgccggcctcgcagtccaactcgtcgcagccgaaagggagggccgaacactctctgaggaagcaactcggctgaggttagagaaggaggctctggaaggttccctcttcgaagttcaacggcagttggcccagcttgaggcacggcgcgaacagctggaggccgagggccaggctctgctcctcgctaaggaaactcttacgggcgaactcgcaggactgcgccagcaaatcatcgcaacccaagaaaaagcttccctcgataaggagttgatggctcagaaactggtgcaggccgagagagaagcccaggcatcattgcgggagcagcgggccgctcatgaagaagacctgcagcgccttcagagggaaaaagaggctgcctggagggagctcgaggctgaaagagcacagcttcagtcccagttgcagagagaacaggaggaattgcttgcccgcctcgaagcagaaaaggaagagctaagtgaggagatagccgcactccagcaggagcgggacgaagggttacttctcgcggagtctgaaaaacaacaagccctgtcgctgaaggaaagcgagaaaacagctcttagcgaaaaactgatgggtacgcgccactctctcgccaccatctctctcgagatggagagacagaagagagatgcccagagccgccaggagcaagatagaagtacggttaatgcactgacgagcgaactgcgggacttaagagctcagcgcgaggaggccgctgcagctcacgcccaggaagtacgtcgccttcaagaacaagcccgagatttgggaaagcaaagggattcatgtcttagagaggccgaggaactgaggacccagctgcgcttgctcgaggatgccagagacgggttgaggcgtgagctacttgaagcgcagcggaaactgcgggagagccaggagggccgtgaagtccagcgtcaagaagctggcgagctcagaaggagtctcggagagggtgcgaaggagcgagaggccctgagacggtctaatgaagagctccggtccgcggtgaagaaagccgaaagtgaacgaatttctctgaagctggctaacgaggataaagaacagaaactagctttactggaggaagcacggacggccgtaggaaaggaagcaggtgagctgagaaccggactgcaggaagtggaacgaagccggctcgaggcacggagggaactgcaagagctgagacgccagatgaagatgttggatagtgagaatacccgtctcggacgcgagttagctgagcttcagggcaggcttgcgctcggggaaagggccgagaaggaatctcggcgcgagactctcggcctccgtcagcgacttctgaagggcgaggcctcactagaggtcatgcggcaagagttgcaggtcgcccagagaaagttgcaggagcaggaaggagaatttcgaaccagggagaggcgcctgcttgggagcctggaggaggcacgcggcacagagaaacagcaactggatcacgcaagagggctggagctcaaactcgaggccgcccgtgccgaagccgccgaactggggcttcgtctgagtgctgccgagggtcgggcacaaggcctggaggctgagctcgctcgggtcgaagtccaaagacgcgccgccgaagcccagctggggggcctcagatctgcactcagacggggactcgggcttgggcgggcccctagtcctgcacctcgacccgtgcctggctctcccgcaagggatgctcccgccgaaggctccggggaagggctcaatagcccaagtaccttggagtgttcacctggcagccagccacccagcccgggaccagctacatctccggcttcccctgatctcgacccggaagctgtgagaggggccctccgcgaatttctgcaggagcttagatcagcccagcgcgaaagagacgagcttcggactcaaacctctgcactgaataggcagctggcagagatggaggccgagcgtgatagcgcaacgtcaagagcccgccaactgcagaaagctgtggccgagtccgaggaggccagacggtccgttgacggccggctgtccggcgtgcaagcagagctggcactgcaggaagagtctgtcaggcgcagtgaaagagagcgccgggcaaccctggatcaggtcgccactctggagaggtccctacaggcaacggagtctgagttacgggcctcccaggaaaagatctcgaagatgaaagctaatgagacaaagctggaaggagacaagaggagactcaaagaggtgctggatgcttccgagagtcgcactgtaaaattagagttacagcggagatccctggaaggagagttgcagcggtccagactcgggctttccgaccgggaagctcaggcgcaagctctgcaggaccgcgtggattctctccagcgccaagtggccgacagcgaagtgaaagctggaactctgcagctgaccgttgaaaggctgaacggagccctcgctaaagtcgaagagagcgagggagccctgcgggacaaggtcagaggtctgacagaagccttggcccagtcctccgcttctctaaacagcacaagggacaagaacctgcatctgcagaaggcgttgactgcctgtgaacacgatcggcaggtgctgcaggagagactggacgccgccagacaagccctgtccgaagcccggaagcagtccagttcgctgggggaacaagtgcagacactcagaggcgaagtggcagatttagagctacaaagagtcgaggcggagggacaactgcagcagcttagagaggttctgcggcaaaggcaggaaggcgaagctgccgccctgaataccgtgcagaagcttcaggacgaaagacgattgcttcaggaaagactaggatctctccagcgggctctggctcagttagaggcggaaaaacgcgaagtggaacggtccgctttgcggcttgagaaggacagggtggctctgcgaaggacattggacaaggtcgagagggagaaactgagatcacacgaggacaccgtacgcttatcagccgagaaagggagattagaccgcaccttgactggcgctgagctagagcttgctgaagcccagcgccagattcagcagctggaagcccaggtggtggtgctggagcagtcacattcacctgctcagttggaagtcgacgcccagcagcagcagctggaactgcagcaggaggtggaaaggttgaggtcagcgcaggcacagaccgagagaacccttgaggcccgagagcgagcgcaccggcagagagttagaggcctggaggaacaagtgagtactttaaaggggcagctccagcaagagttgcgacgatcctcagcaccctttagtcctccttccggcccgcccgaaaagtag

SEQ ID NO: 41465 - DNA, 3612 bp, Artificial Sequence
  Description of Artificial Sequence: Synthetic coding sequence
atggagcaggcccccaacatggccgagccccggggccccgtggaccacggcgttcagatcaggtttatcaccgagccagtgtccggggcggagatgggaacactgaggcgcggcggacgcagaccggcaaaggatgcgcgggcgtccacttatggcgttgctgtacgggtgcagggcattgccggccagccttttgtggtgctcaattcaggagagaaaggtggcgattctttcggagtgcagatcaagggcgctaacgaccagggtgcctctggggctctgagcagtgatctagagttgcctgaaaatccgtattcccaagttaaaggattccccgctccaagccagagctcaacatcagatgaggagcccggcgcctattggaacggcaagctgctgcggtcccactctcaagctagtttagcaggccccggacccgtcgaccccagtaatcggtcaaacagcatgttggagttggctcccaaagtggccagtcccgggtctacaattgatactgctccgctcagcagcgtggatagcctcatcaacaaattcgatagccagcttggaggacaggccaggggaaggaccggcagaagaacccgcatgctccccccagaacagagaaaaaggtctaagtctttggattccagattgccacgggatacttttgaggaaagagaaagacagtctaccaatcactggacatcttccacaaaatacgacaaccatgttgggacatctaagcagccagcgcagtcacagaatctgtcgccactatcgggttttagtagatctaggcagacacaggattgggtgctacagagtttcgaagagccacgtaggtcagcacaggaccctactatgctgcagtttaagtctacccccgacctgctgagggaccaacaggaggcagcaccgcccggctccgtcgatcatatgaaagcaaccatttatggcatacttcgggaaggctctagcgagtccgagaccagcgtgcgacggaaggttagtctcgttctcgaaaagatgcaacccctagtgatggtctcaagtggatccactaaggcagtcgccggtcagggagaattaacgaggaaagtggaagaactgcagcggaaattggacgaagaggtaaaaaagagacagaaactcgaaccttcccaggttggcctggaacggcagcttgaggagaagactgaggagtgtagcagactgcaggaattactagagagaagaaagggtgaggcgcaacaatctaataaggagctccagaacatgaaaagacttctggaccaaggggaggacctccggcatggccttgaaactcaggtcatggaactgcaaaacaaactgaagcatgtgcaaggacctgaacctgccaaggaagtactcctaaaggacctgttggaaaccagggaactgctggaggaggtactcgaaggaaaacaacgcgtcgaggagcagttgaggctgcgggagcgcgagttgaccgctctgaaaggtgctctcaaagaggaagtagcctctcgagaccaagaagtcgagcatgtcagacagcagtatcagcgcgacactgagcaactgaggagatcaatgcaggatgccacgcaggatcatgccgtgctcgaggcggagagacagaagatgagcgctttggtgagggggctgcaacgcgagctcgaagaaaccagcgaagagacggggcactggcaatctatgttccagaagaataaagaagatctgagagcaactaagcaagagcttctgcaacttcggatggagaaagaggagatggaggaagaactaggggagaaaatcgaggtattgcagcgtgagctggagcaggcccgagcttcggccggggatactagacaagtcgaagtcctgaaaaaggagttgctccgaactcaggaggaactcaaggagttacaggctgagaggcagtcacaagaagtcgcgggccgacatcgggatcgggaactcgaaaagcaactcgccgtgctgcgggtggaagctgaccgaggacgagagttggaagagcagaacctccaactccagaagaccctgcaacagctgcgccaagattgcgaagaagcctcaaaggccaagatggttgctgaggcagaggccaccgtgctggggcagcgtcgtgccgccgtggagactacattacgagagacacaagaggaaaacgacgaattccgtcgcagaatcctgggattagaacagcagctgaaagaaactagagggctagtcgatggcggtgaggctgtagaagcccgcttgcgagacaaactccagaggcttgaggcagagaagcaacagctggaagaagccctgaatgccagccaggaagaggagggctctctggcagccgcgaagagagctctggaagcccgtctagaggaggcccagaggggcctggccagattagggcaggaacagcagacgctgaaccgggctttagaagaggagggaaagcagagggaagtgcttcgtagagggaaagccgaacttgaggagcagaaacgcctgctagacagaaccgtagacagattgaataaagaactggagaagatcggcgaagatagcaaacaggctttgcagcagctgcaagcacagctcgaggactacaaggaaaaggcacggagggaagtcgcggacgcccagaggcaggctaaagattgggccagcgaagccgaaaagacaagcggaggtctgtcgcgactccaggatgagatccagagactgcggcaggcactccaggcctctcaggccgaacgcgatacagctcggctggataaagaactgttagcccaaagactacaagggctcgagcaggaggctgaaaacaaaaaaagatcacaggacgaccgcgcccgccagctgaaaggcctggaagaaaaagtgtcgaggctggaaactgaactagacgaagagaagaacaccgtcgaactcctgacagaccgggtcaatcggggacgagaccaggtcgaccaattacgtactgagttgatgcaagaaagatcagcaaggcaggacctggagtgtgacaagatatccctcgagaggcagaacaaagacctgaaaacgagactggcttccagcgagggttttcagaagccgagcgcaagtttatctcagctggagagccaaaaccagttgttacaagagcgacttcaagcagaggagagagagaagacagtcctgcagtcgactaataggaaactggagaggaaggttaaagaactgagcattcagatcgaggacgaacgacaacacgtcaacgatcaaaaagatcagctcagtcttcgcgtgaaggccctaaagcggcaagttgatgaagccgaagaggagattgagcgactggacgggctgagaaagaaggcccagcgcgaggtagaagagcagcacgaagttaatgagcagctgcaggccaggataaaaagcctggaaaaagactcgtggagaaaagcgtctagatccgcagcggaatccgccctcaagaacgagggactttcttcagacgaagagttcgactctgtctatgaccctagttctatcgcctccctcctcactgaaagcaatcttcagacctcctcatgttag

SEQ ID NO: 41466 - DNA, 876 bp, Artificial Sequence
  Description of Artificial Sequence: Synthetic coding sequence
atggagcaggcccccaacatggccgagccccggggccccgtggaccatggagttcaaattaggtttataactgagcccgtgagcggagcagagatgggcaccttgcgcagaggcggcaggcgacccgctaaagatgcaagggcaagtacctacggagtcgccgttcgggtgcagggaatcgccgggcaacctttcgtcgtgctgaactccggcgagaagggtggcgacagttttggtgttcaaatcaagggcgcaaatgatcagggagccagcggggccctcagcagcgacctagagctgccagaaaatccgtactctcaagtgaaaggcttccccgcaccgtcacagtcttccacaagtgacgaggagccaggtgcatactggaacgggaagctgctgaggtcacactctcaggcttcactggccggccccggacctgtcgatccttccaatagatcgaacagcatgttggaactcgcaccgaaagtggcaagtccaggttcaacaattgacacagcccccctttccagcgtagattccctcattaataaatttgatagtcagcttggcggacaagcccggggaaggacaggaagacggacccgaatgctgcccccagagcagcgaaagcgcagtaagtctctggactcacggttacctcgggatacattcgaagaacgtgagcggcagtcgaccaatcactggacatcatccactaagtatgacaaccatgtggggacctccaaacaaccagcacaaagtcagaacctctcccccctgtcaggtttcagcaggtcacgccagacccaggattgggtcctgcaaagttttgaagagccgagacgttccgcccaagatccaactatgctccagtag

SEQ ID NO: 41467 - DNA, 513 bp, Artificial Sequence
  Description of Artificial Sequence: Synthetic coding sequence
atggagcaggcccccaacatggccgagccccggggccccgtggaccacggagtgcagatccgtttcataaccgagcccgtcagcggcgcagagatggggaccctccgaagaggtggccgacggccagcaaaagatgcaagagcctccacctatggggtagcagtccgcgtgcaaggtatcgccggacagccattcgtcgtcctaaatagcggggagaaaggtggcgactcgtttggagtacagataaaaggggccaatgaccagggtgccagcggcgctctctcaagcgacttggaactgcctgaaaatccgtacagtcaggtcaaaggcttcccagccccctcccaaagctccacttccgatgaagaaccaggagcttattggaacggcaagcttttgagaagtcatagtcaagcatccctggccggtcccggcccggtggatccctccaaccggtctaattctatgctggaactcgcacctaaggtggcgtcccccggctcaacaatttag

SEQ ID NO: 41468 - DNA, 513 bp, Artificial Sequence
  Description of Artificial Sequence: Synthetic coding sequence
atggagcaggcccccaacatggccgagccccggggccccgtggaccacggtgtgcagatccgatttataaccgagcccgtctcaggagccgaaatgggaactcttcggagagggggaagacggcccgcgaaagatgccagagcatcgacttacggggtggccgtccgcgtacagggtatcgccggccagccctttgtagtcctgaacagcggtgagaaagggggagattcctttggggtgcagattaagggagccaacgatcagggtgcctccggagcccttagctcggatcttgagctccctgaaaatccatactcccaggtgaaggggttccctgcacccagtcagtcaagtacatcggatgaagaacctggggcttactggaatggcaaactgctgcggagccattctcaggccagtctggctgggccaggaccggtcgacccgagtaacaggtccaacagcatgcttgaactggccccgaaggttgcctctcccgggtcaacaatttag

SEQ ID NO: 41469 - DNA, 699 bp, Artificial Sequence
  Description of Artificial Sequence: Synthetic coding sequence
atgcccggctggttcaagaaggcctggtacggcctggccagcctgctgtctttctctagttttatcctgatcattgtggccttggtggtgcctcattggctcagtggcaaaattctctgtcagactggggtggaccttgtgaacgccacagacagggagcttgtgaagtttattggcgatatctattatggcctgtttcggggatgtaaggtcaggcagtgcggcctcggtggtcgtcaatcccagttcacgatctttccacatcttgtcaaggaactgaacgctggccttcacgtaatgatactgctgctgttattcctggctctagccctcgcattggtgagcatggggtttgctatcctcaacatgatccaagttccgtatagagcagttagcgggcccggcgggatttgtctgtggaatgtcctggcagggggcgtggtggccctggctattgccagcttcgtggcagcggtgaagttccatgatcttacggagcgcatcgccaactttcaggaaaaactattccagtttgtggtggtggaggagcagtatgaggaatcattctggatttgcgttgcctctgcctccgcacatgctgccaacttggtagtagtagctatctcccaaatcccactgcccgagataaagaccaagattgaagaggctactgtgactgcagaggacattctctattag

SEQ ID NO: 41470 - DNA, 681 bp, Artificial Sequence
  Description of Artificial Sequence: Synthetic coding sequence
atgcccaccaccaagaagaccctgatgttcctgagcagcttcttcacctcactcggcagttttatcgtcatctgcagcatcctcggaacacaagcctggataacaagtaccattgctgttcgagactcagcctctaatggctcaattttcattacatacgggctattccggggggagtcatcggaggagcttagtcatggacttgcggagcctaaaaagaagttcgcagtcttagagattttgaacaacagctcccaaaaaaccctccatagcgtcacaattttgttcctcgtgctctcccttattacgtccctgctgtctagcgggtttacattttacaacagcatcagcaacccgtaccagacatttttgggacctactggagtgtatacttggaacggtctgggtgcaagttttgtcttcgttacaatgatcctgtttgtcgccaatacccagtcaaaccaactttccgaagaactcttccagatgctctatccagcaacgactagcaaaggaactactcactcttatggatattcgttttggctgattttgctggtaattctgctgaacatcgtgactgtgaccattattatcttctatcagaaggcaagataccaacggaaacaggagcagagaaagccaatggaatatgcacctcgtgatggaatccttttctag

SEQ ID NO: 41471 - DNA, 687 bp, Artificial Sequence
  Description of Artificial Sequence: Synthetic coding sequence
atggccagcaccgccagcgagatcatcgccttcatggtgagcatcagcggctgggtgctggtgagctcaaccttgccaacagactactggaaggtgtcgactatcgacgggactgtgattacgaccgccacctactgggctaacttgtggaaagcctgcgtgacagactccaccggggtttctaattgcaaagatttcccaagcatgctggctttggacggctatattcaggcctgcaggggattgatgatcgccgcagttagcctgggtttcttcggctcaatcttcgctctttttgggatgaagtgcactaaagttggagggtcagacaaagctaaggccaagattgcatgtctggccggcatcgtgtttattctgtcagggctgtgttccatgacgggatgttctctgtacgccaacaaaattacgactgaattctttgaccctctgtttgtcgagcagaagtatgagctgggtgctgctctttttatcgggtgggccggtgcaagcctgtgcattatcgggggcgtaattttctgtttttctatctctgataataacaagaccccaagatacacctataatggcgcgacctccgtcatgagctccagaacgaagtaccatggtggtgaagactttaaaaccactaatcccagtaagcagttcgataagaatgcatatgtttag

SEQ ID NO: 41472 - DNA, 222 bp, Artificial Sequence
  Description of Artificial Sequence: Synthetic coding sequence
atgatcgccgccgtgagcctgggcttcttcggcagcatcttcgccttatttgggatgaagtgtactaaggtgggcggctccgataaagcaaaagcgaaaattgcttgtttggccgggatcgtgttcatcctgagcggtctgtgcagcatgactgggtgttctttgtatgccaataagattaccaccgaattctttgatccgttattcgtggaacagaaatag

SEQ ID NO: 41473 - DNA, 681 bp, Artificial Sequence
  Description of Artificial Sequence: Synthetic coding sequence
atgagccgggcccagatctgggccctggtgagcggcgtgggcggctttggcgctctggtagccgcaacaacgtccaacgagtggaaggtaacaacacgagccagcagtgtcatcactgccacctgggtctaccagggcctttggatgaactgcgctgggaacgcactgggttcctttcactgccgtcctcactttacaatttttaaggtggcagggtatatccaggcctgtcgaggccttatgattgcagccgtttctctcgggttcttcgggtctatatttgccctcttcggtatgaaatgtacgaaggtggggggctcagacaaagcaaaagctaaaatcgcatgtctggccggaattgtctttatcttatctggactgtgctctatgactggttgttctttgtacgctaacaagattacgaccgaattttttgacccactgtttgtcgagcagaaatatgagctgggggccgccttgttcattggctgggccggagcctctctgtgcatcattgggggggttatcttctgcttttccatctccgataacaacaagaccccacgctacacttataatggggccacatccgtgatgagctctcgaactaagtaccatgggggagaggacttcaaaacaaccaatccttctaagcaatttgataaaaacgcctacgtttag

SEQ ID NO: 41474 - DNA, 735 bp, Artificial Sequence
  Description of Artificial Sequence: Synthetic coding sequence
atgggctgccgggacgtgcacgccgccaccgtgctgagcttcctgtgcgggatcgcatcggtggccggtttgttcgctggcacgttgctgcccaattggagaaaactgaggctcatcaccttcaatagaaacgaaaagaatcttaccgtgtacaccgggttgtgggtgaagtgcgcacggtatgatggatctagtgattgtctgatgtatgacaccacctggtattctagcgtggaccagctggacctgagagtcctccagttcgccttaccactcagtatgctgattgcaatgggagccttgctgctgtgtcttatcggtatgtgcaataccgcattcagatcttccgtcccaaatataaaattggcaaagtgcctggtaaattcagcagggtgtcatctagtggccgggctccttttctttctggcaggaaccgtcagtctgagccctagtatatgggtaatattctacaatatccacctgaacaagaaatttgaacctgttttctctttcgactacgcagtttatgttaccattgcctccgctgggggacttttcatgacttcgctcattctgtttatctggtattgcacctgcaagtctctccccagcccattctggcagccgttgtactcacatcccccctccatgcatacctatagccaaccgtactccgcccggagtcggctctcagcaatcgagatcgacattccagtggtgagccacaccacatag

SEQ ID NO: 41475 - DNA, 564 bp, Artificial Sequence
  Description of Artificial Sequence: Synthetic coding sequence
atgggctgccgggacgtgcacgccgccaccgtgctgagcttcctgtgtggcatcgcttccgtcgctggactttttgccggcactctgttgccgaactggcggaaactcaggctgattacatttaaccgcaatgaaaagaatctaaccgtgtacacgggcttgtgggtgaaatgtgcccggtacgacggttcaagtgactgcctgatgtacgacaccacttggtactcatccgtggaccagctggatctcagggtccttcagtttgcactgccgttgagtatgctgatcgcaatgggcgctcttctgctgtgtctgatcggaatgtgcaacactgcctttcgttctagcgtgccaaatatcaaactggccaaatgtctagtcaacagcgcaggttgccacctggttgcaggcttattgttcttccttgccgggaccgtcagcctttctccatcaatttgggtgatcttctataacattcatttgaataagaaattcgagcctgtgttctcttttgactacgccgtgtacgtgacaattgctagtgctgggggtctgttcatgtag

SEQ ID NO: 41476 - DNA, 735 bp, Artificial Sequence
  Description of Artificial Sequence: Synthetic coding sequence
atgggctgccgggacgtgcacgccgccaccgtgctgagcttcctgtgcggcattgcctccgtcgccggactgtttgcaggcacgctcctacctaactggcgcaaactgaggctaataacattcaaccgaaatgagaaaaaccttaccgtgtacaccgggctatgggtgaagtgtgctaggtatgacggcagctccgattgcctgatgtatgacaccacctggtactcttctgtcgatcagctggatctgcgagtgctccagtttgccctacccctgagcatgctaatagcaatgggcgccctccttctctgtcttattggcatgtgtaacacagcctttaggtctagcgtccctaatattaagctggccaagtgcctggtgaattcagcaggctgccatcttgtggccggtttactgttctttctggcagggaccgtctctttgtcaccgtcaatctgggtaattttttacaacatccatctcaataagaagtttgaacctgtcttcagcttcgactatgctgtctacgtcaccattgcgagtgcagggggtctgttcatgacctcgctgatcctgtttatctggtactgcacctgtaaaagtctgcctagccctttctggcagccattgtatagtcatccaccgagcatgcacacctacagtcagccatattccgcccggagccggctgagtgcgatcgaaatcgatatccctgtagtgtctcatacaacctag

SEQ ID NO: 41477 - DNA, 528 bp, Artificial Sequence
  Description of Artificial Sequence: Synthetic coding sequence
atgggctgccgggacgtgcacgccgccaccgtgctgagcttcctgtgtggtattgcttccgtggctggcctgttcgctggaacccttctgcctaactggcggaagctaagactaattaccttcaatcggaacgaaaagaatctaactgtgtacaccggactgtgggttaaatgcgccagatacgacggctcttcggattgcctaatgtatgacactacctggtacagtagcgtggatcagctcgacctgcgggtgctccagtttgctttgcctctgtcaatgctgatcgctatgggagcgctgctgctgtgcttgataggcatgtgtaataccgcttttcgatcttccgtaccaaacatcaaactggctaagtgtttggttaacagtgccggatgccacctcgtggcgggcctcctgttttttttggctggaacagtgtctctgtcacccagcatatgggtcatcttctacaatatccaccttaacaagaagttcgagcccgtcttctcttttgattacgccgtgtag

SEQ ID NO: 41478 - DNA, 528 bp, Artificial Sequence
  Description of Artificial Sequence: Synthetic coding sequence
atgggctgccgggacgtgcacgccgccaccgtgctgagcttcctgtgtgggatcgccagtgtggcagggctgttcgccggcactctcctgcccaattggcggaagttgcggttgattacgttcaaccggaatgagaaaaaccttacagtttacacaggcctatgggtcaagtgcgctcgatatgacggatccagcgattgcttgatgtacgacaccacatggtatagcagcgtggatcagttggatctcagggtgcttcagtttgctttgcccttgagcatgttgatcgccatgggcgccttactgttatgcctcattggaatgtgcaataccgcttttcggtcgtccgtacccaacatcaaactggcgaagtgccttgttaattctgccggatgtcacctggtggccgggctactgttctttctcgctgggactgtcagtctgagtcccagcatatgggtgatcttctacaacatccaccttaacaaaaaatttgaacctgtcttttctttcgactacgccgtgtag

SEQ ID NO: 41479 - DNA, 381 bp, Artificial Sequence
  Description of Artificial Sequence: Synthetic coding sequence
atgggctgccgggacgtgcacgccgccaccgtgctgagcttcctgtgcggaattgcctcggtcgccgggctctttgctgggaccctactgcccaattggcgcaagttgcgcctgatcacttttaaccgaaacgaaaaaaatctgaccgtgtacacaggcttgtgggttaagtgcgcccggtacgatggcagtagtgattgtttaatgtatgacaccacctggtacagttcagtggatcagctggatcttagggtgttgcagtttgcactaccattaagtatgctgatcgccatgggcgctctattgctctgcctgattggtatgtgtaatacagcctttagaagttccgtgcccaatatcaagctcgcaaaatgtctctag

SEQ ID NO: 41480 - DNA, 735 bp, Artificial Sequence
  Description of Artificial Sequence: Synthetic coding sequence
atgggctgccgggacgtgcacgccgccaccgtgctgagcttcctgtgtggtatcgcctccgtggccggtctgtttgctggcacactgctgcctaattggagaaaacttaggctgattacttttaatcgcaatgaaaagaatctgaccgtgtatactgggttgtgggtgaagtgtgctcgctacgacggaagcagcgattgccttatgtacgataccacttggtacagctcggttgatcaactggatttacgcgtgttacaatttgccctgcccctgagtatgttgatcgctatgggggccctgttattgtgcttaattggcatgtgcaacactgccttcagatcaagcgtgcctaatattaaactcgccaagtgcttggtgaattccgccggttgccatctcgtggccgggctgttgttcttcctcgcaggaacagtgtcactgtctccctccatctgggtgattttctacaacatccatctgaacaagaagttcgaacccgtgttttcctttgactatgctgtgtatgtcactattgcctccgccggcggtctgttcatgactagtcttatcttgttcatctggtattgcacttgcaaatctttgccatctcctttttggcagccgctctactcccatcctccgtcaatgcatacatacagccagccttatagtgcaagaagtaggctcagtgccattgagatagacatcccagttgtgagccataccacatag

SEQ ID NO: 41481 - DNA, 735 bp, Artificial Sequence
  Description of Artificial Sequence: Synthetic coding sequence
atgggctgccgggacgtgcacgccgccaccgtgctgagcttcctgtgtgggattgcctccgtcgctggcctctttgccggcactttgctgccaaattggagaaagctgaggttgatcaccttcaacagaaacgaaaaaaacctgaccgtgtatactggtctatgggtgaagtgtgcgcgctacgacggctcttctgattgcctcatgtatgacaccacctggtatagtagcgtcgaccaattggatttgcgagtgcttcagtttgctctcccgctctcaatgctcattgccatgggcgccttgttgctgtgcctgatcggcatgtgtaatacggccttcagatcatctgtgcccaatatcaagttggctaagtgtctcgtcaacagtgcaggttgccacctggttgccggcctgttgttttttctagccgggacagtttctcttagcccatcaatctgggtgattttctacaacattcacctgaacaaaaaattcgaacccgtcttttccttcgactacgccgtatatgtcacaattgccagtgcaggcgggctgtttatgaccagcctgatcctatttatctggtattgcacctgcaagtctttacccagcccattttggcagcccctgtacagccaccccccctcaatgcacacttatagtcagccttatagcgcccggagtaggctttccgccattgagattgacattccagtcgtgtcacacacaacttag

SEQ ID NO: 41482 - DNA, 687 bp, Artificial Sequence
  Description of Artificial Sequence: Synthetic coding sequence
atgagcatggccgtggagaccttcggcttcttcatggccaccgtgggcctcctgatgctcggtgtaacactgcccaacagctattggagagtgtctacggtccacggtaatgtgattacaacgaatactattttcgagaatctgtggttctcatgtgccaccgactctctgggggtgtacaattgctgggaatttccctctatgcttgctctgagcgggtacatccaggcctgccgcgccctgatgattaccgccatcctcctcgggttcctgggtcttctactgggcatcgcagggctacgctgcacaaacattgggggcctggagctttcgaggaaggcgaagctggccgctactgcaggcgccctacatatcctcgccggcatctgcggaatggtggcgatcagctggtatgctttcaacattaccagggacttcttcgacccactttaccctggaacaaaatatgagctggggccggctttgtacttggggtggtcggccagtttgattagcatcctggggggcctctgcttgtgctccgcctgctgttgtgggtccgacgaagatcctgcagcctcagctcggagaccataccaggcacctgtgagcgtcatgcctgtcgccactagtgatcaggagggcgattccagcttcgggaagtacggaagaaatgcctatgtctag

SEQ ID NO: 41483 - DNA, 687 bp, Artificial Sequence
  Description of Artificial Sequence: Synthetic coding sequence
atgagcatggccgtggagaccttcggcttcttcatggccaccgtggggctgctgatgctgggggtgacattacctaattcttactggagggtttccaccgtccacggcaatgtaataaccacaaataccatcttcgagaatctctggttcagttgtgctacggatagcttgggggtctataattgctgggaatttccaagcatgctggccctttctggctatatccaggcttgtcgcgcactgatgattactgcaattcttctgggattcttaggcctgctgctcgggatcgcgggtctgcggtgcacaaatattggtggactggaattgagcagaaaggcgaagctggccgcaaccgccggggcattgcatatcctcgcaggaatctgcggaatggtcgccataagctggtacgccttcaacatcacgagagatttttttgatcccttataccctgggaccaaatacgagctgggacctgccttgtacctgggatggagtgcctctctgattagtatcctgggagggctttgtctctgtagtgcatgttgttgcgggtctgacgaggaccctgccgctagtgcaagacggccctatcaggcacccgttagcgtgatgcccgtggccacctctgatcaggagggcgattcttctttcggaaagtacgggcgcaatgcctacgtttag

SEQ ID NO: 41484 - DNA, 675 bp, Artificial Sequence
  Description of Artificial Sequence: Synthetic coding sequence
atggccttctaccccctgcagatcgccggcctggtgctgggcttcctaggcatggtgggaacattggctaccaccctgttgccccagtggagagtttcagcatttgtcgggtcaaatatcatcgtgttcgaacggctgtgggaaggcctttggatgaactgcatccggcaggcacgagtgcgcttgcagtgtaaattctattcctctcttctagctctacccccggccttggagaccgccagagcccttatgtgcgttgcagttgctctgagccttatagccttactgatcggcatctgcggaatgaagcaggtgcagtgcacaggctctaatgagcgcgcaaaggcctaccttctcgggacctcaggggttctttttatcctgaccgggattttcgttctgattcctgtttcgtggacggcgaacatcatcatccgcgatttttataatcccgccatacacatcggccagaaacgcgaactcggcgcggccctcttccttgggtgggcatcggcggcagttctcttcatcggcggtggcctcctgtgcggattttgctgctgcaacaggaagaaacaggggtatagatatccagtccctggctacagagttccacataccgacaagagacgcaataccaccatgctgtccaaaacttccacaagctacgtctag

SEQ ID NO: 41485 - DNA, 693 bp, Artificial Sequence
  Description of Artificial Sequence: Synthetic coding sequence
atggccagcctgggcctgcagctggtgggctacatcctgggcctgcttggactcctcgggacgctggtggctatgttacttccttcctggaagaccagttcttacgtcggcgcttcaattgtgaccgccgtggggttttctaaggggttatggatggagtgcgccactcactctactggcataacccagtgcgatatatactctacattattaggtctccctgcagacatccaggctgcccaggctatgatggtgacctcatctgcgatctcgtcacttgcgtgcataatcagcgtcgtgggtatgaggtgcacagtgttttgtcaggagagcagagccaaagacagggtcgcggtggccgggggcgtgttcttcatcttggggggcctcttgggattcattcctgtggcatggaacctgcacgggattttgagggacttctacagccctctcgttcccgatagcatgaaatttgaaatcggcgaagcgctgtatttgggtataatcagcagcctgttcagcttaatagctggcataatcctgtgcttttcgtgtagctcccagaggaatagatccaattactatgacgcgtatcaagcccagcccttggccacccgctcttcccctagaccaggacaaccccctaaggtgaagtctgagtttaattcctattcattgacggggtatgtgtag

SEQ ID NO: 41486 - DNA, 693 bp, Artificial Sequence
  Description of Artificial Sequence: Synthetic coding sequence
atggccagcctgggcctgcagctggtgggctacatcctgggcctgctgggcctgttgggaactctggtcgccatgttgcttccatcttggaagactagcagttacgtgggcgcctctattgtaactgccgtgggattcagcaagggcttgtggatggagtgtgctacccactcaaccggcattacccaatgtgacatctatagcactcttcttggcctccctgcagacatacaagcggctcaagcaatgatggtgacttccagcgctatctctagtttggcatgtattatctctgtggtggggatgagatgcaccgtcttttgccaggagagtagggcaaaggaccgcgtagcagtggccgggggtgtgttcttcattcttggaggacttttggggttcattcccgtggcctggaacctacacggtattctccgagatttctactcccctttggttccggacagtatgaaatttgagattggcgaggccctttacctcggcataattagctctctattcagcctcattgcaggcatcatcttatgcttcagctgttcctctcagcgtaatcgttccaactactacgacgcctaccaggcccagcctttagcgactcgctcctctccacgccccggtcagccccccaaggtgaagagtgagttcaattcatactcccttactggatatgtgtag

SEQ ID NO: 41487 - DNA, 693 bp, Artificial Sequence
  Description of Artificial Sequence: Synthetic coding sequence
atggccagcctgggcctgcagctggtgggctacatcctgggcctgttaggtctgctgggaacgctcgtcgctatgctgctgccaagctggaagacaagttcttacgtgggcgcaagcatagtgacagctgtcggattcagcaagggcttatggatggagtgcgccacacatagcacaggtataacccagtgtgatatctattcaactctgctgggcctgccagcggatattcaggcggctcaggccatgatggtgacttcctcggccattagctctctagcatgcattatatccgtggtgggaatgcggtgcactgtgttctgtcaggagagccgagcaaaggatcgggtggctgtggcggggggcgtctttttcattctgggagggctcttggggttcattcctgttgcgtggaacctacacggaattcttagagatttctacagtcctctggtgcccgacagcatgaagttcgaaatcggtgaagccctctatctgggcatcatatccagcctgttttcgcttatcgccggtataatactgtgtttttcatgcagctctcagcggaacagaagcaattattatgacgcttaccaggcgcagcccctggcaaccagaagctccccgcgccccggtcaacctcccaaggtaaagagcgagttcaacagttactcactcacaggttacgtgtag

SEQ ID NO: 41488 - DNA, 660 bp, Artificial Sequence
  Description of Artificial Sequence: Synthetic coding sequence
atggccagcgccggcctgcagctgctggccttcatcctggccctgtccggtgttagcggcgtgctgacagcaactctactgcctaactggaaagtcaacgtggatgtggactctaacatcattactgccattgtgcaattgcatggtctgtggatggactgcacatggtactcaaccgggatgttcagctgtgcactgaagcatagcatactgtccctgccaattcatgtccaggcagcacgggctacaatggtattagcctgtgtcctgtccgcactgggaatctgtacaagtacagtgggtatgaagtgcacacggctggggggggacagagagacaaagagtcacgctagttttgcaggaggggtatgcttcatgtcagccgggatttcttcactgataagcactgtgtggtacactaaggaaatcatcgcgaatttcttggatctcaccgtccccgaatcaaataagcacgagccaggaggagcgatctacatcggttttatatccgccatgctgctatttatcagcggcatgattttttgcacaagctgtattaagcgcaatcctgaggcccggctggatccaccaacccagcagccaatctcaaacacgcagctagaaaacaattcgacgcacaatctcaaagactacgtgtag

SEQ ID NO: 41489 - DNA, 663 bp, Artificial Sequence
  Description of Artificial Sequence: Synthetic coding sequence
atggccctggtgttccggaccgtggcccagctggccggcgtgagcctcagcctgctcggctgggtgctttcctgtctgactaattatctgccacactggaaaaatttgaacctggaccttaatgaaatggagaactggacaatggggttgtggcagacatgcgtgattcaagaggaagttgggatgcagtgcaaggactttgacagctttctggctttgccagctgagctgcgggtcagtcggatactgatgttcctgtcaaacggattgggtttcctcgggctgctcgtgtccggctttgggctggattgtctgaggattggcgagtcccagagggatcttaaaaggagattactcatcctgggtggcatactgtcctgggctagtggcgttacagctctggtgccagtttcctgggtcgcccacaaaactgtgcaagaattctgggatgagaatgtaccagacttcgtgccacgctgggaattcggtgaggctctattcttggggtggttcgctggcctgtccctgctgttggggggctgtttactgcattgcgccgcctgctcttcccatgcaccattggctagcggccattatgcggtggcgcagacccaggatcaccaccaggaacttgagacacggaataccaatctgaaacactag

SEQ ID NO: 41490 - DNA, 879 bp, Artificial Sequence
  Description of Artificial Sequence: Synthetic coding sequence
atgcggacccccgtggtgatgaccctgggcatggtgctggccccctgcggacttctgcttaacctcactgggactctggcaccaggatggagactggtgaaagggtttcttaaccagcctgttgacgtggagctctatcagggcctctgggacatgtgcagagaacagtcttctcgtgagcgcgagtgcggccagacagatcagtggggctactttgaagcccagcccgtcctggtcgccagggctctgatggtaacgagtctcgcagccactgtcctgggacttcttctcgcctcccttggggtgaggtgttggcaggacgagccgaacttcgtgttggcagggttaagtggtgtggtcttgtttgtcgccggtcttctcgggctaatccctgtttcgtggtataaccattttcttggcgacagagatgttctacctgcccctgcctcccccgtcaccgtccaggtgagctattcgctggtcttagggtacctggggtcttgtctcctgctgcttggtggattcagcttggccctttccttcgccccctggtgcgatgaacggtgtcgccgccgccggaaaggccctagcgccggaccgcggaggtcgtctgtgtccaccatccaggtggagtggcctgaaccagacctcgcccctgcgatcaagtactacagcgacggccaacacaggcctccgcccgcccagcatagaaagcctaagccaaagcctaaagtgggctttcccatgcccaggccacgccccaaggcatacacaaacagcgtggacgtgctggacggcgaggggtgggagagtcaggacgccccgagctgcagtacacatccttgcgatagtagtctgccgtgcgatagcgatctttag

SEQ ID NO: 41491 - DNA, 690 bp, Artificial Sequence
  Description of Artificial Sequence: Synthetic coding sequence
atggcctggagcttccgggccaaggtgcagctgggcggcctgctgctgtctctgcttggttgggtctgctcgtgtgttactacaatactgcctcaatggaaaacactgaatttagagctcaatgagatggaaacttggatcatgggaatctgggaagtttgtgtcgatcgcgaggaagtcgctactgtttgtaaagccttcgagagtttcttgagtctgccccaggagttgcaggtagctcggattctcatggtagcttcccatggtctggggctgttgggcctcctgctatgcagtttcggcagcgaatgcttccagtttcatagaattcgatgggtctttaagagaaggctggggttgctgggtaggacattggaagcgtctgcaagcgccaccaccctcctacctgtgtcctgggtcgctcacgcaacaatccaggacttctgggatgactctattcctgatataatcccaagatgggagttcgggggagccctgtatctgggctgggccgccggtatatttcttgctctcgggggtctgctcctgattttttctgcttgtctaggcaaggaagacgtgcccttcccattgatggccggaccaacagtccccctctcctgcgcacctgtcgaagagtcagatggaagttttcacctgatgctgaggccgcgaaatctggttatatag

SEQ ID NO: 41492 - DNA, 663 bp, Artificial Sequence
  Description of Artificial Sequence: Synthetic coding sequence
atggccagcgccggcatgcagatcctgggcgtggtgctgaccctgcttggctgggtaaacggactggttagctgtgcactgcctatgtggaaggtgaccgcattcatcggaaactcaatcgtggtagcccaggtggtctgggagggcttgtggatgtcttgcgtcgtccaaagtaccggtcagatgcagtgtaaggtctatgattccctactggccttgccccaagatctccaggccgccagagctctctgtgttatcgctctgctagtagcgctgttcgggttgctggtgtaccttgctggcgccaagtgcaccacgtgcgtggaggaaaaagattctaaggcaaggcttgtactcaccagcgggattgtattcgtgatttctggcgtactgaccttgattcctgtgtgttggacagctcatgcaataatcagagatttctataaccctctggtggctgaagcacagaagagggagctgggtgcttccctgtacttgggctgggccgcgagcgggctgctgcttctgggaggaggtctgctgtgctgcacttgtcctagcgggggaagccaggggccgagccattatatggctaggtattccacgagtgctcccgctatatcacgggggccaagtgagtacccgacaaagaattacgtgtag

SEQ ID NO: 41493 - DNA, 663 bp, Artificial Sequence
  Description of Artificial Sequence: Synthetic coding sequence
atggccagcgccggcatgcagatcctgggcgtggtgctgaccctgctgggatgggtaaacgggcttgtgagctgcgcgctgcctatgtggaaggtgactgcttttatcggcaatagtattgttgtggcacaagtggtgtgggaaggtctctggatgtcctgcgtagtacagagcaccgggcagatgcaatgtaaagtttatgattctctgctcgcactaccccaggatcttcaggcagcccgagccctgtgtgtgatcgccttgctggtcgctctgttcggtttactggtttatctggcaggcgcaaagtgcacaacctgcgtggaagaaaaggacagcaaagcgaggctggttcttacttctggcatagtgttcgtgataagcggagttctcaccttgattcctgtatgttggactgcacacgccattatacgcgacttctataatcccctggttgcggaggctcagaaaagggagttgggtgccagtttgtacttgggctgggccgcttccgggttattgctcttaggtgggggcctgctgtgttgtacttgccccagcgggggctctcagggcccttcccattacatggccaggtatagtacaagcgcaccagccatcagccgtggaccttcagaatatccgaccaagaattacgtatag

SEQ ID NO: 41494 - DNA, 636 bp, Artificial Sequence
  Description of Artificial Sequence: Synthetic coding sequence
atggccaacagcggcctgcagctgctgggcttcagcatggccctgctaggatgggtcggattggtcgcttgtacagctatcccccaatggcagatgtctagctatgcgggagacaacattattacggctcaggcaatgtataagggactttggatggactgtgtgacacagtctaccggtatgatgagttgcaagatgtatgattcagtgttggcactgtcagcggccctacaggccactcgggcactgatggtcgtctccctggttctggggtttctggccatgtttgttgccaccatgggcatgaaatgcacgcgatgtggtggcgatgacaaggtaaagaaggcaaggatcgcaatggggggagggataatcttcatcgtagcggggttagcggccctggtggcctgttcttggtacggacaccagatcgtcaccgacttttataaccctcttatccctacgaatatcaagtatgagttcggacctgcgattttcattggctgggccgggtccgccctggtcattcttgggggggcacttctgagttgctcgtgtcctggcaacgagagcaaggccgggtaccgcgtgcccagaagctatcccaagtctaatagtagtaaggagtacgtgtag

SEQ ID NO: 41495 - DNA, 636 bp, Artificial Sequence
  Description of Artificial Sequence: Synthetic coding sequence
atggccaacagcggcctgcagctgctgggcttcagcatggccctgctgggctgggtcgggctggtggcttgtactgccattcctcagtggcagatgtcttcatacgcaggcgacaatatcatcactgcgcaggccatgtacaaggggttatggatggactgtgtgacacagagtacaggcatgatgagctgcaagatgtatgactccgtgcttgcgttgagcgctgcactgcaggctacccgtgcactgatggtggtcagtctcgtgctgggcttcctcgctatgtttgtagcgaccatgggaatgaaatgtactcgttgtggaggggacgacaaggttaaaaaagctcgcatagctatgggaggcggtatcattttcatcgtggcaggcctggcagcattggttgcttgcagttggtatggacatcaaatcgtcactgacttctataatcctctgatcccaactaatatcaagtacgaatttggaccagccatatttatcggttgggccggttcagccctcgttatacttggaggggcactgttaagctgctcatgccccgggaacgagagtaaagctggttacagggttccccgcagctacccaaagagtaattcttccaaggagtacgtgtag

SEQ ID NO: 41496 - DNA, 438 bp, Artificial Sequence
  Description of Artificial Sequence: Synthetic coding sequence
atggccaacagcggcctgcagctgctgggcttcagcatggccctgctggggtgggtagggctcgtagcctgtactgcaatcccgcaatggcaaatgagtagctacgctggcgacaacataataaccgcacaggccatgtacaagggcctgtggatggattgtgtgacccagtctacgggcatgatgtcctgtaagatgtatgatagcgtgttggccttgtccgcagctctgcaggccactcgtgcactcatggttgtcagcctcgtgctgggttttctggccatgttcgtcgccacgatgggaatgaaatgtaccagatgtgggggcgacgacaaggtgaaaaaggcccggatcgcaatgggggggggtatcattttcattgtcgccggcatgagtctcgcactgccatcactgctagccggtcagggcctgccgtag

SEQ ID NO: 41497 - DNA, 678 bp, Artificial Sequence
  Description of Artificial Sequence: Synthetic coding sequence
atggccacccacgccctggagatcgccggcctgttcctgggcggcgtgggaatggttggtaccgtggcggtgaccgtcatgccccagtggagggtctcagcatttatcgagaacaacatcgtggtgtttgaaaatttttgggaaggtctttggatgaactgtgtgcgccaggccaacattagaatgcagtgcaagatttacgattctctattggcattgagtccagatctccaagctgcccgtggtcttatgtgcgctgcctcagtgatgtcttttctggctttcatgatggccattctgggaatgaagtgtactcggtgcacaggtgataacgaaaaagtcaaggcgcacatcttgctgactgcaggaatcatctttatcattactgggatggtggtgctgatccccgtctcttgggtggctaacgccattatccgggatttctacaacagcattgttaacgttgcccagaagagggagctcggcgaggccctctatctgggatggaccactgccctcgtgctgattgtgggcggcgcactgttctgctgcgtgttttgttgtaatgagaaatcctccagctacagatattctatccccagccataggactacccagaagtcatatcatacgggcaagaaatcaccctcagtgtatagccggtctcagtacgtctag

SEQ ID NO: 41498 - DNA, 678 bp, Artificial Sequence
  Description of Artificial Sequence: Synthetic coding sequence
atggccacccacgccctggagatcgccggcctgttcctgggcggcgtcgggatggttggtacagtcgccgtgactgtcatgccccagtggcgagtctctgccttcattgaaaataacatcgtggtgttcgagaacttttgggaaggcctctggatgaactgtgttcgacaggccaatattaggatgcagtgcaagatctacgacagcttgctagcactcagcccagatctccaggctgcgagaggcctgatgtgtgctgcaagtgttatgtcattcctggcgtttatgatggcaatcttaggcatgaaatgcacacgctgtaccggtgacaacgaaaaggtcaaggcacacatcctgctgaccgccgggatcatcttcattatcacgggaatggtggtcttgatacccgtgagctgggtggctaacgccatcatccgagatttctacaactctatcgttaatgtggctcagaaaagggaattgggagaggctctatacttggggtggactactgctctggtgctgatcgtgggcggagccctcttctgctgtgttttctgctgcaatgagaaaagctcttcttacagatacagtatcccatcgcatcggacgacccagaaatcttatcacacaggaaaaaaatcaccatccgtatattcacgaagccaatatgtctag

SEQ ID NO: 41499 - DNA, 702 bp, Artificial Sequence
  Description of Artificial Sequence: Synthetic coding sequence
atggccacccacgccctggagatcgccggcctgttcctgggcggcgtgggcatggtagggacagtggcagtgactgtgatgccgcaatggcgggtgagtgcttttattgaaaacaatattgtggtgttcgaaaatttctgggagggcctgtggatgaactgcgtgaggcaagctaatatacgcatgcagtgcaaaatctacgattccctgttagccctttcccctgatcttcaggctgcgagaggtctcatgtgcgcagcctcggtgatgagctttcttgccttcatgatggctattttgggaatgaagtgtactcggtgcaccggagataacgagaaggtgaaggctcacatcctgcttaccgccggaatcatctttattattactggcatggtcgtcctcattcctgtgtcctgggtggcaaatgcaatcatcagagatttctataatagcatcgtcaacgtggctcagaagcgcgaattgggtgaagctctgtacctcggatggaccaccgctttagtgctgattgttgggggcgccctgttttgttgtgtgttctgctgtaacgagaaaagttcaagctacaggtattccatcccttcccaccgaaccactcagaagtcttaccacactggcaagaaatcacggcttcttcagaagtcagtatgtgttgtggtctatgttttcctgaccctcctgtag

SEQ ID NO: 41500 - DNA, 654 bp, Artificial Sequence
  Description of Artificial Sequence: Synthetic coding sequence
atggccagcaccggcctggagctgctgggcatgaccctggccgtgctgggctggctgggcactctggtgtcttgtgcactgccgctctggaaggtcaccgcatttattgggaactccatcgttgttgcacaggtcgtgtgggagggcctgtggatgtcatgcgtagtacagagtacagggcagatgcagtgcaaagtatacgacagtttactggccttgcctcaggacttacaggccgccagagccctctgcgtgatagccttgttgttggctctgctgggtttactggtggcgattactggcgcccagtgtaccacatgtgtggaagacgagggggctaaagcacgtatagtgttgaccgccggagttatcctgctcttagccggaatcctggtcctcataccagtatgttggacagcacacgcgattatacaggacttttacaacccactcgtcgccgaagccctcaagagggagctgggtgcctctctttacttagggtgggcagccgccgctctgttgatgttaggaggtggcctcctgtgttgtacctgccctccgccgcaagtagaaagaccaagaggtccacgcttggggtattccataccttcaagaagcggagcatctggccttgataaaagggactacgtttag

SEQ ID NO: 41501 - DNA, 762 bp, Artificial Sequence
  Description of Artificial Sequence: Synthetic coding sequence
atggacaaccggttcgccaccgccttcgtgatcgcctgcgtgctgagcctgatttctactatatacatggccgcctcaatcggtaccgatttctggtatgaatatcgatcacccgtgcaggaaaattcctccgatctcaacaagagtatctgggatgagttcatttctgacgaggctgatgagaagacttataatgacgccttattccggtataatggtaccgtgggcttatggaggcgatgtataactatccctaagaacatgcattggtattccccccctgagcgtacggagagctttgacgttgtgaccaagtgtgtgagctttaccctgactgaacaattcatggaaaagttcgtggaccctggaaatcataattcggggatagatttactcaggacttatctctggagatgtcagtttctgctgcctttcgtgagcttgggccttatgtgttttggagcactcattgggttgtgtgcctgtatctgtcgcagtctgtacccaaccattgcaacgggcatactccatctgcttgctgggctctgcacactggggagcgtgagttgctacgtggctggaatcgagctgctgcaccagaagttggaattgccagataacgttagcggcgaattcggttggtccttttgtcttgcatgcgtcagtgcacccttgcagtttatggcatctgccttgttcatttgggcggcccacaccaatagaaaagaatatactttgatgaaagcctaccgggtcgcatag

SEQ ID NO: 41502 - DNA, 762 bp, Artificial Sequence
  Description of Artificial Sequence: Synthetic coding sequence
atggacaaccggttcgccaccgccttcgtgatcgcctgcgtgctgtctctgatatccaccatttacatggcggcgtccatcggcacggacttctggtacgaataccggagccccgttcaggaaaattccagcgacctgaacaagtcaatatgggacgaatttatatcggatgaggcggatgaaaagacatacaatgatgccttgttcagatataacgggaccgtgggcctgtggagacgatgcattacaattccaaaaaatatgcattggtactctccccccgaaagaacagagtccttcgacgtcgttactaaatgtgtctctttcactctgaccgagcagtttatggaaaaattcgtagaccctgggaatcacaattctgggatagacctcctgagaacctatctctggagatgccagttcctgctgccatttgtttctctgggtctgatgtgttttggggccttgatagggctctgtgcctgtatctgcaggtccctgtacccaactattgccacaggaatcctgcacctcttagctggcttatgtacactgggcagtgtgagctgctacgtcgcagggatcgagctgctgcatcagaagctggagctgccagacaatgtgtcaggcgaatttggctggtctttctgcctggcgtgtgtgtcagcccctttacagttcatggcctccgcactattcatctgggctgcgcacactaaccgcaaggaatacacgctgatgaaggcttaccgagtcgcttag

SEQ ID NO: 41503 - DNA, 762 bp, Artificial Sequence
  Description of Artificial Sequence: Synthetic coding sequence
atggacaaccggttcgccaccgccttcgtgatcgcctgcgtgctgtcactgatcagcactatatatatggctgcctctattggcacagatttttggtatgaatatcgttcccctgtgcaagaaaatagctcagatctgaacaagagcatatgggatgaattcatttcagacgaagctgacgagaagacgtataacgatgctctatttcgttacaacggtaccgtcggactgtggcgccggtgcattacgatccccaaaaatatgcattggtattcccctccggaacgtaccgagagctttgatgttgtgaccaaatgtgtttcattcacgttaaccgagcagttcatggagaaatttgtggacccaggcaatcacaattctggcatcgacctgctccgtacatatctttggaggtgccagtttctgctcccttttgtaagccttggcttgatgtgcttcggggcacttattggtctatgtgcttgcatttgtaggtcactctatccaacaattgccacaggcatcctgcacctactcgcaggtttatgtacgttgggaagtgtttcatgttatgtagccggtatcgaactgttgcaccagaaactcgaactcccagacaacgtctctggcgaatttgggtggtcattttgcctagcttgcgtgtcagcccccttgcagtttatggcctcggccttgtttatctgggctgcccacactaatcgtaaggagtacacattaatgaaagcctaccgagtcgcctag

SEQ ID NO: 41504 - DNA, 762 bp, Artificial Sequence
  Description of Artificial Sequence: Synthetic coding sequence
atggacaaccggttcgccaccgccttcgtgatcgcctgcgtgctgtccctgatttctactatatatatggcagcatcgatcgggaccgatttttggtacgaatacaggagtcctgtgcaagaaaattctagtgatcttaataaatcgatttgggacgaatttatcagtgacgaggctgacgagaaaacttataacgacgctctgttccgctacaacggtaccgtgggactgtggagacgctgcattacaataccaaagaatatgcattggtatagtcctcctgagaggaccgaatcatttgacgtagttactaaatgtgtttccttcactctaactgaacagttcatggaaaagttcgtggaccctggaaaccataatagtggcatcgacctgcttcgtacttatctctggcgctgtcaatttctgttgccctttgtgtccctgggactgatgtgtttcggcgccctgattggcctctgcgcttgtatctgcagatccctctaccctactattgcgactggaatcctacacctactggctggcctttgcacgctcggctctgtttcatgctatgtggccggtatcgaacttctgcaccaaaagctggagttacctgataatgtctccggcgagttcggatggtccttttgtctcgcttgcgtttccgcacccttgcagtttatggcatctgccttatttatttgggccgcacacacaaacagaaaggagtataccctgatgaaagcttatcgcgtcgcgtag

SEQ ID NO: 41505 - DNA, 831 bp, Artificial Sequence
  Description of Artificial Sequence: Synthetic coding sequence
atgggcggcgaccggctggagaacaagaccagcgtgagcgtggcctcatggtcatccctcaacgctaggatggataacagatttgccaccgcgtttgtaattgcatgcgtcctgagcctgatttccacaatatacatggcagccagcataggcactgatttctggtatgagtataggagccccgtccaggaaaactcctctgatctgaacaagtctatatgggatgagtttatctctgatgaggccgatgagaaaacatacaacgatgcactttttcgatacaacggcaccgttggcctctggagaagatgcataacaatcccaaaaaacatgcattggtactcaccaccagagcgcaccgaaagttttgacgtggtgactaagtgtgtgagttttacattgaccgagcagtttatggagaaattcgttgacccgggaaatcataattctggaattgatttgttgaggacatatctttggagatgccaattcctcctccctttcgtctcattaggactgatgtgtttcggggcactgatcggcttgtgcgcatgtatttgccgctcattgtaccccacaatagcaactggcatcctgcatcttcttgcaggcctgtgcaccttaggctcagttagctgttacgttgctggcattgagttgctccaccagaaactggagctgcctgataatgtttccggcgagttcggctggagtttttgtcttgcttgtgtgagcgcacccctgcagttcatggctagcgccctattcatttgggcagctcacaccaatagaaaggagtatacgctcatgaaggcctacagagtggcctag

SEQ ID NO: 41506 - DNA, 720 bp, Artificial Sequence
  Description of Artificial Sequence: Synthetic coding sequence
atggacaaccggttcgccaccgccttcgtgatcgcctgcgtgctgagcttaatctctactatttacatggcagcgtcgatcggcacggatttctggtacgaatatcgttctcctgtacaagagaattcatctgacctaaataagagcatctgggatgaattcataagtgacgaagctgatgagaaaacatacaacgacgcactgttccgatataatggcacagtaggactctggcgacgctgtatcaccattcccaagaatatgcactggtacagcccccccgagagaaccgagtcattcgacgtcgtcaccaagtgtgtttcttttactttaactgagcagtttatggaaaagttcgtggaccctgggaatcacaactccgggatagacctcttacgtacctacttatggcggtgtcagtttcttcttccgtttgtcagtctagggctcatgtgctttggggccctgatcgggctctgtgcctgcatttgcaggagtctctatccgaccattgccaccggaatactgcacctgcttgccggcctgtgcacactcgggtctgtgtcttgctacgtggccgggattgagttgttgcaccaaaaactcgagctgccggacaacgtctctggcgaattcggctggtcattttgtcttgcctgcgtttcggcccccctccaattcatggcaagcgccttatttatctgggcggcccacacttag

SEQ ID NO: 41507 - DNA, 762 bp, Artificial Sequence
  Description of Artificial Sequence: Synthetic coding sequence
atggacaaccggttcgccaccgccttcgtgatcgcctgcgtgctgtcattaatctcaacaatttacatggcagccagtatcggaacggacttctggtacgagtatagaagtcctgtgcaagagaattcatctgatcttaacaagtcaatatgggatgagttcatctccgacgaggcagatgagaagacctataatgatgctctgttccgttataatggcaccgttgggctgtggaggcggtgcatcaccatacctaagaatatgcactggtacagtccacctgaaagaacagagagcttcgacgtggtgacaaaatgtgtgagctttacccttactgagcaatttatggagaaattcgttgatcctggaaatcacaactcaggcattgacttgttgcgaacctatttatggcgatgccagtttctactgcccttcgtctccctagggctaatgtgctttggagctctcattggtctgtgcgcatgtatctgtcggagcctttaccctactatcgcaacggggattctgcacctgctggcgggtctgtgcactctcggctcagtgagctgttacgttgcaggtattgagttacttcatcagaaattagagctccccgacaacgtctcaggagaatttggctggtctttctgtctggcttgtgtcagcgctcccttgcagtttatggccagcgctctctttatatgggcagcccatacaaaccgcaaggagtacaccctgatgaaggcataccgagtggcctag

SEQ ID NO: 41508 - DNA, 270 bp, Artificial Sequence
  Description of Artificial Sequence: Synthetic coding sequence
atggacaaccggttcgccaccgccttcgtgatcgcctgcgtgctgagcctaatctccacaatctacatggcagcttccattggaactgacttctggtatgaatacagatcacccgtgcaggaaaattcctccgatttgaacaaaagtatttgggacgagttcatatcagacgaggccgacgagaagacttacaacgatgcacttttccgttataacggcacagtcggtttatggaggcggtgcatcactataccgaagaatatgcactag

SEQ ID NO: 41509 - DNA, 534 bp, Artificial Sequence
  Description of Artificial Sequence: Synthetic coding sequence
atggacaaccggttcgccaccgccttcgtgatcgcctgcgtgctgtcactgatcagcacgatttacatggctgcctctatcggcaccgacttttggtatgagtacaggtccccggttcaggaaaactcttccgatctgaataagtccatttgggatgaatttatcagcgacgaggcagatgagaaaacatataacgacgcgctgttccggtataatgggacagtaggattatggagacggtgtattaccatccctaaaaacatgcactggtacagtccccctgaaaggaccgagtccttcgatgtggtgactaagtgtgtgtccttcacgctgactgaacagtttatggagaagttcgtggatccgggaaatcacaactctgggatcgacctgctcagaacctacctctggcggtgccagtttctcctaccttttgtgtctttgggtttaatgtgttttggtgcccttattgggctgtgcgcatgtatttgtagatccttataccctaccattgccacaggaattttacactag

SEQ ID NO: 41510 - DNA, 438 bp, Artificial Sequence
  Description of Artificial Sequence: Synthetic coding sequence
atggacaaccggttcgccaccgccttcgtgatcgcctgcgtgctgtctcttatcagcacaatctatatggccgctagcattggcactgatttctggtacgagtaccggtccccagtgcaggagaatagttcagatttgaacaaaagcatctgggatgagtttatctctgatgaggccgatgaaaagacatataacgacgctttgttccgatacaatggaactgtagggctgtggagaaggtgcataacaatcccgaaaaacatgcactggtattcccccccagagcgcactgagtcgttcgacgtggtgactaagtgtgtgtctttcaccctgaccgagcagttcatggaaaagttcgtggatcctggcaatcataactccggaatagatctcctgagaacatatctgtggcgctgtcagttcctgttgcccttttag

SEQ ID NO: 41511 - DNA, 519 bp, Artificial Sequence
  Description of Artificial Sequence: Synthetic coding sequence
atggacaaccggttcgccaccgccttcgtgatcgcctgcgtgctgtcgttgatttcaaccatatatatggccgcgagcattggcacagacttttggtacgaatacaggtctccagtgcaggagaactcgagtgatttgaacaagtccatttgggatgaatttatcagtgacgaggccgatgagaaaacctacaacgatgcactgtttcggtataacggtaccgtcgggctctggaggcgctgtattaccattcccaagaatatgcactggtactccccccccgaacggaccgagagtttcgacgtagtgactaaatgcgtcagcttcacacttacagagcaattcatggaaaaatttgtggaccctggaaaccacaattccggcattgacttgctccgcacttatctttggcgctgccaattcttattaccatttgtgagcctgggcttaatgtgctttggtgcacttattggactctgcgcctgtatctgccggtccctctatccaaccattgcctag

SEQ ID NO: 41512 - DNA, 714 bp, Artificial Sequence
  Description of Artificial Sequence: Synthetic coding sequence
atggacaaccggttcgccaccgccttcgtgatcgcctgcgtgctgtctctgatttctaccatctatatggcagcctctatcgggactgatttctggtacgagtacaggtcccctgtgcaggagaatagttctgatctgaataagtcaatatgggatgaattcatctctgatgaggcggatgaaaagacctataacgacgccttgtttcgatacaacggaacggtcggcctttggcggagatgtatcacaattcctaaaaacatgcattggtattcacctccagagcgaaccgagtcttttgatgtcgtgacaaagtgtgttagcttcactctgacggagcagttcatggaaaagttcgtggacccgggaaatcataacagcgggattgatcttctcagaacttacttatggaggtgtcagtttctcctcccatttgtgagcctggggctcatgtgttttggcgccttgattggactgtgcgcctgtatctgtcggagtctgtaccccacgatcgctacgggcatcctgcacctgttggctggactctgcaccttaggaagcgtgagttgctacgtggcggggatcgagttgttacatcagaagcttgaattaccagacaacgtgtcaggcgaattcggctggtccttttgtctagcctgcgtatcagcgcccttgcagtttatggcgagcgcactcttcatctgggccgcctag

SEQ ID NO: 41513 - DNA, 762 bp, Artificial Sequence
  Description of Artificial Sequence: Synthetic coding sequence
atggacaaccggttcgccaccgccttcgtgatcgcctgcgtgctgagcttaatatcgaccatctacatggcagccagcatcggtacggacttttggtacgagtatcgtagtcccgtacaagagaacagcagcgacctgaacaaatccatttgggacgaatttattagcgatgaagctgatgagaaaacctacaacgatgcgctattccggtataatgggacagtggggctgtggcgaagatgtattacgattcccaagaatatgcactggtacagtccccccgaacgtaccgaatctttcgacgtagtaactaagtgtgtgagttttaccctgacggaacaatttatggagaaatttgtggatccaggcaatcataattcaggaatcgatcttctgcgcacatacctttggagatgccaatttttactgcctttcgtttctctgggtcttatgtgctttggagctctgatcggcctttgtgcctgtatctgtcgatctctctatccgacgattgccacaggtattcttcacctgttggctggtctttgcaccctgggctccgtgagctgctacgttgcgggaattgagctcttacaccagaagctggaattgccagataatgtatctggagagtttgggtggagcttctgcttggcttgtgttagcgcccccctacagtttatggcttcagcgttattcatttgggcagcccatacaaatagaaaagagtatacactcatgaaagcctatagggttgcctag

SEQ ID NO: 41514 - DNA, 477 bp, Artificial Sequence
  Description of Artificial Sequence: Synthetic coding sequence
atgggcgagagcttcgacgtggtgaccaagtgcgtgagcttcaccctgactgagcagttcatggagaaatttgttgaccctggcaatcacaattcagggattgacctgctcagaacctacctgtggagatgccagtttttgttgcctttcgtaagtcttgggctcatgtgctttggcgccttgatcggattgtgcgcctgcatttgccgctctctctaccctacaatagcaacaggcatactccatttgctggccgggttgtgtacactgggaagtgtcagttgctacgttgctggcatcgaactcctccaccagaaattggagttgccagacaatgtcagcggtgaatttggatggtcattttgcctggcctgcgtgtcagccccattgcagtttatggccagtgctctcttcatttgggcggctcacactaatcgaaaggaatatacgcttatgaaggcctaccgggtagcctag

SEQ ID NO: 41515 - DNA, 294 bp, Artificial Sequence
  Description of Artificial Sequence: Synthetic coding sequence
atggacaaccggttcgccaccgccttcgtgatcgcctgcgtgctgagtctgatttccacgatttacatggctgcgtctatcggaacagacttctggtatgagtacagatctcccgttcaagagaactcatctgatctgaataagtccatctgggacgagttcatcagtgatgaggctgacgagaaaacttataatgacgcattgtttcgctataacggaactgtgggcctctggagaaggtgcatcactatccctaaaaacatgcactggtattctcccccagagcgcacctag

SEQ ID NO: 41516 - DNA, 762 bp, Artificial Sequence
  Description of Artificial Sequence: Synthetic coding sequence
atggacaaccggttcgccaccgccttcgtgatcgcctgcgtgctgtctttgattagcactatatatatggctgcatcaatcggcacagacttctggtacgagtaccgcagtccagtccaagagaacagtagcgatctaaataagagcatctgggacgagttcatatcagatgaagctgacgaaaagacttacaatgacgccctctttcgatataatggcacagtgggcctgtggcggagatgtatcacaatccccaaaaatatgcactggtatagccctcctgaacgcactgagagctttgacgtagttaccaagtgcgtgagttttactctcacggaacagtttatggaaaaatttgtcgatcccggcaatcataatagcgggatagacttgcttcggacatatctctggcgatgccagtttcttctcccattcgtttctctgggcctgatgtgtttcggggccctaattggattatgcgcctgcatctgccgcagcctctatccaacaatcgctaccgggattctgcatctgctggcgggcctgtgcacccttgggtccgtctcctgttacgtggccgggatcgaactgctgcaccagaagctcgaactacctgacaacgtgtcaggcgagttcgggtggtctttttgcctcgcgtgcgtcagcgctcccctgcaattcatggcaagcgcactctttatttgggccgcccatactaaccggaaggagtacactctgatgaaggcttaccgtgtggcctag

SEQ ID NO: 41517 - DNA, 738 bp, Artificial Sequence
  Description of Artificial Sequence: Synthetic coding sequence
atggacaaccggttcgccaccgccttcgtgatcgcctgcgtgctgtcactgatcagcacgatctatatggcagccagcattggtactgatttttggtatgaatacaggtcccccgtgcaggaaaactcatcagacttgaataagtccatctgggacgaatttatctctgacgaggctgatgaaaagacatacaacgacgcactgtttcgctataatggcaccgtggggctgtggaggagatgtatcactatccccaagaatatgcactggtattcaccacctgagcgtactgaatcctttgacgtggtgaccaaatgtgtcagctttactctcacggaacaattcatggagaagttcgtcgatcctggaaaccataatagcgggattgacttacttaggacttatttgtggcgctgccagtttctccttccttttgtctccctgggactgatgtgttttggcgctctgatcggcttatgcgcctgcatttgccggtccctgtaccctacaatagccaccggcattctccatctactggccggtctgtgtacactaggatctgtttcctgctatgtggccggaattgagctccttcaccagaagctggagctacctgataacgtaagcggtgagttcggctggagcttttgcctagcatgcgtgtccgctcccctgcagttcatggcatctgcactgttcatctgggcagctcatactaacagaaaggaatacacatag

SEQ ID NO: 41518 - DNA, 642 bp, Artificial Sequence
  Description of Artificial Sequence: Synthetic coding sequence
atggacaaccggttcgccaccgccttcgtgatcgcctgcgtgctgagtttaatctctaccatctacatggccgccagtatcgggactgatttctggtatgaataccggtcacctgtgcaggagaactcctctgacctgaataagtctatatgggacgagttcatctccgacgaagctgacgagaagacctataacgacgccttattcaggtacaatgggacagtgggtctgtggaggaggtgtattactatcccgaaaaacatgcactggtacagtccccccgagcggactgaatcttttgacgtggttaccaaatgcgtgtcgtttacccttaccgagcagttcatggagaaattcgtggaccccggcaaccataattccggtattgatctcctgcggacatatctgtggagatgccaatttttacttccgttcgtcagcctcggattaatgtgcttcggcgccctaattgggctgtgtgcttgtatttgtcggtcattatatcccaccatagctaccggtatacttcacctgctcgctggcctgtgtactctaggaagtgtgtcttgttatgttgccgggatcgagttgcttcatcagaagctagagctgcccgacaacgtatcaggagaatttggctag

SEQ ID NO: 41519 - DNA, 543 bp, Artificial Sequence
  Description of Artificial Sequence: Synthetic coding sequence
atggacaaccggttcgccaccgccttcgtgatcgcctgcgtgctgtccctgatctccaccatatatatggccgccagcataggcacagacttctggtatgaatacagatcccccgtccaggaaaactcttcagatctaaataaaagcatctgggatgaatttatatccgacgaggcagatgagaagacctacaacgacgcactgtttaggtataacggaaccgtcggtctctggagaagatgtatcacaatccccaaaaatatgcattggtactcaccgcctgaaaggacggaaagtttcgacgtggtgacaaaatgcgtgagctttacattgactgaacaattcatggaaaaattcgtcgaccccgggaaccacaattccggcatcgatctgctgcggacatatctgtggcgttgccagtttctgctgccatttgtctctctcggactgatgtgttttggcgctctcataggcctgtgcgcctgcatctgccggtccctgtaccccactatcgccaccggcattctgcacctgctcgcgtag

SEQ ID NO: 41520 - DNA, 504 bp, Artificial Sequence
  Description of Artificial Sequence: Synthetic coding sequence
atgggcgtgaagcggagcctgcagagcggcggcatcctgctgagcctcgtggccaacgtcctgatggttttgtcgacggccacgaactactggacaagacaacaagaagggcattccgggctctggcaggagtgtaatcatggcatctgcagcagtatcccatgccagaccaccctcgcggtaacggtggcgtgtatggtgctggcagtgggagttggagtcgtgggcatggttatgggcttgcgcatcagatgtgacgagggggaaagcctcagaggccagactacctcagcatttctgttcttgggcgggctgctgctgctaacggcacttatcggctacactgtaaagaacgcttggaagaataacgtgttcttcagttggtcctacttcagtgggtggttggccctgcccttttcaatcttggcagggttctgtttcttgctcgccgatatgatcatgcagagtactgacgccataagcggcttccccgtgtgcctgtag

SEQ ID NO: 41521 - DNA, 1065 bp, Artificial Sequence
  Description of Artificial Sequence: Synthetic coding sequence
atgggccccgtgagcctgctgcccaagtaccagaagctgaacacctggaacggagatctcgctaagatgactcaccttcaggctggactcagcccagagactatcgagaaagcacgtctcgagttgaatgaaaaccccgatgtcttgcaccaagatatccagcaggtgcgcgatatgattattacaagacctgacataggttttttgcggactgatgacgccttcatcctacgctttctgcgagcaaggaagttccatcaggcggatgcctttcggctgctggcccagtacttccagtaccggcagctgaatctggacatgttcaaaaactttaaggcagacgaccccgggattaagagagccctgatcgatgggttccctggtgttttggagaacagggaccactacggaagaaagatcctcctcctcttcgctgctaattgggaccagagccgaaattccttcactgatatcctaagggcaattctgctgtctttagaagtgctcatcgaagatccagagctgcaaataaacgggtttatactgatcattgactggagcaacttcagctttaaacaagcgtcaaagctgacaccgagcatcctcaagctcgcaatagaagggcttcaggactctttcccagccagatttggaggggtgcattttgtgaaccagccttggtacattcacgccttatatacactcattaaaccttttctgaaagacaagacaagaaagaggattttcctccacggaaacaatctgaactctcttcaccagctgatccacccggaattcttacccagcgagttcgggggcacgctgcccccttatgacatgggaacatgggcacgcacactgcttggaccagactattccgacgaaaatgactacacccacacttcctacaatgccatgcacgtcaagcatacatcttcgaaccttgagcgagagtgctcaccaaaactcatgaagaggtctcagtctgtagtggaggctgggacgctaaagcacgaggaaaagggggaaaatgaaaacacccagcccctgctggctttggactag

SEQ ID NO: 41522 - DNA, 1065 bp, Artificial Sequence
  Description of Artificial Sequence: Synthetic coding sequence
atgggccccgtgagcctgctgcccaagtaccagaagctgaacacctggaatggtgaccttgccaagatgactcatctccaagcggggctgtctcctgaaaccattgaaaaggctcgcttggagcttaatgaaaaccctgacgtccttcaccaggacatccaacaggttcgagatatgatcattactcggcctgatatcggttttctgcggactgacgacgcatttatcttgagatttctacgtgcccggaaatttcaccaagccgacgcctttaggctgttggcacagtacttccaatacaggcagttgaatctcgatatgttcaaaaactttaaggctgatgaccccggaataaagcgagccctgatagacgggttcccaggcgttttagaaaatcgagaccactacggacgcaagattctccttctcttcgccgctaattgggaccagagcagaaacagctttactgatatattgcgggctattttactgagccttgaggtcctgatcgaggatccggaactccagataaacggattcatcctcattatcgattggtccaatttcagtttcaaacaggcttctaagctcacgccatccatcttgaagctggcaattgagggcttgcaggactcctttcccgctcggtttggtggcgtgcactttgtcaaccaaccgtggtacattcacgccctttacacactaatcaaaccatttttgaaggacaagacccgcaaaaggatctttcttcacggtaataacctgaattctttgcatcagctcattcatccggaatttcttccaagtgagtttgggggcactctgcctccctacgacatgggtacttgggcacgaactctattgggccccgattacagcgacgaaaatgactacacacacacaagctacaacgccatgcatgtgaaacacaccagttctaacctggaaagagagtgctccccaaaattaatgaaaaggtctcagtccgtggtggaagcaggaactctgaaacacgaggagaagggtgaaaatgagaacacacagcctctattggccctggactag

SEQ ID NO: 41523 - DNA, 240 bp, Artificial Sequence
  Description of Artificial Sequence: Synthetic coding sequence
atgggccccgtgagcctgctgcccaagtaccagaagctgaacacctggaatggtgacctggcgaagatgacccaccttcaggcaggcctgtctccggagacgatcgagaaggcacgcctggagctgaacgaaaatcctgacgtgttgcatcaggatatccagcaggtgagagacatgattatcacaaggcccgacattggctttctgcgcacagatgatgctttcatcttgcggttctag

SEQ ID NO: 41524 - DNA, 984 bp, Artificial Sequence
  Description of Artificial Sequence: Synthetic coding sequence
atgacccacctgcaggccggcctgagccccgagaccctggagaaggcgagactcgaacttaacgagaaccctgatacactgcaccaggatattcaggaagtgagagatatggtgatcaccagacccgacataggatttctgagaacagatgatgcttttattctccgctttttgagggcccggaaatttcatcattttgaagcatttaggttgctggctcagtattttgagtatcggcaacagaatttggatatgttcaaatctttcaaagccacagaccccggcataaagcaggccttgaaagacggctttcctgggggcctcgctaatctggaccattatggcaggaagattttggtcttgtttgccgcaaactgggatcagtcccggtataccctggttgatatcctgagagctattttgctctccctcgaagctatgattgaggaccctgagcttcaggttaacggattcgttttgatcatcgactggagcaatttcacgtttaaacaagcatctaagctgacccctagtatgctgcgacttgccatcgaaggactccaggacagcttcccggctaggtttgggggtatccactttgtaaaccaaccttggtacatccatgccttgtataccgtgataagaccctttctcaaggagaagactagaaagcggattttcctccacggaaacaatctgaattccctgcaccagcttatacatcctgaaatcctaccttctgaatttggtggcatgctgccaccgtatgatatgggcacctgggcgcggacgctgttggatcacgaatatgacgacgactccgagtacaatgtcgacagctattcaatgccagttaaggaggtagaaaaggaactgagtccgaaatctatgaagagaagccagtcagtcgtggatcccaccgtgctgaaaaggatggacaagaacgaggaagagaacatgcagccactgctgagtttggactag

SEQ ID NO: 41525 - DNA, 546 bp, Artificial Sequence
  Description of Artificial Sequence: Synthetic coding sequence
atgatcgaggaccccgagctgcaggtgaacggcttcgtgctgatcatcgattggtctaacttcacttttaaacaggcatccaaacttactccgagtatgctccgcttagcaatcgagggcttgcaagacagctttccggcccggtttggggggatccactttgttaatcagccttggtatatccacgccctgtacacagtgatccgcccgttcctgaaagagaagactcgaaaacgcattttcctgcacggaaataaccttaacagtctccaccagctcatccatccggaaatcctgccaagcgaattcggaggaatgttacctccctatgatatgggcacatgggctcggacgctgttagatcacgaatatgacgatgatagtgagtataatgtcgattcttacagcatgcccgtcaaggaggttgaaaaggaactgtcacctaaaagcatgaagaggagccaaagcgttgtcgatcctacagtgctcaaacggatggacaaaaatgaggaagagaacatgcagcccttgctgagtctagactag

SEQ ID NO: 41526 - DNA, 2010 bp, Artificial Sequence
  Description of Artificial Sequence: Synthetic coding sequence
atggccgccgcccaggaggccgacggcgcccggagcgccgtggtggccgccggaggtggcagctctggccaggtcacctctaacggctcaattggtagagatcctcctgcagaaactcagccacagaacccgcctgcacaacctgctccaaacgcgtggcaggtgattaagggcgtcctctttcgcatctttattatatgggcgatcagtagctggtttcgccgcgggcctgcccctcaggaccaggcagggcctggaggggcccctagagtggcctctaggaatctatttccaaaggatacgctgatgaatctccacgtttatatctctgagcatgagcacttcacggattttaatgccactagcgctctcttttgggaacagcacgatctggtgtacggcgactggacctctggcgaaaattctgatggttgttacgagcatttcgctgagttagatatccctcagtcagttcagcagaatgggtcaatttacattcacgtgtactttaccaagtccggttttcacccagatccaaggcaaaaggccctgtaccggcgcctggcaaccgtgcacatgtcacgcatgattaacaagtataagcgccgcagattccagaaaacaaagaacctcttgaccggagagacagaagcagaccccgagatgatcaagagagccgaggactatggccccgttgaggtcattagccactggcatcctaatatcacgattaacattgtggatgatcacactccctgggtcaaagggagtgtcccgccccccctggatcagtacgtcaaatttgacgccgtgtctggcgactactaccccatcatttactttaatgactattggaacctgcagaaggattactaccctatcaacgaatctctagcatcactcccccttcgggtgagcttttgtcctctgtcactgtggcggtggcaactttacgcggcacagagtacgaaaagtccttggaatttcctgggcgacgagctatatgagcaatcggacgaggaacaagacagtgtgaaggttgcactcctcgaaacaaatccctacctgctggccctcacaatcatagtatcaatcgtacactccgttttcgaatttctggcgttcaaaaacgatatccagttttggaattcacgccagtctctggagggactctctgttcgaagcgttttctttggagttttccagagtttcgtggtgctactgtatatactggataacgaaacgaacttcgttgtgcaggtctctgttttcatcggggtgcttatcgacttatggaaaattactaaagtaatggacgtgagactcgaccgggagcatcgagtcgctggcatcttcccaaggctcagctttaaagataagagcacgtatatcgagtccagtaccaaggtctacgacgacatggcgttcaggtacttgagctggattctgtttcctcttctgggttgctacgccgtttactcgctgctataccttgagcacaagggttggtactcttgggttctaagcatgctgtacgggttcctgctcactttcgggttcatcactatgaccccacagttatttatcaattataagctgaaaagtgtggcccatctgccttggcgaatgctcacctataaagcactgaatacgttcatcgatgacctctttgcctttgtgatcaaaatgcctgtgatgtacaggatcggatgcctacgggatgatgtggtattcttcatctacctgtatcagcgctggatctacagggttgacccaacacgcgttaatgagtttgggatgtccggcgaggatcccaccgctgctgctcccgttgcggaggttccaacggccgccggagctctcacccctacccctgcgccgaccaccactacggcaacaagggaagaagccagtacttccctccctactaagccaacccagggtgcctccagcgcaagcgagccgcaggaggcgcctccaaaacccgccgaagacaagaagaaggactag

SEQ ID NO: 41527 - DNA, 2061 bp, Artificial Sequence
  Description of Artificial Sequence: Synthetic coding sequence
atggccgccgcccaggaggccgacggcgcccggagcgccgtggtggcagctggcggaggtagtagcggccaggtcacgtccaatggctccataggacgggatccacctgccgagacacagcctcagaacccgccggcacagcccgctccaaatgcctggcaagtgattaaaggggttctgttccgcatttttatcatttgggcaattagctcctggttcaggagaggacccgccccacaggatcaggccggacccggaggcgcgcctagagttgctagccggaacctgttccccaaagacactcttatgaatctgcacgtatacatctcagaacatgagcactttacggacttcaatgcgacatctgccttgttttgggaacaacacgacctcgtttatggggactggacctcgggcgagaactccgatggctgctatgagcacttcgcagaactcgacatccctcagtctgtgcagcagaatggaagtatttacattcatgtgtacttcactaaatctgggtttcatcccgatcctagacagaaagctttatatagacgtctcgctacggtgcacatgagccggatgataaacaagtataagagacgtaggtttcagaaaacgaagaatttattgactggggagaccgaggctgatcccgagatgatcaagagggcagaagattacggccccgtagaagtcataagccattggcacccgaatattactatcaacatcgtagatgatcacacaccttgggtgaaaggatctgtacccccgcccttggaccagtatgtcaaattcgatgccgtttctggagactattacccaatcatttattttaatgactactggaatctgcagaaggactactaccccattaatgagtctctggccagcctgccactcagggtctcattttgcccactgtccctgtggcgatggcagctgtacgcggctcagagcaccaagtctccctggaatttcttaggggacgaactatatgagcaatccgatgaagagcaggatagcgtaaaagtcgctttgctagaaaccaatccctatctgctcgcgcttactatcatcgtcagtattgtgcatagcgtctttgagtttctcgcatttaaaaatgacatccaattttggaattcacgccagagcctcgagggcctgagcgtacgcagcgtcttcttcggagtcttccagagcttcgtagtcctgttgtacattctggacaatgaaaccaacttcgtggtccaagtctctgtgttcatcggcgtactcatcgatctgtggaagattactaaggtgatggacgtgcgcctcgatcgggagcatcgtgtagccgggatttttcctagactttccttcaaagacaagagtacttatattgaatcctcaaccaaagtgtatgatgacatggcttttcgctaccttagttggattctttttcccctcctagggtgttatgccgtgtattcactgctgtacctcgagcacaagggctggtattcatgggttctcagtatgctatacggattcctgctcacgtttggtttcattacgatgactccgcagctgttcataaactataaactgaaatccgtcgctcacctcccgtggaggatgctgacgtacaaagctttgaatacttttatagacgacctttttgcattcgtgatcaagatgccggtaatgtatcgaattggatgtctgcgcgacgatgtagtctttttcatctacctctaccagcgctggatatacagagtggatccgacccgggtcaatgaattcggcatgtccggcgaggaccccaccgctgccgctccagtggctgaagtccccactgcagctggcgcgctaacccctacacctgctcctacaacaaccacagcgactcgagaggaagcgtcaacttccctgcctactaagccaacccagggtgccagctccgcgagtgaaccccagggtcttttcgtggaagcgctcagtgtccctttaagcctatgtgtatccagccaccttgccctgcccgcgcagcaccattgggaaagttggtag

SEQ ID NO: 41528 - DNA, 1968 bp, Artificial Sequence
  Description of Artificial Sequence: Synthetic coding sequence
atgagccggaaggcccacatcaccgagaaggtgaccagcaacggctctattgggcgcgacccccccgcagaaacacaaccacagaacccaccggctcagcccgcccctaatgcgtggcaagtcattaagggagtgttgtttagaatttttattatctgggcaatttcttcttggtttaggcgcggcccagccccccaggaccaagcgggacccgggggcgctcctagggttgcttctcgtaatctgttcccgaaggatacccttatgaatttacatgtctatatcagcgagcacgaacattttactgattttaacgccacttcagccctgttttgggaacagcacgacctggtgtatggggattggacctctggcgaaaatagtgacggatgctatgaacactttgcggagctggacattccacagagcgtccaacaaaatggcagcatatatatacatgtatactttactaagtctggctttcatccagatcctagacagaaagcgctttaccggcggctggcgaccgttcacatgtcaagaatgatcaacaagtacaagcgtcgccgatttcagaagaccaagaatctgctgaccggagagacagaagctgaccccgagatgattaaacgggccgaagattatggacccgtcgaggtcataagccactggcaccccaacataaccatcaacattgtggacgaccacacaccgtgggtgaaaggcagcgtacctccgcccctcgaccagtatgtgaagttcgacgcagtgagtggggactactatcccatcatctactttaatgactactggaatctgcaaaaagactactatccgataaatgagtctctggccagcttgcccctccgcgtctcattctgtccactttccctgtggcggtggcagctgtacgctgcccaaagcaccaagagtccctggaactttctgggagacgaactctatgagcagtcggacgaggaacaggatagcgttaaggtagccctgctagagactaacccctacctccttgctctgactattattgtctctatcgtacatagcgtgttcgagtttcttgcctttaagaacgacattcagttttggaattcacggcagtccctcgagggcttgtccgtgagatctgtgtttttcggagtcttccagtcattcgtggttctgttatacattttagacaacgaaaccaatttcgttgtccaagtctccgtgttcattggagtcctcatcgacctgtggaagattacgaaagtcatggacgtgcgactggatagggagcaccgcgtcgcaggaatttttccgagactgagttttaaggataaaagcacatatattgagtcatcgaccaaggtgtatgacgacatggcgttcagatatctgtcatggattctcttccctctgctcggatgttacgctgtatattccttgttgtatctggagcataagggctggtattcctgggttctctctatgctttacgggtttctcttaacatttgggttcatcaccatgaccccccagcttttcattaattacaaattgaagagcgtcgcgcatctcccatggagaatgctgacctacaaagctctcaataccttcatcgatgacctgttcgcatttgtcatcaaaatgccagttatgtatcggattggctgccttcgagacgatgttgtattcttcatttatctttatcagcgatggatatacagggttgatcctacaagggtgaacgagttcggcatgtccggagaggatcctacggcagccgcacccgtggctgaggtgccaacagctgcaggggccctcaccccgaccccagctccaaccaccaccacggcaacccgagaagaagcctctacatcacttccaaccaagcccacacagggagcgagctctgccagcgagccccaggaggcccctcctaagcccgcagaggataaaaagaaagattag

SEQ ID NO: 41529 - DNA, 1704 bp, Artificial Sequence
  Description of Artificial Sequence: Synthetic coding sequence
atgaacctgcacgtgtacatcagcgagcacgagcacttcaccgacttcaacgctacttccgcattattctgggagcagcatgacctggtttacggggactggacatcaggcgagaattccgatggctgttatgagcacttcgcagagctggatatacctcagtcagtccagcagaatggcagcatatatatccacgtttactttactaagagtggcttccatccagacccccgacagaaagccctatataggcggcttgccactgtccatatgtcgaggatgatcaacaagtacaagcgtcgcaggttccagaagacaaagaacttattgacaggcgaaactgaagcggatcctgagatgataaagagggccgaggattacggccctgtggaagttatcagccattggcacccaaatatcacgatcaatatcgtggatgatcatactccctgggtaaagggatcagtcccccctcccctcgaccaatatgtcaagttcgacgcagtttcaggcgactattatcccataatctattttaacgactattggaacctgcagaaggattactatcccattaacgaatctctcgcttctctgccactccgagtctccttttgccccctgtctctttggcggtggcagttgtacgcggcccagtctactaagtctccctggaattttctcggcgacgagctctatgaacaatccgacgaggagcaggattcagtgaaggtagcactgctcgagaccaacccatacctactggccctgacaataattgtatcaatcgtgcacagcgtgtttgagttcctcgccttcaaaaacgacattcagttttggaactccaggcagtcactggaagggctatccgtgcggtccgtgttctttggtgtatttcaatcattcgtcgtattactgtacattctggacaacgaaacaaatttcgtcgtgcaggtctctgtctttataggagtgctcatcgacctttggaaaatcacgaaagtgatggatgtgcgactagaccgcgagcatcgggtggctggcatttttcctcgcttgtcctttaaagacaaaagcacctatattgagtcaagtaccaaagtttatgatgacatggcatttagatacctttcttggatcctctttcctctgctgggttgctatgcagtgtattcgctgctttacctggagcacaaagggtggtattcatgggtgctgtcgatgctttacggctttcttctgacctttggattcattactatgactcctcagctcttcattaattacaaactgaagtcagtggctcatttgccttggagaatgctgacatacaaggcacttaacaccttcatagatgacctgtttgcatttgtaatcaaaatgcctgtaatgtacagaattgggtgcctcagagatgatgttgtctttttcatctacctttatcagcgctggatttaccgggtggatcccacccgcgtgaacgagttcggaatgtccggcgaggaccccaccgccgccgcccctgtggcggaagttcctactgcagccggcgccctgactccaacgccggcccccacgacaacaactgcaacccgcgaggaggcttctacgagccttccgacgaaacccacacagggcgccagctccgcttctgagccgcaggaagctcccccgaagcctgcagaagataagaagaaagattag

SEQ ID NO: 41530 - DNA, 2124 bp, Artificial Sequence
  Description of Artificial Sequence: Synthetic coding sequence
atgctgggcagcctggtgctgcggcggaaggccctggccccccggctgttattacggctgctcaggtccccgacactccgtggacacggcggggcaagcggcagaaatgtgaccacagggtccctcggtgagccacagtggttaagggtggcgaccggcgggcgacctggcacgagccccgcacttttctccggccggggggctgctaccggaggtcggcagggaggaaggtttgacacgaagtgcctagctgccgcgacttggggtaggttaccaggaccagaagagactctacccgggcaggactcctggaatggagtccccagtcgagccggtctggggatgtgcgcgttggctgccgccttggtagtgcactgctattcaaagagtccctccaataaggatgccgctttgcttgaagcagcccgagctaacaatatgcaggaggtatcccgactgctgtctgagggagcagacgtcaacgctaaacacagactgggttggaccgctcttatggttgcagcaattaacaggaataatagtgttgtccaggtgcttctggccgccggcgccgacccaaacctcggcgacgactttagttctgtctacaagaccgccaaggagcagggtatccactccctggaagacgggggccaggacggcgcctcgagacacattaccaatcagtggacaagcgctctcgaatttaggcgctggctgggtcttcctgcgggtgtactgatcactcgagaagatgattttaacaaccggctcaataacagggccagctttaaagggtgtactgcattgcattatgcagtgctggcggacgattacaggaccgtcaaggagttactggatggcggcgccaatcccctccagaggaatgaaatgggccacacgccccttgactatgcccgagaaggcgaagttatgaaactcttgcggaccagcgaagctaaataccaggagaagcagaggaagcgagaggccgaagagcgccggaggtttccattggaacagcggctgaaggagcatattattggccaggaatcagccatagccacagtgggtgctgcaatccggagaaaagaaaatggctggtacgacgaggagcaccccttagtgtttttgttccttgggagttctgggatcggaaagacagagctcgccaagcagactgccaagtatatgcacaaggacgctaagaagggctttatcagacttgacatgtctgagttccaggagcggcatgaggtggcaaaatttatcggtagccctccgggatatgtgggacatgaagaggggggacaactgactaaaaaactgaaacagtgccccaacgctgttgtgctgttcgacgaagtggataaagcacacccagacgtgctaacgattatgctgcagcttttcgacgagggtagactgacagacggaaaaggtaagaccatcgactgcaaagatgctatatttatcatgacatctaacgtggccagcgatgaaattgcccagcacgcactgcagctgcgccaagaggctctcgagatgtcccggaatcggatagcagaaaacctcggtgacgtacagatttctgacaagattacgatttccaaaaatttcaaagaaaacgtgatccggccgatactgaaggcgcactttagacgcgatgagtttctgggaaggatcaacgagattgtatatttccttccattttgccattcggaattaattcagttggtgaataaagaattgaacttttgggctaagagggccaaacaacgacataacatcaccctactgtgggatagagaagtggctgacgtgctcgtggatggttacaacgtgcactacggcgctagatcgattaaacacgaggtggagcggcgggtggtgaatcaattagctgcagcctacgagcaggatctgcttccggggggatgtactctgcgcatcacagtggaggattccgataaacaacttctcaaatctccagagctacccagcccgcaggcagaaaaaaggttgccgaagctgcggctggagattatagataaggactctaaaactcggcgtctggacatccgcgccccactgcatcctgagaaggtctgtaacacaatttag

SEQ ID NO: 41531 - DNA, 1989 bp, Artificial Sequence
  Description of Artificial Sequence: Synthetic coding sequence
atgccccggggctgccacctgggcacccccagctggagccggcggaacacgcctagaacaggacagcttgagcgaggcccgcagcaagggagaacagggcacgtccggccaggccgaagcgccggggggagcctgctccagcaggagtctgttcagcagggctgcagtccggttggcagttgcccttgtcagcagtacgctaggtctcagcagccacaagagactgccaagaatgacgcacaaagtaggtcctgggcgggtctcaacgctggggtgagcttgaaaaatacaaagattagttcctccgagtggcctctgaggctgttgagcgagggagccgatgtcaatgcaaagcatagactcggttggacagctttaatggtagccgctattaatagaaataattcagtggtccaggtactcttagctgcaggcgccgacccaaacctgggggacgatttctcatcagtgtataaaaccgccaaggagcaggggatccactctctggaagatggtggacaggacggcgcttcaaggcatatcactaatcagtggacaagcgcccttgagttcagacggtggctcggattgcccgctggcgtcctgattactcgggaggacgacttcaataacagactgaataaccgcgccagctttaagggctgcacagctttgcattacgctgtgctggccgatgactacaggacggtgaaagaactgctggacggaggagctaatccactgcagcggaacgagatggggcatacgcctctagattatgctcgggaaggcgaggtgatgaagctgcttcgaacctctgaggccaagtatcaggaaaagcagaggaagagggaagcagaggaaaggaggagattcccacttgagcagcgtctaaaggaacatatcattggacaagagagcgccattgccacagtaggcgccgctatccggagaaaagaaaacggctggtacgacgaagaacatcctctggtgtttctgttcctcgggtcaagtggtatcggaaaaacagagttagccaagcagactgccaaatatatgcacaaagatgccaaaaaaggcttcatccgcctggatatgtctgagtttcaagagagacacgaagtggctaaatttataggctctccacccggctacgtaggccatgaggagggcgggcagctcacaaaaaaattgaagcagtgccccaacgcggtggttttattcgacgaagtcgacaaggcacaccccgacgtgctaaccattatgctgcagttgtttgatgagggccggcttactgacgggaaagggaaaacaatcgattgtaaggatgctatattcataatgaccagtaatgtcgcttcagatgaaatagcacagcatgccctgcagcttagacaagaagccctggagatgagccggaaccggatagccgaaaaccttggggatgtccagatcagcgataaaatcactatcagcaaaaattttaaagaaaacgtcatcagaccaattcttaaagcgcactttagacgggatgagttcttaggaaggatcaatgagatcgtctattttcttcctttctgtcactcggaactgatccagctcgttaacaaagaactgaacttttgggcaaagcgagctaagcagcgccacaatattacactgctctgggacagagaggtggctgatgtgttggtggacgggtacaacgttcactatggggcaagaagtattaagcacgaagtggaacgcagggtagtcaaccagctggccgctgcctacgaacaagatttattgccaggagggtgtacccttcgcattaccgtcgaagacagcgataagcagctgttaaagtcccctgaattaccatctccccaagcggaaaaacgcctgccaaagctgcgtctggaaatcatcgataaggactcaaagacgaggcggctggatattagagctccccttcaccccgagaaagtatgcaacacaatctag

SEQ ID NO: 41532 - DNA, 2034 bp, Artificial Sequence
  Description of Artificial Sequence: Synthetic coding sequence
atgctgggcagcctggtgctgcggcggaaggccctggccccccggctcttgctgaggcttcttagatcaccgaccctgcgaggtcacgggggagcatcaggcagaaatgtgaccaccggaagcctcggggagccacagtggctcagggtggctaccgggggccgacctggaacaagccccgctctgttttcaggccgcggggcagctaccggtggaaggcaagggggtaggttcgacaccaaatgtctggctgccgccacatggggccggttgcctggccccgaggagaccctacccggccaggatagttggaatggagtcccgtcccgtgctggactcgggatgtgcgccttggcagcagcactggtggttcactgctatagtaagtcccccagcaataaggacgcagccttgctggaagctgcccgcgcaaataacatgcaggaggtgagtaggctcctttctgaaggagctgacgtgaatgccaaacatcggctgggctggaccgccctgatggtcgcagctattaacaggaataacagtgtggttcaggtcctgctagccgcaggggccgacccaaacctgggcgacgactttagttcagtttacaagacagcgaaggaacaaggtattcacagcctggaagtgctgataactcgggaggatgatttcaacaacaggctcaacaaccgcgctagctttaaagggtgtactgctctacactacgctgtcctggccgacgattaccgcactgtaaaggagcttctcgatggtggcgctaaccctttgcagagaaatgagatgggacacactccactagactacgccagggagggggaggtcatgaagcttcttaggaccagtgaagcaaagtatcaggagaaacagcggaaacgcgaagccgaggagagacggcggttccccctggagcagaggctgaaagagcatatcatcggacaagagtcagcaatcgcgactgtgggggctgctatccgaaggaaggaaaacggttggtacgatgaggaacacccactcgtttttctatttttaggctcctccggaatcggcaaaactgagctcgccaaacagacggccaagtacatgcataaggatgccaagaaggggtttatccggctggacatgtccgagtttcaggagcgtcatgaagttgctaagtttattgggtcgcctcctggatatgtggggcatgaggaaggaggacaattaacaaagaagctcaagcaatgccctaacgctgtggtattatttgatgaggttgacaaagcgcatccagatgttctgactatcatgctgcagttattcgatgaaggtcggctgaccgacggaaaggggaaaacaattgattgtaaggatgctatcttcataatgacatccaatgtcgcttcagacgagattgcgcagcacgctctgcagttgagacaggaagccttggaaatgagtcgcaaccggatagcggagaatctgggggatgtgcagatctccgataagatcacaatctctaaaaactttaaggaaaacgtgatcagacccattctgaaagcccatttccggagggacgagttcctgggacgcattaacgaaatagtttactttttgcccttttgccactccgaactcatccaacttgttaataaagagctgaacttctgggctaagagggcaaagcagaggcataacattacccttttgtgggatagagaagttgctgacgtcctggtggacgggtacaacgtgcactatggggcccgttccattaaacacgaggtggaacgaagagtggtgaaccagttggccgccgcatacgagcaggatctcctccctggagggtgtactctgcggattaccgtggaggattctgataaacaattactgaagagccctgagctcccttctcctcaggcagagaagcgtcttcctaaattgagattagagatcatcgacaaggactcaaaaactcgccggctcgatataagagcccccctgcatccagagaaagtctgtaataccatctag

SEQ ID NO: 41533 - DNA, 1521 bp, Artificial Sequence
  Description of Artificial Sequence: Synthetic coding sequence
atggtggccgccatcaaccggaacaacagcgtggtgcaggtgctgttggctgcaggggccgatcctaatctcggagatgacttttcctcggtttataagaccgccaaagaacagggaatccactccctcgaagtgctcattacgcgggaggatgactttaataatcgcctgaacaatcgtgcgagtttcaaaggttgcaccgctctccattacgcagtgctggctgacgattacagaacagttaaagaattattagatggtggggcgaaccctctccagcggaatgagatggggcatacacccctggattacgcacgggagggggaggtcatgaaactgctgcgcacgagtgaagcaaagtatcaagaaaaacagaggaagagggaggccgaagaacgacgccgcttccctctcgagcagcggctgaaagagcatatcatcggccaagagtccgccatagcgacagtaggagcagcgatccgcagaaaagagaacgggtggtatgatgaagaacatcctctggtattcctctttcttgggagctcgggcatcggaaaaacggagctggccaagcagacggccaagtacatgcataaggatgcaaagaaagggtttattaggctggatatgtctgagtttcaggagcgtcatgaagtcgctaagttcatcggttctcccccaggctacgtgggacacgaggaagggggccaacttaccaagaaattaaagcagtgccctaacgctgtggtcctgttcgacgaggtggataaagcacatcctgatgtgttgaccattatgctgcagctgtttgatgaaggcagactgacggatggtaagggaaaaacaattgactgcaaggatgcaatcttcattatgacctcgaatgttgctagtgatgagatcgcccagcacgctctgcagctccgacaggaagccctggaaatgagtcggaatcggatcgctgaaaatcttggtgacgtccaaatctccgacaaaatcaccatatccaagaacttcaaggaaaatgtgatccggcccattctaaaggcacatttccggagggatgagttcttgggaaggatcaatgagatcgtgtactttctgcccttctgccactcggaactgatccaacttgtgaataaagagttgaacttctgggccaagcgggcgaagcaacgtcataatataacattattgtgggatcgtgaggttgctgatgtccttgtagatgggtataacgtccattatggggctaggagcatcaagcacgaggtagagaggagagtcgtgaaccagctggcggcagcatacgaacaggacctgctccctggcgggtgcactttaagaatcaccgtggaggactctgataaacagctacttaagagtccagagctgccaagcccgcaggccgaaaaacggctcccaaagctgcggcttgaaatcatcgataaagacagtaaaacaaggaggctggacattcgggctcccctgcatcccgagaaagtctgcaacactatctag

SEQ ID NO: 41534 - DNA, 1902 bp, Artificial Sequence
  Description of Artificial Sequence: Synthetic coding sequence
atgcccagctgcggcgcctgcacctgcggcgccgccgccgtgcggctgatcacctcttcattagcttccgcgcagcggggtattagtggcggcagaatccacatgtccgttcttggcagactggggacatttgagacacagatcctccaacgggcacccctgagaagtttcaccgaaaccccagcttactttgcatccaaagatggcatatctaaggatggttccggggacggtaataaaaagtcagcctctgagggctcatcaaagaagtctgggagtggcaatagtgggaagggaggcaatcagctgagatgtccaaaatgcggcgacttgtgtacccatgttgaaacctttgtctcatctactaggtttgttaagtgtgagaagtgtcaccacttttttgttgtgctgagcgaggccgacagcaagaaatcaattattaaagagcctgagtctgcggcagaggccgttaagttagcttttcagcagaagccgccaccccccccaaagaaaatctacaactatctagataagtacgtagtcggtcagagcttcgctaaaaaagtgttatccgtggctgtgtacaatcactataaacgcatatataataatattcccgccaacttacggcagcaggctgaagtcgagaagcagaccagcctgacaccaagagaacttgagattagacgtcgagaggacgagtaccggtttaccaaactgttgcaaatcgccggtattagtccacatgggaatgccctgggagcttcgatgcagcagcaggttaaccagcagatcccacaggagaagcgaggaggcgaggtgctggactcttctcacgacgacatcaagcttgaaaaatccaatattttgctcctgggccccacaggttccgggaaaacattactggctcagacacttgctaagtgcctggacgtaccatttgcgatctgtgactgcacgaccctaacccaggcagggtacgtgggtgaggacatcgagtcagtgatagccaaattactgcaggacgccaattacaatgtcgagaaggcacagcagggaatcgtcttcctggatgaagtggacaagattggaagcgtccctggaattcatcaattgcgtgacgtggggggggagggagtccagcaaggactgcttaagctcctggagggaaccatagtgaacgttcccgagaagaattcccggaagctgcggggtgagaccgtccaagtggacaccaccaatatactgttcgtcgccagtggagcgtttaatggcttagacaggataatctcgagacgaaaaaacgagaaatacctgggttttggaaccccatctaatctgggtaaagggagaagggccgccgcagctgctgacctggcaaacaggtccggcgaatccaatacgcatcaggatattgaggaaaaagatcgtcttctccgacacgtcgaagcaagagacttgatcgagttcggtatgatcccagagttcgtgggacggcttccagttgtggtccctcttcacagtctggatgagaaaaccctggtacagatcctcacagagcctaggaacgccgtcatcccccagtatcaggcgctgttctccatggacaagtgcgagctcaatgtcacggaggatgctctgaaggccattgcccgactggcattggaaagaaagaccggcgcgcgaggcctgcggagtattatggagaaactacttttggaacctatgtttgaggtaccaaactcggacattgtctgtgtggaagtcgacaaggaggtggtggagggcaaaaaggagcccggctatatacgcgcacccaccaaagagagttccgaggaggagtacgactcaggagtggaagaagaggggtggccgagacaggccgacgccgcaaactcatag

SEQ ID NO: 41535 - DNA, 1602 bp, Artificial Sequence
  Description of Artificial Sequence: Synthetic coding sequence
atgcccagctgcggcgcctgcacctgcggcgccgccgccgtgcggcttattacatctagtttggcttctgctcagcgtggcatctcgggcggtagaattcacatgagtgttctcggccgcctggggacattcgagacacagatcttacagagggcccctctgcgttccttcaccgagacccctgcttacttcgcttccaaagatggcatcagcaaagacggatcaggcgacggaaacaagaaaagcgccagcgaaggctctagcaaaaaatctggtagcggaaacagtgggaaaggtggcaatcagctgcgatgtcccaaatgcggcgatttgtgtactcacgtggagacattcgtaagtagtacccgcttcgtgaaatgtgagaaatgccatcatttcttcgtggttctctctgaggctgactcaaaaaagtctatcattaaggagccagaaagtgccgctgaggcggtgaaactcgccttccaacagaaaccgccgccacctcctaagaagatttacaattacctggataagtatgtggtaggacagtcttttgccaagaaagtcctgtcagtggctgtgtataatcactataagaggatttataacaacatacccgccaatctgagacaacaggccgaggtggaaaagcagacctcactgacgccaagggaactggaaatacgcagacgggaagatgagtacagatttaccaagctcctgcaaatcgccggaataagtccacacggaaacgcactaggcgcttctatgcagcagcaggtcaaccagcagatcccccaggagaaaagagggggggaggttctggatagcagccacgatgacataaagcttgagaagtcaaacatattgctcctgggacccaccggatccggaaagacgctgttggcccagacactggccaagtgcctggacgtgccattcgcgatttgcgattgcactactctcactcaggccggctatgttggcgaggacatcgaatccgttattgctaagctgctgcaagacgctaattacaatgttgaaaaggcccagcagggcattgtcttcctggatgaggtagacaaaattggctctgtgcctggcatccaccagctgagagatgtaggcggagagggagtccagcaggggctgctgaagctgttagagggtacaattgtgaacgttcccgagaagaactctcggaagcttcggggcgaaaccgtgcaggttgacacaactaacatactgtttgttgctagcggtgcatttaatgggcttgacagaattatctccagacgcaagaatgagaagtatctgggattcggcacccccagcaatctgggcaaggggcggcgggcagcggcagccgcggatctggccaaccgatctggagaaagcaatacacatcaggatatagaagagaaggacagactgctcagacacgttgaggctcgagacttaattgagtttggtatgatccccgagtttgtgggacggctgccagtcgttgtgcccctccattccttggatgaaaagacactggtgcagattctaactgagccaccccatccagccttatttactatcttcaacccattttag

SEQ ID NO: 41536 - DNA, 2625 bp, Artificial Sequence
  Description of Artificial Sequence: Synthetic coding sequence
atgctgaagaagttcgacaagaaggacgaggagagcggcggcggcagtaacccttttcagcaccttgagaagtccgccgtgcttcaagaggcacgagtcttcaatgagaccccgattaatccgaggaagtgtgcccatattctcaccaaaatattatatttgattaaccaaggggaacacctgggtactactgaggctaccgaagctttttttgctatgacgaagttgtttcaatcaaatgatcctaccttaaggaggatgtgttatctcacaattaaagaaatgtcctgtatcgcagaggacgtaataatcgttacctctagcctcacaaaagatatgacaggaaaggaggacaactaccgcggaccagccgtgagggcattgtgccaaataactgatagcaccatgctgcaggccatcgaaaggtatatgaagcaagctattgtggataaggtcccgagcgttagctcatcagcactcgtcagctcccttcacctgctcaagtgttcttttgatgtggtgaaaaggtgggtgaatgaggcccaagaagctgccagctctgacaacatcatggtgcaataccatgctttgggcttgctctatcatgtaagaaaaaatgaccggcttgccgtgaataagatgatatcaaaagtcacacggcacggcttgaaatcaccttttgcttactgtatgatgatccgcgtagcatctaagcagctggaggaggaagatggcagcagagattcacctttgtttgacttcatcgaaagctgtcttaggaataagcacgagatggttgtttatgaagccgccagtgccatcgtcaatctcccaggctgttccgcaaaggaattggctccagctgtgtccgtgctgcagctgttttgtagctctccaaaagcggccctgagatatgctgccgttcgcactctgaacaaggtggccatgaagcatccgtctgctgtgaccgcatgtaacctcgatctggagaatctggtgaccgacagcaaccgctctatcgctaccctcgctattacaaccctgctgaaaacaggcagcgagagcagtatcgatcggctgatgaaacagatttcatcgtttatgtcggagatctctgatgaatttaaggtggtggtagtgcaggcgatctcagctctgtgtcagaagtatccccgcaagcatgctgtgctgatgaacttcctcttcaccatgctgcgcgaggagggcggattcgagtataagagagccattgtggactgcatcatctctatcatagaagagaacagcgagtcgaaagagacaggactatcacatctgtgtgaattcatcgaggattgcgaattcaccgttctcgctacccgaatcctgcatctgctcgggcaagaaggacccaaaaccacaaacccctccaaatatatcaggttcatctataaccgggttgtgttagagcacgaagaagtgagggccggggcggtatctgccctggccaagtttggagcgcagaacgaggaaatgcttccgtctattctcgtgcttctcaagagatgtgttatggacgacgataatgaggtacgcgaccgggccaccttttacttgaacgtcctggagcagaagcagaaagctctcaacgcaggctacatcctgaacgggctcaccgtcagcattcctggactggaacgggccctccaacagtacactctggaaccgagcgaaaagcctttcgacttaaagagtgtgcctctggccacagcccctatggctgaacagcgcacggagagtaccccaatcactgcggtcaagcaacctgagaaagtcgcggctactaggcaggagatctttcaagagcagctggctgctgtgccagagttcagagggctgggcccacttttcaaaagctccccagaaccggtggcgctgacagaatctgagaccgagtatgtgattcgatgtaccaaacatacctttaccaaccacatggtttttcagtttgattgcaccaacaccttaaatgaccagaccctggagaacgtcaccgtgcagatggagcctaccgaggcctacgaggtgctctgttacgttcccgcacggtctctgccctataatcaacctggcacctgctacaccttggtggccttacccaaggaggacccaactgccgttgcgtgcacattctcgtgcatgatgaaattcacagtaaaggattgtgatcccactacaggtgagacagacgacgaaggctacgaggatgaatatgtcctcgaagacctggaagtaacagtcgccgatcatatccagaaggtgatgaagctcaattttgaagcggcctgggacgaagtaggggatgaattcgaaaaggaggagactttcaccctgtcaactattaaaaccctcgaggaggcagttgggaatattgttaagtttcttggcatgcatccttgtgagcggagcgacaaggtccctgacaataagaatacacacacattgctcctcgctggagtatttagggggggacacgatattctggttagatcaaggttactgctgctcgatacagtgaccatgcaggtcacggcacggagtctggaggaattacccgttgatattatccttgcttcagttggctag

SEQ ID NO: 41537 - DNA, 534 bp, Artificial Sequence
  Description of Artificial Sequence: Synthetic coding sequence
atggaggccctgatcctggagcccagcctgtacaccgtgaaggccatcctcattctggataacgacggtgatcggctcttcgccaaatattatgatgacacttaccctagcgttaaagagcagaaggccttcgagaaaaatatatttaacaaaacgcatcggactgattctgagatcgccctgctggagggactgaccgtcgtctataaatccagcatagacctctatttctacgttatcggtagctcctatgagaacgagttgatgctcatggccgtgctcaattgtttgtttgactcactgtcccagatgctgaggaagaacgttgagaagcgggcactgctcgaaaacatggagggcctgtttctcgccgtggatgaaatcgtagacggaggcgtaattctcgagtccgacccccagcaagtggttcacagagttgcactgcgtggcgaagacgtgccgctcaccgaacaaaccgtttcccaggtgcttcagagtgcaaaggaacaaattaagtggtccctgttgcggtag

SEQ ID NO: 41538 - DNA, 381 bp, Artificial Sequence
  Description of Artificial Sequence: Synthetic coding sequence
atgatggagatcgacttcctgcccagcaccatgaccacccccaccccagtgagtaggtccaagaggccactcagaaggacattctctactcgccccattggacttacacttatgctcatggcagtcctgaattgcctgttcgatagtcttagccaaatgttgcgaaagaacgtagagaaacgcgccctcttggagaacatggagggactatttctcgctgtggacgaaatcgtcgatggaggagtgattctggagtcagacccccagcaagttgtgcaccgtgtggctctcaggggagaagatgtaccactcacagagcagacagtgtcgcaggtactgcagtccgccaaagaacaaatcaagtggagtctccttagatag

SEQ ID NO: 41539 - DNA, 465 bp, Artificial Sequence
  Description of Artificial Sequence: Synthetic coding sequence
atggaggccctgatcctgtactacgacgacacctaccccagcgtgaaggagcagaaggcttttgagaaaaacatctttaacaagacacatagaacggatagcgagattgccctgttggaaggattaaccgttgtctataagtctagtatcgatctttacttctacgtgatcggaagcagctacgagaatgaattgatgctgatggcagtgttgaattgcctcttcgattctctatcccagatgttacgaaaaaacgtggagaaaagggctttgctggaaaacatggaagggctgtttctggcggtagatgagatcgtggacggtggtgtgattttggagtctgacccacagcaggtagtgcacagggttgccctccgaggggaggatgtaccacttaccgagcagacagtctctcaggtgttacaaagtgctaaggagcagatcaaatggagcctattgcggtag

SEQ ID NO: 41540 - DNA, 279 bp, Artificial Sequence
  Description of Artificial Sequence: Synthetic coding sequence
atggaggccctgatcctggagcccagcctgtacaccgtgaaggccatcttgattttggataacgacggggaccgccttttcgcaaaatattacgacgatacttatcctagtgttaaagagcagaaggcgtttgagaaaaacatcttcaacaagactcacaggactgactccgaaatcgccctcctcgagggactgacagttgtttacaaatcttctatcgatctgtatttttacgtgatcgggtccagttacgaaaacgagctgatgctgatggcatag

SEQ ID NO: 41541 - DNA, 744 bp, Artificial Sequence
  Description of Artificial Sequence: Synthetic coding sequence
atggcctgggccggcagccggcgggtgcccgccggcacccgggccgccgccgaacgatgttgccggctgagtttgtctccaggcgcccagccggccccgccccctggtcccctccccccgcccaggcccatgcgcttccttacttcctgtagcctgctgcttccaagagccgcacagattttggctgctgaggcaggccttccctcatccaggtcgttcatgggcttcgcagcaccattcacgaataagcggaaagcttattcagagcggcgcataatgggctactctatgcaggagatgtatgaggttgtctccaatgttcaggagtacagagaatttgtcccatggtgtaagaaatctcttgtagttagcagccgtaagggccatcttaaggcgcaactcgaagtagggtttcctcctgtgatggagaggtatacaagcgctgtgtctatggttaagccacacatggtcaaagcggtgtgtaccgacggcaaattattcaaccaccttgagactatttggcggttttccccgggtatacctgcgtaccctcgaacatgcaccgtggacttcagcattagctttgagtttcgctcgctcctgcacagccagttagcaaccatgttctttgacgaagtcgtgaagcagaatgttgccgcatttgagcggagagccgctacaaagtttggcccagaaactgctatacctagagagctgatgttccacgaggtacaccaaacctag

SEQ ID NO: 41542 - DNA, 648 bp, Artificial Sequence
  Description of Artificial Sequence: Synthetic coding sequence
atgctgctgcaggtggtgcgggagggcaagttcagcggcttcctgacctcttgcagtctgctcctgcctagggccgctcaaattcttgccgcagaggccggcttgccaagctctaggtcctttatgggatttgcggcaccctttactaataaacgcaaggcatatagcgaaagacgaatcatggggtattctatgcaggagatgtatgaggtcgtgagcaatgttcaggagtaccgcgagttcgttccatggtgcaagaaaagtctggtcgttagcagtcgaaaggggcatctgaaggcccagctggaagtggggttccctcccgtgatggagcggtatacctccgctgtctctatggtcaagccacacatggtcaaagccgtgtgcaccgacggcaagctcttcaatcatctcgagactatatggagattctctcccggcatacccgcatatccccggacgtgtaccgttgatttttcaatttcctttgagttccgtagtctgctgcacagtcagctggctaccatgttttttgatgaggtggttaagcagaacgtggcggcattcgagcgaagggctgccacaaagttcggccccgaaacggcaatacctcgggaactgatgttccatgaggtgcatcaaacatag

SEQ ID NO: 41543 - DNA, 693 bp, Artificial Sequence
  Description of Artificial Sequence: Synthetic coding sequence
atgcacagcagcagccccagccccaccaacgaccggggcctgcggcggactatccgattggcaccccttagcttcggacttaggttcttgaccagttgtagcttgctcctccctcgagccgctcaaatactcgccgctgaagcagggcttccatctagccgatcgttcatgggtttcgcagcaccattcacaaataagcggaaggcatactctgaacgaaggattatggggtactcaatgcaggaaatgtacgaggtagtaagtaatgtccaggagtaccgggaatttgttccctggtgcaagaagtcactggttgtgtcttcccgcaagggccatttaaaggcgcagcttgaggtggggttccctcctgtgatggaacgctacaccagcgccgttagcatggtgaaaccacacatggtgaaagccgtctgcaccgatggaaaactgtttaatcacctggagactatctggaggttctccccaggaatacccgcttatccacgaacctgtaccgtagatttctccatctccttcgaattcagatctctcctgcactcccagctggccacaatgttcttcgacgaagtggtcaagcagaatgtcgctgcttttgaacgccgggcggccacaaaattcggcccagagacagctatcccacgcgagcttatgttccacgaagtgcaccagacttag

SEQ ID NO: 41544 - DNA, 195 bp, Artificial Sequence
  Description of Artificial Sequence: Synthetic coding sequence
tgacggacctgcaccgtggacttcagcatcagcttcgagttccggtccctgcttcatagtcaactggccactatgtttttcgatgaagtggtcaaacagaatgtggcagctttcgaacgtagagctgccacaaagttcggtcctgaaacagctatcccacgcgaacttatgttccatgaggttcaccaaacctag

SEQ ID NO: 41545 - DNA, 717 bp, Artificial Sequence
  Description of Artificial Sequence: Synthetic coding sequence
atggccgcccggaccggccacaccgccctgcggcgggtggtgagcggatgccgtcctaagtctgcaaccgctgccggcgctcaggcccctgtgcgcaatgggaggtatttggccagctgtggcattctgatgagtcgaaccttaccccttcacactagcatattaccgaaggagatctgcgcccggacttttttcaagatcaccgcccctctcatcaacaaaagaaaggaatacagcgagcggcggatactcggatatagtatgcaggagatgtatgacgtggtctctggtgtggaggactataagcattttgtcccctggtgtaagaagagcgacgtaattagcaagcgctcaggctattgcaagacgcgactagaaataggctttcctccagtacttgagcgatatacctcagtggtcacgctagtgaaaccccacttggtgaaagcctcttgtacggacggccgactctttaaccatttagagaccatctggagattcagcccaggccttcctgggtatcctcggacctgcaccctggacttttcaatctcctttgagttcaggagcctcttgcattcccagctggcaaccctgttctttgatgaagtggttaagcagatggtggccgcctttgagcgacgcgcttgcaaattgtacggacctgagacaaacattccccgggaactcatgctccacgaagtccaccacacctag

SEQ ID NO: 41546 - DNA, 633 bp, Artificial Sequence
  Description of Artificial Sequence: Synthetic coding sequence
atgggcgtgtgcgtgtggcggtacctggccagctgcggcatcctgatgagtcgaacccttccactgcataccagcatcctgcccaaggaaatctgcgctaggaccttctttaagattacagctcccttaatcaataagaggaaggaatatagtgagcggcggattttaggatattctatgcaagaaatgtacgacgtggtttccggggtagaggattataagcacttcgtgccatggtgcaagaaaagcgatgtcatctctaaacgctcaggatactgcaagacgaggctcgagatcggatttcctccggtgctggaaagatacacttctgtagtgacccttgtcaagcctcaccttgttaaagcctcttgcaccgatgggaggctcttcaatcacttggaaacaatatggcggtttagtcccgggttacccggctatcctaggacttgcacgctggacttctcaatcagcttcgaattccggagcctgctgcacagtcagctggcgacactcttttttgatgaagtggtgaagcagatggttgctgcatttgagcgccgtgcttgcaagctttacggccccgagacgaacatccctagggagctaatgctgcacgaagtccatcacacctag

SEQ ID NO: 41547 - DNA, 588 bp, Artificial Sequence
  Description of Artificial Sequence: Synthetic coding sequence
atgagccggaccctgcccctgcacaccagcatcctgcccaaggagatttgtgctcgcaccttttttaagataactgctccactcatcaataaaagaaaagagtatagcgagcggcgcattcttgggtatagtatgcaggaaatgtatgacgtcgtgagcggagtggaggactacaaacatttcgtgccatggtgcaagaaatctgacgtgatctcaaaaagaagcggttactgcaaaacgcggctcgagatcggttttccaccggtcctggagagatacacctcggtggtaactctggtgaaaccacatctcgtcaaagccagctgtacagatggacgcctttttaatcacctggaaacaatctggcggttctccccaggacttcccggatatccccgtacatgtaccctcgactttagcatcagctttgagttccggtcccttctgcactcccaactggccacactgttctttgatgaggttgttaaacagatggttgccgcctttgagcggagagcctgtaagctttatggacccgagacaaacatccctcgagagctcatgctgcacgaagtgcaccacacgtag

SEQ ID NO: 41548 - DNA, 984 bp, Artificial Sequence
  Description of Artificial Sequence: Synthetic coding sequence
atggccgcccccggcagctgcgccctgtggagctactgcggccggggatggtccagggccatgaggggctgtcagctgctcggactgcgctcatcttggcctggagacttgctgagcgccagactactatcacaggaaaagagagccgcggagacccatttcggctttgaaaccgtaagcgaagaagagaagggcggtaaggtttaccaggtcttcgaatccgtggccaagaaatacgacgtgatgaatgacatgatgtccctggggatccaccgggtatggaaggatttgctcctttggaagatgcatccactcccgggcacacagctcctggacgttgctggcggaaccggggatattgccttcaggtttcttaattacgtccagtcacagcaccagcggaaacagaaacgtcagctgagagctcaacagaacctcagctgggaggaaatcgctaaagaataccagaacgaggaggactccctgggtggaagtcgagtggtcgtttgcgatattaacaaggaaatgctgaaggttggaaaacagaaggctctcgcccagggttatcgcgcgggactggcgtgggtgctgggcgacgcggaggagctgcccttcgatgacgacaagttcgatatttatacaatagcattcggcatcaggaatgtgactcacattgatcaggcgttgcaggaggcccacagagttctaaaacccgggggtcgctttttgtgtctcgagttttcccaggttaataatcccctaataagtaggttgtacgatctgtattccttccaggtgatcccagtgctgggggaagtgattgctggggattggaagagctaccagtaccttgtggagtcaattcggcgctttccttcacaggaggagtttaaagatatgattgaggatgccggcttccacaaggtcacatatgagtcactaactagcggaatagtggccattcacagcgggttcaaactgtag

SEQ ID NO: 41549 - DNA, 741 bp, Artificial Sequence
  Description of Artificial Sequence: Synthetic coding sequence
atggccgcccccggcagctgcgccctgtggagctactgcggccggggatggagccgggcaatgcgagggtgccagctgttgggtctccggtcatcgtggccaggtgacttgctgagcgcacgtctccttagtcaggagaaaagggctgcggaaacacattttggatttgagaccgtatcggaagaagaaaagggaggcaaagtgtatcaggtgttcgaatcggttgccaagaagtacgacgtaatgaatgatatgatgagtctcggcatccaccgggtgtggaaagacttactgctgtggaaaatgcatccgctcccaggcacccagcttctggatgtagccggcggcactggtgatatcaataaggagatgctcaaggtgggcaagcagaaggcgctcgctcagggtcacgaccgccggtgccggcttagccaaggcgacctgaggaaatctaacattcgccattgcggacatagtttctggctccagaccttgatccctttcctcagctggagcatgaaccagtcataccccgtggaatccctggaactgaaggataacctggctaatgagactgccgccgagcacttgctgctgaggatcagagctctggatagctgtcttaatagaacggtatccaagtggaagaacaaatttctctcactgttctacagttttctatggtcatgttttagtccatcgccaaggggtatttggagcgtgtctctcctgaattgctag

SEQ ID NO: 41550 - DNA, 1182 bp, Artificial Sequence
  Description of Artificial Sequence: Synthetic coding sequence
atgatcttcaccttcatgacccggaagagctgctgcagcaagcaggtgcaaaggaagtactggaggaattgtcagaagcttacggcgacaggctcggcccctttccctttggctctgcagaggtttagcgtggtgtgggatgcctgttctgaagccctgatcatgttcgacaaggataaccttgacgatatgggctatatcgtggaaaacgacgtgatcatgcatgctttgaccaagcagctggaggcagtgagtgaccgagtcacagtcctctaccgttctaaagcaatcagatacacatggccttgtccctttccgatggcggattcctctccatgggtgcacataaccttaggggacgggtcgaccttccagaccaagctgctgatcggcgccgacggccataactcaggggtccgacaagccgtgggcatccagaatgtctcctggaactatgatcagtccgccgtggttgccaccctgcacctatccgaggctaccgagaacaatgtcgcatggcagcgctttctccccagcgggcccatcgctctgctaccattgtccgataccctgagttcgttggtttggtctacttcccacgagcatgctgcagagctcgtgtccatggatgaggagaagtttgtggacgccgtcaactccgctttctggtcagatgctgatcacactgacttcattgataccgccggggccatgctgcagtatgccgtgtctctgctcaagccgaccaaagtgagcgccagacagctgccacccagcgtcgcccgagtagacgccaaaagtcgcgtgctgtttcctctgggcctggggcacgccgcagagtatgtaagacctagagtggccctgattggggatgctgctcatcgcgtccaccccctagctggacagggtgtgaacatgggtttcggtgatatcagttctctggcgcatcatctctcgactgcggctttcaacggcaaggacctcggatcagtaagccatctcaccggatacgagacagaaagacagagacataacacagctcttttggctgccacggacttgctgaagagactctactcaacctcagccagccctttagtcctcttaaggacatgggggttacaagcaacgaatgcagtgagccccctgaaagagcagataatggcattcgcctctaaatag

SEQ ID NO: 41551 - DNA, 1407 bp, Artificial Sequence
  Description of Artificial Sequence: Synthetic coding sequence
atggccgcccggctggtgagccggtgcggcgccgtgcgggccgccccgcactccggccccttagtttcttggcgaaggtggagcggagcaagtaccgacaccgtgtatgatgtcgttgtaagcggcggcggactggttggggctgctatggcgtgcgccttgggatatgatatccattttcacgacaagaaaattctactgctggaggctgggcctaagaaggtactggaaaaactgtcagaaacgtattcaaatcgggtttcatcaatttccccaggaagtgcgaccttactgagctccttcggtgcctgggaccacatctgcaatatgaggtaccgagctttccggcgaatgcaggtgtgggacgcttgcagcgaggctctgatcatgtttgacaaagataacctcgacgacatgggctatattgtcgaaaacgacgttattatgcacgcgctgactaaacaattagaggcagtttcagaccgcgtcacagtgctataccgatcaaaagcaattcgatatacgtggccctgtccatttcccatggccgattctagcccctgggtccatatcactcttggagacggctcgactttccagaccaaactgctaatcggcgcggacggccacaacagcggagtgaggcaagctgttggcatccaaaacgtgagttggaactacgaccagtcggctgtggtcgccaccctccatctgtctgaggccactgaaaacaatgttgcctggcaacgattcctaccatctggccccatcgcgcttttacccctgagcgataccttatcttcgctggtgtggagtacctctcatgagcacgccgccgaattagtgtcaatggacgaggaaaagtttgttgacgctgttaacagtgcattttggtccgatgccgatcacacagacttcatcgatacggccggcgctatgttacagtatgccgtttctttgctcaaacctaccaaggtaagcgctcgacagttacccccttctgttgcccgcgtggatgcaaagtcacgcgtactcttccccctgggccttggtcacgccgccgaatacgtccgccccagggtggccctgataggcgacgccgctcatcgggtccaccctttggccgggcaaggggtgaatatgggctttggggacatatcttcccttgctcaccatctgtcaaccgccgcattcaacggcaaggatttaggttctgtgagtcatctgactggctacgaaactgaacgacagcgtcacaatacagccctcctggctgcgactgaccttctcaagcgtctttacagcacttctgccagtcccttggtgttacttcgaacttggggcttgcaggcaaccaatgctgtgagccctctcaaggagcagatcatggctttcgcctccaagtag

SEQ ID NO: 41552 - DNA, 1332 bp, Artificial Sequence
  Description of Artificial Sequence: Synthetic coding sequence
atgcggggccagggcccccccctgagcagcttcggcgtgtggctggcaagcagagcggctagcgacccctcacggccccggcgacagggatatgatatacattttcatgataagaaaatacttctgctggaggccggacccaaaaaagtcctggaaaagttaagcgaaacatactccaaccgcgtgagctctatttccccaggatcagctactctgctgagttcctttggagcttgggatcatatttgtaatatgagatatagagcattcaggcgaatgcaggtctgggacgcttgcagcgaggcactgatcatgttcgataaagataatctcgatgatatggggtatattgtggaaaatgatgtaataatgcatgccctgacgaagcagctcgaggcagtgtccgaccgggttacagtgctgtatagaagtaaggccatccgctacacatggccgtgccccttcccaatggcggactcttctccttgggtacatataacattgggagatgggtcaacgtttcagacgaagctcctcatcggggccgacggacataactctggcgtgaggcaggcagtaggaatccaaaatgtgagctggaattatgatcagtctgccgtcgtggcgacattacacctatccgaagccacagaaaataatgtagcatggcagcgatttctgcccagtggccctattgccctcctacccctctctgacacactttccagccttgtgtggtcgactagtcatgaacacgccgctgaacttgtcagtatggatgaggaaaaatttgtcgacgctgttaactccgccttttggtcagacgcagaccacacagacttcatcgacactgcgggagcaatgttgcagtatgccgtctccctgctgaagcccaccaaagttagtgccaggcaacttccacccagcgtggcccgcgtggacgccaaatcccgggtcctttttcccttggggctcggccatgccgcggagtacgtgcgacctagggtagcgcttatcggggatgctgcccatcgcgtgcacccgcttgccggtcagggagtcaacatgggctttggtgacatttccagtctggctcatcatctgtccacagccgctttcaacggcaaagacctgggctccgtcagtcatctaaccgggtacgagactgagcggcaacgccacaatactgccctgcttgcagcaaccgacctgctgaagcgcctgtatagcacctcggcatctccactggtcctgctgcgcacgtggggactacaggctacaaacgcagtgagcccactaaaagagcagatcatggcatttgccagcaaatag

SEQ ID NO: 41553 - DNA, 441 bp, Artificial Sequence
  Description of Artificial Sequence: Synthetic coding sequence
atggccgcccggctggtgagccggtgcggcgccgtgcgggccgccccccactccggccctttagtgagttggcgcagatggtctggagcatcaaccgacacggtctacgatgtggtggtctccgggggaggactcgtcggtgcagcaatggcctgcgccctcggctacgacatacatttccatgacaagaagatcctgctgctggaagcaggtccgaaaaaagtacttgagaaactgtcggagacctattctaacagggtttcctcgatttccccgggcagcgccactcttcttagctctttcggggcttgggatcacatctgcaatatgaggtatagggcctttagacgcatgcaggtccctctatacctgtttaatttcgtcaaaatgagctggtccgtgttgcggtaccggagcccgctaagtcccagcgtcctgtag

SEQ ID NO: 41554 - DNA, 417 bp, Artificial Sequence
  Description of Artificial Sequence: Synthetic coding sequence
atgacctggtggtgccgggtggaggcctggtgggccctgccctggcctgtgccctgggatatgatctttacctttatgacacggaagtcctgctgtagtaaacaggtccagagaaaatattggcggaactgtcagaagctgaccgccactggcagtgcccctttcccgctggctctgcagagattctccgtggtgtgggatgcttgcagcgaggcattaatcatgtttgacaaggataacctcgacgatatgggttacattgttgagaacgatgtgatcatgcacgcactgacaaagcaacttgaggctgtgtccgatagagtcacagtgctttaccgtagcaaagccatccgctatacttggccatgccccttccctatggcagattcttctccatgggtacatataaccctttag

SEQ ID NO: 41555 - DNA, 789 bp, Artificial Sequence
  Description of Artificial Sequence: Synthetic coding sequence
atgatcttcaccttcatgacccggaagagctgctgcagcaagcaggtgcagcgcaaatactggcgtaattgccagaaactgacggctaccggctccgcacccttccctctcgcactccagaggtttagtgtggtttgggatgcatgcagcgaagctctcatcatgtttgacaaggataacttggacgacatgggctacatcgtagagaatgacgtcataatgcacgctttaacaaagcagctggaggccgtttctgaccgggtgacagttttgtatcggtccaaagctattagatatacttggccatgccctttcccaatggccgactctagtccgtgggtccatatcacactgggtgatggttccacattccagaccaagttactgataggggccgacggacacaactccggggtgcgccaagctgtggggattcaaaacgtgtcgtggaactacgaccagagtgctgtagtggccaccctccatttgagcgaggcaaccgaaaataacgttgcctggcagagattcctgccttcaggccccatcgccctcctccctctgtccgatacgctgagctcgctggtgtggtcgacttcccacgagcatgccgccgaactcgtctccatggatgaggaaaaattcgtcgacgctgttaactctgctttttggtcagatgccgaccacactgacttcatcgataccgctggtgctatgctgcagtatgccgtcagcttattgaaacccactaaggtttccgcccggcagttgccacccagtgtggcccgatag

SEQ ID NO: 41556 - DNA, 1176 bp, Artificial Sequence
  Description of Artificial Sequence: Synthetic coding sequence
atgatcttcaccttcatgacccggaagagctgctgcagcaagcaggtgcagaggaaatactggcgcaattgccagaagctgaccgccacaggtagtgctcccttccccctggctctgcagaggttctccgtggtgtgggacgcttgctcagaagcccttatcatgttcgacaaggacaatctggacgatatggggtacatagtggaaaacgacgtcattatgcatgctctgacgaaacagttggaagcggtttctgaccgtgtgacagtgttatatcgctccaaagccattcgctacacttggccatgcccttttcccatggcagactctagcccctgggtccatatcaccctgggagacgggtctacttttcagactaaactgctgatcggggccgatggccacaattctggggtgaggcaggccgtcgggatccagaatgtgagttggaactacgaccagtcggcagttgtggcgactttgcatttgtcagaagccacggaaaacaatgtggcctggcagcggttcctgccatcggggccaattgctctcctacccttgtccgacactctatcctcactagtgtggagcacctcacacgaacacgctgcagagttggtcagcatggacgaagaaaaatttgtggacgcagtaaatagcgctttctggtcggacgctgaccataccgattttattgatacagcgggagcgatgttgcagtatgcagtttccctgttgaagccaacaaaagtgtctgcaagacagctgcctccctcagtggccagggtagacgcgaaaagtcgtgttcttttccctcttggtttgggccatgccgcagagtatgttcgcccacgcgtggcactgataggcgatgcagcccatagggtgcatcccctggccggtcaaggtgtgaatatgggctttggagatataagcagcttggctcatcacctgagcactgctgcttttaacgggaaggatctcggtagcgtgagtcatctaacaggctatgagactgagcggcagcggcataacaccgccctgctcgcagcaactgacctgctgaagagattatacagtacctccgcgagccctttggtcctgttgcgaacatggggcctccaggctacgaatgctgtgagcccactgaagattatggcctttgctagcaagtag

SEQ ID NO: 41557 - DNA, 468 bp, Artificial Sequence
  Description of Artificial Sequence: Synthetic coding sequence
atggccggcgccgtgagcctgctgggcgtggtgggcctgctgctggtatcagccctatccggggtgttgggcgaccgtgcaaatccagaccttagagcacatccaggaaacgcggcacatccaggcagtggagccactgagccaagaaggcgacctccactgaaggaccagagagagaggactcgggcaggcagcctgcccctgggagccctgtatacagctgccgtggccgcctttgtgctgtacaaatgcttacagggcaaagatgaaaccgccgtcctccatgaggaggccagcaagcagcagcctctgcagagtgagcagcagctcgcacagttaacgcaacagctggcccagactgaacagcacctgaataatctgatggctcagctcgaccctctctttgagcgtcccgcaggggcctcagagcatgaggcaatggatcacccaagggctgctgcccggtag

SEQ ID NO: 41558 - DNA, 414 bp, Artificial Sequence
  Description of Artificial Sequence: Synthetic coding sequence
atggccggcgccgtgagcctgctgggcgtggtgggcctgctgctggtgagcgcccttagtggagtgctgggagatcgcgccaatcccgaccttagagcacacccaggtaatgccgctcatccgggaagcggagcaacagagcccaggagacggccaccgctgaaagatcaacgcgaacgcaccagggctggatcactccccctgggtgccctctacaccgccgcagtcgctgcatttgtgctgtacaagtgcctgcagggcaaagatgagaccgccgtgttgcatgaagaggctagtaaacagcaaccactgcagagcgagcagcaactcgcccagctcacccaacagctggcccagacagagcaacatctaaacaatctgatggcccagctcgatcctctgtttgaacgatag

SEQ ID NO: 41559 - DNA, 420 bp, Artificial Sequence
  Description of Artificial Sequence: Synthetic coding sequence
atggccggcgccgtgagcctgctgggcgtggtgggcctgctgctggtgtctgcactgtctggagtcctcggagatagggccaaccctgatctgagggcccacccgggcaatgctgcccacccagggtccggtgctaccgaacctcgcagaagaccaccactaaaagaccaacgcgagagaacccgcgctggctctttacctcttggcgcactttacacagcagccgtcgctgcttttgtgctgtataaatgtctgcagggtaaggacgaaacggcagtgttgcacgaggaggcctccaaacagcagcctctgcagagcgaacagcagcttgcccagcttacccagcaactcgctcagacagagcagcatctgaacaatctcatggctcagctcgatcccctatttgagaggtcgttctag

SEQ ID NO: 41560 - DNA, 771 bp, Artificial Sequence
  Description of Artificial Sequence: Synthetic coding sequence
atggccggcgccgtgagcctgctgggcgtggtgggcctgctgctggttagtgccctgtccggagtcctgggggatcgggccaatcccgacctgagggcccatccaggcaacgcggctcaccccggttcaggcgccaccgagccaagaaggagacctcctctgaaggaccaaagagaacgaacccgggctgggagtttaccgctcggagcactctacaccgcagcggtggcggcgttcgtgctgtacaagtgtctgcagggtaaagacgaaaccgccgtgttgcatgaagaggcctctaagcagcaaccactacaaagtgagcagcaactcgctcagttaacccagcagctggctcaaacagagcagcatctaaacaacttgatggctcagttggatcctcttttcgagagagtcaccacgctcgctggggcccagcaagagctccttaatatgaagttgtggaccatccatgaactcctgcaagacagcaagcccgacaaagacatggaggccagcgaaccagaagcttccaggcctttaccagaggacttttgtctgaaagaagatgaagaagagattggcgactcacaggcctgggaagagccaaccaactggtcaacagaaacatggaacctggccacctcatgggaggtcggtcgggggctgcgaaggcgttgttctcaggctgtggccaagggaccaagccatagcctcgggtgggagggcgggaccacagctgagggaagactaaaacagtctctgttctcttag

SEQ ID NO: 41561 - DNA, 360 bp, Artificial Sequence
  Description of Artificial Sequence: Synthetic coding sequence
atggccggcgccgtgagcctgctgggcgtggtgggcctgctgctggtgtccgctctcagcggcgtgctcggcgatcgagctaacccagatcttagggcacatccaggtaacgcggcccatcctggatccggagccaccgaaccacggcgaagaccaccacttaaagatcagcgtgaacgcacacgcgccggctcacttccacttggcgcactgtatactgcggccgtggctgccttcgtactctataagtgtttacaaggcaaagacgagaccgctgtacttcacgaggaggcatccaagcagcagcccctacaatctggaggtttttcaagaagcctctgctgggtgggcggcgtgtag

SEQ ID NO: 41562 - DNA, 852 bp, Artificial Sequence
  Description of Artificial Sequence: Synthetic coding sequence
atggccggcgccgtgagcctgctgggcgtggtgggcctgctgctggtgagtgccctcagtggcgtcttaggggaccgcgcaaaccctgatctgagagcgcacccaggaaacgccgcccatcccggctccggggccactgagccccgccggcggccgcccctcaaggaccaacgggagcgaaccagggcgggtagcctaccgcttggcgctttgtacacagccgcggtggccgcatttgttctttacaaatgcctccagggtaaagacgagacagcagtgcttcatgaggaggcgtctaagcaacagcctctgcagagtgaacaacaactggcccaattgacacagcagttggcacaaaccgaacagcatcttaacaacctgatggcacaactggatccattgttcgagcgcgtgaccacactagccggagcacagcaagagctgctcaatatgaaactgtggacaatccacgagttactgcaggactcaaagcccgacaaggacatggaagcttcagagcctggcgaaggctctggcggagagtctgccggtggcggtgacaaagtctctgagacaggtacctttttgatttcacctcataccgaagcttcccggccactgccggaggatttttgcctaaaggaggatgaagaggagatcggggattctcaggcatgggaagagccaacaaactggtctaccgaaacctggaatctcgcaacttcttgggaggtggggcgcggactgcggcgcaggtgcagtcaggctgtcgccaagggcccaagtcacagcctgggctgggagggcggcaccaccgccgaaggtcggctgaaacagtctctttttagctag

SEQ ID NO: 41563 - DNA, 1011 bp, Artificial Sequence
  Description of Artificial Sequence: Synthetic coding sequence
atgctgcagcggggcctgtggccctggcggacccggctgctgcccacccccggaacctggagaccagcccggccgtggcccttaccccccccgcctcaggtgctgcgcgtgaaactctgcggcaacgttaagtactaccagtcccaccattacagtacagttgttccaccagatgaaataaccgtgatttacagacatggtctgcctctagtaactctgaccttgccttcaagaaaagagagatgtcagtttgtggtgaagccaatgctgtcaacagtaggaagctttttgcaggacctgcagaatgaagacaaggggattaagacagctgccatttttacggctgatggcaatatgatctcggcctcaaccctgatggatatactactgatgaacgactttaaactcgtcattaacaagatagcatacgacgtccagtgtcccaagcgggagaaaccttctaatgaacatacggctgagatggagcacatgaagagtctggtgcaccggctgtttactattctgcacctcgaagaaagtcagaagaaacgcgaacaccacctccttgagaaaattgaccatctgaaggagcagttacaaccactcgagcaggtgaaggctgggatcgaggcccacagcgaggccaaaacatccgggctactttgggccgggttggctctgctgtctattcagggcggggcattggcttggctgacgtggtgggtttactcttgggacattatggaacctgtcacgtatttcatcacttttgcaaacagcatggtgttttttgcctacttcattgttacccgccaggattatacctatagtgccgtcaaatctcgacagttcctccaattctttcataaaaagtcgaagcagcaacacttcgacgttcagcagtataacaagctcaaagaggacctcgccaaggctaaggagtcactgaagcaagcacggcattccctgtgtttgcagatgcaggtcgaggaattgaatgagaaaaactag

SEQ ID NO: 41564 - DNA, 1689 bp, Artificial Sequence
  Description of Artificial Sequence: Synthetic coding sequence
atggacctgcccgagggccccgtgggcggccccaccgccgagatgtaccttcgagaaaggccagaagaagcacgcctcggcatgccagtatctctagaggaacaaattctgaatagcacattcgaagcatgcgaccctcagagaaccgggacagtcgctgtagctcaggtactcgcttacctggaagccgtcacgggacaaggtccccaggatgcgaggcttcaaacactcgctaacagtttggatccgaacggagagggtcccaaggccacggtggacctcgatacttttttagtagttatgcgagactggattgctgcttgtcagctacatggaggactggaactcgaagaggagacagccttccagggagccctgacatcacggcagttgcccagcggctgtccagaggccgaggaacccgccaacctggagtcatttgggggagaagatcccagacccgaactccaggctaccgctgatcttctgtcaagcctcgaagaccttgaactgagtaatagacgactggttggagagaatgcaaagttgcaaaggtcaatggagactgccgaggagggttctgcaagacttggggaagaaatcctggctctccgaaaacagcttcattccacccagcaggcactgcagtttgctaaagccatggatgaagaactcgaagacctcaagaccctggcgcggtcactggaggagcagaatagatcacttctcgcacaggccagacaagctgagaaagagcagcagcacctggtggccgagatggagacgcttcaggaggagaatggtaagctgctcgccgaacgtgatggcgttaagaagcgcagccaggaactggccatggagaaagacacactgaaacgccaattattcgaatgtgaacatctgatctgccaacgggataccatcctgagtgagcgcacacgcgacgtcgagtctctggcccaaacgttggaggagtaccgggtaaccacccaagaacttaggcttgagatttccagattagaggagcaactctctcaaacctatgaggggcctgacgaacttcccgaaggggcccagcttagacgtgtggggtggaccgagctgcttcctcctagcttaggtctggagatcgaagcaatccggcagaaacaggaggtagccacagctgacctcagcaatcccctctgtggggtatggcaatgggaggaggtgatccatgagacgagtgaggaaactgaatttccgtctgaggcacccgctggtgggcagcgcaactttcagggcgaaccagctcatcctgaggagggccgaaaggagccaagtatgtggctgacgcgccgcgaggaggaagaggacgccgaatctcaggtgacagctgatctgccagtcccgctgggggcgcctcggccaggggatatccctgaaaacccccctgagaggcctgccagaagagagttacaacaagcactggtgccggtcatgaaaaagttagttcccgttcggcgccgcgcttggggccagctgtgcctgccgccccaaagactgagggtcacacgtcacccgttaatccccgcccctgtgctaggactgctcttactgctgctgcttagcgtcctgcttctgggacctagcccaccgcccacctggccccacctgcaactgtgttatttgcagcccccccctgtgtag

SEQ ID NO: 41565 - DNA, 357 bp, Artificial Sequence
  Description of Artificial Sequence: Synthetic coding sequence
atgaccaagaagaagcgggagaacctgggcgtggccctggagatcgacgggttggaagagaaactgtcccagtgtcgccgagatttggaggccgttaacagccggctccactcaagagagttatctcccgaggctcgcgagggtactgaagtgagcagcgctcgggagccagaggaacacgctgctctgtgtggtcatctgtaccccccagatgcccgactgtgtcttctcgaccacgtctctctggccttgccacataaccagcatcgccttcccctcggtccccttatcagaatcaagcaggctttgcaggctagcattggacccaggtgctggggtgtcccactaccaacgtag

SEQ ID NO: 41566 - DNA, 294 bp, Artificial Sequence
  Description of Artificial Sequence: Synthetic coding sequence
atgaccaagaagaagcgggagaacctgggcgtggccctggagatcgacggactagaggagaaattatcccagtgcagacgcgacctagaagccgttaattcaaggctgcattctcgcgagctgagtccagaagctcgcaggtccctcgagaaagaaaagaatagtctgatgaataaggctagtaattacgagaaagaactgaagttcttaagacaggagaaccgcaagaatatgctgttgtccgtggccatatttattctgctgaccctagtgtacgcctattggactatgtag

SEQ ID NO: 41567 - DNA, 345 bp, Artificial Sequence
  Description of Artificial Sequence: Synthetic coding sequence
atgaccaagaagaagcgggagaacctgggcgtggccctggagatcgacgggctcgaggagaagctctcccagtgcaggagagatcttgaagcagtcaattcacggctgcactctcgggaactctccccagaggccagggaagggaccgaggtctcatctgcaagagagcctgaggagcacgcagccctttgcggacacttgtaccccccggacgcacgcctgtgcctgcttgatcacgtcagtctagcactgccacacaatcaacataggctccctcttggacccctgatccgcattaaacaagcgctgcaagcatccataggtcctcggtgctggggggtctag

SEQ ID NO: 41568 - DNA, 753 bp, Artificial Sequence
  Description of Artificial Sequence: Synthetic coding sequence
atggccgccggcaccagcagctactgggaggacctgcggaagcaggctcggcaactggagaatgaacttgacctcaagctggtctctttctcaaaactgtgcacctcatactcacactcctccacacgggacggccggagagatcgctactcaagcgacacaacgcccctgctcaacggaagctcccaggatagaatgttcgaaaccatggcaatcgaaattgaacaactcctggccagactcactggagttaatgacaagatggccgaatacacaaactccgcgggagtgcctagtctgaatgccgccctgatgcataccctgcagcgccatcgagacattcttcaggattacactcatgaatttcacaagacaaaggccaattttatggccattcgggagcgcgaaaacctcatggggtccgtccggaaagatatcgaaagctacaagtccggtagtggagttaacaatcgccgcactgagttgtttctgaaggagcacgaccatttaagaaatagcgatcggctcatagaggaaacgattagtatcgcaatggccacaaaggaaaacatgacatcccagcgcggtatgcttaaatcgattcactctaagatgaatacactggcgaatcggttcccagctgtcaatagcttgattcagcggattaacctgcgaaaaagacgcgatagcctgatccttggaggtgtaattggaatatgtactattctgctgctgctgtatgcgttccactag

SEQ ID NO: 41569 - DNA, 1452 bp, Artificial Sequence
  Description of Artificial Sequence: Synthetic coding sequence
atgaaggccttccacaccttctgcgtggtgctgctggtgttcggctccgtcagtgaggcgaagttcgatgatttcgaagatgaggaggatatcgtcgaatacgacgacaacgattttgccgagtttgaagacgtgatggaagacagcgttacggagagtccccagcgcgtcatcatcacagaggatgacgaggatgaaaccactgtcgagctggagggccaggatgagaaccaggagggggactttgaggacgcagacacccaggaaggggatacagagtcagaaccctatgatgatgaagagtttgagggctacgaggataaacctgatacctccagtagcaaaaataaggacccgatcacgatcgtcgatgtcccagcccacctccaaaatagctgggagtcttactacctcgagatcctcatggtcactggactgctggcctacatcatgaattatattattggtaagaataagaacagccggctggcacaagcctggtttaacacccatagggagttgttggagtccaacttcacattggtcggagatgacggaaccaataaagaagccacaagcaccggcaagttaaatcaggagaatgaacatatttacaacctgtggtgtagcggcagagtttgctgtgagggcatgttgattcaacttcgcttcctcaaaaggcaggaccttctgaacgtcctcgctaggatgatgagaccagttagcgatcaggtgcaaatcaaagttactatgaacgatgaggatatggacacatacgtgttcgccgtcgggacgcgcaaggcactcgtacggttgcagaaggaaatgcaggacctgagcgaattttgctcagacaaacctaaaagtggagctaagtatggcctgcccgactctttggccattctgtcggaaatgggagaggttaccgatggcatgatggacaccaagatggtccattttctgacacattacgctgacaagatagagtcagtgcatttcagcgaccagttttccggtcctaaaattatgcaggaggaggggcagcctctcaaactgccagacaccaagcggactctattgttcaccttcaacgtcccagggtctggaaatacctacccaaaagacatggaagccttattaccactcatgaacatggtgatttattcaatcgataaagccaagaaatttcggctaaatcgcgagggaaagcaaaaggctgataaaaatagggctcgggttgaggagaatttcctgaagctgacccacgtgcagaggcaggaagccgcccaaagtcgccgggaagagaagaagagggctgaaaaagagcggatcatgaacgaggaagatcccgagaaacaaagacgcttggaggaagctgctctcagacgggagcagaaaaaactcgagaaaaaacaaatgaaaatgaagcagataaaagtcaaggctatgtag

SEQ ID NO: 41570 - DNA, 1236 bp, Artificial Sequence
  Description of Artificial Sequence: Synthetic coding sequence
atgatgggccggagccccggcttcgccatgcagcacatcgtgggcgtgccacacgtgttagtgcggaggggtctgttaggcagagacctgtttatgactcgaactctctgctcacctggtccaagccagcccggagaaaagcgaccggaagaggtggcccttggcctccaccatcggctcccagccttagggcgggctctgggacattcaatacagcagagggctacaagcactgcaaaaacatggtgggaccgctatgaagagtttgtgggtttaaacgaagttagggaggctcagggcaaggtgaccgaagcagagaaggtgtttatggtggcaaggggactcgtaagagaggccagagaagacctcgaggtccaccaagccaaactcaaagaagtgagagacaggcttgatagggtgtctagagaagactcacaatatctcgagcttgctactctcgaacatagaatgcttcaggaggaaaaacgcctgcgtaccgcttacctgagggcggaggactccgagcgggagaaattcagcttgtttagtgcagctgttcgggagtcccatgagaaagagcggaccagagcggagcggaccaaaaactggtccctgattggatcagtgctgggtgcactgattggagttgccgggagcacctatgtaaatagggtccggctgcaggagctgaaggctctgctcctcgaggcccagaagggcccggtatccctccaggaggccatcagagagcaggcatcttcctattctaggcagcagagggatctgcacaacctgatggtagacctccgtggactcgtgcacgccgctggcccaggccaggacagcgggagccaagccggcagccccccgacccgcgatagagacgttgacgtgctatccgccgccctcaaggaacaactcagccattcgagacaggtgcacagttgtctcgaaggcctgagggaacagttggatggacttgagaagacctgcagtcagatggctggcgtggtccagctagttaagtctgccgcgcacccaggactggtggagccggcggatggcgccatgccctcctttctgttagaacagggcagcatgattctcgctctgtcagatactgagcagcggcttgaggcccaggtaaaccgcaataccatatacagtacgttggttacatgcgtgacattcgtggctactctgcccgtcttgtatatgctctttaaagcctcctag

SEQ ID NO: 41571 - DNA, 1236 bp, Artificial Sequence
  Description of Artificial Sequence: Synthetic coding sequence
atgatgggccggagccccggcttcgccatgcagcacatcgtgggcgttccccatgtgctggtgaggaggggcctgttggggcgcgacctattcatgactcgtactctgtgcagccctgggccatcgcagcccggcgagaagcgtccagaagaggtggctctgggcctgcaccatcggctgcccgcattaggacgggcacttggccactctatacagcagcgagccacgtctacagccaagacctggtgggacagatacgaagagttcgtgggcttgaatgaggtcagagaagctcaggggaaagttaccgaggcagagaaagtcttcatggttgcccgcggcttggttagggaggcgagagaggacctggaggtccaccaggccaagctaaaggaggtaagagataggttagatagggtctcacgggaagattcccagtaccttgagctggccactcttgagcacaggatgttgcaagaagagaagagactacggacagcttacctaagagcagaggatagcgagcgagagaaattcagtttattttccgcagcggtacgggagtcgcacgaaaaggagaggacacgtgccgaacgcactaagaattggtctcttatcgggtcagtgctcggagctctgataggggtggcggggagtacttatgtaaatagagttcgtctacaggagttgaaggccctgctgctggaagcccaaaaggggcctgtgagtctgcaggaggcaataagagagcaggcctcgtcttatagccggcagcaacgtgacctgcacaatctcatggtagatctgcgcggcctggtgcacgcagccggcccaggacaggactctggatctcaagccggatcacctcccacccgggatagagatgtcgatgtgctgagcgctgctctgaaggagcagctgagtcattctaggcaggtccacagttgtttggagggtctacgtgaacaattagatggactagagaaaacctgctcacagatggccggtgtcgttcagctggtcaaaagcgcagctcaccctggactggtcgaacctgccgatggagccatgccttcttttctactagagcagggatccatgatactcgcattatccgataccgagcagagactcgaggcccaggtcaaccggaacaccatctactccactctagttacctgcgtgacctttgtggccaccttgcccgtgttatacatgttattcaaagcgagttag

SEQ ID NO: 41572 - DNA, 909 bp, Artificial Sequence
  Description of Artificial Sequence: Synthetic coding sequence
atggtggcccggggcctggtgcgggaggcccgggaggacctggaggtgcaccaagccaaattaaaggaggtgagggacagattagatagggtgtcaagggaggattctcagtatctggagttagccactttggaacacaggatgctacaagaggaaaaacggctccgcacagcctacttgcgggcagaggactctgaaagggagaagtttagcctatttagtgccgccgtaagagaaagtcacgaaaaggagcggacgcgggctgaacgcacgaaaaattggtccttgatcggtagcgttctaggtgctctcatcggagtggcgggctcaacgtacgtgaatagggtacgcctccaggagctcaaagccctgctgctcgaagcccagaaaggaccagtcagcttacaggaagccataagagaacaggcgtcatcttattcaaggcaacaaagagatttacacaatctgatggttgatcttcgcggcctggtgcatgcagcaggccctggacaggactcaggcagccaggcgggaagcccccctacacgggatcgggatgtcgatgtgctgtccgccgcgctgaaggagcagctcagtcattcgagacaggtccattcatgcctggagggcttaagagaacagctcgacggactcgaaaagacatgtagtcagatggccggagtggtgcagctggtgaaatcagccgcgcatcccggcctggtagaacccgccgacggcgccatgccaagtttcctgttggaacagggctctatgattttggccctgtctgacaccgagcagcggctcgaggcgcaggttaatcgtaacaccatttactccacgctggtcacctgcgtgacttttgttgccaccctgcctgtgctctacatgctcttcaaagcaagttag

SEQ ID NO: 41573 - DNA, 189 bp, Artificial Sequence
  Description of Artificial Sequence: Synthetic coding sequence
atgatgggccggagccccggcttcgccatgcagcacatcgtgggcgtcccccacgtgctcgtgagacgaggcctgttgggccgtgacctgttcatgacccgcaccctgtgtagcccagggcctagccagcccggcgagaaaaggcccgaggaagttgctctcggcttgcaccacagattaccagcctag

SEQ ID NO: 41574 - DNA, 909 bp, Artificial Sequence
  Description of Artificial Sequence: Synthetic coding sequence
atggtggcccggggcctggtgcgggaggcccgggaggacctggaggtacatcaggccaagcttaaagaagtaagagatcggctggatcgggtgtcccgtgaggacagccagtacttagaactagccacactggagcaccgcatgctccaggaagagaaaaggttgcggaccgcgtatctccgagctgaggattctgaacgagagaaattttccttattttcggcagcagtgagggaaagtcatgaaaaggaacggacaagagctgagagaacaaaaaattggtcattgattggctccgtgctgggtgcgttaattggggtggctggcagcacctacgttaacagggttcgtctccaggagctgaaggccctgctgctagaggctcagaaaggccctgtctcactgcaggaagcaataagggagcaggctagctcgtatagtcgccagcagcgggacctgcacaacttgatggttgacctccgcgggctggttcacgcagccggaccaggccaggatagtggttctcaggctgggagtcctccaactagggacagagatgttgacgttctgagcgcggctctcaaagaacaactgagtcattcacgccaggtgcattcgtgtctggaggggctccgcgagcagctcgacgggctggagaagacatgctctcagatggcaggtgtcgtgcagctcgtgaagtccgcagcgcaccctggcctggtggagcctgctgatggggccatgcctagctttttactggaacagggatctatgatactcgcgctgagcgacactgagcagcggctcgaagcacaagtcaacaggaataccatatatagtaccctcgtgacttgcgtcacattcgtggcgaccctccccgttctctacatgctgtttaaagccagttag

SEQ ID NO: 41575 - DNA, 480 bp, Artificial Sequence
  Description of Artificial Sequence: Synthetic coding sequence
atgatgggccggagccccggcttcgccatgcagcacatcgtgggcgtgccccacgtgctggtaaggagaggcttgctcggtagggatctgtttatgaccagaaccctgtgttctcctgggccaagccagcccggtgagaaacgccctgaggaagtggctctaggtctccaccaccgcctgcccgcattgggccgggccctgggacattccatccagcagcgggctacatcaaccgctaagacatggtgggacagatacgaagagtttgtcggcctaaatgaagtgcgagaagcccaaggcaaggtgacggaggccgagaaagtgtttatggtggctagaggcctggtgcgcgaggctcgcgaggaccttgaggttcaccaggctaagctcaaagaggtgagagataggctggacagagtgtcgagagaggacagtcagtaccttgagctggcaacccttgagcacaggatgttacagtag

SEQ ID NO: 41576 - DNA, 909 bp, Artificial Sequence
  Description of Artificial Sequence: Synthetic coding sequence
atggtggcccggggcctggtgcgggaggcccgggaggacctggaggtccaccaggccaaactcaaggaggtgcgggataggctggaccgagtgtctagagaagactctcagtatctcgaactggctacattggagcaccggatgctccaagaggagaaacgactccgtacagcatacctgagagccgaagactccgagcgcgaaaagttttccctatttagtgcagccgtcagggagtctcatgaaaaagaaagaacccgtgccgagcgcactaaaaattggtctctgataggtagtgtgctgggcgcactcattggtgtcgccggtagcacatatgtgaatagagtgaggctgcaggagttgaaggctctgcttctcgaagcacagaagggtcccgtcagtttgcaggaagcgatcagggagcaggcctcgtcctattcacgacaacagcgggatttacacaacctaatggtggaccttagagggctggtgcacgccgcgggaccaggacaggatagcggttctcaagccggatcacctccaacacgggatagggacgtggatgtgctgtcagctgctctcaaagaacaactaagccacagccgccaggtccattcctgtctcgagggcctgagagaacagctggacggacttgagaagacatgctcccaaatggccggcgtagttcagctggtgaaatccgctgcccatcccgggctggtggaacctgcagacggcgctatgcctagtttcctcctggaacagggttccatgatactcgcgctttccgatacagagcagcgactggaagcccaggtcaacaggaacaccatctactcaactctggtcacctgcgttacatttgtggctacgctgcctgtgttgtatatgctctttaaggcctcctag

SEQ ID NO: 41577 - DNA, 321 bp, Artificial Sequence
  Description of Artificial Sequence: Synthetic coding sequence
atggccagcagcggcgccggcgaccccctggacagcaagcggggcgaagccccgttcgcccagaggatcgatcccacccgagaaaagctcacacctgagcagcttcattctatgagacaagccgagctggcgcaatggcagaaggttctgcctcgtcgaagaactcgcaacattgtgacgggcctgggcatcggcgccctggtgctcgccatttatggatacactttctacagcatcagtcaggagaggttcctcgacgagctcgaagatgaggcaaaagccgctagggccagggccttggccagggccagcgggagttag

SEQ ID NO: 41578 - DNA, 435 bp, Artificial Sequence
  Description of Artificial Sequence: Synthetic coding sequence
atggccgcccccagcggcggcgtgaactgcgaggagttcgccgagtttcaggaactgctcaaggtaatgcgaaccattgatgatcggattgtccacgagctgaacaccaccgttccaacagcttctttcgctggcaagatcgacgccagccagacttgcaagcagttgtatgagagcctcatggctgcccacgcatcgagggatcgcgtgattaagaactgcattgcccagacatcggcagtcgtgaagaacctgagagaagagcgcgagaagaatctcgacgacctgacgctcctgaagcagctgagaaaggagcaaaccaaactgaagtggatgcagagcgaactgaacgtcgaggaagtggtgaatgaccgtagttggaaagtcttcaacgagcggtgccgcatccacttcaagccaccaaagaatgagtag

SEQ ID NO: 41579 - DNA, 774 bp, Artificial Sequence
  Description of Artificial Sequence: Synthetic coding sequence
atggactgcggcagcgtgggcggccagcggacccagcggctgcccggcagacagcgtctcctgtttctgccggttgggctgagcgggcgtcctggcggaagtgaaacctccgctcgccgatgcctatctgccctgtcagacgggcttggggctctaaggcctagagcgcctgccgctagaggaggcgtttcacgcgcatcacccctgctgctgttacttttggtgcccagtccccgcctggctgccgccgcaccgagacggcagctgggtgattgggaacgttcacgactgggttacgcagcaccgcctgctggcaggtcctccgcctggagatgctcccctggggtggcggccgccgcgggggctctgccacaataccacggcccagcaccggctctagttagctgcaggcgggagttgtccctgtctgctggttctctgcagctagagcggaagcgccgagattttacctcttccggctcaagaaagctctactttgatacccatgcactcgtgtgtcttctggaggataatgagagtcattccttcatccaagccggcgtacagtggcattccctggggcttctacagccaccaccacctgggtttaagagaagttctcacctcatcctgctcagcagctgggattatcggcacgcaccacctcacttggacaatttctctgtctttcttctcgaaaccggcttccatcacgtcggtcaggctggactgaagttattgacaagttctgacccgccaacgctcgcatcatag

SEQ ID NO: 41580 - DNA, 1080 bp, Artificial Sequence
  Description of Artificial Sequence: Synthetic coding sequence
atggactgcggcagcgtgggcggccagcggacccagcggctgcccggaaggcagcgtttgctctttctcccggtgggcctgagcggaaggccgggaggcagcgagaccagcgcacggcggtgtctgtccgccctcagcgatggcctgggtgctcttagaccgcgcgcacccgcagccagagggggcgtctcccgtgcatcgcctttattattgctgctgttggtacccagccccagacttgccgccgctgccccacgacgccagctgggagattgggagagatcccgccttgggtacgcggccccacccgcagggcgctctagcgcttggaggtgcagccctggtgtggcagctgctgccggggcactgccccagtatcatggccctgctcccgcccttgtcagctgccgacgagagctcagcctctctgccggatcactccagctggagcgaaagcggcgggacttcacttctagcggttctaggaaactttacttcgacactcacgcactcgtgtgtcttcttgaggataatgggtttgcaacacaacaggcagagattatcgtttccgccctcgtcaaaatcttagaagccaacatggatatcgtatataaagacatggttacaaagatgcagcaggagattacattccagcaggttatgtctcagatagctaacgtgaagaaggacatgatcatcctagaaaagtcggagttctctgctctaagggctgagaatgaaaagattaagctcgagttacatcagctgaagcaacaggtaatggatgaggtcattaaagtccggacagatactaagcttgacttcaacctcgaaaaatctcgggtaaaagaactgtatagcctgaacgaaaaaaaattactcgaactcagaacggaaattgtggcactgcacgcacaacaagatcgggctttgacgcagaccgatagaaaaatcgagactgaggtggctggtcttaaaactatgctggagtcacataagttggataatatcaaatacttggccggtagtatttttacctgtttgacagtcgcgctgggcttctaccggctgtggatctag

SEQ ID NO: 41581 - DNA, 738 bp, Artificial Sequence
  Description of Artificial Sequence: Synthetic coding sequence
atgctggccaactgcggcagcgtgtgcgaggagacccagttccggggaacaaccgtcgcgccagcactgggggagttctttactaccacaactaaagaagggtatgatcgcagacctgtggacatcacccccctagaacaaaggaagctcacgttcgacacccacgcactggtacaagacttggaaacacacggctttgataagacacaggccgaaaccatcgtctcagcactgaccgctctgagcaatgtgagtctcgatactatctataaagagatggtgacgcaggcacaacaggaaatcactgtgcaacagttaatggctcaccttgacgctattaggaaagatatggtgatactcgagaagagcgagttcgctaatctgagggcggaaaatgagaagatgaagatcgaactggatcaggttaaacaacagcttatgcacgagacctcccggatccgggccgataataagctcgatatcaatctggagcgctccagggtgacggatatgttcacagaccaggagaaacagctaatggaaaccacaactgagtttaccaagaaggacacgcagacaaaaagcatcatctccgagactagtaataagatcgacgctgagattgcttcgctgaaaacactgatggaatcaaataaactggaaacgataaggtacctggcagcctctgtgttcacctgcttggcgattgctcttggtttctatagattttggaaatag

SEQ ID NO: 41582 - DNA, 462 bp, Artificial Sequence
  Description of Artificial Sequence: Synthetic coding sequence
atggtgacccaggcccagcaggagatcaccgtgcagcagctgatggctcacttggatgcgatccgcaaagatatggttattcttgagaagtccgagttcgccaacctgagagccgaaaatgaaaagatgaaaattgagcttgaccaagtgaaacagcagctcatgcacgaaacttcccggatccgagccgataacaaactggatatcaatctagaaaggagccgtgtgactgatatgtttaccgatcaggagaaacagctcatggagactactacagagtttactaagaaagacactcaaacaaaatcaatcatttctgagacaagcaacaaaatcgatgcagagatcgccagcctgaaaaccctgatggagagtaataagctggagacaatcagatatctggcagccagcgtgtttacctgtctcgcaatcgctttgggattctatcggttctggaagtag

SEQ ID NO: 41583 - DNA, 462 bp, Artificial Sequence
  Description of Artificial Sequence: Synthetic coding sequence
atggtgacccaggcccagcaggagatcaccgtgcagcagctgatggcgcacctcgatgccatcaggaaggacatggtgattttagaaaagtcggaattcgccaatctaagagctgagaatgagaaaatgaagatcgagctggatcaggtgaaacagcagttgatgcacgaaacctcacgcattcgtgcagacaacaaactcgatatcaaccttgagagaagccgggtgacggatatgttcaccgatcaggaaaaacaattgatggagactactactgagttcacaaaaaaggacacccagactaagtccataatctcggagacgagcaataagatcgacgccgaaattgctagcttgaagactcttatggaaagcaacaaactggaaacaattagatatttagccgcttctgttttcacatgcttagccatcgctctggggttctatcggttctggaaatag

SEQ ID NO: 41584 - DNA, 765 bp, Artificial Sequence
  Description of Artificial Sequence: Synthetic coding sequence
atgaacagccggcaggcctggcggctgttcctgagccagggccggggggataggtgggtgtccagaccgcgcggccatttctcccccgctttgcggagggagttttttacaacaaccaccaaagagggctacgacagacgtccggtcgatataactcccctggaacaaagaaagttaacgtttgacacccacgcgctggtccaggatctggaaacccacggattcgataagacccaggccgagaccatcgtatctgctttaacggctttaagcaatgtctccctggatactatatacaaggagatggtgacccaggctcagcaagaaattacagtccaacaattgatggcccacctcgacgccatccggaaagacatggtgatccttgagaaatcagaattcgccaatcttagagccgagaacgagaaaatgaagatcgagcttgatcaggtgaagcaacaactaatgcacgagaccagcaggatccgggctgataataaattagacatcaatctcgagcggtcaagggtgacggacatgttcaccgatcaggagaaacagctgatggagacgaccaccgagttcaccaagaaggatacccagaccaaaagcatcatcagtgaaacctctaataaaatcgatgctgaaattgcctccttgaagaccctaatggaatctaacaagctcgaaacgataagatacctggcagcgagcgtgtttacctgcttggctattgcgctgggcttttaccgcttctggaagtag

SEQ ID NO: 41585 - DNA, 1236 bp, Artificial Sequence
  Description of Artificial Sequence: Synthetic coding sequence
atgcccatgtggaacaaggtgagcggcgtgcacctgagccccagcagtcctgaaatcgtcttggaccgtgaccacagttctagcattggatgcctttccagtgacgctattatatcctccccagagaacacccacgcagctaacagcatcgtctctcagaccatccccaaggcccagatccagcagagtacacatactcacctcgacatatccctgttcccacttggtctcaccgatgagaagtccaacggaacaatagccctagtcgacgattccgaggaccctggagcgaacgtatccaatatccaacttcaacaaaaaattagctcactggagataaagttgaaggtgtctgaagaagagaagcaacggatcaagcaggatgtcgagagcctgatggagaagcacaatgtgctggaaaagggatttctgaaagagaaggaacaggaggctattagcttccaggataggtataaagagctgcaggagaaacacaaacaggagctcgaggacatgaggaaggccggccacgaggcgctgtcaataatcgtggatgagtataaggctctgcttcagtcaagcgtgaagcagcaggtggaagcaatcgagaaacaatacatttccgcgatagaaaaacaggctcacaaatgcgaggaactgctgaatgcacagcaccagagactactcgagatgttggacacagagaaagagctgctcaaggaaaagatcaaagaggctcttatccagcaaagccaggagcaaaaagagatactcgaaaaatgtctggaagaggaacgccaaaggaataaagaggccctggtgtctgcagccaagctcgagaaggaggctgtgaaggatgcagtgcttaaggtagtggaggaggaaagaaaaaatctcgagaaagcccatgcagaagagagggaattgtggaagacagagcacgctaaagatcaagaaaaggttagtcaggagatccagaaggcaatccaggaacagcgtaaaatcagccaggaaacggtgaaggcagcgatcatcgaagaacagaagcgaagcgagaaagccgttgaagaggccgtcaaaaggacccgcgacgaacttatagagtacatcaaagaacagaaaagactcgaccaggtcattcgacagaggagcttgagctctctggagctgttcttgtcctgtgcacagaaacagctgagcgcgctcatcgccactgaaccggttgatatagaatag

SEQ ID NO: 41586 - DNA, 1218 bp, Artificial Sequence
  Description of Artificial Sequence: Synthetic coding sequence
atggacgacgacgacttcggcggcttcgaggccgccgagaccttcgatggcggctcaggcgaaacccagacaacctctccggctatcccatgggccgcctttcctgccgtcagcggggtccatctcagtccatcatcacccgagatcgtgctcgatcgagaccactcctcatcaattggttgcttaagtagcgacgcgattatctcctcgcccgagaatactcacgcggccaattcaatcgtgtcccaaacgatacccaaagcacagattcaacagagcacccatactcacttagacatttcactctttccacttgggctcaccgacgaaaagagtaatggcaccatcgccctggtcgatgactcagaggaccctggggctaacgtcagcaacatacagctgcagcaaaagatttcttctctcgagattaagctgaaggttagcgaggaggaaaagcagcgaatcaagcaggacgtggagagtctcatggagaaacataatgttctcgaaaagggattcttgaaggaaaaggaacaggaagccatctcttttcaagatcgctataaagagctgcaggagaaacataagcaggaattggaggacatgcgaaaggcaggccatgaggcactttccatcatcgtcgatgaatataaacaccagcgtctcctcgagatgctcgatacagagaaagagcttctcaaggaaaagatcaaggaggctctgatccagcaaagtcaggagcagaaagagattctcgagaaatgccttgaagaggagaggcagagaaataaggaggccttagtgagtgccgccaaattagaaaaggaggccgtaaaggatgccgtgctcaaagtggtggaggaggaacggaagaacttagaaaaagcccatgctgaggaacgagaattatggaagactgagcacgccaaggatcaggagaaagtgagccaagagatccagaaagcaatccaggagcaaagaaaaatctcccaggaaactgtgaaggccgccatcatcgaggagcagaaacgctctgaaaaagcggtagaagaagccgtgaagcgaacccgcgatgagttgatcgaatatatcaaagagcagaaacgccttgatcaggttatccggcagagaagtctgagcagtctggaactcttcctgagctgcgcccagaaacaactttcagccttaatcgccaccgaacctgtggatatcgagtag

SEQ ID NO: 41587 - DNA, 1326 bp, Artificial Sequence
  Description of Artificial Sequence: Synthetic coding sequence
atggacgacgacgacttcggcggcttcgaggccgccgagaccttcgacggcggaagcggtgagactcagacgaccagtccagcgataccctgggccgcattccctgcagtgtccggcgttcacctcagcccaagtagccctgaaatcgtgcttgatcgggaccattcttcctccattgggtgccttagcagtgacgctattatatcttctcccgaaaacactcatgccgcaaacagcatcgtgagtcagaccatcccgaaggcccaaatccagcaatcgactcacactcacttggatattagtttatttcccctggggttgactgatgagaagagcaacgggaccattgctttggttgacgattccgaggatccaggcgccaatgtgagtaacatacagttgcagcagaagatctccagcctggagataaaattgaaagtgtctgaagaggagaagcagagaatcaagcaggacgttgaatctctaatggagaagcataacgtcctggagaaggggtttctcaaggaaaaggaacaggaggcaataagttttcaggatcgatacaaggaactccaggaaaaacacaaacaggagttagaggacatgcggaaagccgggcacgaagccctgtccattatagtcgacgaatataaggccttacttcagtccagcgttaagcagcaagtcgaggccatcgaaaaacagtatatctcagccatcgagaagcaggcacataaatgcgaggagctcttgaacgcccagcaccaaagattgctcgaaatgctggatactgaaaaggagctactaaaagagaagatcaaggaggcgctgatccaacagagccaagagcaaaaagagatactcgaaaagtgcctggaagaggaacgccagaggaataaagaagccttggtgtccgcggccaagcttgagaaagaagccgtgaaggatgctgtcctgaaagtggtggaggaggaacggaagaatctggaaaaagcccatgctgaagagcgggagctttggaagactgaacacgccaaggatcaggagaaagtgtcccaggagatccagaaagccatccaggagcaaagaaaaatttctcaggaaacagtcaaagctgccatcatcgaagagcagaagcgatcggaaaaagcggtagaagaagcagttaagaggactagggatgagctgattgaatacattaaagagcaaaagaggctagatcaggtcattaggcagaggtctctctcatccctggaactgttcttgtcgtgcgcacagaagcaactgagtgcacttatcgccaccgaaccagtagatattgagtag

SEQ ID NO: 41588 - DNA, 1086 bp, Artificial Sequence
  Description of Artificial Sequence: Synthetic coding sequence
atggacgacgacgacttcggcggcttcgaggccgccgagaccttcgacgggggctctggtgaaacccagacaaccagtcccgccatcccttgggccgcctttccagccgttagcggggtgcacctatccccttcctccccagaaattgtgctggacagagaccacagctctagtataggatgcctgtcctcagatgccattatatctagcccagagaatacccatgccgccaactccatcgtttctcagacaatccctaaagcccagatccagcagagcacccacacgcatcttgatatcagtttattccctctgggcctgacagacgaaaaatcgaacggtaccatcgcgctggtggatgattccgaggacccaggggccaacgtgagtaacatacagctgcagcagaaaatttctagtctggaaattaagctcaaagtctctgaagaggaaaagcagaggattaagcaggacgtggaatccctgatggagaagcataacgtcctcgagaagggtttcctaaaggaaaaagaacaggaagctatttcctttcaggacaggtataaagagctccaggagaagcataagcaggagctggaggacatgcgaaaggccgggcacgaggccttatcaattatcgtggatgaatacaaggcgctgctccagtcatcagttaaacaacaggtcgaggccatcgagaagcaatacattagcgcaatcgaaaagcaagcccataaatgcgaggaactgctgaatgcccaacaccagcgcctccttgagatgctcgacacagaaaaggagctgctcaaggaaaaaataaaggaggccctcattcagcaaagtcaggagcagaaagagatcctcgaaaaatgtctggaagaagagagacagagaaacaaggaagctcttgtgtccgcagccaaattagagaaggaggccgtcaaagatgctgtgctgaaggtcgtggaagaggagagaaaaaatcttgagaaggcccatgctgaagaacgcgagctgtggaaaaccgaacacgccaaggaccaggagaaagtatcccaggaaatccagaaggctatccaggagtag

SEQ ID NO: 41589 - DNA, 258 bp, Artificial Sequence
  Description of Artificial Sequence: Synthetic coding sequence
atggacgacgacgacttcggcggcttcgaggccgccgagaccttcgatggggggagcggagaaacccagaccacaagcccggctattccttgggccgcatttcctgcagtctccggcgtgcacctgtcaccctcgagtccagaaatcgtgttagaccgggaccactcttcatccattggatgcctatcaagcgatgccattatttccagtcctgaaaacacccatgccgccaactccatcgtgtcccagacaatttag

SEQ ID NO: 41590 - DNA, 1218 bp, Artificial Sequence
  Description of Artificial Sequence: Synthetic coding sequence
atggacgacgacgacttcggcggcttcgaggccgccgagaccttcgatggtggtagcggagaaacacagactacttccccggccattccttgggccgctttcccagccgtgtctggggtgcacctgagcccatcgagccctgaaattgtcttggaccgcgaccactcttcatccataggctgtctcagttccgatgccatcatttcctcaccggagaatacccacgctgcgaattccattgtctcccagaccatccccaaggctcagatccaacaaagcacacacactcacctggatatctctctttttcccctgggacttacagacgaaaaaagtaatggcacgattgcgttagtggacgactccgaggatcccggtgcaaacgtgtcgaatattcagcttcaacagaaaatctccagcctggaaatcaagctgaaagtttcggaggaagagaagcaacgcatcaaacaagacgtggagtccctgatggaaaaacacaacgtgctcgaaaagggctttctcaaggaaaaagaacaggaggctatatctttccaagacaggtacaaggagctccaggagaaacacaagcaagaactggaggacatgcgaaaggcagggcacgaagccttatcaataatcgtggacgagtacaagcaccagcggctgctggagatgctcgacacagagaaggaactgctcaaggagaaaataaaagaggctctgatccaacagagccaggaacagaaggaaattctggagaagtgtctggaagaggagagacaacgcaataaggaggccttggtcagtgccgccaagttggagaaggaagccgtcaaggacgccgtgctgaaagtggtggaggaagagagaaagaacctggaaaaggcccatgccgaagagcgggagttgtggaagaccgagcacgccaaggatcaggaaaaagtctcccaggagattcaaaaagcgattcaggagcagcgcaagatcagccaggagactgtaaaggctgccatcatcgaagagcagaagaggtctgaaaaggctgtggaggaagccgtcaaaagaacaagagatgagctcattgaatatattaaggaacagaagcggctagaccaagtgatacgtcaaaggtcgctgagctcgttggagctcttcctgtcgtgcgcccagaagcagctatctgcactgatcgcaaccgagcccgtggacatcgaatag

SEQ ID NO: 41591 - DNA, 276 bp, Artificial Sequence
  Description of Artificial Sequence: Synthetic coding sequence
atggacgacgacgacttcggcggcttcgaggccgccgagaccttcgatggaggatctggagagacacagacgaccagccctgccatcccctgggccgccttcccagccgtcagtggcgtccatctctccccgagctctccagagattgtactggacagggaccactcatcctccatcggatgtctttcttctgatgccatcatttcttcgcctgagaatacgcatgctgccaactctatcgtgtcgcaaactatccctaaggcgcagatccagtag

SEQ ID NO: 41592 - DNA, 1326 bp, Artificial Sequence
  Description of Artificial Sequence: Synthetic coding sequence
atggacgacgacgacttcggcggcttcgaggccgccgagaccttcgacggaggctcaggcgagacccaaactacatcacctgccataccttgggctgctttcccagcggtgtctggagtacatctgtcacctagttcccctgaaatagtgctggacagggatcatagctcttccattggatgcctctccagcgacgctatcatctcttcccctgagaacacgcacgccgccaattccatcgtctcccaaaccatccccaaggcccagattcaacagtccacccatacccatcttgatatctctctgttcccactgggcctgactgacgaaaaatctaacggcactattgctctggtggatgactcagaagatcccggagcgaatgtgtcgaacattcagttacagcagaaaatatcaagcctcgaaatcaagctgaaagttagcgaagaggagaaacaaagaattaaacaggatgtggagtctttaatggagaaacacaacgtgctggagaaagggtttttgaaagaaaaagagcaggaggccatatcatttcaggaccgttacaaagagctccaggagaaacacaaacaggagcttgaagacatgaggaaggctggccatgaagcattgtcaatcattgtggatgaatacaaagcgctgcttcagtccagcgtcaaacagcaggtggaggctatagagaaacagtacataagcgcgatagaaaagcaggctcacaagtgtgaagaactgctgaacgcgcagcaccagagactgcttgaaatgctggacaccgaaaaagagcttcttaaagagaaaatcaaggaagctttgatacagcagtctcaggagcagaaagagatcctggagaagtgtctggaagaggaaaggcagcgcaacaaggaggcactggtgtctgcagccaaattggaaaaggaagccgtgaaagacgcagtgcttaaggtggtggaagaagaaagaaaaaatctggagaaggcccacgccgaagagcgcgagctgtggaaaactgagcatgcaaaggaccaggagaaagtctctcaggagatacagaaggccattcaggagcagcgcaagatcagccaagaaaccgtaaaggctgctatcatcgaggagcagaagagatccgaaaaggccgttgaggaggccgtgaagagaactagagacgaactgatcgagtacataaaggagcagaaacggctggaccaggttatacggcaacgctccttaagtagcttagagttgtttctttcctgtgctcaaaagcagctctctgctctgatcgctacggaacccgtggacatagaatag

SEQ ID NO: 41593 - DNA, 357 bp, Artificial Sequence
  Description of Artificial Sequence: Synthetic coding sequence
atggccacccccagcctgcggggccggctggcccggttcggcaacccacgcaagcccgtcctgaaacctaacaagcccctgatcttagcaaaccgggttggtgagagaaggcgcgagaagggcgaagcgacttgcataactgagatgtctgtgatgatggcctgctggaaacaaaatgaattccgtgacgacgcttgtcggaaggaaattcagggatttctggattgcgcagcccgagcccaggaggcccgtaagatgagatctattcaagaaaccttaggggagtctggaagcctgcttcctaataagttgaacaaactgctccagcggttcccaaacaaaccttacctctcttag

SEQ ID NO: 41594 - DNA, 294 bp, Artificial Sequence
  Description of Artificial Sequence: Synthetic coding sequence
atggccacccccagcctgcggggccggctggcccggttcggcaacccacgaaaacccgtactgaagcctaacaaacctctgattttggccaatcgggtgggtgagagaaggcgtgagaagggggaggccacctgcattacagaaatgtcagtcatgatggcgtgttggaaacagaatgagttccgagatgacgcatgcagaaaggagattcagggatttctggattgcgcagcgagggctcaagtgaccgatggcagctggggggccttttccgggaaagagtggggcaggtag

SEQ ID NO: 41595 - DNA, 429 bp, Artificial Sequence
  Description of Artificial Sequence: Synthetic coding sequence
atgccccggggcagccggagcgccgccagccggcccgccagccggccagctgcaccttccgcccacccacccgcacaccccccaccgagtgctgccgctcctgctccggcgccaagcggccagcccggcctgatggcccagatggctacaactgccgccggggtggccgtgggctctgcggtggggcacgtgatgggttcagccctcacaggagcattcagtgggggttcctcagaaccctctcagcctgcagtgcagcaggctcccacccctgccgcgccccagcccttgcaaatgggaccatgcgcttacgagatcagacaattcctggactgcagtaccactcagagcgacttgtcactgtgtgagggattttcagaagcgctcaagcaatgtaagtattaccatggtttgtcctcactgccttag

SEQ ID NO: 41596 - DNA, 456 bp, Artificial Sequence
  Description of Artificial Sequence: Synthetic coding sequence
atgccccggggcagccggagccggaccagccggatggccccccccgccagccgggcaccacagatgagggcagccccacgccctgccccggttgcacaaccccccgctgccgccccgccaagtgcagtggggtccagtgctgctgcaccacgccagcctggactcatggctcaaatggcaaccacagctgccggtgtggccgtgggaagtgccgtgggtcacactttaggccacgctatcaccggtgggttttccggagggtccaatgccgagccggcccggcccgacattacttatcaggagccccagggaactcagcccgctcagcagcagcaaccatgtctgtacgagatcaaacagttcctggagtgcgcacagaaccagggtgatatcaagctctgcgagggcttcaatgaagtgcttaaacagtgtagattggctaatggccttgcatag

SEQ ID NO: 41597 - DNA, 468 bp, Artificial Sequence
  Description of Artificial Sequence: Synthetic coding sequence
atgcccgtgagctacagcagcgtgaccacccggtactaccaccgggcaggagcagaggaaggtaaggatcgaatcatctttgtaaccaaagaggatcacgaaaccccttccagcgccgagttggtggccgatgacccaaacgatccttacgaagagcatgggctcatactccctaacggcaatataaattggaattgtccttgcttaggaggtatggcctcagggccatgtggtgagcagtttaaatcggctttcagctgtttccactactcgacagaggagattaaagggtctgattgcgtggatcaattccgcgccatgcaggagtgcatgcagaagtatccggacctctaccctcaggaagacgaagatgaggaggaagagagggagaaaaaacctgcagagcaagcagaggaaacagcacccatcgaggccactgctacaaaggaggaggagggaagtagttag

SEQ ID NO: 41598 - DNA, 429 bp, Artificial Sequence
  Description of Artificial Sequence: Synthetic coding sequence
atgagctactgccggcaggagggcaaggaccggatcatcttcgtgaccaaggaggaccatgaaaccccatcctctgccgaattggtggccgatgacccgaatgatccctacgaagagcacggtctcattctgcccaatggcaatattaattggaattgtccttgcctcgggggaatggcaagcggtccatgcggcgagcagtttaagtcagccttttcgtgttttcattactctaccgaagagattaagggtagcgattgcgtggaccagtttagggctatgcaggaatgtatgcagaaatacccagatctgtatcctcaagaagatgaggacgaggaagaagaacgagaaaaaaagcctgctgagcaagctgaggaaacggctccaattgaggcaacggctactaaggaggaggaggggtcaagctag

SEQ ID NO: 41599 - DNA, 1449 bp, Artificial Sequence
  Description of Artificial Sequence: Synthetic coding sequence
atggccagcttcagcgccgagaccaacagcaccgacctgctgagccagccctggaacgagcctccagtaattttgtcaatggtaatccttagtcttaccttccttcttggactacccggcaatggtctcgtgctctgggtcgccggccttaagatgcagcgcaccgtaaataccatctggtttctccacctgaccctcgcagatctgttgtgttgcctctctctgcctttttcactggcccacctggccctccaagggcagtggccctacggacggttcctttgtaagctaatcccctctattatagtacttaacatgttcgccagtgtgtttctgttgacagccattagcctggaccgctgtctggtggtgtttaagccaatatggtgtcagaatcataggaacgtgggcatggcatgctcgatctgtggctgtatttgggtggtcgcatttgtcatgtgtattccggtgttcgtgtatcgggagatttttacaaccgacaaccataatcggtgcggctacaagttcggtctgagctcctcactggattatccggacttttacggcgatcctcttgagaatagatctctggagaacatcgtgcagccacccggggaaatgaatgaccgcctggatccttcaagttttcagactaacgatcacccatggacagtccccacagtcttccagccccagacctttcagaggccttcggctgattctctgcccaggggctccgcccggttaaccagtcaaaatctttatagtaatgtcttcaaacccgctgatgtggttagtcccaagattcccagcgggttccctatcgaagatcacgaaacgagccctcttgataattcagatgccttcctctcaacacatctgaagttgttcccctcagcttcctcaaactcattttacgagagtgaactaccccagggtttccaggattattacaatttagggcagttcactgacgatgatcaggttcctacccccttggtcgcaattacgatcactcgattggtggtgggatttttgcttcctagcgtgatcatgatcgcatgctactccttcattgtgtttcggatgcagcgcgggaggtttgctaaatctcagagcaaaacgtttcgcgtggcggttgtcgtcgtagcagtgtttcttgtgtgctggaccccgtaccacatatttggggtcctgagcctgctgacagatccggagactcccctgggcaaaacattgatgtcgtgggatcacgtgtgcattgcgctcgcctcagccaatagctgcttcaacccttttctttatgcactgctaggcaaagactttcgcaagaaggctcggcagagcattcagggaatcctggaggctgccttcagtgaagaactcacacgctcaacccactgtccaagcaataatgtgatcagcgaacgtaattctaccacggtgtag

SEQ ID NO: 41600 - DNA, 441 bp, Artificial Sequence
  Description of Artificial Sequence: Synthetic coding sequence
atggccagcttcagcgccgagaccaacagcaccgacctgctgagccagccatggaacgagcccccagtgatcttgtctatggtcatcctctccctgacatttcttttaggcctgccagggaatggccttgtactttgggtggccggcctcaagatgcagcgcaccgtcaatacaatttggttcctccatcttactctggcagacttactgtgctgcctgagtctgccattctccctggcacaccttgctctgcaaggccagtggccctatggaagattcctctgtaagctgataccatctattatcgtgcttaacatgtttgcttcggtgtttctgctgaccgccattagtcttgatcgctgtttagtagtgttcaagccgatatggtgtcagaatcaccgaaatgtaggcatggcctgctctatctgtggctgcatctag

SEQ ID NO: 41601 - DNA, 1053 bp, Artificial Sequence
  Description of Artificial Sequence: Synthetic coding sequence
atggacagcttcaactacaccacccccgactacggccactacgacgataaagacaccctcgacttgaacacgcctgtcgataaaacttctaataccctccgggtcccagacatactggccttagtcatctttgcagtggtgtttctggtgggtgtactcggcaacgcgctggtggtgtgggtcacagcctttgaggcaaagaggacgattaacgccatttggtttctcaatctcgccgtggcagactttctttcgtgtctggcgctacctatcttgttcacttcaatcgtgcagcaccaccactggccattcggaggcgccgcttgcagcatattaccaagcctgattctactcaatatgtacgcctctatcctgctgcttgccacaatctccgctgatcggttcttattggtctttaaaccgatttggtgtcagaacttcagaggcgctggactcgcgtggattgcatgtgcagttgcgtggggactggctctgctgcttaccattccctcatttctctacagggtggtgcgggaggagtacttccccccgaaggtcctgtgtggtgtcgactatagccacgacaagagacgcgagagagccgtggcaatcgtgagactcgttctcggcttcttatggcctctccttacattgacaatctgctacacttttatcctgttgaggacctggagccgacgtgcaacccggagtacgaagactttgaaagtggtagtggcagtagtggcctccttctttattttttggctgccctaccaggtaacaggtatcatgatgtcattcctggaaccaagctcccctacctttctgctgttgaaaaagttggactcgttatgcgtgagttttgcttatataaactgttgcatcaacccgattatttatgtggtagctggtcagggcttccagggccgactccggaagagccttccttcactgctgagaaacgtgctgactgaggagagcgtagtcagggagtccaagagtttcacccgtagtaccgtggatacgatggcacagaagactcaggcagtttag

SEQ ID NO: 41602 - DNA, 477 bp, Artificial Sequence
  Description of Artificial Sequence: Synthetic coding sequence
atggccttcatggtgaagaccatggtgggcggccagctgaagaacctaactgggtcccttgggggtggtgaagataagggagatggcgacaagtctgcagcagaagcccagggcatgagcagagaggaatacgaggagtatcagaagcaacttgtcgaagaaaaaatggaaagagacgcacaattcactcagaggaaagccgaacgggccacattgcggtcccattttagagataagtatcgtctcccaaaaaacgagactgatgagtctcagatccagatggctggcggagatgttgaactgccaagagaattggctaagatgatcgaagaggacactgaggaggaagaggagaaggcctcagtgctgggccagcttgctagcctgcctggactgaatctgggctccctgaaggataaagcacaagcgactctgggcgatctgaagcagtcagccgagaagtgccatgttatgtag

SEQ ID NO: 41603 - DNA, 2142 bp, Artificial Sequence
  Description of Artificial Sequence: Synthetic coding sequence
atggagcccgtggagacctggacccccggcaaggtggccacctggctgcggggtctcgatgattcactgcaagactatccgttcgaggactggcagctgcctgggaaaaatctgctgcagctgtgcccccagtctcttgaggcactggccgtccggagcttggggcaccaagagctgatcctgggtggtgtcgagcagcttcaggctcttagctcccggctccagacagagaacttgcagagcctgactgagggactgctgggagccacacatgactttcagtctatcgttcagggctgcctgggggattgtgccaagacaccaattgacgttttatgtgccgcggttgaattactccacgaagcagacgccctgctattttggctgtcgaggtacctgttctcacacttgaatgactttagcgcctgtcaggaaattcgagaccttctcgaggaactatcgcaggtgctgcacgaggatggccccgcggccgaaaaagagggtactgtccttcgaatctgttcccatgtggctgggatctgccataatattctggtttgctgccctaaggaactgctcgagcagaaggctgttctggagcaggtgcagttagattcaccactgggactcgagatccataccacttccaactgccaacatttcgtgtcccaggtagacacgcaggtacccactgactcaagactgcagattcaacctggggacgaggtggtgcaaattaatgagcaggttgtcgtcggctggcccagaaagaacatggtaagggagctcttgcgagaacctgccggcctgtctttggtattaaaaaaaattccaatacctgagacgccgcctcagaccccgcctcaagtcctcgacagtccacatcagagaagcccttctcttagcctagcccctctgtcaccacgcgctccatccgaagatgtgttcgcctttgacctgtcttcaaacccttcccccggaccttctccagcctggacggattccgcctcactgggacccgaacctctgcccatccccccagagcccccagccatcctgccggccggtgtggcaggcacccctggattgcctgagtcccccgacaagtccccagtgggtagaaagaagtctaagggcctggccaccagactttccaggcgcagggttagctgccgtgaactggggcgcccggattgcgatggctggttgcttttgcggaaggcccctggaggatttatgggtcccagatggcggaggaggtggtttgtgctgaagggccacaccctttactggtaccgacagccacaggacgaaaaggctgaggggctcatcaatgtatctaattatagtctggagagcggtcatgatcagaaaaaaaaatacgtcttccaactcacacacgacgtatacaagcccttcatatttgccgcggataccctgactgacctttcaatgtgggtgagacacctaataacttgtatctcgaaataccagtcacccggacgcgctccaccgccccgggaggaagactgctactctgagaccgaagccgaagacccagacgacgaggcaggatcccacagtgccagcccatcccccgcccaggctggctcccctctgcatggcgataccagccccgctgccacacccactcaacgatcaccacgcaccagttttggcagtttaactgattcttctgaggaagccctagagggcatggtcaggggactgcggcaggggggagtaagtctcctgggtcagcctcagcctctgacgcaagaacaatggcggtcaagtttcatgagacggaatcgagacccacagctgaacgagcgggtccacagggtgcgggctctgcagtctactctgaaggcaaaactccaggaactgcaagtcctggaagaagtccttggcgatccagagcttactggcgaaaaattcaggcaatggaaagaacagaatagagagctgtattctgaaggcttgggcgcatggggcgtcgcacaggccgagggatcatcacacatcctgacctctgacagcacagagcagagtccacactctctaccctccgatcctgaggaacattcacacttatgtccactgacgtctgaatcttcactgagacctccagacctttag

SEQ ID NO: 41604 - DNA, 2163 bp, Artificial Sequence
  Description of Artificial Sequence: Synthetic coding sequence
atggagcccgtggagacctggacccccggcaaggtggccacctggctgagaggccttgatgacagcctgcaggactacccatttgaagactggcagttacccggtaaaaacctcctccagctatgcccccagtcactggaggccttggcagtgcgcagtttgggccatcaagaattaattctgggcggcgtggagcagttgcaggccttgagttcacgtctccaaaccgagaacctgcagagtttgacagagggcctccttggagctacgcatgacttccaatcaatcgtccagggctgtctgggcgattgtgccaagacccccatcgatgttctgtgcgcagcagtggaactcctgcatgaggccgatgcccttctcttctggttgagtcgatatttgttctctcacctgaatgacttctcagcctgtcaagaaattagggacctgctagaagaacttagtcaggtgcttcacgaggacgggcccgccgctgaaaaggagggaaccgttctgaggatttgtagtcacgtagcaggcatatgccacaatattcttgtatgttgtcccaaggaactgctcgagcagaaggccgtacttgaacaggtgcagctggactcgcctctgggtctagagatccatacaacaagcaactgccagcatttcgtgtctcaggttgatactcaggtgcccacggattctagactccagatccagcccggggacgaagtggtccagatcaatgagcaggtagttgtgagggaagagagagatatggtgggttggccccgcaaaaacatggtgcgagaactcctaagggagcccgctggcttgtcgctggtgctaaagaagattcccatccctgagactcctccacagacaccacctcaggtgttagatagcccacatcaacgctccccttccctatctctggcaccgctttcccctcgggcgcccagcgaagacgtgttcgcttttgacctttctagtaatccctcacccggaccttcccctgcctggactgactcagcctcactgggtccagaaccattgccaatcccaccggaaccaccagcaatcctacccgccggagttgccggtactcccggtttacctgaatctcccgacaaaagccccgttggtaggaaaaagtctaaggggttggccacaagactaagcaggagaagagtgtcttgccgggagttagggcgaccagattgcgacggctggcttctcttacgaaaggctcccggggggttcatgggcccccgctggcgccggcggtggtttgtgcttaaggggcacacactgtattggtatcgtcagcctcaggatgagaaagccgagggcttaatcaatgtgagcaattatagcttggagtcaggtcacgaccagaaaaaaaagtacgtgttccaactaacacacgacgtctacaagccatttattttcgccgccgatacactgaccgatctgagcatgtgggtgcgacacctcattacgtgtatctcaaaatatcaatcccccggacgagccccgcctcctcgcgaggaggactgttactcagagaccgaggctgaagatccagatgacgaggctgggtctcactctgcttctccgtctcccgcacaggctggttcacctctccacggtgacaccagcccggccgccactcccacccaacgaagtccacggacaagttttggctccctgactgatagcagcgaggaagcgttggagggtatggtgcgcgggctgcgtcaggggggagtgtcccttctgggacagccacagccactcactcaggagcagtggcgctcctcctttatgagaaggaatcgggaccctcagttgaatgaacgagtgcatcgggtgagggccctccagtccacccttaaagccaaactgcaggagctgcaagtgctggaggaagtactcggtgatcccgagctgacgggtgaaaagtttcgccagtggaaagagcagaacagggagctgtactcggagggtttaggtgcatggggcgttgcacaggcagagggatccagccacattctcacttctgatagcacggagcaatccccccactcacttccatctgaccctgaagagcactctcacctgtgtcctctgactagtgagagtagcctacgaccgccggatctgtag

SEQ ID NO: 41605 - DNA, 936 bp, Artificial Sequence
  Description of Artificial Sequence: Synthetic coding sequence
atggagcccgtggagacctggacccccggcaaggtggccacctggctgcggggcctcgatgatagccttcaggactacccttttgaggactggcagctgccaggcaagaatttgctgcagctctgcccccagagtttggaggccttagccgtgcgatcgctaggccatcaggaactgatcctgggaggggtggagcagttgcaggctctgtccagtagactacagactgagaaccttcagtctctaactgaggggcttcttggggctacccacgattttcagtcaatagtacagggctgtctcggtgactgtgcaaaaacccccattgatgtgctatgcgccgccgtggaactgctgcacgaggcagacgcgctgcttttctggctatcccgataccttttctcacacctgaacgattttagcgcctgtcaggaaatccgagatctgctggaagagctctcccaggttttacacgaggatctgcagccccgcggctgggacctgccacagcaccctggactgctgccccagggcgccgctggcactgaaggcagagccagggccggagccgctggacaatccatcggaccacgaaacagccatcaccacccccatacttgcctacagacaccaccaaatcggcacctccccctgttacgcccaccatccagcctgcaaaccccaccgcaggtgccggctccggctgctccactacccctgttgccccctaacctgcttagcgacccctgcctacactgtttcgtgcccggctgttcccccgatgcaccaagtggccctggccttccagccccggaagagcctatcaccgtcagcggacctacggtgtcacaggtcactggcagtgttcaggtctgcttgggcggagaaaccgtgggttcatcccacccaccatgtcctccacaaggccctatttag

SEQ ID NO: 41606 - DNA, 4155 bp, Artificial Sequence
  Description of Artificial Sequence: Synthetic coding sequence
atgatgcacctgcggctgttctgcatcctgctggccgccgtgagcggcgctgaggggtgggggtactacgggtgcgatgaggaactggtcgggccactttacgcacgctccctgggggcctcctcgtactacagtctgctaacggcaccccgttttgccagactccacggcattagtggatggagcccgcgcattggcgatccaaacccctggttgcagattgacttaatgaaaaagcaccgaattcgcgcagtggccacccagggctctttcaatagctgggactgggtcactcgatatatgctgctgtacggtgacagggttgattcttggaccccattctatcagcgcggtcacaacagcactttcttcggtaatgtcaacgagtcggcagtcgttcgtcacgacctccactttcattttacagctagatacatccgtatagtgccattggcatggaaccctagaggcaagattgggctccgcctagggctgtacgggtgtccatataaggcagacattctttactttgatggggacgatgcgatcagttatcggttcccccgcggggtgtctaggagtctgtgggatgtcttcgcattctcattcaagacagaggagaaggacggccttctcctgcatgccgagggcgcacaaggggactatgttacccttgagcttgagggcgcccatctgcttctccacatgtctttaggcagcagcccgattcagcctagaccaggtcatacaaccgttagcgccggcggggtcttgaatgaccagcactggcactacgtgcgcgtggataggtttggaagagacgtcaacttcacccttgatgggtatgtgcaacgattcatcctaaacggtgactttgaaaggctgaatttagatactgagatgttcattggaggtctggtaggagctgcccggaagaatctagcctaccgacataacttcagggggtgtattgagaatgttatttttaaccgggtgaatattgccgacctggctgtgaggcgacactcacggatcaccttcgaggggaaggtggcctttcgctgcctcgatccggtgccccatcctattaactttggcgggcctcacaactttgtccaagttcctggctttccccgtcgcggtcggctcgcagtgtcctttaggttcaggacatgggacctcacaggtctactactttttagccgcttgggagatggactcggacacgttgagctgacattgtccgagggacaagtgaatgtgtcaatcgcacagtctggccgcaagaagctgcagtttgccgctggctatcggctgaatgacggtttttggcatgaagtgaattttgtcgcccaggagaaccatgctgtcatcagtatcgacgacgtcgagggagccgaggtccgggtgtcataccctcttctcattcggaccgggaccagttacttcttcggaggctgccctaagcccgccagcagatgggactgccacagcaaccagacggccttccatggctgtatggagttacttaaggtggacggacagctggtcaacctcacactagtggagggccgacggttggggttctatgccgaggtgttgtttgacacctgtggaattactgaccggtgttcacctaacatgtgtgaacatgatggcagatgttaccagtcctgggatgacttcatttgttactgcgaactgactgggtataaaggtgaaacctgccacaccccactgtataaggaatcatgcgaagcgtatcgcctgtctggcaaaacgtcgggaaacttcaccattgaccctgatggcagcggtccactaaagccctttgtagtgtattgtgacattcgcgagaaccgcgcttggacggtcgtacgccatgatcgactctggacaaccagggtcaccgggtcttcaatggagcggcccttccttggggctattcagtactggaatgcctcctgggaagaggtcagcgctcttgccaatgcctcacaacattgcgaacagtggatagaatttagctgctataactcgcggctcttaaatactgcaggcggttatccgtattctttttggatcggacgaaatgaggaacagcatttttattggggcggttctcagcccggcatccagcggtgtgcatgcgggctggaccggtcgtgtgttgaccctgcactatattgtaactgtgatgccgatcagcctcagtggcgcacagacaagggtctgctaaccttcgtggaccatctgccagttacgcaagttgtaatcggcgataccaatcgatcaactagcgaagcccagttttttctccggcctctaagatgttacggggataggaactcctggaatactattagctttcataccggggccgccctgcgtttcccaccaattcgtgcaaaccactctctagacgtatctttctatttccggaccagtgcaccctcaggggttttcctcgaaaacatgggtggaccgtactgccagtggcggcgaccctatgttcgagtagagctcaatacctctagggatgttgtgtttgcatttgacgtgggtaacggagatgaaaatctgaccgtccacagtgatgactttgagttcaatgacgacgagtggcatctcgtaagggcggagattaatgtcaaacaagccagactgcgggttgatcatagaccctgggtgctgaggccaatgcccctgcagacatatatctggatggagtacgaccagccactgtacgtgggctcagcagaactcaagcgccggccgttcgttgggtgcttacgggccatgagactcaatggcgtgactcttaatcttgagggcagggctaacgccagtgagggcaccagtcccaattgtaccggccactgtgctcatcccaggctaccgtgtttccacggaggccgttgtgtcgaaaggtactcatactacacatgtgactgtgacctgacagctttcgacggcccttattgtaatcacgatatcggcgggttttttgagcccggcacttggatgcggtataatctgcagtctgctctgcgcagtgcagcacgggagttctctcacatgttatcccgtccagtgcccggctacgagcccggttacatcccagggtacgacacccccggatacgtgcctggctaccatggacctggatacaggctgcctgattaccctaggcctggtagacccgtccccggatacaggggcccggtgtacaacgtaaccggcgaggaggtcagtttttcatttagcacaagcagtgcacccgccgtgctcctgtacgtgtcctcattcgtgcgcgattacatggccgtccttattaaagacgatggtacattgcagttaaggtaccagctgggaacctccccttacgtgtaccagttaactacaagaccagtcactgacggccagccacactcgattaacattacccgggtataccgcaatctgttcatacaggtagactattttcctctaactgagcagaagttctctctgcttgttgactcacagctcgatagcccgaaagccctgtacctaggccgggtcatggaaaccggggtgattgaccccgaaattcagcggtataatacccctgggtttagcggctgtctgagcggggtgcggttcaacaacgtggcaccactgaagactcattttaggactccgagacccatgaccgctgaactcgcagaggcgctgagggtgcaaggggagctctccgaatccaactgtggggccatgccccggctggtttcagaggttccacctgagctggatccttggtacctaccccctgattttccttactaccatgacgagggctgggtcgctattttgttgggattcctggttgcttttttactactgggccttgtggggatgctggtgctgttctatcttcagaatcacaggtacaaagggagttatcatactaacgagcccaaggccgcccacgagtaccacccaggtagcaagcccccactgcccactagcggccctgcccaggtccctaccccaacagctgctcctaaccaagccccggccagcgctccagccccagctcctaccccagcccccgcccccggtccccgggaccagaatctgccccagatcctcgaggaatcccgaagtgaatag

SEQ ID NO: 41607 - DNA, 1143 bp, Artificial Sequence
  Description of Artificial Sequence: Synthetic coding sequence
atggccagcgtggcctgggccgtgctgaaggtgctgctgctgctgcctacacagacatggagtcctgtgggggcaggtaatccgcctgactgtgatagtcctctggcatctgcccttcctaggagtagcttctcttccagcagtgaattatcatctagccacggcccgggcttctcgagactcaacaggagagatggcgcaggcggttggacaccactggtatctaataagtatcaatggctccaaattgatcttggggaacgaatggaggtaaccgctgtcgccacgcagggcggctatggaagttcagattgggtgacgagttatctccttatgttcagtgacggaggccgtaactggaaacagtatcgaagggaggaatccatttggggctttccaggcaacacaaatgccgacagcgtcgtgcattaccggttgcagcccccatttgaggcgcgcttcctgcgatttctgcctcttgcgtggaaccccaggggaaggatcggtatgaggattgaagtatacggctgcgcctataagtctgaagtcgtttatttcgacgggcaatctgcattactatatacgttggacaaaaagcccctgaaaccaattcgggacgttataagcttaaagtttaaggctatgcaaagtaacggcatcttgctgcatcgagaaggccagcatggcaaccacatcacgttagagcttattaaggggaaactggtctttttcctgaactctggtaacgccaagctgcccagtaccattgctcccgtgactttgacgttagggagtcttttggacgatcagcattggcatagcgtgttaatcgagctgctcgacacgcaggtgaactttaccgtggataagcatacacaccatttccaggcaaaaggagatagtagtaacctggatttgaactttgagatttccttcgggggcatactttctccaggtagatctagagcgttcactaggaagtccttccatggctgccttgaaaatctgtattacaatggagtcgacgttacagaacttgcaaagaagcataaaccccagatactcatgatggaattggcacacgggctccaggaccagaacctaaaaatctccttaaccgtgtgtcaccagaccactcaatag

SEQ ID NO: 41608 - DNA, 2241 bp, Artificial Sequence
  Description of Artificial Sequence: Synthetic coding sequence
atggccagcgtggcctgggccgtgctgaaggtgctgctgctgctgcccactcagacctggagtcccgtgggcgctggaaatcccccagactgtgattcacccctggcaagcgctcttccacgtagctcgttctcctcatcctctgagctgagctcctcccacggccccggcttcagcagattaaatcgtcgggacggcgctggaggttggactccactagtcagtaataaatatcaatggctccagatcgatctaggagaaagaatggaagtgaccgccgtcgccacccagggcggctacggctcctcagactgggtaacttcatacctcctcatgttttctgatgggggcagaaattggaagcagtatcggcgggaggagtccatctggggttttcctggtaataccaatgcagattcagtcgtgcactatcgcttgcagccacctttcgaggccaggttcctccgatttttgcccctagcttggaatcctaggggaagaattgggatgcgcattgaagtgtacggttgtgcttataagtccgaagtggtatactttgatggacaatctgcactcttgtatactctcgataaaaaacctttaaaacccatcagggacgtgatttccctcaaattcaaggctatgcagtcaaatgggatcctcctgcatagagagggacagcacggtaaccacattactttggagttgattaagggcaaattggtgttcttcctgaattccggtaacgcaaaactcccaagcacgatcgcgcccgtgacccttactctgggcagcctgctagatgaccagcactggcattccgtccttatagaactgctggatacacaggtgaacttcaccgttgacaagcatactcaccattttcaggcgaaaggtgatagctccaacctcgacctaaattttgaaatttcgttcggaggcattctgagtcccggcaggagtcgggcctttaccagaaagtcgttccacggatgcctggagaacttgtactacaatggcgtggacgtaacggagctcgccaaaaaacacaagccacagattctcatgatgggcaacgtttcttttagctgcccccagccacagaccgttcccgtcaccttccttagctctcggagttaccttgcccttcctggaaactcaggcgaggataaggtttctgtgacttttcagtttcggacttggaaccgtgccggccatcttctgttcggggagttgcagagaggctcgggaagctttgtactctttttaaaagacgggaagctcaagctgtctctatttcaggcgggtcagagtcccaggaatgtgacggccggggccgggctcaacgatggacaatggcacagtgtcagcttctcggccaagtggtcccacatgaatgttgttgttgatgatgataccgccgtccagccacttgtggctgttctgatcgactcaggtgacacatactactttggagggtgtttgggcaatagctccgggtccggctgcaaatctcccctgggtgggtttcagggatgcctacgactcatcactattggagacaaggccgtggatcccattctggttcagcagggagctctcggcagttttagagacctccagatcgactcctgcgggattaccgatcggtgcctgccctcctactgcgagcatggcggcgaatgttctcagagctgggatacattctcttgtgattgcttgggcacagggtacaccggtgagacatgccattcgagtctgtacgagcagtcatgtgaagcccacaagcacagggggaacccatctggcctatactacatagatgccgacggcagcggacctttagggccattcttagtgtattgcaatatgacagcggatagcgcatggactgtagtacgccacggcggccccgacgcagtaacccttcgaggcgctccaagcggacatccgctttcagctgtatctttcgcctacgccgccggcgctggccagctgcgcgccgcggtgaacctagcagagcgctgtgagcagcgcttggcactgaggtgtggcacggcaagacgaccagattcccgagacggaacccctcttagctggtgggttggtaggacaaacgaaactcacacttcctggggtggctccctacctgacgcccaaaagtgtacttgtggactggagggcaactgtatagactctcagtactactgtaactgcgatgcaggccagaatgaatggtag

SEQ ID NO: 41609 - DNA, 609 bp, Artificial Sequence
  Description of Artificial Sequence: Synthetic coding sequence
atgacctaccacttccaggagcactacaccctgagcgagaacagctccagcctggtttcctccctgtaccgagatgtgaccctgactagggagatgatcacactgtccttcaggacaacccgcagtcctagcctgctgctctacgtaagcagcttttacgaagagtacttgtcagtgattctggctaataacggatctttgcaaattaggtacaaactcgaccgccaccagaaccccgacgcgttcacatttgatttcaagaatatggcagacggccagttgcatcaggtcaaaattaatagggaggaagccgtggtgatggtggaggttaaccagtctgccaagaagcaggtcatcctgtcgtcagggaccgaattcaatgccgtcaaatctctgatattgggtaaggtactaggccgatccggacctgtcgatgagggcgaacctctcgtgaatgctgaccgcagggattctgcagtgatgggcggcgttatcgcggtggttattttcatactgctttgtataacagctattgcgattaggatttaccagcagcggaagcttcggaaggaaaacgagtcaaaggttagcaaaaaggaggaatgctag

SEQ ID NO: 41610 - DNA, 3531 bp, Artificial Sequence
  Description of Artificial Sequence: Synthetic coding sequence
tgaggccgggagctggagaccggccagggccggcagagcagcgtgggtgcagcccaggggacgggtgtaagagctggcgtcagagctgggaccacccagagcggcaggcgtagggcaagagtgagcggccgcctggccgaggtttctatggccagcgtggcctgggcggtgctgaaggtactgctcctgttacctacccagacctggtcgccagtgggagcgggaaacccacccgactgtgatagcccgctggctagtgctctgcctaggtcctccttttcatcaagctcggaattgtcatcatctcatggccctggtttctcgagactgaacagacgtgacggcgccggcggctggacaccacttgtgtccaataagtatcagtggttgcaaattgatctgggagagagaatggaggttaccgcagtcgctactcaaggaggctacggttcaagcgactgggtcacctcctaccttctcatgttctctgatgggggtcgtaactggaaacagtaccgccgcgaagagagtatttggggatttccgggaaataccaacgctgactccgtcgtgcactatcggctacaacctcctttcgaggcccgctttctgagattcctgcccttggcatggaaccctcggggaagaatcgggatgcggattgaggtgtatggctgtgcttataaatcagaggtcgtttactttgacggccagtccgcgctgctttatactttggataagaagcctctgaaacccattagggatgtcatctcactgaagttcaaggcaatgcagagcaacggtatccttctacacagggaaggacagcacgggaaccatattacactggagttaatcaaggggaagctcgtcttcttcctgaactctgggaatgccaaactcccttcaactatcgcgcctgtgaccctgacactcggaagtctgttagatgaccaacattggcactcagtcctcatcgagctgctcgatacccaggtcaactttactgtggataaacacacacatcatttccaggcaaagggcgattcttctaacctggatctgaactttgagatatcattcgggggaattctgtctcctggccggagccgggccttcactcgtaaatccttccacggctgtctggaaaacttgtattataacggcgttgacgtgacggagctggcgaagaagcacaaaccccagattctcatgatgggaaacgtctctttttcctgcccacagcctcagacggtgccagtgacgttcctgtcatccagatcgtatctagccttacccggaaacagtggagaggataaggtgtccgtaactttccagtttagaacctggaatcgggccggccatctgctgtttggcgaattgcagagagggagcggatccttcgttctttttctgaaggatggtaaactcaagctgtcgctgttccaggctggccagtctcctagaaatgtgaccgctggtgccggacttaatgacgggcagtggcactcagtgagtttcagtgctaaatggagtcatatgaacgtcgtggtggatgatgacaccgccgtgcaacccctggtagcggtcttaattgactcaggcgatacctactacttcggcggttgtctaggaaacagctctggttcagggtgcaagtctcccctgggcggcttccagggttgcctccgcctcattacaattggagacaaagctgtggacccaatactcgtccagcagggggctttggggagttttcgtgacctgcagatagacagttgcgggattactgacagatgcttgccatcgtattgcgagcacggcggagaatgttcccaatcttgggatacgtttagttgcgactgcctcggcactggctacaccggtgaaacctgtcacagttcactgtacgaacaatcttgtgaggctcacaaacacagagggaacccatctggcctgtattacattgacgccgacggctccggccccctgggtcctttccttgtttattgtaacatgacggctgattccgcttggaccgtggtgaggcacggaggcccggacgccgtgaccttgagaggggctcccagcggccatccgctgtcagcagtttcattcgcctacgccgctggggctggtcagctccgggccgccgtaaacttggcagagcgctgtgagcagcgattagccctccgctgtgggaccgctcgacggcctgactcaagggacgggacacccctaagttggtgggtggggcgtaccaatgagacccacacatcttggggggggtcccttcccgatgctcagaaatgcacttgcggcctcgagggcaattgcatcgatagccagtactattgcaactgcgacgctggccagaacgagtggacctcagacacaatcgtgttgagtcagaaagaacacctgccggtaactcagatcgtgatgactgacaccggccagccccattcagaggccgactacaccctgggccccctcctttgtcgcggcgacaagtctttctggaactccgcttcattcaacacagagacctcatatctacactttccagccttccatggcgaactcacggccgacgtttgcttttttttcaagactacggtttcttcaggggtgttcatggagaatctgggaatcaccgattttatccggatcgaactgcgggcccccacagaggtgactttttcattcgatgtgggaaatggcccctgcgaagttactgtgcagagtcccaccccgtttaacgacaaccagtggcaccatgtacgggctgagcgcaatgtgaaaggggcgagtcttcaggtagatcagctcccacagaaaatgcagcctgctcctgcggacggacacgtgcggctgcaattaaatagccagctgttcattggaggtactgcaactcggcaaagaggattcttaggatgtattcgctccctgcagctgaatggagtggcgttggacttggaggagcgtgcgacggtgacgccaggtgtggagcctggctgtgctggccattgcagcacatacgggcatctgtgtcggaatggcggtcggtgccgtgaaaagcggaggggcgttacttgcgattgcgctttctctgcttacgatgggcccttttgctcaaacgaaatcagcgcttacttcgcgactggcagttctatgacgtaccacttccaggaacactatacactcagcgagaactcatccagcctggtgagctcactgtatagagatgttactctgacacgggaaatgataacgttgagtttccggaccacccgcagtccctccttgctcctgtatgttagcagcttctacgaggaatatttgtctgtgattctagccaacaacggctcactccagattcgctacaagctagaccggcatcagaatcccgatgcctttacattcgactttaagaatatggcagatggccagttgcatcaagtcaaaataaatagggaggaagccgtggtgatggtggaagtcattccacagatgcagaaatcaaattag

SEQ ID NO: 41611 - DNA, 3867 bp, Artificial Sequence
  Description of Artificial Sequence: Synthetic coding sequence
atggccagcgtggcctgggccgtgctgaaggtgctgctgctgctgcccacccaaacgtggtctccggttggcgcgggcaaccctccagactgcgatagccctctagcctcagccttgcccagatcttccttttcatcctcatctgagctgtcctcgtcacacggtcctggcttttctcgcctcaataggcgcgacggagccggtggatggacccctctagtttctaataagtatcagtggctccagattgacttgggagaacggatggaagtgactgccgttgccacccagggaggatacggaagctctgactgggttaccagctacctgctcatgttctccgatggggggcggaattggaagcaatatagaagggaagaaagtatatggggctttccaggaaacacaaatgccgattcagtggtgcactaccgcttgcagccccccttcgaggcacgatttcttcggttcctcccactggcttggaatccacgcggtcgcataggcatgagaatcgaagtttacggatgtgcatataagagtgaggtggtctattttgacggtcagagcgccctcctttatacgctcgacaaaaaaccactgaaacccatcagagacgtcatttctctgaagttcaaggctatgcagagtaacggcatactgctgcaccgggaagggcagcacggcaaccacatcacactggaacttattaagggaaagctggtcttcttcctaaattctggaaatgcaaagctcccaagcaccatcgcccctgttacactgactctgggctcactgctagacgatcagcattggcactctgtcctgatcgaacttctggatacccaggtgaatttcactgtggacaagcacacacatcactttcaggccaagggtgactccagcaacctggatctgaactttgaaatttcctttgggggtatactctcccccggccgtagcagggccttcacgcggaagtcatttcacggttgcctcgagaatctgtattataatggcgtcgacgttaccgagcttgccaagaaacacaagccccagatcctcatgatgggcaacgtgtcctttagctgcccacagccacagacagtgccagtaacttttctgtcatctaggtcttaccttgcactgcctggtaactcgggtgaggacaaagtgtccgttactttccagttccgcacgtggaaccgcgcaggtcacctgctatttggtgagttgcaacgtggaagtgggtccttcgtgctgtttctcaaggatggcaagctaaagctcagcctctttcaggctggacagagtccccgaaatgttaccgcaggagctggactgaatgatggccagtggcattctgtcagttttagcgctaaatggtcacacatgaacgtggtggtggacgatgacacagctgttcagcctctggtcgctgtcctgatagactcgggcgacacctactacttcggagggtgtctcggtaatagcagcggaagtggctgtaagtcccccctaggtgggtttcaggggtgtcttcggctgattacgataggggacaaggcagtcgaccccatcctggttcagcagggggccctaggcagcttccgagacttgcagatcgactcatgcggcatcaccgatcgctgcctgcccagctactgtgagcatggcggggagtgctcacagagctgggacacattcagctgtgactgcctgggtaccggctatacgggcgagacatgccactcgtctctgtacgagcaatcctgcgaagcccataaacatagaggtaacccgagtggtctctattacatcgacgctgatgggagcgggcctctagggccctttctggtatattgcaacatgaccgccgacagcgcatggactgtcgtgagacatggcgggcccgacgccgttacactacggggcgccccaagtgggcaccccctcagcgcggtctcatttgcctacgcagcaggcgcagggcaactgagagcagctgtaaatctagccgagcgctgcgaacaaaggctggcactccgatgtggtaccgcacggcggcccgatagcagagatggtacgcccctgagctggtgggtagggaggacaaatgaaacccacacgagctgggggggtagtctgccagatgctcagaagtgtacctgtgggcttgagggcaattgtatagatagccagtactattgtaattgcgatgccggacagaatgaatggacttccgatactatagtcctgtcccaaaaggaacacttaccagtgacccagatcgtgatgacagatacgggccagccccactccgaggcagattacacactcggacccctcctgtgtcgtggcgataagtcgttctggaacagtgcatcatttaataccgagacaagctacctgcatttccccgcttttcacggagagctgactgccgacgtgtgcttttttttcaagacaacagtcagctctggcgttttcatggagaatttgggcattaccgatttcatccgcatcgaattgcgtgctcccactgaggttacattctcttttgatgtgggaaatggaccttgtgaggtgacagtgcagagcccgaccccttttaatgataaccagtggcatcatgtcagagcagaacgtaacgtcaagggggcaagtctccaggtggatcagctccctcaaaaaatgcagcccgcgcctgccgatggccacgtacgcctgcagctcaacagccagctctttatcggcggcacagctactaggcaaagagggttcctgggatgtatcaggtccctccaacttaacggtgtcgcccttgatctggaggagcgagccacagttacaccaggagtggaacctggctgcgccggtcattgctctacctacgggcatctatgcagaaacggtggccgctgtagagagaagcgccgtggggtcacatgcgattgtgccttctcagcttacgacgggcctttctgtagcaatgagatctccgcttacttcgctacagggagcagcatgacgtatcacttccaggaacactatactctcagtgaaaacagcagctcactggtctctagtctgtacagggacgttacccttacccgggagatgatcacactttccttccgcaccactcgatcaccttccctccttttgtacgtctccagcttttacgaggagtatctgagtgtgattctcgctaacaatgggtcattgcagattaggtacaagctcgaccggcaccagaatccagacgcatttactttcgacttcaagaatatggcagatgggcaactgcaccaagtgaaaatcaaccgggaggaggcggttgttatggtggaggtgaatcagagcgctaaaaaacaggtgatcctatcctcaggcaccgagtttaacgcagttaagtctcttatcctagggaaggtgttggaggcagccggggctgatcctgatacacgcagagccgccacatccggatttacagggtgcttgagcgccgtgcgatttggtcgagccgctccccttaaggcggcactccgccccagtggacctagccgagtgactgtgagaggccatgtcgccccaatggcaaggtgcgctgcgggcgccgcaagcggttcaccggcccgggaactggctccccggcttgccggtggcgccgggcgttccggccccgtggatgagggggagcctcttgtcaacgcggaccggagggactctgccgtcatgggcggcgtgatcgccgttgtaatcttcatcctgctctgcatcactgctattgcaattcgcatttatcagcagcgaaaactcagaaaggagaatgagtctaaggtgtctaagaaggaagaatgttag

SEQ ID NO: 41612 - DNA, 1803 bp, Artificial Sequence
  Description of Artificial Sequence: Synthetic coding sequence
atggccagcgtggcctgggccgtgctgaaggtgctgctgctgctgccaactcagacctggtcacctgtgggagcaggcaacccacctgactgcgatagcccgctggcctccgccttaccccggagttcgttctccagttcttcagaactgtccagctcacacgggcccggtttttcgcgcttgaatagacgtgatggggccggcggatggactcctcttgtgtccaataagtatcaatggctccagattgacctgggtgaacgaatggaagtgacggccgtggccactcagggcggttatggctcttcagattgggtaactagctacttgctcatgttctctgatggcggacggaactggaaacaatataggagggaagaaagtatctggggcttccccggaaataccaatgccgattccgtcgtgcactaccggctgcaacctccatttgaggcccggttccttaggttcctaccccttgcttggaacccgcgggggcgcattggtatgcgcatcgaagtctatggttgtgcctataaaagcgaggttgtgtactttgacggacaaagcgcgttgctgtacacgctagacaagaagcccttaaagccaatccgcgacgtaatttccctgaagtttaaggccatgcagtcaaatggaatacttctgcaccgagaagggcaacatggcaaccacattacactggagttaataaaagggaaactagtctttttcctcaacagtggcaacgccaagttgccaagcaccattgcccctgtgaccctaaccctcgggtccctgctggatgaccagcactggcacagtgtccttatagagctattggatacacaggtgaacttcactgtggataaacatacccaccatttccaagcaaagggcgattcaagtaaccttgatctcaactttgagatttcgttcggcggcatcctgtctccgggcagatcccgcgctttcacaagaaaatcatttcatgggtgcttagagaatctgtactacaacggggttgatgtaacagagctggccaagaaacacaaacctcagatcctgatgatgggaaatgtatccttttcctgtcctcagcctcaaactgtccccgtgacatttttatcatcccgcagttacctcgccctgccagggaatagtggggaagacaaggtcagtgtgacctttcagtttcgcacttggaatcgggctggacatctgttgttcggcgaattgcagcgaggttccgggtcattcgtgctgtttcttaaggacgggaagcttaagttgagccttttccaagcaggccagtccccacgcaatgtgacagcaggagctggcctgaatgacggccagtggcacagtgttagtttctccgctaagtggtcgcatatgaacgtggtggtcgacgacgataccgcagtacagcccctggtggcggttctcattgactccggcgacacctattattttggcgcattatacgaacagtcctgtgaagcccacaaacatagaggaaaccccagcggtttgtactacatcgatgccgatggaagtggcccattggggccatttttggtgtactgtaatatgaccgattccgcctggactgtggtgaggcacgggggcccagacgctgtaacattgagaggagcaccttccgggcatccgttgtctgccgtaagctttgcgtacgcagcaggggcagggcagctccgggccgccgttaatctagctgagcggtgtgagcagcgtctggcccttaggtgtggaaccgcccgtaggccagactccaggggctag

SEQ ID NO: 41613 - DNA, 3921 bp, Artificial Sequence
  Description of Artificial Sequence: Synthetic coding sequence
atggacagcctgccccggctgaccagcgtgctgaccctgctgttctccggtctctggcatctcgggctcactgcaaccaactacaactgcgatgaccccctcgctagccttctgagtcctatggcgtttagcagtagctctgatctcacaggcacccatagtccagctcagctgaattggagggtgggtactggtgggtggtcccctgccgattctaacgcccaacagtggttgcagatggacctgggaaacagagtggaaataactgccgttgccacacaaggccggtatggctcatctgactgggtgacgagctattcccttatgttttctgacacaggcaggaattggaagcagtacaaacaggaagactcaatatggacctttgcgggcaatatgaacgccgatagtgttgtgcatcacaagctccttcacagcgtgagagctcgctttgtaagattcgtccctttagaatggaatcccagcggcaagatcgggatgcgcgtggaagtgtatggatgctcctacaaatctgacgtcgcagactttgatggccgatcgtctctcctgtatcggttcaaccagaagttgatgtccaccctgaaagacgtgatatcactgaagttcaagtcaatgcagggggatggtgttctcttccacggggagggacagcggggagaccatatcaccctggaactgcagaagggcagacttgcactccacctgaatctgggagattctaaggctaggctcagttcgagcctcccgagcgccaccctggggtccctgttggatgaccaacattggcacagcgtactgattgagcgcgtcggtaagcaggtcaactttaccgtagacaagcacacccagcattttaggacaaagggagaaaccgacgcgctggatatcgactacgaactgagctttggcggaattcccgtgcctgggaaaccaggcacttttcttaagaagaattttcacgggtgtatcgaaaacctttattacaacggcgtgaatatcatcgacctggctaagagaagaaagcatcaaatatacacaggcaatgtgacattttcctgtagcgagcctcaaattgtgcctatcacttttgtcaactcctcaggatcatatctgctattaccagggacaccccagattgatggactgagcgtctcatttcagttccgtacctggaataaagacgggctgctcctgtcgacagagttgtctgaagggagcggcactttactcctgagtctggaaggtggcatcctgcgcctcgttattcagaaaatgacagaacgggtggcggaaatcctgacaggatctaatctgaacgacgggctgtggcacagtgtctccatcaacgcacgccgcaatcggataaccctcactctggacgacgaagcagctccccctgctcctgatagcacttgggtgcaaatctattcaggtaacagttactacttcggcggctgtccagacaacctcaccgactctcagtgtcttaatcctataaaggcgttccaggggtgtatgaggctgatttttattgacaaccagcccaaggacctgatcagtgtacagcaagggagtttgggtaatttctcagacctgcatatcgacctgtgcagcatcaaggataggtgcctgcccaattactgcgagcacgggggctcctgttcccagtcctggaccactttttattgcaattgctctgatacaagctataccggagctacctgccataattcgatatacgaacagagttgtgaggtctatcgtcaccagggcaacacagccgggttcttttacattgacagcgatggatcggggcccttaggcccgttgcaggtttattgtaacataaccgaagacaaaatctggaccagcgtgcaacataacaatacagagctaacacgcgtcaggggcgccaatcccgagaaaccatatgcaatggcgttggattatggcgggagcatggaacaactggaagctgtcattgatggcagtgaacattgcgaacaggaggtagcctaccactgccgccgctctagattactgaatacccccgatggtacaccattcacctggtggattggcagaagtaatgaaagacatccatactggggcgggtccccaccgggggtacaacagtgcgagtgcggactggacgaatcttgtttggatattcagcatttttgcaattgtgatgcagacaaggatgagtggactaatgataccgggttcctgtccttcaaggaccatttgcccgtgacccagatcgtaattaccgacacagaccgcagcaactccgaagccgcatggcggatcggccctctaagatgttacggagaccggaggttttggaatgccgtgtctttctataccgaggcctcctacctgcacttccctaccttccatgccgaattctccgccgatatctcgtttttttttaagacgaccgccctgtctggggtgttcctggagaacctggggattaaagatttcattagactagaaatttctagcccttccgagattaccttcgccatcgacgtaggaaatgggcccgtagaactcgtggtacagtccccgtccctactgaacgataatcagtggcattacgttcgcgccgaaaggaatctgaaggagacttctttgcaggtggataatctgccgcggtccactcgggagacttccgaagaagggcattttagactacagttgaactcccagttattcgtgggggggacctccagccgccaaaaaggatttctcggctgcatccgatcactccacctaaacggacagaaaatggacctggaggagcgggcaaaggtgaccagtggcgtgcggcccggatgccccggccattgtagtagttacggatcgatctgccacaacggtggcaaatgcgttgaaaagcacaacgggtatctgtgtgactgcacgaactctccttatgagggaccattttgtaaaaaggaggtgagcgctgtcttcgaagccggcacatcagtcacttacatgtttcaggagccttatcctgttaccaaaaacatttccctttcgtcgtcggctatctataccgattctgcccccagcaaggagaatatagccctcagtttcgtgaccactcaggctccctcattgctgctgtttatcaattcgtcaagtcaggatttcgtcgtggttcttctctgcaagaatggctccctacaggtgagatatcatctgaacaaggaggagacacatgtgttcacgatcgacgccgataatttcgctaatcgtcggatgcaccatctgaagattaatagggagggtagagagctgacaattcagatggatcagcagctgcggctgtcatacaactttagtcccgaggtcgaattccgagtgattcgctcattaaccttaggcaaagttaccgaaaacctaggccttgattccgaggtggccaaagctaacgccatgggctttgccgggtgcatgtccagcgtacagtataaccacattgctccccttaaagccgccttgagacacgcaactgtcgcccccgtgaccgttcacggcacccttactgagagctcgtgtgggtttatggtcgatagtgacgttaacgccgtgacaacagttcactcctcttctgaccccttcggcaaaactgatgaaagagagcctctcaccaatgctgtacgtagtgactctgctgtgatagggggagtgatcgctgtggtgatttttattatcttctgtattatcggaattatgaccagatttctctaccagcataaacagtcacaccggacctctcaaatgaaggagaaggagtatcctgaaaatttggacagcagcttcaggaacgagatcgacctccagaacacagtgagtgaatgtaagcgagagtacttcatatag

SEQ ID NO: 41614 - DNA, 3129 bp, Artificial Sequence
  Description of Artificial Sequence: Synthetic coding sequence
atgaagcagagccccgccctggcccccgaggagcggtgccggcgggccgggtccccaaagcccgtcctgcgggctgacgataacaacatgggtaacggttgttcacaaaagctggccacagctaacctgctcagatttctgctcttggtattaatcccatgtatctgtgccttggtccttctactggtgatcctgctgagctatgtaggcacccttcagaaagtgtacttcaagagcaacggctccgaacctctcgtgacagatggcgaaatccagggtagcgacgtgatcctgactaacacaatctataaccagtctactgtggtgagcacagcgcaccccgaccagcatgtgccagcgtggacgacagatgcttccctgccgggggatcagtcgcatcggaacacatcagcttgcatgaacatcactcacagccagtgtcagatgctgccctaccacgccactctgacacctttattgtctgtcgtgcggaatatggagatggaaaagttcctaaaatttttcacctacttgcatcgcctgtcctgctatcagcacattatgctgtttggctgtactctcgcattccccgagtgtattatcgacggcgacgattctcacggcctgctgccctgccggtccttttgcgaagcagctaaagaaggttgcgaaagcgtactcggcatggtcaactatagttggccagactttctacggtgttcacagttccggaaccagaccgagagctcaaacgtgtcaagaatctgcttctccccccaacaagagaatgggaaacagctgctgtgcggacggggggagaattttctgtgtgctagcgggatttgcattcctggaaagctgcagtgcaacggatataatgattgcgacgattggtctgacgaagcacattgtaattgctccgaaaacttattccactgtcacacaggaaaatgcctcaactattcgctggtgtgcgatgggtacgacgactgtggggatctgtccgacgagcagaactgcgactgcaacccgaccacagagcatagatgtggagatggccgctgtatcgcaatggaatgggtatgcgatggtgaccatgactgcgtagacaagagcgacgaggtgaattgttcatgccacagccaagggctggtagagtgccgcaatggacagtgcattcccagcaccttccagtgcgacggagacgaagactgcaaggatgggagcgatgaggagaattgtagtgtgattcagacttcttgccaagaaggggaccagcggtgcctctataacccatgtttagattcgtgcggcgggtcatctctgtgtgacccaaataactctctgaacaactgcagccagtgcgagccgattaccctggaactgtgcatgaatttaccatacaatagcaccagctatccaaattattttggtcatcgcacacagaaagaggccagcatttcctgggagagctccctgttcccagccctggttcagaccaattgctacaaatacctgatgttcttctcttgcacaatcctggtacccaaatgcgacgtgaatacaggagagcacataccgccttgcagggctctgtgcgaacattccaaagaacgttgtgagtcagtgttaggaatcgtgggactgcagtggcccgaggatacagattgttcccagttccccgaagaaaatagtgataatcagacttgtctcatgcctgacgagtacgtagaggaatgtagcccttcacattttaagtgccggtcgggtcagtgcgtacttgcaagtagaaggtgcgacggccaggcagattgcgacgacgactccgatgaggagaactgtggatgcaaggagcgcgatctctgggagtgccccagtaataaacagtgtttgaaacatacagtgatctgcgatgggttccccgattgtcctgattatatggatgaaaaaaattgcagtttctgccaggatgacgagcttgaatgcgctaatcacgcatgtgtttcacgagatctgtggtgtgacggagaggcggattgcagcgattcatcggatgagtgggattgcgtgacattgtctatcaatgttaacagctcttcattccttatggttcacagggccgccaccgagcaccacgtgtgtgccgatggctggcaggaaatcctgtctcagcttgcttgcaagcaaatgggcttgggggagccgtccgtgacgaagctgattcaggaacaggagaaagagccgaggtggcttaccttgcactctaactgggagagccttaacggaaccacattacacgagctccttgtgaatggacaaagctgcgagtccaggtccaagataagcttgctgtgcacgaaacaggattgtgggcggcggcctgccgctagaatgaataagagaatcctcgggggtaggacctctcgtcctggacgctggccgtggcagtgcagcctgcagagcgagcccagtggacatatctgtggctgcgttctgatcgctaaaaaatgggtgctgactgtggcacattgttttgaaggtagggaaaatgccgccgtctggaaggtggttcttgggatcaacaacctggaccatcccagcgtgtttatgcagactcgctttgtaaagacgatcatcctgcatccaaggtattctcgtgccgtggtcgactacgacattagcatcgtggagctctcagaagacatcagtgagactggatacgtgaggcccgtctgtctaccaaacccagagcagtggctcgagccagacacttattgttacatcactggctggggccacatgggtaacaagatgcctttcaaactacaggagggtgaagtacgtattattagtttggaacactgtcagagttatttcgacatgaagaccatcaccacccgaatgatctgcgccgggtacgaatcaggtacagtggacagctgtatgggagacagcggagggcccctggtgtgtgaaaagccgggggggcggtggaccctttttggcctgacctcatggggttctgtgtgctttagtaaagttttagggccaggcgtttattctaacgtatcttattttgtggaatggatcaaacggcagatctacatccagacttttctgctcaactag

SEQ ID NO: 41615 - DNA, 2928 bp, Artificial Sequence
  Description of Artificial Sequence: Synthetic coding sequence
atgaagcagagccccgccctggcccccgaggagcggtgccggcgggccggctctcccaagcccgtcctgagagctgatgacaacaatatgggtaatggatgctctcaaaagttggcaacggctaatctcctaagattcttgttgctggtgctgattccttgcatctgcgcgctggtgctgttattggtaatcctgctgtcatatgtgggggcttgtatgaacatcacacactcccagtgccagatgctgccctaccacgccactctaacacccttgctgagtgtagtgcggaatatggagatggaaaaattccttaagttcttcacatatctgcatcggcttagttgctatcagcacatcatgctgtttggttgcaccctggcattcccggaatgtattattgacggggatgacagccacggtttactgccctgtcggagcttctgtgaggcggcgaaggaggggtgtgagagtgtgcttggtatggtaaattattcgtggccggatttcctgcgctgctctcagttccggaaccaaactgagtcgagtaacgtgtcacggatctgttttagcccccaacaagaaaatgggaaacaactactttgcggtcggggagagaactttctatgtgcatcgggaatttgcatccccggtaagttgcaatgtaatggttataatgattgtgatgattggagcgatgaggcccactgcaattgcagcgaaaatctctttcattgccacaccggaaagtgtctgaactattctctggtttgtgacggttatgatgactgcggcgacctaagcgacgaacagaactgcgactgcaaccccactacagagcacaggtgtggcgatgggcgttgtatcgcaatggagtgggtgtgcgatggggaccacgattgcgtcgacaagtccgatgaggtcaattgttcctgccactcccagggacttgtggaatgcagaaacgggcagtgtatcccaagtaccttccaatgcgacggagacgaggactgcaaggacggaagtgacgaggaaaattgttcagtgatccagacaagttgtcaggaaggggatcaaaggtgcttatacaatccttgtctagatagctgtggcggctcgagcctgtgcgatcccaacaacagcctcaacaattgctcgcagtgtgagcctatcaccttggagctgtgtatgaatctgccgtacaactcgacctcctatcccaactattttggccatcggacccagaaggaggcaagtatctcttgggagagcagccttttccccgctttggtgcagacaaactgctacaaatatctcatgtttttcagttgtaccattttagttccaaagtgtgatgtaaataccggcgagcacatccctccatgccgagcactctgcgagcactccaaggagcgctgcgagtccgtcttaggtatcgtcgggcttcaatggcctgaagacaccgactgttcccagtttccagaagagaactctgacaatcagacatgcctcatgccagacgaatacgttgaggagtgtagcccctcccatttcaagtgtcgcagcggccagtgtgtgttggcaagtcggcggtgcgatggtcaagcagactgcgatgacgacagtgacgaagagaactgtgggtgtaaagagcgggatctctgggaatgtccgagcaataaacagtgtctgaaacatactgtaatatgcgatggcttcccggattgtcctgattatatggacgaaaaaaactgtagcttctgtcaggacgatgaacttgaatgtgcaaaccatgcctgtgtgtcacgggatctgtggtgcgacggggaagccgattgctcagattcatctgacgagtgggactgcgtgacacttagcatcaacgtaaactcgtcaagcttcctcatggttcatcgcgctgctaccgagcaccatgtgtgcgctgatgggtggcaagaaatcctgtcgcagctcgcttgtaagcaaatggggttaggcgagccatccgtcactaagctaatccaggagcaagaaaaggagccaagatggcttactcttcatagcaactgggagagcttaaatggtacaaccctgcacgagctcctggtaaatggccaaagttgtgaatcgagatcaaagatcagcctgctgtgtacaaagcaggactgtggcagaagacccgccgcaagaatgaataagcgcatcctgggagggagaacgagccggccagggaggtggccctggcaatgcagtttgcagtcagaaccttccggccacatttgtgggtgcgtccttatagcaaagaagtgggtgcttacagtagctcattgttttgaggggagagagaacgcggcagtatggaaggtagtgctgggcattaacaacctggaccatccaagtgttttcatgcagactcgattcgtgaaaacaatcattctgcaccctcggtattcacgcgcggtggtggattacgatatttcaattgtggagctctccgaagatatttcagaaacaggttacgtgcggccagtgtgcctgcccaatcccgaacagtggcttgagcccgacacatattgctacattactggctggggccatatggggaataagatgcctttcaagctgcaggagggcgaagtccgcatcatcagcttagaacactgtcagtcatactttgatatgaagacaatcacaactcgaatgatatgcgcaggctacgaatctgggacggtcgacagctgcatgggggactcaggtgggcccctggtgtgcgagaagcccggcggaagatggacccttttcggcttgacctcttgggggtccgtgtgttttagtaaggtgctcgggccaggtgtgtattctaacgtctcttacttcgtggagtggataaagagacagatctacatacagacattcttgctgaattag

SEQ ID NO: 41616 - DNA, 3018 bp, Artificial Sequence
  Description of Artificial Sequence: Synthetic coding sequence
atgaagcagagccccgccctggcccccgaggagcggtgccggcgggccgggtccccaaaacctgtcctgagggcagacgacaataatatggggaatgggtgttcccaaaagctcgccaccgctaatcttctgaggtttctcttgctcgtactgattccatgtatctgcgcgctggtgctgttgctcgttatcttacttagctatgttggcacgctgcagaaggtgtactttaaaagtaatggctccgagccactagtgacagatggggagatccagggctccgacgtcattctgaccaacacaatatacaaccagtctactgtggtgagcacagcccatccagatcaacacgtaccagcttggacgactgacgcgtcactgcctggagaccagagccatagaaacacatccgcttgcatgaatatcacccattcacagtgtcagatgctcccttaccatgccacgcttacccctctgctaagtgtcgtgagaaacatggaaatggaaaagttcctcaaatttttcacctatttgcacaggctttcctgttaccagcatataatgttattcggctgcactctcgccttccccgaatgtatcatcgacggggacgattctcacggcctgctgccctgtagatccttttgcgaggccgcaaaggaggggtgtgaatcggtcctcggcatggtgaactacagttggccggatttcctgcgctgttcacagttccggaaccagaccgaatcatccaatgtttcccggatctgctttagcccacaacaagagaatggcaagcagctcctatgcgggaggggcgaaaacttcctctgtgcttccggcatttgcattccaggtaaactgcagtgcaatgggtacaacgattgtgatgattggtccgacgaggcacactgcaactgcagtgagaacctgtttcactgtcatactggtaagtgcctgaactattcactggtttgcgacggatatgacgactgcggcgatctgagcgacgaacagaactgcgcttgccactctcagggccttgtggagtgcagaaacggccagtgcatccccagcactttccagtgtgacggagatgaagactgcaaggatggctccgacgaagagaattgctcagtcattcagacaagctgtcaagagggagaccagcggtgcctttataacccgtgcctcgattcctgcggtggttcaagtctgtgtgatccaaacaatagcctcaacaattgcagccagtgtgaaccaataaccctggaactctgcatgaacctcccctacaacagtacctcttaccccaactacttcggtcaccgaacccagaaggaggctagcatcagttgggagagttcactcttccctgcactggtgcaaaccaactgctacaaataccttatgttcttcagctgcacaatacttgtgcctaagtgcgacgtaaatacgggagaacacattcctccctgtcgggccctttgtgaacatagcaaggaacggtgcgaatctgtcctgggcattgtagggctgcagtggcccgaggacacagactgctcccaattccccgaagaaaactctgataatcagacttgcctaatgcccgatgaatatgttgaagagtgttccccaagccattttaagtgtaggagcgggcagtgtgttcttgcctcccgccggtgtgacggtcaggccgattgcgacgatgatagtgatgaagagaattgcgggtgtaaagaacgcgatctgtgggaatgtccgtcaaacaagcagtgtcttaagcacacagtgatctgcgatggctttcctgactgtcctgactatatggatgagaaaaattgctcgttttgccaggatgatgagctcgagtgtgccaatcatgcatgtgtatccagggatctgtggtgcgacggggaagctgactgttcagattcctcagacgagtgggactgcgttaccctaagtatcaatgtgaacagcagttcattcctgatggtgcatcgagcagcaacagaacatcacgtgtgtgccgatggctggcaggagatcctctctcaactcgcctgcaagcagatgggactcggcgagccgagcgttaccaagttaattcaggagcaagagaaggagccccgttggctgactctacactctaactgggaaagccttaatggaacaacgctgcacgaactgctggtgaatgggcagtcctgcgaaagcagaagtaaaataagccttctttgcacaaaacaggattgcgggcgaagaccggccgctagaatgaataaaagaatactcgggggacggacctcaaggccaggtcgctggccgtggcaatgttctttacaatcagaaccaagtggccatatctgtgggtgtgtccttatcgcaaagaaatgggtactcacggtggcacactgtttcgaggggcgcgaaaacgcggccgtgtggaaagtggtgctcggaattaataacctcgatcatcccagtgtgttcatgcagactagatttgtcaagactataattctgcatcccaggtactccagagcggtggtggactacgatatcagcatcgtcgaactgagcgaggacatctccgagacaggctacgtgaggcctgtctgtctgcccaaccctgagcagtggctagaacccgacacctactgttacatcactggctggggacatatgggcaacaagatgcccttcaaactgcaggagggagaagttcggatcatttcccttgaacattgtcaatcttacttcgatatgaaaactattactacaagaatgatctgcgcagggtatgagtcaggcactgtcgacagctgtatgggggacagcggtggacctttggtgtgcgaaaaacccggaggacgatggacactctttggactgaccagttggggttccgtctgcttcagcaaagtgctgggtccaggcgtatatagcaatgtgagctacttcgtcgagtggatcaaaagacaaatatatatccagaccttcttattgaattag

SEQ ID NO: 41617 - DNA, 555 bp, Artificial Sequence
  Description of Artificial Sequence: Synthetic coding sequence
atgaagcccgacgagacccccatgttcgaccccagcctgctgaaggaagtcgactggtctcaaaataccgctacgttctcacccgcgatttcaccaacacaccccggggaaggccttgttctccgtcccctgtgtacagccgatctcaaccgcggattcttcaaggtgttggggcagctcactgagaccggcgtcgtctcacctgaacagtttatgaagagcttcgagcacatgaagaaatcaggggattattacgtgacagtcgttgaggacgtgaccttggggcagatcgtggcaaccgcaacacttattatagagcacaaattcattcatagctgtgccaaacgcggacgagtggaagatgtggtggtgagcgacgaatgtaggggtaagcagctgggaaagctcctgctgagcacactgactctcctttcaaaaaaattgaactgttacaagattactctggagtgcctgccccaaaatgtcgggttttataagaagttcggatatactgtgagcgaagagaactacatgtgccggcgcttcttaaaatag

SEQ ID NO: 41618 - DNA, 291 bp, Artificial Sequence
  Description of Artificial Sequence: Synthetic coding sequence
atggccttcaccttcgccgccttctgctacatgctggccctgctgttgacggccgcactgatctttttcgcgatctggcacattattgcatttgatgagctgaagacagactacaaaaatccaatagaccagtgcaacaccctcaatcccctggtcctacctgagtatcttattcatgcctttttttgcgtcatgttcctgtgcgcggccgagtggctgacactgggtctgaacatgccactgctagcgtaccacatctggtctatgatctacgtgctcgtcagctcatag

SEQ ID NO: 41619 - DNA, 483 bp, Artificial Sequence
  Description of Artificial Sequence: Synthetic coding sequence
atggccttcaccttcgccgccttctgctacatgctgaccctggtgttgtgcgcttccctgatctttttcgtgatttggcacattatcgcctttgacgaactcaggaccgatttcaagaacccaatcgaccagggaaaccctgcacgcgctcgcgaaagactcaagaatatcgagagaatctgttgcctgctgcgaaagctcgtggtacccgaatactccatccatggactattctgcttgatgtttctgtgcgctgctgaatgggtcactctgggtttgaacatccccctgctattttaccatctatggcgatactttcatcgtccggccgacgggagcgaggtgatgtacgacgcagtctccattatgaatgcagacatactaaactactgccagaaggagtcatggtgtaagctcgctttctatctcctgtccttcttctactatttgtactccatggtctacaccttagtgtcgttctag

SEQ ID NO: 41620 - DNA, 483 bp, Artificial Sequence
  Description of Artificial Sequence: Synthetic coding sequence
atggccttcaccttcgccgccttctgctacatgctgagcctggtgctgtgcgcggcactgattttctttgctatttggcacattattgccttcgatgaactgaggaccgactttaagtcacctatcgatcaatgcaacccggtccatgcgcgggaacgcttgaggaacattgagcggatttgcttcctcctacggaagctggttttgcctgagtatagcattcactcactattttgcattatgttcctctgtgcgcaggagtggctcacacttggtctcaatgtgccgttactgttttatcatttctggcgatatttccactgtcctgccgactcttcggaactcgcgtatgacccacccgttgtgatgaacgccgacaccctcagctactgtcagaaagaagcttggtgcaaactggctttttatctgctgagtttcttctattacctttattgcatgatatacacactggtatccagctag

SEQ ID NO: 41621 - DNA, 414 bp, Artificial Sequence
  Description of Artificial Sequence: Synthetic coding sequence
atggaggccgtggtgttcgtgttcagcctgctggactgctgcgccttaatctttctcagtgtgtacttcattatcaccttatccgatttggaatgcgattacattaatgctaggtcctgttgctccaagctcaataagtgggtgattcctgagctcattggacacacaatcgtgaccgttcttctgctgatgtctctccactggttcatcttcctgcttaacttgcctgtggccacctggaacatctaccggtacatcatggtgccatcagggaacatgggggttttcgaccccaccgaaatccacaaccgcggtcagcttaaatcacatatgaaagaggctatgatcaagctcggctttcacctgctctgcttttttatgtatctgtatagtggaagtaactgcccctgttag

SEQ ID NO: 41622 - DNA, 279 bp, Artificial Sequence
  Description of Artificial Sequence: Synthetic coding sequence
atggaggccgtggtgttcgtgttcagcctgctggactgctgcgccctaatatttctgtcagtgtattttatcatcaccttatccgacctggaatgcgattatataaacgcaaggtcctgttgttctaagttgaacaagtgggtaattcccgagctcatcggccacacaatagttacagtgctgctactaatgtcccttcactggtttatttttctgctaaatctgcctgtggcgacctggaatatttatcggatgatcctggcactgatcaatgattag

SEQ ID NO: 41623 - DNA, 273 bp, Artificial Sequence
  Description of Artificial Sequence: Synthetic coding sequence
atggaggccgtggtgttcgtgttcagcctgctggactgctgcgccctgatctttctttctgtgtacttcatcatcactctgagcgaccttgaatgcgactatataaacgcacggtcttgctgttctaaactcaacaaatgggttattccggagctcataggccacaccattgtgacagtccttctgcttatgtctcttcattggttcatttttctgctgaacctccctgtggcaacctggaatatttaccggggaagcaactgcccttgttag

SEQ ID NO: 41624 - DNA, 420 bp, Artificial Sequence
  Description of Artificial Sequence: Synthetic coding sequence
atggaggccgtggtgttcgtgttcagcctgctggactgctgcgcccttatctttctttccgtctacttcatcatcactctctctgatctggaatgtgattatattaacgccaggagctgctgctccaaattaaacaagtgggttataccagaattgattggccatacaatcgtgaccgtgctgttgctgatgtccctgcactggttcatattcctcctgaaccttcccgtggccacgtggaatatctatcggtatatcatggttccctctggcaatatgggagtgtttgacccgaccgaaattcataaccgcggtcagctgaaatcccatatgaaagaggccatgattaagctggggtttcatctcttgtgtttcttcatgtatttatatagcatgatcctggcacttatcaatgattag

SEQ ID NO: 41625 - DNA, 246 bp, Artificial Sequence
  Description of Artificial Sequence: Synthetic coding sequence
atggacggcggccagcccatccccagcagcctggtgcccctgggcaacgaaagcgcagacagcagcatgagtttggaacagaagatgacattcgttttcgttatcttgttgtttatatttctgggaatcttgatcgtccgttgttttcgcatcctgcttgatccatacagaagcatgcccacttcaacctgggctgatgggttagaagggctggaaaaaggccagttcgatcacgcacttgcatag

SEQ ID NO: 41626 - DNA, 246 bp, Artificial Sequence
  Description of Artificial Sequence: Synthetic coding sequence
atggacggcggccagcccatccccagcagcctggtgcccctgggcaacgaatccgccgattcttcgatgagtttagaacagaaaatgactttcgtttttgtgatcctcctgtttatctttttgggaatccttatagtgaggtgttttaggatcctgctggatccataccgatcaatgcccaccagcacctgggcagacggcctggagggtctggagaaggggcagtttgaccatgcacttgcatag

SEQ ID NO: 41627 - DNA, 114 bp, Artificial Sequence
  Description of Artificial Sequence: Synthetic coding sequence
gtgtacaccgactacatctacttcaacagcttcctggagagcttccagggcttcttcgtgtccgtcttctactgttttcttaactccgaggtgcggtcagccatccggaagtag

SEQ ID NO: 41628 - DNA, 723 bp, Artificial Sequence
  Description of Artificial Sequence: Synthetic coding sequence
atgagccccgaggtgcaccagagcaacgtgggctggtgccggctggtaaccgccgcttataattacttccacgttaccaattttttttggatgttcggagaaggctgttatctacacacagccatagtactaacatacagcaccgatcggctgaggaaatggatgttcatttgcataggctggggcgtgcccttcccaataattgttgcctgggcgatcggaaaactatactacgacaatgaaaaatgctggttcggaaaaagaccgggcgtctataccgattacatttaccagggacctatgatccttgtcttgctgatcaatttcatttttctcttcaacatagtccgcatcctgatgacaaaattgcgtgccagtacaacgtcagagaccatccagtaccgcaaagcagtcaaagccacccttgtccttcttccactgctcggtatcacatacatgcttttttttgtgaaccccggcgaggatgaagtgagccgcgtagtattcatctactttaattcatttcttgaaagctttcagggcttcttcgtgagcgtgttttactgttttttaaattcggaggtcagatctgcaatccgtaaacgctggcaccgatggcaggataagcactctatacgggcccgcgtcgccagagctatgagtattcctacctctcctactcgtgtttcctttcatagcataaaacagagcaccgcggtgtag

SEQ ID NO: 41629 - DNA, 1206 bp, Artificial Sequence
  Description of Artificial Sequence: Synthetic coding sequence
atgggcggccacccccagctgcggctggtgaaggccctgctgctgctcggtctcaatccagtatccgcaagcttgcaggaccagcattgcgaatcccttagccttgccagtaatattagtgggcttcaatgtaacgcctctgtcgatttaattggaacctgttggccgcgtagccccgccggtcagctggtcgttcggccctgtccagccttcttttacggggtgagatataatacaacaaataatggctatagagaatgtttagctaacgggtcctgggctgctagggtgaactattcggagtgtcaggagattctcaacgaagagaaaaaatctaaagttcactaccatgtggctgttattatcaattacctcgggcattgtatttcattagtagctctgctggtggcatttgtgctgtttctgcgcctgagaagtatacgctgcctgcggaacatcattcactggaacttgattagtgcattcattttgagaaatgcaacctggttcgtagtccagctaaccatgtcccccgaggtgcatcagtccaacgttggttggtgtcgcctggtcacggccgcctacaattattttcacgtaactaatttcttttggatgttcggggaagggtgttacctgcatacagccatagtcctaacatactcaacagatcgcttacgcaagtggatgttcatttgcatcggctggggagtgccattcccaatcatcgtagcgtgggcaattggaaagctgtactacgacaatgaaaagtgttggtttggcaaaagaccaggcgtctacacagactatatctatcaggggcccatgattctggtgctgctcatcaacttcatctttttgttcaacatcgtacggattttaatgaccaagctgagagcaagcacaacatcggagaccatccaatatcgaaaggctgtgaaagccactctggttctcctccccctgttggggattacctacatgttgttttttgtgaacccgggggaagacgaagtttcgagggtggttttcatttatttcaattctttcctggaatccttccaggtgcgttccgctatcaggaagcgctggcaccgatggcaggacaagcattcaattcgagctcgcgtggccagggccatgagcatccctacgagtcccactagagtctccttccatagtatcaagcagagtaccgcggtatag

SEQ ID NO: 41630 - DNA, 1128 bp, Artificial Sequence
  Description of Artificial Sequence: Synthetic coding sequence
atgggcggccacccccagctgcggctggtgaaggccctgctgctgcttgggctgaatccagtaagcgcgtccctgcaggaccaacattgcgaatccctgagcctggcctcaaatatcagcgacaatggttatcgagagtgtcttgccaacggcagctgggcggctcgagtcaattactctgagtgccaagagatactcaatgaggagaagaaaagcaaggttcactaccacgtcgccgtgataatcaactatctcggccattgcatctctctggtggcactcctggttgcatttgtcctctttttacggctacggagcatccggtgcctgagaaacatcatccactggaacctgatctccgccttcattctccggaatgctacctggttcgtcgtccagctgacaatgtcccctgaagttcaccagagtaacgtcgggtggtgccggctggtgacggccgcttataattactttcatgtgaccaactttttttggatgtttggtgaaggttgctacctgcacacagcaatcgtgctcacgtactctactgatcggctgcgaaagtggatgttcatttgtattggatggggggttccctttccaatcatcgtcgcttgggctatcggaaagctgtattacgacaacgagaagtgttggttcggcaaaaggcctggagtgtataccgattatatatatcaagggcctatgatcctggtgcttctgatcaatttcatatttcttttcaacattgtgcgtattctgatgactaaactgagggcatcaacgaccagcgagactatacaatacagaaaggcagtgaaagccaccctcgtgctactgcctctgcttggcatcacctacatgctgttctttgtgaatcccggcgaagatgaggtgagtcgggtcgtgtttatatactttaatagctttttggaatccttccaaggctttttcgtgtctgtcttttattgttttctcaatagcgaagtacggtcagctattcgcaaacggtggcacaggtggcaggataaacacagtatcagagctagggtggcgcgagcaatgagcatccctacatctccaacaagggtctcgttccattccattaagcagtcaacagctgtgtag

SEQ ID NO: 41631 - DNA, 378 bp, Artificial Sequence
  Description of Artificial Sequence: Synthetic coding sequence
atgggcggccacccccagctgcggctggtgaaggccctgctgctgttagggcttaacccagtctcagcttcgttgcaggaccaacattgcgaaagcctgagtctggcgtccaacatttcgggactccaatgcaacgcgagtgtggacctaatcggcacatgctggccaagatcccctgccgggcaacttgtggtgagaccatgtccagcattcttctatggtgtgaggtataataccactaacaacggatatcgcgagtgtctggcaaatggctcatgggccgctcgcgtcaattattctgaatgtcaggaaattcttaacgaggaggagccaggtacacaggcacagccaggacgggcccatcgcggcggcacttag

SEQ ID NO: 41632 - DNA, 1248 bp, Artificial Sequence
  Description of Artificial Sequence: Synthetic coding sequence
atgggcggccacccccagctgcggctggtgaaggccctgctgctgctgggattaaaccccgtgtcagccagtctgcaagatcagcattgcgaatccctcagcctggcgagcaacataagtggcctccagtgtaacgccagcgtcgatctcattgggacgtgctggccccgctcccctgctggacagctggtcgtcagaccatgcccagcctttttttacggtgtgcggtataacacaaccaacaacggatacagggaatgcctcgccaatgggagttgggctgcccgcgtgaattactccgaatgtcaggagatcctcaatgaggaaaagaagagcaaagttcactaccacgtggccgtaatcattaactatctcgggcattgtatcagcctggttgctctgctcgttgccttcgtcctgttcttgagattacgatctatacgctgcttgcgaaacataattcactggaaccttatctccgcttttattctccgcaatgctacctggttcgtggttcaactgacgatgagcccagaagtgcaccagtctaacgtgggctggtgccgactggtgaccgcagcatacaactacttccacgtcactaacttcttttggatgttcggggaaggctgctatctccacaccgcaattgtgctgacatacagcactgatcgactaaggaaatggatgttcatttgtattgggtggggtgtgccctttccaataatcgtcgcatgggctatcgggaagctgtactacgataacgagaaatgctggtttggaaaacggcccggagtctacacagattacatctatcaaggcccaatgatcttggtgctgctcatcaactttattttcctcttcaatatcgttagaatcctgatgactaagctgcgcgcctcaacaacttccgagaccatccaatatcgaaaggcggtgaaagctactctggtgctattgcccctactggggatcacatacatgctgttttttgtaaacccaggggaagacgaggtcagccgggtggtattcatctattttaattccttcctggaatcattccagggcttctttgtatctgtgttttactgtttcctgaattcagaggtaagatcggccatccgcaagcggtggcacagatggcaagataaacactccatcagggctcgtgtcgcgcgggctatgtcaattcctaccagccctactcgggtgtctttccactcaataaagcaatctaccgccgtgtag

SEQ ID NO: 41633 - DNA, 858 bp, Artificial Sequence
  Description of Artificial Sequence: Synthetic coding sequence
atggtgagcgccaccatcccccagaagaagagcaaggtgcactaccacgtggcggtcatcatcaactacctggggcactgtatctccctggtcgcattgttggttgcctttgttctctttctgagattaagatccatcagatgtctgagaaacatcatccattggaacctgatttcggcttttatcctaaggaatgccacctggtttgttgttcagttgactatgagtccggaagtgcatcagagcaacgttggctggtgccgcttggtgacagccgcatacaactatttccacgtgaccaacttcttttggatgttcggagagggatgttacctgcataccgcaattgtgctgacttacagcactgataggctcaggaagtggatgttcatctgcataggttggggcgtaccgttccctataattgtcgcctgggcaatcggtaagttgtactatgataacgaaaagtgctggttcgggaagcgccctggagtttacaccgactatatctatcagggcccaatgatcttggtcctgctcatcaacttcattttcctgtttaacatcgtgaggattctgatgacaaagcttagagcttcaactaccagcgaaaccattcagtatagggcatccctctgtctgtgcagtacagtctcatccattgttagaagtgtactacccagcggacgggggggaactggcggccggacgagcacacggtccgtacccgagtggccagttccatgcccttcacctcccccacagcccgtgtccgcgttcactgcctccagtagcccacagcagtcagaattagccggccatggtgccgcccccaagcagctatggttggggggctag

SEQ ID NO: 41634 - DNA, 1335 bp, Artificial Sequence
  Description of Artificial Sequence: Synthetic coding sequence
atgggcggccacccccagctgcggctggtgaaggccctgctgctgctcggtcttaatcctgtctcagcatcgctgcaggaccagcattgtgaaagcttgtccctcgcttcaaatataagcgggctgcaatgcaatgcctccgtcgacctgatcgggacatgctggcctcgctccccagctggccagttggtggttcgcccttgccctgcctttttttatggcgtgagatataacaccacaaataatgggtaccgcgagtgcttagccaatggatcttgggccgcgcgagtgaactattcagaatgccaggagatcctcaacgaggaaaagaaaagcaaggtgcactaccatgtggcagttatcatcaactacctgggccactgtatcagtctggttgctcttctggtagccttcgtcctgtttctccgcttacggcctggctgtactcactggggagatcaggccgacggggcactcgaggtcggtgctccttggagtggcgcacccttccaggttagaagatctattagatgcctgcgaaatatcatacactggaacctgatcagcgcctttatcttgagaaatgctacttggttcgtcgtccagttgacaatgtctccagaagtccaccagagtaatgtgggatggtgcagactggtaacagcagcctacaactatttccatgtgacaaactttttctggatgttcggtgaggggtgctacttgcacactgccatcgtgctgacatattctactgaccgcctgagaaagtggatgttcatttgtatcggttggggcgtcccattccccatcatcgttgcctgggcaataggaaagctgtactacgacaacgagaaatgctggtttggcaagcggccaggcgtttatacagactatatctaccaggggccgatgattctggttctcctgatcaactttatattcctatttaatatagttcgcatcctcatgacaaaactgcgggctagcactacaagtgagaccatccagtatcgaaaggctgtcaaagccaccttggtcctgctcccattgcttggcatcacttacatgctctttttcgtcaatccaggagaagatgaggtatccagagtggtgttcatctacttcaattcttttctggagagcttccagggcttttttgtttcagtgttttactgctttctcaattctgaggtgcggtcagctattcgcaaacgctggcataggtggcaggataaacacagcattagagcccgggtggccagagcgatgtccatcccgacctcccctactagggtgtccttccacagcattaagcaaagtacggccgtttag

SEQ ID NO: 41635 - DNA, 321 bp, Artificial Sequence
  Description of Artificial Sequence: Synthetic coding sequence
atggccctggaccccgccgaccagcacctgcggcacgtggagaaggacgttctgattccaaagatcatgagggagaaagctaaggagaggtgtagtgagcaggtgcaagactttacaaaatgctgcaaaaacagtggggtgctcatggtcgtcaagtgtaggaaagagaactccgccctaaaagagtgtcttacggcgtactataatgaccctgccttttatgaagagtgcaaaatggagtacctgaaggagagagaggagtttcgcaagaccggcatcccgacaaagaagagacttcagaagttgcctacatcgatgtag

SEQ ID NO: 41636 - DNA, 321 bp, Artificial Sequence
  Description of Artificial Sequence: Synthetic coding sequence
atgttcgcccccgccgtgatgcgggccttccggaagaacaagaccctcggttatggagtgcccatgctcctgctcatcgtcggggggagttttggcctaagggaattttcacagatccgctacgatgcagtcaagagtaaaatggatcctgagctagaaaagaaactgaaggaaaataaaatctcccttgaatccgaatatgaaaaaatcaaggactcgaagttcgatgactggaagaacatacgcggcccgcgcccatgggaagatcccgatctccttcagggtcggaatcccgaaagtcttaagactaagaccacatag

SEQ ID NO: 41637 - DNA, 1002 bp, Artificial Sequence
  Description of Artificial Sequence: Synthetic coding sequence
atgctgtgccggctgggcggccggtggctgcggcccctgcccgccctgcagctgtgggccagggacctgcccttggcccccgtccctactagcggggcaaaaaggcccactctacccgtgtgggccgtggctcctgtgtccgctgtgcatgccaatggatggtatgaggccttagcagcttctagccctgtccgagttgccgaggaggtcctcctgggggtgcatgcagctactggccttccctggtggggtagtatcttgctctcaactgtggcgctgcggggcgcagtgaccctgcccctggctgcatatcagcattatatcctggccaaggtcgaaaacctgcaaccagagataaagacaattgctaggcatttgaaccaggaagtcgcagttagagctaatcagctcggttggtctaagcgtgacgccagattaacatacctgaagaacatgaggagactaatctccgagttgtatgtccgcgataactgtcatccgtttaaggccacagtgctggtctggattcagctcccaatgtggatatttatgtctttcgccctgcgcaatctctccaccggtgcagctcacagcgaaggtttctctgtccaagagcagctcgcgacaggcggtattttgtggtttcccgatctgacggcacccgatagtacctggatattacctatcagcgttggggtcattaacctcctgatagtcgagatttgcgcactccagaagatcggtatgtctagattccagacctatattacctacttcgtgcgtgctatgtcagtacttatgatccctatagctgccacagtgccttcctctatcgtcctttactggctgtgctcgtcattcgtgggattaagccagaatctgctgcttaggagtccagggttcaggcagctatgccggataccaagcaccaagagcgattccgagaccccatataaagatatctttgccgcctttaataccaaatttatcagtcgtaagtag

SEQ ID NO: 41638 - DNA, 1005 bp, Artificial Sequence
  Description of Artificial Sequence: Synthetic coding sequence
atgctgtgccggctgggcggccggtggctgcggcccctgcccgccctccaactctgggcacgcgatctgccactcgcaccagttcctacgtcaggagccaagaggccaacccttcctgtctgggccgtggccccggtttccgccgtccacgcaaatggctggtacgaagcactcgccgcgtcgtcacctgtgcgagtggccgaggaggttctgctgggcgtgcacgccgcaacaggattgccctggtgggggtcaatactgcttagcacagtggcccttaggggcgccgttacactgcctctggcagcttaccagcattatatcctcgcgaaagtggagaaccttcagcccgagatcaagaccatagctaggcacctcaatcaggaggtggccgttcgcgcgaatcagctagggtggagtaagcgagatgcccgactgacatatctgaagaatatgagaagactgataagtgagctgtatgtgagagataactgtcatccctttaaggccacagttctggtctggatccagctgcctatgtggatctttatgagctttgctctacggaacctctccactggggcggcccactccgaggccggattttcagtacaggagcagctggcaaccggtggtatcctctggtttcctgatctgacggcacctgactcaacatggatactccccatcagtgtgggagtcattaacctactgatcgtcgagatttgtgccttacagaagataggaatgtcacggtttcaaacctacattacatactttgtccgtgcaatgtctgtcttgatgatcccgatcgcagcgacagttccctcctcgattgtcctctactggttatgttctagctttgtgggactttcacaaaatctgcttcttagaagtccaggctttcgtcaactctgcaggataccatccactaagtctgacagtgaaaccccttacaaggacatttttgccgcgttcaacactaagtttatttcgagaaagtag

SEQ ID NO: 41639 - DNA, 2334 bp, Artificial Sequence
  Description of Artificial Sequence: Synthetic coding sequence
atggaggagcccggcgccaccccccagccctacctgggcctggtgttggaggagttgcgccgtgttgtcgctgccttacctgagagcatgcgccctgacgagaatccgtatgggtttccgtcagaactggtcgtctgcgcagccgtgatcggctttttcgttgtgctcctgttcctgtggcgttccttccggagtgttaggtcgcgcctgtatgttgggagagaacagaaactgggggccacactctccggtcttattgaagagaaatgtaagctgctggaaaagttttcattgatccagaaggagtatgaaggatacgaagtggagagtagtctggaagacgcatcttttgagaaagctgcggccgaggaggctaggagcctggaagccacatgtgagaagctgaataggtctaactcagaactggaggacgaaatcttatgccttgaaaaggacctgaaggaggagaagagcaagcattcacaacaggatgagctgatggcagacatatcgaaatccatccagagcctagaggatgagtccaaaagcctaaaaagccagatcgcagaggccaagataatttgcaagacatttaaaatgtccgaggaacgaagagccatcgcgatcaaggatgctctgaacgaaaatagccagctccagacaagtcacaagcaactgtttcagcaagaagcggaagtgtggaaaggcgaagtgagcgagttgaataagcaaaaaattacattcgaggattccaaggtgcacgcagaacaggtgctgaatgacaaggaaaatcatataaagaccctcactgggcacctgccaatgatgaaggaccaggcggccgttctggaagaggatactaccgacgacgataatctggagttggaagtgaatagccagtgggagaacggcgccaatctggatgatcccctgaagggtgcactgaaaaagttgattcacgcggcaaaactcaacgtgagtttaaagtctctcgaaggcgagcggaaccacattatcatccagctgtcagaagttgacaagacaaaggaggagttgacggaacacatcaaaaacctccaaacccaacaagcctcactgcaaagcgaaaacatctatttcgaaagcgaaaatcaaaagctccagcagaagctcaagattatgacagagttttaccaagagaacgaaatgaaactgtaccgaaagctgacagttgaggagaactataggatcgaagaagaagagaagctgagtagggttgaagaaaagattagtagagccacagagggactggaaacatacaggaagctcgccaaggacctggaggaggagctggagcggactgtgcatttttaccaaaagcaggtcatatcatatgaaaaacggggccacgacaattggctagccgctaggaccgccgaacgtaacctgagcgatctccgaaaggagaacgcacacaacaagcagaagctgaccgaaactgaactgaagtttgaattgctggagaaagatcctaacgcactcgatgtttcgaacaccgctttcggaagagaacactccccctgctccccttctccactgggccgcccaagctcagaaacacgcgccttcccgagcccccagactctgcttgaggacccccttcgactttctccggtgcttccagggggcgggggtcgtggcccgagctcacccgggaatccacttgatcaccaaatcaccaatgagagaggtgaaccctcctatgaccggctaattgatccccatcgggccccatctgatacagggagcctgtcgagtcctgtggagcaggatagaaggatgatgtttccacctcccgggcaaagctatcctgacagcaccctgccaccccaaagagaggaccggttctactctaatagtgagaggctcagcggtcctgcagagccaagatcattcaagatgacaagcctggacaagatggaccgctctatgcctagcgaaatggaatcctccagaaacgacgctaaagacgatcttgggaacctgaacgtccctgacagttcacttccagccgagaacgaggcaacgggacccggtctcatccccccacctctggcccctataagcggcccgcttttcccagtggacactaggggcccatttatgcgccggggccctccattccctcctccccctccagggactatgttcggcgccagccgcgggtacttcccccccagggatttcccagggccccctcacgcacccttcgcaatgaggaatatctaccctcctagaggactgcccccatacttgcatcctaggcccggcttctaccctaaccccacattctag

SEQ ID NO: 41640 - DNA, 2334 bp, Artificial Sequence
  Description of Artificial Sequence: Synthetic coding sequence
atggaggagcccggcgccaccccccagccctacctgggcctggtgctggaagaactgcgccgagtggttgctgcccttccagagtccatgagacctgacgagaatccctacggatttccatcagagctggtcgtgtgtgcggcggttatcggttttttcgttgtgctgctgttcttgtggcggagttttcggtccgtgcggtccaggctgtatgtcggccgagaacagaaattgggcgccactctttcaggcttaatcgaggagaagtgcaagctcctcgaaaaattcagcttaatccagaaggagtacgaggggtacgaggtggagtcatcattagaagacgccagcttcgaaaaagcggcagcagaggaagcccgctcactggaagctacttgcgagaagcttaatcgttccaattctgagctggaggacgaaattctgtgcctggaaaaagatctcaaagaggaaaaatccaagcactctcaacaggatgagctgatggccgacatttctaaatcaattcaaagcttggaagatgaatccaagtccctgaagtctcaaatcgctgaggccaagataatttgtaaaacttttaagatgagcgaggagcgaagggcaatcgctatcaaggatgcgctcaatgaaaacagccaactccagaccagccataagcaattgttccaacaggaggccgaggtttggaaggggcaagtctccgagcttaacaaacagaagatcacctttgaagactccaaggtccacgccgaacaggtcctgaatgataaagagaaccacattaaaacactcacaggccacctgcctatgatgaaagatcaggcggcagtgttagaagaggatactacggacgatgacaacctggaactggaggtcaacagtcagtgggagaacggtgccaaccttgacgatccattgaagggtgccctgaagaaactcattcatgctgcgaaactaaacgtgtctcttaagagtctggaaggcgaaaggaaccacatcatcatccaattgtcagaagtggacaagaccaaagaagagttgactgagcacattaaaaacctgcaaacacagcaagcatccctgcagagcgagaacatctattttgaatctgaaaaccagaaactccagcaaaagctcaaaatcatgaccgagttttatcaggagaacgagatgaaactgtatcgaaaactgactgtagaagagaactataggatcgaggaggaggagaaactcagcagagtagaggagaagatttcccgcgcaaccgagggcctcgagacgtaccgcaagttggcaaaggatttagaagaagagctggagcggacagtgcatttttatcagaaacaagttataagctatgagaaacggggccacgacaactggctcgctgctagaaccgccgaacgtaacctttccgacttgagaaaggagaacgctcataataagcagaaactaactgagaccgagctcaagtttgaactgctcgagaaggatccaaacgcattggacgtttctaacacagcctttgggcgcgaacatagtccttgtagccccagtccccttgggcgcccatcctctgagactcgggcctttccatccccgcagactctgctagaagacccgctcagactaagtcccgtgttgcctggcgggggcggaaggggccctagttcaccaggtaacccacttgatcaccagatcacaaatgaacgaggcgagccgagttacgatcgccttatcgacccccaccgcgctccctccgataccggctcactgtcgtctccagtagaacaagaccggcggatgatgtttccccctccaggtcagtcataccctgacagcactctgccaccccaaagagaagatcgattttacagcaacagtgaaaggttaagcgggccagcggagccccggagcttcaagatgacttcactcgataaaatggatagatccatgccaagcgagatggagtcatcaaggaacgacgccaaagatgacttgggcaatcttaatgttcctgatagtagtctccctgcagaaaatgaagctactgggcctggctttatccccccccctcttgcccctgttcgcggaccactgtttcctgtcgacaccagggggcctttcatgcggcgtggaccgcccttcccacccccgccacctggaaccatgtttggtgcgtctcgaggttatttcccgccgagggatttccccgggcctccccatgctccatttgcaatgaggaacatctaccccccacgcggtttacctccttatcttcatccgcgtccaggattctatcctaacccgaccttttag

SEQ ID NO: 41641 - DNA, 2334 bp, Artificial Sequence
  Description of Artificial Sequence: Synthetic coding sequence
atggaggagcccggcgccaccccccagccctacctgggcctggtgctagaagagctgggcagagtggtcgctgcacttcccgagtcgatgagacccgacgagaacccttatggatttccttccgagttggtagtgtgcgccgccgtcatcggattcttcgtggtcctcttgttcctctggaggagttttcgatctgtgcgatctcgactctatgtgggtagagagcagaagctgggcgctactctgtcaggacttattgaggaaaagtgcaagctgctggagaagttttccctcattcaaaaggagtacgagggctacgaagttgagtcgtcactggaggatgcctcctttgaaaaagccgcagctgaggaggctcggtctttggaagcaacttgcgagaagctctctaggagcaattccgaactggaggatgaaattttatgcctggaaaaggatttaaaagaggaaaagtccaaacactctcagcaggacgaattgatggcagacattagcaagtccatccagagcttagaagatgagagcaagagccttaagtcccagatagctgaagctaaaatcatttgcaagacattcaaaatgagcgaagagagaagagcgatcgctatcaaggatgctttaaacgagaattctcagttgcagacgtcgcataagcagcttttccagcaggaggccgaagtctggaaaggccaggtgtcagagctaaacaaacaaaagatcacctttgaagacagcaaggttcacgccgagcaggtgttaaatgataaagagaatcatatcaagaccctgacgggccacctgcctatgatgaaagaccaggctgcggtgctcgaggaggacacaactgatgacgacaacttggagcttaaggttaacagtcagtgggaaaacggggccaacctagacgaccctcccaaaggcgcattgaaaaaattgatccatgccgcaaagctgaatgtgtccctcaaatctcttgagggtgagaggaatcatattatcatacagctctcagaggtagacaaaacgaaggaggagttaactgagcacattaaaaacttacagactcagcaagcatctctccagagcgaaaatatttattttgagtcagagaatcagaagctgcagcagaagcttaagattatgactgaattttaccaagaaaatgaaatgaagctctatcggaagttaaccgtcgaagaaaactacaggattgaagaggaagagaaactgtccagggttgaggaaaagatcagtcacgctactgaggaactggaaacatatcgcaaactcgcgaaggatctcgaggaggaattggaacggaccgttcacttctatcagaaacaggtgatatcatatgaaaagagagggcatgataattggctcgccgctaggactgccgagagaaacctgtccgatctgaggaaggagaacgctcacaacaaacagaaactcacagaaagggagctcaagtttgaactcctggagaaggatccgaatgccctggacgtttcaaataccgcattcggcagggaacattctccctgctccccaagtccactcggaagaccgtccagtgagaccagggcatttccgtccccacaaaccttgctggaggatccactgagactctctcctgttctgcccggcggcggtgggagaggcccgtccagcccaggcaatcctttggaccatcagatcaccaacgaaagaggagagccatcctatgacaggctgattgatccgcatagagctccatcagacactggatccctgtcttctccggtcgagcaggatagacgtatgatgtttccaccacccggccagtcctaccctgattccactctgccacctcaacgtgaggatcgcttctattccaattctgaacggttgtccgggcccgccgagcctcggtctttcaagatgacctccttggataagatggaccgtagcatgccatctgagatggagtcgtcgcgtaacgacgcgaaagacgacctgggtaaccttaacgtgcctgattccagtctgccagccgagaacgaagctacaggaccaggcctgataccgcctcctttggcccccataagtgggcccctctttcctgtcgacacccgaggaccatttatgaggcgaggcccaccatttcctccgcctccaccagggactatgtttggagcttctagggggtacttcccccctcgggacttccccggtcccccccacgctccctttgcaatgagaaatatctacccccccaggggccttcccccatacttacacccccggccggggttctatcccaacccaacattctag

SEQ ID NO: 41642 - DNA, 735 bp, Artificial Sequence
  Description of Artificial Sequence: Synthetic coding sequence
atgatgcggacccagtgcctgctgggcctgcggaccttcgtggccttcgctgctaaactttggtcctttttcatataccttctgaggcgccagatacgcacggtgatccaataccagactgttcggtatgacatcctgccgcttagtcccgtgtcacggaatcgccttgctcaggtgaaaagaaagatacttgttctagatctcgatgaaactctgatccactctcaccatgatggagtactcaggcctacagtgagaccagggacaccccccgacttcattttgaaggtcgtgatcgataagcatcctgttagattctttgtacacaaaaggccgcacgtagactttttcttggaggtggtttcacagtggtacgagcttgtggtatttacggcctccatggagatctacgggagtgctgtagccgacaagttggataatagcagaagcattctcaagcggcgttactacaggcagcattgcacactcgagctgggttcttatatcaaggatttgtcagttgttcactctgatttgagttcaatagtgatccttgataacagccccggagcttatcgcagtcaccccgataacgcaataccgattaaatcatggttttctgacccgagcgatacggcattactcaatttgttacccatgttggacgcgttgcgttttacagcagacgtgagaagcgtgctcagcaggaacctgcaccagcacaggctgtggtag

SEQ ID NO: 41643 - DNA, 735 bp, Artificial Sequence
  Description of Artificial Sequence: Synthetic coding sequence
atgatgcggacccagtgcctgctgggcctgcggaccttcgtggcctttgctgcgaaactttggagctttttcatatatctactgcggcgccaaatacgcaccgtgatccaatatcagacagttagatacgacattctccctctgtcccccgtgtcacgaaacaggctggcccaggtgaagcgtaaaatactggtgctagatttggatgaaacactcatccattcgcaccacgacggcgtcctgcgtccaactgtccgccctggtaccccacctgattttatcctgaaggtggtgatcgataaacatcctgtgcggttctttgtgcataaacgtcctcacgtggatttcttccttgaagtcgtttctcaatggtacgagctggttgtattcacggcttcaatggaaatctatggtagtgcagtggcagacaagttggataatagcaggagtatcctgaagcggaggtactacaggcaacattgcaccctggaattaggcagttatatcaaagacctctcagtcgtgcatagtgatctgtctagtatcgttatactggacaacagtccaggcgcctatcgttcacaccccgacaacgctatcccgattaaaagctggttttcagacccgtctgacactgcgctgttgaatctgctgccgatgttagacgcgctcaggttcaccgccgatgtgaggtcagtgttgagtaggaacctgcatcagcacagactatggtag

SEQ ID NO: 41644 - DNA, 690 bp, Artificial Sequence
  Description of Artificial Sequence: Synthetic coding sequence
atgcaggacgaggacggctacatcaccctgaacatcaagacccggaagcctgcccttatatcggtaggctctgcttcctcatcatggtggagagttatggcactgatcttgttgatcttgtgcgttggcatggtggtagggcttgttgccttggggatctggagcgtgatgcagcgcaactatctgcaaggcgagaatgagaatcggacaggcacattgcagcagctggcaaagcgtttttgtcagtatgtggtgaagcagagcgagctgaagggtacttttaaaggtcacaagtgttccccttgcgataccaactggcgctactatggggacagctgttatggctttttccgccacaatctgacatgggaggagtctaaacagtactgcactgacatgaatgctaccctcctcaagatcgataatcgaaacatagtagaatacattaaagcaagaacacacctcattcgatgggttggtctgagtagacagaagtcgaatgaggtatggaaatgggaagacggatccgtgatcagtgagaatatgttcgagtttctggaggatggcaaaggcaacatgaactgcgcttactttcataacggtaaaatgcaccccactttctgtgagaacaagcattatttgatgtgcgagaggaaggccggcatgaccaaggtagaccagttaccttag

SEQ ID NO: 41645 - DNA, 591 bp, Artificial Sequence
  Description of Artificial Sequence: Synthetic coding sequence
atgcaggacgaggacggctacatcaccctgaacatcaagacccggaagcctgcgttgatttcagccgtgatgcagagaaactaccttcaaggcgagaacgaaaaccgaaccgggactctgcagcagctggcgaagcggttctgccagtacgtagtgaaacagtccgaactgaaaggcactttcaagggccataaatgctcaccatgcgatactaactggcgctactatggcgactcttgctacggctttttccgccataatcttacctgggaggaatctaagcaatactgtacagatatgaacgctactctactgaaaattgataatcggaacatcgtggagtacatcaaggctagaacacatctgatcagatgggtgggcctgtcacggcaaaagtctaatgaagtttggaagtgggaggacggctctgtgatcagtgaaaacatgtttgagttcctggaggacggcaagggcaacatgaactgcgcctattttcataacgggaagatgcatcctaccttttgtgaaaataagcattatctgatgtgcgaacgaaaagcaggcatgacaaaagttgaccaattgccttag

SEQ ID NO: 41646 - DNA, 417 bp, Artificial Sequence
  Description of Artificial Sequence: Synthetic coding sequence
cacaagtgcagcccctgcgacaccaactggcggtactacggcgactcgtgttacgggttttttcgccacaacctcacctgggaggagagcaaacagtactgcacagacatgaatgccacattgctcaagattgacagtaaggaagagaaattgttcctgacatcctttcgcatcctgaccatcgtattcatatgggtgggcttgagcaggcagaaatctaacgaagtatggaagtgggaggacgggtcagtgattagcgatagcctattttctcaatccaactttcagaatggaaagggcaatatgaactgcgcttattttcacaatggaaagatgcaccctactttctgcgaaaacaaacattacctcatgtgcgaacgcaaggccggcatgacgaaggtagaccaactgccctag

SEQ ID NO: 41647 - DNA, 591 bp, Artificial Sequence
  Description of Artificial Sequence: Synthetic coding sequence
atgcaggacgaggacggctacatcaccctgaacatcaagacccggaaaccagctcttataagtgcggtaatgcagcgcaattacctgcagggagagaatgaaaaccgcaccggtacactgcagcagctggctaagagattctgccaatatgttgtgaagcaatcagagcttaaaggcaccttcaaaggtcacaagtgctccccgtgtgacaccaactggcggtactatggcgacagttgttacggcttcttcagacacaacctgacgtgggaggaatccaagcaatactgtactgacatgaatgcgacgttgctgaagatagacaatcggaacattgtagaatatattaaggcgcggacccacctgatccgttgggtcgggcttagtcgccaaaagagtaatgaggtctggaagtgggaagacggcagcgtgatttcagagaacatgtttgaattcctggaagacgggaagggtaatatgaactgcgcatacttccacaatggtaagatgcatcccacattctgcgagaacaaacattatctgatgtgtgaaagaaaggctgggatgactaaggtggatcaactgccgtag

SEQ ID NO: 41648 - DNA, 831 bp, Artificial Sequence
  Description of Artificial Sequence: Synthetic coding sequence
atgagcgaggaggtgacctacgccaccctgaccttccaggacagcgctggagcacgcaacaatagagacggaaacaacctgagaaaaagagggcaccctgccccctctcccatctggaggcacgccgcgctaggcctcgtgaccctgtgtttgatgctgttaattggactggtgacattaggaatgatgtttcttcagatatccaatgatataaacagcgattcggaaaagctcagtcagcttcagaagaccatacaacaacagcaggataatctctctcagcaattaggcaattctaataacctgtcgatggaggaggaattcctgaaatcccagatcagttccgtgttgaagagacaagagcaaatggcaataaagctatgccaggaattgatcatccatacctccgatcaccgttgtaatccatgtccaaagatgtggcagtggtaccaaaactcctgttattactttacaaccaacgaggaaaagacctgggctaatagcagaaaagactgcatcgataagaattcgacactcgtgaagatcgattcactcgaagagaaggatttccttatgagccagccccttttgatgttctccttcttctggctgggcctcagctgggactcgagcgggaggtcctggttctgggaagacgggtccgtacctagcccctctttgttctccaccaaggaactggatcaaatcaatgggtctaagggatgtgcctatttccagaaaggcaacatatacatttctagatgctcagcagaaattttttggatatgtgagaagacagccgccccggtcaagaccgaggatttggactag

SEQ ID NO: 41649 - DNA, 699 bp, Artificial Sequence
  Description of Artificial Sequence: Synthetic coding sequence
atgagcgaggaggtgacctacgccaccctgaccttccaggacagcgctggtgcccgcaataatagagacggtaataatttgcgcaagagaggacatcctgccccatcacctatatggcggcacgcagcactgggcttggtgacgttgtgcctaatgctgctcatcggtctcgtaactttgggcatgatgttcctccagatcagcaacgacatcaattccgactcagaaaagctttcccagctgcaaaagacaattcaacaacagcaagataatctgagtcaacagttaggcaacagtaacaatctgtctatggaagaagagttcctaaaaagtcagatatcgtcagtgctcaagaggcaggagcagatggccatcaaactctgtcaggagctaattattcacacctctgaccatagatgcaatccgtgtcctaagatgtggcaatggtatcagaattcctgctattatttcactactaacgaggagaagacctgggctaactcccgtaaggattgcatcgacaagaattctactctggtaaagattgattcgctggaagaaaaagattttttgatgagccaacccctgctgatgttttcatttttctggctgggactatcttgggattcctcaggtcggagctggttttgggaagacggctctgtcccttcaccatccttgtacgtcagcaactactag

SEQ ID NO: 41650 - DNA, 1473 bp, Artificial Sequence
  Description of Artificial Sequence: Synthetic coding sequence
atgcggcccgccttcgccctgtgcctgctgtggcaggccctgtggcccggcccaggtgggggcgagcaccccacagcagaccgcgcggggtgcagtgcatcgggggcgtgttatagcctccatcacgcaacgatgaagcgtcaggctgctgaagaggcttgcattctgaggggaggcgctctcagtacggtgcgcgccggagccgaactgcgcgccgtacttgcactgttgcgggccgggcccggcccgggggggggctcaaaggacctcttattctgggttgccttagagcggagacgctcacattgtactctcgaaaatgagccactcaggggattcagttggctctccagtgatccaggtggacttgaatctgatacccttcagtgggtggaggagccccagaggtcctgcacagctaggagatgtgcagtcctgcaggcaacaggcggcgtggagccggctggctggaaagaaatgcgatgccacttgagagccaatggctatctctgcaagtaccaatttgaggtgttgtgccccgcccccagacccggagcagcctctaaccttagctacagagctccattccagctacacagcgccgccttggattttagcccacccggaaccgaagtgtccgctctgtgcaggggtcaactcccgatctctgtcacctgtatagccgacgagattggcgcccggtgggataaactgtccggggacgttctgtgcccctgtcctggaagatatctgcgggcgggaaagtgcgcggagctgcccaactgtctggatgacctggggggcttcgcctgcgagtgtgctacaggttttgagcttggtaaggatggacggagctgtgtgactagtggcgaaggccaacctacactcggcggcaccggcgttccaacgaggagaccccctgctaccgctacttcgcctgtgcctcagcgaacgtggcctatcagagtggacgaaaagctgggcgagaccccattggtccctgaacaggataacagtgtgaccagcatccctgaaattccccggtggggatcacaaagcaccatgtccaccctccagatgagtctgcaagcggagtccaaagccacaattactccgtccggttctgtaatttccaagtttaactccacaaccagttctgccacaccccaagcttttgattccagttccgcagtggtgttcattttcgtcagtaccgccgtcgtggtgctcgtgattcttacaatgacggtgctgggtttggtgaaactgtgctttcacgagagtccatcatcgcaaccacggaaagagtcaatggggcctccgggcctggagagcgacccagaaccagcagccttgggatctagttcagcccactgcactaataacggggtaaaagttggagattgcgatcttagggaccgggccgagggggcactgctcgccgagagcccgctggggtcctccgatgcgtag

SEQ ID NO: 41651 - DNA, 633 bp, Artificial Sequence
  Description of Artificial Sequence: Synthetic coding sequence
ggcaccaacagccgggccatgtgctgcgtgccccccggccggtacttacgcgccggcaagtgcgcggagttaccaaattgtctcgacgatctgggtggctttgcatgtgagtgtgcaactggatttgaactcggaaaagacggcaggagctgcgtcacgagcggcgaagggcagccgacgctcgggggaaccggtgttcctactaggagacctcctgccacggcaacatcgccagtacctcagcgaacgtggcccattagagttgatgagaaactgggagaaactcccctggtgcccgaacaagataactccgtgacctcaattcctgagattcctagatggggcagccaatctactatgagcacacttcaaatgtccttgcaggccgagtccaaagctacgatcacgccctcaggctctgtgatctctaagttcaactccaccaccagctccgcgacaccacaggccttcgattcctcatctgctgtggtgtttatttttgtgagcaccgccgtcgtggtgcttgttatccttacaatgacagtgctgggtcttgtcaagctgtgtttccatgagagtccttcatcgcagccccgcaaggagtcaatggggcctccaggccttgaatcgtag

SEQ ID NO: 41652 - DNA, 870 bp, Artificial Sequence
  Description of Artificial Sequence: Synthetic coding sequence
atgcacaacctgtacagcatcaccggctaccccgacccccccggcactatggaggaggaagaagaagatgacgactatgaaaattccactcccccatacaaagatctccctcccaagccaggtaccatggaggaggaggaggaagatgacgattatgagaacagtacacccccctacaaggatttgccaccgaagccagctctgacccttagtttttctagccctgggagcagcgcccctcctcggccccctcgcgccgccaaagagacagagaaaccacccctaccctgcaagccacggaatatgacaggcctcgatctcgcggctgtaacttgcccccccccccaactggccgtaaatttagagccctccccactgcagccatccctcgcggccactccggtcccatggttaaaccagaggtctggcgggcccgggtgctgccaaaaacgttggatggtgtacttatgcctgctggttgtgaccagcctcttcctagggtgcctgggacttacagttaccctaattaagtatcaagaactcatggaggagctgcgcatgctgtcattccagcagatgacatggagaaccaacatgaccggaatggccggactggctggtctgaagcacgatatcgccagagtccgcgcagacaccaaccagtcactggtggagctatggggacttctagactgccgtagaatcacttgtccagagggttggctgccattcgagggcaaatgttattacttctcaccttccaccaaatcttgggacgaagccagaatgttttgtcaggaaaactatagtcatttggtaatcatcaattcctttgcagagcatttacttggcgccaggggaacgcaatag

SEQ ID NO: 41653 - DNA, 1137 bp, Artificial Sequence
  Description of Artificial Sequence: Synthetic coding sequence
atgcacaacctgtacagcatcaccggctaccccgacccccccggcacaatggaagaggaagaggaagacgatgactatgaaaactctacaccaccttacaaggacctcccccctaagcctggtactatggaagaagaggaggaggatgacgattacgagaattccactcccccttacaaggatttacctccaaaacctggaaccatggaagaagaagaagaggatgatgactatgaaaattcaacccccccctataaggatttgcctccaaagcccgggagttcggcccctccccggccgccaagagcggcaaaggagactgaaaaacctcccctcccctgcaagcccaggaatatgactggccttgacctggcagcagtcacctgtcctccgccacagttagctgtgaatctggaaccgtcacctcttcaaccatccctagcagcgacgccagtcccttggctgaaccagcggagcgggggaccaggatgttgtcagaagaggtggatggtgtatctctgcctgctggtggtaacgtccctgttcctcgggtgtctaggcttgactgtgacactgattaagtaccaggaactgatggaggagcttcggatgttatcattccagcagatgacatggcggactaatatgacagggatggccggattagccggtctgaaacatgacatcgcccgagtccgggctgacacaaaccagtctctggtggaattatggggcctcctcgattgtcggaggattacctgcccagagggatggctgccctttgaggggaagtgttactatttcagtccaagcactaaaagctgggacgaggctaggatgttctgccaggagaattactctcatctggtgatcattaattcttttgccgagcacaatttcgtggctaaagcgcacgggagcccgcgcgtatactggctgggtctgaacgatcgggcccaggagggcgactggcgatggctggatgggtcccccgttaccttgtctttttgggaaccagaggagcctaacaacatacacgatgaggattgcgctacaatgaacaaaggagggacctggaacgacttgtcttgttacaaaacaacttattggatctgtgaacgcaaatgcagctgttag

SEQ ID NO: 41654 - DNA, 921 bp, Artificial Sequence
  Description of Artificial Sequence: Synthetic coding sequence
atgcacaacctgtacagcatcaccggctaccccgacccccccggcaccatggaggaggaggaagaagatgatgattacgaaaactccaccccaccatacaaggacttgccacccaagccgggaacgatggaagaggaagaagaagatgatgactacgaaaactctacacctccttacaaagaccttccaccgaagcctggtaccatggaggaagaggaggaagatgacgactatgagaatagtacccctccttataaagacctgcctccaaaacctggaagttctgccccgcccaggccccccagggccgccaaggagacagaaaagcctcccctcccttgcaaacccaggaatatgacggggttagatctggccgcggtgacgtgtccacccccccagctggcagtgaatctggagccctcccctctccagccctccctggctgcgaccccagtgccttggttgaatcagagaagtggaggacccggatgttgccagaaaaggtggatggtgtacctctgtcttcttgtagtgacatccctgtttcttgggtgcctcggtcttaccgttactctgatcaaataccaggagctgatggaagagcttaggatgctcagtttccaacagatgacatggcggacaaatatgacagggatggccggcctggccggcctgaaacacgacatagccagggtcagggccgatacaaaccagagcctggttgaactgtggggtctgctggactgccgccggatcacatgccctgagggctggctgccctttgagggcaaatgctactacttttctcccagtacaaagtcttgggatgaggccaggatgttttgtcaggagaactacagtcatttggtgatcatcaatagttttgcagaacaccttctgggggcccggggtacccagtag

SEQ ID NO: 41655 - DNA, 1770 bp, Artificial Sequence
  Description of Artificial Sequence: Synthetic coding sequence
atggacggcgaggccgtgcggttctgcaccgacaaccagtgcgtgagtttgcatccccaggaggtggactccgttgcaatggccccagccgctccaaagatccctagattggtgcaggccacgccggcatttatggccgtgaccctggtgttttctctggtgaccctgtttgtcgtggtgcagcagcaaacacgccccgttcccaaacccgtccaggctgtgatcctcggcgataatatcaccggacacctgccttttgaacccaataaccatcaccactttgggcgcgaagccgagatgagggagctgatccaaacctttaaagggcatatggaaaacagttctgcatgggtcgtggaaattcagatgctgaagtgtagggtggacaacgttaacagtcagttgcaggtccttggtgaccacctgggaaacaccaacgccgacattcagatggtgaaaggtgtcctgaaggatgccaccactctcagcctgcagactcagatgctgagatcaagccttgaagggactaacgctgagatccaacgattgaaagaggacttagagaaggctgacgcactcacttttcaaacgttaaatttcctgaagtccagcctggagaacaccagtatcgagctccacgtgctctcccgcggcctggagaacgcgaactcggagattcagatgcttaatgcttcccttgagaccgccaacactcaggcgcagctggccaacagctcgctcaaaaacgctaacgcagaaatctacgttttgaggggtcatctggacagtgtgaacgatttacgcacacagaaccaggttttgaggaactcgttagagggcgctaacgcggaaatccaggggctgaaagagaacctacaaaataccaatgcactgaacagccagacgcaagcattcattaagtcgagttttgataataccagcgccgaaattcagtttctaaggggccacctcgaacgggctggcgacgaaatccatgtgttaaagagagatctcaaaatggtcaccgcccagactcaaaaagccaacggcagattggatcagaccgacacccagattcaagtattcaagtcagagatggagaacgtcaacaccctgaatgcccagattcaggtgctcaacggacacatgaagaacgccagtcgggaaatacagactctgaaacagggcatgaagaacgcttcagctctcacgtcacagacccagatgctggattccaacttacagaaggcctccgccgagattcaacgactgaggggggatctagaaaacactaaagccttgacaatggaaattcaacaagagcaaagtcgcctgaagaccctccatgtggtcattacttcccaggaacagctccagcgcacccagagccagcttttgcaaatggtcctgcagggttggaagttcaatggggggtccctttattatttctccagcgttaaaaagagttggcatgaggctgagcaattttgcgtctcccaaggtgcccacctagcttccgtggctagcaaggaagaacaagcattccttgtagagtttacaagcaaagtgtactattggattggtctgactgaccggggcaccgagggcagttggaggtggacggatggcacgccgtttaacgccgcacagaacaaggcacccggatctaaaggctcatgtcccctgagaaaatacattatcgtgaacagcgggatgggagcctgctcattcattgacaccccgccctgtccctggatcctctccaactag

SEQ ID NO: 41656 - DNA, 882 bp, Artificial Sequence
  Description of Artificial Sequence: Synthetic coding sequence
atggacaccacccggtacagcaagtggggcggcagcagcgaggaggtgcccggtggcccttggggcagatgggtgcactggagccgaaggcccctctttctggcattggcagttctagtgacaactgtgttgtgggccgtgatcctttctatactgctgtccaaagcctcaaccgagagagccgcccttctggacggccatgacctgctgagaacaaacgcttcaaaacaaactgcggccttaggagccttaaaagaggaggtgggggattgccatagctgctgcagcggtacccaggcccagctgcagacgaccagagccgaacttggggaggcacaggctaagcttatggaacaggagtcagccttaagagaactgagggagcgggtgactcaaggcctggctgaggctggaaggggccgagaggatgtgcggacagaactgttccgggcactcgaagccgtcagactccagaacaattcttgcgagccttgtcctacctcttggctcagctttgaaggcagctgctatttcttctctgtgcccaagaccacatgggcggcggcccaggaccactgcgctgacgcctccgcacacctggtcatcgtgggcggcctggacgagcagggtttcctgacccgaaatacccgcgggagggggtactggcttggcttgagggccgttcgccatttgggcaaggtccaaggttatcaatgggtggatggtgtcagtctcagcttttcacattggaatcagggtgagccaaacgatgcgtggggcagagagaactgcgtgatgatgctccacacgggtttgtggaacgatgccccttgtgactctgagaaggacggctggatttgtgagaagcgccacaactgttag

SEQ ID NO: 41657 - DNA, 759 bp, Artificial Sequence
  Description of Artificial Sequence: Synthetic coding sequence
atggagcaggagagcgccctgcgggagctgcgggagcgggtgacccagggcctggccgaggcaggacgtggcagagaggatgtaaggactgagctctttagggccctcgaagccgtgagattacagaacaacagttgcgagccatgtcctactagttggctcagcttcgaggggtcatgctacttttttagtgtccccaaaacaacttgggccgccgctcaggaccattgcgcggatgcctcagctcatcttgtgatagttggcggactggacgaacaagggtttctcacgagaaacaccaggggacgcggatactggctgggactcagagcagtgcggcatctgggcaaggtgcaaggctaccagtgggtagacggagtctctctgtccttctctcactggaaccagggagagcccaatgacgcctgggggcgggagaattgcgtcatgatgctccacactggactttggaatgacgccccttgtgacagtgagaaagatggctggatctgtgaaaaagcacagttgcttacgccgccctcagcactggagcctcgacccctgcaacatgtagttagttggggcttgttaacatccctggctcctggagcggattgccaacgggttttcagttcttcctcaacagctgctgaatcccagaaacacttagcgcagcactcaccggtacagccctccgcctgggctcttggcccaccgtgcagacctcatcccaattctacacacgctgaccccacttag

SEQ ID NO: 41658 - DNA, 726 bp, Artificial Sequence
  Description of Artificial Sequence: Synthetic coding sequence
atgcacgaggaggagatctacaccagcctgcagtgggacagccccgcccccgacacataccagaagtgcctgtcatctaataaatgtagtggcgcctgctgcctggtcatggtgattagctgcgtcttctgcatgggcttgttaaccgcgagcatttttttgggcgtgaaactgctacaggtgagcaccattgccatgcagcagcaggagaagctcattcagcaagagcgggccctcctcaatttcaccgaatggaagagaagctgtgcactccagatgaagtattgccaggcattcatgcaaaattccctgagtagcgcccacaatagctcaccttgcccgaacaactggatccaaaatcgggagtcctgctattatgtcagcgagatttggtcaatctggcacactagccaggaaaactgtcttaaggaagggtccacactgctgcagatcgagagtaaggaagaaatggattttattacgggtagtctgcgcaaaattaagggttcttatgattattgggtcgggctgtcgcaggacggacatagtggaaggtggctttggcaggatgggagttcccccagccccggcctgctccccgctgagcgctctcaatcagctaatcaggtgtgtggctacgtaaaatcaaactctctgctgtccagtaattgtagcacatggaaatactttatttgtgagaagtacgcactaaggtcttctgtatag

SEQ ID NO: 41659 - DNA, 504 bp, Artificial Sequence
  Description of Artificial Sequence: Synthetic coding sequence
atggtgagcaacttcttccacgtgatccaggtgttcgagaagagcgcaacattgattagcaagacagaacacatagggttcgtgatttacagttggcgtaaaagcacaacacatcttgggagcaggagaaagtttgcgatttccatttatctctccgaagtgtcactccagaagtatgattgtcccttttccggcacatcattcgttgtgttttccttattcctcatttgcgccatggccggcgatgtcgtgtatgctgacatcaagaccgtacgcacttccccccttgagcttgcttttcctctacaacggtccgtctcttttaatttctctaccgtacacaaatcttgtccagccaaggattggaaggtgcacaagggaaagtgttattggattgctgagaccaaaaaatcctggaacaagtcacagaatgattgtgcaattaacaactcttacctcatggtgatccaggacattaccgcaatggtccgctttaatatctag

SEQ ID NO: 41660 - DNA, 108 bp, Artificial Sequence
  Description of Artificial Sequence: Synthetic coding sequence
caggacatcaccgccatgctgatcaccttcctgctgtacctgcagatggcgttcctccagtgtgtgtatatcagcgacgttagtgtgtacccaaattttttcctctag

SEQ ID NO: 41661 - DNA, 726 bp, Artificial Sequence
  Description of Artificial Sequence: Synthetic coding sequence
atgggccacaacagcaccgtggagatcatctacatcaccgaggacgatgtaatacagtctcagaatgccctgggaaagtacaatacaagcatggcactattcgaaagcaattccttcgaaaagactattttggaaagcccttattacgtggacctgaaccaaacattgttcgttcaagtttctctccatacctctgatccaaatcttgtggtattcctcgacacttgccgcgctagtcccacatctgatttcgcttctccaacctacgatcttatcaagtctggctgctcccgtgatgaaacctgtaaagtttacccactgtttggacactacggccggtttcagttcaacgctttcaaattcctgcggagtatgagctctgtctaccttcagtgcaaggtgcttatttgtgatagctccgaccaccagagtaggtgcaaccagggatgcgtgtcgcggtcaaagcgagatatcagttcttacaaatggaaaactgactccattatcggtccgatccgtctcaaaagagaccgcagtgcttctggaaatagcggatttcaacacgaaacacacgctgaggagacccccaatcagccatttaacagtgtgcatttattctcttttatggtcctggctttgaatgtcgtcaccgtggccactattaccgtgaggcacttcgtaaatcagagagccgactataaataccagaagcttcagaactactag

SEQ ID NO: 41662 - DNA, 981 bp, Artificial Sequence
  Description of Artificial Sequence: Synthetic coding sequence
atgcgggtgatcatcagcaagagctacctggaggccttcaacagcaatggaaataaccttcagttgaaggaccctacctgtcgtcccaaattaagcaacgtggtggagttttcagtacccctgaacgggtgcgggactatccgaaaagtggaggatcagagtatcacttacacgaatatcatcacattcagcgcgtccagcacctccgaggttattacccggcaaaagcaattacagataatcgtcaagtgtgaaatgggacacaatagcaccgtcgagatcatctacattaccgaagatgacgtcatacagagtcagaacgctctggggaagtataacactagcatggctctgtttgagtctaattcatttgaaaagacaattttggagagcccttactatgtcgacctgaaccagaccttgtttgtgcaggtgtctctccacactagcgatccaaatctcgtcgtatttttggacacatgccgggcctcccccacctcagattttgcttcccccacatatgatctgatcaaatctggctgttcccgagacgagacctgtaaggtctacccactcttcggccattatggaagatttcagtttaacgcgttcaaatttctgcgttctatgtcaagcgtctacctacagtgtaaagtccttatttgtgatagctctgaccaccaaagccgctgtaatcagggctgcgtttccagaagcaagagggacatcagctcttacaagtggaagactgactccatcattggaccaatcaggctgaaacgggatcgcagtgcatccggtaactcaggctttcaacacgagacccacgctgaggaaacccccaatcagccttttaatagcgtgcacctgttttcttttatggtgctcgcactgaacgtggtcactgtggctaccatcacagtgcgccactttgtaaatcagcgcgccgattataaatatcaaaagcttcagaactactag

SEQ ID NO: 41663 - DNA, 981 bp, Artificial Sequence
  Description of Artificial Sequence: Synthetic coding sequence
atgcgggtgatcatcagcaagagctacctggaggccttcaacagcaacgggaataatcttcaactgaaggatcccacatgccggccaaagctcagtaatgtggtggaattttctgtccctctgaatgggtgtggaaccatcagaaaggtggaagaccaatccatcacttataccaacatcataacattcagcgcgagttctaccagcgaggtgatcaccagacaaaagcagctgcagatcatcgtgaaatgtgagatgggtcataactccacagtggaaatcatttacataaccgaagatgatgttattcagtctcagaatgctctagggaaatacaatacctcgatggcgctctttgagagcaattcttttgagaaaaccatccttgaaagcccctattacgtggaccttaaccagaccctcttcgtgcaagtgtccctgcacaccagcgaccctaatctcgtcgttttcctggatacctgtagagcatcacctactagcgatttcgcctcccccacctacgacctaattaagtcagggtgctctagggatgaaacatgtaaggtgtaccctctatttggacattatggccgatttcaatttaacgcattcaagtttctgcgttcaatgagcagtgtttacctccagtgcaaggtgttgatctgtgacagctcagatcaccagagccgctgcaatcaggggtgtgtgagtaggtcaaaaagggacattagttcctataaatggaaaacagattccatcatcggacccattagactcaaacgcgaccgctctgcctctggtaactctggatttcagcacgaaactcatgctgaagagacacctaaccagccctttaacagcgtccacctgttctctttcatggtgcttgctctgaatgtagttaccgtcgcaaccattactgttcgccatttcgtgaatcagcgcgcagattacaaataccagaagttgcagaattactag

SEQ ID NO: 41664 - DNA, 981 bp, Artificial Sequence
  Description of Artificial Sequence: Synthetic coding sequence
atgcgggtgatcatcagcaagagctacctggaggccttcaacagcaacggtaataatctccagctgaaggatccaacatgtcgaccaaaattgtccaacgtcgtggaattctctgtcccactaaacggttgtggtactatccgtaaagtcgaagatcaatctatcacatatactaatattattaccttcagcgcatcatccacatctgaagtcattacaagacagaaacagcttcagattattgtgaagtgcgaaatggggcataacagcacagtggaaatcatttacatcacggaggacgacgtgatacagtcccagaacgccctggggaaatacaacaccagtatggcactattcgagtctaatagcttcgagaagactattcttgagtcaccctattatgtcgatctaaatcaaacactctttgtgcaggtgtcgctgcatactagtgacccaaatctggtggtttttttggacacttgccgggctagccctacatcagacttcgctagccccacgtacgaccttataaagtcaggttgctccagagacgagacttgcaaagtgtaccccctgtttggacattatggacggtttcagttcaacgcctttaagtttcttcgctcaatgtcctccgtgtaccttcaatgcaaggtcttgatctgtgacagctctgatcaccaatcgcgttgcaaccagggctgcgtttcacgatccaagagggacatcagttcctataagtggaagaccgattctattatcggtcccattcggctgaagcgggatcggtccgccagtggaaatagcggatttcaacacgagacccacgctgaggaaacccccaaccagcccttcaactccgtgcacctgttctcgttcatggtgctcgccctcaacgtggtaaccgtggccactattacggtgcggcacttcgtgaatcagcgggcagattataaatatcagaaactccagaactattag

SEQ ID NO: 41665 - DNA, 1824 bp, Artificial Sequence
  Description of Artificial Sequence: Synthetic coding sequence
atggagctggtgcggcggctgatgcccctgaccctgctgatcctgagttgtctggccgaactgaccatggctgaagccgagggcaacgcatcttgtaccgtgagtctgggaggagccaacatggctgaaacccataaggcgatgatcctgcagctcaacccctccgagaattgtacatggacaatagaacggccggagaataagagtatcaggattatcttctcctatgtgcagctcgatccagacgggagttgtgagagcgaaaacattaaggtcttcgacgggacttcatcgaacggtcctctgctgggccaggtttgttctaagaatgattatgttcctgtgttcgaatcatctagcagcaccttgacctttcaaatcgtcaccgactcagcgcgcattcagcggactgtctttgtcttctactactttttttctcccaacatctctattcctaactgtggggggtatctggatacacttgagggaagtttcacatccccgaattacccgaagccgcaccctgagctagcctactgcgtgtggcatatacaggtcgaaaaggattacaaaattaagcttaattttaaggaaatctttttggaaatcgacaaacagtgtaaattcgattttctggccatctacgatgggccttccactaacagcggcctgatcggacaggtctgcgggagggtcaccccaacctttgaaagtagctcaaactctttgaccgtggtgctctccactgattatgctaatagttatagaggcttttccgcctcatacacctctatctatgctgaaaacataaacactacctccctcacctgctcctctgaccgtatgcgcgttataatcagcaaatcttatcttgaagcgttcaatagcaacgggaataacctgcagttgaaagatccgacttgtcgacccaaattaagcaacgtagtagaattttctgttcctctgaacgggtgtggaacaatcaggaaagttgaggatcagtcgattacctatacgaacattatcaccttcagtgcctcttccacatcagaagtcattactcgccaaaagcaacttcaaattatcgtgaagtgcgaaatgggacacaacagcactgtcgagatcatctacataactgaagatgacgtcattcagagtcagaatgcactaggcaaatacaacacctccatggcactctttgagtccaacagcttcgagaaaactatcctggaaagcccttattacgtggaccttaaccagacactgtttgtccaggttagtcttcacaccagcgaccctaacttggtagtctttttggacacatgccgggcatctccgacatcagatttcgcttcgccaacctatgacctgatcaaaagtggctgctcccgggacgagacttgtaaggtctaccccctgttcgggcattatgggaggttccagttcaatgcctttaaatttctgcgctctatgtcctccgtgtacctccagtgcaaagtccttatatgcgacagcagcgaccaccagtcaaggtgcaatcagggttgtgtgagtaggagcaaaagggacattagttcatacaagtggaaaactgacagcatcatcggcccgattaggctgaagagagaccgatcagcaagcggcaatagtgggtttcagcacgagacccacgcggaggagacacctaaccagccattcaattccgtgcacctgtttagcttcatggtgctggccctgaacgtggtgactgtggcaaccattacagtgagacatttcgtgaatcaaagggccgattataaataccaaaagctacagaactactag

SEQ ID NO: 41666 - DNA, 2238 bp, Artificial Sequence
  Description of Artificial Sequence: Synthetic coding sequence
atgcggcccgacagccacccctacggcttcccctgggagctggtgataagggcagccgtggcaggcttctttgccgtgttatttctgtggagaagttttagaagtgtcacaagccgactttatgtgcgcagggaaaaaaagttcgctgtggctctgtcgggcctgatcgaggagaagtgtaaattattggagaagttttctctagtccagaaagagtatgaaggttatgaagttgaatcaagcttaaagaacgccagctttgagaaggaggccaccgaagcccagagcctggaggccacgtgtgaaaagctcaaccggtttaatagcgagctcgtccacgagattttatgtctggagaaggaactgaaggaagagaaaagtaaacacagcgagcagaatgaactgatggcagatattagtaaacgcatacaatcacttgaagacgaaagcaagagtttgaagagccaggtagccgaggcaaagatgaccttcaaacgcttccaagcaaatgaagagcgacttgaaatcgagattcaagacgcctggaaggaaaattctgagctgcaggagagtcagaaacaacttctgcaggaagctgaagtttggaaagagcaggtatctgagttgatcaagcagaagcggacattcgaggactccaaagttcatgccgagcaggtgttaaatgacaaggagaaccatattaaaaccctgaccgagagactgttaaagatgaaggatggggtggccatgttagaagaagatgtgactgacgatgacaatctggagctcgaaatgaattccgagagtgaagacggcgcatatctagacaacccacccaaaggggcactcaagaaactgatccatgcagctaagctgaatgctagtctgaagacattggagggcgaacgaaaccagatttacattcaactcagtgaagtcgacaagactaaggaggagttgactgaacacatcaagaatctgcagaccgagcaagccagcctccagtcagaaaatactcatttcgagtctgaaaaccagaagcttcaacagaagttgaaggtgatgactgagctctatcaggagaacgagatgaagctgtatagaaagttgattgtggaagagaagtgcagattagaaaaagaggagaaactttcgaaagtggacgaaatgatatcccacgctaccgaggaactcgagacatacagaaagagagcgaaagacctgaaagagttcgaaaagacaattcacttttatcagaagaagattatcttgcacgaaaagaaggcccacgacaattggtctgcggcttggactgccgagaggaacctcaatgaccttcggaaagagaatgcccataacaggcagaagttaacagagattgagttcaaaataaagctgctcgaaaaagatccctatggcctggacgtgcccaacacagccttcggcaggcagcattcaccctatggccctagcccactaggttggccttcctccgaaaccagagcttctctgtatccaccaaccctcctggaagggccgctgaggctgagtccccttctgccacggggcggcggaagagggagtcggggccccgggaatccgcccgaccaccagatcactaaggaaagaggagagtcatcttgtgacaggcttaccgatccacacagggcccctagcgatgctggccctctggcccctccttgggagcaggattatcgcatgatgttccccccgccaggtcagagctacccagatagtgcactccccccacaacgccaggaccggttttacagtaactgtgctcgccttagtgggcccgccgaactgaggtccttcaacatgcctagcttggacaagatggatggctcaatgccaagcgagatggaaagtagcaggaacgatacaaaggataacctgggcaatctgaaggtccccgactcctccctgccagcagagaacgaggctacaggtcctgggtttgtgccccctcccctggcccccattcgtggcttgctgttcccggtggatactaggggcccgttcatccgcagaggaccaccgtttccccctcctcctcccgggacagtcttcggagcctcaccggactatttcagtcccagggacgtgccgggtcctccccgggcccccttcgcgatgagaaacgtctatctgccacgtgggtttctgccatatcgaccccccaggcctgccttctttccgcctgcccccactttttag

SEQ ID NO: 41667 - DNA, 225 bp, Artificial Sequence
  Description of Artificial Sequence: Synthetic coding sequence
atgttcgtgatcatcagcctgcacaactgcgtggtgatcagcttcgtgcttttcctattcggaggcaataattttattcagaatttctatctgcctcaaaactacattgaccagtttctgctgacaagtttcccgacattcacatcggtgggagtgctgatcgttctggtcctgtgctctgccttcctgttactctggcaaggtgagggggtgaacctgagatag

SEQ ID NO: 41668 - DNA, 4518 bp, Artificial Sequence
  Description of Artificial Sequence: Synthetic coding sequence
atgctgtgcgtggccggcgcccggctgaagcgggagctggacgccaccgccacagtgctagccaaccgccaggatgaatcagagcaaagccggaagaggttgatcgaacaaagccgcgagttcaaaaaaaataccccagaagatctgcgaaagcaggtagcaccgcttctcaagtcttttcagggcgaaatcgacgccttgtccaagcgcagcaaggaggcagaagcagccttcctcaacgtgtacaagcggctgattgatgtacccgaccctgtcccggccttggacttgggacagcagctccaacttaaagtccagcgactacatgacattgagacagagaaccagaaactgcgagaaaccctcgaagagtacaataaagaatttgctgaggtgaagaaccaggaagtcacaatcaaggccctgaaggaaaagatccgggagtacgagcaaacactaaaaaaccaggccgagaccattgcactcgagaaagagcagaagctccaaaatgactttgctgagaaggagcgcaaactccaggagacccagatgagcaccacatctaaactagaagaggccgagcataaagtgcagagcctgcagaccgctctggaaaaaacgcggactgaacttttcgatctcaaaacaaaatacgacgaggagaccaccgctaaggccgacgagatcgaaatgataatgaccgatctcgaaagagcaaatcaacgcgccgaggtagctcaaagagaagcggagacattgcgtgaacaactatcatccgccaatcactctctccagcttgcttcccagatccagaaagctcccgacgtcgaacaagccatcgaggtccttacccggtcaagccttgaagttgaactggctgccaaggagcgcgaaatcgcgcaactggttgaggacgtccagcggctgcaagctagcttgacaaagctacgggaaaactccgcatctcagatttcccagttggagcaacaactatctgctaaaaattctaccctgaagcagcttgaggagaagctgaaagggcaggccgactatgaagaagtaaagaaagagttgaatattctcaaatctatggagttcgcaccttctgagggcgcaggcactcaggatgctgcaaaacccttagaagtcctgctactggaaaagaacagatctctccagagcgagaatgccgccctgcggatctctaactccgacctgagcgggtctgcaagacgaaaagggaaggatcagcccgaatctaggcggcctggttctctcccagctcctccgccctcacagctgcctaggaatcctggtgagcaggcctctaatacaaacggaacacaccagttcagtcctgcagggttatcccaggactttttttctagcagcctggcctccccatcgctccccttagcctctacaggaaagttcgcgttaaattctttgctccagaggcaactgatgcagtccttttattctaaagccatgcaagaagctgggtcaaccagtatgatattctccaccggaccttacagtaccaactccataagttcccaaagtcccctgcagcagtctcctgatgtcaacggaatggccccatcaccttcccagtccgaaagcgccggttctgtgtctgaaggtgaggaaatggacaccgcagagattgcccgccaggtcaaggagcagttaatcaaacataatattggacagcgcatcttcggccattacgtgttaggtctgagccagggtagtgtgtctgagattctagcaaggccaaaaccctggaataagctcacagtgaggggcaaggaacccttccataagatgaaacagttcttatctgatgagcagaatattctggcactgcggtctatccagggcaggcaacgggagaaccctggccaaagcctgaaccggctgtttcaagaagtgcctaaacgtcgtaatggctctgaagggaacatcaccacccgaatccgagcctctgaaaccggctcggacgaggcaattaagtcaattctggagcaagccaagagagagctgcaggtacagaaaactgccgagcccgcccagccatcttccgcatccggctccggcaatagcgacgacgccattagaagtatcctgcaacaggcacgaagggagatggaggcacagcaggctgcacttgatcccgctcttaaacaggctcctctgtcccagtctgatattactatcttgacaccaaaactactgtctacctctcctatgccgacagtatcaagttatccaccgcttgctatcagtttgaagaagcctagtgccgcccctgaggccggagcgagcgctttgcccaaccccccggccctcaaaaaagaggcgcaggatgcacccggtctggaccctcagggtgcagccgattgcgctcagggcgtcctcagacaggttaagaacgaggtgggtcggtccggtgcctggaaagatcattggtggagcgctgtgcagcctgaacggcgcaatgctgctagctctgaggaagccaaggccgaagaaacaggcggaggcaaggagaaggggtctggtggtagcggcgggggttcacagcccagggctgaaagatcacagctgcagggccccagctctagtgaatactggaaggagtggccatccgcagagtcgccatatagccagtcgagtgagctgtctctcaccggcgctagcaggtccgaaacccctcagaacagccccctgccgagttcacctattgtacctatgtcaaaacccactaagccttccgtgcccccgctgacccctgagcagtatgaggtgtacatgtaccaggaggtggatacaatcgaactgacacggcaggtgaaagagaagcttgctaagaatggcatatgtcagagaatcttcggggaaaaagtgctgggactctcgcaggggtcagtttcagatatgctgtcaagaccaaaaccttggagcaagctcactcagaagggcagggagccttttattcgcatgcagctgtggctgaatggagaactgggtcagggcgttctgcctgtgcagggacagcaacagggacccgtgctacattccgttacaagcttgcaggatcctcttcaacagggttgcgtgtcaagtgagtcaactcccaagacatctgcttcttgttcacccgcacccgagtccccaatgagttctagcgagtccgtgaaaagtcttacagaactggtccagcagccttgcccgccaattgaagcgtccaaggatagcaaacctcccgagccatctgaccccccagctagtgatagccagcctaccacccctctccctctgagcggacactcagccctgtccatccaagaactggtggctatgagcccggagctggatacctacgggataacaaagcgagtgaaggaggtccttactgacaataatcttgggcagcgtctttttggggagaccatcctcggccttactcaagggagcgtgagcgacctgctggcacgccctaagccttggcataaactctccttgaagggtagagagccatttgtgcggatgcagttatggttgaatgaccctaacaatgttgaaaagctgatggatatgaaaaggatggaaaaaaaggcctatatgaaacgaagacatagcagtgtctcagatagccagccttgcgaaccgcctagcgtcggtactgagtatagtcagggcgcgtctccgcagccccagcaccagctgaagaagccccgcgtagtcctggccccagaagagaaagaggccctgaagagggcctaccagcagaagccttacccctctcccaaaaccattgaggacctggcaacacagctgaatttaaagaccagtacagtgattaactggtttcacaattaccggtctaggatccggagggagcttttcatcgaggaaattcaggccggcagccagggccaggctggagcgagtgactccccgagcgctcggtctggccgggccgcgccctcctctgagggggatagttgcgatggcgtcgaggccaccgagggcccgggcagcgcggacaccgaggagccaaagtcccagggagaggctgaaagggaggaagttccccgacccgccgaacagaccgaacccccccccagtgggactcccggaccagacgatgccagggatgacgaccacgaaggaggccccgtcgagggccctggtcccttgccaagccccgcctcagcgaccgccaccgccgccccggcagcacctgaagacgctgccacctctgcagctgccgccccaggagaaggtccagcagcacctagctccgctccgcctccttcaaacagctcctctagctcagctccaagacggccaagttctctgcagtctctgtttggactgccagaagccgcgggagcccgagactcgcgcgataacccattacgaaagaagaaagccgccaacctgaacagcataatccacagactcgagaaggccgcttcccgagaggaaccgatcgagtgggagttctag

SEQ ID NO: 41669 - DNA, 2037 bp, Artificial Sequence
  Description of Artificial Sequence: Synthetic coding sequence
atggccgccaacgtgggcagcatgttccagtactggaagcggttcgatctgcagcagctgcagagagaactggatgccactgcgactgtacttgcgaacagacaagatgagtcagagcagtctagaaaacggcttatcgagcagtcgagagaattcaagaaaaacacgccagaagacctcagaaagcaagtagcacccctattgaagtctttccagggcgagattgacgctctgtccaagcggtctaaagaggccgaggctgcctttctcaatgtgtacaagagattgatagatgtgccagatcctgtcccagccctggacctgggccaacagttgcagctgaaagtgcagagactccacgacattgagacggagaaccagaagctgcgcgaaaccctcgaagagtacaacaaggaatttgccgaagtcaagaatcaggaggtgactatcaaagctctgaaggaaaaaatcagagagtacgagcagacgttgaagaatcaggcggagactatcgcacttgaaaaagaacagaagcttcagaacgactttgcagagaaagagaggaagttgcaggaaactcagatgtctacaacctccaagctagaggaagccgaacacaaggtacagtcactgcagacagctctggaaaaaactaggactgaacttttcgacctaaagacaaaatatgatgaggaaaccacagcaaaggctgacgaaattgaaatgatcatgaccgaccttgagagagccaatcagagggccgaggtggcccagcgagaggctgagactctgcgggagcagctctcgtctgctaaccacagcttgcagctggctagtcagatccagaaagcacctgatgtggagcaggccatagaggtcctcacacgctcatccctcgaggtcgagctcgcagcgaaggagcgggaaattgcccagttagtcgaagacgtccagcggctccaggcctcattgacaaagctgagagagaactccgccagccaaatttcacagctggaacaacagctaagcgccaaaaactcgactcttaagcagctggaagagaaactgaaagggcaagcggattacgaggaagtcaaaaaagagctgaacatccttaaatctatggaattcgcacccagcgaaggcgctggcacacaggatgccgccaagccgctggaagtgcttcttctggagaagaatagatctctgcagtccgagaatgcagcgcttcggatcagtaatagcgacctcagcgggcgatgcgcagagcttcaagtccgtatcacagaagccgtggccactgctaccgagcagcgcgaacttatcgccaggcttgaacaggatctgtccattattcagtctattcagcgacctgacgccgaaggtgctgccgaacaccggctcgagaaaatccctgaaccgatcaaggaagcgacggccctgttttacggaccggccgctcccgcctctggtgcattgccagaaggccaggtagactccttgctttccataatcagtagccagcgagagcgttttcgagctagaaaccaggagcttgaggccgagaatcgcttagcgcaacacaccttgcaggccttgcagtcagagctggatagcctaagggccgacaacataaaactttttgaaaaaataaagtttctccagagctaccctggccggggctctgggtctgatgatactgaactacgatattcttcacaatatgaggagcggctcgacccgttttcttctttcagcaagcgcgagcgacaacgaaaatacctgtcactgtccccctgggacaaggcaactctgtctatgggcaggttggtcctttcgaataaaatggctaggaccatcgggtttttttatactctgttcctgcactgcctggtatttctggtgctgtacaaacttgcctggtctgagtccatggagagggattgtgccacattctgtgctaagaaatttgctgaccacttgcataagttccatgaaaatgacaatggagcagctgcgggcgatttgtggcagtag

SEQ ID NO: 41670 - DNA, 4551 bp, Artificial Sequence
  Description of Artificial Sequence: Synthetic coding sequence
atggccgccaacgtgggcagcatgttccagtactggaagcggttcgacctccagcaactgcaaagggagctggatgccaccgccacagtactcgccaatcgtcaggacgaaagcgaacagtcaaggaagcgccttatcgaacagagtagggaatttaagaagaatacccccgaggacctgagaaagcaggtggcccctctccttaagagcttccagggcgagatcgatgcgctttctaaaaggagcaaggaagccgaagctgcttttctcaacgtgtacaaacgcttgattgatgtccctgaccccgttcccgccttggaccttggtcagcagcttcagttgaaggtacagaggttgcacgacatcgaaacggagaatcaaaaactgcgagagacactggaagagtataacaaagaatttgctgaggtaaagaatcaggaagtaaccattaaggcgcttaaggagaagatccgggagtacgaacagactctgaagaaccaggctgagaccatagccttagagaaagagcaaaaactccagaatgattttgctgaaaaagagcgcaagttgcaggaaactcagatgtcaaccacttccaagctggaggaggccgaacataaggtgcagagcttacaaaccgcactggagaagactcgcacagagctcttcgacctcaaaacaaagtacgacgaagagacgacagcgaaagcagatgagattgagatgattatgaccgatttggaaagggcaaaccaacgagccgaagttgcacagagagaggcagaaacactaagagagcagctgtcatcagctaaccactccctgcaacttgctagtcagatccagaaagctcccgatgtagagcaggccattgaggtgctcacaaggtcttcactcgaggtggagctggcggcgaaggaaagagaaatcgcccagctggtggaagatgtgcaacgcctccaggcatcactgacaaaattacgggagaattcagcatcccagatcagccagcttgagcagcaactgtctgctaaaaactctacactcaagcagctggaggaaaagcttaagggacaggccgattacgaggaagtgaagaaagagttgaatatactgaaaagcatggagtttgccccatccgaaggcgccggcacccaggatgctgctaaaccccttgaagttctgttgcttgagaagaaccggtcgctgcagtcagaaaatgctgcacttcggatttcaaactccgatctatctggttcggctaggagaaaagggaaagaccagcctgagtcaagacggcctggaagcctgccggctccccctccgtcccagctgcccagaaaccccggggaacaggctagcaacaccaacggcacacaccaattctctcccgccgggttatcccaagacttttttagttccagcctagccagtcccagccttcctctggccagcacaggaaagttcgccctcaactcgttgctgcagcgccaattgatgcagagtttttatagcaaggcaatgcaagaagctgggagtacatctatgatcttttctacgggaccctactctactaactcaatctcttcccagagtcccctccagcagagcccagatgtaaatggtatggcgccctccccaagtcagtccgaatcagctggttcggtcagtgaaggtgaggaaatggacaccgccgaaatcgccagacaggttaaggaacagctcattaagcacaacattggccagagaattttcggccactatgtcctgggtctgtcacagggcagtgtgtctgagatcttggccaggccaaaaccatggaataagctgaccgtgaggggcaaggagcctttccataagatgaagcagtttctctcagacgaacagaacatcctggccctccgcagtatccagggccgccagcgggagaacccaggccagtcactcaaccgcttattccaagaagtccccaagcgcaggaacggctccgaaggcaacattacaactcggatccgggcctccgaaacaggaagcgatgaggcaatcaaatcgatcctcgagcaagctaagcgggagctgcaggtgcagaagacagcggagcccgcacagccaagtagcgcgagcggctccggaaattctgacgatgccattcgctccattctgcagcaggctaggagggaaatggaagcacaacaagccgccctggatcccgccttaaagcaggccccactgtctcagtcagacattaccattctgacccctaaactccttagtacctctcctatgcctaccgtctccagctatcctccgctggctatcagtctgaagaaaccatcagctgcacccgaagcgggggcatccgcactccctaacccgcccgcacttaaaaaggaggcccaggacgctccgggtctggacccgcaaggggcagccgactgcgcacagggagtcctgagacaggtcaagaacgaggtaggccgctccggcgcttggaaagaccactggtggagcgcagtacagccggagaggcgcaacgccgcatcgagtgaagaggccaaagctgaggagaccggcggtggtaaagaaaaagggagcgggggctcaggcgggggctctcagccacgcgctgaaagatcccagctccaggggcccagctcttctgagtactggaaggaatggccaagcgctgagtcaccttatagccagtcctctgagctatctctcactggggcttcaaggagtgagacccctcagaattcccccctgcccagttcacccattgtgcccatgtctaagcctacaaaacccagtgtccctcccctgacccctgagcagtatgaggtgtatatgtaccaggaggtggacacaatcgagttaacacggcaggtgaaggagaagctcgcaaagaacggcatatgtcagagaatcttcggggagaaggtcctggggctctctcagggctccgtgtctgatatgctctcccgcccgaaaccttggagcaagctgacgcaaaaaggccgagaaccttttatccgtatgcagctctggctcaacggggagctgggacagggtgtcctgccagtgcagggccagcagcagggccctgtgttacattcggtcacctcattacaggaccctctccagcagggatgcgtctccagcgagtctactcccaagactagtgcctcatgcagccctgcccccgagagcccaatgtccagtagtgaaagcgtaaaatcgttaacagagctggttcagcaaccctgtcctcctatcgaggccagcaaggacagcaaacctcccgaaccgtctgatccccccgctagtgactcgcagccaaccacacccctgcccctgtccggacattctgccttgagtatccaggaactcgtcgctatgtcacccgagttggatacttatgggattaccaagcgggtgaaagaggtgctgactgacaacaacctagggcagcgcctgtttggggaaacgattctaggtcttacgcaagggtccgtgagcgatctgctggctcgtccaaaaccctggcacaagctgagcctgaaaggtcgagaaccatttgtgaggatgcagctgtggcttaacgacccaaacaatgtggaaaaactgatggacatgaaacggatggagaagaaggcctacatgaagcgaaggcatagcagtgtgagcgactcccaaccatgtgaacctccatcggttggaaccgaatactcccagggcgcgagtcctcagccacagcaccagctcaagaagccgagagtagtccttgcacccgaggaaaaggaggcactgaaacgggcttaccaacaaaagccatatccatcaccgaagacgatagaagacttggcaacgcagctcaacctgaaaaccagcacagtgatcaattggttccataactataggtctcgaatacgtagggagcttttcatcgaggagatccaggccgggagtcaaggccaggctggtgccagtgattcaccctcagctcgaagtggaagggctgcacctagctctgagggcgacagctgtgacggagttgaagcaacagaaggtccaggctctgccgatactgaagagcccaaatcacagggggaagccgaaagggaggaggttccccgacctgccgaacagaccgaaccccccccttctggtacgcccggaccagatgatgcccgcgacgacgaccatgagggtggccctgtggaggggccgggcccgcttccttcaccggcaagcgctacagcgacagcagctcctgcagcacccgaggacgctgccacatctgccgccgcagctcccggagaaggcccagcggctccgagctccgcgccacccccctcgaattcctcctctagcagcgcaccacgcagaccctccagcctccagtccctctttggcttaccggaagccgcgggggctagggacagtcgcgataacccacttaggaaaaagaaggccgcaaatctcaatagcatcattcatcggctggaaaaggccgctagccgcgaagaaccgatagagtgggaattttag

SEQ ID NO: 41671 - DNA, 1920 bp, Artificial Sequence
  Description of Artificial Sequence: Synthetic coding sequence
atggccgccaacgtgggcagcatgttccagtactggaagcggttcgatctacaacagttacaggacttgcgcaaacaggtcgctccacttctgaaatcgttccagggtgaaattgacgccttgtcgaaacgctccaaagaggctgaggcagcattcctaaatgtgtacaagcgtcttattgacgtccctgatcctgttccagcacttgatctgggtcagcagttgcagttaaaggtccaacggctccacgacatcgaaacagagaatcagaaactaagggagacattggaagaatataacaaagagtttgcagaggtgaaaaaccaggaagtgactatcaaggcactcaaagagaaaatccgggaatacgagcagaccctgaaaaatcaagcagaaacaattgccctggaaaaagaacagaaactgcaaaacgacttcgccgaaaaagagcggaagctgcaggagactcagatgtccactacctctaaactggaggaagcagagcataaagtgcagtcgctacagaccgctctggaaaagactcggacagagctctttgacctcaagacaaagtatgacgaagagacgactgctaaagccgacgaaattgagatgatcatgacagatttagagagagccaaccagcgcgccgaggtagcccagcgggaagccgagacactaagggagcagcttagcagtgctaatcatagtttacaactggccagccagattcagaaggcgccggatgtggccatcgaggtgctgacacggtcatctctcgaggtcgaacttgcagctaaagagagggagatcgcccagcttgtcgaggatgtacagagacttcaggcgtctctcacgaaattgagagagaattccgcatcgcagatttctcagctcgagcaacaactgtcagccaaaaactcaacactgaaacaactcgaggaaaaactaaaaggacaggccgactacgaggaagttaagaaggagttgaacatccttaagtccatggagttcgcccctagcgaaggggccgggacccaagatgcagccaaaccgctcgaggtgctcctgctggagaagaataggagcctccagtctgaaaacgccgcgctcaggatcagcaactccgatttatcgggacgatgtgccgaattacaagtgcgcatcacagaagctgtcgccaccgcaacagagcagcgggagctcatagcgcgccttgaacaggatctgagcatcatacaaagcatccagcggcctgacgctgagggggcagcggagcataggttggagaagattcctgaacctatcaaagaagccaccgcccttttttatggccccgcagcacccgcgtctggagctctacctgagggacaagtcgactctctgctatctatcatttcgtcccaaagggaacggtttcgggcccgaaatcaggaactggaggcggagaatcgtctggcccagcacacgctgcaggccctccagtctgaactggattcgctccgggccgataacatcaagttgttcgaaaaaattaagttccttcagagttacccgggacgcggatccggctccgatgacaccgagctgcgctactcttctcagtatgaagaacggctcgatccgttttcaagctttagtaaaagagagcggcagcggaaatacctttcactcagcccctgggacaaagctaccctgtctatgggaaggctggtcttgagtaacaagatggcccgcactattggattcttctatactcttttcttacactgtctcgtcttcttggttctctataagctcgcctggagtgagagcatggaaagggattgtgcaacattttgcgcgaaaaagttcgctgaccatttgcataagttccacgaaaatgataatggcgctgctgccggcgatctgtggcagtag

SEQ ID NO: 41672 - DNA, 1899 bp, Artificial Sequence
  Description of Artificial Sequence: Synthetic coding sequence
atggccgccaacgtgggcagcatgttccagtactggaagcggttcgaccttcaacagctacagcgggaactagacgcgacagccactgtgctagcaaaccggcaagatgaaagcgaacaaagtcgaaaacggttgattgagcagtcccgagaatttaaaaaaaatacccctgaggacctgcgaaagcaggttgcccccctgctgaaaagcttccaaggcgagattgatgccctgtccaagaggtctaaagaggctgaggccgcgttcttaaatgtctacaagcgattgattgatgtaccggaggtcacgatcaaggctttgaaggagaagatccgggagtatgaacaaacccttaagaatcaggctgaaacaatcgccctggaaaaggagcagaagctgcagaacgactttgccgaaaaggagcgcaaactgcaggagactcagatgtctacaacgagcaagcttgaggaagcggagcataaagttcagagtctacagaccgctcttgagaagacgaggactgaattatttgacctgaaaacaaaatacgatgaagagaccactgctaaggctgatgaaatcgagatgattatgactgatttagaacgggccaaccaaagagccgaggtcgcgcagagggaggcggaaactttaagggagcagcttagttcagccaatcatagcctgcagctggcctctcaaatccaaaaagcgcccgatgtggagcaggccattgaggttctaacccgttcttccttagaagttgaactggccgccaaggagcgggagatagcacagctggtcgaggacgtccagaggctccaggccagtctgacaaagctccgcgagaactctgcatctcagatttcccagcttgagcaacagctttctgccaagaactctactctaaagcagctggaggagaagctcaaaggccaggcagattatgaagaagttaaaaaggagttgaacatactcaagtccatggaattcgctccttccgaaggggccggtacccaagacgccgccaaaccactggaggttttgctcctggaaaagaaccgatccctgcagtccgagaacgccgcattgaggattagtaattcggatctgagcggtcgctgtgcagagctgcaggtacggataactgaagctgtggcaacagcgactgagcagcgtgagctgattgcaaggctggaacaggatctgagcattatccagagtattcagcggccagatgctgagggcgctgccgaacacagactggaaaaaatccctgagcctattaaggaagctaccgccctgttttacggtccagccgcccccgcgtcaggagccctgccggaaggtcaagtagactcattattatccattatcagtagtcaacgggaacggtttagggccagaaaccaggagctcgaggcagagaaccggctcgcccagcataccttgcaagcattgcagagtgaacttgatagccttagagcagacaatattaagctgttcgagaaaatcaaattcctccaatcataccccggacgcgggagcggctctgacgacaccgaactcaggtatagctcgcaatatgaggaaagactggaccctttcagctccttcagtaaacgtgagcggcagaggaaatacctgtcactgtcaccctgggataaggcaaccctttctatgggtcgtctggtgctgagtaacaagatggcacgaacaattgggttcttctatactctgttcctgcattgcttagtgtttctggtcctgtataaactggcatggagcgagtccatggaacgagattgtgccactttttgtgccaagaaattcgccgaccacttgcacaaatttcacgagaacgacaacggggcagcagccggagacctctggcaatag

SEQ ID NO: 41673 - DNA, 2031 bp, Artificial Sequence
  Description of Artificial Sequence: Synthetic coding sequence
atggccgccaacgtgggcagcatgttccagtactggaagcggttcgacctccaacagctccagcgtgagctggatgcaaccgctactgtgctggctaaccgacaagacgaaagcgaacagtcgcgaaagaggctcattgaacagtctagggagtttaagaagaacacaccagaagaccttaggaagcaggtggcgccacttcttaagagctttcagggggagatcgatgccttatccaagcgatcaaaagaagcagaagcagcatttctcaacgtatataaacggttaattgatgtgcctgatccagtccctgccttagacctagggcagcagttgcagctgaaggtccagagacttcatgacattgagacagaaaaccagaaattgagggaaaccctcgaggaatacaacaaagagttcgctgaagtgaaaaaccaggaggtgaccattaaggctcttaaggagaagataagagaatacgaacagacactaaagaaccaggccgaaaccattgccctggaaaaagaacagaagcttcagaacgacttcgcggaaaaggagcgcaagctgcaggaaacgcagatgtcaactacctctaagcttgaggaggctgagcacaaggtccaatccctacaaaccgctttggaaaagactcggactgagctgttcgatctcaagaccaaatacgacgaagagacaacagcgaaggctgatgaaatcgaaatgattatgaccgatctggaaagggctaatcagcgcgcggaagtagcgcagcgagaagccgagacactcagagaacagctgtccagcgctaatcactctctccagctcgcctcccagatacagaaagcacctgatgtggccattgaggtcttgaccagatcgtcgctcgaggtcgaactggctgccaaggaaagggaaatcgctcaacttgtggaggatgtacagcgacttcaggcaagtttgacaaagctcagagaaaatagcgcctcccagattagtcagctggaacagcagttgtcagccaagaactccaccctcaagcagctcgaggagaaattaaaaggccaggccgattacgaagaagttaagaaggagctgaacatactgaagtctatggagtttgctcccagcgagggtgccggtacacaggacgccgccaaaccactggaagtgttgctcctggaaaaaaataggtccttgcagtccgaaaacgcggctctgcgcattagcaacagcgatctgtccggccgttgtgctgaactccaagtgcgcatcactgaagccgtggcaactgcaacagagcaaagggagctgattgctcggctggaacaggacctctcaataatccagagcatccagagacctgacgcagaaggtgccgccgaacaccgcctggagaagattcccgagcctataaaggaggctaccgcgctcttctatggcccggcggcccctgcatccggggctctccccgagggtcaagtcgacagcctgctatcaataatctctagtcagcgagaacgcttcagggcccgcaaccaggagctggaggcggagaaccggttggctcagcatacacttcaagcgctgcagagcgaactcgacagcctgcgagcggacaacattaagttattcgagaaaatcaaatttctgcaatcataccctggccggggcagtgggagtgatgataccgaattgcgctatagcagccagtacgaggagagactggatccctttagttcattttcgaagcgggagcggcaacgaaaatatctgtctctgagcccctgggacaaagcgacgctctccatgggcagactggtgttatccaacaaaatggcaaggactatcgggttcttttacacattatttttgcactgtctggtgttccttgtactgtataaactggcctggagcgaaagtatggagcgcgactgtgcgacattttgcgccaagaagtttgccgatcatctgcataaatttcacgaaaacgataatggcgcagctgctggagacctgtggcaatag

SEQ ID NO: 41674 - DNA, 4212 bp, Artificial Sequence
  Description of Artificial Sequence: Synthetic coding sequence
atgctgtgcgtggccggcgcccggctgaagcgggagctggacgccaccgccaccgtcctggctaaccgacaggacgagtcagagcagagccgaaaaagacttatcgaacagtcccgggagttcaagaagaacacccctgaagacctgagaaaacaggtggcacccctcctgaagagctttcagggagagatcgatgctctgtctaagcggtccaaagaagccgaggcggcgtttttaaatgtctataagcgtttaatagatgtcccagaccccgtgcctgctcttgatctgggccagcaacttcaactgaaagtgcagagactccacgatatcgagaccgagaatcagaaactcagagaaacacttgaggagtacaacaaagagttcgccgaggtaaagaaccaagaggttactatcaaggcactcaaggagaagattagagaatacgaacagacactgaagaatcaagccgaaacaatcgccctcgagaaggagcaaaaactgcagaacgattttgcggagaaagaacgtaagctgcaagagacccagatgtctacaacgtctaagctagaggaggccgaacataaggtgcagagcctgcagacagccctggagaagactagaaccgagctgtttgaccttaaaactaagtacgacgaagagacaaccgctaaagcggacgaaatcgagatgattatgacagatctggaacgagctaatcagcgtgcagaagtcgctcagagggaggctgaaacgctgagagagcagctgagcagtgcgaatcactccctgcaactggcttctcagatccagaaggcaccggatgtagagcaagccatcgaggtgctgacccggtcgtctctggaagtggagcttgccgccaaagagcgcgagatcgcccagctggtggaggacgttcaacggcttcaggcgtccctaacaaagttgcgcgaaaattctgcttcccaaatatcgcagctggagcagcagctgtctgccaaaaactctaccctaaaacagctggaagaaaaacttaagggccaagcagactatgaggaagtcaagaaagaattgaatatactaaagtcaatggagttcgcccccagcgagggggcaggtactcaggatgcagccaaacctctggaggtgttgctcctggagaagaatcggtctctacaaagcgagaacgccgcccttaggatctccaacagtgacctcagtggtccttattccacgaactctatttccagccagtctcctctgcaacaatctccggatgtgaacggcatggctccatcaccaagtcaaagtgagtcagccgggtctgtctccgagggggaggaaatggatactgctgaaatcgcccgccaggttaaggaacagttgatcaaacataacattggtcagaggatctttggccattatgtgttaggcctatcacagggaagcgtttcagagatcctggcgcgaccgaagccttggaacaagctcacagtcaggggcaaggaaccatttcacaaaatgaagcagtttctgtcagatgagcagaatattctagccctgagaagtatacaggggcggcagcgggagaaccctggacagtcattaaatcggctttttcaggaggtcccaaaacgtagaaatggatccgaaggtaatatcacaacccggattcgcgcgagtgagaccggttccgacgaagccatcaaatccattctggaacaagcgaaaagagaactgcaagtccagaaaacagcagaaccggcccagccatcatctgccagcgggtccggaaatagcgatgacgccattagatccatcctgcagcaggctaggcgggagatggaagcccagcaggcagctctggatccagccctgaagcaggcccctttgtctcagtccgatattactatattgacgcccaagcttctcagcacgagtcccatgcccaccgtctcatcctatcctccactcgctatttcactgaagaagccctctgcagccccagaggcgggcgcaagtgctcttccaaacccacccgctctcaagaaagaagctcaagacgcgcccggcttggacccccagggagccgccgactgtgcacagggagtactccgacaggtcaaaaatgaggtcgggcggagcggcgcgtggaaggaccactggtggagtgccgtgcagcccgagaggcgaaacgctgccagcagtgaggaggccaaagccgaggagaccggtgggggcaaagagaaggggagtggcgggagtggcggcggatcacagccacgggcagaaagaagtcagctacagggaccaagctcttcggaatattggaaagagtggccttcggccgagtccccctactcccagtcctccgagctgtctcttaccggcgcgtctcgctccgaaaccccacagaattcccctctcccatcaagtcctattgtgccaatgagcaaaccaacaaagccatctgtccccccacttacccctgaacagtacgaagtttatatgtaccaagaggtggatactatagaactgaccaggcaggtgaaggaaaagctcgctaaaaacggtatctgccaacggatttttggcgaaaaggtgcttggcctcagtcaagggtccgtttctgacatgttgtcccggcccaagccctggagcaagctgacccagaaagggagggagccatttataaggatgcagctgtggctgaacggcgagctcggccagggggtcctgccagtccagggccaacagcagggaccagtgcttcattcagtgacatcccttcaggatccgctgcagcaaggctgcgtaagttccgagtctacccctaagacaagcgccagctgtagcccagctccggagagcccaatgagttcctcagaatccgtcaagagcctcactgaactggttcagcagccctgccctcctattgaagcaagcaaagattctaaacctcctgaaccttccgacccccctgcctcggacagtcagcccactaccccactgccgctctcgggacacagcgccctcagtatacaagaactcgtggcaatgagccccgagctggatacttacggcatcacaaaaagagtgaaggaggtgttaactgacaacaacctgggccagcggcttttcggggagaccatccttggcttgacacagggcagcgtttccgatctcctggccaggccgaagccgtggcataaactatctctcaagggacgcgagccgttcgttagaatgcagctctggctgaacgatccaaataacgtcgagaagctcatggacatgaagcggatggagaaaaaagcttatatgaaaagacgccactcgtcagtatccgactctcagccatgtgaaccgccgagcgtgggaaccgaatacagccagggcgcctcaccccagccgcagcaccagctaaagaaaccacgcgtggtgcttgctcccgaagagaaggaagctctgaagagggcctaccagcaaaagccctacccctctcccaagaccatcgaggatttggcaacccaattaaacctcaagacaagtaccgtgattaattggttccacaactacaggtcccgtattagaagagaactgtttatagaggaaattcaggctggtagccagggtcaggcgggcgcatccgatagcccatcagctagaagcgggagggcagccccctcatccgagggcgactcatgtgacggcgtcgaggcaactgagggccctggatcagccgatactgaggagcccaaaagccaaggcgaggcagaaagagaggaggttcctagacctgctgagcagaccgagcctccaccatctggaactccgggtcctgacgacgccagagacgacgaccacgaaggaggacctgtggaagggcctggtccgttgccctccccagcttccgcaacggctacagctgcaccagcagccccggaagatgcggccacgtcagcagcagccgctccgggtgagggacccgcagccccatcatcagctccacccccctcaaattcatccagtagctccgccccgcgcaggccaagcagcctgcagtccctctttgggctccccgaggctgccggcgctcgggatagccgtgataaccccttgaggaaaaagaaggccgccaacctcaactccatcattcatagactggagaaggctgcgtcccgtgaagaaccaattgaatgggagttctag

SEQ ID NO: 41675 - DNA, 1989 bp, Artificial Sequence
  Description of Artificial Sequence: Synthetic coding sequence
atggccgccaacgtgggcagcatgttccagtactggaagcggttcgatctgcagcagttgcaacgcgagctggacgccactgctactgttctcgccaataggcaggacgagtcagaacagtcacgcaagcgcctcatcgaacaatcacgggaattcaagaaaaatacaccggaaatcgacgcattgtccaagcggtcaaaagaggccgaggctgcttttcttaatgtgtacaagagactaatcgacgtgccagacccagtacccgccctggatcttgggcagcagttgcagctcaaggtccagcggttgcacgatatagagacggagaaccaaaagctgagggagacgttagaggaatacaacaaggagtttgcagaggtgaagaaccaggaggtaaccattaaggctcttaaagaaaagattagagaatacgaacagacactgaagaaccaggcagagactattgcactcgaaaaggagcagaaactgcagaatgattttgccgagaaggagcgtaaattgcaggaaacgcagatgagcactactagtaaactggaagaggctgaacacaaagtgcagagcctgcaaaccgcattagaaaaaactaggaccgagttattcgacttaaaaactaaatatgacgaggaaacaacagcaaaagccgacgagatagaaatgataatgacagacttagaacgggcaaatcagcgggcggaagtggcacagagagaggccgaaaccctacgtgaacagttaagtagcgccaaccattccctgcaactggcttcacagatacaaaaggccccagatgtagagcaagcaatagaggtgctgacgaggagctccctcgaagtagagttggcagccaaggagagggaaatcgcacagttggtggaggacgtgcaacgattgcaggcctccttgacaaagctccgcgagaacagcgcgtcgcagatcagtcagctggagcagcagctgtccgccaaaaatagcacactgaagcagctcgaggagaagttaaagggccaagcagattatgaagaggttaaaaaggaactgaacattctgaagtccatggagtttgcacccagtgagggagctggcacccaggatgccgcaaaaccgctggaggtgctcttgttggagaagaaccgctcgcttcagtctgagaatgcagctctgcggatcagcaactccgacctgtctggaagatgcgccgaactccaggtccggattaccgaagccgtggccaccgcaactgaacaacgggagctgatagctagactggaacaggacctgagcatcattcagtcaatacaaaggccagatgctgaaggtgccgctgaacaccggctcgaaaagatcccagaaccgatcaaggaggcaaccgcactgttttacggtcctgctgctcccgccagtggcgccctacccgaagggcaggtcgactctctgttgtcgatcatatctagtcagagggagcgttttcgtgcacgcaatcaggagctcgaggcggagaatcgactggctcagcatacgctccaggctctgcagtctgaattggactcacttagagctgataacatcaagctttttgaaaaaatcaagtttctgcagtcgtaccctgggaggggttcagggtcagacgacacagagctgagatactctagccaatacgaggagaggctggacccattctccagtttctccaaaagggagcgccaacggaaatatttgagcctcagtccttgggataaggccactctttccatgggccgattagttttaagtaataaaatggcccgcaccattggatttttttacacactgtttctgcactgcctggttttcctcgtgctgtacaagctcgcctggtccgagagcatggaacgggattgcgccacattctgtgctaaaaaattcgcagaccatctgcacaagtttcacgaaaatgacaacggcgcggctgcgggagacctgtggcagtag

SEQ ID NO: 41676 - DNA, 4452 bp, Artificial Sequence
  Description of Artificial Sequence: Synthetic coding sequence
atgctgtgcgtggccggcgcccggctgaagcgggagctggacgccaccgcaactgtcctcgctaatcggcaggatgagtccgagcagtcgcgaaaacgcctgatcgaacagagccgggagtttaaaaaaaacaccccagaggacctacgtaaacaggtagctccattgcttaagtcattccaaggagaaatcgacgctttaagtaagcgatctaaagaagccgaagcagcattcttgaatgtgtacaaacggctgattgatgttccagatccggtgcctgccctggacctgggacagcagctgcagttaaaggtgcagaggctgcacgatatagaaacagagaatcagaaattacgagagactctggaggaatataacaaggaatttgcagaggtgaagaaccaggaggtgaccattaaggctcttaaggagaagatccgtgagtacgagcagaccctaaagaaccaagccgagacgatagcactagagaaagagcagaaacttcagaacgatttcgcggagaaggaacgcaaactccaggaaacccaaatgagtaccacgtctaagctggaagaggctgaacacaaggttcagagcctacagaccgccctagagaaaactcgcacagaattgtttgacctgaagactaagtacgacgaggagaccaccgcaaaggcagacgagatagagatgatcatgaccgatctggagcgtgccaaccagagagctgaagtagcacagagagaggcagagaccttgcgagagcaactgtccagcgccaatcacagtctgcagctggctagtcagattcaaaaagcacccgatgtcgagcaagccatcgaggttcttacgcgatcttcgttggaagtggagctggcagctaaggagagagaaatagcccaactagtggaagacgtgcagaggctgcaggccagcctcacgaaactaagagagaattccgcgtctcagatctcacagttggaacagcaattgtcagctaagaacagcactttgaaacagctcgaggagaaactgaaaggccaagccgattatgaggaggtgaagaaagagctgaacatattgaaatctatggagttcgccccttccgaaggggcagggacccaagacgcagctaagccgctcgaggtcctgctcctcgaaaagaaccggagcctccagagcgaaaatgcagcccttaggatcagcaacagcgacctgtccggatcggcccggcggaaggggaaggaccagccggaatctcgacgcccaggcagcctgcctgccccccccccatcccagctccccaggaatcctggcgaacaggcgtcaaacactaacgggacccatcagttttctcctgccgggctgtcccaggacttcttctcttcctccctggccagccccagcctccccctagccagcacgggaaaattcgctctgaactccttgctgcaaaggcagctaatgcagagtttctacagcaaagcaatgcaggaagctggttccacctcgatgatcttcagtaccggcccttatagcaccaactctataagtagccagagccctttgcagcagtcgcccgacgtgaatggcatggctccatcgccatcccagtcagaatctgcaggatctgtgagcgagggggaggagatggatacagcggagattgccaggcaggtcaaggagcagctgataaaacataatatagggcagcggatatttggccactacgtgctggggctgtctcaggggagtgtgagcgagatactggcccgccccaagccctggaataaactgaccgtacggggcaaggaaccattccacaaaatgaaacagttcctgtccgacgagcagaacatcctggcgctgcggagtatacaaggcagacagcggggcaacatcaccactcgcatccgggcctcagagacaggctctgatgaggctatcaaatccatactggagcaggcaaaacgtgaattgcaggtccaaaagacggccgagcctgctcaaccaagctcagcgtccgggtcaggcaattccgatgacgccatccgaagcatcctgcagcaggcaaggcgagagatggaagctcagcaagcggctcttgacccagctctaaaacaggctcctctctcacagtctgatatcaccatccttacccccaagcttctgagcacgagtccaatgccaactgtctcatcatatccccccctggcaatctctctgaaaaagccatctgccgccccagaagccggagcatccgctctgccaaatccaccggccctgaaaaaggaggctcaagatgcaccaggactggatccacaaggagcggccgattgtgctcaaggcgtgcttagacaggtgaaaaatgaggtcggccggtccggcgcctggaaagatcactggtggtccgctgtccagcccgagcgaaggaacgctgctagctccgaagaggcaaaggccgaggagaccggaggtggaaaggagaaagggagcgggggttcaggcggcgggagtcagcctcgcgctgaacggtcacagctacaggggccaagtagctctgagtactggaaggagtggcctagcgcggagagcccctattcccagtcatccgagctgagcctgacgggcgcgtcgcgctctgaaacaccacagaactctccgcttccttcaagcccaatcgtcccaatgtcaaaaccgaccaaaccatccgttccccctctgacacccgagcagtacgaagtgtacatgtaccaagaggtggacactattgaactcacaagacaggttaaagagaagctcgctaaaaacggcatctgtcagcgtatctttggcgagaaggtcctgggtctcagccagggctcggtctccgacatgctctccagacccaaaccatggtcaaagcttacgcagaagggaagagaaccattcatcaggatgcaactgtggctgaacggggaactaggccagggcgtgctgccagtgcaggggcagcagcaggggcctgtactgcactcggtcacttcacttcaggaccctctgcagcaaggctgtgtatcctctgagagcacacccaaaacatccgccagttgctccccagcccctgagagtcccatgtcctcctctgagtcagttaagtctctgacagaattggtgcagcagccttgtccccccattgaggccagcaaggattctaagccgccggaaccaagcgaccccccggctagtgatagtcagccaacaactccccttccactgagcgggcatagtgccctctcaatccaggagctggtggccatgagcccagagcttgatacttacggaattaccaaacgagttaaggaagttcttaccgacaataacctgggtcaaaggctgtttggcgagactatcctgggcttgacccagggttccgtgtcagatttattggcccgccccaagccttggcataagttatcgctgaagggcagggagccctttgtgcgcatgcaactgtggctgaacgatcctaacaatgtcgagaagctaatggatatgaaaaggatggagaaaaaagcctatatgaaaagaagacactctagtgtctctgatagccaaccttgcgagccaccctcggtgggcactgagtacagccaaggggcgagcccacagcctcagcatcagctgaagaagcccagagtcgtgttggcacccgaggagaaagaagccctgaagcgggcctaccaacaaaagccctacccatccccgaaaaccatcgaagacctggcaactcagttgaatttaaagaccagtactgtcatcaactggttccacaactacagaagtcgtatacggcgggagctgttcatagaggaaatccaggcagggagtcagggccaggccggcgcctctgactctccaagtgccagaagcggaagagctgccccttcatcggaaggcgactcttgtgacggcgtcgaagctactgaagggcccggttccgcagacactgaggagccaaagtcccagggagaagctgagagggaagaggttcccagacctgcagaacagacagagcctcccccctctgggactcctggaccagacgacgcgagagacgacgaccacgaaggcggacccgtagaggggccgggacctctgccctctcctgcttctgccacggccaccgctgccccagccgccccagaggatgccgccacatcggctgccgcagcacccggggagggacccgctgccccctcttccgctccacctccctctaatagcagcagcagcagcgcccctagacgcccatctagtttacagagcttattcggtctgccagaggccgccggagcccgggactcaagggacaacccattaagaaagaagaaagccgctaacctgaacagtatcatccaccggcttgagaaagcagcatcacgcgaggagcccattgagtgggagttctag

SEQ ID NO: 41677 - DNA, 4350 bp, Artificial Sequence
  Description of Artificial Sequence: Synthetic coding sequence
atgctgtgcgtggccggcgcccggctgaagcgggagctggacgccacagctactgtgctagcgaaccgccaggacgaaagtgagcagtctcgaaagagacttatcgagcagagcagagaattcaaaaaaaatacacctgaagaccttcgcaaacaggtggcccctctcctcaagagtttccagggtgaaatagatgccttaagtaagcgatcaaaggaagccgaagcagccttcctgaatgtgtacaagcggctcatcgacgttcccgatccagtacccgcccttgaccttggccaacaactccaattgaaagttcagcggctgcatgatatcgagaccgagaatcagaagctcagagagactcttgaggaatataataaggagtttgcagaagtaaaaaaccaggaggtgactatcaaagctctgaaggagaagatccgtgagtacgaacaaactctcaagaatcaggccgagacgatcgccttggagaaagagcaaaagctccaaaacgactttgccgagaaggaaaggaagttacaggagacccaaatgtcgacaactagtaagctggaggaggctgagcataaagtacagtccctgcaaaccgccctggaaaagacccggaccgagttatttgacctgaagactaaatacgacgaagaaacaacagcaaaggctgacgagatcgaaatgattatgaccgatcttgaaagagccaatcagcgcgcagaagtggcccaacgggaggccgaaacccttcgtgagcagctgagtagcgccaatcatagtttgcagttggcgagccaaattcagaaagctccggacgtcgagcaggccatcgaggtcctcactcgtagctccttagaggtagagctcgccgccaaggagcgtgagattgcccagctcgtggaggacgtccagaggttgcaggcttccctgaccaaactgcgcgaaaattcagccagtcaaatctctcagttggagcagcagttgtctgctaaaaactctacgctcaaacagctcgaagaaaagttgaagggtcaggctgattatgaggaggttaagaaggagctaaacatcttgaaaagcatggaattcgctccttcagaaggggccggtacacaggatgccgctaagcccctagaggtcctcctgctggagaaaaatcggtcactccagagcgaaaacgcggccctccgtatctctaatagcgatctgtcggggagcgcccgtcggaagggcaaggatcagcctgaaagtagacgcccgggcagcctgccggccccacctccgagccagctgccacggaaccccggtgaacaggcgtccaatacaaatgggacgcatcaattctcacccgcaggtttaagtcaagacttcttttcttcatccttggcctcccctagtttaccactggctagcacaggaaaatttgcactgaactcgcttttgcagagacagttgatgcagtccttttacagtaaggctatgcaggaggcaggaagcacgtctatgattttctctactggcccatattcaaccaactcaataagcagtcagtcccccctgcagcagtctccggacgtcaatgggatggcaccctccccgagccagtctgaatcagcgggctcggtaagcgaaggagaggagatggacacagccgaaatcgcgaggcaggtgaaagaacagttaatcaagcacaacattgggcagcgaatctttggacactacgtcctgggactgtcccagggatccgtgagtgaaattctggccagacctaaaccctggaacaagctgacagtacgtggcaaggaacctttccataaaatgaaacagtttctgtccgatgagcagaatatacttgctctgagatctatccaagggagacagcgcgctgagcctgcccagccttctagtgcatctggctcaggtaactcagacgacgcgatcaggtccatccttcagcaggcacgtcgggaaatggaagcacaacaagctgcactggaccccgctctgaaacaagctccactgagtcagtccgacatcaccattctcacccccaagcttctttcaactagccccatgcctacggtatcgagctaccctccattggctatcagcctgaaaaagccctctgccgcaccggaggccggggccagcgcactacccaacccccctgccctcaaaaaggaggcccaggatgctccagggttagacccgcaaggggcagccgactgtgcacaaggtgtactccggcaggtaaaaaatgaagtgggccgctcaggtgcctggaaagaccactggtggtccgctgtgcagccggaaaggcgaaatgccgcttctagtgaagaggcaaaagcggaggaaaccgggggcggcaaagagaagggaagcgggggatccggcggaggatcccagccccgggccgagagaagccagctgcaaggccccagtagctccgagtattggaaggagtggcccagcgctgagtcaccctatagccagagcagcgagttgagtttaactggtgcgtcgcgcagtgagaccccacagaatagtcccctccctagtagcccgattgttccaatgagcaaacctaccaaaccaagcgtgccccctctgacccctgagcagtatgaggtgtacatgtatcaggaggtggacactattgagttgacaagacaggtgaaagagaaactggctaagaacggtatttgccaacgcatctttggagaaaaagtgcttggtttatcccagggatcagtgtcagacatgctctcgagacctaaaccttggagtaaattaacacagaaggggcgcgagccctttatcaggatgcaactgtggctaaacggagaactgggacagggagttctgccggtgcagggacagcaacaaggccctgtactgcactcagtcaccagcttacaggatcccctccaacagggttgcgtgagttctgagagtactccgaagacaagtgcaagttgtagcccggcccctgaaagtccaatgtcctcaagtgagtctgtgaaatctctgacggagctggtgcagcaaccctgtccacctatcgaggccagtaaggattcaaaacctcctgagccttctgaccctcccgcctctgatagtcagcccaccactcctctgccactctcagggcacagtgccctgtccatccaagaactggtggcaatgtcacctgagctggatacatacggtattactaagcgagtaaaagaagttctgacagataacaatctgggtcagaggctgttcggtgagacaatactgggcctaacacagggcagcgttagtgacctgctggcaagaccaaaaccatggcacaaactcagtctcaagggcagagaaccttttgttagaatgcagctatggctgaacgatccaaataatgtggagaagcttatggatatgaaaaggatggaaaaaaaggcctatatgaaacgcaggcactccagcgtctccgacagccaaccttgcgagccaccatccgtcgggacggaatatagccagggggcatccccacagcctcagcaccaactcaaaaagcctcgggtggttctcgcccccgaggaaaaggaagccctaaaaagggcttaccagcagaaaccctacccttcccccaagaccattgaagatctggccacgcaacttaatctaaaaactagtaccgtgatcaactggtttcacaattacaggtcaaggatccgacgtgagctgttcattgaggagatacaggcaggatctcaggggcaagcgggcgcatcagattctccatcagcccgctctggtcgggcggctccctccagtgagggggatagctgcgatggtgtggaagccacagagggacccggatcagccgacaccgaggaacctaaatcacagggggaggccgaacgtgaagaggttccacgtccagctgagcagactgagcctcccccctctggaacaccggggcccgatgacgctagggatgacgaccacgaaggcgggcccgttgaaggtccaggccctttgccctctcccgcaagcgctactgcaacggctgccccagccgctccagaagatgccgctacttcagcagctgccgccccaggggaaggcccagccgccccgtcttctgcccctcccccttctaactcttcctccagttccgcacctagacgacccagctcacttcagagcttgttcggactgcctgaggccgccggggcccgggactcacgcgacaacccactgaggaagaaaaaagctgcaaacctgaattcgatcatacacagactggagaaggccgccagccgcgaagagcccatcgagtgggaattctag

SEQ ID NO: 41678 - DNA, 4044 bp, Artificial Sequence
  Description of Artificial Sequence: Synthetic coding sequence
atgctgtgcgtggccggcgcccggctgaagcgggagctggacgccaccgccaccgtattagcaaaccgccaagatgaatcagagcagagtagaaagcgcctgattgaacaatccagagagttcaaaaaaaacaccccggaggaccttaggaaacaggtcgcacccctcctaaaatcatttcagggcgagattgacgccctgagtaaaaggtccaaggaggccgaggcagctttcctcaatgtttacaaacggctgatcgacgtacctgaccccgtgccagcactcgacctgggccaacaactgcagctcaaggttcagaggcttcacgacatagaaaccgagaaccagaagctgcgagagacattagaagagtacaacaaagagtttgctgaagtgaaaaaccaggaagtcacgattaaggccctgaaggagaagattagagagtatgaacagacgctcaagaaccaagctgaaacaatcgctttggaaaaagagcaaaaactacagaacgactttgccgaaaaagaacggaagctccaggaaacccagatgtcaaccacatctaagctcgaagaggccgagcacaaggtgcagtccctgcaaactgccttagaaaagactaggacagagctgttcgatttgaagacaaaatacgacgaagagacaacagcaaaggcggatgagattgagatgattatgacagatcttgaacgcgccaaccagcgggcggaggtcgcccagcgagaggccgaaacactgcgtgaacagctgtcttcggcgaaccattccctgcagttggcctctcagattcagaaggcacccgatgtagagcaggctattgaagtgctgaccagatcatcccttgaagttgaattggctgctaaagaacgggagatagcccaattagtggaagatgtgcaaaggctgcaggcctctctgaccaagctcagagagaacagcgccagccagatctcacagttggaacagcagctttctgctaagaactccacgctcaagcagttggaggaaaagctaaagggacaggctgactacgaagaggttaaaaaagagctcaacatattgaaaagtatggaatttgctccttcggagggggctgggacccaggatgcggctaagccactcgaggtgctcctgttagagaaaaatcgcagcttacaatctgaaaacgctgccctccgaatctctaactcagacctttcaggaccatactctaccaactcaatttcttctcagagccccctacagcaatccccagatgtcaatggcatggccccctcccccagccagagcgagtctgcagggtctgtgagcgagggcgaagagatggatacggccgagatcgccaggcaggtaaaagaacagctaatcaagcacaacatcggccagagaatcttcgggcattatgtgttaggcttgtcccaaggatcagtgtccgagatcttggcaagaccaaaaccctggaataaactcaccgtgagaggcaaggagcctttccacaagatgaaacagttcctttccgatgagcagaatatcctcgccctgcggtctatacagggtaggcagagggccgagccagctcaacccagtagcgcctccgggtccgggaacagtgacgacgccatacgctccatcctccagcaggcccgtcgcgagatggaggcccagcaggctgccctcgacccggccctcaaacaggctcccctgagccagagcgacataacaatcctgactcctaaattactttctaccagtcctatgccaactgtttcctcctatcctcctctggcaatctctctgaagaagccatctgctgcaccagaagcaggggcgagtgcgttgcctaatccccctgccctaaaaaaagaggctcaagacgcaccaggcctcgatccacagggggctgccgactgtgcccagggtgtactccgacaggtgaaaaatgaagtgggcaggagcggtgcctggaaagaccactggtggagcgccgttcagcccgagcgtcgcaatgccgccagtagtgaagaggccaaagcagaggaaaccggaggcgggaaggaaaaaggctccgggggttccgggggcggttcacaaccgcgcgccgagaggtctcaactgcaaggcccaagttcctctgaatactggaaggagtggcctagtgcagaaagtccctattcccagtccagcgagctttctctgacaggcgcgtcccgctctgaaaccccacagaacagccccctgccctcgtcccctatagtgccaatgtctaaaccgacaaagccctcagtacccccactaactccagaacagtacgaggtgtatatgtaccaggaggtggatacaattgagctgacccgacaggtgaaggaaaagctggccaaaaatgggatctgccagaggatttttggggaaaaggttctcgggctgtctcaagggagtgtgtctgatatgctcagccggccaaagccctggtccaaactgacacaaaaaggtagggaaccatttattagaatgcaactgtggttgaacggcgagctgggccaaggggtgcttcccgtgcaagggcaacagcaaggaccagtcctccacagcgttacaagcctgcaggatcctctgcagcagggttgcgtgagtagcgaatctactccaaaaacaagtgccagttgcagccccgcccccgagagccctatgtctagtagtgagtctgtgaagtcactgactgagcttgtgcagcagccatgccctcccatcgaggcaagcaaagattcaaagccgccagagcccagtgacccacctgcttccgatagccagcccacaaccccgttgcccctgagcgggcactccgccctcagtattcaggaactcgtggcaatgtctccagagctggacacgtacggtattacaaagcgggtgaaggaggtattaacagataacaacctggggcagcggttatttggtgaaaccattctgggactgacacaaggcagtgtctctgatctgctggccaggccgaagccctggcacaagttatccctgaagggtcgcgagcccttcgttagaatgcagctgtggctcaatgaccccaacaacgtcgaaaagctcatggacatgaagaggatggaaaaaaaggcttatatgaagcggaggcactcctcagtgtctgatagccagccctgtgagcccccgtctgtgggcaccgaatattcgcaaggtgcatctccacagccccaacaccaactgaaaaagcctagggtcgtgcttgctcccgaagagaaggaggccctgaagcgagcctatcaacagaagccctatccaagtcccaaaactattgaggatcttgcaacacagctgaatctgaaaacatctaccgtaatcaactggttccacaactaccggagccgtattcggagggaactgttcatcgaggaaattcaggcaggcagtcaaggtcaggcaggtgccagcgactccccctctgcccggtctggacgtgctgctccaagcagtgagggcgacagctgcgacggggttgaagcaacggaagggccaggtagtgccgataccgaggagccaaagagccagggtgaggccgaacgggaggaggtcccccggcctgcagaacagaccgagccaccaccctctggtacccctggccccgatgacgcgagggatgatgaccatgaaggcgggcctgttgagggtccagggccactccctagtccagcctccgcgacggctacagccgcccctgctgctcccgaggacgcggccacctcagccgccgcagcaccaggtgaagggcctgccgcacctagttctgctcctccaccatctaatagtagctcaagtagtgccccgagaagacctagttctctgcaatcactgttcgggctacccgaggctgcaggcgcccgagacagtcgggataatcccctgcgcaaaaagaaggctgccaatctgaactctataatacatcgactcgagaaagcagcttcacgcgaggaacctatcgaatgggagttctag

SEQ ID NO: 41679 - DNA, 1902 bp, Artificial Sequence
  Description of Artificial Sequence: Synthetic coding sequence
atgaagatcagcgcctggctgatgtgcgcccggggcaaggacctgaggaagcaggtggcaccactgctgaagtccttccagggagaaatagacgctctcagcaaacgaagcaaagaagcagaagcggctttcctgaacgtgtataaaagactgatcgacgtgcctgaccccgtcccagccctggatctgggccagcagctccagctcaaggtgcaacggctgcacgacattgagactgaaaaccagaaactacgcgagacactggaggagtacaacaaggaattcgccgaggtaaagaaccaggaggtgaccataaaggcactgaaagagaagattcgagagtatgagcaaacactgaagaaccaggctgagacgatagccttggagaaggagcagaaattacagaacgatttcgcggagaaagagcggaagctccaggaaactcaaatgtctaccacgtctaagctggaagaggctgagcataaggtccagagcctgcagacagcactcgaaaagacaaggactgagctgttcgacctcaaaaccaagtatgacgaggaaaccacagcaaaggccgacgagattgaaatgattatgactgaccttgagcgagccaatcagcgggccgaggtggcacaacgcgaggctgagaccctgagggagcagctgtccagtgctaaccactcccttcagcttgcctcccagatacaaaaggcccccgacgtagaacaggctatcgaggtactgacaaggagctcgctcgaggtggagctcgccgccaaggaacgcgagatagcccaactggttgaggatgtccagagactgcaagcttcactgactaagctacgcgagaattcggcttctcagatctcccagctggaacagcagctgtctgccaagaactccacactgaagcagctggaagagaaattaaagggacaggctgactacgaggaggtgaagaaagagctgaacattctcaaaagcatggaattcgcccctagcgagggtgctggcacacaggacgccgcaaaaccacttgaggtgttgctgttagaaaagaaccgctccctgcagtctgaaaacgccgctctcaggatctcaaacagcgatctctccggcagatgcgcagagctgcaggtgaggatcacagaagccgtggccaccgccactgaacagagggagctgattgcccgcctggaacaggacctcagcatcattcagtccatacagcgacctgacgctgaaggggccgccgaacaccgacttgagaagatccccgaacctatcaaagaagctactgctctcttctacggccctgctgcccccgcctccggggctttgcccgagggccaggtggattccttgttgtccattatttcttcccagcgagagagattcagagctcgaaaccaggagcttgaggccgagaaccgactggcacagcacacacttcaggcgctacagtccgagctggactccctgcgggccgataacatcaaactttttgaaaagatcaaatttctccagagctaccccggtcgcgggagtggcagcgatgatacggaactgaggtactcatcccagtacgaggagcgtctggaccctttcagcagtttctcgaaaagagaacggcagcgcaaatatttgagtctgagcccatgggacaaggctacactgagcatggggcgactcgtgctatctaataagatggcgagaaccattggtttcttctacacattatttctccattgcctggtgtttctggtcctctataagcttgcctggagtgagagcatggagagagactgcgcgacgttctgcgcgaaaaaatttgctgaccacctgcacaagttccatgagaacgacaacggcgccgcggccggcgacttatggcaatag

SEQ ID NO: 41680 - DNA, 2079 bp, Artificial Sequence
  Description of Artificial Sequence: Synthetic coding sequence
atgagcgccggcaccggcaagggcggcccccagacccccgtggagagcccaaccgcgtcttcgaagttaccacaagcccactggctgtgttctcccggcataaaacgggaactggatgcaactgctactgttctagccaacagacaagacgaatcagaacagagtagaaaaaggcttatagagcagagtcgagaatttaagaagaatactccagaggacctcagaaagcaggtcgctcccctgctgaagtccttccaaggcgaaatcgatgctcttagtaagagatccaaggaggctgaagcggcattcctgaacgtctacaagcggctgatcgatgtgcccgaccctgtgcccgctttagatctcggccagcagttgcagctgaaagttcaacgtttgcacgatatcgagaccgaaaaccagaaactgcgggaaaccttagaagaatacaacaaggaattcgcggaggtgaagaatcaagaagtaaccattaaggccctgaaagaaaaaatcagggaatatgaacaaacccttaagaaccaggcggagactattgccctagagaaggagcagaagttgcaaaacgattttgcagaaaaggagcgcaaactgcaagaaacacagatgtccaccaccagcaaactcgaggaggccgaacacaaggtccagtccctccagacagcactagaaaagaccagaaccgaactgttcgatctgaaaaccaagtatgatgaggagaccactgccaaagccgacgagatcgagatgattatgaccgaccttgaacgtgctaatcaacgggctgaagtagctcaaagagaggctgaaaccctccgggaacagctttcttccgctaatcatagcctccagctggctagtcagatacagaaggcacctgatgttgagcaggcaatagaggtgctgactcggagttctcttgaggtggaactcgcagccaaggagcgggaaatcgctcagctcgtagaagacgtccagcggctccaggccagcctgacaaagctgcgcgaaaattccgctagccaaatttcgcagctggaacagcagctgtcggctaaaaacagcactctgaagcagcttgaagaaaaactcaagggccaagcagactacgaggaggttaaaaaggagctgaacatcttaaaatctatggagtttgcccccagtgaaggagccggaacccaggatgcggccaaaccactcgaggttctgctgctggaaaagaaccgcagtcttcagtcggagaatgcagctctcaggatttcaaatagcgacctttccggccgatgtgccgagctccaagtccgcatcaccgaggccgttgctactgccaccgagcagagagaactgatagcccgactggaacaggatctcagtatcattcagagtatacaaagaccagacgccgagggagcggcagagcacagactagagaaaattccagagcctataaaggaagctactgcgctcttctacggcccagcagcaccagcttccggggcacttcccgagggccaggtggatagtctgttgagtattatttcttcccagagggagcgctttcgggctagaaatcaggaattagaggccgagaacagactggcccaacacaccctccaagcactgcagagcgagctggatagcctgcgggcagataatattaagctgttcgaaaaaataaaattcctacagtcctatccgggccgcgggagcggttctgatgatacagagctcaggtattcctctcaatatgaggaacgtctggaccccttttccagtttctcaaagagggaaagacaaagaaaatacctgtccctcagtccctgggataaagcaactttatccatgggtaggctcgtgttgtctaacaaaatggccagaactatcggttttttttacaccttgttcttgcattgtctggtcttcttagtgttatacaagctcgcctggagtgagtccatggaaagagactgcgccaccttttgtgctaagaagttcgctgaccacctccataagtttcacgagaacgacaatggcgctgcagctggagacctgtggcagtag

SEQ ID NO: 41681 - DNA, 1719 bp, Artificial Sequence
  Description of Artificial Sequence: Synthetic coding sequence
atggaccgggccggcgccgacatgtgggccagcaccttcaccctggcaatggcggagcgcaaacctcaagatgtctgggtactccttccagagcactccctggtcccggggtgcctggacgggggcggggtccagtacttacttgtgggcttatcacggctgcaatgcgggcactgccctggaacgtgggatagtgcacatgttcatgttctgtttcatctatggtgggatagggccagccatcgtgggttagttaagatgcgtatctggggccagcgctgtcggctctgccccgcaccgggggactgccaagtaaggccgccaggcgagcagcccttcttgtctcggttagttttacacatcctgcaagattgctatggggacggcccaggtccagcccgccatccccgggaagcatatgaaggatgttgtgaggcatgcgaactgggagtttgcttcttgcaaaaagctccagatccagcctggagcgccaacgccactaaggggaattttcctgccacagcttggggaggaactggtaccgttagtagagggaagccactgagcactcctggcgatgatttaggaaagggtggtgttgtgatagcaattccttttagtctggtgggcaccagcaacgatcaagtgccgatcgccgagggaccagcacctcccgctggggcctcccttcctgttacgggttcatgcgaggccctggttatcggccaagggtcgatctttctgtcaggcgacagtgttgctatgcctggtggaaaaggatttcctgtggctatcggagatcccctgtttcacggtcctggactactgggaagctccattcagacgtttgaactcaaaggtttcttgtttaagggccgtgggtcactatgctcacccgtgggtgttgctcagggatgggggcctatttcactgaataacggcttggtgcctgttgggaagcacaccccaactgtcttctattgcgttggtctgagcgcctctggcgaaggctctctgaccttccccagctccctcacatctatattcacaaacactctgtcagagcccacggacggcccagtagccacaaaggaggcctctatcactttcccattcatttttacagatgtgaaagacgcagtggctgaagtggctgaagggaatggaaaagagggcggagggcagggcctagtccctgtgggccacgacgctctgccagagaccaacgccgggggcctaccgtcacaggttaaagggtccctggcccttcctttcccagccgacgttcagggaaaagacgcctttacagatatcacggaaggcaaggaaaaggaaggaggactggtaaccgctgggcacgacgccccactcgaggcaaacgcggagggccctattaccgtgagcgagggatgcattactataccctttgctgtttttgacgtgatcaaaagaaagggcggaggtcacgtggcctatggccctcaggggaacggatgcttttcacaaggttactatcagaaaagacagctgaggagcagattccataaggcgcgctgcggttgcaggcgggaagaagacgaaaggcccggacgggcatgtcgcagaccccatgccgagccatatgaagatttctggatctgggtgtctatgactgtatgcgtgttttggctcatgtgcatgtgtagattgaaccccggcatatacccacagcaggtgtag

SEQ ID NO: 41682 - DNA, 1728 bp, Artificial Sequence
  Description of Artificial Sequence: Synthetic coding sequence
atgagccaggacaccaaggtgaagaccaccgagagcagcccccccgcaccctctaaggcacggaaactgctccctgtgctggacccctcaggggactactactattggtggttaaacaccatggtttttcctgtgatgtacaacctaataatcctggtctgccgagcgtgttttcccgatctccagcacggctacctggtggcatggctcgtgttggattacaccagtgatttgctctacctcctcgatatggtggttaggtttcacaccggcttcctggagcagggcattttggtggtcgacaagggacgcatttcctctcgttacgtgcgcacctggtcctttttcctggacttggctagcctgatgccaactgatgtcgtgtacgttcgtcttggaccacacacccctacactcagattgaataggttccttagagcccctagactctttgaagcattcgataggaccgaaacacgaaccgcttacccaaatgcgttccggatcgccaagttaatgttgtatatatttgtcgtcatccactggaactcttgcctgtattttgccctctctagatatcttgggttcggtagagacgcttgggtttatccggaccctgcgcagcccggatttgaacgccttaggaggcagtatctttacagcttctactttagtaccctgatcctgactactgtgggtgatacccccccccccgcacgcgaggaggagtatttgtttatggtaggagacttccttctggccgtcatggggttcgctacaataatgggatccatgtcatctgtcatatataacatgaacactgctgatgcagctttttacccagaccatgcactggtcaagaagtacatgaaactccagcacgttaaccgaaaacttgaaaggcgagtgatcgattggtatcagcacctgcaaataaataagaagatgactaatgaggtggctatcctccagcatctgcctgagcggctgcgggcagaagtggcggtgtccgttcacctgtctaccctgtctcgggtacaaatttttcagaattgcgaggcgtccctgttagaggaactggtgcttaaactgcagccgcagacttacagccctggggaatacgtatgtagaaagggtgacatcggtcaggagatgtatatcatacgagagggccaactggccgtggtggccgatgacgggattactcagtatgctgtgcttggcgctggcttgtacttcggcgaaatctcaatcataaacataaaaggcaacatgtcggggaatcggcgcactgcaaacataaaaagtttgggatattccgatctattctgtctgtcaaaggaggacctgagagaagtgctctccgaatatcctcaggctcagacaataatggaggagaaaggtagagaaatattgctcaaaatgaacaagctcgacgtgaacgcggaggccgctgagatcgccctgcaggaggcgacggaatcccggctaagggggctagatcaacaactcgacgaccttcagactaaatttgctcgacttcttgctgagctggaaagttccgcactgaagattgcctacagaattgaaaggttagaatggcaaacccgtgagtggcccatgcctgaggacctggctgaggcggatgacgagggcgagcccgaagaaggcacttccaaagacgaagaagggagggcctcacaggaaggccccccgggcccagaatag

SEQ ID NO: 41683 - DNA, 1164 bp, Artificial Sequence
  Description of Artificial Sequence: Synthetic coding sequence
atgatggacgagccctggtgggagggccgggtggccagcgacgtgcactgcactctcagggagaaagaactgaagctgcccaccttcagagcccatagccctttgttgaaatccagacgattttttgttgacatccttaccctgttgtcaagtcactgtcaactatgtccagcagcccgccacctcgcagtgtatctacttgaccactttatggatagatataatgtgactacgagcaagcagctgtatacggttgctgtgtcatgcctgcttctggcgtccaagttcgaagaccgcgaggaccatgtcccaaaactggaacaaattaatagtacccggatcctgtcttcacagaacttcactctgacaaagaaggagttattaagtacggagctgctcctcctagaagctttcagttggaatttgtgtctcccgacccctgcgcatttcctggactattatctcttggccagtgtatcacagaaagatcaccactgtcacacctggcctacgacctgccctcgcaaaaccaaggaatgcttaaaggagtatgctcactactttctggaggttaccctgcaggatcatatattttataaatttcagccatccgtcgtagctgccgcttgcgtgggagccagtagaatttgtttgcagctttcaccgtactggactcgggacttgcaacggattagcagttactctctggagcacctgagcacatgtatcgagatcttgcttgtcgtctatgacaacgtacttaaggacgccgttgccgtcaagagtcaggccttagccatggttccaggcactcctccaacgccaacccaggtgctgttccagccacctgcttacccagcccttggtcagcccgctacaaccctcgcacagttccagactcctgtgcaggatctttgtctggcttaccgcgactccctccaggcccatcggtctggctcccttctctctggctcaaccggtagcagtttacatacaccctatcaacccctgcagccattggacatgtgcccagtgccggtgccagctagtctctccatgcatatggccatagccgcagaaccacgacactgtctggccaccacctatggctccagctatttcagcgggagccacatgttccctacaggctgttttgatagatag

SEQ ID NO: 41684 - DNA, 1308 bp, Artificial Sequence
  Description of Artificial Sequence: Synthetic coding sequence
atgatggacgagccctggtgggagggccgggtggccagcgacgtgcactgtacactgagagagaaggaacttaagctccccactttcagagcgcacagccctctcttaaaaagccggcgcttttttgtggacatcctaaccctcctgagcagccactgccagttgtgtcctgccgctagacacctagccgtttatctcttggatcacttcatggaccgctataatgtgactacatctaagcagctctataccgtagcagtctcctgccttttactggccaacggagtgtcactgctatcacctaggctcaaatgttccgggatgattagcgcccactgcaacctacatcttcccggcagcagcaacagcccagcctcagcaccacatcctccgcctacccccccacaggtcgccgaaaccacaggaaagttcgaggatcgagaagaccacgtgccaaaactggagcagatcaattccacaagaattctgtcttcccagaatttcactcttacgaaaaaggagcttctgtccactgaactactgttattggaagctttcagctggaatctgtgtttgcccacccccgcacactttctggactactatcttctggcttccgtcagtcagaaggaccaccattgccatacatggcctacaacctgtcctaggaagactaaggagtgtctcaaagagtacgctcactacttcctggaggttactctacaggatcacatcttctataagtttcagccgtctgtggtggcagccgcttgcgttggcgcatcacgtatctgcctgcaactctcaccatactggacccgggatctgcagagaatttcaagttacagccttgagcacttatccacatgcatcgagatcctcctggtcgtatatgacaacgtgctgaaagacgccgtggccgtcaagagtcaggctctcgcaatggtccctggcaccccacccacacctacccaagttctgttccagcctcccgcctacccagcactggggcagcccgccaccaccctggcacaatttcagacacccgtgcaggacctgtgcctggcttatcgggactcccttcaggcccatcggagcggttctctactatcaggaagtaccggctcctccctccacactccgtaccagcctctgcagccactcgacatgtgccccgtgccggttccggccagcctgtcaatgcatatggctatcgcggccgagcctagacattgcctggcaactacatatggtagtagttacttcagcggtagtcacatgtttcccaccggctgtttcgacagatag

SEQ ID NO: 41685 - DNA, 501 bp, Artificial Sequence
  Description of Artificial Sequence: Synthetic coding sequence
atgcggcacaccagcaagcggaagccccagtactacgaggccgagatggtactgaaatactacaagcaccttgaagagggctccgtgagtctctgttgcccaggctggagcgctgtggctcagtccaggctgaccgccgccagcacattcggtgcacaagtaatactgttgtttcagttgtccgagcaactgcgcctgcaggagctgaagctcccaacctttagagctcactccccactactcaaatctagaagatttttcgtggatatacttaccctgctcagcagtcactgccagctgtgtccagctgccagacatttggctgtatatctccttgaccacttcatggacaggtacaatgttaccacatctaaacagctctatacagtggccgtgtcttgtctgttgttggcctctcgcaataaagggtctgggtcccccgtccctacaaggtccgcacagcagtgccgtcagacatgggccagaggatctccatggtag

SEQ ID NO: 41686 - DNA, 759 bp, Artificial Sequence
  Description of Artificial Sequence: Synthetic coding sequence
atgatggacgagccctggtgggagggccgggtggccagcgacgtgcactgtacgttgagggagaaagagctcaaactgccaacttttcgtgctcattcacctctactgaagtctcgtaggtttttcgttgatatactgaccttgctgagctcgcactgtcagctgtgccctgcggctaggcacttagccgtttaccttctggaccactttatggacagatacaatgtgaccacttcaaagcagctgtacaccgtggccgtgtcttgtttgctcctcgccagcaaatttgaggaccgtgaggatcatgtaccaaaactggagcagattaattcaaccaggatcctaagctcacaaaactttactctgaccaaaaaagaactgctcagcaccgagctgctgttgctggaggcattttcatggaatctttgtctgccaaccccagcccattttctcgattattatctgttggcatccgtctcgcaaaaagaccaccactgtcatacatggcccactacctgtccccgcaagacgaaggaatgtctaaaagaatatgcccattattttcttgaagttacactgcaggatcatattttctataagttccagccctcagtggtggccgccgcctgtgtgggcgctagcaggatctgtctccagctctcaccttactggacaagggacttgcagagaatttcatcttatagtctggaacacctctctacctgcatcgaaatacttctggtgccgttgttccgctag

SEQ ID NO: 41687 - DNA, 756 bp, Artificial Sequence
  Description of Artificial Sequence: Synthetic coding sequence
atggacgagccctggtgggagggccgggtggccagcgacgtgcactgtacactgagggagaaagaactgaaactccccacgttccgcgcccactctccacttctcaagagcaggcgtttcttcgtggatatcctgactctccttagcagccactgccaactatgtccggctgctcgacacctggccgtgtacttgctcgaccactttatggatagatataacgtcaccaccagcaagcagctctacacggtggccgtgagctgcttgctgctagcctccaaatttgaggatcgggaagaccacgtgccaaagttggaacaaatcaactccacacgcatcctgtcaagtcagaacttcacattgactaaaaaagagctgctttccacagaactactactgctagaggctttttcctggaacttatgcctaccaaccccggcccatttcttggattactatctgttagcctctgtatcccagaaggaccaccactgtcacacctggcccactacctgtcctagaaagaccaaggagtgtctgaaagagtatgcccactattttttggaggtgacgcttcaggatcatatcttctataaattccaaccctccgtggtggctgctgcctgcgtgggcgcgtctcggatttgtcttcagttgtccccgtattggactagggacttacaacgcatctccagctactcactcgaacatctaagcacatgcatcgaaatccttctggtccccctttttagatag

SEQ ID NO: 41688 - DNA, 1233 bp, Artificial Sequence
  Description of Artificial Sequence: Synthetic coding sequence
atggacctgaccggcctgctgctggacgaggagggcaccttcagccttgccggatttcaggatttcacatttctccccggacaccaaaagctatccgcccgcataagacggcgcttgtactacgggtgggactgggaggccgactgttctctggaggaattgagctcacctgtcgctgacatcgccgtcgagctgttgcagaaggcagccccaagccccatccgccgacttcagaaaaaatacgtggcccacgtgtcgagagaggcgtgtatttctccctgcgccatgatgttggctctggtttatatagaaaggctgaggcacagaaacccagactaccttcagcacgttagttcttctgacctcttcctgatctcaatgatggtggcatcaaagtacctgtacgacgaaggagaagaggaagaggtattcaacgatgaatggggcgccgcagggggggtcgcggttcctacattgaacgccctcgagagagggttcctctccgccatggattggcacctctacactgaccccagagagattttcgaagtgctgtcatggctggagtcatgtgtggccgagcagcaaggtcggtggcgcggctggtatacgtacacagacctctgtgtgcttctggagcaaccaacttggcagctggcactgggttcactgtgccagagactggtgaaactttcatgtctgctagccgtcgcctatgtgtccagcgtagcactcgccgtggccagtgtagccgtgatccaccagtcactcggcctgagctgcatcccaacacccggaccaccggatctcggattgaccagtcgctgcttgttagagccatgcattccatccgttcctcagtgtctgccatcgttggctaacgtaagcagctgcctggaaggcagtatggggctgcgatcgctctggggatcattattggcctccctgactccaccgccacttcctcccccagatcccccagccccgccaactctgctgcacaattgtcatctctgccagaaattgcagcgtgactcacctacatgccatgcatgtttgcacccaaatcggactgttcctacggcccttagttccccttggtatcatacctacggcttggctccaccttggccttggtcaccagtgctgctaagtctcccacagccccagcaatgctccctgttcagcgttatggagctagccagactgaagagcttcgtttttcctggctag

SEQ ID NO: 41689 - DNA, 1233 bp, Artificial Sequence
  Description of Artificial Sequence: Synthetic coding sequence
atggacctgaccggcctgctgctggacgaggagggcaccttcagcttagccgggttccaggactttaccttcctccctggacatcagaagttgtctgcacggataagacgaagactgtattacggatgggactgggaagctgactgctcattggaggagctgtcctcccccgttgcggatatagccgtggagctcctgcagaaggctgctccatcccccataagacgactccagaaaaaatacgtggcgcacgtatccagggaggcctgcatcagcccttgcgcgatgatgctggcccttgtgtatatcgaaaggctgcgacaccggaaccctgactacctccagcacgtgtccagctcagatctcttccttatttccatgatggtggctagtaagtatctttatgatgagggagaggaagaagaggtgtttaatgacgaatggggtgccgcaggcggagtggctgtgccaactctgaatgccctggagcggggattcctgtcagccatggactggcacctttacacagacccaagagaaatcttcgaggttctttcctggcttgagagctgtgtggcggagcagcagggcagatggcgagggtggtacacttacaccgacctgtgtgtgcttttagagcagccaacatggcaattggctctcggcagcctgtgccagaggctggtcaaactcagttgtctactcgcggtagcctatgtatccagcgtcgctctggcagttgcatccgtggctgtgatccatcaatccctcggcctctcctgcatccccacaccaggcccccctgacctgggcctgaccagcagatgcctgctggagccatgtattccctcggtgccccagtgccttccaagtctggctaatgtctcatcgtgccttgaaggcagcatgggtctgcggagcttgtgggggtctctactggcgtccctgacaccgcccccattgccgcctcctgacccccccgcacctccgacactcctgcataattgccatctgtgccagaagctccagcgcgactcaccaacctgccacgcctgtctgcatccaaatcgcactgtacccacagcgctgagttccccatggtaccacacctacgggctggcccccccatggccttggtccccagtcctgctgagtctgcctcagccacagcaatgtagcttgttctccgtgatggaactcgcacggctgaaatctttcgtctttccaggttag

SEQ ID NO: 41690 - DNA, 927 bp, Artificial Sequence
  Description of Artificial Sequence: Synthetic coding sequence
atggacctgaccggcctgctgctggacgaggagggcaccttcagcctcgcaggctttcaggacttcacgtttctgcctggccaccagaagctgtcagctcgcatcagacggcgcctgtactacggttgggactgggaggccgactgttctctggaggaactgagttctccagtggctgatattgcagtagagctgcttcaaaaagcggcaccttctcccatcaggagactgcaaaagaagtacgtggctcacgtctcccgagaagcctgtatctcgccttgcgctatgatgctggcattggtctatatcgaaagactgcgacaccggaaccccgattatctgcagcatgtttccagtagcgacctctttttaatctccatgatggtggcgagtaaatacctgtacgatgagggagaggaggaagaggtgttcaacgacgaatggggtgccgccggtggcgttgcggttcctactttgaacgcccttgaacgcgggttcctcagcgccatggattggcatctgtatacagacccccgcgaaattttcgaagtattgtcatggctcgaatcctgcgttgccgagcagcaaggcaggtggagaggttggtacacctacaccgacttgtgtgtcctgctggagcagcctacctggcagctggcactgggctccctctgccagcggctcgttaagctatcttgccttctagctgtagcttatgtgtcaagtgtcgccctggctgtggccagcgtcgcggttatccaccaatccttgggcctgagttgcatacctactccggggccccctgacctgggcctcacctccagatgcttgctggagccctgcatcccaagtgtgccccagtgcctgccatccctggccaatgtgtccagttgcttggaaggtagtatgggcctgcggagcctgtag

SEQ ID NO: 41691 - DNA, 1356 bp, Artificial Sequence
  Description of Artificial Sequence: Synthetic coding sequence
atgcacggctacttcggctgcaacgccgccgccgagcccggctactcagcgtttgtgggaacaccacaaatctgtgtcactaaaatgtcgacgcggaattgtcaaggcatggactccgtcattaagccactggatactattccagaagacaagaaggtacgagtacagcgcactcaaagcacttttgatcctttcgagaagcccgccaaccaagtcaaacgggtgcactcagagaacaatgcttgcattaattttaagacaagcagtacgggaaaggaaagtccaaaggtgcggcgacatagttcacctagtagccctacctcccctaaattcggcaaggccgatagttatgagaagctggaaaagctgggggaaggaagctacgctaccgtgtacaagggtaagtctaaggtgaacggaaaacttgtagccttaaaagtgatacgcctgcaggaagaagaggggactccattcacagcaatccgggaggcatctctactgaagggcttaaaacacgctaacattgtcttgttgcacgatatcatacacactaaggagacccttactctcgtgtttgaatatgttcacaccgatttatgtcaatacatggataagcaccctggcggacttcatccagacaacgtcaagctctttctcttccaattgctccgcgggctgtcttatatccaccagaggtatattctgcaccgggacctgaaaccccagaatctgctaatatctgacactggcgagctgaagctcgctgactttggtctggcgagagccaagagcgtcccttcgcacacttacagcaacgaagtggtgactctatggtaccgtccccctgacgtcctcctgggctctacagaatatagcacgtgcttggacatgtggggcgtggggtgcatctttgtggaaatgatccagggcgtggccgcctttcccggcatgaaggatattcaggaccagctcgagcggatctttctggtactcgggaccccaaacgaggacacgtggcccggcgtgcatagtttgccgcacttcaagccagaacgttttacgctctactccagcaagaatctacgccaagcctggaacaagctgagttatgtgaaccacgctgaggacctggccagcaaactgttacagtgctccccaaaaaatagactctctgcacaggccgccctttcccacgaatatttctcagacttgccccctcgactttgggagctgactgacatgtcttcgatttttacagtgcctaacgtgaggctgcagcctgaagccggagaatcaatgagagccttcggcaagaacaactcttatggaaagtcactatcaaactctaaacattag

SEQ ID NO: 41692 - DNA, 1410 bp, Artificial Sequence
  Description of Artificial Sequence: Synthetic coding sequence
atgtgcgacctgatcgagccccagcccgccgagaagatcggcaagatgaaaaaactgcgccgaacactgtctgagtcattctcacggatcgccctgaagaaggatgatacaacctttgacgagatttgcgttacaaagatgtccacgcgcaactgccagggaatggacagcgtcattaagcctttggataccattcctgaggataaaaaggtccgcgtacagaggacacagagcacttttgacccatttgagaaaccagccaaccaagtcaaaagggtgcatagcgaaaacaatgcctgtattaacttcaaaaccagtagcaccgggaaagagtctccgaaggtgcgccgccactcatctcctagtagtccaactagcccgaaatttggaaaagccgatagttacgagaaactggaaaaactgggcgaagggtcctacgctacagtgtataagggcaaaagtaaggtgaatggcaagctcgtggcgctcaaggtcattcgactgcaggaagaggaggggactcctttcactgcaatccgggaggcctctcttctgaaggggttaaagcatgccaatattgtcctactgcacgatatcatacacactaaggagaccctaactctggtattcgaatacgtgcacacagacctgtgccagtacatggacaagcatcctgggggcctgcaccctgacaatgtcaaattgtttctattccagctactgaggggacttagctacatccaccagaggtacatccttcaccgggacttaaagccgcagaatctgctgatttccgatacgggtgaactaaagttggctgactttggcctggcccgcgctaagtctgtgccaagtcacacatattccaatgaggtggttacactatggtaccgacccccagacgtgctgttggggagtaccgaatatagtacctgtttggacatgtggggtgttggctgcatcttcgtcgagatgattcagggtgtggcggccttcccgggaatgaaagacatccaagaccagctcgaacggatattccttgtactgggcaccccaaacgaggacacttggcctggtgtccattcgctgccccatttcaagccggaacgctttactctgtactctagtaagaacctgcgacaagcctggaataaactctcatacgtgaaccatgccgaggatctggcatccaaactgctccagtgtagcccaaagaacaggctgtctgctcaggctgcccttagtcacgaatacttcagtgatctcccccctcggctgtgggagcttacggacatgagttctattttcacagtgccaaacgttcgcctgcagcccgaggctggcgagtctatgagagcattcggcaaaaataatagctacggtaagtccttgtctaattcaaagcattag

SEQ ID NO: 41693 - DNA, 1023 bp, Artificial Sequence
  Description of Artificial Sequence: Synthetic coding sequence
atgctggccctgaccctgcggcccccccccctggccaagagccaccttaaattaggcggtactcctgctccagctcgagttaacggcaagctggtcgccctcaaggtcattaggttacaagaagaagagggcactccatttacagccattagagaagctagtttgctcaaaggattgaagcacgctaatatcgtcttgttgcacgatatcatacacacaaaggaaacgctcacactagtatttgagtacgttcacactgatctgtgtcaatatatggacaaacatcctggaggccttcaccccgataatgtcaaactgttcctgttccagctgctgcgcgggcttagctatattcaccaaaggtatatccttcacagggatctcaaacctcaaaatttactaatctcagacaccggcgaactgaagctggccgattttggccttgctcgcgcaaaaagtgtaccatctcacacatacagtaacgaggtagtgacactatggtatcgccctcctgacgttctgctgggatccacagaatattcaacatgtttggatatgtggggtgttggctgtatcttcgtagagatgatccagggggtcgcagctttccccggcatgaaggacattcaggaccagcttgagcgtatattccttgtcttagggacccctaacgaggatacttggcctggagtgcattcacttcctcacttcaaacctgagcgattcaccctgtatagtagcaagaacctgcggcaagcctggaacaaactgtcatacgtgaaccacgcagaagacctggcttcaaagctgctacaatgcagtccaaaaaaccgccttagcgcacaggccgcgctcagccatgaatacttctctgacttgcctccgagactttgggagttaactgatatgagctctatcttcacagtacccaacgttcgcctacaaccagaggcgggtgagagtatgcgtgccttcgggaaaaataatagctacggcaagagcctttccaactctaagcattag

SEQ ID NO: 41694 - DNA, 1353 bp, Artificial Sequence
  Description of Artificial Sequence: Synthetic coding sequence
atggaccagtactgcatcctgggccggatcggcgagggcgcccacggaattgttttcaaagccaagcacgtggagaccggcgagattgtggcgctgaaaaaggtagccctacggcggctggaggacggatttcccaatcaggctctccgagaaatcaaggctctccaggagatggaagataatcagtacgtcgtacagcttaaggccgtatttccgcacggaggaggctttgtgttggcattcgagtttatgcttagtgaccttgctgaggtggtacggcacgcccagcggccattggcacaggcccaagtcaagtcttacctacaaatgttgttgaagggcgtggccttttgtcacgccaataatatcgttcacagagatctcaagcctgctaatctcctgatcagcgcatcaggacagctcaaaattgccgactttggactcgccagggtgttctctcccgatggctcccgcctctatacacaccaagttgccactcgctcagtcggttgcataatgggagagcttctgaatgggtctccactatttccaggaaagaacgacattgagcagctctgctacgtcctgagaattttgggcacgccgaacccccaagtatggcccgaactgaccgaactgcccgattacaataagatctcatttaaagaacaggttccaatgcccctcgaggaggtccttcccgacgtttcacctcaggcactcgacctcctggggcaatttctcttgtacccgccccatcagcgcattgctgcaagcaaagcactcctgcaccagtatttttttaccgcgcctctgcccgcccatcctagcgagcttccaatcccccagcgcttggggggccctgcccccaaagctcatcctggccccccacacatccacgactttcatgtggaccggcccctggaggtggccgtggagccacgggcagactcagctctgcatcctggtggggtgcgctcctggccctggtccaggctgccggccccccaggaccactctgttcacttgttcctgtgccacctgcctgggttcaccctccagggactaccaatggcaactgtaggaccgcaccataccttacctctgagtccttgtgagggctggtctcgaggcaggggccacgtgccaagccaggaatatgagaacatacagtcatcaagaggcgattcatggcccgtactcggagagccatatctcctctgtgcaaccgacgtgccaatcagaacagtgtctagcgctgcatcacagggactgcacatgcaaaatgatgatgcttgccttggtgccgctcctgagtgttgtctgttggtgaaggagaagtgccgggaatag

SEQ ID NO: 41695 - DNA, 1041 bp, Artificial Sequence
  Description of Artificial Sequence: Synthetic coding sequence
atggaccagtactgcatcctgggccggatcggcgagggcgcccacgggatcgtctttaaagcaaaacacgtcgagaccggcgagattgtggcacttaagaaggtggctctgagacggctggaggatggatttcccaaccaggcactccgtgaaataaaagcactccaggaaatggaagataaccagtatgtggtccaactcaaagcagtatttcctcacggaggcgggttcgtgctcgcctttgagttcatgttgtccgacctggccgaagtggtgcgccacgcgcaacggccccttgcccaagcgcaggtgaagagttatctgcaaatgctacttaaaggtgtcgctttctgtcacgcaaataacatagtgcacagggatctgaagccagctaacctgctgataagcgcatctggacagttaaagatcgcagacttcggcctcgctagagttttttcccccgatgggtcccgcttgtatactcaccaggtagctacacgatggtatcgtgccccagaattgctctacggagctagacagtacgaccagggtgtggatctctggtccgttggatgtattatgggcgaactgctgaacggatcaccactcttcccggggaagaatgacatcgagcagctgtgttacgttcttcgtatactcggaacccctaaccctcaggtgtggcccgaactgaccgaactccccgattataacaaaattagttttaaggagcaagtgcctatgcctttagaagaggttctgcccgacgtctctcctcaggctctcgacttgctaggccaatttctgttgtaccctccccatcagagaatcgccgccagtaaagcactcttacaccaatacttcttcaccgcacctctcccagcccacccttctgaactccctatccctcagagactgggcggtccagcaccaaaggctcaccctggacctccccacatccatgattttcatgtcgatagacccttggaggagtcactgctcaatccagagctgattaggcccttcattctggagggttag

SEQ ID NO: 41696 - DNA, 1017 bp, Artificial Sequence
  Description of Artificial Sequence: Synthetic coding sequence
atggaccagtactgcatcctgggccggatcggcgagggcgcccacgggatagtattcaaggctaagcacgtcgaaccaagagtggggtggcaatgcctccccagcatcttgcagacgggagagatcgtggccctcaagaaggtggccttgcggcgtctggaagacggctttcccaatcaggctctccgcgaaatcaaagctttgcaggagatggaagacaaccagtatgtcgtgcagctgaaagcagtgtttccacatgggggagggtttgtactggccttcgaatttatgctgtcggacttagccgaggtcgtacggcacgctcagagaccactggcccaggcgcaggtgaaatcctacttgcagatgctgctcaagggcgttgccttttgccacgccaacaacattgtccatcgggatctcaagccagcgaacctgctaatcagcgctagtggacagctgaagatagctgattttgggttggcccgggtgttctctcccgatggcagccgcctatacactcatcaagtggcaacccggagcgtgggctgtattatgggcgaactcctgaatgggtcacccctatttcctggcaagaacgatatcgaacagctttgctacgtgctaaggatcttaggtacgcctaatccccaggtctggcccgagctgactgaacttcccgattataacaagatctcatttaaagaacaggtccccatgcctctggaagaggtgcttcctgatgtcagtccacaagccctggatttgctgggccagtttctactgtatccaccgcaccagagaatcgccgcatcaaaagctctcctgcaccagtacttcttcaccgcccctctccccgcccatcccagcgaactgcccattccccagcgcttgggtgggcctgcccccaaagcacaccccggacctccccacatccacgacttccatgtggaccgtcccctggaggagagtttgctaaatccggaactgattagacctttcattctggaaggctag

SEQ ID NO: 41697 - DNA, 732 bp, Artificial Sequence
  Description of Artificial Sequence: Synthetic coding sequence
atggaccagtactgcatcctgggccggatcggcgagggcgcccacggaatagtctttaaagccaaacacgtggagaccggggagatcgtcgcattaaaaaaggttgccttaaggaggctggaagatggcttcccgaaccaggcccttcgcgagatcaaggctttgcaggaaatggaagacaaccagtacgtggtccagttgaaggccgtcttcccacacggtggaggcttcgtgctggccttcgaattcatgctctctgacctcgccgaagtggtgaggcacgctcagcggcccctggcgcaagctcaggtgaagagttatctccagatgttgttgaagggggtcgctttttgtcatgcaaataatatcgtgcacagagatttaaagcctgccaatctgttgatttccgcgtctggacagttgaagattgctgacttcggcctggcgagggtcttttcccccgacggaagccggctgtacacccatcaggtggcaacgcggtccagcttgtcatgtcgtaccactactcgcagccctctcagaagtcggtgcccttgtccttggcggcgttgctgtctgacctcattgcctcgccactggatttgttgggtgaatagcttctctacgctcttgacaagtgctagccagctcccccgcctgtcctccatatcaacctctagccaacttccatgcctcccaattcatctgtcatgcagattcctgtctgtgtag

SEQ ID NO: 41698 - DNA, 978 bp, Artificial Sequence
  Description of Artificial Sequence: Synthetic coding sequence
atggaccagtactgcatcctgggccggatcggcgagggcgcccacgggattgtatttaaagccaaacacgtggaaaccggtgagatagtggctctgaagaaggttgccctgagaagacttgaggatggcttccctaaccaggccctcagggaaattaaagctctacaggagatggaggacaatcagtacgttgtgcaattgaaagctgttttcccacatggcggaggatttgtcttggccttcgagtttatgctgtccgacctggccgaagtggttcgccacgctcaacgccctctggcccaggcccaagtgaaaagctacctgcagatgctgctcaagggcgtggccttctgccacgcgaacaacatagtgcatagagacttgaaacctgctaatttattgatcagtgctagcggccagttaaagattgcagatttcggactcgccagagtatttagcccagacgggtccagactctacacccaccaggtcgccacaagatcggtgggttgcattatgggcgaactccttaatgggagccccctttttcctggaaaaaacgatatcgagcagctttgctacgtgttgaggattctgggcacccccaacccgcaagtttggccagagctaaccgagctgcctgactataacaaaatttcttttaaggagcaagtgcctatgccattggaggaggtgctccccgacgtgtcccctcaagcattggatctgcttggtcagttcctcctgtaccctcctcatcagaggattgcagcctccaaggcactactgcaccaatacttctttacagcccctctgccagcccacccgagcgagctgcctattccccaacggctgggtggaccagcccctaaggctcacccgggccctccccatatccacgactttcatgtggatcggcccctggaagagagcctgctgaaccccgagctcatccggccctttattctagagggctag

SEQ ID NO: 41699 - DNA, 465 bp, Artificial Sequence
  Description of Artificial Sequence: Synthetic coding sequence
atggacgccccccggctgcccgtgcggcccggcgtgctgctgcccaaactggtgctactgtttgtatacgctgacgattgtctagcccaatgcgggaaggactgcaagagttactgctgtgatgggaccaccccttactgctgttcctactacgcgtatatcggaaacatattgagtgggacagcaattgctggtatcgtgtttgggatcgtgtttatcatgggagtgatcgctgggattgcaatctgtatctgtatgtgcatgaaaaaccaccgggccacgcgggttgggattctgcgcacaacccacatcaacactgtgagtagctacccagggccccccccttatggacacgatcatgaaatggagtactgcgccgatttgccccccccatattcgcctacaccacagggaccagctcagcgctcgccacctccgccatatccaggaaacgcgcgaaagtag

SEQ ID NO: 41700 - DNA, 519 bp, Artificial Sequence
  Description of Artificial Sequence: Synthetic coding sequence
atgaagtgcgagcccggctggccccggacccccgagtggccccccagcccccgcctgagcgctgtcgggcgggataaggagacctgggcgccttctgccgcaaggttaggtcctcgagcccctcagctgcggggagtgcctcagagtcttgcacgagacgcccccggccctgggagcctgggccggctgcctcggcagtggccagggctgtgtagtacaaggttatcaggggctctgttgtctcccagcgaccggccaccaagcagcccttttccccctgtgcctgggtcgccattcgcgccttctctgaggccaccagcatggatggacgcccctaggctgcccgtcagaccgggcgtgctgctccccaagctcgtgctgctctttgtgtatgcagacgactgtttggcccaatgtggaaaagattgcaagtcatactgctgcgatggcactacaccctactgttgttcgtactatgcatatataggcaacatactctcatgttgttgcccccgctag

SEQ ID NO: 41701 - DNA, 675 bp, Artificial Sequence
  Description of Artificial Sequence: Synthetic coding sequence
atgagcatcctgctgcccaacatggccgagttcgacaccatcagcgagttggaagaagaagaggaagaagaggctgctacctcaagtagcagcccatcctcttccagtagtgtgtctgggccagatgacgacgaagaagatgaggaggaggaggaagaggaggaagaggaggaggaggaggaggaagaggaagaggaggaagaagcccctccacccccgcgcgtggtcagcgaggaacacttgaggcgatatgcgccagatccagttttggtgaggggagctggtcacataaccgtatttgggctgtccaacaagttcgacacagagtttccatcagtactcaccggtaaggtcgctccagaagaatttaagacatccatcggtagagtgaacgcatgtttaaaaaaggcactgcccgtgaatgtcaagtggctcctgtgcggatgcctgtgctgttgctgcaccctcggatgctctttgtggccggtcatctgtctgaataagagaactcgacgctccatacagaagctcatcgaatgggagaacaaccgcttgtatcataagctggccctgcattggaagctcactaagcgcaaatgcgagactagcaatatgatggagtatgtcattttgatagagtttcttcctaagtaccccatctttcggccagactag

SEQ ID NO: 41702 - DNA, 615 bp, Artificial Sequence
  Description of Artificial Sequence: Synthetic coding sequence
atgagcatcctgctgcccaacatggccgagttcgacaccatcagcgagctcgaggaagaggaagaggaagaggctgcaacttcatcgagtagcccatcctcgagctctagtgtgagcgggcccgatgacgatgaagaagatgaagaagaagaggaggaggaggaagaggaagaggaagaggaggaagaggaggaggaagaagaggcccccccaccaccgagagtcgtcagcgaagagcatcttcggcgctatgcacctgaccctgtacttgtgaggggcgccggtcatattaccgtgtttggcctgagcaataaattcgatacggaattcccatccgtcttaactgggaaggtggcaccggaggagttcaaaacaagcatcggccgcgtcaatgcctgcctaaagaaggctttgccagtaaacgtaaagtggcttttgtgcgggtgcctctgctgttgttgcacccttggctgtagtctgtggccggtcatatgtctgaataaacgcacccgcaggtctatccagaagcttattgaatgggaaaacaaccgcctatatcataaggtgattctgattgagtttttgccaaagtaccctattttcagacccgattag

SEQ ID NO: 41703 - DNA, 1341 bp, Artificial Sequence
  Description of Artificial Sequence: Synthetic coding sequence
atgcacgagcccagcctgtgcgccaacgtggagtgcccccccgcccacacatgcccttgtggcgttcccgcatgtagctgtgcacatgtcgagtgccccccagctcatacctgccggtgcggggtccctgcttgtagtcatatgcctatgtggtcggcacgccttctgacacgggcccatgttgagtgcccccccgcccacacaagagtgcacgtcgagtgcccccctgcacatgtccccatgtggtctgctcatctgctgacctgtgccgatgtcgagtgtcatctgctgactcatgtgccaatgtggtcggccaggctgctgacttgtccctgtggcgtaccggcttgctcacatgtcccaatgcgcagcgcccgcctgctgacaagggctcacgccgagtgtccacccgcccatacctgtccttgtggtgtgccggcgtgcagccacgtgcctatgcggtcggctaggctgctgacacgggctgacgttgagtgtcctcccgcacacacatgtccttgtggtgtccctgcgtgctctcacgtccctacttggtcagcacgcctcatcactagagcacacgtggagtgttctcccgcccacacatgtcgatgcggagttcctgcatgttcccacgtccccatgtggagtgtccgcctactgaccagagcagatgccgaatgtccacccgctcatacttgcaggtgcggagtgcccgcatgcagtcatgttcccatgtggagcgcacgactcctgacatgcagatgcggggtgccggcctgttctcatgtacctatgtggtcagcccgattgctcacgtgccgctgtggtgtccccgcctgctcccacgtgccgatgtggtcggccaggctgctgactagagcgcatgtggaatgtccacccgcccacacttgccgccgcggcgtgcccgcctgctccagggcccatatggagtgtcccccagcccacacctgccactgtggagtgcctgcctgctcccatacctgcaggtgtggtgtccccgcatgctctcatgtccctatgtggagcgcccgcctcctaaccagggctcacgtggaatgtccaccagctcataccagagcccatgtggagtgcccgccagctcacacttgcccgtgtggggtacccgcttgtagtcatacctgcccttgtggtgtgccagcatgtagtcacaaggcacttgcctggtggttctgccggttccctgtgctgccagctgaatctgacgctgtcacagttcactctacccacggcggctttctgatcagattttacgtaaaggatcccttttacattagcctgcatctggagatcacctag

SEQ ID NO: 41704 - DNA, 1167 bp, Artificial Sequence
  Description of Artificial Sequence: Synthetic coding sequence
gccaacgtggagtgcccccccgcccacacctgcccctgcggcgtgcctgcctgttcttgtgctcacgtggagtgcccaccggctcatacatgtcggtgtggtgttcccgcttgctcccatatgccaatgtggtctgcccgtctattgactcgtgcccatgtggaatgtccgcctgctcacacacgggtgcacgtcgagtgtccccctgcacacgtgcccatgtggtctgcccacctgttgacctgcgcagacgtcgaatgccacctgttgacccatgtccctatgtggtccgctagactgcttacccgtgcagacgccgagtgtcctcccgcccatacttgcccttgcggggttccagcttgttctcatgtgcccatgcgtagcgcccgcctattgaccagagctcatgctgagtgtcctcccgctcacacatgcagacgcggggtgcctgcatgcagccacgtgccaatgtggagcgccaggctgctcacccgcgccgacgccgaatgcccacctgcacatacgtgcaggtgtggagtgcccgcctgtagtcatgtacccatgtggtctgcacgcctgctcacttgcaggtgtggcgtgccagcctgttcacacgtgccaatgtggtcggctcgtctcttgacctgtaggtgcggcgtgcccgcctgctcacatgtgcctatgtggtctgcccgcttactgacccgagcccacgtagaatgtccacctgcccatacttgccgccggggcgtgcctgcctgcagccgggcccacatggaatgcccccccgcccacacatgtcattgcggcgtgcccgcctgtagccatacttgtcgttgtggcgtccctgcatgctcacacgttccaatgtggtccgctaggctgctgactcgggctcacgttgaatgcccccctgcgcacacgagagcccacgtggaatgtccaccggcccacacttgtccatgtggggtccccgcctgttctcacacatgtccctgtggcgtccctgcgtgctctcacaaagccctggcttggtggttttgtagattcccggtgcttcccgcggagtctgatgccgtcactgttcactctacccatggcggttttttaatcaggttctatgtcaaggatccattctacattagtctgcacctggagataacttag

SEQ ID NO: 41705 - DNA, 861 bp, Artificial Sequence
  Description of Artificial Sequence: Synthetic coding sequence
atggccatggagggctactggcggttcctggccctgctgggcagcgccctgctcgtgggcttcctctctgtcatcttcgccttggtgtgggtgttgcattatcgcgagggacttgggtgggacggtagcgctcttgagtttaactggcacccagttcttatggtgacgggctttgtctttatccagggcatcgctattattgtgtatcgactgccctggacctggaaatgttccaagttactcatgaagagtatccatgccggactgaacgccgtagccgcaatcctggcaattatctctgtggtggccgtgttcgagaaccacaacgttaataatattgccaacatgtattctttacactcttgggtgggcttgatcgccgtgatctgttacctcctgcagctgctgagcgggttctcagtctttctgcttccttgggcaccactgtctcttcgcgcattcctgatgcctatccacgtctactccggaattgtcattttcgggacagtcatagcaacagccctgatgggcttgaccgaaaagctgattttcagcctgagggatcccgcctactccacctttccaccagaaggcgtgtttgtcaatactctaggcctgctgattctagtgttcggtgcgttaattttctggattgtcacccggccacaatggaagaggcctaaggagcccaattctacaattttacatccgaacggaggaacggagcagggcgccaggggatccatgcctgcgtatagcggcaacaatatggataaatcggattcagagcttaattctgaggtggctgccagaaaacgcaatctagccctcgatgaggcaggtcagcgcagcaccatgtag

SEQ ID NO: 41706 - DNA, 474 bp, Artificial Sequence
  Description of Artificial Sequence: Synthetic coding sequence
atggccatggagggctactggcggttcctggccctgctgggcagcgcccttctggtcggtttcttgtccgtaatcttcgctcttgtgtgggtgctccattacagggagggcttgggctgggacggaagcgcgctggaatttaattggcatcccgtcctgatggttacagggtttgtgttcatccaggggatagcctctttcagatttttctcactctctgcaagcatgggatcagcattcagcccttctattagccatgctcatacatgcttgttctggaactgtcatctgtggaattctgattgcaactctacttacggcatcgatagagagaccgacttttttcccgaaagaagctgcatacagtacatccccgctcgccgttgctttcggaaatatgcctggccctccgatcccggagtcaggggtcctcacttcctggacagccaccagaccgctatggagaccagttag

SEQ ID NO: 41707 - DNA, 687 bp, Artificial Sequence
  Description of Artificial Sequence: Synthetic coding sequence
atgctggacgagggcgaggccatcatcgtgtaccggctgccctggacctggaagtgcagtaagcttctcatgaagagtattcatgcaggactcaacgccgtggcagctattcttgcgattatttcagtggtggcagtgttcgagaaccataacgtgaacaatattgcgaatatgtatagtctccattcttgggtcgggctcattgccgtaatttgctacctgctacagctgctctcaggctttagcgtctttctgctgccttgggcgcctctgagcctgagagcctttctgatgccaattcatgtgtactccgggatagtcatcttcggtacagttatagcaacagcactcatgggactcaccgaaaaactgatattctctcttagggatcctgcttattccacctttccccctgaaggcgttttcgtcaatacactgggcctcctcattttggtcttcggcgctttaattttttggattgtgactagacctcagtggaagaggccgaaggaacctaattccactatcttacacccgaatggaggcaccgagcagggggcacgtgggtccatgccggcttattctggcaacaatatggacaaatcagattccgagttgaacagtgaggtggcggcccgaaaaagaaacctggcgctcgacgaggcagggcaaagatcaaccatgtag

SEQ ID NO: 41708 - DNA, 729 bp, Artificial Sequence
  Description of Artificial Sequence: Synthetic coding sequence
atggtgagcggccggttctacctgagctgcctgctgctgggcagcttgggatctatgtgcattttgtttacaatctactggatgcagtattggaggggtgggtttgcttggaacggatcaatctatatgttcaactggcaccctgtgcttatggtcgcaggtatggtggtattttatggaggagcatccctagtttaccgcctcccacagagttgggtgggtccaaagcttccttggaagttactccacgccgctctgcatttgatggcctttgtcctgacagtggtgggcctggtggcggtgttcacctttcacaaccacggccggaccgctaatctgtacagtctacactcctggctggggataaccaccgttttcctttttgcttgtcagtggttcttaggtttcgctgtgttcctgctgccctgggcatccatgtggttacgcagcctcctcaagcccatccatgtctttttcggagctgccatcttgtcactttccattgcttccgttataagcggcataaacgagaaattatttttctcgttaaaaaacacaactagaccctatcacagcctaccctcggaggccgtgttcgcgaactcgacgggcatgctggtggtggccttcgggttattagtgctgtacattctgctggcctcaagttggaaaagaccggagcccggcatcttgactgataggcagccattgctacacgatggggaatag

SEQ ID NO: 41709 - DNA, 780 bp, Artificial Sequence
  Description of Artificial Sequence: Synthetic coding sequence
atgggcaagaacttcagcgacagcttcctgagccgggagtgcgtgataaggatggtgagcggccggttttatctctcatgtcttcttctcggctccctcggctctatgtgtatcttatttacaatctactggatgcagtactggcggggcggcttcgcttggaatggatccatctatatgtttaactggcatcctgtgctgatggtggcggggatggtggtcttttatggaggagcttcactcgtttatagattgcctcagtcgtgggtgggacctaagttgccttggaagctgttgcatgccgccttgcacctgatggcatttgtgctgaccgtagtaggtctcgtcgccgtcttcacttttcataaccatggccgcacagccaatttgtactccctacactcgtggctaggaattaccaccgtgttcctgttcgcctgccagtggtttttgggatttgccgtgttcctgctcccatgggcttccatgtggctgaggtcactgctaaagcccatacatgtgttttttggagcggccatcctgtccctgagcatcgcatctgtgattagcggcattaacgagaagctgttcttctcactgaaaaacaccacccgaccataccactctctgcccagcgaagctgtttttgccaatagcacaggaatgttagtggtggcatttggattgctggtgctctatatcttactcgcaagcagttggaagcgacccgaacctggtattctgaccgacaggcaaccactactgcacgatggtgagtag

SEQ ID NO: 41710 - DNA, 729 bp, Artificial Sequence
  Description of Artificial Sequence: Synthetic coding sequence
atggtgagcggccggttctacctgagctgcctgctgctgggcagcttgggatcgatgtgtatcctgtttaccatctattggatgcaatactggcgagggggctttgcatggaatggtagcatctacatgttcaactggcaccctgtgctgatggtggcagggatggtagtcttttacggcggggctagtcttgtctaccgccttccccaatcttgggttggacctaagctaccgtggaagctactgcatgcagcactgcacctcatggcctttgtcctgacagtggtcggactggtggctgttttcacctttcacaaccatggcaggacggctaacttgtacagcttgcattcctggctgggaattacaaccgtatttctatttgcatgccaatggtttcttgggttcgctgtgtttctccttccctgggctagcatgtggttgcgttcccttctgaaacctatccacgtatttttcggcgccgcgatactgtccctgtcaatagcctccgttatatctgggataaacgagaaacttttcttcagcctgaagaataccactcgtccatatcatagcctgccaagcgaagcagtgtttgcaaacagcacgggtatgcttgttgtcgcgttcgggctactggtgctctatatcttgttggcatctagttggaagaggccagaaccgggtatcttgaccgatagacagccattgctccacgacggtgagtag

SEQ ID NO: 41711 - DNA, 549 bp, Artificial Sequence
  Description of Artificial Sequence: Synthetic coding sequence
atggtgagcggccggttctacctgagctgcctgctgctgggcagcttggggtccatgtgcatactcttcaccatctactggatgcagtactggcgcggtggtttcgcatggaacggaagcatctacatgtttaactggcaccccgtcctaatggtggccggaatggtggttttttacggcggtgcttctctggtctaccgcttgccgcagtcctgggtgggaccaaagctgccatggaagctccttcatgcagcactccatctcatggcattcgtgttgacagtcgtgggcttggttgccgtgtttacttttcacaaccacggaaggactgcaaacttatacagtttgcactcatggctggggattacaaccgtcttcctctttgcatgtcagtggttcctcgggttcgccgtctttctcttaccctgggcatctatgtggctgcgttcgctgctgaagcccatacacgtatttttcggagccgctatcctaagtctgagcatcgcatccgtcatctcaggcataaacgaaaagttgttcttctcgtag

SEQ ID NO: 41712 - DNA, 87 bp, Artificial Sequence
  Description of Artificial Sequence: Synthetic coding sequence
atggtgagcggccggttctacctgagctgcctgctgctgggcagcctgggctcgatgtgtatcctgtttacaatatattggatgtag

SEQ ID NO: 41713 - DNA, 348 bp, Artificial Sequence
  Description of Artificial Sequence: Synthetic coding sequence
atggtgagcggccggttctacctgagctgcctgctgctgggcagcttaggcagcatgtgtatcctattcacaatctattggatgcaatattggagaggaggattcgcatggaatgggtcgatctacatgtttaattggcatccagtcttgatggttgccggtatggttgttttctatggtggcgctagccttgtgtatcggctcccacaaagctgggtcgggcctaagcttccttggaaactgctgcacgctgccctccatttaatggcattcgttctaaccgtggtaggcctcgtggctgtttttacctttcacaatcacgggaggactgccaatttgtacagctag

SEQ ID NO: 41714 - DNA, 603 bp, Artificial Sequence
  Description of Artificial Sequence: Synthetic coding sequence
atggtgagcggccggttctacctgagctgcctgctgctgggcagcttaggcagtatgtgtatactatttactatctactggatgcaatattggcggggaggctttgcttggaatgggagtatctacatgtttaactggcatccggtgcttatggtggcaggcatggtcgtattctatggaggagccagtctggtatataggctgccacaatcctgggtgggcccaaaactaccttggaagttactgcacgctgctctccacctgatggccttcgtgttgaccgtggtgggattggtcgccgtgttcacgttccataaccatggcaggacagcgaatctgtattccctgcactcgtggctggggattactactgtgttcttgtttgcttgtcagtggtttttaggcttcgcagtcttcctgcttccctgggccagcatgtggctgcgaagcctgctgaaacctatacacgtgtttttcggcgcggcaatactttctctctcaatcgcctccgtcattagtggcataaacgagaaactcttcttctcattaaagaacaccaccaggccttaccactccctcccatcagaggctgtctttgcctag

SEQ ID NO: 41715 - DNA, 168 bp, Artificial Sequence
  Description of Artificial Sequence: Synthetic coding sequence
atggtgagcggccggttctacctgagctgcctgctgctgggcagccttgggagtatgtgcatactcttcactatctattggatgcagtactggagggggggcttcgcttggaatggctcaatatacatgttcaactggcatccagtcctgatggtggccgggatgtag

SEQ ID NO: 41716 - DNA, 918 bp, Artificial Sequence
  Description of Artificial Sequence: Synthetic coding sequence
atgggcatccagaccagccccgtgctgctggccagcctgggcgtggggctggtgacccttctgggtcttgccgtcggtagctatcttgttcggagaagtcgcagacctcaggttacactcctggatcctaatgagaagtacctgctgcgcctcctcgacaagacaactgtaagccataacactaagcgatttcgttttgcccttcctacggcccaccatacgttaggcctgccagtcggcaagcatatttacctcagtactagaatagacggaagcctcgtgatcagaccctatacccctgtgacttctgatgaggaccagggctacgtcgacctggtgattaaagtttatcttaagggggtgcatccgaaattccctgaaggtgggaagatgagccagtatttggatagtttgaaggtgggcgatgttgtggaattcagggggccttctggccttctgacttacaccgggaagggccatttcaacattcaaccaaataagaaatcgcccccggagcctcgcgtggcaaaaaagctggggatgattgccggaggcaccggaatcacccccatgcttcaactgattagagctatactcaaggttcccgaggaccccactcagtgctttctgctcttcgcaaatcagacagaaaaagatatcattctgcgggaggacctagaggagctgcaggccagatatccgaatcgcttcaaattatggtttacactcgaccatccaccaaaggactgggcctattcgaagggattcgtgacagccgatatgatccgcgagcatctgcctgcccctggcgatgacgtgctggttctcctgtgcgggcctcctccaatggtgcagctggcctgtcatcccaacctagacaaactggggtattcacagaaaatgaggtttacctactag

SEQ ID NO: 41717 - DNA, 681 bp, Artificial Sequence
  Description of Artificial Sequence: Synthetic coding sequence
tgaaccgcccaccacaccctgggcctgcccgtgggcaagcacatctatctgagcacccggatcgacggcagtctggtgattcggccttacaccccggtgactagcgacgaagaccagggctatgtggacctcgttatcaaggtttacctcaagggggtgcatcccaagttcccggaagggggtaaaatgagtcaatatttggattctctcaaggtaggagatgttgtggagtttaggggacccagcggcctcctgacatacactgggaaaggccacttcaacatccagccaaacaagaaatcaccaccagaaccaagggtcgcaaaaaagctaggaatgatcgccggaggcacaggcataactcccatgctacagctgatcagggccatacttaaagtccccgaagatcccactcagtgcttcctgctcttcgctaaccagacagaaaaagacattatcctacgggaagatctagaagagctgcaggcacgataccccaaccggtttaaactctggttcacactcgatcatcccccaaaaggtatcctgcccatttctggacatcctaccataccctccagcagcaaatccaagccttgcccttttgtaaacagtgggttcatagagatcaatttggcgtcccactgtcagttggggtcactgtcagctcaaacacagtag

SEQ ID NO: 41718 - DNA, 402 bp, Artificial Sequence
  Description of Artificial Sequence: Synthetic coding sequence
atgcagcccctggaggtgggcctggtgcccgcccccgccggcgagcctaggttgacaaggtggctgcgaagaggatccggcatcctagcccatttggtggcccttggattcaccatcttcctgacagcactgtcccgaccaggaacaaagaccggcccactgatggaggacaggagtgagggtgggagagcacggtgggtgatgccagagattcctgctctatgggaagccgatgcaggcgggtcacttgaggttttctccccggggaccctttactcttggccctggcgaagcgctagcgcctggctgaaaccttcctattctagccacttgaacacaccgtgcagcagctctgcccccgagaaacacggcagcggctctaccggccaggggcgaccctag

SEQ ID NO: 41719 - DNA, 756 bp, Artificial Sequence
  Description of Artificial Sequence: Synthetic coding sequence
atgcagcccctggaggtgggcctggtgcccgcccccgccggcgagccccgcctcacccgatggctgcggcgcggatccggcattctggctcatctcgtagctttagggtttaccattttcctgacagcgctgtctcggcccgggaccaagacgggaccacttatggaggaccgaagcgagggtggccgggctcgctgggtgatgccagagattcccgccctgtgggaagccgacgccggaggctccctcgagttctgtctgtgcatggctgaggcgatcttgcttttctctcctgagcatagcctgtttttcttttgctcgcgtaaggcacgtatacgtctgcactgggccgggcaaacattagcaatcctctgtgccgcgctgggtctgggttttattatcagctcgagaacaaggtccgaattgcctcacctcgtttcctggcattcctgggttggagcactaaccctgctggcgacagccgtgcaagctctctgtggactatgcctcctgtgtcctagggccgcgcgggtgagtagagtggcgagacttaagctgtaccacttgacttgtggtctggtcgtgtacctgatggcaactgtcaccgtgctcctcggcatgtactcagtttggtttcaggcgcaaattaagggcgctgcttggtatctgtgtctcgcacttcccgtttacccagctctcgtgatcatgcaccagatatcgcgcagctatctgccgaggaagaaaatggagatgtag

SEQ ID NO: 41720 - DNA, 519 bp, Artificial Sequence
  Description of Artificial Sequence: Synthetic coding sequence
atgcagcccctggagttctgcctgtgcatggccgaggccatcctgttgttttcacccgagcattctctgtttttcttctgctctcggaaggctcgaattcgccttcattgggcagggcagactcttgcaatcctgtgcgccgctctggggttgggtttcattatctcctccagaacaagatcggagttgcctcaccttgtcagctggcactcatgggtcggcgccttaacactgttagccacagctgttcaagccctctgtggcctgtgcctactatgtccacgagcagcgcgggtctcccgggtggctcggctcaaactatatcatcttacatgcggactcgtggtctacctgatggccaccgtgaccgttctactggggatgtactcagtgtggttccaggcccagatcaaaggtgccgcttggtacttatgcctggcactgcccgtgtatccagccctcgttataatgcaccagattagtcggtcttaccttccaagaaagaaaatggaaatgtag

SEQ ID NO: 41721 - DNA, 690 bp, Artificial Sequence
  Description of Artificial Sequence: Synthetic coding sequence
atgcagcccctggaggtgggcctggtgcccgcccccgccggcgagccacgactcacacgctggcttcgccgcggcagtggtattcttgctcacctggtagcccttggcttcaccatttttctcactgcgttatcgagaccagggaccagtttgttttcatggcaccctgtctttatggcccttgccttttgcctgtgtatggcagaagccatactccttttttcccccgagcacagcctgttttttttttgttccaggaaagccaggattcgccttcattgggctgggcagacactggccatcctgtgcgctgccctcggtctggggttcatcatctcgtcccggacacggagcgaactgcctcacttggtgtcttggcattcctgggtgggcgctttaaccctgttggccaccgccgtacaggccttgtgtggcctctgcctcctgtgtccccgggcggctagagtatcgcgagtggcaaggctcaagctgtaccacctgacctgtggattagtggtgtacctcatggcaacggtcactgtgctgttaggaatgtacagcgtatggttccaggcccagattaagggtgccgcttggtacctctgcctggctctgcccgtgtatcccgccttggtcattatgcaccagatctccagatcttatctccctcggaagaagatggaaatgtag

SEQ ID NO: 41722 - DNA, 387 bp, Artificial Sequence
  Description of Artificial Sequence: Synthetic coding sequence
atgcagcccctggaggtgggcctggtgcccgcccccgccggcgagccacgcctcaccaggtggctgcggcgaggatcaggaattctggcccaccttgtcgctcttggttttacaatatttctgacagccctttcaaggcctggcacaaaaactggaccattaatggaggatcgctccgagggcgggagagcccggtgggtcatgcccgagatacccgcactgtgggaagcggatgctggcgggtccctggaagttttctctcctggcaccctgtacagctggccgtggcgcatgtacgaatccacaagcttcttctcaggccttcaggcgaggcacgaagcctattggctgtcccctatgttcacagtgcttccactgcacggttag

SEQ ID NO: 41723 - DNA, 225 bp, Artificial Sequence
  Description of Artificial Sequence: Synthetic coding sequence
atgcccaagtactacgaggacaagccccagggcggcgcctgcgccggcctgaaagaagacctgggagcatgccttctgcagtccgactgtgtggtgcaggaaggaaagagcccgcgtcagtgcctaaaggaaggctactgtaattctttgaaatacgctttcttcgaatgcaaacgatccgtcctcgacaaccgcgcgcgctttagaggacgaaaagggtactag

SEQ ID NO: 41724 - DNA, 330 bp, Artificial Sequence
  Description of Artificial Sequence: Synthetic coding sequence
atggccgccgtgggcgtgttcagcgtgagccggctgctgggccggagtcggccacagcttgggcggccaatgagctctggagcccacggcgaagagggttctgctcgcatgtggaagaccttaacattctttgtcgccttaccaggcgtggccgtgtcaatgctcaatgtgtatcttaaatcacaccatggtgaacacgaacgaccggagttcatcgcttatccgcacctgcgaattcgcaccaaaccatttccttggggggacgggaatcacacactcttccacaaccctcatgtgaatccgctccccactggctacgaggatgaatag

SEQ ID NO: 41725 - DNA, 294 bp, Artificial Sequence
  Description of Artificial Sequence: Synthetic coding sequence
atggccctgcccctgcggcccctgacccggggcctggccagcgccgctaaaggcggtcacggaggggccggcgctcgcacatggcgccttctgacctttgtgcttgcccttccctcggtggccctctgcacctttaactcttacctgcatagcgggcaccggccaagaccagagttccgcccttaccagcacctgcggatcagaacaaagccctatccctggggtgacggaaatcatacactcttccacaattcccacgtcaaccctcttccaacaggctatgagcatccttag

SEQ ID NO: 41726 - DNA, 267 bp, Artificial Sequence
  Description of Artificial Sequence: Synthetic coding sequence
atgctggacgtggaggcccaggagccccccaagggcaagtggagcaccccaccatttgatcccagatttccctctcagaatcagatccgtaattgttaccagaactttctggactaccaccgctgccttaaaaccaggaccagaagaggtaaaagtacacagccctgtgagtactattttcgggtctatcactccctgtgccccattagttgggtggagtcttggaacgagcagattaaaaacggaatctttgcagggaaaatctag

SEQ ID NO: 41727 - DNA, 243 bp, Artificial Sequence
  Description of Artificial Sequence: Synthetic coding sequence
atgttccccctggtgaagagcgccctgaaccggctgcaggtgcggagcattcagcagaccatggccagacagagtcaccaaaagcgtactcccgacttccacgataagtacggtaacgctgttctggctagtggggcaactttttgtattgtaacatggacttatgtggccactcaggtgggcatcgagtggaacttatcccccgtgggtcgggtgacccccaaagagtggcgcaatcaatag

SEQ ID NO: 41728 - DNA, 210 bp, Artificial Sequence
  Description of Artificial Sequence: Synthetic coding sequence
atgagcgtgctgacccccctgctgctgcggggcctgaccggcagcgcaagacgcctacctgtgccgcgcgccaagattcattccctgccacctgaagggaagttaggcatcatggaactcgccgtgggccttacgtcctgtttcgttacctttctgctgcctgcgggatggatcttgtctcatctggagacataccggcggccggagtag

SEQ ID NO: 41729 - DNA, 219 bp, Artificial Sequence
  Description of Artificial Sequence: Synthetic coding sequence
atgcccctgctgcggggccggtgccccgcccggcggcactaccggcgtcttgccctcctgggcctgcagccggccccacgcttcgcccacagtggacccccgagacagcggcctctgtctgccgcagaaatggccgtgggtttggttgtgttcttcacaacatttctcacccccgctgcctacgtcctaggcaatctgaagcagtttcggaggaactag

SEQ ID NO: 41730 - DNA, 1092 bp, Artificial Sequence
  Description of Artificial Sequence: Synthetic coding sequence
atggcccccgaggccaccaagaacttcctgcccctgctggacgccgtgtctagagactttgtgtccgtactgcacagacgcatcaaaaaggccggctccggaaactactctggagacattagtgatgacctgtttcgatttgccttcgagtctattactaatgtgattttcggcgaacgccaagggatgctggaggaggtagtgaatcccgaggcccagaggttcattgacgctatttaccaaatgttccacacaagtgtgcctatgctgaatctccctcctgacctcttccggctctttcgtacgaagacgtggaaggaccacgtggctgcttgggacgtaatcttctcgaaggccgacatttacacacagaatttttactgggagctgaggcagaaagggtccgttcaccacgactataggggtatcctgtacaggctgctcggggattctaaaatgtcttttgaagacatcaaggcgaacgtgacagaaatgcttgctgggggcgtcgatactacctccatgacactccagtggcatctgtacgagatggcccgtaacttgaaggttcaggacatgctgcgagcagaagtattggctgcccgccaccaggctcagggtgacatggccactatgctgcagctggtgccactgctcaaggcaagtatcaaggaaactctgaggctgcaccccatctccgtgacgttgcagcggtacctggtgaatgacttggtactgcgggactacatgattccagcgaaaaccctagtgcaggtggcgatctacgccctgggtcgcgaacccaccttcttttttgatccagagaatttcgacccgacccgctggctctccaaggacaaaaacatcacgtacttccgcaatctgggctttggctggggggttcggcaatgcctaggaaggagaatcgccgaactggagatgactatctttcttataaatatgttggagaacttcagggtcgagatccaacacctgtccgatgttggtaccacgttcaatctgattctgatgcctgaaaaaccaataagttttaccttttggccatttaaccaagaggcgacccagcagtag

SEQ ID NO: 41731 - DNA, 1566 bp, Artificial Sequence
  Description of Artificial Sequence: Synthetic coding sequence
atgctggccaagggcctgcccccccggagcgtgctggtgaagggctgccaaacattcctatctgcacctcgcgaggggctgggtcgtctgcgcgtacctaccggcgagggagcaggcatctcaaccagaagccctcgccctttcaacgagattcccagccctggagacaatggatggctcaatctgtaccacttctggagggagacagggacgcacaaagttcacctgcaccacgtgcagaacttccagaagtacggccctatctacagggagaaactggggaacgtcgaatctgtttacgtgatagacccagaagacgttgcactcttgtttaagtccgagggccctaatccagagagattcctgatcccgccttgggtggcctaccatcagtactatcagcggcccatcggcgtgctgctgaagaagtctgctgcctggaaaaaggatcgggtagccctaaatcaagaggtcatggccccagaggccactaagaatttcctgcccctcctggacgccgtcagtagagatttcgtgtctgttctgcaccgccggatcaagaaagccggatccggcaactattctggggacatatccgacgatctattccgttttgcttttgagagtattacaaatgtgattttcggggaaaggcaaggcatgctggaggaggtcgtgaacccagaggcacagaggtttatagacgctatttaccaaatgtttcacactagcgtacctatgctgaatttaccccccgatttgttccgcctctttagaacaaaaacatggaaggaccacgtcgccgcctgggacgtgatttttagtaaagctgatatctatactcagaacttctattgggagcttaggcagaagggatctgtccaccacgactatcgcggaatcctctaccgcctcctgggtgacagcaaaatgtcctttgaggacatcaaggccaacgtcaccgagatgctggccggcggagtggacaccaccagtatgacgttacagtggcatctttatgaaatggcacgtaatcttaaagttcaggatatgctgagggcggaagttcttgccgcccgacatcaagcacaaggtgacatggctaccatgttgcagctggtgccattacttaaagcgagcatcaaggagacccttaggctccatcccatttcggtcacccttcagcggtacctggtcaacgaccttgttctgcgcgattatatgatccctgccaagaccctggtacaggtagccatttacgccttgggaagagagccgacctttttctttgatcctgagaattttgacccaacccgctggttatcaaaagataaaaacatcacttactttcgcaacttgggtttcgggtggggggtccgccaatgtctgggaaggcggattgccgaacttgagatgaccatattcctaatcaatatgctcgagaatttcagggtggaaatccagcacctctcagacgttggaacaacctttaacctcattctaatgccggaaaagccaatcagtttcacattttggcccttcaatcaggaggcgacccagcaatag

SEQ ID NO: 41732 - DNA, 1092 bp, Artificial Sequence
  Description of Artificial Sequence: Synthetic coding sequence
atggcccccgaggccaccaagaacttcctgcccctgctggacgccgtaagtcgagatttcgtgagcgtcctgcacaggcgaataaagaaagctggctccggtaattactctggagacatcagtgatgatttgtttaggtttgccttcgaatccatcacgaacgtgatatttggtgagcgtcagggtatgctggaggaggtggtgaatcccgaggcccagagattcatcgatgctatttatcagatgtttcatacctccgtccccatgctgaacttgcccccagatctctttcgcctgttcagaacaaaaacatggaaggaccacgtggccgcatgggacgtcattttcagtaaggcagatatctacacccagaacttctattgggaacttcgccaaaagggctccgttcaccacgactataggggcattctgtatcgactcttaggagacagtaaaatgtctttcgaggatatcaaggccaatgtgactgaaatgttggcgggaggagtcgacacgacgagcatgacattacagtggcacctgtacgagatggctagaaatctcaaggttcaagacatgttgagggctgaggtcttagccgccagacaccaggcccagggcgacatggccacaatgctgcagctggtgccactgttaaaggcctccattaaagaaacccttaggctgcaccctatttccgtgacattgcaacgctatctggtcaacgacctggtgctaagggattacatgatccccgccaagaccctagtccaggtggctatttacgctctcggccgggaacctacattcttctttgacccagagaattttgatccaactagatggctgtcgaaggacaagaatatcacttacttcagaaatcttggtttcggctggggagtgcggcagtgcctgggcagaagaatagcggaactcgagatgacaattttcctgatcaatatgctggagaattttcgcgtggagatccagcacctgagcgatgtaggcaccaccttcaacctgattctgatgccagaaaaacccatctccttcactttttggccgttcaatcaagaggccactcagcagtag

SEQ ID NO: 41733 - DNA, 1245 bp, Artificial Sequence
  Description of Artificial Sequence: Synthetic coding sequence
atgctggccaagggcctgcccccccggagcgtgctggtgaagggctgccagacctttctaagcgctccccgtgaggggctgggtcgcctacgtgtgccaactggcgagggtgccggcatctctactcgcagtcctcgccccttcaacgaaatccccagcccaggcgacaatggatggctcaatctttatcatttctggagagaaactggaacccataaggttcacctccaccacgttcagaattttcagaagtatgggcctatctatcgcgaaaagctgggtaacgtagaaagcgtatacgtcatcgacccagaggacgtggcactcctcttcaaatccgagggccccaaccccgaaagattcctcatacccccttgggtggcttatcaccagtattatcagcggcccattggcgtcttgctgaagaaatccgctgcctggaagaaggaccgcgtcgcgctgaatcaggaggtaatggctcccgaggctacaaagaactttctaccccttcttgatgccgtcagcagagacttcgtgtcagtgctgcacaggcggatcaagaaagctggcagcggcaattacagcggagatatttccgatgacctattccgctttgcctttgaaagcattacaaacgtcatcttcggtgagcgccagggaatgctggaagaggtcgttaacccggaggctcagcgattcatagacgcaatttatcagatgttccacactagtgtgcctatgctcaacctgcctccagatctctttcggctatttaggaccaagacttggaaggatcatgttgccgcctgggatgttatttttagtaaagctgatatctacacacaaaacttttattgggagctgcgccagaaaggttccgtacatcacgattacagggggattctgtatagactacttggggactccaagatgagcttcgaagacatcaaggccaacgttacagagatgcttgctggcggggtcgataccacaagcatgacgctccagtggcacctctatgagatggcacggaaccttaaggtgcaagatatgctgagagccgaggttctggcagcccgacaccaggcccagggcgacatggccactatgttgcaactggtgcccttattgaaagcttccattaaagaaacccttcgacattggtgcaagtggccatccatgctatgggccgaaagcccgccttccagctcgacaaggaaaattctcacccaacctgacggttag

SEQ ID NO: 41734 - DNA, 861 bp, Artificial Sequence
  Description of Artificial Sequence: Synthetic coding sequence
atgcccagcacccggtgcagcacccccgccagcccctgcagcaccttcccccagacttgttctgtttgcagcggccctcggccgaaagatcacgtggcagcctgggatgttatcttttccaaagctgatatctacactcagaacttctactgggaactcaggcaaaagggctctgtgcaccacgactataggggcatactgtaccggctgctgggcgatagtaagatgagctttgaggacattaaggctaatgtaaccgagatgctggctgggggtgtggataccacatcaatgacactacagtggcatctgtacgaaatggcaagaaacctcaaagtgcaagatatgctcagggcagaagttcttgcagcacgtcaccaggcacagggcgatatggctacaatgctacagctggttccactattgaaggcctcgatcaaggagacccttcggttgcaccccatctcagtgacgctgcagaggtatttggtgaatgatctcgtgctgcgagactatatgatacccgctaaaacccttgtgcaggtggcaatctacgctctaggcagagagcccaccttttttttcgatccagagaactttgacccaacacggtggctctccaaagacaaaaacatcacctatttcaggaatctaggattcggatggggcgtgaggcagtgtttgggccgccgcattgctgaattggagatgacaatctttctgattaacatgttggaaaactttagagtggagattcagcacctcagcgatgtcggtaccacatttaatctgatcctgatgccagaaaagcccatttcgtttacgttttggcctttcaaccaggaggccactcagcaatag

SEQ ID NO: 41735 - DNA, 435 bp, Artificial Sequence
  Description of Artificial Sequence: Synthetic coding sequence
atgctggccaagggcctgcccccccggagcgtgctggtgaagggctgccagacattcttatccgcaccacgtgagggcctcggacggcttcgggttcctacaggcgagggggctgggatctcaactagatcgcctcggcccttcaatgagattccttctcccggcgacaacggctggctgaacctgtatcacttttggcgggagaccggtacacacaaggtgcacctgcaccatgtccaaaatttccagaaatacggcccgatttaccgtgaaaagctgggcaatgtagaaagcgtctacgtcatagatcccgaggacgtagctctcctgtttaagagtgagggtcccaatccagaacggttccttatcccaccttgggtcgcttaccaccaatattaccagcgccctatcggggtactccttaatcaccattag

SEQ ID NO: 41736 - DNA, 1473 bp, Artificial Sequence
  Description of Artificial Sequence: Synthetic coding sequence
atggaccccgccgtggccctggtgctgtgcctgagctgcctgttcttgctttctctttggagacaaagtagcggaagaggaaggctgccctctggaccgactcccttgcccatcataggtaacattctgcagctggacgtgaaggatatgagcaagtcgctgactaacttttcgaaggtgtacgggccggtgttcaccgtttatttcggactaaaacctatcgtggtcttgcacgggtatgaggctgtgaaggaggccctgatagatcatggagaagaattctccggaagaggctcattcccagtggctgagaaggtgaataaaggactcggaatcctattctccaatggaaagcgatggaaagagattaggcgattctgtttgatgaccttacgaaatttcggtatggggaagcgcagcattgaggatagagtgcaggaggaagccaggtgccttgtagaagaactgcggaagactaacgcaagcccttgcgaccccacttttattctcggttgcgctccgtgtaacgtgatctgtagcgtgatcttccacgaccggtttgattataaagatcagcgcttcttgaatttaatggagaaattcaatgagaacctccgtatcctgagcagcccctggattcaagtttgtaataacttccccgctctgatagattatctgccggggtctcacaacaagatcgcagagaacttcgcatacatcaagagttatgtgctggaacggattaaagaacaccaggagagcctcgacatgaacagtgcacgagacttcatcgattgtttcttaattaaaatggaacaggagaagcacaatcagcaatcagaattcacggtcgagtcccttatcgcaacggtcacagatatgttcggcgccggtactgaaaccacgtccacaacattgagatatgggttactgttactgttgaagtatccggaagtgaccgcaaaggtccaagaggagattgagtgcgtcgtgggcagaaataggagcccctgtatgcaggatagatcccatatgccctacacagacgccgttgtgcacgaaattcagcgctatatcgacctgctccccactaacctcccccacgccgtcacctgtgacgtcaaatttaagaactatctcattcctaagggcacaaccattatcacctcattgacaagtgtgctccataacgataaagagttccccaaccccgagatgttcgaccctggccattttctggataaaagcggcaacttcaaaaaatccgactatttcatgccattcagcgctggcaaacgcatgtgcatgggtgaaggattagcgcgtatggagcttttcctgttcctaaccacgatcttgcagaatttcaatcttaagagtcaggtggaccctaaggacatagatatcacccctattgcaaacgcttttggccgcgttccacctttataccagttatgcttcatcccggtctag

SEQ ID NO: 41737 - DNA, 1296 bp, Artificial Sequence
  Description of Artificial Sequence: Synthetic coding sequence
atggaccccgccgtggccctggtgctgtgcctgagctgcctgttcctgctcagcctgtggcgccaatcttctggccgcggacgactcccttctggccccacaccattgcctattataggcaacatcttgcaactggacgtgaaagatatgtcgaaatccctcactaactttagtaaggtctacggccctgtgtttacagtctatttcggtctcaaaccaatagtggtgctgcacggatacgaagctgtgaaggaggcactgatagaccatggagaagaattctcaggtcggggctcattcccagtggctgagaaagttaataagggccttggcatcttgttcagtaacgggaaacgatggaaagagatccgcaggttttgcctgatgacattgagaaatttcggtatgggaaagcggagcattgaggatcgagttcaggaggaagcgcgttgtcttgttgaggagctccggaagaccaatgcaagtccgtgcgatcctactttcatcctagggtgtgccccttgcaacgttatttgctctgtgattttccatgataggtttgactacaaggaccaacgcttcctgaacctcatggaaaaatttaatgagaatctgcgcattctcagcagtccttggattcaggagaagcacaatcaacaatcagagtttacagttgaatctctgatagccacagtgaccgacatgtttggcgctggcacagagacaacctcgaccacacttcgatatggtttacttctgctcctgaaatatcccgaagtcacggcaaaagtccaggaggagatcgagtgcgttgttgggcggaaccggtcaccctgcatgcaggacaggtcacatatgccctacaccgatgccgtggtccatgagatacagagatacattgatctgttgccaacaaacttgccccatgctgtgacctgtgatgtgaagtttaagaattatttgatcccaaaaggcaccacaatcattactagcctgacaagtgtgttacataatgacaaggaattcccaaacccagaaatgttcgaccccggacattttctggataagtcaggcaacttcaaaaaatccgattattttatgccattctcggcaggaaagcggatgtgcatgggtgaaggcctggctagaatggagttgtttctatttcttacaacaatcctccagaactttaacctcaagtcccaggtcgaccccaaggacattgacattaccccaatagctaacgcatttgggcgtgttccaccactttaccagctgtgcttcatcccagtgtag

SEQ ID NO: 41738 - DNA, 1473 bp, Artificial Sequence
  Description of Artificial Sequence: Synthetic coding sequence
atggccctgctgctgctgctgttcctgggcctgctgggcctgtggggactgctctgtgcttgtgctcaggaccccagtccggcagcacggtggccacccggtcccagacctctgcccctggtggggaacctgcatctgctacgtcttagtcagcaagatagaagtctcatggagctgagcgagcgatacggccccgtgttcacggttcatcttggcaggcaaaaaactgtagtgcttaccggcttcgaggcagtgaaggaggcccttgcaggccctggacaggagttggcagacagaccccctattgcaatcttccagctcatacagaggggcggcgggatcttcttctcttcaggggcccggtggcgagccgctagacagttcactgttcgggcactccattccctgggagtgggacgtgaacctgtcgcggacaagatattacaggaactgaaatgtttatctggacagctggatggataccgcggccgcccgttccccctcgcacttctcggatgggccccttcgaatatcacctttgccttgctgttcggaagaaggttcgattatcgcgaccctgtgttcgtcagtttgctgggtctgattgatgaggtgatggtgcttctgggatcccctggactccagttattcaacgtctatccatggcttggggcccttcttcagctacatcggcccgtccttcgcaagatagaggaagtgagggctatcctccgcaccctcctcgaagcccgtcggccccatgtgtgtcccggcgaccccgtgtgcagctacgtggatgccctgattcagcagggtcagggcgacgatccagagggtctgtttgctgaagcaaacgccgtagcttgtacactggacatggtaatggccggaacagaaacgacttcagccacactacagtgggccgcattattaatggggcgacacccagatgttcaagggagggtccaggaggagcttgaccgggtcctgggtccggggcgcacaccaagattggaggatcagcaggctctgccctatacaagtgccgtgctgcatgaggtgcagaggttcattacattgctccctcacgtaccgaggtgtacagccgccgacacccaattgggcgggttcctgctgcccaagggaactcccgtcatccccctgcttacatctgtgctactcgatgaaacacagtggcagacccctggacagtttaaccccggtcatttcttggatgctaacggccattttgtgaaaagggaggcttttttaccttttagcgctggacgaagggtgtgtgtcggagagcgcctggccagaactgaactattcttgcttttcgctgggctcctgcagagatacagattgctccctccaccgggcgtgtccccagcctctctggataccacccccgcacgcgcgttcacaatgaggccgagggcccaggccctatgtgcagtaccaagaccttag

SEQ ID NO: 41739 - DNA, 1389 bp, Artificial Sequence
  Description of Artificial Sequence: Synthetic coding sequence
atgctggacttcgccatcttcgccgtgaccttcctgctggccctggtgggggcggtcctgtatctatatcccgcctcccggcaggcagccggcatacccggaataacacctacagaagagaaagacggaaacctgcccgacatcgtgaattccgggtcgctgcatgagttcctcgtgaatctgcatgaaaggtacggccctgtcgtctccttctggtttggtaggcgactggtggtaagcctgggtaccgttgatgttctgaagcagcatattaatcccaataagacaagtgatcccttcgagactatgctgaagtcactgcttcggtatcagtccggagggggctctgtctctgaaaaccacatgagaaaaaaactgtatgaaaacggcgttaccgatagtctgaagtctaatttcgctctccttcttaagctctcagaggagctgctggacaagtggctatcgtatcctgaaacccagcacgtgcctctgtcccagcacatgctcgggtttgctatgaagtcggttactcagatggtcatgggatccactttcgaagacgatcaagaggtgatccgctttcagaaaaaccacgggactgtatggagtgagattggaaaggggttcctggacggctcccttgataagaacatgactaggaagaagcagtatgaggacgcactgatgcaactggagagtgtgctcagaaacataataaaggaacgaaagggccggaacttctcccagcacatattcattgatagcctggtccagggaaatcttaatgaccagcaaattctcgaggactccatgattttctcccttgcttcctgcatcattacagcaaaattatgcacctgggccatctgctttctgacgacctctgaggaggttcagaagaagctgtatgaagagattaatcaagtgtttggaaacggcccagtgactcccgagaaaatcgaacaactgcgatactgccagcacgtgctgtgcgagactgtccgtaccgccaagctgactccagtgtcggcacagctccaggacattgagggaaaaatagatcgattcatcatcccgcgagaaactctagtcctgtatgcactcggggtcgttctacaggatcctaacacctggccctcgccgcacaaatttgaccccgataggttcgacgacgagttagtgatgaagactttctcatctctgggattctccgggacacaggagtgtcctgagctgagattcgcatacatggtgacaacggtgctcttgagtgtgttggtcaagaggctccacctcctgtccgttgaggggcaggtgattgaaaccaaatatgagctggtgaccagctcgcgggaagaggcttggataacggtgtcaaagagatactag

SEQ ID NO: 41740 - DNA, 1308 bp, Artificial Sequence
  Description of Artificial Sequence: Synthetic coding sequence
atgctggacttcgccatcttcgccgtgaccttcctgctggccctggtcggcgctgtcctatacctctatcccgccagcaggcaggccgccggaatcccgggcattacacctacagaagaaaaggacggaaatttgccggacatcgttaatagcggttcacttcatgaatttctggtgaacctccacgagcgctacgggcctgtggtctctttttggtttggaaggcgcctggtggtttctctgggtacagtcgacgtgctcaaacaacacatcaacccaaataaaacctcggatccatttgagaccatgcttaagagtctgctgcggtaccaaagtggaggaggatcagtgtccgaaaaccacatgagaaaaaaattgtacgagaacggcgttactgatagcctaaagtccaacttcgctttattactcaaactgagtgaagagttactcgataagtggctctcatatcccgaaacacagcacgtgcccctgtctcagcatatgctgggattcgctatgaagtccgtaacgcagatggtcatgggatccacattcgaggatgaccaggaagtgatccgtttccaaaagaaccatggaacacccagctgtaattggtcgcttttcaaagagcatcataagcgaactaaacggaaagagctccagtctacttacttcatcgacagcctcgtgcaggggaacctcaatgaccagcagatactggaggattcaatgatttttagcctcgccagctgcataatcacggcaaagttgtgcacttgggccatatgcttcctcactacttcggaggaggtgcagaagaagctctacgaagaaattaaccaggtgttcggaaacgggcctgtcactcctgaaaagatagaacagctccgatattgccagcatgtgctgtgtgaaaccgtcagaactgcaaagctgaccccggtcagcgctcagctccaggatatagaaggtaagattgaccggttcataattcccagagaaacgttagtactttacgctctgggagtggtactccaggacccaaacacatggccgtcaccacataagttcgaccctgacaggtttgatgacgaattagtgatgaaaacattcagcagcttaggcttcagcggcacacaggagtgcccagagctgcggttcgcatatatggtgacaacggttctcctctctgttttggtcaagcggctccatctcctctcagtggaagggcaggtcattgagactaagtatgagctggtcacttccagtcgggaggaggcttggatcacagttagtaagcggtactag

SEQ ID NO: 41741 - DNA, 1539 bp, Artificial Sequence
  Description of Artificial Sequence: Synthetic coding sequence
atgctgttcgagggcctggacctggtgagcgccctggccaccctggcagcatgtcttgtgagcgtgacccttctccttgccgtgtcacagcagctgtggcaacttagatgggcagcaactcgtgacaagagctgtaagctacccatacccaaaggctctatgggatttcctttaatcggggaaaccggacactggctgctccagggaagcggatttcagagcagccggagagagaaatacggaaatgtgttcaagacccatcttctaggaaggccactcatcagagtaacaggagccgagaacgtacgcaagatcctgatgggcgagcaccacctggtttctactgagtggcccagatccaccagaatgttacttgggcctaacaccgtctccaattcgatcggcgatatccaccgcaataaaaggaaggtctttagtaagatattcagccacgaggccctggagtcctatttgcccaaaatccagctggtgatccaagacacattgcgcgcttggtcaagccaccctgaagcgataaatgtgtaccaagaagcccagaagctaacatttcgcatggctatccgggttttgcttggattttccatcccggaggaggatctgggacaccttttcgaagtttaccagcagttcgtggacaacgttttctccctgcctgtggacctgcccttctcaggctacaggcgcgggattcaggcacgtcaaatcctgcagaaaggcctggagaaggctattcgggaaaaattgcagtgtactcaaggtaaagattaccttgatgctctggatttgcttatcgagtcaagcaaagagcatgggaaagagatgaccatgcaagagttgaaagatggcacactggaacttatttttgccgcatacgctaccaccgcatccgcctctactagcttgatcatgcaattactgaaacaccccacggtgctcgaaaagttgcgagacgagctacgggcacatggcatcttacacagcgggggatgcccatgcgagggcactctccgtttggacaccctgtcgggattgcgctacctggactgtgtgattaaagaagtgatgcggctgttcacacccattagcgggggctacaggaccgtgctacaaacatttgagttagatggtttccagattccaaaaggttggagtgtgatgtactcaattagggacacacatgacaccgccccagtttttaaggatgttaacgtgtttgatcccgaccgcttttcccaagccagaagcgaagacaaagatgggaggttccactacctgccgtttggtggtggggttcgcacttgtttgggtaaacatcttgcaaaactctttctgaaggtgcttgccgtggaattggcgagcacctcccggtttgagcttgcaactagaacctttccaagaatcaccctggtgcccgtattacaccccgtcgatggactgtccgtgaaatttttcggactggactcaaaccagaatgaaattcttccagagaccgaggcaatgctgagtgccacagtgtag

SEQ ID NO: 41742 - DNA, 1314 bp, Artificial Sequence
  Description of Artificial Sequence: Synthetic coding sequence
atgctgttcgagggcctggacctggtgagcgccctggccaccctggctgcctgccttgtgtccgtgaccctgctacttgcagtgagccagcagctatggcagctgcgctgggcggctacgagggataagagctgcaagctacctattccaaaaggttcgatgggcttccctcttataggtgagacaggccactggctgctgcaggtctttagcaagatcttcagtcacgaggcccttgagtcctatctcccaaagatacagctcgtgatccaagatacattaagagcttggagcagccaccccgaggcaatcaacgtgtaccaggaggcgcaaaaactcacattcaggatggccattagggttctgttgggcttctcaatccctgaagaggatctgggacacctatttgaagtctatcagcaatttgtggataacgtgttcagtttgcccgtggacctacccttcagtgggtatcgccggggcatacaggcccgccagatactgcagaaaggacttgagaaggctattagggaaaaactccagtgtacccagggcaaagattatctggacgcactcgacctgttaattgagtcctctaaggaacacggcaaggagatgaccatgcaggaacttaaggacggaaccttggagcttatatttgcagcatacgcgaccacagcctccgccagcactagccttattatgcagctgctaaagcaccctactgtgctggaaaagctgcgggatgagcttcgcgcccacgggattctgcactcaggagggtgtccatgcgagggaacactccggcttgatactttgagtggccttaggtacctagactgcgtgataaaagaggtaatgcgtcttttcactcctatctccggggggtatagaaccgtcctgcagacctttgagttggacgggttccagattcctaagggttggtctgtgatgtactccatccgggacacgcacgacacagccccagtctttaaggacgttaatgtgtttgatcccgatcggtttagtcaggccagatcagaggacaaggacgggcgctttcattacctccccttcgggggcggtgtgaggacatgtcttggcaaacacctggccaagttattcctgaaggtgttagccgtggaactggcctccacatcgaggttcgagcttgcgacaaggacttttcctaggatcactttggtcccggtccttcaccccgtggacggcctgtcagtgaaatttttcggtttggattccaatcagaacgaaatcctacccgagactgaggccatgctgtctgcgaccgtgtag

SEQ ID NO: 41743 - DNA, 1368 bp, Artificial Sequence
  Description of Artificial Sequence: Synthetic coding sequence
atgagcgtgagcgtgctgagccccagccggcggctgggcggcgtgtccggaattctgcaggtgaccagcttacttattctcctgcttctgctgatcaaagcagcgcaactgtatctgcacaggcagtggcttctgaaggccctgcagcagttcccctgccccccttctcactggcttttcggccacatccaggaatttcagcacgatcaagaactgcagaggatccaggagcgcgtgaagacattccccagtgcctgcccatactggatctgggggggcaaagtgcgcgtccagctgtacgaccccgactacatgaaggtcattctgggccgttcagacccgaagtcacacggatcctacaagttcctcgcacctaggataggctacggactgcttctgttgaatggccaaacttggttccagcatcggaggatgctgaccccggccttccacaacgatattctcaagccttacgtgggactgatggcagacagtgtcagagtgatgctggataaatgggaagaattgcttgggcaggattcacccctggaggtcttccaacacgtcagtctaatgacactggacactatcatgaaatccgcctttagccaccagggtagtatccaggtagataggaattcacaatcttacattcaggccatatctgacctcaattcgctggtgttctgttgtatgaggaacgctttccacgaaaacgacacaatatacagcctgacttcagccggccggtggactcatagggcctgtcagttagctcaccaacacacggaccaagtcattcagttgcgcaaggcccagctccaaaaggaaggagaactggaaaaaatcaagcgaaagcgacacctggatttccttgacattttgctgttagccaaaatggagaatggcagcattcttagcgacaaggacctgagggctgaagttgacacttttatgtttgagggccacgacactaccgcttcagggatatcttggatcctgtacgccctggcgacacaccccaaacaccaggagcgatgtcgtgaggaaattcacggcctgctgggagacggcgcctcaatcacatggaaccacctagaccagatgccctatactactatgtgtatcaaagaagccttgcgcctctatcctcccgttcctggtattggcagagagctgagcacacccgtcactttccctgatggcagatcactgccaaagggtatcatggtgctcttgtctatttacggtttgcaccacaacccgaaagtctggccgaatctcgaagtgtttgatccaagccggttcgcccccggcagcgcgcagcattcacatgccttcttgcccttttcggggggcagtcgatag

SEQ ID NO: 41744 - DNA, 1266 bp, Artificial Sequence
  Description of Artificial Sequence: Synthetic coding sequence
atgagcgtgagcgtgctgagccccagccggcggctgggcggcgtgtccggaatactgcaggtcacatctctgctgatcctgcttcttttactgatcaaggccgcgcaactgtacctgcaccgccaatggcttttaaaggctctccagcagtttccctgtccgccttcccactggctgttcggccacatacaggagtttcagcacgatcaggaactgcaacgcatacaggagcgtgtgaaaacgttcccatccgcttgcccgtattggatctggggcggaaaagtgcgagtgcagctctacgacccagattatatgaaagtgattttggggcgctctgacccaaagtcccatgggtcttataaatttctcgctcccagaatagggtacggcctccttttgctgaacggtcagacatggtttcaacatcgaaggatgttaactcccgcgtttcacaatgacattcttaagccttatgttggcctcatggcagattctgtacgcgtcatgctcgacaaatgggaagagttactcggccaagactccccgctcgaagtgtttcagcacgtcagtctgatgacattggacacaatcatgaagtcagccttttctcaccaaggcagcattcaggttgatcgaccaagcgatccaacagaagagggatctacgacagaaggagggggagcaggtgaggaccaggaagaagaggccttaggctttagcggacatccccctctcgggcagagagcgccgggccttcccagaccttgttggtgcagcggttggaactgtttcagaaaccatctcgatcagatgccgtacactaccatgtgcattaaagaagccttacgcctgtacccgccagttccaggtataggtagggagctgagtactcctgtgactttcccagatggcaggtctttaccaaaaggcatcatggtcctgctatccatctacggcttgcatcataaccccaaagtgtggccgaatctcgaggtgtttgacccttctaggttcgcccctggctccgcccaacacagccatgcctttctgccattctcgggagggtccaggaattgcattggcaaacagttcgcaatgaaccaactgaaagttgccagagcacttaccctcttaagattcgagctgctccccgaccctacccggatacctatcccaatggcacggcttgtgctaaagagtaaaaacggcatccatttacgccttcgccgtctgccaaacccctgtgaggataaagatcagctgtag

SEQ ID NO: 41745 - DNA, 1560 bp, Artificial Sequence
  Description of Artificial Sequence: Synthetic coding sequence
atgagcgtgagcgtgctgagccccagccggcggctgggcggcgtgtccggtattctgcaggtgacaagtttactcatactgctgctgctcctgattaaagccgcccagttgtatttgcatcgacaatggctcctaaaggctcttcagcagttcccttgcccgccgagtcattggctgttcgggcacattcaggaatttcaacatgatcaagaacttcaacgcatacaggagcgggttaagactttcccctcagcctgtccatactggatctggggggggaaggtcagggtacaactatacgatcctgattacatgaaagtgatactcggccgctctgacccaaaaagtcacggaagctacaagttcctggctccacgaatcggatatggactcctgctactgaatgggcaaacctggttccagcatcgcagaatgcttaccccagccttccataatgacattctgaagccctacgtcggcttaatggccgattcggtcagggtgatgctggacaagtgggaggagttgttgggccaggactcccctctcgaggtattccagcacgtgtctctgatgacgctcgatacgattatgaagtcagcattttctcaccagggatctatccaagttgacagaaattcacaatcatacattcaggccatatctgatcttaatagccttgtattttgctgcatgcgcaatgcatttcacgaaaatgacacaatctattcgctgactagcgctggacgttggacacaccgcgcatgtcagctggcgcaccagcatacagaccaggtgatccagcttagaaaagcccaacttcagaaggagggggaacttgagaagataaaacgaaaacgccatctggatttcctggatatcctgctccttgctaaaatggagaatggttctatactgagtgataaagatttgcgtgccgaggtggatactttcatgttcgagggccatgataccaccgccagcggtatcagctggattctgtatgccttagctactcaccctaagcaccaagaacgctgtagagaagagatacacgggttactcggtgatggagcctcaatcacatggaaccacctagatcaaatgccttataccacaatgtgcatcaaggaggccctcaggctgtaccccccggttcccggtatagggcgcgaattgtccaccccggtgacatttccagacggtagaagtctccccaagggcatcatggttctgctcagcatatatggtctacaccataaccccaaggtgtggccgaacctggaggtgttcgatccaagccgattcgcgcctggttctgctcagcatagccacgcatttttgccgtttagtggcgggtctaggaattgcattgggaagcagttcgccatgaaccagctgaaggtcgcacgcgccctcaccctactgaggtttgagctcctgcctgaccccacgaggatccccattcccatggcaagacttgtgttgaagtcaaagaatggcattcacctccgcctgcgaagactgccgaacccctgcgaggacaaagatcagctctag

SEQ ID NO: 41746 - DNA, 1536 bp, Artificial Sequence
  Description of Artificial Sequence: Synthetic coding sequence
atggtgcccagcttcctgagcctgagcttcagcagcctgggcctgtgggccagtggcctgatcctcgtacttgggttcctgaagctgatccaccttctgctgagaaggcagaccctggcaaaggctatggacaaattcccaggaccgccaacgcactggctcttcggacacgctctggagatccaggaaacaggatcgctggacaaagttgtgtcctgggctcaccagtttccgtacgcacatccgttgtggttcggccaatttatcgggttcttaaatatatacgagcctgactacgcgaaggctgtgtattccagaggcgaccccaaagctcccgacgtgtacgatttcttcctgcagtggattgggagaggcttactggtgctcgagggtccgaaatggctccagcaccggaaactgcttacacccggctttcactatgacgttttgaaaccatatgtggctgtctttactgagtcaacaagaattatgctggacaagtgggaggagaaggcccgagagggcaagtcattcgacatattctgcgatgtggggcacatggccctgaacacgctcatgaagtgcaccttcgggcgaggcgacacagggcttgggcatcgcgactcaagctattacttggccgtgtcggacctcaccctgcttatgcagcagcggttagttagtttccagtatcacaacgatttcatatactggctcacccctcacggtagaagatttctgagggcctgtcaagtggcgcacgaccacaccgatcaggtcataagggagcgcaaagctgctctccaagatgagaaagtgaggaagaaaatccaaaatcgccggcacttggactttctagatatcctactgggcgcacgcgatgaagatgacatcaagctgtccgacgcagatctgcgggcggaagtggacacctttatgttcgaaggtcatgacaccactacttcagggatcagttggtttctctactgcatggctctctatccagaacaccagcatagatgcagagaggaagtgagggagattttgggcgaccaggatttttttcaatgggatgacctcggaaagatgacctatttaactatgtgtatcaaagagagctttcgcctataccccccggtgcctcaggtttacagacaactgtcaaagcccgtaacctttgttgacggtcggagcctgccagctggttcgctcatcagtatgcacatatatgctctacacagaaattcagccgtgtggcccgatccagaagtgtttgacagtctacggttctctactgagaacgcttctaaacgacatcctttcgccttcatgcctttctcagccggccctcgcaactgtataggccaacagttcgccatgtcagagatgaaggtggtaactgcaatgtgcctactccggttcgagttctcactcgacccatctaggctgcctattaaaatgccccagctcgttctcagatcaaaaaacggctttcacctacaccttaagcctctgggtcctggaagcggcaaatag

SEQ ID NO: 41747 - DNA, 1494 bp, Artificial Sequence
  Description of Artificial Sequence: Synthetic coding sequence
atggtgcccagcttcctgagcctgagcttcagcagcctgggcctgtgggcaagcggactcattctggtgctgggctttttgaaactcatccatctgctcctcaggagacagaccttagccaaggcaatggacaaattccccggcccacctacccactggcttttcggacatgcgctagagattcaagagacagggtcgctggacaaggtggtctcttgggcgcaccagttcccatatgcccaccccctttggtttggccagtttattggcttcctgaacatctacgagcctgactatgctaaggccgtgtacagtaggggaggccgagggctcctggtcctagaggggccaaaatggctgcagcatcgaaaattattgacccccggcttccattacgatgtgctgaaaccttatgttgccgttttcacagagtccacacgcataatgctagacaagtgggaggaaaaggcgcgtgagggcaaaagtttcgatattttctgcgacgtcggccacatggctctaaacacactgatgaaatgcacttttgggcgaggagacaccggattaggacattcaagagacagctcttactacttggctgttagcgaccttactttgttgatgcagcagcgacttgtctccttccagtaccacaacgacttcatttactggctgacccctcatggccgccggttcctgcgcgcctgccaagtggctcacgaccacacagatcaagtaattagggagaggaaggccgccctccaggacgaaaaagtccggaagaaaatccagaacagaagacatctagattttctagatatcctgttgggggctagagacgaggacgatatcaagttatcagatgccgaccttagggcagaggtggacacctttatgttcgaagggcatgatactacaacaagcggcatcagttggttcctgtactgcatggccctgtatcccgagcatcagcacagatgtcgggaagaagtccgcgagatcctaggagaccaggatttcttccagtgggacgatctgggcaaaatgacctacctgacgatgtgtatcaaggaaagttttcgcctgtatccccctgtgccccaagtctatcgccagctcagtaaaccagtgacctttgtcgacggccgatctcttcccgcagggtcgctgatctccatgcacatatatgcactccacaggaattccgcagtctggccagatccggaagtgttcgactctctccgcttctcaactgaaaacgcctcgaaaaggcaccccttcgctttcatgcccttctccgccggcccacgaaactgcattggccagcagttcgccatgagcgaaatgaaagtggtaacagccatgtgccttcttcgcttcgagttttccctggacccctctcgcctgcccatcaaaatgccccaactggtgcttagatcaaaaaatggattccacttgcacctcaaaccgttaggtccaggctccggaaaatag

SEQ ID NO: 41748 - DNA, 1539 bp, Artificial Sequence
  Description of Artificial Sequence: Synthetic coding sequence
atggtgcccagcttcctgagcctgagcttcagcagcctgggcctgtgggcatctggcttaattttggtcctaggttttctgaaactgattcatctcttgttgcgacggcaaaccttggcgaaggcaatggataagttcccaggcccccccacccactggctgttcgggcacgctttggagattcaggagacaggatccctggacaaagtggttagctgggcgcatcaattcccttatgcccatcctctttggtttggccagttcatcggtttccttaatatatatgagccggactatgctaaagctgtgtactcccgcggagatcccaaagctcctgacgtgtacgacttcttcttgcagtggattggaagaggattgctggtgctggagggaccaaagtggcttcaacacagaaagctgcttacccccggctttcactacgacgtactaaagccctacgtggcggtgttcactgagtcaaccaggattatgcttgataaatgggaagagaaagcgcgggaagggaagtcatttgatatattttgtgatgttgggcatatggcattgaatacgctcatgaagtgcacctttggcaggggggacacgggccttggacactcccgggatagctcctactacctggctgtctctgacttgaccctactgatgcagcagcggctggttagctttcaatatcataacgatttcatttactggctgaccccacacgggaggaggtttctgagggcctgccaggtggcgcacgatcacacagaccaggtgatccgcgaacgcaaagcagctctgcaggacgaaaaagtgcggaagaagatacagaacaggaggcacctggatttcctggacatccttctcggagctcgggatgaagacgatatcaaattgtccgatgctgacttaagagcggaggtcgataccttcatgtttgaaggccatgacacaacaacgagtgggattagctggtttctgtactgtatggctctgtatcctgagcaccagcacagatgtagggaagaggtgcgcgagattctcggggaccaggatttcttccagtgggatgacctggggaaaatgacataccttacgatgtgcataaaagaatcattcaggttgtatccacccgtgccccaggtttaccggcaactgagtaaacctgtgacctttgtggacggaaggtcccttccagctggctcactaatttccatgcacatctacgcactacataggaactccgcagtgtggcctgacccagaagtgtttgattcacttcgcttttcaactgaaaatgccagcaagcggcatccctttgcatttatgcctttctctgccggaccaagaaactgtataggacagcagttcgcaatgagtgaaatgaaagtggtgaccgccatgtgcctcctgaggtttgagttttcactggaccccagccgtctgcctattaagatgcctcaactggtcctccgcagtaaaaacggatttcacctgcatcttaaaccgctcggcccaggttcagggaaatag

SEQ ID NO: 41749 - DNA, 573 bp, Artificial Sequence
  Description of Artificial Sequence: Synthetic coding sequence
atgctgacccccgccttccacttcaacatcctgaagccctacatgaagatctttaacgaatccgtcaacatcatgcatgccaagtggcagctcctggcgagtgaaggcagcgcctgtttggacatgttcgaacatatttcattgatgacacttgatagcctccagaaatgcgtttttagttttgattcccactgtcaggaaaagcccagcgaatacatcgctgccattttagagctttctgctctcgtgagcaagagacaccacgagatcctgctccatattgattttctctactacctgacccctgacggccaacgcttccgccgggcatgtcgacttgtacatgatttcacagatgctgttatccaggagcgccgtcgaacactcccgagtcagggagtcgacgactttctgcaagccaaggctaaatccaaaaccttggacttcatagacgtgctcctgctctctaaagcaatgaccccccgccctgtggtctccccggggtcatgtacaactctgcagagtacccaaaatacccggtctgcagcggggaggaggtgtaagaacttttag

SEQ ID NO: 41750 - DNA, 1974 bp, Artificial Sequence
  Description of Artificial Sequence: Synthetic coding sequence
atggccagcgcccggaaggccagccggcccatgcgggacgtgttcggggatttttctgacgtcagccttgaggatagcaccatggaagaaatcaggaatttccagatcagtcgcaacctgacgaagattgcccctggccactcacgctttttgaagcggaaccagacactggacgagaaacatctgttgttgaaagagaacccggtgctcggctcaggtccaagactggcatcctgtcgtccacccactaccgccagcaggatacgggcaaacgccgccctgatgaaattggcccaacttgagacaaggatcatgaaccgcaagcttcaacgaaacctttccgacacggagtcagatagcatgactgccgatgcaggcttgcctaaacgggcagacagaatactgtccggaggggccctggaacttgccagccagaacacggataaaacaagccagaatcaggcgcgagaacttccagtgactgagaataacgcccagaacgctaaggtctctcgatttttaaaaaaaaagcaggctcccgttgagaacatctcccccgaagcccctgctggtaaagagagaactctccagacacctaaacaaaaggaacctgcaagaacctttgactctcctgatagtgacgaagaggaaatgaaggttctcttgggttcattaatggacagttcgcgagagaagaacacaaatcagggtttctcttcggcgaatgttagtgaggaagaggaacggaaacttttctctgttccgtcgcagcttagggcattcacagtgccctccgtcgagctctctagcgcaaaacccagtcaaacctcccacctgccaactagcctggctgcagacaggaccttgcactctacacgctcccgggccgattacccgcagagccatgtttcctcagacaccgcctcccatacgccatctgtctcgatcacgggggccttttcaaacagcgtgtcgctgaagatgggccacgtcaaactagtgtcaagtccaggccggagcgaggcagagaccgtcgatgaacccgtatccgagggggctgacgacagcctggacgagttccgcattaacatcctaagcttagacggtctcgctcctgccgtttccgagaattctgacttggagcaggaggaggaatcagcacaacgccaaaagacagccggcaagatatttcgagccgaagcttctacggggcaggacgccccaagacaggctcaggctcggtcctgggcttcacagggaaaagctgccagtgccgagggcgacgaaagtgaggttagtgagcacctgagtgcaagctccgcgtccgccatccagcaggactcgacaagttctatgcagcccccatctgaagcccccatggtcaacactgtctcatctgcatattcagaagatttcgaaaacagtccaagcctaaccgcctctgagcctaccgctcacagcaaggaaagcttagatagaacattggatgcactcagcgagtccagttcctccgtgaagacagacctccctcaaacagcagagtctagaaagaagagcggcagacacgtgactagggtcctcgtgaaagatactgctgtgcagactcctgacccggccttcacctacgagtggacaaaagtcgcttctatggccgccatgggccccgctttaggtggggcgtacgttgaccctacccccatcgccaatcacgtcatttccgcggatgcaatcgaggcgttgaccgcctattctcctgcagttctggccctgcacgacgtgctgaaacagcagctctcacttactcagcagtttatacaggcctcccggcacctccatgcttctttgcttcggtccctggacgctgattctttccattaccacacattagaagaagcgaaagaatatattaggtgtcatcgcccggctccccttaccatggaggatgctctcgaagaagtgaataaggaattgtag

SEQ ID NO: 41751 - DNA, 1116 bp, Artificial Sequence
  Description of Artificial Sequence: Synthetic coding sequence
atgctgacccccgccttccacttcaacatcctgaagccctacatgaaaatcttcaatgaaagcgtaaatattatgcacgcgaaatggcagcttctggctagcgagggcagcgcttgcctcgacatgtttgaacatataagcttgatgactctcgacagcctgcaaaaatgtgtcttttccttcgatagtcactgccaggagaaaccttcggaatacattgctgccattttggagctgagcgctctggtatctaagaggcaccacgaaatactcctacacattgatttcctttattacctcacgcctgacggacagcgattcagaagggcctgcaggctggtccacgactttactgatgctgtgatccaggaacggagacggacactcccctcccagggggtggacgattttctgcaagccaaagccaagtctaaaacgttggattttattgatgttctcctgttgtcaaaggacgaagacggtaagaagctgtctgacgaggatatccgggcagaagccgacactttcatgttcgaggggcacgacacaacagcaagtgggctgagctgggttttgtaccatctggcaaagcacccagaataccaggaaagatgtcgccaagaggtgcaagaacttctaaaagatcgcgagcccaaggaaattgagtgggacgatctggctcacttgccattcctgacaatgtgtatgaaagagtctctgcgcctgcacccaccagtgccagtgattagcaggcacgtgacgcaggacatagtcctgcccgatgggcgggttattcccaaggggattatctgtctgatatcagtattcgggacccaccacaatcctgccgtttggcctgacccggaggtgtatgatcccttccgcttcgacccagaaaatatcaaggagcgtagcccgctcgcttttattccgttttccgcaggtccgcgaaattgtataggacagaccttcgctatggccgagatgaaagttgttctggcactcactctgctgcgcttcagggtcctgcccgatcacaccgagccccggcgcaagccagagttagtattgcgcgccgagggaggtctgtggctgagagtcgaacctctgtcctag

SEQ ID NO: 41752 - DNA, 1530 bp, Artificial Sequence
  Description of Artificial Sequence: Synthetic coding sequence
atggagttcagctggctggagacccggtgggcccggcccttctacctggccttcgtgttctgcttagccttggggcttctccaggcgattaaactatatctgagaaggcagagactcctcagggaccttagaccgttccctgctccacctacgcactggttcttggggcaccagaagttcatccaggacgacaatatggaaaagctagaagagatcatcgaaaagtatccaagggcttttccattctggattggacccttccaggcgttcttctgcatctacgacccagattatgcgaaaactttactgtctaggactgacccgaagtctcaatatctccaaaagttttccccccccctgttaggaaaagggttagctgctctagacggcccgaagtggtttcagcatcgcagactgctgacccctggctttcacttcaacattctgaaagcttacattgaggtgatggcgcactctgtgaaaatgatgctagataaatgggaaaaaatctgttccactcaggacactagcgtcgaggtgtacgagcacatcaactctatgagcctagacattattatgaagtgtgcattcagtaaggaaaccaattgccagacaaactcaacccacgatccatacgccaaggcgattttcgagctctccaagatcatcttccaccgactgtactctcttctgtaccactctgacattatttttaagttgtcaccacagggctacagatttcaaaagctgtcaagggttctgaaccaatatacagacacgatcatccaggagcggaaaaagtccctccaggccggcgtgaaacaggacaacacccctaaacgcaagtaccaagattttctggacatcgtacttagtgctaaggacgagtcaggaagcagcttctcagacatcgacgtccactcagaggtgtctacttttctcctcgccggccatgataccctggccgcctcaatcagttggatcctctactgcttggctctcaatccagaacatcaggagcgatgtagggaggaggtcaggggcattcttggagatgggtcctcgattacatgggatcagttaggcgagatgtcttacaccaccatgtgtataaaggaaacttgccgactaatccctgcagtgccatcgattagtagagatctttcaaagcctctcacgttccctgacggatgtactctacctgcagggattacagtggtgctctctatctggggactacatcacaatcctgccgtgtggaaaaatcccaaagtctttgaccctctgagattctcacaggaaaacagtgaccagcgacacccgtacgcttatctccccttttcggccgggtcccgtaactgcatcggccaggaattcgcaatgattgagctaaaagtgacaattgccctcatcttgctgcatttcagggtgactcccgaccctactagaccactcacgtttccaaatcactttattctcaagccgaagaacggcatgtatcttcatctgaagaaactctcagagtgctag

SEQ ID NO: 41753 - DNA, 1527 bp, Artificial Sequence
  Description of Artificial Sequence: Synthetic coding sequence
atgatgtggggcggcggcctggacctgtgccccatgcccggccagctgaagttcccaccttgtctgtcgaggtgcctcctctgggagcccccatcactgtacctaactcagccgacctctagtctggccgaacctcaagctttaatttgtatgacttcgtcaagttcgggattgttcatccaggatgataacatggaaaagctcgaggagattatcgagaagtatcctcgagcattccctttttggatcggccctttccaggcattcttctgcatctacgaccctgattatgccaagacgctgctgagtcggacggacccaaaaagccagtatctccaaaagttctcacccccactgctgggaaagggcttagccgcccttgacgggcccaagtggttccagcatagaagattactgacccccgggttccattttaatatattgaaagcctatattgaggttatggcacacagcgttaaaatgatgctcgataagtgggagaaaatatgttctacccaggataccagcgtggaagtgtatgagcatattaatagtatgagcctagatatcattatgaagtgtgctttctcaaaagagactaattgtcagacaaactcaactcatgacccttatgcaaaagcgatctttgaactttctaagattatttttcacagactgtacagtctgctttatcactcagatataatatttaagctctccccacagggctaccgatttcaaaagctctctagggtgctgaaccagtatactgacactatcattcaggagcgtaagaagtcccttcaggccggcgtaaaacaggataacaccccaaaacgcaagtatcaagatttcctggacattgtgctttctgctaaggatgagtcgggatcatcattctctgatatcgatgtacacagtgaggtgtcgaccttcctgcttgcagggcacgacacactggccgcgtcaatatcttggatcttgtattgcttggccttgaatcctgagcaccaggagcgatgtcgcgaagaggtgcgcggcatactgggggatggttctagcattacatgggaccagttgggggagatgagttataccactatgtgtatcaaggagacctgtagacttatccccgccgtcccatccatctccagggacctctcaaaacccctgacctttccagacggctgcaccttgcctgctggcattactgtggtgctctctatatggggcctgcaccacaaccccgcagtatggaaaaatcccaaagtgttcgatcctctgcgcttcagccaggagaattccgaccagcgtcacccctacgcatacctcccctttagtgccggtagcaggaattgtatcggccaggaatttgccatgatcgagctgaaagtgacaatcgctctgatactactccactttagggtgacacccgatcccacacggccccttacctttccaaaccactttattttaaaaccaaaaaacggaatgtatcttcacctgaaaaaactgtctgaatgctag

SEQ ID NO: 41754 - DNA, 1518 bp, Artificial Sequence
  Description of Artificial Sequence: Synthetic coding sequence
atggagcccagctggctgcaggagctgatggcccaccccttcctgttattgattctgctgtgcatgtctttgctgctgtttcaagtcattcggctttatcagcggcgtcggtggatgattcgcgccctgcacctctttcccgctcctccagcccattggttctacgggcataaagagttttaccctgttaaagaattcgaggtttaccataaactcatggaaaaatatccctgcgccgtgccactgtgggtggggcctttcaccatgtttttctcagtgcacgatccagattacgccaagattcttctcaaacggcaagatccaaagagcgcggttagtcataagatactggagtcctgggtgggccgtggactggttaccctggatggcagtaagtggaagaagcaccgacaaattgttaagccggggttcaacatcagcatcttgaaaatctttatcacgatgatgtcagagagtgtgcgcatgatgttgaataagtgggaggaacacatagcccaaaatagcagattagaactctttcagcatgtttctctgatgacacttgattcaattatgaagtgtgctttttctcaccaaggatccattcagctagactcaaccttagacagctatttaaaggcagtgtttaatctgagcaaaatcagcaatcagcgtatgaacaatttcttgcaccataacgatctggtgttcaagttcagctcccaaggtcagatctttagtaagtttaatcaggagcttcaccagtttacggagaaggtcatccaggatagaaaggaatctctgaaagacaaactgaagcaggatacaacccaaaagcgcagatgggactttttggacatcctgctgtcagccaaatctgagaatacgaaagatttttcagaggccgacctgcaagctgaggtcaaaactttcatgttcgccggacatgataccacctcgtctgctattagctggatactgtattgtttggctaagtatccagaacaccaacagaggtgccgggatgaaattagggagctgctgggggacggatccagcatcacctgggagcaccttagtcagatgccttacacaaccatgtgcatcaaggagtgccttcggttgtatgccccggtagtgaatatctctcgactgctggataagccaatcaccttcccagacggaaggtccttgcctgccgggatcacagttttcattaatatctgggccctgcaccacaatccttacttctgggaagatccacaagtttttaaccctctcagattctctcgggaaaactcagagaagatccatccttatgccttcattccattttctgctggcttacggaattgcataggtcagcatttcgcaataatcgagtgcaaggtggcggtcgctctgactctgctaaggtttaagctggctccagatcatagcagacccccacagcctgtacggcaggtcgtactgaaaagtaaaaacggcatacacgtcttcgccaagaaagtctgttag

SEQ ID NO: 41755 - DNA, 1809 bp, Artificial Sequence
  Description of Artificial Sequence: Synthetic coding sequence
atgcccagcgccaagcagcggggcagcaagggcggccacggcgccgctagcccttctgaaaaaggcgctcacccgtctggtggtgcagacgatgttgctaagaagccacccccagccccacagcagccaccacctccgcccgctccacatccacagcagcatccacaacagcatccacaaaatcaggctcacggcaaaggcgggcatcgcggaggggggggaggagggggcaagtctagctcgtctagctcagcttctgcggctgcagctgctgcagccgctagctcgagtgcaagttgttctcgaaggctcggccgggcactgaattttctcttctacctcgccttagtggccgccgctgccttctccggatggtgtgtgcaccatgtcttggaggaggtgcaacaggtgcgacggtcccatcaagatttctccagacagcgcgaggagctgggccagggccttcaaggcgttgagcagaaggttcagtctcttcaagccaccttcggcacatttgagtccattctgagaagctcccagcacaagcaggatctgacggagaaggctgtaaagcagggggagtccgaagtgtctcggatatctgaggtgttgcagaagttgcagaacgagatcctgaaggacctgtcagacgggattcatgttgtcaaggatgcccgagagcgcgacttcacttcattggaaaatactgtagaggagagactaactgagctgacaaagtctattaacgacaacattgctattttcacagaggtgcagaagaggtcacagaaagagattaacgatatgaaggccaaggtggctagcttagaagaaagcgagggtaacaagcaagatttaaaagcgcttaaggaggctgtgaaggagattcaaacatccgctaagtctagagaatgggatatggaggctctccgctcaacactgcagacaatggagtctgacatctacacagaggtgcgcgaactcgtcagtttgaaacaggaacagcaggcttttaaagaagcagccgacaccgagcggttggctctgcaggcccttactgagaaactacttcggtcggaagaaagcgtttcgcggctgccagaagaaattcgccggcttgaagaggagctgcgacaactcaagtcagatagccacggtccaaaagaggatggcggttttcggcatagcgaggccttcgaagctctgcagcaaaagagccagggactcgattctcgtctgcagcatgttgaggatggggtcctctccatgcaggtggcctcggcaaggcagactgagtctttggagtcgcttctgtccaaatcccaagaacacgagcagcgattggccgctctccagggccggttggaaggcctaggctcatcagaggcagatcaggatggtctggcctccactgtccggagtttaggcgagacccagctggtgctgtacggggatgtggaggagttaaagagaagcgtgggagaattgccaagtaccgtcgagagtctacagaaggtgcaagagcaggtgcacactttgctgagccaggatcaagcccaggcagctaggctgcctccgcaagatttcctggatcggctgagctctctggataacttgaaagccagcgtaagccaggtcgaagccgatctgaaaatgctgcggacagccgtcgacagcctcgtcgcctacagtgttaagatagaaaccaacgagaataatctggaatccgccaagggactccttgatgacctccgcaatgatctggacagattgttcgtgaaggttgagaaaatccacgagaaggtgtag

SEQ ID NO: 41756 - DNA, 9897 bp, Artificial Sequence
  Description of Artificial Sequence: Synthetic coding sequence
atgcagaaggagctgggcatcgtgcccagctgccccggcatgaagtctcctagaccccatttgctcttgcctcttctgctgttactattgctgctgctgggcgccggcgttcctggggcttggggccaggctgggagcctggacttgcagatagacgaagagcagccagcaggcaccctgatcggcgatatctcagctgggctgcccgcagggacagccgcacccttgatgtacttcatctcagctcaggaaggcagtggggtcggcactgacctcgccatcgatgagcacagcggagtagtccggacggccagggtgctcgatagagagcagcgggacagataccgtttcaccgccgtgacccctgatggcgccaccgtggaggtgacagtcagggtggctgatatcaatgaccacgctcccgccttcccccaggcaagagcagccctgcaagtccctgaacataccgccttcggcaccagatacccgcttgaaccggcccgcgatgccgatgcaggaagactgggcactcagggctacgccttaagcggagacggcgcaggcgagacttttcgactggagactaggccagggccggacggaacgcctgtccccgagctggtggttaccggagagcttgacagggagaataggtcccactatatgctgcagctcgaagcctacgacggtggctccccgcctcggcgagcccaggccctactggacgtcacgcttttggatattaacgaccacgcccccgcctttaatcagtcacggtatcacgctgtcgtatcagaaagccttgctccgggttccccagttctgcaagtgttcgcaagcgatgcagatgccggagtcaacggtgccgtcacttatgaaatcaaccgtaggcagtccgagggtgatggtccttttagtatagatgcgcatacaggactgctacagcttgagaggccacttgattttgagcagcggcgtgtgcatgagttagtggtgcaggcaagagatggcggagcacatcccgaattaggaagcgccttcgttacagttcatgtgagagacgcaaacgataaccagccttcaatgacggtgatttttttgagtgctgatggcagtccccaggtgtccgaggccgccccccccggccagctcgttgccaggatctcagtatccgatcctgacgacggggacttcgcgcatgtgaatgtatctcttgagggcggagagggacacttcgccctttcaactcaggatagtgttatttaccttgtatgtgttgctcgcagactcgatagggaggaacgtgatgcttacaatctgcgggtcaccgcaaccgacagtggcagcccaccgttgagggccgaagcggcctttgtgttgcatgtgaccgatgtaaacgacaatgcgccagcctttgataggcagctgtatcggccagaacccttgccagaagtagcattgccagggtctttcgtcgtgcgtgttactgctcgggatcccgatcagggaaccaatggccaggtgacatactcactggctcccggggctcacacacactggttcagcatagatcccacctccggcatcatcaccaccgccgcttccctggactacgaactcgaaccccaaccgcagctcattgtcgtcgctaccgatggtggcctgccccccctcgccagctccgctacggtgagcgtcgccctacaggacgtgaatgataacgaacctcagtttcagagaacattctataacgcatctctgccagaaggcacacagccagggacgtgcttccttcaggtgacagccaccgatgcagatagtggaccctttggcctcctcagctatagtctgggtgctgggttgggatcaagtggcagcccaccatttcgtatcgacgcccactccggcgacgtgtgtacgactaggaccctggatcgcgatcagggacctagcagcttcgacttcacggttacagcagttgacggcggcgggcttaaaagcatggtgtacgtgaaggttttcctgagcgacgagaacgacaacccaccacaattttatccaagagagtatgctgcttccatctcagcgcagtcacccccaggcaccgcagtcctccgattacgggctcacgaccccgatcagggttctcacggtcgccttagttatcatatcctagcgggaaactcaccccccttattcactctcgacgaacaatccggtctgctgacagtggcctggccactagcccggcgggcaaactccgttgtgcagctggagattggggcagaagatggtggcgggctgcaggcagagccatccgcccgtgtggatatctccatagtacccggaaccccaacccctcccatctttgaacaactccagtatgttttcagtgttcccgaagatgtggcccctggcacctccgtcgggatcgtgcaagcacacaatcccccaggaagactggcacctgttacactgtcactttctggcggggacccccgcggcttattttctcttgacgccgtcagtggtctgcttcagactcttcgccctcttgatcgcgagttgctgggccccgtcctagaactggaagtgcgagcagggtccggagtacctcctgcctttgctgttgcgagggtgcgggttctcttggacgatgtgaacgacaactcccccgcattcccagcaccggaagacaccgtgctgcttccccctaacacggctccaggtaccccaatctacacattaagggccttagatccggacagcggagtgaactcgagagtgactttcactctcttggcgggcggtggtggggccttcactgtggaccccaccacgggtcacgtgagactgatgcgccctctcggcccctctggcggacccgcccacgaacttgaactggaggccagagacggagggagcccccctaggacctcgcattttcgactacgtgtggtagtccaggacgtaggcacaagagggctggcccccaggtttaactcccctacttaccgcgtggatttgccatccggtacaactgcagggacccaggtgctgcaggtacaggctcaggcacccgatggaggccctataacatatcatctcgccgcagaaggagcttcttctccttttgggcttgagccccaatctgggtggttgtgggttagagctgccctggatcgggaggcgcaggagctttacatactaaaggtcatggccgtgagcggttccaaggccgagctggggcagcagactgggaccgccacagtcagagtgtcgatcctgaaccagaacgagcacagtcccaggctgagcgaggatcctacatttcttgctgtggccgagaatcagccaccagggacctctgtggggcgcgtcttcgccaccgatcgggattcaggtccgaacggtcggttgacatattcactacaacaacttagcgaggattctaaggctttccgcatacacccccagacaggggaggtaacaaccctgcaaacgctcgatagggaacagcagtctagctatcagcttctggtgcaagtccaggatggggggagcccaccccgatccacaactggaacagtgcacgtggctgtcctggacctgaacgataattcgcctacatttcttcaagcatctggcgcagccgggggaggactgcccattcaagttccagatcgcgtccccccagggactttagtgacaacactacaggccaaggaccctgatgaaggtgagaacgggacaattctgtataccctgactggtcccggcagcgaactcttctccctgcaccctcactctggggaattgctgaccgcagcacccctcatccgagccgagcgtcctcattacgtgctcactctgagtgctcacgatcagggctcgcctcctaggtccgcatctctacagctactggtgcaggtattgccctcagccagactagccgaaccacctcccgacctagctgaaagagatccggctgctcctgttcctgtggtactgactgtgacagccgccgagggtctgcgtcccgggtcactgctcggtagcgtcgccgctccagagcctgcaggagtcggcgcactgacatataccctcgtgggcggagccgacccggagggaacatttgcacttgatgctgcctctggccggctctaccttgcaagaccattggatttcgaggccgggcccccttggcgcgccctcacggtacgcgcagagggcccgggtggagcgggcgcacgccttttgcgcgtgcaggtccaggtgcaagacgaaaatgagcacgctcccgctttcgctcgggaccccctagcccttgctctgcccgaaaaccctgagccaggagccgctttgtacacctttagggcctccgatgcagacgggcccggcccaaactccgacgtgcgctatcggctgcttaggcaggagccacccgtccccgctttgcggcttgacgctcgcactggagccttgtctgccccaagaggcctggatagagagaccacccccgccctgttgcttcttgttgaggccaccgaccggccagccaacgcctccagacggcgcgctgcacgggtaagcgccagagtgttcgtcacagacgagaatgacaacgcgcccgtcttcgcctctccaagtagagtgagactgccagaagaccagccccccggtcccgcggccttacatgtggtcgcccgcgatccagatcttggcgaagcagccagagtgagctacaggttggcgagtggcggggacggtcatttccggctccactcctctacaggcgccctgtccgtcgtgagacccctcgatcgcgaacagagggcagaacatgtactgaccgttgtcgctagtgaccatggctcaccaccacgctcggctacccaggtattaactgtgtctgtcgctgacgtgaacgacgaagctccaaccttccagcagcaggaatattcggtgctgctacgcgaaaacaatcctcccggtacaagtctgctcactctccgtgctaccgaccctgacgttggtgcaaacgggcaggtgacatacgggggtgtgagcagtgaatctttcagtttggatcccgataccggagttttgaccacccttcgggccctggaccgagaagagcaggaagagatcaacctgacagtttacgcccaggaccgagggtccccaccacaactgactcatgtcaccgtgcgggtggccgtcgaggacgaaaatgatcacgcccccacctttggatctgcgcacctatccctcgaggtccccgaaggacaggatcctcagacacttacgatgttacgtgcatctgacccagatgtgggtgccaatggacaattgcagtatcggatcctggatggcgacccaagtggggcattcgtactcgacctagccagcggcgaatttggaactatgcgacccctggatcgcgaagttgaaccggcctttcagctgcgaatcgaagcaagggacgggggacaacccgctcttagtgcaaccctgctgctgacagttactgtcctggacgccaacgatcacgcccctgctttcccagttcctgcatacagcgtggaagttcccgaagacgtgccagccgggaccctgctgcttcaacttcaggctcatgacccagacgctggcgcgaatggtcatgtgacatactatctgggcgccggcaccgcgggggcattccttctcgagccttcctcaggcgagctgcgaacagctgccgctcttgacagagaacagtgtcccagctatactttctctgtttcagctgtcgatggtgcagccgccggacctttgagcacgaccgtgagcgtcaccatcaccgtccgagacgtaaacgaccacgcacccacctttccgacatctcctttaagattgcggctcccccggcctggcccctcgttttcgaccccaacgttagccctggctacactgagggctgaagatcgggacgctggagctaatgcctctatcctgtaccggctggcaggaactccccctccaggaactacggtcgactcgtacaccggtgagattcgagtcgctcgatccccagttgccctcggaccgcgcgacagagtgctattcattgttgccactgacttgggaaggcctgcgcgttcggccactggggttatcatcgtgggtctccagggagaggccgaaagggggcctagattccccagggctagctctgaagctacgatccgagaaaacgctccccccggcacccccattgtatcacccagagctgtgcatgccggtgggacaaacggcccaataacatactctatactttccggaaacgaaaaaggaacatttagtatacagccaagcaccggcgccatcaccgtcagaagcgccgaggggctagacttcgaggttagcccaaggctgcggctcgtgctccaagcagaatcaggcggggccttcgcctttactgtcctcacacttacactgcaagacgccaacgacaacgcccctagatttctccgcccgcattacgttgcttttcttcccgagtcacggccccttgaaggccccctgctacaggttgaggcagatgacctggatcaaggatccggcggccagattagttactccttagcggccagccagcccgctagaggcctgtttcatgtggatcccacaactggaaccatcacaacaactgccattctggatcgcgagatctgggccgagacgcggctggtgctcatggccacggatcggggtagtcccgcgttggtcggatcagccacgctgacagtgatggtgattgatactaacgacaatcgacctactatcccccagccgtgggaactgcgggtaagtgaggatgcactgttagggagtgaaattgcacaagtcacaggaaacgatgtggatagtgggccagtcttatggtacgtcctgtccccaagcggtcctcaggatccctttagcgtcggtaggtacgggggaagggtctcgctcactggaccattggacttcgagcagtgtgataggtaccaacttcagctactcgctcacgatggccctcacgaggggcgagccaatctcacagttttggtggaagatgtgaatgataatgcaccagcctttagccagagcctatatcaggtgatgctcctggagcatactcctccaggctcagccatcctatcagtaagcgctacagatcgggactctggtgctaatggacatatctcgtatcacttggcctcaccagccgatgggttttcagtggacccaaacaacggtacactgtttaccatcgtagggaccgtagcactaggccacgacggatctggggccgtggatgttgtcctggaagcccgcgaccatggagctcccggaagggctgctcgggcgaccgtccacgtgcagctgcaggaccagaacgatcacgccccatccttcacattatctcactatcgagtggcagtgactgaggaccttcccccaggctctactttgctcactctggaagctacagatgccgatggcagccgctctcatgccgctgtagattacagcattattagcgggaattggggccgtgtctttcaattggaacctcggctggccgaggctggcgagagcgcaggacctgggcctagagccttggggtgtttagtcctcttggaaccactcgacttcgaatccctgacccaatacaatctaactgtcgccgccgccgatcggggacaaccccctcagtcgtccgtggtccccgtcaccgtaacagtcctggatgtgaatgacaacccccccgttttcaccagagcatcctatcgcgtgacggtccccgaggatacccccgtgggagcagaacttctgcatgtagaggcaagcgatgctgatcctggaccacacggcctggttaggttcacggtatccagtggtgacccatcaggactctttgaactggatgagtcttctgggacgctccgacttgctcacgccctggactgcgaaactcaggcaagacaccaattagtcgttcaggcagcggaccccgctggtgctcactttgcgttagcacctgtcacgattgaggtgcaggatgtaaatgaccacggccccgctttccctttaaacctcctcagcacaagcgtcgccgagaatcagccccccggcaccctggtgaccacactgcacgccattgacggggatgccggcgcttttggccggctgcgctactctctcctcgaagcggggccaggacccgagggtcgagaagcgttcgccctgaactcaagcactggggagctgcgtgccagggttccctttgattatgagcacaccgagagctttcgcctgttggtcggcgcagccgatgcaggcaaccttagtgctagtgtcaccgtttctgtcctggtaacgggcgaagatgagtacgatcccgtgttcctggcgcctgcattccactttcaggtccccgagggggccaggcgcggacatagccttggccacgtccaagcgacagatgaagacggtggagcagatggactagttctgtatagcctggcgacaagcagcccttatttcgggataaatcagaccaccggcgcactgtacctgcgagttgatagccgagcaccaggttctggcacggctaccagcggcggcggcggccggacccgtagggaagccccaagggaacttaggctggaggttatcgctcgaggaccactcccaggatctcggtccgccacggtgcccgtcacagtggacatcacccacaccgccttgggactggcccctgatctgaacctgctcctggtgggcgccgtggccgccagcctgggtgtggtggttgtccttgccctggctgctttagttttagggttagtccgcgctcggtcacgcaaagcagaggctgcacctggccctatgagccaggccgctcccttagcatcagactctctccaaaagttgggccgggaaccaccaagtccaccaccgagcgagcacctttaccaccaaactctcccatcctacgggggacctggagccggtgggccatatcctcgcggagggagcctcgacccaagccattcaagcgggcggggatcggccgaagccgctgaggacgacgaaatccgaatgattaacgagttcccaagagtcgcttccgtcgcgagttctctcgccgcccgtggccctgatagcgggattcagcaggacgcagatggattgagtgacacttcatgtgaacctcccgcaccagatacttggtacaaaggccgaaaggcggggctgctattgccgggcgctggagcaaccctctatagggaggaggggccccctgcaaccgctacggctttcctggggggctgtggtctctctcctgcccccactggagactatggtttcccggcagatggtaagccctgcgtggcaggagctctgacagccattgtagcaggggaggaagaattgcggggctcctacaattgggactacctcctgtcttggtgcccacaattccagcctctggcctccgtatttacggagatcgctaggctgaaggacgaggctaggccatgcccccctgcgccgcgaattgatccaccgcctctcatcactgccgtggctcacccaggggcgaagagtgtgccgcccaagccggctaatacagccgcggcaagggcaatattcccacccgccagtcacaggtctcctatttctcacgaaggcagtctgtcatccgccgcgatgagcccctctttctcaccttctctgagtccgttagcagctcgcagccccgttgtctccccattcggagtagcacagggaccctctgctagcgccctaagtgcagaatccggcctggagccccctgatgacacggagctgcacatctag

SEQ ID NO: 41757 - DNA, 462 bp, Artificial Sequence
  Description of Artificial Sequence: Synthetic coding sequence
atgaaggccccctgcccccagctgccctgcccccccgccagccacccgttgtgcctgttgtggctgctagctcaccccctgtcgcaccacctagggtggccaagagtaccacagccccagcactcggcccagtcccttgcttggagccacctgatgacaaggtcctgcacaagttcatgcggccctggttgggcacccacatgggacgcccacagcgttccaaacgctggccctaccctgagcctcccttgggcagctagcgattacgattggctgagaggaggtcatcaccaggcacctgccctgcaccccgagttacctagtcctttacgtgttctgggaccccaaaagccttgctgttccctgacctgcgaccaagtgcagtgcggggagaagtatgaaggaggcagttcgcccggctttagctccgtgagagacccatgtccggcacccgctccttag

SEQ ID NO: 41758 - DNA, 2121 bp, Artificial Sequence
  Description of Artificial Sequence: Synthetic coding sequence
atggacatcaagcaccaccagaacggcacccggggccagcggcggaaacagccacacacaaccgtgcagaggctgctcacttggggactacccgtgtcttgttcttggtttctgtggaggcagcccggagagttccctgttactgctctgctacttggagcaggagcgggcgggctgctggctattggccttttccaactgctggtgaatcctatgaacatatacgaggagcagaagatcatgtttctctacagtctggtgggcctgggcgcgatggggtggggcacctccccccacatccggtgtgcatctctgcttcttgttccaaagatgttgggtaaggaagggcgactgtttgtcttgggatatgcactggccgcaatttatgtcggcccagtcgcgaatctgcggcacaacctaaataatgtcattgccagcttaggctgcacagttgaactgcagattaacaacactagggctgcatggcgcatcagtaccgcccccctgcgggccatgtttaaagaccttctgtcctctaaggaactgcttagggctgaaacacggaacatatctgcaactttcgaagacctggacgcacaagttaatagcgaaacgggatacacacctgaggatacaatggacagtggcgagaccgcccagggtagagaggccagacaggccccggctagcagactgcatttaagcacacaaaaaatgtatgaactgaagaccaaactgaggtgctcatacgtagtgaatcaagcaattctcagctgcaggcggtggtttgatcggaaacacgagcagtgcatgaaacacatctgggtgcctctgttgacccacctgctttgccttcctatgaagtttaagttcttctgtgggattgcaaaagtcatggaagtctggtgtaggaatagaatccctgttgagggtaattttggccagacctacgattctctgaatcagtcaattcgcggcctggacggtgaattttctgctaacattgactttaaagaggaaaaacaagccggcgtactgggtctgaacacgtcctgggaacgagtctcgaccgaagtgcgcgactacgtgtatcgccaggaggcacggctggaatgggccttgggcctgctgcatgtactgctcagctgcacatttctccttgtgttgcatgcttccttctcatatatggattcctacaatcacgatatccggttcgataacatttacatctctacatatttctgtcagatcgatgaccgaagaaagaagctgggaaaacgtaccctactacctctcaggaaggcagaagaaaagaccgtaatcttcccctgcaagccaacgatacaggcgagtgagatgagcaacgtcgtgcgagagttgcttgaaacactgcctattcttctgcttctcgtggtgctctgcggattagattgggccctttactctatttttgacacaatcagacaccatagtttcctgcagtattcttttaggtcaagtcacaagttagaggtcaaagtgggaggggactcaatgctagcccggctgctgaggaagaccattggggcattaaatacttcctctgaaaccgtgatggaaagtaacaacatgccctgtctgccccaacccgttggcctggacgcccgagcctactggcgtgcagccgtgccaatcggcttgttggtttgtctttgtctattacaggcctttgggtacaggctgcgccgtgtgatcgccgccttctattttcccaaacgggaaaagaagaggatattgttcctctataacgacttgctgaaaaagcgggctgccttcacgaagcttcgcagagccgccattttgcgccgtgagcgacaacagaaggctccacggcaccctttagccgatatcttacaccgcggctgcccgctgctgaggcgatggttatgtaggagatgcgtggtctgtcaagcaccagagacacctgaatcctatgtgtgtcggactttggattgtgaagcagtgtattgttggtcatgctgggatgatatgcgacagcgctgtcccgtgtgcactccaagggaggaactttctagtagcgcgttttccgattccaatgacgatactgcatacgctgggtag

SEQ ID NO: 41759 - DNA, 1995 bp, Artificial Sequence
  Description of Artificial Sequence: Synthetic coding sequence
atggacatcaagcaccaccagaacggcacccggggccagcggcggaaacagccccataccaccgtgcagagactattgacctggggattgccagtgtcctgttcatggttcctttggcgccagcctggtgagttcccggtaacggccctcttgctgggcgctggagccggcggcctcttagcgattggcctctttcagctcttggtgaatccaatgaacatttatgaagaacagaaaattatgttcctgtatagcttggtcggtcttggggcaatgggctggggtacttctccacatatcagatgtgcaagtctgctgcttgtgcctaagatgctgggtaaggaaggccgtctctttgtcctcggatacgcactagccgcaatctacgtcggtcccgttgctaatcttagacataatttgaataatgtgatcgctagtcttgggtgcactgtggaactgcagatcaacaatactagggctgcatggcgtataagtaccgcgccgttgcgcgcgatgttcaaagatttgctgtctagcaaagagctgctgcgtgcagagaccagaaacatctccgccaccttcgaggatctagatgcccaggtgaactctgagactggctacacccccgaggataccatggattccggggagacagcacagggccgagaagccaggcaggcccctgcttctagattgcacctgtcaacccaaaagatgtatgagctcaaaactaagttgagatgcagctacgttgtgaatcaagctattctgtcatgccgtcggtggtttgatagaaagcacgaacaatgcatgaagcatatctgggtgccactgctgactcacctactctgtttgcctatgaaatttaaattcttttgtgggattgccaaggtcatggaggtgtggtgcagaaataggatcccagtagagggaaatttcggtcagacctacgactctctgaatcagagcatcaggggcttggacggcgaattttcagccaacattgactttaaagaggagaagcaggccggcgtgctgggtttgaacacatcctgggagagggtgagtaccgaggtgcgggactacgtgtaccgccaagaggcaaggttggagtgggcattaggcctactacacgtgctgctgtcgtgcacctttctcctggtcctgcacgcaagcttctcctacatggacagttataaccacgatatccggtttgacaatatctacatctcaacctatttttgtcagatcgacgatcggaggaagaaattgggcaagcgcacactcctaccattacggaaagctgaagagaaaactgtcattttcccctgtaagcccaccatacaggcctcggaaatgtccaatgtcgtccgcgaactgctggaaaccctgcccatactcctcctgctcgtcgtcctgtgcgggctcgactgggcattatacagtatctttgacactatcagacaccattcattccttcaatactcatttaggtcttctcacaagctggaagtcaaggtgggtggcgacagcatgttggcacgtttactgaggaagacgattggggctctcaacacaagcagcgagaccgtgatggagagcaacaatatgccctgtttgccacagccggtgggtctggatgctcgagcctactggcgcgccgccgtgcccatcggactgttagtctgtctttgcttgctgcaagcttttgggtaccggctccgccgggtgattgctgccttttacttccccaagcgtgagaaaaagcgcattctgttcctctacaacgacttgctgaaaaagcgggcagccttcactaaactgagaagagctgcaatactgcgcagagaacgccagcagaaagcacctgtgtttaccgaacctcagttcctccccttgaagaacggtaaaaccggcgaaatatgcaaagcatgcagcctggagatatctcttgagtggtggtccggcgtggggctaaggtgtcagcgggcttag

SEQ ID NO: 41760 - DNA, 1995 bp, Artificial Sequence
  Description of Artificial Sequence: Synthetic coding sequence
atggacatcaagcaccaccagaacggcacccggggccagcggcggaaacagccccacaccaccgtgcagcggctgctgacttggggactgccagtctcctgttcttggttcttgtggcggcagcctggggagttccccgtcactgcactgctgctcggtgccggtgcggggggactactggccattgggctgtttcagctcttagtgaatcctatgaacatttacgaggagcagaagatcatgtttctttattccttagtgggcttgggcgccatgggctggggaactagtccccacattagatgcgcttctctgttgctggtgcccaaaatgctaggcaaggagggccggttgtttgtactaggttacgcccttgccgctatatacgtgggccccgtggcgaatctgagacacaatctgaacaatgtcatcgctagtctgggctgtactgtagagcttcagatcaataacacaagagccgcgtggcgcatatcgactgcccctctgagagcgatgttcaaagaccttctatcatctaaagaattgttgagagcggagacccgcaatatatcagccacattcgaagatctggatgcccaggtaaactcagagaccgggtatacccctgaagatactatggacagtggtgagacagcacaagggcgcgaggcccgtcaggccccagcctctaggttgcacttgagcacgcaaaaaatgtacgaactgaagaccaagctgcgatgctcttacgtagtaaaccaagctatcctcagttgccggaggtggtttgaccgcaaacacgagcagtgcatgaaacatatttgggttcccttattaacccacctgctatgccttccaatgaagtttaaattcttttgtggaattgcaaaagtgatggaagtctggtgtaggaatcggatcccagtggaaggcaattttggccaaacatacgatagcctgaatcagtcgatcagagggctcgacggagagttctctgcaaatatcgactttaaagaagaaaaacaggcaggcgtgctcgggttaaatacatcctgggaaagggtgtcaactgaagtgcgagattatgtttatcgccaggaagctcgcctcgagtgggcactgggcttactgcacgtgctgctgagctgtacatttctgctggtgttgcacgccagcttttcctatatggactcctataaccacgacatccggttcgataacatttatatcagtacttacttctgccaaatcgacgacagaaggaagaagctcggtaagcgcacattgctccctctccgcaaagccgaagaaaagactgtaatcttcccttgtaaacctactatccaggcgagcgagatgtccaacgttgtcagagagctgctggagacattacccattctgctcctgctcgtcgtgctgtgcgggctggattgggcactgtactcaatctttgacactatacgccaccactcattccttcagtactcattccgctccagccataaattagaggtcaaggtaggaggggattcaatgctggctagacttctacgtaaaaccatcggagccctcaatactagttctgagacagtgatggagtccaacaatatgccatgcctgccgcaaccggtggggttggatgcacgggcttactggcgtgctgcggtccccattggcctgctggtttgcctgtgcctgttgcaggcgtttggttaccggcttcgcagggtcattgctgctttttacttccccaagcgggagaagaaacgaatcctgtttctgtacaatgacctgctgaaaaagcgggctgctttcactaaactccgtagggctgccatcttgaggcgcgaaaggcagcaaaaggcgcctgtgttcacagagccccaatttttgcctctcaagaatggtaagacgggggagatctgcaaggcgtgctctctcgagatttctctggagtggtggtctggggtcggtttaaggtgtcaacgggcatag

SEQ ID NO: 41761 - DNA, 2046 bp, Artificial Sequence
  Description of Artificial Sequence: Synthetic coding sequence
atggacatcaagcaccaccagaacggcacccggggccagcggcggaaacagccacacacgacagtccagagactgttgacttggggcctgcctgtgtcttgttcgtggtttctgtggcgacaaccaggtgaatttcccgtcaccgcactcctgctgggcgccggtgccggggggctcctagctattggactcggtgcaatgggctgggggaccagtcctcacatcaggtgcgcttcgctgctccttgtacctaagatgcttggcaaagagggtcgcctctttgtattgggatatgctcttgcagcgatttacgtcggtcctgtggctaatctacgccacaatctgaacaatgttatcgcctccttgggatgcaccgtagaactccaaattaataacacacgagcagcttggcgcataagcactgcacctctgagagcaatgtttaaagatcttctaagctcaaaggagcttctgcgagccgaaactagaaatatcagcgcgaccttcgaagacctcgatgcacaggtgaacagtgagactggatacacacccgaagacactatggattcaggtgagacagcccagggtcgcgaggcccggcaagctccagcttcgagacttcaccttagtacccagaagatgtacgagctaaagacgaagctcagatgttcctacgtggtgaaccaggctattctctcttgtcggaggtggtttgatagaaaacacgagcaatgcatgaaacacatatgggttccccttttgactcatttgctgtgcttgcccatgaaattcaaatttttttgtggaatcgctaaagtgatggaggtctggtgtaggaaccgtattcccgtggagggcaactttggccagacttatgacagcctaaatcagagtattaggggattggacggagaattctccgcaaatatcgactttaaggaggaaaagcaagcaggtgtcctcggcctcaacacgtcctgggagcgggtatcaactgaggtgagagattacgtttacaggcaggaggcaagattggagtgggcgttaggtctgctccatgtgctgttgtcctgtacatttttgctagtgctgcatgcaagtttctcatatatggatagctacaatcatgacatacgctttgataacatttatatctcgacttacttttgtcagatagacgatagaagaaaaaaactcggtaagcgtacacttctacccctgagaaaagccgaagaaaaaaccgtgatattcccgtgcaagcctaccattcaggcttcagaaatgagtaatgtggttcgcgaattactggaaaccctgcccattctactacttctggtggttctgtgtggattggattgggccctgtattctatctttgatacaatacgccatcactccttcctgcaatacagcttccgttcaagccataaattggaggtgaaagtgggtggggacagcatgctggctcgcttgctaagaaagacaatcggcgcattaaacacttcgagcgagaccgtcatggagtccaataacatgccgtgcctcccacaaccagtcggattggatgccagggcctactggcgggctgccgtccctattggtctgctggtatgtctctgtctgctgcaggccttcggttaccggctccggagggtgatcgctgcattttatttccctaagagggaaaaaaagagaattctcttcctgtataatgacctgctgaagaagcgcgctgcatttactaaacttcggagagccgccattctccgcagggagcgacagcagaaagcacccaggcaccccctggcagacattctccacagaggctgtcctctcctccgtcggtggctttgccgcagatgcgtcgtctgccaggcacctgaaacaccagaaagctatgtgtgccgaaccttggactgcgaagcagtatactgctggtcctgttgggacgacatgagacagagatgcccggtgtgcacaccacgggaggaactgagtagctccgccttttctgactcaaatgatgatactgcttacgcgggctag

SEQ ID NO: 41762 - DNA, 1920 bp, Artificial Sequence
  Description of Artificial Sequence: Synthetic coding sequence
atgcccaaggtgatgaaggacgtggtgcaccccctgggcggcgaggaaccttctatggcacgggccgttgtgcggtcggtcggagggttcaccctcgggttgagcctggctaccgcatatggcctgctggagctgctggtcgaggggcactccccatgggggtgcctggtgggtacactgacgctcgctgcttttttgagtctggggatgggcttctcgcggcaggtaagagccaccgtcctgcttctgctgccgcaggcctttagccgacaggggagaacgctcttattggtggcggccttcggcctcgtgctccagggcccctgtgcaaataccctgaggaatttcacgagagcctctgaagcagtagcatgcggcgctgaactcgcactaaaccagacagctgaggtgttgcagagagcaaagcagcctctggtttcagctttgaacaagatcaaagcgattgccaggaagactaaggaagtagcagatcgggttagaaagttttttagatccattatggacggcgtcaagcacatcgcccgggccctgcgaaatgtttggcagtggctgcttcacatcggcgacgtgtgtaactcagagttaggcaacccatacctgaagtgcgccagggtgtttgatgatgctaaagactcatgcatgatggtgatacctcaggcgtatcatctttgctacgttttgatgcccttcaaactcgcactatgtggccttgctagcctggtgcaggttttctgcgtcatccctaaatatatacagcccttcttaagacaaactattggcacccctgttattcagctgttgaatagggtcagacaagagttcgaatttaatatgactgccacccaccacttcagtgtcgatctaaatgcctctcgatcgctttcccaagtcgctatggacctccacgaagcagtttcaatgaagctgcaccgggtacgggaggcactcgcccttatgggatttaccacgcctctgctgctcgtgctactctacctgcaggctcttttttatcgctactgctaccttaactgggaccactatgacaacatatacatcactagcaggttccttcggatggaagcggtgaggtccacagccgggctccctactgtcttgcctctctccgctcatgaagcgcgtaggtacattccaccgggaagtattttcctgtcacaatgggagaaatttttttacatcctggagacatttaatctcatacggcacctgttgttggtcctgttcctggtgttcctcgattacgcagtgttctgggtcttggacctcgcaagacatcagcttcagggtgaaatcgtcgctcgtagcccggtcttggtgagcctgacagtcgaaggaaccggttatgcaggcaatatctacagagacctcgtctccgctttcgatgttctgcaacagggcaacatcagtattctgtccagaagatgcctactgcgccccagtgaacctgacagcaccggctatatcgtgatcggcgtgatgtatggcctgtgcttttttattactctatttggaagttacgtgtcaaggctgcgacgagtgatctgtgcttcctattacccgtcccgggagcaggagcgtatatcctacctctacaatgtcttactgtcacgccgtactaacctgctcgcggccctacatcgttcagtaagaaggcgagcagcagatcagggacaccgatctgccttcttagtgctcgcgagtagatgcccttgtcttggtccgtttgtgagccacttctggcttcatcaggcatactgtttgggttgcggtcagccccaggacgagggagatatggaaaatacagttagctgcagtacccctggttgtcagggattcatttgcaaatggcactgtagttccagcctggtctgcacgccctag

SEQ ID NO: 41763 - DNA, 2322 bp, Artificial Sequence
  Description of Artificial Sequence: Synthetic coding sequence
atgcccaaggtgatgaaggacgtggtgcaccccctgggcggcgaggagccaagcatggctcgggcagtggtgcgatccgtgggcggatttaccctcggcctgagtttagcaaccgcttatggattgttggagttgcttgtcgagggccattcaccctgggggtgcttagtcgggaccttgactcttgcagcctttttgagcttgggtatggggttctctaggcaagtgcgggcaaccgttttactgctgctcccccaagccttcagccgacaaggtaggactttactgttggtcgccgccttcggactggtactgcagggtccgtgcgccaacaccctaaggaacttcacgcgagcctcagaggcagtggcctgcggggctgaactggctctcaaccaaaccgctgaggtcttgcagcgggctaaacagccactggtctccgccctcaataagatcaaagcgattgcaagaaaaaccaaagaggtggctgaccgggtcaggaagtttttcagatcgatcatggatggcgtcaaacatattgcacgggccctgcgtaacgtttggcaatggctgttacatatcggcgatgtttgtaactccgaacttgggaatccatatctgaagtgcgccagagtgtttgatgacgcaaaagacagttgcatgatggtcatcccccaagcatatcatctttgctacgtcctcatgcctttcaaattagctttgtgtgggcttgcctctttagtccaggtattttgcgtgattccgaagtatattcagcccttcttacgtcaaactataggcactcccgtaatccagctgctgaaccgcgtgaggcaggagttcgagtttaacatgaccgctacccatcatttcagtgttgatctgaatgcttctagatctctaagccaggtggccatggacctacacgaagccgtctcaatgaaattgcatagagtccgggaggcgctcgcccttatgggcttcacaacgcccttgctgttggtgctgctctatctgcaagctctgttttaccgatactgttacttaaattgggaccattacgacaatatctatattacgagtaggtttttgaggatggaagccgtcaggagtacggctggcctgccaacagtcctgccgctctctgctcacgaggcaagacgctacatcccgcctggtagcatctttctgagtcagtgggaaaaattcttctacattctggaaaccttcaacttaatcaggcaccttctcttggtgttattccttgtgtttctggactatgctgtgttctgggtcctggacctagctagacaccagctccaaggcgaaattgtggcccggtccccagtgcttgtatctctgaccgttgaggggactggctacgcaggaaacatctaccgcgatcttgtctccgcttttgatgttcttcaacagggtaatatttcaattctaagccgtagatgcctgctcaggcccagtgaacccgatagtaccgggtacattgtgattggagttatgtacgggctttgcttcttcattaccttattcggctcttatgttagtcgactgcggagagtcatctgcgccagctattatccatctagagagcaggaacggatctcctatctctacaatgttctgctgtcgcgcagaacaaatctcctggccgccttacatagatccgtgcgtcggagagcagctgaccaaggccaccggtccgcttttctggtcttagctagccgatgtccctgcttgggcccattcgtctcacatttctggctgcaccaggcgtattgcttaggctgtggccagccccaggatgagggcgatatggaaaatactgtctcctgcagtacacccggctgtcaggggctgtactgtctgacctgttttagactcttggataacacgtgtagcgtgtgcgcctccccactgagctaccagggggatttggatctggaactggattctagcgatgaggaaggtccgcagctgtggctggcggcagctcaacggaaggatccagagcaagcctggctgttgcaacaacagttgcaggaagttctcggccggagtttaagtatggagtcaacatccgagtctagtgacctggatgaggagaaaggcccccaacagagaaaacacggccagcagcccctaccagaggcccaccaaccagtgagtattcttacctctcccgagccgcatcggcctcccgaaacatcatccgccacaaagggcgcacctactccggcttccgagcccagtgtccccttaagtcccccttctctgccagaccccagccacccacctcccaaatag

SEQ ID NO: 41764 - DNA, 1563 bp, Artificial Sequence
  Description of Artificial Sequence: Synthetic coding sequence
atgggccccacccggaagcccaacgtgtgcagccggctgagccggcgtgcgctgggctgcttcagccgggacgccggggttgtgcagcggacaaacctgggcattctgagagcactagtgtgtcaggagtccactaagtttaaaaacgtatggacaactcatagccgctctccaatcgcttacgagcgggggagaatttactttgataactaccggcgctgcgtatcttccgtggcgtcggaaccccgcaagctgtacgaaatgccgaagtgcagcaagagcgaaaagattgaagacgcgctgttgtgggagtgtcctgtaggggacattctgccaaattcatcagattacaagtctagcctgatcgccctcactgcccacaattggttgcttagaatcagtgcaaccaccggcaagatcctggagaagatttacttggccccgtattgcaaatttcggtatttatcatgggacacaccccaggaagtgattgccgtcaaatcggcccagaacaggggttccgccgtggcacggcaagcagggatccaacagcatgtgctgctctacttggccgttttcagagtacttccattctccttggtgggtatactcgagatcaacaagaagatcttcgggaatgtcaccgatgctaccctctcgcatggaattctgattgttatgtacagttcgggtctggtgcggctgtactcattccaaaccattgctgagcaattcatgcaacaaaaactggaccttggatgcgcctgcaggtggggtgggactaccggcacggttggcgaagctcccttcggcatcccatgtaacataaaaatcaccgacatgccgccccttctgttcgaggttagctctctggagaacgcctttcaaatcggcggccacccatggcactacattgtgacccctaacaaaaaaaagcagaagggagtgttccatatctgcgctttaaaagacaactcattggcaaagaacgggatccaggaaatggactgttgcagcctcgagagtgactggatctacttccaccccgatgcttctggaagaattatacacgtggggccaaatcaagtgaaggtgctaaagcttaccgaaatcgagaataacagttctcagcaccaaatttcggaggattttgtcattcttgctaacagggaaaatcataaaaatgagaacgtgctgaccgtgacagcttctgggcgggtcgtgaaaaagagcttcaatctcctggatgacgatccggaacaggagacattcaagatcgtggattatgaggatgagctggacctcctcagtgtggtcgccgtgacccagattgatgccgaggggaaggcgcatctggattttcactgcaacgagtacggaacactgctgaagagcatcccgctggtcgagtcttgggacgtgacttattcccatgaagtttattttgaccgtgacctggtgctccatattgaacagaagcccaatcgcgttttcagttgctatgtttaccaaatgatttgcgatactggcgaggaggaggaaaccatcaaccggtcttgctag

SEQ ID NO: 41765 - DNA, 813 bp, Artificial Sequence
  Description of Artificial Sequence: Synthetic coding sequence
cggcacagcaccacctgcttcgccgtgccctgcagcgtgcccagcagtacttttttcacatgtcgcgatagccgggatcagcaaaaagacatgccaccactcctcttcgaagtctctagtctcgaaaacgccttccagattggcgggcatccttggcactacattgttacccctaacaaaaagaagcagaagggcgtgttccacatttgcgcgctaaaggacaatagcctggcaaagaacggaatccaggaaatggactgctgtagcctggagtctgactggatctacttccaccccgacgccagcgggcggatcattcacgtggggccaaaccaagtgaaagtgctcaaactaacagaaattgaaaacaattcaagccagcatcagatcagcgaagatttcgttattctggccaaccgagagaatcataagaatgagaacgtcctcacagtgacagcatcaggacgagtggtgaaaaagtcctttaatttgctggacgatgaccctgagcaggagacattcaagatcgtggactatgaggacgagctggatctgctttcagtcgtcgctgtcacacaaatcgatgcagaggggaaggctcatctcgacttccattgcaacgagtatggaacccttctgaagagcatcccactggtcgaatcatgggacgtaacctatagtcatgaagtttatttcgatcgggatctggtgttacacattgagcagaaacccaatcgtgtgttttcctgttatgtttatcagatgatctgtgatacgggcgaagaagaggaaaccatcaatagatcctgttag

SEQ ID NO: 41766 - DNA, 1362 bp, Artificial Sequence
  Description of Artificial Sequence: Synthetic coding sequence
atgggccccacccggaagcccaacgtgtgcagccggctgagccggcgcgctctcggctgctttagtagagatgctggtgtggtgcagcggactaaccttggcattctgcgcgcgcttgtttgtcaggagagtaccaaattcaagaacgtttggaccacacactccagatccccaattgcctacgagagagggaggatatatttcgataactacaggaggtgtgtgtcctcagtcgctagtgaacccagaaagctctacgagatgccaaaatgctcgaagtccgagaagattgaggacgcattgctgtgggagtgtccagtcggcgacatcctgccgaatagctcggactataaatccagtctgattgccctgaccgctcacaactggcttctgcggatctctgcaaccaccggaaaaatccttgaaaaaatttacctggccccatattgcaaatttagatatctgtcctgggacactcctcaggaggtcatcgccgtaaagtcggcccaaaatcgcggctcagctgtggctcggcaagccggcattcagcagcacgtgctcctttaccttgccgtctttcgggtgctgccgttttcactcgtgggtatccttgaaatcaataaaaagattttcgggaatgtcacagacgctacgctgtcccatggcatactgatcgtgatgtattcctcaggactggtccggctgtattcttttcagaccattgcggaacagtttatgcagcagaaacttgaccttggctgtgcatgtcggtggggcggtactacaggcacagtcggggaagccccgtttggaatcccttgtaatatcaaaataactgacatgccacctctgctgtttgaggtcagctccctcgagaacgcgtttcagattggggggcatccttggcactacatcgttacacccaacaagaagaagcagaaaggtgtcttccacatttgcgcgcttaaagataatagccttaacgaaaacgtcctgactgtgacagcgtcagggagggtcgtcaaaaaatcattcaatctactggatgatgatcccgaacaagaaaccttcaaaatcgtagattacgaagatgagctagacctgctgtctgtcgtggcggtgacgcaaatagatgcggaaggaaaagctcatttagatttccactgtaatgagtacggcaccctgctgaagagcataccccttgttgaatcatgggacgtgacctattctcatgaggtttattttgacagggatcttgtcctccatatcgaacagaagccaaatcgtgtgtttagctgctacgtgtaccagatgatctgcgatacgggcgaggaggaggagacaataaacaggtcatgttag

SEQ ID NO: 41767 - DNA, 945 bp, Artificial Sequence
  Description of Artificial Sequence: Synthetic coding sequence
atggtggcccccgtgtggtacctggtggccgccgccctgctggtgggcttcattctgtttctgaccagaagtaggggcagagctgcaagcgccggccaggagccactccacaacgaagagctggccggtgcaggtcgcgtagcgcagccaggtccccttgagcctgaagagcctagggcaggaggccgacctcgaaggagaagagatctgggctctcggctgcaggcccagcggagagcacaaagggtcgcctgggccgaggcagacgagaatgaagaggaagcggtcattttggcccaggaggaggagggggtcgagaagcccgccgaaacacatttgagcggaaagattggtgccaagaagttgagaaaactggaggaaaagcaagcccgcaaggcacagcgtgaggcggaggaagccgaacgggaagaacgtaagaggctggagtcgcaacgcgaagctgaatggaagaaagaagaagaaagactgcgcctggaagaggaacaaaaggaagaggaggagaggaaggcgagagaggaacaggcacaacgggagcacgaagaatacctcaagcttaaggaggcgtttgttgttgaggaggaaggagtgggagagacaatgacagaggagcagtcccagagctttctgactgagttcatcaactacattaagcaatcaaaagttgtgctgctcgaggacttggcatcccaggttggactaaggacacaagacacaatcaacaggatccaggaccttttggcagagggcaccattacaggcgttatagacgatagaggaaagtttatctatataactccagaggaactcgccgccgttgcaaactttatcagacagaggggccgcgtttctatcgctgaactagcccaggcttccaatagtctcatcgcgtggggtcgtgagagtccagctcaggcccccgcatag

SEQ ID NO: 41768 - DNA, 897 bp, Artificial Sequence
  Description of Artificial Sequence: Synthetic coding sequence
atggtggcccccgtgtggtacctggtggccgccgccctgctggtggggttcatcctgtttttaacacgatctcggggtagagcagcatctgccggtcaggaaccccttcacaatgaagagctcgctggagccggaagggtagcacagcctggacctttggagccggaggagcctagggctggtggacggccccggcgccgtcgcgacctgggtagcaggttgcaggcccagagacgcgctcaacgagttgcgtgggcagaagctgacgaaaacgaagaggaagcagtcattctggcgcaagaggaagaaggcgtggagaagcccgctgaaactcatttatcaggaaagatcggtgctaagaagcttcgcaaactggaagagaaacaggctaggaaggcgcagcgcgaggctgaggaggcggagagagaggagagaaagcggctggagagccagcgcgaagccgagtggaagaaagaagaagaacgactgaggctggaggaagagcagaaggaggaggaagagagaaaagcccgagaggaacaggcgcagcgggaacacgaggagtatcttaagctcaaagaggccttcgtcgtcgaagaggagggcgtcggcgagactatgacagaggaacagagtcagtcctttctgaccgaatttattaactacatcaaacagtcaaaagtggtgcttttggaggatctggcttcgcaggttggtttgcggacacaagtgtcccccggcacgtggccagcagtctgctccgtcgctagaggcctttggctggcggaaaggacttgtccgaaggacagggtgttgatgcaccgccttccttgtcctcagcccagagtctcctcagcacagaaaagccctggaactctgggcatcttgcacttttag

SEQ ID NO: 41769 - DNA, 942 bp, Artificial Sequence
  Description of Artificial Sequence: Synthetic coding sequence
atggtggcccccgtgtggtacctggtggccgccgccctgctggtgggcttcatcctgttcctcactcggtctaggggaagagctgcttctgccggacaggaacccctgcacaacgaggaattggccggtgctggaagagtggcacagcctggtcccttagaaccagaggagccgcgggccggtggccgcccacgccgtcgaagggatctggggtcacggctgcaggcccagagaagggctcagcgcgtcgcttgggccgaggctgacgagaacgaggaagaagccgtgatactggcccaggaggaggagggagttgaaaagcctgccgagacccaccttagtggtaaaatcggagctaagaaactgagaaagcttgaggaaaagcaggctaggaaggcccagcgcgaggcggaagaagctgaacgggaggagcgtaagcgtctcgagagccagcgcgaggctgaatggaaaaaggaggaagagcgcctccggctcgaggaggagcagaaggaggaggaggagagaaaggccagggaagagcaggcacaaagagagcacgaagagtatctaaaactgaaggaagcattcgtggtggaagaggagggcgtgggtgaaaccatgactgaagaacaatctcagtcattcctgaccgaattcattaactacattaagcaatctaaagtcgtcctcctcgaggatttggccagccaggtgggcttaaggactcaggtgagtcccggcacatggccagctgtctgctctgtggctcgggggctttggctggcagagagaacctgtccaaaagatagggttttaatgcacaggctcccctgtccacagcccagggtgtcgagcgcccagaaatcaccaggaacactggggatactgcacttctcccttattgcctggggccgtgaatctcctgcccaggcgcccgcttag

SEQ ID NO: 41770 - DNA, 324 bp, Artificial Sequence
  Description of Artificial Sequence: Synthetic coding sequence
atggccaacgaggtgcaggacctgctgagcccccggaagggcggccatcccccagctgtcaaggcggggggcatgcgaatcagtaagaagcaagagatcgggacactcgaaagacacaccaagaagaccggcttcgaaaagacttccgccattgctaacgtggccaagatccagactttagatgctttgaacgatgccctggagaaattgaactacaagtttcctgcgactgtccatatggcacatcagaagccaacccccgccctcgagaaagtggttcccctgaagcggatctatatcatccagcagcctcggaagtgttag

SEQ ID NO: 41771 - DNA, 2760 bp, Artificial Sequence
  Description of Artificial Sequence: Synthetic coding sequence
atggccagcgccaccgccgccgccgcccggcggggcctgggccgggctttaccgcttttttggcgcgggtaccagacggaaagaggcgtttatggctacagaccacggaaaccagagtcgcgcgagccacaaggcgcactggagaggcccccggtcgaccacggacttgcaaggcttgtgactgtctactgcgaacacggacataaagctgccaagataaatccgctgttcacaggccaggcgttactggaaaatgtgcctgagatccaggcccttgttcaaacactgcaggggcccttccacaccgccggattgctcaatatggggaaggaagaggcttctctggaggaggtcctggtgtatctgaatcagatctattgcggccaaataagcatcgaaaccagtcagttgcaaagccaggacgagaaagattggttcgccaagcgattcgaggagcttcagaaagaaaccttcaccaccgaggaacgaaaacatctctcaaaattgatgctggaatcacaagagttcgatcacttcctcgccaccaagttctctaccgtgaaacggtatggcggcgaaggcgccgaatcaatgatgggctttttccatgaactgctgaaaatgagcgcttattccggcattactgacgtcatcatcggcatgccccaccgcggtaggctcaaccttctgaccggcctgcttcagtttccccctgaacttatgtttcgtaagatgcgcggattgagtgagtttcctgaaaatttcagtgccacaggcgacgtgctgtcccacttaaccagctccgttgatctgtatttcggtgctcaccatcccctacatgtgaccatgctgcccaacccttcccacctggaggccgtcaacccggtcgctgtgggaaaaacgcgcgggcgccaacagagtcggcaggatggcgattacagtccagacaattcggcccagcccggagatcgagtgatctgtctgcaggtgcatggcgacgcctcgttttgtggacagggcatcgtccctgagacttttactctgagcaacctgccacactttcggatcgggggcagcgtccatctcatcgttaacaaccagttgggatacaccaccccagccgagcgggggcgatccagtttgtattgcagcgacattgggaaactggtcgggtgtgccataattcacgtgaacggagactctccagaagaggtagtacgagccacccgactggcatttgaataccagcgacagtttaggaaggacgttatcatagacttgctgtgctacagacagtgggggcataatgagttggacgagcctttctacaccaacccaattatgtacaaaatcattcgcgctcggaaaagcattcccgatacgtatgctgagcacctcatcgccgggggattgatgactcaggaggaggtgtcagagatcaaatcaagttactacgctaaactgaatgatcatctgaacaatatggcccattaccgtcctccagccctgaatctacaggcccattggcagggtctggcacagcccgaagctcagatcacaacctggtccacgggtgtgcctctggacctgctgcgctttgtaggcatgaagtcagtcgaggtaccaagggagctccagatgcactcacatctgctgaagacccatgtccagtctcgtatggaaaaaatgatggatgggattaagctggattgggctaccgctgaggccctggctctgggaagcctgcttgcgcagggttttaacgtcaggctcagcggccaggacgtgggaaggggcacgttcagccagagacacgccatcgtagtttgtcaggaaaccgatgacacatacatccctctgaaccacatggacccgaatcagaaagggtttttggaggtctcaaacagtcctctttcagaggaagccgtgctcgggttcgaatacggtatgtctatcgaatctccaaagttgctacctttgtgggaagcccagttcggagacttctttaacggggcgcagatcatcttcgacactttcatcagcggcggggaagcgaagtggttactgcaatcaggaattgtcatcctgctgccacatggctacgatggcgctggacctgatcacagttcttgtaggatcgagagattcttgcagatgtgcgatagtgccgaggaaggagtggatggagatacagttaacatgtttgtggtacatcctactacaccagcccaatactttcacttactgcgcagacaaatggtgagaaacttccgaaaaccgctcatcgtagcctctcccaagatgctattaaggctcccggcagcagtgtccactttacaggagatggctcccggaacgacctttaatccagtcatcggtgactcttcagtcgaccctaagaaggtgaagactttagtgttttgcagcggcaagcacttctacagcctggtgaaacaaagggagtcgcttggagcaaagaagcacgacttcgctattatcagggtggaagagctttgtcctttcccccttgactccctccaacaggagatgtccaagtataaacatgtgaaggaccacatctggtcgcaagaagagccccagaacatggggccctggtccttcgtttccccaaggttcgaaaagcagctcgcatgtaaactgagactggtgggcagaccaccactcccagttcctgccgttggcatcggaactgtgcacctccatcagcatgaagacatcctagcaaagaccttcgcatag

SEQ ID NO: 41772 - DNA, 486 bp, Artificial Sequence
  Description of Artificial Sequence: Synthetic coding sequence
ggccggcagcagagccggcaggacggcgactacagccccgacaacagcgcacagcctggcgatagagtgatatgcctgcaagtccacggtgatgccagtttttgtggtcaggggatcgtgcctgaaacgttcaccctctctaacctgcctcacttcagaatcggaggctcagtccatctgattgtcaacaatcaactgggttacaccacacccgcagagaggggtcgcagcagtctgtattgttctgacatcggcaagctcgtgggctgtgctatcatccatgtcaatggtgattctcccgaggaagtcgtgcgtgcaactaggctcgcatttgagtaccagcgtcagttccggaaggacgttattattgaccttctctgttacaggcagtggggtcacaatgagcttgacgagccattctacaccaacccaataatgtacaaaatcatccgatataattacaagcctctttgcgacatgccctag

SEQ ID NO: 41773 - DNA, 927 bp, Artificial Sequence
  Description of Artificial Sequence: Synthetic coding sequence
atggccagcgccaccgccgccgccgcccggcggggcctgggccgggctctgccactcttctggcgaggttaccagacagaacgcggcgtttatggataccgacctcgtaaacccgagtcacgggagcctcagggggcactggagcgccctcccgtggatcatggtttagctaggttggtcaccgtgtattgtgagcacggtcataaagccgccaagattaaccctctctttactggccaggcgctcctcgagaacgtgccagagatccaggcactggtacagactttgcagggacctttccataccgcggggctgctcaatatggggaaggaggaggcctctctggaggaggtattggtttacttgaatcagatctattgtggacagatcagcatcgagacttctcagcttcagtcccaggatgagaaggattggttcgcaaaaagattcgaggaactgcagaaagaaacctttactacagaggaacgaaaacatctctctaaactgatgctggagtcgcagcttatgtttaggaagatgcgtggcctaagcgagttccccgaaaatttttctgccaccggggacgtgctttcccatctcacttcttcagtggacctgtatttcggcgcacaccacccacttcatgttactatgctgccaaacccctctcacctagaggcagtgaatcccgttgccgtggggaaaacccgcggccggcagcagagtcgacaggacggtgattattctcccgataactccgcccagccaggggacagggtgatatgtctgcaggtgcacggggacgcgtcattttgcgggcaaggcatcgtgcctgaaactttcacactctctaacttgcctcattttcgcatcggcggctctgtgcatctgattgttaacaaccaacttggttacacaaccccctag

SEQ ID NO: 41774 - DNA, 645 bp, Artificial Sequence
  Description of Artificial Sequence: Synthetic coding sequence
tgaaagatcatccgggcccggaagagcatccccgacacctacgccgaacacctgatagccggcggcctcatgacacaggaggaagtcagtgaaattaaatctagctattacgctaaactaaatgatcacttgaataatatggcgcactaccgcccacctgcacttaatctccaggcccactggcagggactagcccagcccgaggctcagataaccacgtggtccacaggcgtgccactcgatctgctgcgctttgttggcatgaaatccgtggaggtacctcgcgagctgcaaatgcactctcacctgttgaaaacacatgtgcaatcccggatggaaaagatgatggatgggataaagctcgactgggccacagccgaggcgctggctctgggcagccttttagcacagggatttaacgttcgtctcagcggccaagacgtaggacgagggacctttagccaaaggcacgcgattgtggtttgtcaagaaacggatgacacctacatcccgctgaaccatatggatcctaaccagaaggggttccttgaagagaggccctccggaagttacaaagcggcttcttcatcatcttttcatatggcgaccatgggcctcggccagacaacgcatcccgttgaatag

SEQ ID NO: 41775 - DNA, 942 bp, Artificial Sequence
  Description of Artificial Sequence: Synthetic coding sequence
atggccgcccccatgaacggccaggtgtgcgtggtgaccggcgccagcagaggaattggtcgcgggatcgcgttgcaattatgcaaggccggggccacagtctatattaccggaagacatcttgacactttgcgggtggtggcacaagaagcccagtcattgggcggacagtgcgtcccagtggtgtgtgacagtagccaggaatcggaggtccgctctctcttcgaacaggtggaccgcgagcagcaaggccgattggacgtgcttgtcaacaatgcctacgccggggtgcagaccatactaaacacacgaaacaaagcattttgggagacccccgcaagcatgtgggacgacatcaacaacgtgggcctgagagggcactacttttgttctgtttatggcgccagactgatggttcctgcagggcagggattgattgtggtcatctccagccccggatctcttcagtatatgtttaatgtcccatacggagttgggaaagctgcttgtgataagttggccgccgattgcgcccacgagctgcggcggcacggcgtgtcctgcgtctccctctggcctggaatcgtgcaaacggagttattgaaggagcatatggccaaagaggaagtgctacaggatcccgtgctaaagcagttcaaatccgcattttcctccgcagaaacaactgagcttagtgggaagtgcgtagtggccctggccacagaccctaatatacttagcttgtccggcaaagtcctgcccagttgtgacctggctcggcggtatggcctgagggacgtagatgggagacccgtccaggactacctcagtcttagttccgtgttatcccatgtgtcagggctggggtggttagcttcttatctgccttcctttcttagagtgcccaagtggataatcgccttgtatacctcaaaattttag

SEQ ID NO: 41776 - DNA, 942 bp, Artificial Sequence
  Description of Artificial Sequence: Synthetic coding sequence
atggccgcccccatgaacggccaggtgtgcgtggtgaccggcgccagccgcggtattgggcggggcatcgcgttgcaactgtgtaaggccggggccacggtgtatattactggccggcacctcgacacgctacgagtggtcgcccaggaggcacaatcactcggtggccagtgcgtgccggtggtctgtgactcttcccaagagtctgaggtgaggagtctgttcgaacaggtggatagggagcaacagggacgcctggatgtactcgtcaacaacgcatatgcaggggttcagactatacttaacacccgcaacaaggccttttgggaaactcctgctagcatgtgggacgacataaacaatgtcggcctgaggggccactacttttgttctgtgtacggggcccggctcatggtcccagccggacaggggctgatagttgttatatcatccccggggagtctgcagtacatgtttaacgttccctatggagtgggtaaggctgcttgcgacaaactcgctgctgactgcgcccatgagcttaggagacatggtgtgtcctgtgtttccttgtggcctgggatcgtccagacggaactgctgaaagagcacatggccaaggaagaggtcctgcaagatccagtccttaagcagttcaaatccgctttttcatccgcagaaacgacggagctctctggtaagtgtgtcgtagccctggcgaccgaccctaacattctgtccctttccggaaaggtcctgccatcttgcgacctggcacggcggtacggactacgggacgtggatggacgcccagtccaagactatctctcactctcctctgtgcttagtcacgtcagcgggctgggctggcttgccagttacctcccctcatttcttcgcgtgcctaagtggatcatagccctgtacacatccaagttctag

SEQ ID NO: 41777 - DNA, 978 bp, Artificial Sequence
  Description of Artificial Sequence: Synthetic coding sequence
ttcatcagcggcagcagccggaagagcctgcccaaggtgaaggccatggacttcatcacatctacggcaatactcccactgctctttggatgcttgggggttttcggcttgtttagactgctgcagtgggttcgaggaaaagcatacctgaggaacgcagtagttgtgatcactggagctacatccggcctgggtaaagagtgtgccaaagtcttttacgctgccggagctaaactggtcctgtgcggccggaatggaggcgccttggaggagctgatccgggagctgactgcgtcacacgccacgaaggtgcagacgcacaagccctacttagtgacatttgatctgaccgatagcggagcaattgtggccgccgctgctgagattctccaatgtttcggttacgtagacatactggtgaacaatgccggtatatcgtaccgtggaacgatcatggacacgacggtagatgtggataagcgagtgatggagaccaattatttcggccctgtggctctgactaaggctctgctcccaagcatgatcaaaaggagacaagggcacattgtcgctatatcttctattcagggtaaaatgagcatcccatttcgctctgcttatgccgcttccaaacatgccacccaggctttttttgattgtctgagggccgagatggagcagtatgagatcgaggtcaccgtgatctcccccggatacatccacactaacctttccgtgaatgctataactgccgacgggagccgctatggggtcatggacacaacgactgcccaaggcagaagtcccgttgaagtggcgcaggacgtccttgcagcagtgggcaagaagaaaaaagatgtgatcctggctgaccttctgccttcactggcagtgtatctgagaacgctggctcctggtttgttcttctcacttatggccagccgcgcaaggaaggagcgaaaatccaagaatagttag

SEQ ID NO: 41778 - DNA, 978 bp, Artificial Sequence
  Description of Artificial Sequence: Synthetic coding sequence
atggtgagccccgccacccggaagagcctgcccaaggtgaaggccatggactttattacttcaacggccattctgcccctcttatttggctgtctcggcgtttttggcctttttcgcttactccagtgggtccggggtaaggcatacttacgcaatgctgtggtggtgatcactggcgcaacttccggactgggaaaggaatgcgccaaagtgttttacgcagcaggggctaagttggtgctctgtggacgcaacgggggcgctttggaggagctgatcagggagctgactgccagtcatgcaactaaggtgcagacacacaaaccgtatctagtcacattcgaccttacagatagtggagcgattgtagcggccgcggctgagatccttcaatgctttggctacgtcgatatcctcgtcaacaacgctggtatctcatatcgcggaaccattatggacaccacagtggatgtggataagagggttatggaaactaactattttggacctgtggcactgaccaaggcactcctcccgtccatgataaagagaaggcaggggcatatcgtagcaattagttctattcagggtaaaatgtctatcccatttcgcagtgcgtacgccgcctcgaagcacgcaacccaggcgttctttgactgcttgagggctgagatggaacaatacgaaattgaagtgaccgtgataagccccggatatatccacacgaatctaagtgtaaacgctataaccgccgacggaagccgctatggcgtgatggacacaacgacagcccagggccgcagtcccgttgaagtcgcccaggatgtcctggcagccgttggaaaaaaaaagaaggatgtgattctagccgacctgctcccatccctggctgtgtacctaagaactctcgcaccaggcttgtttttttcgctaatggcatcacgagccaggaaggagaggaagtccaagaacagctag

SEQ ID NO: 41779 - DNA, 4587 bp, Artificial Sequence
  Description of Artificial Sequence: Synthetic coding sequence
atgagcgtggccatccggaagcggagctgggaggagcacgtgacccattggatggggcagccgttcaattccgacgatcggaataccgcatgtcaccacggtctggtggccgactctctgcaggcttcgatggagaaggacgccaccttaaatgtggatagaaaggagaagtgtgtttcccttcctgactgctgtcatggctctgagctgcgcgacttccccgggcgtcctatggggcacctttccaaagatgtcgatgagaatgacagccatgaaggggaagaccagttcctgagtctggaggcgtcaacagaaacgctagtacacgtatctgatgaggataacaacgctgacctgtgtcttacggatgacaaacaggtcctgaacactcagggtcagaagacttctggacagcacatgatccagggagctggcagcctggaaaaggctttacccattattcagagcaaccaggtttcctctaattcatgggggatcgccggagagacagagctcgccctggtcaaagagtcaggggagcgtaaagtcactgattcaattagcaaatcactggaactttgtaatgaaataagtctgagcgagatcaaagacgcccctaaggtgaatgcggtggatacactcaatgtcaaagatatcgctcccgaaaaacagctgttgaacagtgcagtgatagcccaacagagaaggaagccagaccccccgaaagatgaaaacgaacggtcaacatgcaacgtggtccagaacgagttcctcgatacaccatgtaccaataggggtctgcctctattaaaaactgacttcggaagctgcctcttacagccaccttcctgccctaatggcatgagcgcggagaacggattagagaagagcgggtttagccagcatcagaataagagccctcccaaagttaaggccgaggacgggatgcagtgccttcagctcaaggaaaccctagctacgcaggagcctaccgacaatcaggtgaggcttaggaagcggaaggagatcagagaggacagggacagggcaagactggattccatggtgctactcataatgaaactcgatcagttggaccaagatatcgagaacgccttaagcacctctagctctccctccggcacaccgacaaacctgaggaggcatgtgcccgatctggaatctggcagcgagagcggggccgatacaataagcgtgaaccagacccgtgtcaacttgtcgagtgatacagaatctactgacctaccttcgtcaacacctgtggccaactccggaaccaagccaaagactaccgcgattcaggggatatctgagaaagaaaaggctgagattgaagcgaaagaggcctgtgactggcttagagccaccgggttcccccagtacgcccaactttacgaagattttctctttcctatcgatatttccctcgttaagagagaacacgattttttggatagagacgctattgaagctctctgcagacggctgaatacgctgaataagtgtgctgtaatgaaacttgagatcagcccccacagaaaacggagtgacgactcagacgaggacgagccgtgtgctatctcaggaaagtggacatttcagcgagattcaaagagatggagtaggctcgaggagtttgatgtattctcgccaaagcaggatctggtccctgggtcacctgatgactcacatcccaaggatggtccaagccccgggggcacgctcatggatctctcagaacggcaagaggtgtcaagtgtccgctctttgtccagcacagggtccctgccctcccatgcgccgcctagcgaagatgcagctacaccacgcactaatagcgtcatttctgtgtgctccagctctaacctggccggcaatgatgattccttcggcagtcttccttcccccaaggaactttcatcattctcattctcaatgaagggccacgagaagactgcgaagtctaaaacccggagcctgttaaagcgtatggaatctctcaaacttaagagtagccatcactccaagcacaaggcaccatccaagctgggacttatcatatccggccccatcttgcaggaaggcatggacgaagagaagctgaaacagttgaattgcgtggagatatccgctctgaatggtaaccgcattaacgtccctatggtcagaaaacggtcagtgtccaactctacacagacctccagctctagtagccagtcggagacttcttctgcagtgagtactcccagtccggtcacacggactagatctctgtccgcctgtaataaaagagtcggaatgtaccttgaaggctttgaccctttcaatcagtccacatttaacaacgtagtggagcaaaatttcaaaaacagggaatcttacccagaagatacggttttctacatcccagaggaccataaacctgggacctttccaaaggctttgactaatgggagtttttccccttctggcaataacggttccgttaattggaggactggcagctttcacgggccaggtcatatatccctgagacgtgagaattcttcagatagcccaaaagaactgaagcgccggaattcttcctcaagcatgtcgtctcgtctctccatttacgacaacgtgccgggctctattctctacagttcctctggagacctggccgatctggagaacgaggacatattccccgaattggatgacatcttgtatcacgtgaaaggtatgcagcgcattgtcaatcagtggtctgagaagttctctgatgaaggggactcggactccgcactcgactccgtgtctccctgtccgtccagcccaaagcagatccacctggacgtcgataatgaccggaccaccccttctgatctggatagtacaggaaatagcctaaatgaaccagaggagcccagcgagattcccgaaagacgagactctggtgtgggggcctccctgacccgtagcaatcgacaccgactgcgttggcacagcttccagagttcccaccgaccttcacttaatagcgtgtcactgcaaatcaactgtcagtctgtagcccagatgaatcttttgcagaagtactccctgctgaaactgacagctttgttagagaaatatacaccaagcaataagcatgggttttcctgggctgtccccaagtttatgaagcgtatcaaagtgcctgattacaaggatcgctccgtgttcggcgtgcccctgacagtgaacgtccagagaacaggacaacctttaccgcagtccatccagcaggcaatgcggtatctacgcaatcactgtctggaccaggtaggtctgtttcgcaagtcaggggttaaatctaggatacaggccctccgccagatgaacgagggggctattgactgcgtgaattacgaaggccagagtgcctacgacgtggcggatatgctgaagcagtactttcgggatctccccgagcctctgatgacgaacaagctgtctgagacgttcctccaaatttatcagtatgtcccaaaggaccaaagattgcaggcgataaaagcagccataatgttacttcccgatgaaaaccgagaagtcctgcaaacactgctgtactttctgagtgatgtcacagccgcagtgaaggaaaatcagatgacacctaccaaccttgcagtctgtctggctccatctctcttccatctcaataccttgaagcgcgaaaactctagtccgcgggtgatgcagcgcaagcagtctctgggaaagcctgatcagaaagatctcaatgagaacctagctgccacgcaggggctggcacatatgatcgccgaatgtaagaagctttttcaagtcccggaggagatgtctcggtgccggaactcatacacggagcaagaactgaaaccactcaccctggaagccctggggcacctggggaacgatgacagcgccgactatcagcattttctacaagattgtgtggacggcctgttcaaggaggttaaagagaaattcaagggctgggtctcctattccactagcgagcaagctgagcttagctacaaaaaggtcagtgagggcccacctctccgcctctggcggtcagtgatagaggtccctgctgttcccgaggaaatacttaaacggctgctgaaggagcagcacttgtgggacgtcgaccttttggactcaaaggttatcgaaattctggactcccagacagaaatctatcagtacgtccagaatagcatggctcctcaccctgcaagagactacgtggtcctacgcacctggcgaactaacctgcccaagggggcctgtgcactgttgctaacaagtgtggaccacgaccgggcccccgtagttggggtgcgggtgaatgtgcttctgtcaagatacttgattgagccctgcgggccaggtaagtcgaagctcacatacatgtgccgcgtggacctgcgaggccatatgcccgaatggtacactaagtccttcgggcatctgtgtgcagccgaagttgtgaagattagggatagcttctccaaccaaaacaccgagactaaggataccaagtctcggtag

SEQ ID NO: 41780 - DNA, 1497 bp, Artificial Sequence
  Description of Artificial Sequence: Synthetic coding sequence
atgagcgtggccatccggaagcggagctgggaggagcacgtgacccactggatggggcagcctttcaacagcgacgacaggaataccgcgtgtcaccatgggctcgtggccgacagtcttcaggcatccatggagaaagatgcaacattaaacgttgacagaaaggagaagtgtgtttctcttcccgattgttgtcatggatctgagctgcgggattttcctggtagacctatgggccatctttccaaggacgtggatgagaatgatagccatgaaggcgaggaccagttcttgtctctcgaagcgagcacagagacattagttcatgtctccgatgaggacaataacgctgacctctgcctcacggacgataagcaggtcctgaatacccagggacagaaaacctccggacagcacatgatacagggcgccggatcgcttgagaaggcccttcctataatccagagtaatcaagtcagctccaattcctggggcattgctggcgagacagagttggccctggttaaagagtcaggagagcgcaaggtcacagacagcatctccaagagcctagaattatgcaatgagatttcgctctctgaaatcaaggatgcccctaaggtaaacgccgttgacaccttgaatgtcaaggatatcgcaccagaaaagcagctgctgaactccgccgtcatcgcacagcagcgccgcaagccagacccgccaaaggacgaaaacgagagaagcacctgcaatgtcgtgcagaacgaatttctggataccccgtgtactaacagagggctgccattgctgaaaactgattttggctcttgcctgctgcagccgccatcttgtcccaatggcatgtcagccgaaaacggcctcgaaaagagtggttttagtcaacaccaaaacaagtcaccgcccaaagtcaaggctgaagacgggatgcagtgcctccagctgaaggagaccctcgctacacaagagccgactgacaaccaggttcgcctgcggaagaggaaagaaatcagggaagaccgggacagggctaggcttgatagcatggttctcctgatcatgaagttagatcagttagatcaagacattgaaaacgctctgtctacgagtagctctccaagtggcacgccaacaaatttacggcggcatgtgcccgatctggagagcggttctgagagtggagctgacacaatctccgtcaaccaaacacgcgtcaacctgtcgtctgacaccgagtctacagatctcccttcctctacaccagtggctaacagtggaacaaaacccaagactactgccatccagggaatcagcgaaaaagaaaaagccgcggtgaagtcggtcaagctcgaggttgatgaagacaaatccactaagggctccaatttctcaaattcagaagtggcaatcgggctgtcaccgtacaccttcccgcaaaaacggctgttccatgtggcaggcgaggagaacatcacctag

SEQ ID NO: 41781 - DNA, 3276 bp, Artificial Sequence
  Description of Artificial Sequence: Synthetic coding sequence
atgtgccggaagaagcccgacaccatgatcctgacccagatcgaggctaaggaagcatgcgactggctgagggctacgggatttcctcagtatgcccagctttacgaggactttttattccctatcgacatcagtcttgtcaaaagggagcacgacttccttgatagggatgccatcgaagctctctgccgtaggctgaacaccctcaacaaatgcgccgtgatgaaactagagatttccccacaccggaagagatccgatgactccgacgaggatgaaccatgcgcaatttctgggaaatggactttccaacgcgacagtaaacgctggtcccggcttgaagaattcgatgtgttctctccaaagcaggatctggtccctggatcacccgacgatagtcaccctaaagacggtccctcacccggcggcactttaatggatctgtcagaacgtcaagaggtgagcagcgttcggagcctgtcatctactggcagcctgccgagtcacgcccccccctcagaggacgcagctacccctcgcaccaactcggttatcagcgtgtgttcgtctagcaacctggcaggaaatgacgacagcttcggatcattgccatcccccaaagaactgtcctccttctccttcagcatgaaggggcacgagaagacagcaaagagcaaaaccaggtcactgctgaagagaatggagtccctcaagctcaaatcctcccatcacagcaaacataaagctccgtccaaattggggttgattatctcaggtcctatcctgcaggaggggatggatgaggaaaaacttaaacagttgaattgcgtggagatcagcgctctgaacggcaaccgaatcaatgtgcccatggtccgcaagagaagcgtcagtaattctacgcagacttcctcttccagtagccagtcggaaacatccagcgccgtcagtacccctagtcccgtgacacggacaaggagcttaagtgcttgtaataaacgggtcggaatgtatcttgagggctttgatcccttcaatcagtccacttttaacaacgtagttgagcagaattttaagaatcgcgagtcataccctgaagacaccgtgttttatattcccgaggaccataaaccagggacgttccctaaggctctcaccaacggctctttttcgccgtctggcaacaacgggtcagttaattggcgaaccggcagcttccacggacctggacacatttcattaaggcgtgagaattcaagcgattctcccaaagaactgaaacggcggaattctagtagctctatgtctagtaggctgtctatctatgataacgttccaggaagtattctgtatagctcttcaggggatctggcagatctcgaaaacgaggacatattccctgagctggatgatatactgtaccatgttaagggcatgcagcggatagtcaatcagtggagcgaaaagttttcagatgaaggggacagcgattcagccctcgattcagtttctccttgccccagtagtccaaagcagattcatctggatgtggataatgatagaaccaccccttctgacctggactcgacgggcaattctctgaacgagcccgaggagccctcggagatcccagagagaagagatagtggagtaggagcctctctgactaggagtaacaggcacaggctgcgctggcattccttccagtctagccataggccgagcttaaattccgttagcctccagatcaactgtcagtctgtggcacagatgaacctgcttcagaaatattcactgctgaagctgacagcacttctggagaaatacactcctagcaacaaacacggatttagctgggcagtgcccaagttcatgaagcgcatcaaagtgcccgattataaagataggtctgtgttcggcgtacctttgaccgtcaatgtgcagagaacaggccagcccttgcctcagtccatacagcaagcaatgcgttacctccgcaaccactgtctagatcaggtgggtctcttcaggaagtccggagtcaagtctcgcatccaggctctcaggcaaatgaacgaaggagccattgactgcgtcaattatgagggccagtcagcctatgatgtcgccgatatgctgaaacagtatttccgagatctgcctgagcctcttatgactaacaaactgagcgagactttcctgcagatttaccaatatgtgcctaaagaccaaagacttcaagccataaaggcagcaattatgctcctgcctgacgagaatagagaggtgctgcaaacactgctgtatttcctctctgacgtcacggccgctgttaaggaaaatcagatgacccccacaaatctggccgtttgtctcgccccatcactgtttcacctgaataccttaaagcgagagaactcctcacctcgtgtgatgcagcgtaagcagagcctcggaaagcccgaccagaaagacctaaacgaaaacttagctgctacccagggccttgcccatatgatcgcagaatgcaagaaactgttccaggtgcctgaggaaatgtcacgttgccgcaacagctacacagaacaggagctgaaaccactaactctggaggctcttgggcacctggggaatgacgattccgccgactaccagcacttcctccaggactgtgttgatggtctgtttaaggaggtcaaggaaaaatttaaagggtgggtgtcctatagcacgagcgaacaggccgagctatcatataaaaaggtgtctgaaggcccccccctgaggttgtggcgctcagtcatagaagttcctgctgtgcctgaggagatactgaagagactcttgaaggaacagcatctgtgggatgtggaccttcttgactccaaggtgatcgaaatcctcgactctcagaccgagatctatcagtatgtgcagaacagcatggccccccaccccgcgcgcgactatgttgtgcttcggacgtggcgcactaacctgccaaaaggggcatgtgcactcctgctgacatcagtggatcacgatagggcacccgtcgtgggcgttcgtgtgaacgtgctgctgagtcgatacctcattgagccatgcggccctgggaaaagtaagcttacctacatgtgcagagtcgatttacgcgggcacatgcctgagtggtacaccaaaagtttcggacatctatgtgctgcagaagttgtcaaaatcagagatagcttttcaaaccagaacactgaaacgaaggacacaaaatcgcggtag

SEQ ID NO: 41782 - DNA, 972 bp, Artificial Sequence
  Description of Artificial Sequence: Synthetic coding sequence
atgggcagccgggtgagccgggaggacttcgagtgggtgtacaccgaccagccccacgccgatcgcaggcgggagatcctggcaaaataccctgagataaaatctctcatgaaaccggaccctaacctgatctggattattatcatgatggtgctcacacaacttggtgccttctacattgtcaaggacctggactggaaatgggtgatctttggcgcatatgcctttggttcttgtatcaatcactctatgacgctcgcgatacatgagattgcccacaatgccgcgttcggaaattgtaaagccatgtggaaccgctggtttggcatgttcgctaacctgcccatcggcatcccatacagtatatccttcaaacgataccatatggaccaccatcgatacctcggcgctgacggagtggacgttgatatacccacagacttcgagggctggttcttttgtaccgcattcagaaaatttatttgggttattcttcagcctctgttctacgcatttaggcccttgttcatcaatcccaaacctattacgtatttggaagtgattaatactgtagctcaagtgacatttgatattttgatttattacttcttaggaatcaagtctttagtgtatatgttggccgcatctctgctcggccttggcctgcatcccatatcgggtcatttcatcgctgagcactacatgtttttgaaagggcacgaaacctatagttattacggacctctgaacctgttgacattcaacgtgggataccataacgaacaccacgattttcctaatatccccggcaagtcattgccactggtgcgaaagatcgctgctgagtactacgacaatcttcctcattacaacagctggattaaagtgctctacgatttcgtgatggatgatacgatcagcccctacagcaggatgaagaggcaccaaaaaggcgagatggtgctggagtag

SEQ ID NO: 41783 - DNA, 972 bp, Artificial Sequence
  Description of Artificial Sequence: Synthetic coding sequence
atgggcagccgggtgagccgggaggacttcgagtgggtgtacaccgatcaacctcatgctgaccgccggagggaaattctggccaagtaccctgagattaaatcactgatgaaaccggatccaaaccttatatggatcatcatcatgatggtgttgacccagctgggggccttctacatcgtgaaggacttagactggaaatgggtgatatttggcgcttacgcctttgggtcttgcatcaatcactccatgactctagcgatccatgagatcgcacataacgccgccttcgggaactgcaaggctatgtggaaccgttggttcggtatgtttgcaaacctgcccattgggataccgtattccataagttttaagaggtaccacatggaccatcatcgatacttgggggccgacggcgtggacgttgatattccgaccgattttgagggatggtttttctgtacagcctttcgaaaatttatctgggttatcctgcagcccttgttttatgctttccggcctctgtttatcaatccgaagcccattacttacctcgaagtgataaacaccgtggcgcaagttacgttcgatattctcatttactattttttgggtattaaaagcctcgtctatatgctggccgcctccttgctgggtcttgggctgcatcctatttccggacactttatcgcggaacactatatgtttctgaagggacacgaaacgtatagctattacggacccctgaacctgttgacattcaatgtggggtaccataatgagcaccacgactttccaaatataccaggcaagagcctgccccttgttcgcaaaatcgcagctgagtattacgacaatctgcctcattacaatagctggatcaaagtgctgtacgacttcgtcatggacgatactataagcccatacagtagaatgaaaagacatcagaagggggagatggtgcttgagtag

SEQ ID NO: 41784 - DNA, 786 bp, Artificial Sequence
  Description of Artificial Sequence: Synthetic coding sequence
atggtgagcccccagctggccaagtaccccgagatcaagagcctgatgaaacccgaccccaatctgatctggattatcatcatgatggtgctcacccagctaggcgccttttatatcgtgaaagacctggattggaagtgggtgatattcggtgcatacgctttcggctcctgtattaaccatagcatgactctagccatacacgaaatcgcccacaatgcggcattcgggaattgtaaggccatgtggaacagatggttcggaatgtttgccaacctcccgattggtattccctactccattagttttaagagatatcacatggatcaccatcggtacctgggggcagatggagtagacgtcgatatccctacagatttcgagggttggttcttctgtacagccttcaggaagtttatctgggtcatactccagcccctcttctatgcctttcgacctctatttattaatcctaagccgatcacatatctcgaggtgatcaataccgtggcccaggtgacgttcgacatcttgatctattattttttaggaatcaaatccctggtgtacatgcttgcagcgagtctacttggcctagggctacacccaatatcagggcactttattgcagaacactacatgtttctgaagggccacgaaacctattcttattatggtccacttaacttgctcactttcaacgttggatatcataatgagcaccacgattttccaaacatcccaggtaagtccctccctttggtgcgtaaaattgccgcggaatag

SEQ ID NO: 41785 - DNA, 1152 bp, Artificial Sequence
  Description of Artificial Sequence: Synthetic coding sequence
atgcccagcggctgccggtgcctgcacctggtgtgcctgctgtgcatcctgggggctcctgggcaaccagtgcgcgccgatgattgctcatcacactgtgatctggctcacgggtgttgcgcccccgacgggtcttgccgatgcgatcccggctgggagggactgcactgcgagcgctgcgttaggatgcccgggtgccaacatggaacatgccatcagccttggcagtgtatatgtcattcagggtgggctgggaagttttgtgataaggatgaacacatatgcacgacacagagcccctgccagaatggcggccagtgcatgtatgatggcggtggcgagtatcattgcgtctgcctgccagggttccatggacgtgattgcgagagaaaagctggaccatgtgaacaggcaggcagtccctgccgcaacggaggccagtgtcaagatgaccaaggctttgcccttaactttacctgccgatgtctagtgggatttgtgggagcgaggtgcgaggtcaacgtggatgactgtcttatgcgtccctgtgctaacggcgcaacatgtctcgacggaattaacagattctcctgcctttgccccgagggttttgccggcaggttttgtaccatcaacctcgacgactgtgctagcaggccatgccaaaggggtgctcggtgccgcgatcgggtccacgactttgactgtctgtgccctagcgggtacggagggaaaacatgcgagcttgttctgcccgtccccgaccccccgacaaccgtggacacaccactcggccccacctctgcggtagttgtgcctgcgaccgggcccgcaccacacagcgccggagctgggctgctgcggatctccgttaaggaagtggtgagacggcaggaggctgggctcggtgaaccaagccttgtcgccctggtggttttcggagccctaacagctgctctcgttcttgctacagttctactgactctacgcgcctggaggcgcggcgtgtgtccccccggaccatgttgctacccggccccgcactatgcccctgcttgtcaggatcaagagtgccaggtcagcatgctgcctgccgggcttcctcttccaagggatctccccccggaacctggcaaaactactgcactatag

SEQ ID NO: 41786 - DNA, 1134 bp, Artificial Sequence
  Description of Artificial Sequence: Synthetic coding sequence
atgcccagcggctgccggtgcctgcacctggtgtgcctgctgtgcattctcggagcaccaggacagcctgtcagagcagatgattgcagcagtcattgtgatcttgcccacgggtgctgcgccccggacgggtcctgcagatgcgatccaggctgggagggtcttcactgtgagagatgtgtcaggatgcctggttgtcagcatggcacttgtcatcagccctggcagtgcatctgtcactctggatgggccgatgaacacatttgcaccactcagagcccctgccaaaacggcggacagtgcatgtatgacggaggcggagagtaccactgcgtgtgcctgccggggttccacggtcgcgactgcgaacgcaaggccggtccctgcgaacaggctggctctccctgtcgcaatggtggtcagtgtcaggacgaccaaggcttcgctctcaacttcacatgtcgctgcctcgtcggcttcgtgggcgcccgctgcgaagtcaacgtggatgactgtcttatgcggccgtgtgcaaacggggccacttgcctcgatggtattaacagattttcctgtctttgtccggagggctttgccggaagattctgcactataaatctcgacgattgtgccagccgcccctgtcagcggggtgcccgctgtcgagaccgggtccatgacttcgactgtctgtgtcctagcggctatggagggaagacatgtgaactggtgctgccggtccccgatccgcccaccacagtcgatactccacttggtccgacctcagccgtcgtcgtgcccgcaaccggccccgccccccacagcgctggcgccgggttacttagaatttcagtcaaagaagtcgttcgcagacaggaggctggactgggtgagccttctttagtggctctagtggtgtttggagcactgactgcagccttggttttggccaccgtcttgcttactttacgggcctggcgccgcggcgtgtgcccccccggcccttgctgctacccggccccgcactatgcgccggcctgccaagaccaggagtgtcaggtcagtatgttacccgccggcctgccgctccctcgggacctgccgccagaacctgggaagactaccgccttgtag

SEQ ID NO: 41787 - DNA, 1152 bp, Artificial Sequence
  Description of Artificial Sequence: Synthetic coding sequence
atgcccagcggctgccggtgcctgcacctggtgtgcctgctgtgcatactcggagctcctggtcagccagtacgggccgacgactgttcatctcattgcgaccttgcccacggatgctgtgcccccgatggtagttgccgctgcgatcccggatgggagggactccattgtgagcggtgcgtgaggatgcccggatgtcagcatggtacttgccatcagccctggcaatgtatctgccatagcggatgggccgggaagttttgcgataaggacgagcacatctgcactactcagtcaccgtgtcagaatggaggccagtgcatgtacgatgggggaggagaatatcactgcgtctgtcttcccgggtttcacggtagggattgcgagagaaaagcagggccctgcgagcaggcagggagtccttgtagaaacggtggccagtgccaagacgaccaaggtttcgcccttaactttacatgccggtgtctcgttgggtttgtcggcgcccggtgtgaggtcaatgtcgacgactgccttatgcgcccttgcgccaatggggctacctgtctggatggtattaatcgcttttcctgtctgtgcccagaaggattcgccgggcgattttgcaccatcaacctcgatgactgtgcctctcgcccatgccagaggggagctcggtgcagggatcgagtacacgactttgattgcctgtgcccttccgggtatggcggcaagacctgcgagctggtgctgcctgttcctgacccccctacaactgtcgacacaccgctgggtcccactagcgccgtggtagtgcccgctaccgggccagccccacattccgccggagcaggactgctccggatcagtgtgaaggaagtagttcggaggcaagaggccgggcttggggagcccagcttagtggcgctggtggtcttcggggcactgacagcagctctcgtcctggcaacggttctgttaactctcagagcatggagaaggggggtgtgtccaccaggcccttgttgctatcccgcgccacactacgcccctgcttgtcaagaccaggagtgtcaggtctccatgctgcctgccgggttgcctcttcctagggacttaccgccagagccaggtaagaccactgctctctag

SEQ ID NO: 41788 - DNA, 405 bp, Artificial Sequence
  Description of Artificial Sequence: Synthetic coding sequence
atgcccagcggctgccggtgcctgcacctggtgtgcctgctgtgcattcttggtgcccctgggcaacccgttagagctgatgattgttcctcacattgcgacttggcccacgggtgctgtgcccctgatggctcttgcagatgtgatcccggctgggaaggcctgcactgtgaaagatgcgtgaggatgcctggctgtcagcacggaacatgtcaccagccgtggcagtgcatatgtcacagcggatgggccggaaaattctgcgataaggatgagcacatttgcaccacacaatctccatgccagaacggtggccagtgtatgtacgacggcggcggagaataccactgtgtttgcctcccaggatttcatggacgggactgtgagagaaaagccggaccgtag

SEQ ID NO: 41789 - DNA, 1134 bp, Artificial Sequence
  Description of Artificial Sequence: Synthetic coding sequence
atgcccagcggctgccggtgcctgcacctggtgtgcctgctgtgcatcttaggagcccccggccagcctgtgcgggctgacgattgtagctcacattgtgaccttgcgcacggctgttgcgccccagacggttcttgtaggtgtgatcctggctgggagggccttcactgcgagagatgtgtgagaatgccaggatgtcaacacggaacatgccaccagccgtggcagtgtatttgccattccggctgggccgatgagcatatttgcaccactcagtcgccctgtcagaatggaggacagtgcatgtacgatggtgggggagagtaccactgtgtgtgcttgccagggttccatggccgggactgcgaacggaaagccggcccttgcgagcaggctggttctccatgccggaacggtgggcagtgtcaggatgatcagggatttgctctcaattttacgtgcaggtgcctagtgggcttcgtcggcgcccgatgtgaagtcaatgtcgatgattgtctaatgagaccctgcgcgaacggcgccacgtgcttagatggaatcaacaggtttagctgtctctgccctgagggtttcgctggccgcttttgcacaatcaacctcgatgattgtgctagccggccctgccagcggggagcgcggtgcagagacagagtgcatgatttcgattgcctatgtccatcggggtacggaggaaaaacctgtgagctggtgctgccagtccctgatccacctaccaccgttgacaccccccttgggcctacgtccgctgtggttgttcccgccactggaccagctccacatagcgcaggagcaggcttgctgagaatatcagtcaaagaggtggtccgccggcaggaggccggcctcggcgagcccagcctagtagctttggtcgtgttcggcgccctgaccgcagctctagtcctggccaccgttctgctaacgctgcgcgcttggcgaagaggagtgtgtccacctggaccatgctgttaccccgctccacactatgcgccagcctgccaggatcaggagtgtcaggtctccatgctgccagcggggctcccattacctagggacctcccgccggagcccgggaaaaccactgcactctag

SEQ ID NO: 41790 - DNA, 870 bp, Artificial Sequence
  Description of Artificial Sequence: Synthetic coding sequence
tgaggctgccagcacggcacctgccaccagccctggcagtgcatctgccattccggttgggctggcaaattctgcgataaagggttccacggtcgggattgcgagcgaaaagctggcccatgcgaacaggccggcagtccttgtagaaatggcggacagtgtcaggatgaccaaggctttgcactgaatttcacctgccggtgcctggtaggatttgtgggcgccagatgcgaggtgaatgttgatgattgcctcatgcgcccttgtgccaatggagcgacctgcctcgacggcatcaatcgcttttcatgcctgtgtccggaaggctttgccggccgcttttgtaccattaacctcgatgattgtgcgtcccgcccttgtcagcggggagctcggtgcagagaccgggtccacgatttcgattgcctgtgtccgagtgggtacggaggcaaaacgtgtgagctcgttttgcccgtgccagacccgcccaccactgtcgacacaccgttgggacctacatctgctgtcgtggtcccagccacaggccctgctccccattcagcaggcgccggattgttgagaatttccgttaaagaagtggtgcgccgccaagaggccggactgggagagccctctctcgtggcactcgtagttttcggggccttgacagcagcactcgtgctggccacagtactcctgacactccgggcatggaggagaggtgtctgcccacccggaccctgttgttacccagctccccattacgcacctgcttgccaggaccaggaatgtcaggttagtatgctgccagcagggttgcccctgcctcgcgacttgcccccagaacccggtaaaaccaccgccctatag

SEQ ID NO: 41791 - DNA, 3441 bp, Artificial Sequence
  Description of Artificial Sequence: Synthetic coding sequence
atgcggaagaccgacgtggaccccctggacgaggtgtgctaccgggtcgtgatgcagctgtgcggcctctggggccaccctgttctggccgttcgggtcctcttcgaaatgaagaccgctcgtataaaacccaatgctataacttacggttattacaacaaagtcgtgttggagagtccttggccaagtagtacccgcagcgggatattcctgtggaccaaagtgcgcaatgtggttcgaggtcttgcccagttcagacagcctctgaagaaaaccgtacaacggagccaagtcagttctatcagtgccctgcagaacgtcactggcggatctgatggtgacacggtaagtcatggaagcgttgactctagcaatgatgccaacaatggtgaacacaccgtgtttgtgagggatctcattcggctggaatcaatcgataatcacagcagcaccggagggcagagcgatcagggttacggttcaaaggacgagctgattaaagatgatgctgagattcacgtcccagaggaacaggccgccagagagctgataactaagacaaaaatgcagactgaagaagtttgcgacgcctcggccatcgtggctaagcattcccagccgtcacctgaaccccacagccctacagaacctcctgcttggggttcaagtattgtaaaagtgccctcggggatttttgacgttaatagccgcaaaagctccatttctaatgtgttgttcagtacccaggaccccgtagaggacgccgtgtttggagaagccaccaatttgaagaaaaatggcgatcgaggcgagaagcgccaaaaacatttcccagagcgcagttgctccttcagtagcgaatcgagagctggtatgctcctcaagaaaagtagcttggactcaaattcgagcgagatggctattatgatgggagctgatgccaaaattttgacggccgccctcacctgccccaagacatccctgctgcatatcgcacgcacacactccttcgagaacgtctcatgtcatctgcccgatagtcggacatgtatgtccgaatcgacgtggaatcccgagcataggtccagcccggtgccagagatgctggaggaatctcaggagttgcttgaaccagtggtggacgacgtccccaagacaacagcaaccgttgatacttacgaatctctcctgtctgattccaactccaaccagtctagagatctgaagaccgtgtctaaggacctgagaaacaaaaggtcttcgttatacgggattgctaaggtggttcagagggaagatgtggagacaggactggaccctctgagcctgctggcgaccgagtgtactgggggcaagacaccggacagcgaagataaactttttagtcccgttatcgcacgcaacctcgccgacgagatagagtcctacatgaacctgaaatctccactaggtagtaaatcttcaagcatggaactgcacagggaagagaaccgggaatccggtatgaccacggctttcattcacgcactcgagagacgtagtagtctacctctggaccatggctcccctgcccaggaaaaccccgagtccgaaaagagttcccccgctgtctcacgtagcaagacatttaccgggcgttttaagcagcagaccccttcgcgcacccataaagaacggagcacgagcttgtctgctctcgtgcgcagttcccctcacggcagcctcggaagcgttgtgaactccctgagcgggcttaaacttgacaatatactcagtggccctaagattgacgttctgaagtccggaatgaaacaggctgccactgtcgcctcaaagatgtgggtagctgtagccagtgcttatagctacagcgacgatgaggaggagaccaatagagattactcttttcctgctgggctggaagaccacattttgggagagaacatctcccccaatacgagtatcagcggactggtgccctcagagttgacccagagcaataccagccttgggagcagcagctcctcaggcgacgtcggaaagcttcactatcccactggagaagttccctttcctcggggtatgaagggacaggatttcgagaagtcagaccacggatcatcgcagaacacatcgatgtcttccatctatcagaactgcgccatggaagtcctgatgtccagctgcagtcaatgcagagcatgtggcgccctggtctatgatgaggaaatcatggctggttggacagcagatgattctaacctgaacacagcctgccctttttgtaagagcaatttcctaccgttactgaacatcgaatttaaagacctcagaggaagcgcatcctttttcctcaaacctagcaccagcggggactcactgcagtcaggcagtatccccctcgccaacgagagcctggagcacaaacctgtcagctccctagcggagcctgatctcatcaactttatggacttcccaaagcacaatcaaattattacagaggagacgggttctgcggtggaaccatccgacgaaatcaaacgggcatccggagatgtccaaaccatgaagatctcatcagtgcccaactcactgtcgaaaagaaacgtgagcctcacccgtagccacagtgtgggagggcctctccagaatattgattttacacagagacccttccacggtatatctaccgtgtcccttcccaacagcttacaggaagtcgttgatccccttggcaaacgacctaatcctccacccgtgtcagtgccgtatctgtcacccctggtgctccgaaaggagctggaatcactcctcgagaatgaaggcgatcaggtgatccatacatcttcttttattaatcagcacccaattattttttggaatctcgtgtggtatttccgacgcttagacctgcccagcaatctgccaggattaatcctgacaagcgagcattgtaacgagggtgtgcagctgcctttatcatccctctcccaggattccaagctcgtgtatatccagctattgtgggataatatcaaccttcaccaggagcctagggagcctctatatgtgagctggcgcaatttcaattcagagaaaaaatcctccctgctctccgaggaacaacaggagacatccacacttgtcgaaaccattaggcagtctatccagcacaataatgtgctaaaacctatcaatctgttgagccagcagatgaaacctgggatgaagaggcagcgcagcctatacagggaaattttattcctgtctctggtaagtctcggcagggagaatatagacattgaagctttcgataatgagtacggtattgcatataattctttatccagtgagattctggaacgcctgcagaaaatagatgctcccccatccgcttcagttgaatggtgtcgaaaatgttttggagctcctttgatttag

SEQ ID NO: 41792 - DNA, 2013 bp, Artificial Sequence
  Description of Artificial Sequence: Synthetic coding sequence
atgaacctgaagagccccctgggcagcaagagcagcagcatggagctgcatagggaggagaaccgggagagcggaatgaccaccgccttcattcacgcacttgaaaggcggagttccctgccactggaccacggatctccagcccaagaaaacccagaatcggagaaatcttctcccgccgtaagtagatctaagactttcaccggaaggttcaagcagcagacaccctcgcgcacccacaaagagaggtcaacatcattgagtgcgttggttcggagctcccctcacggctctctgggctcagtggtgaattcactctcagggctgaagctggataatatcctttccggtccgaaaattgatgtgctgaaaagcgggatgaaacaggcagccacggttgcgagcaagatgtgggtggctgtggcctccgcctactcatatagcgatgatgaggaagaaactaatagggactactccttccctgccgggctggaagaccatattctgggcgaaaacatctcgccaaatacctctatctcaggattggtgccttccgagctgactcagtccaatacatctcttggaagctcatccagcagtggggatgtcggtaagctccactacccaacaggggaagtgcctttcccgcgggggatgaaaggccaggactttgagaagtctgaccacggctccagtcaaaataccagcatgtcctccatttaccagaattgcgcaatggaagttctgatgtctagctgctctcagtgtagagcttgcggggccctggtgtatgacgaggagattatggccgggtggactgcagacgattctaacctgaacacagcttgtccattttgtaagtctaactttctgcccctcctcaacatcgaattcaaagatcttcgcggctcggcttctttctttcttaagccatcgacatcaggcgattccctgcagtcaggctccatccctcttgcgaatgagtctttagaacacaagcctgtgagcagcctagctgaaccagacttgattaacttcatggacttccccaagcacaaccagatcatcaccgaggagaccgggtctgcagtggaaccctcggacgaaatcaagagagcctcgggcgacgttcagactatgaaaatctcatccgttcctaacagcctgtctaaaaggaacgtgtcactcactcgctctcattccgttggaggccctctgcagaatatcgacttcacacaaaggcccttccatggaatcagtaccgtttctctcccaaattcgcttcaggaagttgttgacccacttgggaaaaggcccaacccccctccagtgagcgtgccgtatttgagtcccctggtgctgcggaaagagttggagagcctgctagaaaatgagggcgatcaggtcatccacacctccagtttcatcaatcagcacccaatcatattctggaatttggtttggtacttcaggcgcctagatcttcctagtaacctacccggccttattctaacatcggaacattgtaatgagggcgtgcagctccccttaagctccctgtcacaagacagtaagctggtttatatccagctgttatgggataatattaacctccaccaggagccaagggagcctctgtacgtctcttggcggaattttaatagcgaaaaaaagtcctcccttctgtcagaagagcagcaagaaacttctaccctggttgaaactattcgtcagagcatccagcacaacaatgtgcttaagccgattaatctcctgagtcagcagatgaagcccggaatgaagagacagcgttctctataccgagagattttgtttctcagcctggtttctttgggcagagagaacatagacattgaagcctttgacaacgaatatggcatcgcctacaacagtctttcatcagagatcctcgagcgcctgcagaaaatcgacgcaccccccagcgcctccgtcgaatggtgcaggaagtgctttggcgcccccttaatctag

SEQ ID NO: 41793 - DNA, 777 bp, Artificial Sequence
  Description of Artificial Sequence: Synthetic coding sequence
atgaagcaggccgccaccgtggccagcaagatgtgggtggccgtggcttccgcttattcatattccgacgacgaagaagaaactaaccgggactattctttcccggccggattggaggatcacatcctcggagagaatatttctccaaataccagcattagtgggctggttccctccgaacttacccagtccaatacttccctcggtagttccagttcttcaggagacgtggggaagctccactatccaacaggggaagtgccatttcctcgtgggatgaaaggccaggactttgaaaagtccgaccacggcagcagccaaaataccagtatgagctctatctaccagaactgtgctatggaggtcctaatgagctcctgctctcagtgccgcgcctgtggcgccctggtctacgatgaggagatcatggccggatggacagctgatgatagtaacctcaacacagcctgccccttctgcaaaagcaactttctgccactgctgaatatcgagttcaaggatcttagaggcagcgcctcatttttcctcaaaccctccacgagtggggattcgctccagtcagggtcaataccattggctaatgagtccttggagcacaagccagtgagtagcttagccgagcccgacttgatcaacttcatggactttccaaaacacaaccagatcatcaccgaggagaccggcagcgctgtcgaaccccgctaccagcgcgtgcagaggccgctttatgtggtcattaacggagtacctttatag

SEQ ID NO: 41794 - DNA, 2376 bp, Artificial Sequence
  Description of Artificial Sequence: Synthetic coding sequence
atgctgctgaagaagagcagcctggacagcaacagcagcgagatggctattatgatgggcgctgacgcaaagattttgactgccgccttgacttgcccaaagacttcgctcttgcacattgcacgcacacacagcttcgagaacgtgagttgccacctgcccgactctcgcacatgtatgtccgaatctacttggaaccctgagcatcgctctagtccagtgcctgaaatgttggaagagtcacaggagctactagagcctgtagttgacgacgtgccaaaaacgactgctactgtggacacctatgagagtctcctgagcgactcaaattccaatcagagccgcgatctgaagaccgtgtccaaggatctgcggaataaacgatcttccttatacgggatcgccaaagtggtacaaagagaggatgtggaaactggcttggatccattaagcctactggccactgaatgtactggcggtaagacgcccgatagtgaggacaaactgttcagccccgtcattgcccggaatctcgctgacgagatagaatcctacatgaatcttaagagccccctgggctctaaatcgagtagtatggagctgcatcgcgaagaaaatcgggaatctggcatgaccaccgccttcatccacgcactagagcgtcggtcctcactgccactggaccacggcagtcctgctcaagaaaacccagaaagcgagaagtcctccccggccgtgtccaggtctaagactttcactgggagattcaagcagcagactccctcccgaactcacaaggaacgttcgacttcattgagcgccttggtgcggtccagtccgcatgggagcctgggtagtgttgtgaactcgctgagtgggttaaagctggataatattctgagcgggcctaagatagatgtccttaagagtggcatgaaacaagccgctacggtcgctagcaagatgtgggttgcagtggcctctgcctactcctactccgacgatgaggaggaaactaatcgggactacagtttcccggcagggctggaagatcacattcttggagaaaatatctcccccaatacaagcatcagtggactagtgccatctgagctgacacaatctaatacctctctggggagcagctcatctagcggcgacgtaggcaaactgcactaccccaccggcgaggtgccgtttcctcgaggcatgaagggacaagacttcgaaaagtcagaccacggcagctcccagaatacctccatgtctagtatttaccaaaactgcgccatggaggttctcatgtcttcctgcagtcaatgcagggcttgtggagctcttgtgtatgatgaagagatcatggcaggctggaccgcagatgatagcaatttaaacacagcatgtcccttttgcaagagcaatttccttcctctgctcaatatcgagttcaaggatttgcggggaagtgccagtttttttctaaagccttcgactagcggagacagcttacagtcaggatcgatcccccttgccaacgaatcattggagcacaaaccagtcagcagtcttgccgagcccgatttgattaactttatggatttccccaaacataaccagatcatcactgaggagactgggtccgcagtggagcctagcgacgagattaaaagagccagcggtgacgttcagaccatgaaaatatcttctgtgccaaactccttatcaaaacgcaacgtgtctctcacccgatcccacagtgtggggggtccactgcagaatattgatttcacccagaggccctttcacggcatctccactgtctctttacccaattccctccaagaagtggtggaccctttaggaaagcgccctaatcccccacccgttagtgtcccatacctgtccccacttgtactcaggaaggaactggagagccttctcgagaatgagggcgatcaggtgatacatacgtcatccttcattaatcagcatcccattattttctggaatctggtctggtacttccgtcgcctggacttgcccagcaatctgcctggacttatattgacctctgagcattgcaacgaaggggtacagctgcccctgtcatcgctgtcccaggactccaaacttgtctacatccagctgctatgggacaatatcaatctgcatcaagagccccgggagcctctatatgtctcttggcgcaacttcaacagcgaaaaaaagtctagtctgctgagcgaggagcagcaggagacatctacccttgtggaaacaatccgccagtcgatccagcacaataacgtcttaaaaccaattaacctgttgtctcaacagatgaagcccggtatgaagcgccaacgaggaatctag

SEQ ID NO: 41795 - DNA, 3441 bp, Artificial Sequence
  Description of Artificial Sequence: Synthetic coding sequence
atgcggaagaccgacgtggaccccctggacgaggtgtgctaccgggtagtcatgcaactttgcgggctgtggggacacccagtcctcgcagtccgcgtgctctttgaaatgaaaactgctcgcatcaaacctaatgccatcacatacggttattacaacaaggttgtcttggagtccccttggcctagcagcacccgaagtggtattttcctctggacaaaagtgaggaatgtggtacgtgggctggctcagttcaggcaaccactgaagaagaccgtgcagcgctctcaggtatccagcatctccgctctgcagaacgtgacgggcgggagtgatggggataccgtgtctcatggaagcgtggacagtagtaacgacgcaaacaacggagagcacactgtgtttgtccgggacctcattcggctggaaagtattgataaccacagttctacaggaggccagtctgaccaagggtacggcagcaaagacgaactgatcaaggacgacgcagagatccatgtacctgaggagcaggcagcccgggagctcattaccaagacgaagatgcagacagaggaggtctgtgatgctagtgccattgttgccaagcattctcagccgagtcctgagccacattcgcccaccgagcctccagcctggggatcctcgattgtcaaggtgccctctggtatcttcgacgttaatagtcggaaatcttcaatatcaaacgtcttgttttcgacccaggaccccgttgaggacgccgtattcggcgaggccacaaatctgaaaaaaaatggagacaggggcgaaaagagacagaaacactttccagagcgctcttgctcattttccagcgagagccgggctggcatgctccttaagaaatccagcctggattccaatagctctgagatggccattatgatgggcgctgacgccaagatcctaacagctgcactaacctgcccaaaaacttctctgctacacattgctaggacccattccttcgagaatgtgtcttgtcatctgccagacagtcggacctgtatgagcgagtcaacttggaatcctgagcatcgctcatcccctgtaccggaaatgctggaggaatctcaggagctgttagagcctgtggtcgatgacgtgcccaaaaccaccgcaactgtcgacacatatgaatcactgctgtccgacagtaactctaatcagtcccgggatcttaagactgtctccaaagacctgaggaataagagaagctctttgtacgggatcgccaaagtggtacagcgggaagacgttgagacaggcctcgacccgctgagcctcttggctaccgagtgcacaggaggcaagacacctgacagtgaagataaacttttttctccagtgatcgcgcgtaatcttgccgacgagatagaatcatacatgaatctaaaaagccctctaggctccaagagtagctctatggagcttcatagggaagaaaatcgagagtctggtatgaccactgcttttatacacgcgctagagcgacgctccagtcttcccctggatcacgggagtcctgcccaggagaacccagagtcggagaaaagttccccagccgtgtctcgatcgaaaacgtttacggggagattcaagcagcaaactccatccaggacacataaggaacgatctacctctctgagtgctctggtacggagcagtccccacggcagcttgggatccgtagttaattctctgtccggtttgaaactagacaatattctcagcggacccaagattgacgtcttgaagagtggaatgaaacaggccgctaccgtggccagtaagatgtgggtcgccgtagctagtgcctactcttactcagacgacgaagaagagactaacagagattacagcttcccggcaggcctcgaggaccatatcctcggcgagaacatctcgcccaacaccagtatcagtgggttggttccatccgagttgacacaaagcaatacctctctaggcagctcttcatcaagcggcgatgtgggcaagttacattaccctacaggtgaagtcccatttcctcgcggaatgaaaggccaagatttcgagaaatccgatcacgggagctcccaaaatacttcaatgagctctatttaccaaaactgtgctatggaggttctgatgagctcttgtagccaatgtcgcgcatgtggagctttggtgtacgacgaggagattatggccggatggaccgccgacgactcaaacctcaatacagcctgcccgttctgtaagtctaattttttacctttgcttaacatagaattcaaagaccttcgaggctcagcctcattctttctcaagccctccacctctggcgatagcctgcagtcagggagcatcccactggctaatgaatccctcgagcataagccagtatcttcacttgccgagcccgatctgataaacttcatggattttccaaagcacaaccagattattacagaagaaaccggctccgctgtggagccgtccgacgaaattaaaagagcaagtggcgacgtacaaacgatgaaaatttcaagtgtgcctaattctctgagtaagcggaatgtgagccttaccagatctcacagcgttgggggtcctctacagaatattgacttcacacaacggcctttccacggaatctctaccgtcagcctaccaaactcattacaggaggtcgtggatccacttggcaaaaggcctaaccccccgccagtgtcagttccttatctgtcacctctggtgctgaggaaggagctggagtccctgctggagaacgagggagaccaggtcattcacacatccagctttatcaaccagcaccccattatattctggaacctcgtgtggtattttaggcgcctggacttgccctcgaaccttcctggtctcatcctaacttccgaacactgcaatgaaggagtgcagcttcctctgagctccctgtcacaggactctaagctggtgtacatccagctcctgtgggataatatcaatctccatcaggagccgcgcgaacccctgtatgtctcatggagaaacttcaactccgaaaagaagagctctcttttgtccgaggaacaacaggaaacgtctacattagtggaaaccattaggcagtcgatccaacacaacaacgtccttaaaccaatcaacctgctgtcccagcagatgaaacccggcatgaaacgccaacgatcattgtacagagagatcctctttctatccctggtgtctctgggcagagagaatatcgatatagaggccttcgacaacgagtatgggattgcctataattcgctctcatctgaaatcctggaaagactgcagaaaatcgacgcaccacccagtgcatcagtcgagtggtgccgtaagtgtttcggggccccactcatttag

SEQ ID NO: 41796 - DNA, 5022 bp, Artificial Sequence
  Description of Artificial Sequence: Synthetic coding sequence
atgggcgccaccatcgagtgctgggaccccgagaccaagtaccccctgccagtttttagtacctttgtactcacaggcagcagtgccaaaaaagtgtacggcgccgccattcaattttatgaaccatattctcgggagctcctctcagagaagcagctcatgcacttaggcttgctgactcccgtcgaaagaaaaatggtctccaagtcgatcaatacaaacaagtgcatttgtctgttgagtcactggcccttcttcgaagctttcagaaaatttctaatgtttatctacaaactgagcgtgtccggcccacacccattgcctatcgaaaagcacatttcacacttcatgcaaaacatcccattcccatcacctcaacggccacgcatcttggtacagttgtctgtgcatgatgctctcattctatctcagcctgtaagtacacccctgcctctgtcaggcgcgaatttctcgaccctgctcatgaacttagggcccgaaaactgtgccactttgctgctgtttgtgctgctggagagcaagatcctacttcattcactgcgccctgcagtgttaacaggggtagccgaggctgtggtggctatgatcttccctttccaatggcagtgcccctacatccccctgtgtcccctaagtctggctgctgtgctatccgctcccctacctttcattgttggcgtcgacagccgatatttcgatctccatgacccgccccaagatgtggtgtgcattgatctagacaccaatatgctgtacgtgagcgatgaaaaaaaaaacatgaattggaaacagctcccaaagaaaccctgcaagaatcttctgagtacactgaagaaactgtatccacaactgagctcggtgcaccagaaaacgcaggagggaagtgcaattgacatgactcccatcgaagccgatttttcatggcaaaagaagatgacccagctggagatggagatccaagaggcctttctgagatttatggcctcaatcctgaagggataccgtacctacctgcggcctatcactgaggctcctagcaacaaggctacagccgcagacagcctgttcgatcgccaaggctttctgaagtcccgtgaccgcgcatacgcgaagttctacacattgctgagcaagacccagatattcatcagattcattgaagagtgctccttcgtttccgataaagacactggcttggccttcttcgatgactgcattgaaaagctcttcccagataagggcacagagaagacggacaaggtcgacttcgattcagcggaagacacaagactgatcgagcttgatgattctcaaaaatcagagcacacggtgttcatcatgccaccggagccaccgccagacgatggaaaggatctctcccccaaatattcctataagtacttcccccgattagacctaaaactttttgatcgtcctcaagaactcaaactttgcttttcccgtcacccgacaggcaatagcatcactaaatcccctcctctcatggccaagagaactaagcaggagatcaagacggctcacaaactggcgaaacgctgttatacaaatcccccccaatgggccaagtgtctcttttcgcattgttactccctgtggtttatttgccttcccgcttacgtcagagtgtcccaccctaaggtccgtgccttgcagcaggcatacgacgtcttaattaagatgcgaaagacagatgtcgacccactagacgaagtctgctatcgggtcgtgatgcagttgtgcggcctatggggtcatcctgtgctcgccgtaagagttctgtttgagatgaaaactgctcggatcaagcccaatgccatcacctacggatattacaataaggtggtgttggaatccccctggccatcctcaacacgttccggcatatttctctggactaaagtgcgcaatgtggtccgtggtttggcacaattcagacagcccttaaagaagaccgtacagcgcagtcaggtttccagcatcagcggcggccagagcgatcaggggtatggctctaaggacgaactgattaaggatgacgcagaaatccacgttccagaggaacaagctgcccgcgaacttatcacaaagactaagatgcaaactgaagaggtttgcgacgcttccgctattgttgctaaacattcccagccaagcccggagcctcactccccaacagagcccccagcatggggctcctccatcgtgaaagttccctcaggaatattcgatgtgaactctaggaaatcttcaaccggctccatctccaatgtcctgttctccacccaagaccccgtcgaggatgctgtgtttggcgaggccacaaacttgaaaaagaacggcgaccgaggggagaagaggcaaaagcattttcccgaaagatcatgctccttctcctccgaatctcgggccggtatgctcctaaaaaagagctcacttgatagcaactcttctgaaatggccattatgatgggggcagatgctaaaattttaaccgcagccctgacatgccctaagacaagtctgctccatatcgcccgaacccactcttttgaaaacgttagctgccaccttcctgacagtagaacatgcatgtccgaaagcacatggaaccctgaacaccggtcgtcccctgtgccagagatgttagaagaaagccaggaacttctggaaccagtggtggatgatgttcctaaaaccaccgcaaccgtggatacctacgagagtctgctgagcgattcaaatagtaatcaatcccgggaccttaagacggtcagcaaggatttgcggaataaaaggagctctttgtatggaatcgccaaggtcgtgcagagggaagacgtggagactggcttagatcccctgtcactgctggccaccgagtgtacaggcggaaaaacacccgactcagaggataaactgttctctcctgtgatagcccgcaatctcgctgacgaaatcgaatcttacatgaatctgaagtcccctctgggttctaaaagttcaagtatggagctgcatagagaggagaacagggagtcaggcatgaccacagccttcatccacgcattagagagacgctcttccctccctctggaccatgggagccccgcccaggaaaatccagagtccgagaaatcatctcctgccgtgtcccgatcaaaaacgttcacgggacgtttcaaacaacaaacaccctctaggacccataaggagagatccaccagcctgagcgccctggtgagatcaagtccacatggatccctgggtagcgttgtcaactcgctgtctggcctgaaactcgacaatattctgtctggacctaaaatagacgtgctcaagtccggcatgaaacaagccgccactgtcgcctcaaagatgtgggtggccgtcgcttctgcgtacagctactctgatgatgaggaagagacaaatagggactatagttttcccgctggattagaagatcacattctgggagagaatatctcgcctaacacgtctatctctgggttggttccgtcagaactgactcaaagtaacacgagcctcggttcctcatcgagttccggagacgtgggcaaactgcactaccctactggcgaggtccctttcccacgcggaatgaaggggcaggatttcgaaaaatccgaccatggaagctctcagaatacttccatgagtagcatctatcagaattgtgcaatggaggtgctgatgtcctcatgcagtcagtgcagggcttgtggcgctttggtgtacgacgaagaaatcatggcagggtggactgctgacgattctaacctcaacactgcctgccccttctgtaagagcaatttcctgcctctgctgaacatcgagttcaaggacctccgaggctcagcaagctttttcttaaaaccatcaacctcaggcgatagccttcagagcggtagtatccctctggccaacgagtcactggaacataaacctgtttcgtctctggccgagcctgatctgatcaattttatggactttccaaagcataaccagatcatcaccgaagagacgggaagtgccgtggagccctctgacgagattaagcgcgcgagtggagatgttcagacaatgaagatctcttctgtaccgaacagcctgtcgaaacgaaacgtatcccttaccagatcccacagtgtcgggggaccccttcaaaatattgatttcacccagaggccttttcacggcatctcgactgtaagcctacccaattctctgcaggaggttgtcgatccacttgggaaacggcctaatccaccccccgtgagcgtgccatacctgtcaccgctggtacttagaaaagagctcgagagcctccttgaaaatgagggcgatcaggtaattcatacatccagtttcattaaccaacaccccataattttctggaacctggtctggtactttcgacgactggacctccccagtaatctgccaggtttaattctcacctcagagcattgtaacgagggcgtgcagctgcccctctcttcactgtcacaggactccaagcttgtgtatattcagttactgtgggacaatatcaatctccaccaggaaccgcgggaaccactctatgtcagttggcggaatttcaactccgagaagaagtcttctttgctgtctgaagaacagcaggagactagtacactggttgagacaatcagacaatccattcagcacaataacgtcctgaaaccaataaatcttctatctcagcaaatgaagccaggcatgaagcggcaacgaagcctttatcgggagatactgttcctctctctcgtgagcctaggccgagaaaacatcgacatcgaggcatttgataatgagtacggaatcgcttataactcgctttcttccgaaatactggaacggctgcagaagatagacgctcctccttcggcatctgtagaatggtgtagaaaatgcttcggcgctccgctgatctag

SEQ ID NO: 41797 - DNA, 2376 bp, Artificial Sequence
  Description of Artificial Sequence: Synthetic coding sequence
atgctgctgaagaagagcagcctggacagcaacagcagcgagatggctatcatgatgggagccgatgctaagatcctgaccgctgctctcacctgccctaaaacatctttgctccacatagctcgaacacacagcttcgaaaatgtcagctgccacctccccgattcccgaacctgtatgtctgaaagcacttggaaccccgaacatcgatcttccccagtgcccgaaatgttggaagagtcgcaagagcttttagagcccgttgtggacgacgtccctaaaaccaccgccactgttgacacctatgaatctcttttaagtgatagcaactccaaccagagcagggacttaaaaacagtgagcaaagatctgcggaataagcgcagttctctatacggtatcgcgaaagtcgtgcagagggaagatgtggagacgggactggatcccttgagtctgctggcgacagagtgcaccggtgggaaaacccctgatagtgaggacaagctgttctcgcccgtgatagcacgcaatttagctgacgagattgaaagttacatgaatttgaagagccctcttggttccaaatcctcatctatggaactccaccgcgaggagaaccgggagagcggtatgacaaccgcgttcatccacgccctcgaaaggagatcatcacttcccctggaccacggttccccggcacaggaaaacccggagtctgagaagtctagccccgcggtctcacggtctaagacatttactggcagatttaaacaacagaccccttctcggactcataaagaaaggtccacgtccttgagcgccctagtgcgcagttctcctcacggatctttgggctcggtggtcaattcgctgagcggactgaagcttgataacattttgagcgggccaaagatcgacgtccttaaatccggcatgaagcaggccgctactgttgcgtcaaaaatgtgggtggctgtggccagcgcatactcatattccgacgacgaagaagagacaaaccgggactattcttttcctgctggtcttgaagaccacattctcggggagaacatctccccaaacaccagtatttccggcctggtgccctcagaactgacgcagtcaaacacgagcctgggttcatctagcagcagcggagatgtgggtaagctgcactatccgacaggggaagtgccgtttccaagagggatgaagggacaggattttgaaaagagcgaccatggctccagccaaaacacctccatgtcttcgatataccagaactgcgctatggaagttctgatgagttcatgtagccagtgtagagcatgtggagctctcgtgtatgacgaagagatcatggcagggtggacagcagacgactccaatttgaataccgcttgccccttttgcaaatctaactttctcccccttctgaatattgagtttaaggatctgaggggctcggcctcttttttcctgaagccaagcacctccggagactctttacagtccggttctatccccctcgccaacgaaagcctggaacacaaaccagtcagctccctggcagagccggatctaattaactttatggactttcccaagcacaaccagattatcacggaggaaacaggttctgccgtggaaccatctgacgagattaaacgcgcaagtggggatgttcagaccatgaaaataagctcggtgccaaatagcttgtcaaagaggaacgtgtctttaacccggtctcatagcgtaggcggaccactgcaaaacatcgacttcacacaacgtccttttcacgggatcagcacagtgagtttacccaactcactgcaggaagtagtcgatccactgggcaaacgcccaaatccccccccggtgagtgtgccgtacctgtctccactggttctcaggaaggagttggaatctcttctggaaaatgagggggatcaggttattcacacaagctcctttatcaatcagcacccgatcatcttctggaatctcgtctggtacttccgtcggttggatctaccctccaacttgcccggactgatcttgacctcggagcattgcaacgagggcgtgcaactgccgttgtcttccctctcccaggatagcaagttagtttacattcagcttctatgggacaacattaatcttcaccaagaaccacgggagccactgtacgtgagttggcgcaactttaatagtgaaaagaagtctagcctgctgtctgaagagcagcaggagactagtaccctcgtggagactattcgacaatcaatacaacacaacaacgtgctgaaacctatcaatttactgtctcagcaaatgaaaccaggcatgaaacggcagagaaacatctag

SEQ ID NO: 41798 - DNA, 3012 bp, Artificial Sequence
  Description of Artificial Sequence: Synthetic coding sequence
atgctgaccaccagcggcggccagagcgaccagggctacggcagcaaagatgagctcatcaaagatgacgcagaaatacatgtgcccgaggagcaggccgcgcgagagctgattaccaagacgaaaatgcagaccgaagaggtctgcgatgcatcagccatcgtggccaagcacagccaaccctcccctgagcctcactctccgacagagccaccggcctggggatcctccatagtaaaggtcccttcgggcatctttgacgtgaattctagaaaatcttcaaccggatcaatttccaatgtcctcttcagtactcaggaccctgttgaggacgccgtattcggggaagccacgaacctcaagaaaaacggggacagaggggagaaacgacaaaagcatttccccgaacggagctgttctttcagcagcgaatcacgtgctggcatgctcctgaagaagtcctctttggactctaattcaagcgagatggcaatcatgatgggagcagatgctaaaatactaactgcagccctaacctgccccaagacctctctgctccacatcgcgcgcacccactcatttgaaaacgtctcatgtcatcttccggactccaggacatgtatgagcgagtctacatggaaccccgaacaccgcagcagccccgtgcctgaaatgctggaggagtcccaagagcttttggagcccgtggtggacgatgtgcctaagacaaccgctactgtggatacttatgagtcactactgtctgatagcaacagcaatcagtcgagagacctcaagactgtgagcaaagacctacgcaacaagcgaagctctctgtacggcatcgccaaggtcgttcaacgggaagacgtcgagacggggctggatcccctttccctgctggcgacagagtgcactggtggcaaaactcctgactcggaggacaagctcttttcacccgtaatcgctcggaacttggctgacgagatcgaatcatatatgaacctgaagtcccccctcggtagtaagtcctcctcaatggagctgcatcgggaagaaaatagggagtccggtatgacaaccgcattcatacacgctttggaacgacgatcatccctgcccctggatcatggcagcccggcccaggagaacccagaaagcgagaagtcctcgccagctgtgtctcgatctaaaacgttcaccggacgcttcaaacagcagacaccaagtagaactcacaaggaacggtctacctccttaagcgcattggtgcggtcaagcccccacggatccctcggtagcgtggtcaactctttatctggcttgaaactggataacatcctatccgggcccaaaattgacgtgctaaagtctggcatgaaacaggccgctacagtggcttctaaaatgtgggttgccgttgctagtgcctatagctactcagatgacgaagaagagacaaatcgggactatagttttcccgcagggctggaggatcatatactcggcgagaatatttcacccaacacgtctatcagtggattggtgcccagtgaattgacacagtcaaacaccagtctgggcagtagttcatccagcggtgacgtcgggaagcttcactaccccaccggggaagtgccatttccacgcggcatgaaggggcaggattttgaaaagagtgatcatggtagctcacagaatacctcaatgagttcaatctaccagaattgcgcgatggaagtgctgatgtcctcctgttcccaatgcagggcctgcggggcccttgtatatgacgaagaaattatggctggctggactgcagatgactcgaaccttaataccgcatgtcctttctgcaaaagcaatttccttccattactgaatattgagttcaaggatttgcgcggctccgcaagctttttccttaaaccctctacatcaggagactcactgcagtccggcagcatccctctcgctaacgaatcactggaacataagcccgtaagcagcttggctgagcctgacttgatcaatttcatggattttcctaaacataaccagatcatcaccgaggagacggggtctgccgttgagcccagtgatgaaatcaagcgcgcatcaggggacgtgcagacaatgaaaatctcttccgtgccaaactctttgagcaagcggaacgtgtcactgacaagatcacactctgtgggagggcctttacaaaatattgatttcacccaaagaccgtttcatggcatttccaccgttagccttcctaattccctgcaagaagtcgtggatcctttgggcaaacgaccaaatccgccacctgtaagcgtcccttatctgtctccactggtgctcaggaaggagctcgagagtttactggagaacgaaggtgaccaggtgattcatactagtagcttcataaaccagcaccccattatcttttggaacctcgtctggtatttccggcgcctggatctaccttccaatctccctggactcatactaacatctgagcactgtaatgaaggtgtgcaattgcctctgagcagcctctctcaggactctaaactggtctacatccaactcctatgggacaatattaacctccaccaagaacctagggagccgctttacgtgagctggcgtaacttcaactctgagaagaagagctcattactgtccgaggagcaacaagaaacgtccactctcgtggagactatcaggcaatcaatacaacacaacaatgtgcttaaaccaatcaacctgctctctcagcagatgaaacctgggatgaagcgccagcgaagcttatatagggagatactgttcctgtcattagtctctttaggtcgcgaaaatatcgatattgaggcttttgataacgagtatggcattgcatataatagcctcagttcagagatcttagagagactgcagaagatcgatgccccaccatccgccagtgtggaatggtgtcgtaaatgtttcggggccccacttatatag

SEQ ID NO: 41799 - DNA, 3864 bp, Artificial Sequence
  Description of Artificial Sequence: Synthetic coding sequence
atgagcggcggcggcggcggcggcggcagcgcccccagccggttcgcggactactttgtgatatgcggcctggacactgaaacaggactggagccagacgagctctccgctctgtgccagtatatacaggccagtaaagccagagacggggcatcacctttcatttcatccactaccgagggcgagaattttgagcagacaccactgcggagaaccttcaagagcaaggtactggcccgctaccctgaaaacgtggagtggaatccattcgaccaggacgccgtcggtatgctgtgtatgccaaaggggctcgcatttaagacccaggccgatccgagggagccacaatttcacgccttcataattactcgggaggacggcagccggactttcggttttgccctgactttctatgaggaggtcacctctaagcagatctgctccgcaatgcagacactgtatcacatgcataacgccgaatatgacgtcttgcatgcccctcccgctgacgaccgggaccaatctagcatggaagatggggaggatacgccagtgacaaaactgcaacggtttaactcctacgatatcagccgcgacacactctatgtgagtaagtgcatttgtctgatcacccctatgtcgttcatgaaggcttgccggtccgtgctagaacagctccaccaggccgtaacttccccacaacctccccctctccctctggaaagctacatttataatgtgctttacgaggttccactccccccccctggccggagtctgaagttctccggagtttatggccctataatatgccagcgccctagcaccaatgagctgcccctgttcgacttccccgtaaaagaggtgttcgaactgttaggggtggagaatgtctttcagctgttcacttgcgctctcctcgaattccagatcctgttgtactcacagcactaccaacggctaatgacagtggcagaaacaattaccgctctgatgttcccattccaatggcagcatgtatatgtccctatactgccggccagtctcctgcattttttagatgcacctgtgccatatttaatgggccttcactctaatggactagacgaccggtcgaaacttgaattaccccaggaggcaaacctctgctttgtagacattgataatcattttattgaactgccagaggacttaccgcagttccccaacaagctggaattcgtacaagaggttagtgaaatcctcatggcatttgggattcctcccgagggcaatctgcattgcagtgagagtgcatccaaactgaagcgactccgagccagcgagttagtttcagacaaaaggaatggaaatatcgcgggcagtccactccactcctatgagctgctgaaggagaacgagacaattgcccgactccaggccctcgtcaaaaggaccggggttagccttgaaaagctcgaggtgcgagaggaccccagtagtaacaaggatctcaaagtccagtgtgatgaggaagagctgcgaatttatcaactgaacattcaaatacgcgaggtcttcgcgaaccggtttacacagatgtttgccgactatgaggtcttcgtgatccaacctagccaggataaggagtcttggtttaccaaccgggagcaaatgcagaacttcgacaaagctagttttctgtcagatcaacccgaaccgtatctgccatttctgtctcggtttctagaaactcaaatgttcgcttcctttatcgacaacaagatcatgtgccacgacgatgacgataaggacccagtactccgggtgttcgattcccgtgtggacaagattaggctcctgaacgtccgcacccccacactgaggacttctatgtatcaaaagtgcactactgtcgacgaggccgaaaaggcaatagaactgcgtttagctaaaatagatcacaccgcaatccacccccatctgctggacatgaagattggccagggaaagtacgaacctggtttttttccaaaactgcaatctgatgttttatctacaggccctgcaagcaacaagtggactaagagaaatgctcccgcccagtggcggagaaaagatcgccagaagcagcacactgagcacctgcgactggacaacgaccaaagagaaaagtatatccaagaagcccgaacaatgggatccaccatcagacagcccaaactcagcaacctaagcccctcagtcatcgcccagacgaactggaagttcgtagagggactcctcaaggaatgtaggaataaaactaaacgcatgttggtcgagaagatgggccgagaagccgttgagctcggtcacggggaagtcaatattacgggagtcgaggagaatacccttatcgcctccctgtgcgaccttctcgagcgaatttggtctcacgggctgcaagtgaagcaggggaaaagcgcgttgtggtctcacctcctccactatcaagataacaggcagcgcaaacttacaagcggctccctctccaccagcggtatactgctagactccgaaagaaggaagtccgacgcctctagtttgatgcctcccctacgcatcagcctgattcaggatatgcggcatatacaaaacatcggtgagattaagacagacgttggcaaagcacgggcttgggtgcggttgtcaatggaaaaaaagctgctttctcgtcatttgaagcagctgttgagcgatcacgaactgaccaaaaaactgtataaaagatacgcgtttctgcggtgtgacgatgaaaaagagcagtttctttatcatctcttaagctttaatgcagttgactacttttgtttcactaacgtcttcacaactatactcatcccataccacattcttattgtgccctctaagaaactgggcggaagtatgttcacggcaaatccgtggatctgtatttccggagagctcggcgaaacccaaattatgcagatcccaaggaacgtccttgagatgacatttgaatgtcagaatttgggcaagctcactactgtgcaaattggccatgacaattctggactgtatgctaaatggctcgtggaatatgtgatggtgcgaaatgaaatcacaggccatacctacaaatttccatgtggaaggtggcttggaaagggcatggatgatggcagtcttgagagaatactcgtgggggagcttctgacgagccagcctgaggtagatgaaaggccttgcagaacccctccactgcagcagtcccccagcgtgatcaggcggttggtaacaatctcccctaacaataagcctaagttgaatacgggccagatccaggagagtatcggagaggccgtaaacggcattgttaaacactttcacaagcctgagaaagaaagagggtctttgacacttctcctgtgcggcgaatgcggcctcgtaagtgcactggaacaggcgttccagcatggctttaagtctccacgcctctttaagaacgtgttcatctgggatttcctcgaaaaagcccagacctattatgaaaccctggagaagaatgaggtagtacccgaagagaactggcacactcgggccagaaatttctgcaggttcgtgactgctattaataacacacccagaaatataggtaaggatggcaaattccagatgctggtatgtctaggcgctagggatcacctgctgcaccactggattgctctgctggctgattgtcctattactgcccacatgtatgaagacgtggctcttattaaggatcacacgctcgtcaactcgcttatccgggtgctgcagacacttcaggaattcaacattactctagaaacctccctcgtcaagggaatcgatatttag

SEQ ID NO: 41800 - DNA, 1893 bp, Artificial Sequence
  Description of Artificial Sequence: Synthetic coding sequence
atgaagatcggccagggcaagtacgagcccggcttcttccccaagctgcagtctgacgtgctctctactgggcccgcatccaacaaatggaccaaaagaaacgcacctgctcagtggcgacgcaaagacagacagaagcaacacacagagcacctccgccttgataatgatcaaagagaaaagtacattcaggaagcccgcacaatgggctccacgataagacagcccaagttgagcaatctttccccgtctgtgatcgcgcaaaccaattggaagtttgtggagggcttacttaaagagtgtagaaacaaaactaagaggatgctggttgaaaaaatggggcgggaggccgttgaactcggtcatggagaggttaatatcaccggtgttgaagagaacaccctcatcgcttcgctgtgtgatctcctggagcggatctggtctcacggcctgcaggtgaagcaaggaaagtccgcattatggagtcatctcctgcattatcaggacaataggcagcgaaagctaacctctggatcgctgagcacctctgggatcctgctggactcggagagacgtaagtccgacgcttcctctctaatgcccccgctgagaatttccctgatccaggatatgcgacatatccaaaacattggagagataaagaccgacgttggtaaagctcgcgcatgggtgcgattgagcatggaaaaaaagttgctgtcccggcatctgaagcagttactgagcgaccacgagctgaccaaaaagctatataagcgatacgcttttcttaggtgtgatgatgagaaggagcagttcctttaccatttgctgagcttcaatgctgtcgattatttctgtttcaccaatgttttcacaacaattcttatcccgtatcacatcctaatcgtaccaagcaagaagctgggcggatctatgtttactgctaacccatggatctgtatcagtggggagcttggcgagactcaaattatgcagatcccaagaaacgtcctcgaaatgacattcgaatgtcaaaacctgggcaagctgaccacagtgcagattggtcacgataacagtggcctgtatgctaagtggttggttgagtatgtgatggttcgtaatgagatcaccgggcatacatacaagtttccatgtggaagatggcttgggaaagggatggatgatggcagcctggaaagaatcctggttggcgaattgttgacctcgcagcccgaggttgacgaacggccgtgccgcacacctcccctgcagcaatccccatctgttatccggcggctggtaaccatcagccccaacaacaaaccaaaactgaataccgggcaaatccaggagtccataggtgaggcggtcaacggcatcgtgaaacacttccataaacccgaaaaagagagagggtctttaaccctccttctgtgcggagagtgcggtttagtgagtgcactggagcaggcattccagcacggcttcaaaagccctcgtctgttcaagaatgtgtttatatgggacttcctggagaaggcacagacatattacgagacattggaaaaaaatgaggtggtcccagaagagaattggcacactcgcgccagaaacttttgcagatttgtcaccgcaatcaataataccccccggaatataggaaaagacgggaagttccagatgctggtgtgcctgggtgcgcgggatcacctgctacatcattggatagcgctactcgccgactgccccatcactgcacatatgtacgaagacgtggccctcatcaaggaccacactctagtgaattccttaatacgggtgttacagacgctccaggaatttaacatcaccctggaaacctctttggtgaagggcattgatatttag

SEQ ID NO: 41801 - DNA, 3726 bp, Artificial Sequence
  Description of Artificial Sequence: Synthetic coding sequence
atgagcggcggcggcggcggcggcggcagcgcccccagccggttcgctgattacttcgtgatctgcgggctcgacaccgaaactggactggagccggatgagctgtcagccctctgccagtacatccaggccagtaaggcgcgggacggggcttcccccttcattagctcgaccaccgaaggagaaaactttgaacagacaccgctgcgaagaaccttcaaatccaaggtacttgcccgatacccagagaacgttgaatggaatccatttgatcaggatgccgtgggtatgctgtgcatgccgaagggactggcattcaaaacacaggccgacccccgcgaaccccagtttcatgcgtttataatcacacgtgaagatgggagcaggacctttgggtttgccctgaccttttatgaggaagtaaccagcaaacagatttgctccgcgatgcaaaccctttaccatatgcataacgccgagtatgacgtgctgcatgcgccgccagccgacgacagagaccagtctagtatggaagacggtgaagacaccccagtaactaagttgcagagattcaactcttacgatataagtcgggataccctttacgtgtcgaagtgcatttgcctcattactcccatgtcatttatgaaggcctgccggtccgtgctggagcagttgcaccaggcagtgacgagtccgcagccgccgcccctccccctagagagctatatttacaatgtcctgtatgaggtcccattgcccccccctggtcgctctctgaagtttagtggcgtgtatggccccattatctgccagcgaccgtctacgaacgagctgccactcttcgactttccagtcaaagaggtgtttgagctgcttggcgtggagaacgtgttccagctgttcacgtgcgctcttcttgaattccagatcttgctctacagccagcactaccagcggctgatgacggtggctgaaactattaccgcgctcatgttcccatttcagtggcagcatgtgtacgtcccaatcctacctgcaagtctgctccatttcctcgatgccccagtcccatacctcatgggactgcattctaacggcctggacgacagaagcaaacttgaattaccgcaagaagccaatctctgtttcgtggatattgacaaccactttatcgagctccctgaggatctgccacagttcccaaataagctggagttcgtgcaagaagtgagcgaaatacttatggccttcggaatccccccggaaggcaatctgcactgtagcgaaagcgctagtaagcttaaacgcttacgggcctcagaactggtcagtgacaagagaaacggaaacatagccgggtctccccttcacagttatgagcttctcaaagagaatgagaccatagcacgcctgcaggcactggtgaaaaggaccggcgtctcactggaaaaattagaggtgagggaggatccatcatctaacaaggatctcaaagtgcagtgtgatgaggaagagctaagaatttaccagttaaacatccagatccgtgaagtgtttgccaacaggtttacgcagatgtttgccgactacgaggtttttgtaatccaaccaagtcaggataaggagagctggttcactaaccgggaacaaatgcagaactttgacaaagcatcctttctgagcgaccagccggaaccctacttacccttcctctcacgctttctagagacacagatgtttgccagtttcatcgacaataagatcatgtgtcatgacgacgatgacaaagatccagtgttacgtgtgttcgattccagagtggataagatcaggctgcttaacgtgcgaacaccaacccttagaacatccatgtaccaaaaatgcaccacagtagacgaagcagagaaagcaattgagttacgcctggccaaaatagaccacactgccattcacccccatctgctagacatgaagatcggtcagggaaaatatgaacctggcttcttccctaagctgcagtccgacgtcctgtccacgggtccagcaagcaacaagtggacaaagcgcaatgctcccgctcagtggcgccggaaggatcggcaaaaacagcataccgaacatcttcgactggacaatgaccaacgggaaaagtatattcaggaggctcgtaccatgggttctaccatcaggcagccaaaactgagcaatttaagtccaagcgtaattgcccaaaccaattggaagttcgtggagggcctcctcaaagagtgcagaaacaagacaaaaagaatgctggtagaaaaaatggggcgggaagctgttgaactcggacacggtgaagttaacatcactggggtggaagagaatactctcattgctagcctgtgtgatctcctggagagaatttggtcacatgggctgcaggttaagcagggtaagagtgcactgtggtcacacttgttgcattatcaggataaccgtcagaggaagctgactagcggcagcctctctacaagcggcattttgctggactctgagaggcgcaagagcgacgccagcagcctaatgccaccactgcggatctccctcattcaggacatgcgacacattcagaacatcggagaaattaagacagatgtcggaaaggcaagagcatgggtgcgcctctcaatggagaaaaagctgctaagcaggcatttgaagcagctgctcagcgaccatgagctcaccaaaaaactgtataagcgctacgctttcctgagatgtgacgacgaaaaggaacagttcctgtatcaccttctgtcttttaacgccgtggattacttctgctttacaaatgttttcaccacgattttgattccttatcacattctgatcgtaccctccaagaagctcggcggcagcatgtttaccgctaacccgtggatctgtatcagcggggagctgggtgaaactcagataatgcagatccccaggaatgttcttgagatgacgtttgagtgtcaaaatttaggtaagctgaccacggtgcaaatcgggcatgataactccggcctctatgcaaaatggcttgtcgagtacgtcatggttagaaacgagattaccggacatacgtataagttcccttgcgggcggtggctgggaaagggcatggacgacggcagcttggagcgcatactggtgggggaactactaacttcacagccggaggtcgatgagagaccgtgtcgcacccctcccctgcagcagagtccaagcgtgatcagacgactggtgaccatcagccctaataacaagccgaaacttaatacaggccaaatacaggaatctatcggagaagccgttaacgggatcgtgaaacacttccataaacctgagaaggaacgcggatcgttaacacttctcttgtgcggggagtgtggtctggtgagcgccctcgaacaagcattccagcacgggttcaagtcaccccgacttttcaaaaacgtattcatttgggacttcctggagaaggcccaaacttactacgagactctagagaagaatgaggtggtgccggaggagaactggcatacacgtgcgaggaacttttgtcggtttgtcacagccatcaataacaccccccgcaacataggtaaggatgaaataactagctacacgaccggtctgccttgctggttaaccgctccatcgcttcacacatgcatgcgcatgtggcattag

SEQ ID NO: 41802 - DNA, 3930 bp, Artificial Sequence
  Description of Artificial Sequence: Synthetic coding sequence
atgggcacccaccaccacgcccagctgatcttcgtgttcctggtggaaatgagattccatcatgtagatcaggctggcttagaactgctgacctcgagcaattcacccgcttccgccagtagaagtgctgaaattaccgtggtatcccagcacgcacagccagggtttttgtatcagtggctggaggccgacagacatggaaaatctcagggagcggccaatacaacgtcgggagagaattttgaccagagtcctctcagacgcactttcaaaagcaaggtgttggcccattacccacaaaatatagagtggaatccatttgaccaggatgcagtaaacatgctatgcatgccaaaggggctgtcttttaggactcagacagataataaggatccccagtttcacagtttcatcataacccgagaagatgggtcacgtacgtatgggttcgtgctgacattctatgaagaagtcacctccaaacaaatttgcaccgctatgcagaccctgtaccagatgcataacgcagagcattactcgagcgtgtacgcaagtagttcttgtagcatggactctttggctagcagcctcgacgaaggcgatactactagcctcttgaaactccagcgatacaatagctatgatatctccagggacacactgtacgtgtctaagagcatctgcctaattacccctcttccgttcatgcaggcgtgtaaaaaatttctcatccagctatataaggccgtcacaagtcagcagcctccacccttgcctctggagtcttacattcacaacatactgtatgaggttcccctcccaccaccgggccgttctctcaagttttacggcgtatatgagcccgtgatttgccagagacccggccctagcgaactccctctgtccgattacccgctcagagaagcctttgaattacttgggctggaaaatcttgtgcaggtgtttacgtgcgttctgcttgagatgcaaattctgttgtactcacaggactatcaacggctcatgactgttgctgaaggaattactacactgctgttcccctttcagtggcagcacgtgtatgtgcctattctgcctgcttctctcttacacttcctcgacgccccagtgccctatctcatgggactccagtccaaggaagggacagatcgcagcaagctagagctcccccaagaggcgaacctatgcttcgtcgatatcgacaatcactttatcgagctgcctgaggagtttccacagttcccaaacaaagtggatttcatccaggaactgtccgaggtccttgtccagttcgggattccgcccgagggtagtctacattgcagcgaatctaccagtaagttgaagaatatggttctcaaagacctggtgaatgacaagaagaatggaaatgtgtgcaccaacaatattagcatgtacgaacttctgaaagggaacgaaactatcgctcggctccaggccttagctaagcgcacaggggttgcagtcgaaaagatggacctgagcgcaagtttaggagaaaaagataaggatctaaaactacattgtgaagaagctgaactgagggactaccagctgaatgtacaattgagagaggtgtttgccaacagattcactcagatgttcgcagattatgaggctttcgtgattcagacagcccaagacatggagtcctggctgaccaatcgggagcaaatgcaaaattttgacaaggcatcattcctctccgaccaaccagagccatatctgcccttcctttctcgcttcatagagactcagatgtttgccacctttattgataataaaattatgagccagtgggaagagaaagacccgctactgagggtgttcgatacacgcatcgataaaataagactgtacaatgtgcgtgcccctactcttcgcacctccatttaccagaaatgttctactctgaaggaggccgcccagagtatcgagcagaggttgatgaagatggatcacaccgccattcaccctcatctccttgacatgaaaataggccaagggaagtacgagcagggtttcttcccaaaactgcagtctgacgtcctagcaaccgggcccacgagtaacaatcggtgggtgagccgttccgcgactgcgcaacggagaaaggagagattgaggcagcactcagagcacgtgggcttggataacgatctgagagaaaaatatatgcaggaggcacgttctcttgggaagaatctgcgtcagccgaaactgtcggatctatctccagcggtgatagcacaaacgaactgcaagtttgtcgagggacttttaaaagaatgcagaatgaagacaaagagaatgctcgttgagaagatgggacacgaagcggtcgaactaggtcacggggaggccaatattaccggcctggaggaaaacaccctcatcgcttctctgtgcgacctcctggagcgaatctggtcccacggactccaggtcaaacagggcaagagcgcgctgtggagccacctgattcagttccaggaccgagaggaaaaacaggaacatctggccgaatcaccagtggctctaggcccagaacggagaaaatctgacagcggagtgatgctgccaaccctgcgggtgagtctgatccaggacatgcggcacatccaaaacatgtctgagatcaaaacagacgtcggaagagctcgcgcctggatacggcttagcctggagaagaaacttctcagccaacacctgaaacaactgctgtctaaccaacctctgaccaagaagctgtacaagcgttacgctttcttacggtgtgaagaagaacgggagcagttcttatatcacctgctgagccttaacgctgtggattatttttgtttcacttccgtgtttactactattatgatcccatatcggagcgtgattatcccaatcaaaaagctgtccaatgcaattattacctctaacccgtggatatgtgtcagtggagagctcggtgatacaggcgttatgcaaatcccaaagaatctcctggagatgacttttgagtgtcaaaacctcgggaagcttacaactgttcagatcgggcacgataacagcgggctgctggctaagtggctcgtcgactgtgtcatggtgcggaatgaaatcactggtcacacgtaccggtttccgtgcggtagatggctgggtaaggggattgatgacggcagcctcgagcgaattcttatcggagagttgatgacaagcgcctctgacgaagatctggtgaaacaatgtagaacaccccctcagcagaaatcacccaccactgcccgtcgcctgagcatcacttcactcactggcaagaataataagccaaacgcaggacaaatccaggaaggtattggcgaggccgtcaataacattgttaaacatttccacaaacctgaaaaggagagaggctccctgaccgttttgctgtgtggggagaacggacttgttgccgccctcgaacaagtgttccaccatgggttcaagagcgcgagaattttccacaagaatgtgtttatctgggacttcatcgagaaagtggtggcatacttcgaaacaacggaccagatcctcgacaacgaagatgatgtgttaattcagaaatcttcgtgcaagacattttgccactatgtaaatgctattaacactgccccccgtaacataggcaaagacgggaagtttcagatcttggtgtgtttgggcacccgggataggttacttccgcagtggattccactgttggcggagtgcccagccatcactcgcatgtacgaggagagtgccttgctaagagatcggatgacagtcaactcactaatccgtatcttacaaaccattcaggatttcaccatagtactggagggtagtctcattaagggcgttgacgtatag

SEQ ID NO: 41803 - DNA, 2217 bp, Artificial Sequence
  Description of Artificial Sequence: Synthetic coding sequence
atgagcggcagctgcgccgcccccggccccggcagcggcagcagccccgctgcttgtaggtttgcccactacttcgtgctctgtggtatcgatgccgacagtgggctggagcccgatgagctggccgtcttataccagtggttagaggccgacaggcatggaaagtcccagggcgccgctaacacgacatctggggagaacttcgaccagagcccacttcggcgcacattcaaatccaaggtccttgcccattacccgcaaaacatagaatggaacccattcgaccaggacgcggtcaacatgttatgtatgcctaagggcctttctttccggacgcagaccgataataaggacccccaatttcattccttcattatcacgcgggaggacgggagccgtacttacggctttgtcctgaccttctacgaggaggttactagcaagcagatctgcaccgcaatgcaaaccctttatcaaatgcataacgccgagcactatagtagtgtgtacgcttctagctcttgttccatggactctctggcatcatctctcgatgagggggacacaacatctctcctgaaactgcaacgctataattcctacgatatctcccgtgacacactgtacgttagtaaaagcatttgcctgattactcccctgccattcatgcaggcctgcaaaaagttcttgatccaattatataaggccgtgacctctcaacagcctcctccactgcccttagagtcctatatccataatatactgtatgaagtcccgctacccccaccaggccggtccctgaagttttatggcgtgtatgagcctgtgatctgccagcgccccggcccgtccgaactcccactctcagactaccctctgcgtgaggcgtttgagctactggggcttgaaaacctggtacaggtgttcacatgtgtgctgctcgagatgcagatcctactgtattctcaggactatcagcgccttatgaccgtcgcggaagggataacaacgctgttgttcccttttcaatggcagcatgtgtacgtgcctatcctgcctgcctctctgttgcattttcttgacgccccagttccttatttgatggggctacagtccaaggaaggaacggaccggtcaaagcttgagcttcctcaggaagctaatctgtgcttcgtcgatatagataaccattttattgaactccccgaagaatttccacaatttcccaacaaggtggacttcattcaggaactgtcagaagtgctggtgcaattcggaatacctcccgaaggctcgctccactgctctgagtccacctctaaactgaagaacatggtgctgaaggatttggtaaatgacaagaaaaatggcaatgtgtgtactaataatattagcatgtatgagctcctgaaaggcaacgagactatagctaggttgcaggctctggcaaaaaggaccggggtcgccgttgaaaagatggaccttagcgcctctctaggagagaaggacaaggacctgaagttgcactgtgaggaagccgaacttcgggactaccagctgaacgttcaactgagagaagtctttgctaacaggtttacgcagatgtttgcagactatgaggcctttgtgatccaaactgctcaagatatggaaagctggctaacgaatcgggaacagatgcagaattttgataaggccagttttctttccgaccagcctgaaccttacctgccttttctgtcccgatttatcgaaacacaaatgtttgcgacttttattgataataagatcatgtcccaatgggaagagaaggatcccctgttgcgggtgtttgatacccgaattgataaaatcagactgtataatgtgagagcccccacgttgcgaaccagtatctatcagaagtgttcgacactgaaggaagccgcccagagcattgagcagcggctgatgaaaatggaccacacagccatccatccacacctcctggacatgaaaatcggacagggaaagtacgagcaggggttctttccaaagctgcagtcagacgtactcgcaaccgggcctacttctaataaccgatgggtcagtcgctcagcaaccgcccagagacgcaaggagagattacggcaacactcggagcacgttgggcttgacaatgatttgcgcgaagtgtgtggactgccaagttggggagccagtcagcaagcaccctag

SEQ ID NO: 41804 - DNA, 3825 bp, Artificial Sequence
  Description of Artificial Sequence: Synthetic coding sequence
atgagcggcagctgcgccgcccccggccccggcagcggcagcagccccgctgcctgtagattcgcacattactttgtcctctgtggcattgatgccgattctggcctggagccagacgaactcgcaggtgagaatttcgatcagagtcccctaaggaggacttttaagagcaaagttctagcccattacccgcagaacatcgagtggaatccctttgatcaggacgcggttaatatgctgtgcatgcctaaaggcttgtcttttaggacccaaaccgacaataaagacccacagttccacagctttataataacccgagaagacggctccagaacatacggtttcgtcttgacattttacgaagaagtgacttccaagcagatttgcaccgcaatgcagactttgtatcagatgcacaacgcagagcactattcttctgtatacgctagtagcagctgttccatggattctctggcttcaagcctggacgagggagacaccactagcctcctcaagcttcaacggtataattcttacgatatctcaagggatacactgtacgtttcgaaaagcatatgtttgataacccccttgcctttcatgcaagcctgtaagaaattcttgattcaactctacaaggctgtgacttcccaacagccccccccgctcccattagaatcgtatatccacaacattctttacgaagttcctctcccaccccctggccggtccctgaagttctatggggtgtacgagcccgtcatctgtcagaggcctgggccaagtgagctgccattgtccgactacccactgcgagaggcctttgaacttttggggctcgagaatctggtgcaggtattcacttgcgtgttattggagatgcaaattttgctttactcacaggactaccagaggcttatgacagttgcagagggaattacaacgcttctgttcccctttcagtggcagcatgtatatgtcccaattttgcccgcctcgttgttacatttcctcgatgcacccgtgccatacctgatgggcttgcaaagcaaggaaggcaccgatagatctaaactggagctccctcaggaggccaacctgtgtttcgttgatatagacaaccattttatagaactgcctgaggaattcccacagtttcccaataaggtggatttcattcaggagctcagcgaggtcctggtgcaattcggcatccctcctgaaggttccctgcactgttccgaaagcacatcaaagttgaagaatatggttcttaaagaccttgtcaatgacaaaaagaatggaaacgtctgtactaataacatttctatgtacgagcttcttaagggcaatgagaccatcgctcgcctgcaggccctcgctaaacggaccggggtggccgtggaaaaaatggatctgtcggcctccctgggcgaaaaggataaggacctcaaattgcactgtgaagaggctgagttgagggactaccaactgaacgtgcagctgcgagaagtcttcgctaaccgcttcacccagatgtttgccgactatgaagcttttgtgatccaaacagcccaagatatggaaagctggttgacaaaccgggagcagatgcaaaactttgacaaagctagttttcttagcgaccaaccagagccctacctgccatttctatcgcgatttattgagacccaaatgtttgctacatttatcgataacaaaataatgagccaatgggaagaaaaagacccccttcttcgagtattcgacacgcggatcgataaaatacgcctgtataacgtccgcgcccctaccctgcgaacaagtatttaccaaaaatgttcaacactcaaggaggctgcgcagagcatagagcagcgcctgatgaaaatggaccacaccgcaatccatcctcacctgcttgatatgaagatcggacagggtaaatacgagcaaggtttttttcccaaactgcaatccgatgtgctcgctactgggcctacaagtaataaccgctgggtgtctagatccgccaccgcgcagaggcgtaaggagcgcttgcgacaacactctgagcacgttggcctagacaatgaccttagggagaaatatatgcaagaagcccgaagccttgggaagaatctacgacaacctaagctgagcgacctttctcctgcagttatcgcacagactaattgcaagtttgtagaagggctgctcaaagaatgcagaatgaaaaccaaacggatgcttgttgaaaagatgggccatgaggcggtggagctgggacacggggaggccaacatcactggtctcgaagaaaatacactgattgcttcactgtgtgaccttttagaacgaatctggagccatggactgcaggtgaaacagggcaagagcgcgttgtggagtcacctgatacagtttcaggatagagaagagaagcaggagcatctggctgagtcacccgtggctctgggtcctgaacgtcgtaagagcgattctggggtcatgttgccaactctccgagtctcactgattcaggacatgcggcatatacagaatatgtccgagatcaaaaccgacgtcggtagggcccgggcatggattcgcctgtccctcgaaaagaagttactctcacagcatctgaagcagttactgtcaaaccagccactgacaaagaagctttataagcggtatgcgtttctgcggtgcgaagaggagagagaacagttcctataccacttgctttccctgaatgccgtagactatttttgcttcacctcagttttcaccaccatcatgatcccttatagatcggtcattatccccattaagaaacttagcaacgccattatcacatccaacccctggatatgcgtgtccggcgaactgggggacaccggggtcatgcagatccccaaaaatctgttggagatgacatttgagtgccagaacctcggtaagctgactacagtgcagattggccacgataattccgggctcctggcaaagtggttggtcgactgtgtgatggtccgcaacgaaatcaccgggcatacctatagattcccgtgtggccgctggttaggtaaaggaattgatgatgggagtctcgaacgtatattgataggtgaacttatgacatctgcatccgatgaggatctcgtgaagcagtgtcgaaccccaccacagcagaagagccctactactgccaggcgcctgagcatcacgagtctgacgggaaaaaacaacaagcccaacgccggccaaattcaggaaggtataggagaagccgtcaacaacattgtaaagcatttccacaagccagaaaaggagcgaggcagccttactgtgctgctctgcggagagaacggcctggtggctgccctggagcaggtgttccaccatggatttaagtccgcccggatcttccacaaaaatgtcttcatatgggatttcattgagaaggtggttgcttattttgaaactacggatcagatcttggataatgaggacgatgtgctcattcagaagtcttcctgtaagacattctgccattacgttaacgctatcaataccgcgcctagaaatatcggaaaggatgggaagttccagattctagtttgcctcggcacacgcgacaggcttctgccacagtggatccctctgctggctgagtgtcccgcaattaccagaatgtatgaagagagtgccctgctgcgcgaccgtatgacagtgaactcactaattaggatcctgcagactatccaggatttcacaatcgtactggagggatctctgattaagggcgttgacgtctag

SEQ ID NO: 41805 - DNA, 3930 bp, Artificial Sequence
  Description of Artificial Sequence: Synthetic coding sequence
atgggcacccaccaccacgcccagctgatcttcgtgttcctggtggagatgaggttccatcacgtggaccaggctgggctggaactgctgacctcttccaactctcccgctagcgcctcccggtccgcagagattaccgtggtttctcagcatgcgcaaccaggctttctgtatcagtggctcgaagctgaccgccacggcaagtcccagggcgctgccaacacaacctctggggagaattttgaccagagccctctccggagaaccttcaagtccaaggtactggctcactacccccagaatattgaatggaatccttttgatcaggatgctgtaaatatgctgtgcatgcccaaggggctgagcttccgcacccaaacggataataaggatcctcaattccattcttttataatcacccgggaggacggaagtaggacatacgggtttgtcctgactttttatgaggaagtcacttcaaagcaaatctgtacagccatgcagacactgtatcagatgcataatgccgagcattactcttccgtttatgcatccagctcctgttctatggattccctggcgtcatctctcgacgaaggtgatactacatccctgctcaagctacagcggtataactcttacgacatctctcgcgatactctgtacgtgagcaagagtatatgccttataacccccctgcctttcatgcaagcctgcaagaaatttctcatacagttgtataaagccgtgacgtcccagcaacctccaccactgcctttagaatcctacatacacaatatcctttatgaagtgcccctaccacccccaggtaggtcactgaaattctacggcgtctacgaacctgtgatttgccagcgcccaggacctagcgaactccctctgagcgattatcctctgcgtgaggccttcgaactgcttggactggaaaatttagtccaggtctttacctgcgtcctgctggagatgcagatcctgctgtactctcaggactaccagcgacttatgacggtggccgagggtattactacactcctatttccatttcagtggcagcacgtgtacgttccaatcctcccagcgtccctcttgcacttccttgatgcccctgtaccctacctcatggggctccagtccaaagagggaaccgacagatccaaactggagctgccacaagaggctaatctgtgctttgtggatatagacaatcacttcatcgaactgccagaggagttccctcagtttcccaataaggtcgatttcattcaggagctgtcagaagtacttgtccaatttgggatcccacccgaggggtccctccactgcagtgaatccaccagcaaactcaagaatatggtgctgaaagaccttgtgaatgataagaaaaacggaaacgtatgcactaataatatcagtatgtacgaactactaaaaggcaacgaaacaatcgcgagactgcaggcgctggcaaaaaggaccggggtagcagtggagaagatggacctttcggcatccctcggcgagaaggataaagatctgaagctccactgcgaggaagctgaactcagagactaccaattgaatgtgcagttgagggaagtgtttgctaatcggttcacgcagatgttcgctgattacgaggcttttgtgatccagaccgcacaggacatggagagctggctcaccaaccgcgaacagatgcagaactttgataaggccagtttcctgtctgaccagccagagccgtacttaccttttttgagcagatttatcgagacgcagatgttcgcaacgtttattgataataaaataatgagtcaatgggaggagaaggatccactgctaagagtcttcgacacacgcatagacaaaatcaggctgtacaatgtacgggcgcctacgctccgcacatccatctaccaaaaatgtagcaccctgaaggaggcggcccaaagcatcgagcagagactcatgaagatggaccatactgccatacatccacacctgctagacatgaagataggtcagggaaaatacgagcaagggttcttccccaagctacagagcgacgtcctggcaaccggtcctactagtaacaacagatgggtgtcgagatcagcaactgcccaaagaaggaaggagcggctgaggcagcactcggagcacgtgggtctggacaacgaccttagggagaaatacatgcaggaggcccggtcactggggaagaacctgcgccagccaaaactttctgacttgagtcctgcggtcatcgcacagactaattgtaaattcgtggagggtctcctcaaagaatgccggatgaagactaagagaatgttagtggaaaagatggggcacgaggccgtagagctaggacatggagaagcgaacattacaggattggaagagaatactctgatcgctagcctttgcgatctgctggaaagaatttggtctcacggccttcaggtgaaacagggtaaatctgccttgtggagtcatctgatccaattccaggatcgtgaggagaaacaggagcacctggccgagagcccagtcgcattgggccctgaaagacgcaaatcagatagcggagtgatgctccccactctgcgagtctctctgatccaggacatgcgacatattcagaatatgtcagagatcaaaactgatgttgggcgggcaagagcgtggatccgactgagcctagagaagaagctgctaagccaacacctgaagcagctcctttccaaccaacccttgactaaaaaactgtacaagcgctacgccttcctgcggtgcgaggaagaaagggagcaattcctctatcatctgctcagtttaaatgccgtagactatttctgtttcaccagtgtattcacaacaataatgatcccatatcgctctgtgattatacctatcaagaagcttagcaatgctataatcactagcaatccttggatctgtgtgagcggtgagttaggcgacaccggggtgatgcagattccgaagaacctgctcgaaatgacatttgagtgccagaacctgggaaaactaaccacagtgcagatcgggcacgacaactcaggtttgttagccaagtggctagtggactgtgttatggtaagaaacgaaattacaggtcacacctatagatttccatgcggcaggtggttggggaaaggtatagatgacggtagtctggaaagaattctgatcggagaactcatgacgtccgcatccgatgaggacttggtcaagcagtgccgcaccccccctcaacagaagagccctaccacagcacggaggctctccatcacatccctaacgggcaagaataataagcccaatgctggtcaaatccaggaagggatcggagaagccgttaataacatcgtgaagcactttcataagcctgaaaaagagcgaggctctctgaccgtgttactgtgcggcgaaaacggtttagtggctgctctggaacaggtctttcaccacggattcaaatctgcacgtatctttcacaaaaatgtgtttatatgggacttcattgaaaaggtagttgcttacttcgagactactgaccaaatcttggataacgaggatgacgttctgatccaaaaatcatcatgtaaaactttttgccactacgtgaatgccatcaacaccgcaccaaggaacataggaaaagatggcaaatttcagatactggtttgcttgggcacacgcgacagactgctcccacagtggataccgctcttggcagagtgtcccgcaattactagaatgtacgaggagtccgcactgctcagagatcgcatgaccgttaatagcctgatacgtatcctgcagaccatccaggattttacgattgtgctcgaaggctctctaatcaagggcgtcgacgtttag

SEQ ID NO: 41806 - DNA, 399 bp, Artificial Sequence
  Description of Artificial Sequence: Synthetic coding sequence
atgttcctggtgggcctgaccggcggcatcgccagcggcaagagctccgttatacaggtgtttcagcagctgggctgtgcagttattgacgtggatgttatggctcgtcacgtcgtgcaacccggctaccctgcacaccggaggatcgttgaggtgttcggaacagaggttctgttagaaaacggggacatcaacaggaaggtgctcggggacctgatatttaaccagcccgaccggagacaacttctcaatgcaatcacccacccagagattaggaaagagatgatgaaagaaacattcaaatatttcctgcgtgagcccaggacgtcccctaggggaaagaagcacgtcccctcagcgttgaaggaagcggatagccttatgcggcgggatacttag

SEQ ID NO: 41807 - DNA, 696 bp, Artificial Sequence
  Description of Artificial Sequence: Synthetic coding sequence
atgttcctggtgggcctgaccggcggcatcgccagcggcaagagcagcgtgattcaggtctttcagcaactagggtgcgcagtgattgatgtggacgtcatggccaggcacgtggtgcagccaggttacccagcccatcggaggattgttgaggtgtttggcaccgaggtcctattggaaaatggcgacattaatcgcaaggtcctgggggatctgatttttaatcaaccagatagaagacaattgcttaatgccatcacccatcccgagatccgcaaagagatgatgaaagagacatttaagtatttcctgcgaggataccggtacgtaattcttgacattccactgctgttcgagacaaaaaaactgctgaagtacatgaagcatacggtggtcgtctactgtgatagagatacacagctggctcgacttatgcggaggaactccctgaatcgaaaggatgcggaggcgcggatcaacgcgcaacttcctctgaccgacaaagcccgtatggcacggcatgtactggacaattccggggaatggtccgtgactaaacggcaggtgattctcctgcacactgagctagagaggtcgctggagtacttaccgcttaggtttggggtgttaactggcctcgcagcgattgctagcctgctttacctgctgactcactatttgcttccctacgcctag

SEQ ID NO: 41808 - DNA, 696 bp, Artificial Sequence
  Description of Artificial Sequence: Synthetic coding sequence
atgttcctggtgggcctgaccggcggcatcgccagcggcaagagctctgttatccaggtgttccagcagctgggttgcgcagtaatagatgtcgacgtgatggctcgccatgtggtgcagccaggataccctgcccataggagaatagtggaggttttcggcactgaggtgctcctggaaaacggagacataaacagaaaagtgcttggtgacctgatcttcaatcagcctgaccgacggcagctgctgaatgccatcacgcatccagagatacgcaaggagatgatgaaggagacgtttaagtattttcttagagggtacaggtatgtcatcctcgatattcccctgctgttcgaaaccaaaaaactgcttaaatacatgaaacacacagtggtggtttattgcgatcgcgatacacaactcgcaaggcttatgcggcgaaattcccttaaccgcaaggacgcagaggctcgcatcaacgctcagctgcctctgaccgataaggctcgcatggccagacacgtgctggataacagtggcgaatggtctgtcaccaaacgccaggtgattctgctccacacagagttagaacgtagcctggagtatctgccgttaagattcggggtcctgaccggattagccgcaatcgcatccctactgtacctgttaacacattacttgctcccttacgcctag

SEQ ID NO: 41809 - DNA, 756 bp, Artificial Sequence
  Description of Artificial Sequence: Synthetic coding sequence
atgagcgacatcggcgactggttccggagcatccccgccatcacccgctactggtttgcagctaccgtggctgtgccactggtggggaagctgggcttgatcagcccggcgtacttatttctgtggccagaagccttcctttacaggtttcagatttggaggccaattacagctactttctattttccggtgggaccggggacaggcttcctgtacctcgttaacctgtattttctttaccagtattccacaaggttggaaacaggggcttttgatggccgacctgcggactacctgtttatgctactgttcaattggatctgcatcgtgatcactggactggcgatggacatgcagctcctgatgatcccactgattatgtctgtgctgtacgtctgggctcagctaaatagggacatgattgtttcgttttggtttgggacaaggtttaaggcctgctatctgccctgggtgatactggggtttaattatataataggcggcagcgtgataaatgaactcatcggaaatttggtgggccacctgtacttttttctgatgttcaggtacccaatggacctcggcggccggaactttctgtcaactccacaatttttatacaggtggctgccatcgagaaggggtggcgtgtctgggtttggagtgccacccgccagcatgagacgggcagcagaccaaaatggcggtggcggccgtcacaactggggtcagggtttccgcctgggcgatcaatag

SEQ ID NO: 41810 - DNA, 696 bp, Artificial Sequence
  Description of Artificial Sequence: Synthetic coding sequence
atgagcgacatcggcgactggttccggagcatccccgccatcacccgctattggtttgccgccactgtggctgtccccctggtgggaaagctgggactaatcagtcctgcatatctgttcctgtggcccgaggcgttcttgtaccgcttccagatctggcgcccgatcactgccacgttttatttcccggtgggtcccggaacaggattcttgtacttggtcaacctgtacttcctgtaccaatactctacgcgcttggagaccggcgccttcgacggtcgccctgcggattatctgttcatgctcctttttaattggatctgtattgtcattacgggtctcgcaatggacatgcagctgctaatgattcccttaattatgagcgtgctgtatgtttgggcacagctgaaccgggatatgatcgtgtccttttggttcgggacccgtttcaaagcatgctatctaccatgggttatactgggatttaactatatcattggtggcagctaccccatggatctgggagggcgcaatttcctctctacccctcagttcctgtataggtggctccctagcagacgcggtggggttagcgggttcggggttccccccgcgagcatgaggagagccgccgaccagaatggcggggggggcaggcataactgggggcagggcttccgcctgggagaccagtag

SEQ ID NO: 41811 - DNA, 456 bp, Artificial Sequence
  Description of Artificial Sequence: Synthetic coding sequence
atgagcgacatcggcgactggttccggagcatccccgccatcaccaggtactggtttgcagctaccgtcgctgttcctctggtcggcaagctggggttaatatctccggcatatctctttctgtggccagaagccttcctgtaccggttccaggcctgttatttaccatgggtgatcttgggtttcaactacatcataggtggcagcgtcatcaatgagttgatcggtaacctcgtaggccatctttacttctttctgatgttcagatatcccatggatttgggtggtagaaatttcctctctacaccccagttcttgtatcgctggttaccctcacgtaggggaggagtgtccggttttggggtgccccctgctagcatgcggagagcggccgaccagaatggggggggcggcaggcacaattgggggcaggggtttcggctgggtgaccagtag

SEQ ID NO: 41812 - DNA, 720 bp, Artificial Sequence
  Description of Artificial Sequence: Synthetic coding sequence
atggcctaccagagcctgcggctggagtacctgcagatcccccccgtctccagggcctatacaaccgcctgcgttttgaccacagcagccgtgcagctggaactgattacaccttttcagctgtacttcaatccagagttgattttcaaacatttccaaatctggaggctgataaccaatttcctgtttttcggccctgttggctttaactttctgtttaacatgatctttttataccggtactgcagaatgcttgaagaaggaagtttcagaggaagaacagctgattttgttttcatgtttctgttcggtggattcttgatgacactcttcggtctgtttgtctcattggtgttcctgggccaagcatttactataatgctggtgtacgtgtggagccggcggaatccttacgtacgtatgaacttttttggactcctcaactttcaggcaccgttcctgccatgggtgctcatgggtttttcgctgctgttaggtaacagtatcatagtcgatcttttagggatcgccgtcggtcatatttactttttcttggaagacgtgttcccgaatcagccagggggcattcgtatccttaaaactccatcaatccttaaagccatcttcgatacacccgatgaagatcctaactataatcctctgcccgaagaacggcccggagggttcgcatggggagaggggcagaggctagggggctag

SEQ ID NO: 41813 - DNA, 708 bp, Artificial Sequence
  Description of Artificial Sequence: Synthetic coding sequence
atggcctggcagggcctggccgccgagttcctgcaggtgcccgccgtgacaagggcttataccgccgcctgcgttctgacgactgcagcagtccagctcgagctattgtccccgtttcaactgtattttaacccacacttggtttttcgaaagtttcaagtgtggcggctcgttaccaacttcctcttttttggccctctgggcttctcctttttctttaacatgctctttgtgttcaggtactgtcggatgctggaggaggggagctttcgcgggagaaccgccgactttgtctttatgtttctattcggcggtgtgctgatgacactcctcggtcttctgggctccctgttcttccttgggcaagccctgatggctatgctagtctacgtatggagtagacgtagtccacgtgttcgggtaaacttctttggcctccttaccttccaggcaccattcttgccctgggctctgatgggcttcagtcttctgcttggcaattccatcttagtggaccttctggggattgcggtgggacacatttattacttccttgaggatgtctttccgaaccaaccagggggaaaaagattactgcaaacaccaggcttccttaaactactgctggatgcaccagctgaggatcccaactaccttccgctgcctgaggagcagccaggaccccatctgcccccgccgcagcagtag

SEQ ID NO: 41814 - DNA, 618 bp, Artificial Sequence
  Description of Artificial Sequence: Synthetic coding sequence
atggcctggcagggcctggccgccgagttcctgcaggtgcccgccgtgactcgcgcatatactgcggcatgcgtcctgacaacagctgcagtgcaattagaactcttgtccccattccaactgtacttcaacccacacctggtgttcagaaaattccaggtgtggcgcttagtgacgaacttcttattctttggaccactgggattctctttctttttcaatatgctgttcgttttccgatactgccgtatgttagaagaagggagttttcgaggccggacagcagatttcgtattcatgtttctattcggaggggttctgatgactctgctggggttgcttggcagtctattttttttgggccaggcactgatggccatgttggtgtatgtctggagccggcgcagccccagagtccgggtcaacttcttcggcctactcacgttccaggccccttttctcccctgggctttgatggggtttagtctcctgctggggaactccatactggtggacctactgggaattgccgtcggtcatatttattatttcctagaagatgttttccctaaccagcctggcggaaaaaggctcctgcagacacccggatttctatag

SEQ ID NO: 41815 - DNA, 720 bp, Artificial Sequence
  Description of Artificial Sequence: Synthetic coding sequence
atggcctggcagggcctggccgccgagttcctgcaggtgcccgccgttactcgggcctacaccgcagcatgtgtgttgaccactgctgctgtccagttagaactgttaagcccatttcagctgtatttcaatccacacctggtgtttaggaagttccaagtttggcgactggttactaattttttgtttttcggccctctgggattttcttttttcttcaacatgctgttcgtgtttaggtattgcaggatgttggaggagggctccttccgcggcagaaccgccgactttgtttttatgtttctctttggcggggtccttatgactttgttaggactcctcggctctctgttctttctaggccaggcactcatggccatgctcgtatatgtctggagccgtcggtcccctagggtccgcgttaatttcttcggtttattaaccttccaggccccatttcttccatgggctctcatggggttctcactgttgctcggaaactctattttggtcgacctacttgggatagcagttgggcatatctattacttcctcgaggatgtgttccctaaccaacctggcgggaagcggctattacagactcccggatttctgggactgcagtcttccaaagctccagctggaagttccttaaccatatggacacaacagagccagggcggccccgggactgccggcgagctggctgctccatcctag

SEQ ID NO: 41816 - DNA, 2838 bp, Artificial Sequence
  Description of Artificial Sequence: Synthetic coding sequence
atggccgagggccagggcggcggcggccagcggtgggactgggccggcggtggacgggccgcagaagaggaagtcgtccgtcgtcggtgtcgacgcggtgaagaggcccaggtggctcagccttggccagaaggttctcgcggcaccgcagcagggcccccggtggaggagaggtttcgtcaacttcatttgagaaagcaagtgtcttataggaaggcaatcaccaaaagcggcttgcagcacctggctccaccccctcccacccctggcgccccatgctccgagagcgaacggcaaataagaagcaccgtggactggtctgagtccgctacctacggagagcatatctggtttgaaacaaatgttagtggtgacttttgctacgttggagaacagtactgcgtggcccgcatgctcaagagcgtgagtcgccgtaagtgcgcggcatgcaagatcgtggtccacactccttgtatcgagcagctcgaaaagataaacttccggtgcaagccatccttcagggaatctggctcaaggaatgtgcgcgaacccaccttcgttagacaccattgggtccatcggcggagacaagacgggaagtgccgccattgtggtaaaggcttccagcagaaatttactttccattcaaaagagatagtggctatctcttgctcttggtgcaagcaggcctatcactctaaagtgagctgcttcatgctgcagcagatcgaggaaccttgcagcttgggcgtacacgccgctgttgttatcccccccacatggatactgagagctcgacgtccccaaaataccctgaaagcttcaaaaaaaaaaaagcgggccagctttaaaagaaagtccagtaaaaagggcccggaagagggccgatggcgccccttcattatccgcccgaccccatcaccactgatgaaaccgcttctcgtgtttgtaaaccccaagagtggcggcaatcagggggctaagattatccagagctttctctggtacctcaatcccaggcaggttttcgatctgagccagggcggtcccaaagaagccttagaaatgtacagaaaggttcacaacctccgtattttggcatgcggaggagatggaaccgtgggatggatcctgtcaaccttggatcagctgcggttgaagccccctcctcccgtggctatcctgcccctcggcacgggaaatgatctggctagaacactgaactggggcggcggctacaccgacgagcctgtgtccaagattctgagccacgtagaggagggcaacgtagttcagctggatagatgggatctccatgcagaaccgaatcctgaagccggacctgaagatcgggacgagggggccactgaccggcttcctctcgacgtatttaacaattacttctcccttggcttcgacgcacatgtgacactcgaatttcacgaatctcgcgaggccaatccagagaaatttaacagtcgattcaggaacaagatgttctacgccgggaccgcgttcagcgatttcctgatgggctcctccaaggatctggcaaaacatatcagagtcgtgtgcgatggaatggatctgaccccaaagattcaggatctcaagccccagtgtgttgtttttcttaatattcctagatattgtgcaggcacgatgccttgggggcaccctggagagcaccacgactttgagccccagcgccacgacgatgggtatctggaggtgatcggattcacaatgacaagcctggctgcactgcaagtggggggtcatggtgagcgtttgacccagtgccgagaagtcgtgctgactacatctaaagccattccagtccaagtggatggcgagccttgtaagctggccgcctcacggattcgaatcgctttaaggaatcaggccaccatggtgcagaaagcgaagcgccgttcagccgctcctctgcactcagaccagcagccagttcccgagcagctgcgcatccaggtatctcgggtttccatgcacgactatgaggctctgcattacgacaaggagcagcttaaggaggccagtgtaccactcgggacggtcgttgtccctggggacagcgacctggaactgtgccgcgcccacatcgaaaggctgcagcaggaacctgatggggcaggtgctaaaagtcccacctgccagaagctctcgccaaaatggtgcttcctggacgctaccacagcgtcacgattctacaggatagatagagctcaggagcacctcaactacgttactgagatcgctcaggacgagatttacatcttggaccctgagcttctgggagccagtgcccgaccagacctgccaacacccacctctcccttacccactagcccctgctcacccacaccccggtcgctgcagggcgacgccgctcccccgcagggggaggagttaattgaagccgcaaaacgcaacgacttttgtaaacttcaagagttgcaccgagccggcggcgacctaatgcacagggacgaacagtctaggacattattgcatcacgccgtttcaacaggaagcaaggatgttgttcgctacctcttggaccacgcaccgcctgagatcctggatgctgttgaagagaatggcgagacatgtctgcaccaggctgcggccctgggccagcgcaccatatgccactacatcgttgaagccggagccagtctgatgaagactgatcagcagggagatacaccaagacaacgggcggaaaaggcacaggatacagaactggctgcctacctggagaatcggcaacattaccagatgatacagagagaggaccaagagactgccgtgtag

SEQ ID NO: 41817 - DNA, 2805 bp, Artificial Sequence
  Description of Artificial Sequence: Synthetic coding sequence
atggagccccgggacggcagccccgaggcccggagcagcgacagcgaaagcgcctccgcatctagttccggcagcgaacgagatgccggtcccgagcccgacaaggccccaaggcgccttaataaacgtaggtttcctgggctcagactcttcggccatagaaaggctatcactaagtccggactgcagcacctcgcccccccaccacccacacccggggctccatgctcggaatctgagcggcagatcaggtccaccgtggactggagtgagtccgccacctacggcgagcacatttggttcgaaaccaatgtgagcggcgatttctgttacgttggggaacagtactgcgttgctcgcatgctgcagaagtccgtgtctaggagaaaatgtgctgcctgcaaaatcgtggtgcatacgccctgtatagagcagttggaaaaaattaacttccgttgcaaaccaagttttagggagtccggatctcgcaatgtgagggaacccacgttcgttaggcatcactgggtgcatcgtcgtcgacaggacggaaaatgccggcactgcggaaaggggtttcagcagaagtttacgtttcacagtaaggaaatcgtagccatctcatgttcatggtgtaaacaggcataccatagcaaggtgtcatgcttcatgttacaacagatcgaggagccttgctctctgggcgtacatgctgccgtcgtcatccctcctacctggatcctgagggcccgaaggccgcaaaacactcttaaggcttcaaaaaaaaagaagcgcgcttcattcaaaaggaagtccagcaagaagggaccggaagagggtagatggcgcccctttattataaggcctactcccagcccacttatgaagccactgctcgtttttgtcaatcccaagagtggagggaatcagggcgcaaaaatcatacagtcttttctgtggtacctgaacccacggcaggtgtttgatctcagccaaggaggccctaaggaagctctggaaatgtatcggaaggtccacaatctacgaatcctggcgtgcggcggggatggcaccgtcggatggatcctgagtaccttggaccagcttagactgaagcccccacccccggttgctattcttccactggggactggaaacgacctggctagaacactgaactggggcggcgggtacaccgacgagcctgtgtctaaaatcctgtctcacgtcgaagagggcaatgtcgtacagctagaccgttgggatttgcatgctgagcctaacccggaagctgggcccgaggaccgggatgaaggggcaaccgacaggctgcctctggacgtttttaataactactttagcctgggctttgatgctcacgtgactctcgagtttcacgagtcgagagaagccaaccccgaaaaattcaattctcgtttccggaacaagatgttttatgccgggactgccttttcggatttcctgatgggaagttctaaggaccttgctaagcacatccgagttgtgtgtgatggaatggacctgacccccaaaatacaagacttaaagccacagtgcgtcgtctttctgaatattcctcgctactgcgccgggaccatgccatggggacatccaggagaacatcacgacttcgaaccgcagcgccatgatgatggatacctcgaggtaattggttttacaatgaccagcttagcggctctgcaggtaggtgggcatggcgagagacttacgcagtgccgggaggtcgtgttaactacctcaaaggctatacccgtgcaggtggacggtgaaccatgcaaacttgctgctagccgtatccgcatcgccctccggaaccaggccactatggtccagaaagccaagcggaggagcgccgcacctcttcactctgaccagcagcctgtgcccgagcagctgcggatacaggtctctcgtgtgtctatgcatgactatgaagccttgcactatgacaaagaacaacttaaggaagcttcagtgcccctcgggactgttgttgtccctggagattcagatctggagctctgccgtgcacacatagagcggctccagcaggaacctgacggagctggagcgaaatcgcctacatgccaaaagctgtcacccaaatggtgcttcctcgatgccacgacagcgtcgagattttaccgtatcgatcgcgcacaagagcacttaaattatgtcacagagattgcccaggacgaaatctatattctggaccctgaattgctgggtgcctccgctcgtccagacttacctactcccacgtctccgcttcctacatcgccttgcagcccaaccccgcgcagcctgcagggcgacgctgccccccctcagggcgaggagcttatcgaagctgccaagcgcaatgacttctgcaaacttcaagagttgcacagggccgggggcgacctgatgcatcgggacgagcagtctcgcaccctgttgcaccacgctgtgtccaccggctccaaagacgtggtaagatatctgttagaccatgcgccccccgagatcctggatgcagttgaagagaacccttgctctccatccggagagacgtgtctccaccaggccgcagctctgggacaaagaaccatctgccactacatcgtcgaggccggcgcctccctaatgaagactgaccagcagggagatacacctcgccaacgcgctgaaaaggcccaagacacggaattggccgcttacctcgagaatcgccagcattatcagatgattcagcgagaggaccaggagactgctgtgtag

SEQ ID NO: 41818 - DNA, 3495 bp, Artificial Sequence
  Description of Artificial Sequence: Synthetic coding sequence
atggccggcgccggcggccagcaccacccccccggcgccgccggcggcgccgctgccggcgccggcgctgccgtcaccagtgcagctgcctcggccggccctggcgaggattcctcagactcagaggcggagcaggagggaccccagaagcttatccggaaggtgtccactagcggccaaatcaggaccaagaccagcatcaaggaaggacagctcttgaagcagacgtctagctttcagaggtggaaaaagcggtacttcaaactgagaggccggacgctgtattacgccaaggactccaaaagtctgatctttgatgaggtcgacttatcggatgcttccgtggccgaagcctctacaaaaaatgctaacaattcttttacaattattactcccttcagacgactaatgttgtgtgccgaaaatcgcaaggagatggaagactggatctcttctctgaagtccgtgcagacacgggaaccgtacgaggtggctcagtttaacgtggagcacttcagcggtatgcacaattggtacgcttgcagccatgctcgccctaccttttgtaacgtgtgcagggagtccctgtcaggcgtgacttctcacgggctttcatgcgaggtgtgtaagtttaaggcccacaagagatgcgctgtgagggctacgaacaattgcaaatggactacgctagcgagcatcgggaaagacatcattgaagacgaagacggagtagctatgcctcatcagtggctcgagggtaacctcccagtgtctgcgaaatgtgcagtgtgtgataagacctgtgggtcagtgctgaggctgcaggactggaagtgcttgtggtgtaagaccatggttcataccgcctgcaaagatctgtatcatcctatctgcccacttgggcaatgtaaggtgagtattatcccccccatcgctctgaattccacggactccgacggcttctgccgcgccaccttcagtttttgtgtatcaccactcctggtgtttgtgaacagcaagagtggtgataatcagggcgtgaagtttctaaggaggttcaaacaactattaaatccagcccaggtgttcgacctcatgaacgggggcccgcatctgggcctgcggctgtttcagaagttcgataactttcgcattctggtctgtggaggggatgggtctgtaggatgggtgctttctgagatcgacaagctgaatctgaacaagcaatgtcagctgggggtactgccactcggcaccgggaacgaccttgcccgggtcttgggctggggaggctcctacgacgatgacactcagctacctcagattttagagaagctggagagagcttctacaaaaatgctcgaccgctggagcataatgacctatgagctgaagctaccacccaaggcaagcctcctgcctggaccgcctgaggcaagtgaggaattctatatgacaatctatgaggattcagtcgccacacatctcaccaagattctcaattccgatgagcacgcagtagtgatttcgagcgccaaaaccttgtgcgagactgtcaaggatttcgtggctaaggtcgagaagacttatgacaagacgttggagaatgccgtcgtcgcagatgctgtggcttccaaatgctctgtactcaatgaaaaactggagcaacttctccaagcccttcacactgactcccaggctgcaccagttctgccggggctcagtccgctcatcgtagaagaggatgccgtggaatccagctcagaagaaagtctcggagaatccaaagagcaactaggcgacgatgtgaccaagccaagttcacagaaggccgttaagccacgcgaaattatgttgcgagcgaacagcctgaaaaaggccgtgcgccaggtcattgaagaggccggcaaggttatggacgacccaacagtgcatccctgtgagcccgcgaatcagtcaagtgactacgatagtaccgaaaccgatgagagtaaagaagaggcaaaggacgacggagctaaggaatctatcaccgtgaagacagcaccacgatctcccgatgccagggccagctacggacattcacagacagattccgtccctggccctgctgtagcggcttccaaggaaaatctcccagtgcttaacaccagaatcatctgtccaggactcagggcagggctcgccgcgtccatagcgggatcctccatcatcaataaaatgctgctggctaatatagatccattcggcgctaccccctttattgatcccgacctcgattctgtcgacggctattctgagaaatgtgtgatgaacaactattttgggattggactggacgccaaaatttccctcgaatttaataacaagcgcgaggagcatccagaaaaatgccgctcaagaacgaagaatctgatgtggtatggagtgctgggaacgcgagaactgcttcagcgtagttacaaaaacctcgaacagcgcgttcagctggagtgtgatgggcagtatatccctctgccaagcttacaaggcattgccgtgttgaacattccatcctacgcggggggcacaaacttttggggaggcacaaaggaagacgatatattcgctgccccgtcgtttgatgataagattctcgaggtggtagcaatattcgactcgatgcaaatggcagtttcccgagttatcaaactacagcaccatcgaatagctcagtgtaggacagtgaagataaccatatttggtgatgagggggtcccagtgcaagttgatggcgaggcctgggtccagccaccaggaattataaagatcgtccacaagaatcgggcccagatgctcactagagaccgggccttcgagtccacgctcaaatcctgggaggacaaacaaaaatgcgactccggtaagcccgtacttaggacacacctctacatccaccacgccatcgatctggccactgaggaggtcagccagatgcaactctgttcacaggccgcagaagagctgatcactaggatctgcgacgccgcgaccattcattgtctcctggagcaggagctggctcatgccgtgaacgcctgctcccatgcactaaataaagcgaatcccaggtgccctgaatcactgactagagacaccgctactgagatagccatcaacgtgaaggctctctacaatgagacagagtccctgctggtgggacgggtgccactgcagttggaatccccacacgaggaacgcgtatcaaacgccctgcatagcgttgaggtagagctccagaagctcaccgagattccgtggctttactacatactgcatcccaacgaggatgaggaaccaccgatggactgcactaagagaaataaccgctccaccgtgttcagaatcgttcctaagttcaaaaaggagaaggttcagaaacagaaaacaagcagccagcccggttccggagacacagaatcagggtcgtgcgaggccaactcaccagggaattag

SEQ ID NO: 41819 - DNA, 3663 bp, Artificial Sequence
  Description of Artificial Sequence: Synthetic coding sequence
atggccggcgccggcggccagcaccacccccccggcgccgccggcggggcagccgctggcgctggggcggctgttacatcagccgccgcctcagcaggacctggtgaggattctagtgacagtgaagccgagcaggaaggccctcagaaactgataaggaaggtgtcgacctcagggcagatccggactaagacgtccatcaaagaaggtcagcttctcaaacagacgagcagcttccagcgttggaagaagcgctacttcaagttgcggggccgtaccctgtactatgccaaggacagcaaatcactcatttttgacgaagtcgatctgtctgatgcctcagtggcggaagctagcactaaaaacgccaataattccttcactatcatcacaccattccgaagactcatgttgtgcgcagaaaatcggaaagaaatggaggactggatttcctctctgaaatcagtgcagacgcgagagccctatgaagtggcccagttcaatgttgagcattttagcggcatgcataactggtacgcctgctcccatgctagacctacattttgcaacgtatgtcgtgaatccctatcaggcgtaacttcacatggcctgagctgtgaggtgtgtaagttcaaggcacacaagcgctgcgccgtgagggcgactaataattgcaagtggacaaccctggcgtcaatagggaaggatattatcgaggatgaagatggtgtcgctatgccacatcagtggctcgaagggaatcttcccgtgtccgcaaagtgtgctgtctgcgataagacgtgtggatcggtgctgaggttacaagactggaagtgcctgtggtgcaaaaccatggtccacacagcctgtaaggacctgtaccatcccatctgtccgctcggtcaatgcaaggtatcaattatccctcctatcgcacttaacagcacggatagtgatggcttctgtcgcgcaaccttcagcttctgcgtgagccctttactggtcttcgtgaactccaaaagcggagataaccaaggggtcaagttcctgcgtcgatttaagcagctgttgaatccagcacaagtgtttgacctcatgaacggaggaccacacctaggcctgaggctgttccaaaagtttgacaatttcaggatcttagtgtgtgggggggacggttctgttggctgggtactgtcagagatcgataagcttaatctgaataagcagtgtcagctcggcgtactgcccctcggtacagggaacgatctcgcccgcgtcctcggctgggggggctcctatgacgatgacacgcagctgccccagatactagaaaagctggaaagggccagcactaagatgctggacaggtggagcataatgacatacgagctcaaacttccacctaaagcctctctgctgccaggacctccagaggcaagcgaggaattctacatgacgatttatgaggattccgtcgcgacccacctcacaaaaattctcaactctgatgagcatgccgtggtgataagctctgctaaaactctctgcgagactgttaaggactttgtggccaaggtggagaagacatacgacaaaactctcgaaaatgctgtggtggctgatgccgttgcaagtaaatgctcggttctgaatgagaagctggagcaacttttgcaagctctccacaccgattctcaggctgctcccgtgctcccagggttgtcaccactcattgtggaggaggatgccgtcgaaagtagttcagaggagagtctaggagaatccaaggagcagttaggggacgatgtgactaaaccgtcgagccagaaggctgtcaaacccagagaaattatgctgagagcaaatagtctgaagaaggccgtcagacaggttattgaggaggcagggaaagtgatggacgatcccaccgtgcatccctgtgagcctgctaatcaaagtagtgattacgacagtacagaaactgatgaatccaaggaggaagccaaggatgatggggcgaaggagtccattactgtgaagactgccccgcgctcccccgatgcccgagcatcttatgggcattctcaaacagacagcgtacctggccctgccgtggccgcgagcaaggagaatctcccagtgttgaacacaagaattatctgtcccggcctacgagccggcctggccgccagcatcgccgggtcgtcaataatcaacaagatgctattagccaacatcgatccatttggtgcaacaccattcatcgatcccgatcttgactctgttgacggatacagtgaaaaatgtgttatgaacaattactttggcatcggactcgatgctaagatcagcctcgaattcaacaacaagagggaagaacaccccgagaagtgccggagtaggaccaagaacctgatgtggtacggcgttctgggaacacgcgagctcctccaaaggtcctataaaaatttggaacagagagtccaactcgaatgcgatggacagtatatacctctgccttcactccaaggtatcgctgtgttgaatattccttcctacgcaggaggtacaaacttctgggggggcactaaggaggatgatattttcgccgcaccgagttttgacgataaaattctcgaggtggtggctatttttgactcaatgcagatggccgtatccagagtgattaagctgcaacatcacaggatcgcgcagtgccgtacggtgaagattacaatctttggtgatgaaggcgtccccgtgcaggttgatggtgaagcttgggtgcagccaccagggatcattaagatcgtacataaaaatcgcgctcagatgctaactcgcgatagagcttttgaaagtaccctgaaaagttgggaggacaagcagaaatgtgactccgggaagccagtcctgcggactcatttatacatacatcatgccattgacctcgcaactgaggaggtcagtcagatgcagttgtgttcacaggcagccgaagaattgatcactcgcatctgtgacgccgcgacaatccactgcctgctcgaacaggaactcgcacacgctgtcaatgcttgtagtcacgcgttgaacaaggccaatccccgttgccctgaatccttgaccagggatacggctacggaaattgccataaatgtgaaagctctttataatgaaacagagtcactcctcgtaggcagggtccctctgcagctggaaagcccccacgaagagcgggtgtctaatgcactgcacagcgtcgaggttgaactccagaagctcacagaaatcccttggctgtactatattcttcatccaaatgaagacgaggaaccccccatggactgtacgaagaggaacaatcgctctacagtctttagaatcgtaccgaaattcaagaaggaaaaagtccagaagcagaagacatcctcgcaaccagtgcagaagtggggaacagaggaggtggcagcctggctggacttactgaacctcggcgagtacaaagatatcttcataagacacgacatccgaggtgcggaacttctccatctggaacggagggatctgaaggatttaggaatcccaaaggtggggcacgtcaagcgaattttacagggaattaaagaactgggcaggagcactccgcaaagtgaagtgtag

SEQ ID NO: 41820 - DNA, 3303 bp, Artificial Sequence
  Description of Artificial Sequence: Synthetic coding sequence
atgctgtgcgccgagaaccggaaggagatggaggactggatcagctctctcaagtcggtgcaaacacgggaaccttatgaagtggcccagttcaatgtggagcacttcagcggcatgcacaattggtatgcctgtagccacgctcgacccactttttgtaacgtgtgtcgcgagtctctgtctggggtaacatctcatggcctgagctgcgaagtttgtaaattcaaggctcataaaaggtgcgccgtgagagccactaataattgcaaatggaccaccttggctagcatcggtaaggacatcatcgaagatgaagacggcgtcgcgatgccacatcaatggctggagggaaatcttcccgtctcagccaagtgcgccgtgtgcgataagacatgtgggagtgtgctgcgtctgcaagactggaagtgcctgtggtgcaagacaatggtccatacggcctgcaaagacctgtatcaccctatatgcccattgggccagtgtaaggtgtccatcatcccccctatcgctcttaattctacggactcagatggattctgtcgggcaaccttttctttttgtgtgtcacctctcttggtgttcgtaaattcaaagagcggcgataaccagggcgtgaagtttttacgccggttcaagcagctgttgaaccccgcacaagtgttcgacctcatgaacggtggcccgcatctgggcttaagactgtttcaaaagtttgataactttagaattctagtctgcggaggggatggctctgtggggtgggtgctttcggagattgacaagctgaacctcaacaaacagtgtcagctcggagtgctccccctaggaacaggcaacgacctggctcgggttttgggctggggcggttcctatgacgatgatacccagctgccacaaattctggagaaacttgagagggctagcacgaagatgctggatcgctggtctatcatgacctatgagctgaaactccccccaaaagcctccctcctacccggtcctcccgaggcttccgaagaattctatatgactatatatgaggattcagtagccacccacctgactaaaattttaaattctgatgaacatgcggtggtgatctccagcgcaaagacactctgtgagaccgtgaaggacttcgtcgctaaagttgagaagacatacgataagaccctagagaacgctgtggttgccgacgcggtagcttctaagtgttccgttctgaacgagaaactggagcagctcttgcaagcacttcacacggactcccaagccgcccccgtactacccggactgtccccactaattgtcgaagaagacgcggtggaatcctcttccgaggagtccctcggcgagtcgaaggaacagttaggtgacgacgtcacaaagccgtccagtcagaaggccgtgaagccaagagagataatgttacgggcgaactccctcaaaaaggctgtccgacaagtgatcgaggaggctgggaaagtgatggacgaccctaccgttcatccttgcgagcctgccaatcagagcagcgattatgatagtactgaaacagacgagagtaaggaggaagccaaggacgatggcgccaaagagtcaatcactgtgaaaacagccccacgatcgcccgatgctcgagcatcatatggacactcacagaccgatagcgtaccaggacctgcagtagccgcttccaaagaaaacctgccagtgctcaataccaggatcatctgccctggactgcgtgccggcttggccgcaagcatcgctggttcatcaatcatcaataagatgctgttagccaatattgacccctttggcgctacaccatttattgatccagacctggattccgtggacggatactccgagaagtgcgtgatgaataactattttggaattgggctggacgctaagataagcctagaattcaataacaaacgagaggaacacccagaaaagtgtaggtcccggaccaagaatctgatgtggtacggagttctcggcactcgcgaacttttgcagaggtcatacaagaatctggaacagcgagttcagctagaatgtgatggacagtacattccacttcccagtctgcaaggtattgctgtactgaacatcccctcttatgcaggcggaactaacttttgggggggaacaaaggaagatgacatattcgccgctcccagcttcgacgacaaaatcctcgaggttgtcgctatctttgactctatgcaaatggcagtttcaagggtgattaaattacagcatcacaggatcgctcagtgtcggacggtcaaaattacaatattcggtgatgagggggtgccggtccaggtcgacggggaggcctgggtgcagcctcctggcataattaagatcgtgcacaaaaaccgcgcccaaatgctcactcgcgacagagctttcgagtccaccttgaagagttgggaggacaaacagaagtgcgattccggaaaacctgtcctgcgaacacatctatacatccatcatgccatcgatttggcaacagaagaggttagccagatgcagctatgcagccaagccgccgaagaactcattaccaggatatgcgatgctgcaactatccactgtctcttggagcaggagctggcccatgctgtgaatgcatgctcccatgcactgaataaagctaatcctagatgtcccgagtcactaacccgggataccgccaccgaaattgccataaacgtgaaagctctgtacaacgagacggagtccctactggtgggtcgagtcccattacaactggagtcgcctcacgaggaaagggtctctaatgccttgcattctgttgaagtggaacttcagaagttaactgagattccctggctgtactacattctccaccccaatgaggatgaggagcctccaatggattgcactaaaagaaataacaggtcaaccgtgtttaggattgtgcccaagtttaaaaaggaaaaggtgcagaagcagaagacttcgtcacaacccgttcagaagtgggggactgaagaggtcgccgcttggctggatctccttaaccttggtgagtacaaagacatattcatacggcatgacatccggggagcggaactgctgcatctggagaggcgcgacctcaaaaataccgttggagagaagcgagatacaaaagagaacggaaagcacatggacttggggattcctaaagtaggccacgtcaaacgcatattacagggtattaaagagctgggaagatccactccgcaaagtgaagtatag

SEQ ID NO: 41821 - DNA, 3255 bp, Artificial Sequence
  Description of Artificial Sequence: Synthetic coding sequence
atgctgtgcgccgagaaccggaaggagatggaggactggatcagcagccttaaaagcgtacagacccgtgagccctacgaagtggcacagtttaacgtggaacatttcagcggcatgcacaactggtacgcctgcagccacgcaaggccgactttttgtaatgtgtgccgcgaaagcttgtcaggcgtgacatcccacggactgtcttgcgaagtctgtaagtttaaggctcacaaacggtgtgccgttcgtgcaaccaacaattgcaaatggacaacgctggcttctattggcaaggacatcatcgaggacgaggatggggtcgcaatgcctcatcagtggctggaaggcaacctgcccgtgagcgcgaagtgcgccgtttgtgacaaaacgtgcggatccgttctgcgactgcaagactggaagtgcctgtggtgcaagaccatggtccacaccgcatgcaaggacctgtatcaccctatctgtcccttgggccagtgcaaggtgagcatcatccctcccatcgcattgaattctacagacagtgacggcttctgcagggcaacattctccttttgtgtgtctcccttactggtatttgtgaactcaaaatcaggagacaatcagggcgtgaagtttcttaggcggttcaagcaactccttaatcccgcgcaagtgtttgatctgatgaacggcggcccacacctcggcctgaggctctttcagaagttcgacaactttaggattctggtgtgcggtggagacggcagcgtcggctgggtgctcagcgagatcgacaagcttaatctcaataagcaatgtcagctgggggtgctgccactaggaacaggaaacgaccttgcccgagtgctgggctggggcgggtcatatgatgacgacacacagttgccacagatcttagagaaactggaaagagcctccactaaaatgctcgaccgctggtccatcatgacctacgaactgaaactgccccctaaggcctccctcctgcccggcccacccgaagccagtgaagagttctacatgacaatctatgaagacagcgtggccacccacctcaccaagatcctgaactccgatgagcatgctgtggtgatttcatctgccaagactctttgcgagacagttaaagacttcgtcgccaaggtggaaaaaacatatgataaaacactggagaatgccgtggtagctgacgctgtcgctagcaagtgctccgtccttaatgaaaagctggaacagctcctccaggcacttcatactgacagccaagccgcacccgttctgcccggcctgtcaccactgattgtagaggaagatgctgttgaatctagttcagaagagagcctgggggagtctaaggaacagcttggcgatgatgtcacaaaacctagttctcaaaaggccgtgaaaccacgtgagatcatgctgagggccaacagtcttaaaaaagccgtaagacaggttatcgaagaggccggcaaagtcatggacgaccctacggttcatccatgcgaacccgccaaccagtcttccgattatgactccaccgaaacagacgaatcgaaagaagaggctaaagacgacggggcaaaggagagcattacagtgaaaacagctcctaggtcacctgacgccagagcttcttacggccactcacagaccgactcagtcccaggccccgccgtggctgcctctaaagaaaatcttccggttctaaacacgcggataatatgcccaggtctccgggctggcctggctgcatcgatcgccgggtcaagtattattaacaagatgctgctggctaatattgatccatttggagccacccccttcatagatccagacttggactccgtggatggttattcagagaagtgtgtgatgaacaactattttggaatcggccttgacgcaaaaatctctcttgagttcaacaacaaacgcgaggagcacccagagaagtgtagatctcgaactaaaaatcttatgtggtacggcgtgcttggcacacgggagctgttgcagcgtagctacaaaaacctggagcagagagtccagctggaatgtgatggtcagtatattcccttgccctccctgcagggaatcgcggtgcttaacataccctcatatgccgggggtacgaatttttgggggggcacaaaagaggatgacattttcgcggcaccaagttttgatgataagatcctggaggtggttgcgattttcgactccatgcaaatggccgtttctcgagtgatcaagctgcagcaccaccgaattgcacagtgtcggacggtaaaaatcactattttcggagatgagggtgtcccagtacaggtggacggggaagcctgggtacagcccccaggaattataaagattgtccataagaacagagcccagatgctgactagggatagggcctttgaatccaccctcaagagttgggaagataagcagaaatgtgactctggcaaacctgtactgcgcacgcacctgtatatccatcatgccatcgacctcgccacagaagaagtaagtcagatgcagctttgttctcaggcagccgaagaattaatcactcggatttgtgacgccgccacaatacactgcctgctcgaacaagaactggcacacgccgtgaatgcttgtagccacgcgctgaacaaggcgaacccccgatgccccgagtctctgacaagagacacagctacggaaatcgcaatcaacgtcaaagccctgtacaatgaaacagaatccctgctggtcggacgtgtgcccctacagctcgaaagtccccatgaagagagagttagcaatgctctgcacagtgtagaggtggagctccaaaagctcaccgaaatcccttggttgtattacatcctgcacccgaacgaggatgaagagcccccaatggattgcacgaaacgcaataaccgatccaccgtgttcaggattgtgcctaagttcaagaaggagaaggttcaaaagcagaaaacttcctcccagcctgtccagaagtggggaacagaggaagttgccgcctggttggatctgctcaatttgggtgagtacaaagacatcttcatccggcacgacatcaggggcgccgaattgcttcatctagagagacgtgatcttaaagaccttggcatacccaaggtgggccacgtgaagaggattctgcagggtattaaggaactcggtcggtctacccctcagtcagaggtgtag

SEQ ID NO: 41822 - DNA, 2760 bp, Artificial Sequence
  Description of Artificial Sequence: Synthetic coding sequence
atgtggaacatcagccagggctgcaccaccggcacccccgcccccaccccagacccccctagtgtgacttgcgccgagcgagttttcctcgaaagccctcccatggcttgccccgccaaggtgcacactgcttgcaaagatctttaccatccaatctgcccactggggcagtgtaaggtcagtatcatccctcccatcgcactcaactctacggattctgacggcttctgtagagccacgttcagtttctgtgtgtctcctctcctagttttcgtaaactctaagagcggcgacaaccagggcgtaaagtttcttcgtcggttcaaacagttgctgaaccccgctcaggtcttcgatctgatgaacggaggccctcacctgggcctacggcttttccagaagttcgacaattttcgcattctggtgtgcgggggggatggctccgtagggtgggtactctccgaaatcgataaattaaaccttaacaagcagtgccagcttggggttctgcccctcggtactggcaacgacctcgcgcgagtgctgggatggggcggatcttatgatgatgacacacaattgccacagatcttggaaaagcttgagagggccagcaccaaaatgctggatcgctggagcatcatgacctatgagctgaaactgcccccaaaagcatccctgcttccaggccctcctgaagcgtctgaggaattctatatgactatatacgaggacagtgtcgctacacacctgaccaaaattctgaattccgacgaacacgctgtggtcatttcatctgctaaaacattatgtgaaacagtcaaagattttgtggcaaaagtagagaagacctacgacaagaccctcgagaatgcggtggtggcggatgcagttgcttcgaagtgttctgtgctcaatgaaaaactggagcagttgcttcaagcattgcatacagattcccaggccgcccccgtgctccctggtctttcacctttaatcgtggaggaggacgccgtggagtcaagttctgaggaatcacttggcgaatcaaaagagcagcttggggatgatgtgacaaaaccatcaagtcagaaagcagtcaagccaagagaaataatgctcagggccaatagcctgaagaaggctgtgaggcaggtaatcgaggaggctggtaaagtgatggacgaccccactgtgcatccttgtgagccagcgaatcagagtagtgactacgatagtaccgagactgacgagtctaaagaggaagccaaagacgatggtgccaaagagtccatcactgttaaaactgccccgcggtctccggatgcacgtgcctcctatgggcattctcagactgactctgtgcctgggcctgctgtggccgcatctaaggagaacctgcccgtcctaaatacacgaattatctgtcccggactaagggccggtctggcagctagcatcgccggtagttctattattaacaaaatgcttctcgcaaatatcgacccgtttggcgccaccccatttattgaccccgacctggacagtgtggatggatattctgaaaagtgtgtcatgaataattattttggcataggcctggacgcgaagatttcactagagttcaacaacaaaagggaagaacatccggagaaatgccgaagtaggacaaagaatctgatgtggtacggcgtcctaggtaccagagagcttctccagcgcagctataaaaatctagagcagcgtgtgcaattggaatgtgatggacagtacattccactgccgagtttacagggcatcgcagtcctcaacatcccctcgtacgctggtggtacaaatttttggggtggaacaaaggaggacgatatctttgcggccccttcattcgacgataagatccttgaagtggtggctatcttcgattcgatgcagatggctgtttccagagtgataaagctgcagcaccatcgcatcgcccagtgcaggaccgtgaagataacaattttcggtgatgagggagtgcctgttcaggttgacggcgaggcctgggtccagccacctgggatcattaagattgttcataaaaatcgagcacagatgctgacccgcgatcgcgcattcgagagtactctgaagagctgggaggacaagcagaagtgtgacagcgggaaaccagtcctacgcacccacttatacattcatcatgcaatcgaccttgctacagaggaggtgtcccagatgcaattgtgttctcaagcggcggaagagctgatcacacggatatgtgacgctgctaccatacactgccttcttgagcaggagctggcacacgcggttaacgcatgttcacacgcacttaacaaagccaacccgcgatgcccggagagtctcacccgcgatacagccaccgaaatagccattaacgtgaaggccctttacaatgaaacggagtccctgctcgtaggtcgggtgcccctgcagctggaatctcctcacgaggagagagttagtaacgctctgcactcagtagaggtggagctacagaagctgacagaaattccttggctgtattacatactgcatcccaatgaggatgaggaaccgcctatggactgcaccaagcgaaacaaccgatccaccgtcttccgcatagtgcccaaattcaaaaaagaaaaggtgcagaaacagaaaacttcttcacaacccggatctggcgacactgagtcaggcagttgcgaggctaatagtcctggcaactag

SEQ ID NO: 41823 - DNA, 3495 bp, Artificial Sequence
  Description of Artificial Sequence: Synthetic coding sequence
atggccggcgccggcggccagcaccacccccccggcgccgccggcggagctgcagccggcgctggtgctgcagttacatctgccgcggcttctgccgggcccggtgaggattcctcagatagtgaagctgaacaggagggaccacaaaagctgattcggaaagtcagcaccagcgggcagattcgaactaaaacaagcataaaagaaggccagctgctgaagcaaacttcaagctttcaacggtggaaaaagcgatactttaaactgagaggtcgcacgctctactatgctaaagactctaagagcctaatattcgatgaggtcgacctgtccgacgcctctgtggctgaggcatctaccaaaaatgcaaataacagctttactatcattacgccgttccgacggttgatgctgtgcgccgagaaccgcaaagagatggaagactggatttcttctctgaagagcgtgcagacacgagagccatatgaagttgctcaatttaacgtggagcatttctccggcatgcacaattggtacgcatgtagtcacgcccgacccacattctgtaacgtgtgccgtgaaagtctgtcaggggtgacctctcacgggctgtcctgcgaggtttgtaagttcaaagctcataagcggtgcgctgtcagggccaccaacaattgtaaatggacgacgctcgcttccattggaaaggacatcatagaagatgaggatggtgttgctatgcctcaccaatggctggaagggaacctgcccgtgagtgccaagtgtgcagtttgtgacaagacctgtggctctgtgcttaggctgcaggattggaaatgtctctggtgcaagaccatggtccacaccgcctgcaaagacctttatcatccgatatgcccactaggacagtgcaaggtgtctatcattccccctattgcacttaatagtacagatagtgatggtttttgtcgggccacattttctttttgtgttagtcctttgctggtatttgtgaacagcaagtctggcgacaatcagggcgttaagttcctccgacgcttcaaacaattgcttaatcctgcccaggttttcgacctaatgaatggcggcccgcatctggggctgagactgttccagaagtttgacaacttcagaatcttggtttgcggcggcgatgggagtgttggatgggttctaagcgagattgataagcttaatttgaacaagcagtgccagttaggtgtgctgccactgggtaccggaaatgatctggcacgggtgttggggtggggtggaagctacgacgacgacacacagctgcctcagatattggaaaagctggagcgcgccagtaccaagatgttggacaggtggagtattatgacttacgaacttaagcttccccctaaagcgtccttacttcccgggccccctgaagcgtctgaggagttttacatgaccatctatgaggactctgtggccacccatctgactaaaatcctcaatagcgatgagcacgccgtggtaatatcttccgccaaaacgctttgtgagactgtgaaagacttcgtagcgaaggtggaaaagacttacgacaaaacattagagaacgccgtcgtggccgacgccgtggcctctaaatgtagtgtgctgaacgagaagctagagcagttgctgcaagcactgcacacggacagtcaagccgcccccgtcctgcctgggctgtcccccctgatcgttgaagaagatgccgtggagagctccagcgaagaatccctgggggaatcgaaggagcaactcggagacgatgtaaccaagcccagctcccaaaaagccgtgaagccccgggaaatcatgttgcgcgctaactccctcaaaaaagccgtgagacaagtcatagaagaagccggaaaagtaatggatgacccaacagtgcacccctgtgaacccgctaatcagagctccgattatgactcaaccgagaccgacgaatccaaagaggaagcgaaggacgacggcgctaaggagtcaattacggtgaaaacagctccaaggagcccagatgctcgggcctcctacggacacagccagactgactccgttccgggccccgcagtcgccgcaagtaaagagaatcttccagtgctgaacactaggattatatgtccgggactgagggctggcctcgccgctagcatcgccggaagcagtatcataaataagatgctccttgctaacatagacccattcggagcaacgccatttattgacccagatctggattcggttgacgggtacagcgagaagtgcgtgatgaataactactttgggatcggcctggacgcgaagataagccttgagtttaataataaacgcgaggagcacccagaaaagtgtcgctccaggacaaaaaatctcatgtggtacggcgttcttggcacgcgtgagctgctacaaagatcctacaaaaacctcgagcagagggtacagctcgaatgcgacggacagtatattccacttccatccctgcaggggatagccgttctgaacatccccagttatgccggcggaaccaatttctggggcggaactaaagaagatgatatatttgccgcaccttcttttgatgataaaatcctcgaggtggtggctattttcgactcaatgcagatggctgtgtccagggtgattaaactgcagcatcatcggatcgcgcagtgccgcactgttaagatcacaatctttggagacgagggcgtgcccgttcaggtggatggcgaggcatgggtgcaacctcccggcattattaagatcgtgcataaaaatagagcccaaatgctgacgagggatagagccttcgagagtaccctgaaatcttgggaggacaagcagaagtgcgacagcggcaagcccgttctcagaacccatctgtacattcatcatgccatcgatctcgcgaccgaggaggtaagtcagatgcagttgtgcagtcaagcagccgaagaattaatcactcggatctgtgacgcggcgacaattcactgcctcctagagcaggagctggcccatgccgttaatgcgtgcagccacgcactgaataaagccaacccgagatgcccagaatccctgacccgtgatacggccacagagatcgccattaacgtcaaggctttgtataacgagaccgagtccctgttggtgggaagagtgcccttgcagctcgaatccccccacgaggagcgcgtgagtaatgccctgcactccgtcgaagtcgagttgcagaaactaactgagatcccctggctttactatatcctccacccaaacgaagatgaggaaccaccgatggattgcaccaaaagaaacaacaggagcaccgtatttcggatcgtccctaagttcaagaaagaaaaagtgcagaaacaaaaaaccagctcccaacccggaagcggtgacacagaatcgggaagttgtgaggcgaacagcccaggaaactag

SEQ ID NO: 41824 - DNA, 2721 bp, Artificial Sequence
  Description of Artificial Sequence: Synthetic coding sequence
atggagccccgggacggcagccccgaggcccggagcagcgacagcgagagcgcaagtgctagttcaagcgggtcggaaagagatgcagggcccgaacccgataaggcacctcggaggctgaataaaagaaggttccctggcctgaggttattcgggcaccgaaaggccataactaaatcaggtcttcaacatctggcaccaccgcctccaacgccaggcgccccgtgttctgagagcgaacggcagatcagatctactgtggactggagtgagtccgccacctacggggagcatatttggttcgagaccaacgtatcaggcgatttctgttacgtgggcgagcagtactgtgtagcaagaatgctgcagaaaagcgtgagccggcgaaagtgtgctgcttgcaaaatcgtggtccatacaccctgcatcgagcagctggagaagatcaattttcggtgtaagccctctttcagggaatcaggatccagaaatgttcgggaaggctttcaacaaaaatttacattccacagtaaagagatagtggccattagttgcagctggtgtaagcaagcttatcactccaaggtgagttgtttcatgttgcagcaaatcgaggagccatgttcgttaggggttcatgccgccgtcgttattccacctacatggatcttgcgggcaagacgccctcaaaatacactgaaagcctcaaagaagaagaaacgggcatccttcaaaaggaagagctccaaaaagggacctgaggaaggacgttggcggcccttcattataagaccaacccccagcccgcttatgaagcctctcttagtatttgtgaatccaaagagcggcggaaatcaaggggcgaagattatccagagttttctctggtacctgaatcctaggcaggtgttcgatttatcgcagggcgggccgaaggaggctctagaaatgtaccgcaaggtgcataacctgagaattttggcatgcggaggagacggaacggtgggctggatccttagcacgctcgatcagctcagactaaagcccccgccacctgtcgccatcctcccactgggtactgggaatgatcttgcgcggacattaaactggggcggaggctatacagatgagcctgtgagcaagatactgtcccatgtggaggaagggaatgtggtccagttagaccggtgggatttacacgcagagcctaatcccgaggctgggccggaagacagggatgaaggcgccaccgatcgccttcctctcgacgtcttcaataattatttctccttaggctttgacgcccatgttaccctggagttccatgaatcccgggaggctaaccccgaaaagttcaactcaaggtttcgcaacaagatgttttacgcaggaactgcgttctccgactttttgatggggagctccaaagatctggccaagcatattagagtggtctgcgacgggatggatcttacacctaaaattcaagacctgaaaccacagtgcgtcgtatttttaaacatcccacggtattgtgccggtaccatgccttggggacatcccggagagcaccacgacttcgagccacaacgacatgacgatggctacctggaagtaattggattcacaatgacgtctttagcagcattacaggtcggcgggcatggggaacgcctgacccagtgtcgggaagtcgtgctcactaccagtaaagctattccagtccaagtggatggggaaccatgtaaactggctgcctcccgtatccgaatcgctttgcgcaaccaggcaaccatggtccagaaggcgaagcggagaagcgccgcccccctccattcggatcagcagcccgtcccagaacaacttcgcatccaggtaagcagagtctccatgcatgattacgaagctttacactatgacaaggagcagctgaaggaagcgtctgttccactgggtaccgtcgttgttccaggcgactccgatctagagttgtgccgagctcacatcgaacggctccagcaggagcctgacggtgctggagctaagagtcctacttgtcagaagctgtcacccaagtggtgtttcctggatgctactaccgccagtaggttttacagaattgatcgcgctcaggagcacttgaactacgtcactgaaattgcacaggatgaaatttacattctggaccctgaactgttgggagcgagtgcaaggcctgacctccccaccccaacatctcctctcccaaccagtccctgctccccaactccacgctcccttcagggggatgctgcccccccacagggcgaagagctgatcgaagctgcaaaacggaatgacttctgtaagctccaggaactgcatcgcgcaggaggcgacttgatgcaccgggacgagcagtcacgaacactgttgcatcacgctgtctccacaggctcaaaagatgtggtgcgttacttactcgaccatgcacctcccgagattctggacgccgtggaagaaaatggggaaacctgcttacatcaggcagccgccctagggcagcgcaccatatgtcactatatcgtagaagctggcgcttctcttatgaagaccgatcagcaaggggatacacccagacagagagcagaaaaagcccaagacactgaactggccgcctatttggagaatcgccaacactaccagatgatccagcgggaggatcaagaaacggcagtgtag

SEQ ID NO: 41825 - DNA, 2688 bp, Artificial Sequence
  Description of Artificial Sequence: Synthetic coding sequence
atgtggcggtaccggagctgggacgtgccccagatccccagcgaggcccctcagacccaaaaggctatcacaaagtctggccttcagcatttagctcccccaccaccaacaccaggggctccatgttccgaatctgagcggcagatacgctctaccgtcgactggtctgaatcagccacctacggagagcatatatggttcgagacaaacgtctccggagatttttgctacgttggtgagcagtactgtgtggccaggatgctccaaaaatctgtaagtaggaggaaatgcgccgcctgcaagatcgtggtacacaccccctgcatcgagcagctggagaagataaactttaggtgcaagccttcatttcgggaaagcggcagcaggaatgtgcgagagcctacctttgtgcgccatcattgggttcacagaaggaggcaggatgggaaatgccggcactgcggaaagggattccagcagaaattcactttccattcgaaagaaatcgttgcaatttcatgtagttggtgcaagcaggcctatcacagcaaggtcagctgtttcatgctccagcaaatcgaggagccctgcagcctgggagtccacgctgcggtggtcattcctccgacttggatcctacgcgcccggaggcctcagaacacattgaaagcgtctaagaaaaagaagagagcctcctttaagcgaaagagctccaaaaaaggcccagaagagggaagatggcggccatttataattagacccacgccgtcgcctctgatgaagcctctcctggtattcgtaaacccaaagagcggtggcaaccagggggctaagattatccagtctttcctttggtacctgaacccgagacaggttttcgacctttctcagggtggcccgaaggaggctcttgaaatgtataggaaagtgcacaacctgaggatccttgcctgcggcggagacggaacggtaggctggattctttctactctcgatcagctgaggctcaagccacccccacccgtcgcaattttacccctcggcactggcaatgatcttgctcggaccctcaactggggtggcggatacaccgacgagccagtctctaagatcctgtctcacgtggaggagggaaatgttgtgcagttggatcgttgggatctgcatgccgagcccaacccggaagctggaccggaggatcgcgatgaaggcgccacagaccgtctgcctttagacgtcttcaacaactattttagtctcggatttgacgctcacgtaaccctggagttccacgagtcccgtgaggccaaccccgaaaagtttaactccagatttcggaacaaaatgttttatgcaggaaccgccttcagtgattttctgatggggtccagcaaggatctcgcgaagcatatccgcgtggtatgtgacggcatggatcttacaccaaagatccaggatcttaagccacaatgtgtggtttttttgaacataccccgatattgtgcgggtactatgccatggggccaccccggagaacaccacgattttgaaccccaacgccatgatgatggctaccttgaggtgatcgggtttactatgacttccctcgccgcactccaggtcggtggacacggggaacgattgacgcaatgtagggaggtcgtgcttacgacatctaaggccatccccgttcaggtggatggagagccctgcaagctcgcggcatctcggattaggattgcccttagaaaccaggctactatggttcagaaggcgaagaggcggagcgcggccccactgcactccgaccaacagcccgtcccagagcagctgagaatccaagtgtccagagtctccatgcacgactatgaggcgctgcactatgacaaagagcagctgaaagaggcgtctgtgcctctgggcacggtagtagtgccaggcgacagcgacctggaattgtgtagagcgcacatcgagcgcctacagcaagagcctgacggtgcaggcgctaagagcccaacttgtcagaagctgtctcctaaatggtgctttttagatgctaccaccgccagccgtttttaccgtattgatagagcgcaagaacatcttaactacgtaaccgagatcgctcaagatgaaatctatatcctcgacccagagttgttaggggcatccgccagacctgacctgcccactcccacttcccccctgccaacgagtccctgctctcccacccctcgctcactccaaggggacgcagctccgccacagggcgaggagctgatcgaagccgctaagagaaatgacttttgcaaacttcaagaactccatcgcgccggaggggatctgatgcacagggatgaacaaagccggacactgctacaccacgccgtgtcaactggttccaaagatgtggtgaggtatctgctggatcatgccccaccagagatccttgacgctgtggaagaaaacggcgagacatgtctccaccaggccgcagccctcgggcaacgaactatctgccactatatcgtggaggcgggtgctagcctgatgaaaaccgaccaacagggggacaccccgcgccagagggccgagaaggcgcaggacactgagctagcagcttacctggagaatcgccaacattatcagatgatccagagggaggaccaggaaactgccgtgtag

SEQ ID NO: 41826 - DNA, 2790 bp, Artificial Sequence
  Description of Artificial Sequence: Synthetic coding sequence
atggagccccgggacggcagccccgaggcccggagcagcgacagcgagagcgctagtgcctcatcaagcgggtccgaacgagacgctgggcctgagcccgataaagctcccagaagactgaacaagcgacgcttcccagggctgcgactgttcggtcatagaaaagctatcaccaaatctgggcttcagcacctggccccaccaccaccaacaccgggagcaccatgctccgaaagcgaaaggcaaatccggagcacagttgactggtccgagtctgctacctacggcgagcacatctggtttgagacgaatgtcagtggagatttttgctatgtcggtgagcagtattgcgtcgcgagaatgcttcagaaaagtgtgagccgtagaaagtgtgccgcctgcaagatcgtggttcataccccgtgtattgaacagctggaaaagatcaatttccgctgtaagcctagtttcagggagtctggttcccggaacgttcgggagcccacgtttgtgagacaccattgggtccaccgccgacgacaagacggtaaatgtcgacattgcggcaagggctttcagcagaaattcacctttcattcaaaagagattgtggctattagttgcagctggtgtaagcaggcatatcactccaaggttagttgtttcatgctgcagcaaatcgaggaaccctgttcactcggcgtgcacgccgctgtggtgatcccccctacgtggattctgcgcgcccgtcgaccccaaaataccctgaaggctagtaaaaagaaaaagcgagcttctttcaagaggaaaagttcgaagaagggtccagaagaagggaggtggcgccccttcatcatccgtcccacaccaagtcctctcatgaagcctctcttggtgtttgtgaaccctaaatccggggggaaccaaggcgcaaaaatcatccaatccttcctctggtacctgaatcccaggcaggtgttcgatctttcacagggcgggccaaaagaggctctcgagatgtatagaaaagtgcataacctccgaattctcgcttgtggaggagatggtaccgtcggttggattctgagcaccttagaccaactgagacttaagcctccccctcccgtggcaattctccctctgggaacaggtaatgaccttgcaaggacactgaactggggaggaggctacacagatgagccagtttctaagatcttgtcacatgtggaggagggtaatgtggtccaattggaccgatgggatctccatgccgagcccaatcctgaagcgggaccagaagatagagacgagggcgctaccgatcgattgcccttagatgtgttcaacaactatttctctctgggttttgacgcccacgtaactttggaattccatgaatcacgggaagccaaccccgagaagttcaatagtaggttcagaaacaagatgttctacgccgggacggccttttccgatttcctaatgggatcttctaaagaccttgccaagcacatccgagttgtatgcgacggcatggatctgaccccaaaaatccaggatttaaaaccgcagtgtgtagtgtttctgaacattcctcggtactgtgcaggtactatgccatggggccaccctggagagcaccatgacttcgagcctcagagacacgatgacggttacctggaggtcattgggtttacgatgacttctttggcggctctccaggttggtggacacggggagagactgacgcagtgtagagaagttgtgctaaccacctctaaagcaatcccggttcaggttgatggggagccctgtaaactcgctgcttccagaattcggattgccctcagaaatcaagccaccatggtgcaaaaagctaaacggaggtctgcagcgccacttcatagcgatcagcagccggtgccagaacagctcaggatacaggtgagtcgtgtgtccatgcacgactatgaagcgctgcattatgacaaggagcagctgaaggaggcttctgtccccttgggaaccgttgtcgttccaggggactccgacctggagctgtgtcgggcacacattgaacgcttgcagcaggagccagatggtgctggagcgaagtcaccgacatgccaaaaattgtccccaaagtggtgcttcctcgatgcaactacggcttcgcgcttctaccggattgatcgggcccaggaacacctaaactatgtgacagaaatcgctcaggatgagatctacatactggatcccgagcttctcggggcctctgcgcgacctgatctgcctacacccacctctccactgccgacctcaccatgttctccgaccccccgcagtttgcagggtgacgctgccccgcctcagggggaagagttgatcgaagccgccaagaggaacgacttttgcaagctacaagaactacacagagccgggggagatctgatgcaccgggacgaacaaagccgaacgcttctgcatcacgccgtgtccactggctccaaggatgttgtgcggtacctccttgaccatgcacctcctgaaattctcgacgccgttgaggaaaacggcgaaacatgtctccaccaagctgctgccctgggccaaagaaccatctgccattatattgtcgaggctggtgcaagcctgatgaaaaccgaccagcaaggcgatactccaaggcaaagagcggaaaaggcccaggatacagagctggcagcatatctggaaaaccggcagcactaccagatgatacaaagggaagatcaggagaccgccgtgtag

SEQ ID NO: 41827 - DNA, 3354 bp, Artificial Sequence
  Description of Artificial Sequence: Synthetic coding sequence
atggagaccttcttccggcggcacttccggggcaaggtgcccggccctggggaaggacaacagcggcccagtagtgtggggctgccgacaggcaaggcgcgaagacgaagtcccgctggccaggctagtagttccctggcccaaaggcgaaggtcatctgctcaattacagggatgcctcctgagctgtggtgtgagagcccaggggagcagtagaagaagaagcagcacggtgcccccatcttgcaatcctagatttatcgttgacaaggtcttgacgcctcagccaaccacagtcggcgcccagcttctgggggctcctctcctcctcaccgggctcgttgggatgaatgaggaagagggcgttcaggaggacgttgtggctgaagcgagcagcgctattcagcctggcactaagactcccggtcctccgccccctagaggagcccaaccccttctgccactgccccgttacctccgtagggcaagctcccacctgctccctgctgacgctgtatacgaccatgccctgtggggattgcatggatattaccggcgacttagccagcgtcgccccagtggacaacacccgggaccaggagggagacgcgcctctgggaccaccgccggaacaatgctgcccacaagagtgaggcccctgagtagacggcggcaggtggccctgcggcggaaggcggccgggccccaggcctggtctgccctgctggctaaagctattactaagagtggcctccaacacctggccccacccccacccaccccaggagcgccctgctccgagagcgaacgacaaattagatccaccgtggactggtcagaaagcgccacttatggagagcatatttggttcgagaccaatgtctccggtgacttctgttacgtaggagaacaatattgcgtcgcccggatgctgaagtcagtgtcacggcgcaaatgcgctgcctgtaagattgtcgtccatactccatgcattgagcagctggaaaagataaactttcggtgcaagccttctttccgggaatcggggtctagaaacgtgcgtgaaccaacctttgtacgccatcactgggttcataggagaaggcaagacggtaagtgccggcactgcggtaaaggttttcagcaaaaatttacatttcatagcaaagagatcgtggcgatatcttgttcatggtgcaagcaggcctatcatagcaaggtctcctgtttcatgctgcagcaaatcgaggagccatgcagcctgggggtgcacgctgcggtggtgatcccacccacctggatcctcagggcgcgcaggccacagaacacattgaaggcatctaagaagaagaagcgtgcctctttcaagcgcaaaagttccaaaaagggtcctgaggaaggaagatggcgcccatttattattcggcctaccccttctccactcatgaagcccctgctagtttttgtcaaccccaaaagcgggggcaatcagggcgcaaagatcattcaatcctttctgtggtacctaaacccaaggcaggtcttcgacctatcccaggggggacctaaggaggccttagaaatgtatcgcaaggtgcataacttgcgaatactggcctgcggaggcgacgggaccgtagggtggatcctgagcactctggatcagctgcggctaaagccgccaccccccgtggccatcctgccgttgggcactggcaatgatcttgcaagaactctgaactggggcggcggttatacagacgaacccgtctcaaagattctgtcgcacgtagaggaaggtaatgtggtgcagctggataggtgggacttgcacgcagaacccaatcctgaggccgggcccgaagatcgcgatgagggggccaccgacaggctgcctctggatgtttttaataactacttttctctcgggtttgacgcccatgtcacgctggagtttcacgagagcagggaagccaatcctgagaagtttaatagtcggtttcggaataagatgttttacgctggaaccgccttttcagactttctgatgggcagctccaaggatctcgcaaagcatattcgggtggtgtgcgacggcatggatctgaccccaaagattcaggacctgaagccgcaatgtgtggtgttcctgaacattccaaggtattgtgcggggacgatgccttggggacatcccggagaacatcacgatttcgagccccagcgacacgatgacgggtacttggaggtgatcggattcactatgacaagcctggccgccctgcaagtcggggggcacggagaaagattaacacagtgccgcgaagtcgtcctaacaacctctaaagcgataccggtacaggtggacggtgagccatgtaaactggccgcctcacgtatccggattgctctgcgcaatcaggccacaatggtgcagaaggcaaagcggagaagtgctgctccactgcacagtgatcaacaacctgtgcctgaacagctgcggatccaggtgtccagagtttccatgcatgactacgaggcgctgcactatgataaagaacagcttaaggaagcaagcgttcctttgggaacagttgtggtgccaggggattctgatcttgaactttgtagagcccacattgaaagactgcagcaagagcccgatggcgcaggtgccaaatctcctacctgtcagaaactttctccgaagtggtgtttcttagatgctacgaccgcatcccgcttttatcgcatagaccgtgcgcaggagcatctgaactatgttaccgaaatcgcccaggacgagatttatattctggatccagaattgctgggtgcatcggccagaccagacctgccaacacctacctcgcctctgcctacaagtccctgcagcccgacgcctcgctccctgcaaggagacgcggccccaccgcagggcgaggagctgattgaagcagcaaaaagaaacgacttttgcaagctccaggagctccaccgggccgggggagatctgatgcaccgcgatgagcaatcgcgaacgctgttgcatcacgccgtcagtacaggcagcaaggacgtggtgcgctacctgctggatcacgctccacctgagatcttggatgccgtggaggaaaatggagagacttgtctccaccaggcggcagccctggggcagaggaccatctgtcactatatcgttgaggccggcgcgagtctgatgaaaacagatcagcagggggatacaccacgacagcgtgccgagaaggcacaggataccgagctggccgcgtatctagaaaatcggcagcactatcagatgatccaacgggaggatcaggaaaccgccgtgtag

SEQ ID NO: 41828 - DNA, 2787 bp, Artificial Sequence
  Description of Artificial Sequence: Synthetic coding sequence
atggagccccgggacggcagccccgaggcccggagcagcgacagcgagagcgcgagcgccagctcttccggctccgaacgagacgctggaccagaacccgataaggcacctcgccgacttaacaaaaggcgctttccaggcctgcgtctgtttggacacaggaaggcgattactaagtctgggcttcagcatctggctccgccacccccgacccctggcgcaccctgcagtgagagcgagcgccaaatccgcagtacggtggattggtctgagagcgcgacatatggagagcatatttggtttgaaacgaatgtgtctggcgatttttgttacgtcggcgaacagtactgcgtggctagaatgctgaaatctgtgagtcggagaaagtgcgcagcctgcaagatagtcgtacacactccatgcatcgagcagctcgagaaaattaacttcaggtgtaagccctctttccgcgaaagcggcagccgcaatgttagagaacctactttcgtgagacaccattgggttcacagacgacggcaggacggaaagtgtcgccattgtggaaagggattccagcagaaattcaccttccacagcaaggagatcgtagcaatctcatgctcctggtgcaagcaggcctatcactcaaaagtgagctgtttcatgctacagcagatcgaggaaccgtgttccttaggggtgcatgccgctgtggtaattcccccaacctggattctgcgtgcgcgccggcctcagaatacactgaaagcttcaaaaaagaagaagagggccagcttcaaacggaagtcctctaagaaaggaccagaggaaggccgctggcggccgtttatcattcggcccaccccatctccccttatgaagccactgcttgtgtttgtgaatcctaaaagcggtggcaaccagggcgccaaaattatacagagtttcctttggtaccttaatccccggcaggtattcgatctttcacagggtgggccgaaggaggcactggagatgtacaggaaagtgcacaatcttagaattcttgcatgtggcggtgacgggactgtcggctggatcctgagtacactcgaccagctgcgtttaaagcccccgcctcccgtcgccatattacctctgggaacaggaaatgatctcgcacggactctcaattgggggggggggtataccgacgaacctgtgtctaagatcttgtcccacgtcgaggagggaaacgtggtgcagctggatcgatgggacctgcatgcggaacccaaccccgaggcaggtcctgaggatcgcgatgagggtgctacagaccgcctccctctagatgtgttcaacaactacttctccctggggttcgacgcccatgttacacttgagtttcacgagtcacgcgaggcaaaccccgagaaatttaacagcagattcagaaataagatgttttacgctggtactgcctttagtgacttccttatgggtagttccaaggacttggcaaagcacattagagttgtctgtgatggcatggacctgactccaaagatccaggacctgaagccccaatgcgtcgtgttcctgaacattcccaggtactgcgcggggaccatgccttggggtcacccaggcgagcaccacgatttcgagccgcaacgccacgatgacggatacctcgaggttatcgggttcaccatgactagtttggccgcactccaagtcgggggtcatggtgaacgtctgacgcagtgcagagaggtggtgcttaccacttccaaggctatcccagtgcaggtggatggagaaccatgtaaacttgccgcctccaggatcagaatcgctttgaggaaccaggccacaatggtacagaaagctaaaaggcgcagcgctgccccactccactccgaccagcagccagtcccggagcagcttaggattcaagtaagtagagtgagtatgcatgactacgaggccctgcattacgacaaagaacaattgaaggaggcttctgtgccactgggcactgtcgtggtgcccggagattccgacctcgagctttgccgggcacatatagaaagactgcagcaggagccagacggtgccggcgcaaaatcgcccacgtgccagaaactctccccaaaatggtgctttctggacgccaccacagcctcccgcttttaccgtatcgaccgggcccaggaacaccttaactacgttaccgagattgcacaggatgaaatctacattctggacccagagctgttaggcgcgagcgcacgccctgatctgcccacaccaacctccccactgcctaccagcccgtgttcccctactccacggagtctacaaggcgacgcagcccccccacagggtgaggaactgatcgaggccgccaagcggaatgacttttgcaagttacaggaactccatcgcgcggggggagaccttatgcatagggacgaacaatccaggacccttcttcatcatgcggtgtctacgggatcgaaagacgtcgtaaggtatctgctggatcatgcccctcccgagatcctggatgccgtggaggaaaacggagaaacgtgcctgcaccaagccgccgcccttggtcagcggaccatctgtcactacatcgtggaggccggcgcctctctcatgaagaccgatcagcagggagatacccctagacagcgagccgagaaagctcaggacacggaactagccgcctacctcgagaatagacagcactaccaaatgatccagcgagaggaccaggaaacagccgtgtag

SEQ ID NO: 41829 - DNA, 846 bp, Artificial Sequence
  Description of Artificial Sequence: Synthetic coding sequence
atggagccccgggacggcagccccgaggcccggagcagcgacagcgaaagcgcatccgcatcgagttctgggtcagagcgggacgcgggccctgagcccgacaaggctccacgccggctgaacaaaaggcgattccccgggcttcgcctctttgggcactcaaagagcaagagccccacatgccagaaactttccccgaagtggtgctttctcgatgcaaccacagcctcaaggttctaccgaatcgatcgggctcaggagcacctcaattacgttactgagatagcccaggatgaaatatacattcttgacccagagcttctgggcgcatccgctcggcccgacttgcccaccccgaccagtcctctgccaaccagcccctgcagcccaactccgcggtctctccagggagatgccgccccccctcagggagaagagcttattgaggctgctaagagaaatgacttctgtaaactccaggaactgcaccgggcggggggggatctcatgcatagggacgaacagtcaagaacactgcttcaccatgcggtgagcactggttctaaggatgtggtgcgatacctcttggatcacgcgccccctgaaatcctcgatgccgtggaggaaaacggtgaaacatgtctccaccaagccgctgcactgggtcagcgaaccatttgtcactacatcgtggaagctggcgcatctctgatgaaaacagatcaacaaggagatactccaaggcagagggcagagaaggctcaggatacagagcttgcggcctacctcgagaacaggcagcactaccaaatgatacaacgcgaggaccaggagaccgctgtttag

SEQ ID NO: 41830 - DNA, 1014 bp, Artificial Sequence
  Description of Artificial Sequence: Synthetic coding sequence
atggccttcttcagccggctgaacctgcaggagggcctgcagaccttctttgtcctccagtggatccctgtctacatatttttgggcgccatacctattctgctgattccttactttctgcttttcagtaagttctggccccttgcagtactgtccctggcatggctaacatatgactggaacacgcactcccagggcggcagacggtcagcttgggtgcgaaattggactctctggaagtacttcaggaactactttccagttaagctggtgaagactcacgatttgagcccaaaacacaattacattattgcaaatcatcctcacgggatcttatcatttggcgtattcatcaacttcgctaccgaggcgacgggcatcgcaaggatttttccaagcataaccccgttcgtgggcaccctcgaacgcatcttttggatccccattgtgcgggagtatgtgatgtctatgggtgtctgtccggtgtcctcatcagctcttaaatatctgctgacccagaagggctcaggcaatgccgtggtcatagtagtgggcggggctgctgaagctcttctctgtagacccggcgcatctaccctcttcctgaaacagagaaagggctttgtgaaaatggcactgcagacaggtgcgtatctggtgccttcctacagcttcggggagaatgaagtgtttaatcaagaaacgttccctgaagggacatggttacggctgtttcaaaagacctttcaagatacattcaaaaaaatcttgggactgaacttctgcacttttcacgggcgcggctttacacgcgggagctggggtttcctcccttttaaccgtcccattacgacagtggtcggtgagccgctgccaatccctcgaattaaacgtccaaatcaaaagaccgtggataagtatcatgcactgtacatttccgctctcagaaagttatttgaccaacacaaggtcgagtacggcttaccagagacgcaggagttaaccattacttag

SEQ ID NO: 41831 - DNA, 267 bp, Artificial Sequence
  Description of Artificial Sequence: Synthetic coding sequence
atgcccgccttcgccgagttcgagaaggccgccgaggaggtgcggcatctcaagacaaagccgtcagacgaggagatgctgtttatttatggacattataagcaggcaacagtgggagacatcaacacagagcgccctggcatgcttgacttcacaggcaaggccaaatgggatgcgtggaacgagctcaaaggaacctcaaaagaggacgccatgaaggcatacattaacaaagtcgaggaactcaaaaaaaagtatggtatctag

SEQ ID NO: 41832 - DNA, 315 bp, Artificial Sequence
  Description of Artificial Sequence: Synthetic coding sequence
atgtggggcgacctgtggctgctgccccccgccagcgccaaccccgggaccggaacagaggcagagttcgaaaaggccgcggaagaggtgaggcacttaaagacaaaacccagcgatgaggagatgctttttatttacggtcattacaaacaggccacggtgggcgacattaacactgagagacccggcatgctggatttcacagggaaggctaaatgggatgcttggaatgagctgaagggcacatcaaaagaagacgcaatgaaggcctatatcaacaaggtcgaggagctgaagaagaagtacggtatttag

SEQ ID NO: 41833 - DNA, 264 bp, Artificial Sequence
  Description of Artificial Sequence: Synthetic coding sequence
atgagccaggccgagttcgagaaggccgccgaggaggtgcggcacctgaagaccaagccttccgatgaagagatgttattcatttacggccattacaaacaggcgaccgtcggcgacatcaacaccgagaggccaggcatgttagattttacaggcaaggctaaatgggatgcatggaacgagttaaaagggacatcgaaggaagatgcaatgaaagcctatattaacaaggtggaggagctcaagaaaaagtatggaatctag

SEQ ID NO: 41834 - DNA, 315 bp, Artificial Sequence
  Description of Artificial Sequence: Synthetic coding sequence
atgtggggcgacctgtggctgctgccccccgccagcgccaaccccggcacaggaactgaggccgaattcgaaaaggccgccgaggaagttcgtcatcttaagactaaacctagcgacgaagagatgctctttatctacggccattataaacaggccacagtgggcgatattaacactgagagacctggaatgctggacttcacaggaaaggccaaatgggacgcctggaatgagctcaaaggcacgtcaaaagaagatgcaatgaaagcctacattaataaagtggaggaactaaagaagaaatacggcatttag

SEQ ID NO: 41835 - DNA, 390 bp, Artificial Sequence
  Description of Artificial Sequence: Synthetic coding sequence
atgagccagcaccgggccggccggcggggcggcgtgggcaagcggggcgtgcggggaagggaacttgggggccagggcaaatacggcgcagggtgcagcgagtgcggtacaagaagaattgcggcaagaggcgaagctgaattcgagaaggctgccgaggaagtcaggcatctcaagaccaaaccttccgatgaggaaatgcttttcatctacggccattataagcaggctacggtcggcgatattaacacagagaggcccgggatgctggacttcacaggtaaggctaaatgggacgcttggaatgaactcaagggtacgtcaaaagaagatgcaatgaaagcttacataaataaagtggaagagttaaagaagaagtacggaatctag

SEQ ID NO: 41836 - DNA, 315 bp, Artificial Sequence
  Description of Artificial Sequence: Synthetic coding sequence
atgtggggcgacctgtggctgctgccccccgccagcgccaaccccggaacagggaccgaggcagaattcgagaaagcagctgaggaagttaggcatcttaagactaagccttctgacgaggagatgttgttcatatacgggcactacaaacaggccactgttggggatatcaatacagaaaggccaggaatgctagactttacagggaaggccaaatgggatgcttggaatgaactgaaaggtacctctaaggaagatgccatgaaggcctatatcaataaagtggaggagctcaagaagaaatacggcatttag

SEQ ID NO: 41837 - DNA, 447 bp, Artificial Sequence
  Description of Artificial Sequence: Synthetic coding sequence
atggagcggtggggcaagggcctgcacggcctggaggagcggggcgacagcgtgcctatccctaaacatcgtgcaggaagaaggggaggggtgggaaagcgaggcgtgcgagggcgcgagctcggcggccaaggtaagtacggcgccggatgtagcgagtgcggcacaagaaggattgctgcaagaggggaggcagagtttgagaaagccgccgaagaggtgcgccacctgaaaaccaagccctctgatgaagagatgctgttcatctacggccactataaacaggccaccgttggtgatattaacaccgaaagaccaggcatgctggactttaccgggaaggccaagtgggatgcttggaacgagcttaaaggcacttcaaaagaagacgctatgaaggcctacatcaacaaagtcgaagagcttaagaaaaaatacggaatctag

SEQ ID NO: 41838 - DNA, 564 bp, Artificial Sequence
  Description of Artificial Sequence: Synthetic coding sequence
atgttcctgctgctgaactgcatcgtggccgtgagccagaacatgggaatcgggaagaacggcgacctgccccggccccctttgcgaaatgagttccggtatttccaacggatgaccacaacttcatctgtggaagggaagcagaaccttgtgataatgggccgtaagacttggttcagcatccccgaaaagaacagacctttgaaggacagaatcaatctcgtcttgagtcgcgaactgaaggagccaccccaaggggcccactttctggcccggagcttggacgatgccctaaagctgaccgaacgaccagaactggctaacaaggtggacatgatctggatcgttggcggctcctcagtgtataaggaggctatgaaccacctcggacatttgaagcttttcgttacaaggataatgcaggacttcgagtctgacacatttttttccgaaatcgacctcgagaagtataaactgctacccgagtatcccggtgtgctgtccgacgtgcaggaagggaagcacattaaatacaaatttgaggtctgcgaaaaagatgattag

SEQ ID NO: 41839 - DNA, 564 bp, Artificial Sequence
  Description of Artificial Sequence: Synthetic coding sequence
atgttcctgctgctgaactgcatcgtggccgtgagccagaacatggggatcggaaaaaatggggacctgcctcgacccccactacgcaacgagttcaggtactttcagagaatgaccactacctctagcgtcgagggcaaacagaacttagtgattatggggaggaagacttggtttagtatccctgagaaaaaccgtcctttgaaagatcgcattaatctggttttgtccagagagctcaaggagccccctcaaggcgcgcacttcctggcccggagcctggacgacgcattaaagttaacggaaaggcccgagctcgcaaacaaggtggatatgatttggatcgtcgggggttccagcgtttacaaggaagctatgaaccatctgggacacctgaaactctttgttaccaggataatgcaggacttcgagagcgacactttcttttccgaaatcgatttggagaagtacaagctcctcccagagtaccccggcgtgctgtctgatgtccaggagggcaaacatattaagtacaaatttgaagtctgcgagaaagatgactag

SEQ ID NO: 41840 - DNA, 564 bp, Artificial Sequence
  Description of Artificial Sequence: Synthetic coding sequence
atgttcctgctgctgaactgcatcgtggccgtgagccagaacatgggaattggcaagaatggggatttgcctaggccgccactcaggaatgagttcagatatttccagaggatgacaaccactagcagcgtggagggaaagcagaacttagtcatcatgggtcgcaagacgtggttctcaattcctgagaaaaaccgtcccctgaaggaccgcatcaacctcgtgctgtctagggagctgaaggagcctccacaaggagcgcactttctagccagatcactggacgatgctttgaagcttacagaacggccagagttggccaacaaggtggatatgatttggattgttggcggatcgagcgtatacaaagaagccatgaaccaccttggtcacctgaagctctttgtgacgaggatcatgcaggactttgagtccgacacctttttctcagagattgaccttgaaaaatataaattgttgcctgaatatccaggcgtactctccgacgtgcaggaggggaaacatatcaagtataaatttgaagtgtgcgagaaagacgattag

SEQ ID NO: 41841 - DNA, 345 bp, Artificial Sequence
  Description of Artificial Sequence: Synthetic coding sequence
atgttcctgctgctgaactgcatcgtggccgtgagccagaacatgggtatcgggaagaatggagatttgcctagaccaccacttcggaacgagtttaggtatttccagcggatgacaacgacctcttccgtcgaaggtaaacaaaacctcgtgatcatgggccggaaaacatggttcagtatacctgaaaagaatcgacccctgaaagatcgaattaatctcgtgttgtccagagagctgaaggagcccccgcagggtgcgcacttcctggcaagaagcttagacgatgctctaaagctcacagaacgacccgagctggctaacaaagttgacatgatttggtag

SEQ ID NO: 41842 - DNA, 597 bp, Artificial Sequence
  Description of Artificial Sequence: Synthetic coding sequence
atgcccgagcagagcaacgactaccgggtggtggtgttcggcgccggtggcgtcgggaagtcttccctggttctccgattcgtgaaaggcactttcagagacacatacatacccacaatcgaggacacatacaggcaggtgataagctgtgataaatccgtctgcacactgcagattactgatactaccgggagccaccagttcccagctatgcagcgtctgtctatctccaaggggcatgcttttatcctggtctttagcgtcacatcaaaacagtcactcgaggagttaggcccgatatacaagctgattgtgcagatcaagggtagcgtcgaggatattccagtcatgctcgttggtaataaatgcgatgagacccagagagaagtggacaccagggaagcccaggccgtcgctcaggagtggaagtgcgccttcatggagacaagcgccaaaatgaattacaatgtcaaggagcttttccaggagctgttgaccctcgagactcgacgtaatatgagtcttaatatcgacggtaagcggtccggcaaacagaagcggacggaccgcgtgaaaggcaagtgtacattgatgtag

SEQ ID NO: 41843 - DNA, 600 bp, Artificial Sequence
  Description of Artificial Sequence: Synthetic coding sequence
atgcccgagcagagcaacgactaccgggtggccgtgttcggcgccggaggcgtgggaaagtctagtcttgtcctgcgatttgttaagggtacttttcgagagtcatatattcccacagtggaggatacctacagacaagtaataagctgcgataagtcaatttgtaccctccagatcacagacacgaccggatcacatcagttccctgcaatgcagcgactgagcatttctaaaggccacgccttcatactggtatattccattacgtccaggcaatctctggaagagcttaagccaatctacgagcagatctgcgagattaaaggcgacgtagagtcaattcctatcatgttggtggggaacaagtgcgacgagagtcccagtagagaggttcagtcctcagaagccgaggctcttgcgaggacctggaagtgcgcttttatggaaacatcagcaaaactgaatcataatgtaaaggagctttttcaggagttactcaatctggagaaacgtaggactgtgagtttacaaattgatggaaagaaatctaaacagcagaagagaaaagagaagttaaaggggaagtgcgtgattatgtag

SEQ ID NO: 41844 - DNA, 690 bp, Artificial Sequence
  Description of Artificial Sequence: Synthetic coding sequence
atgggcaacgccagcttcggcagcaaggagcagaagctgctgaagcgcctccggctcttgccggccctcctgattctgagagcgtttaaaccccatcggaagatacgcgactaccgtgtcgtggtcgtggggacagctggggtgggaaagagcacactgctccataagtgggcctccggcaacttccgccatgagtacctgcctactattgaaaatacctactgccagctcctcggatgtagccacggagtgttatctctccacattacagattctaagtctggtgacggcaatcgcgccttacagcggcatgtgattgctcgcgggcatgctttcgtcctggtgtacagcgtcacaaaaaaggaaacactagaggaactgaaggcgttctacgagttaatttgcaagatcaagggcaataatcttcataaatttcctattgtgctggtcggcaataaatctgacgacacccaccgagaagttgcactgaatgacggtgcaacctgcgcgatggagtggaactgtgcctttatggaaatttcagctaagacggatgttaatgttcaggagttattccacatgctcctcaattacaagaagaagcccactaccggcctccaggagccagagaagaagtcccagatgccaaacacaaccgaaaagctcttggacaagtgcatcatcatgtag

SEQ ID NO: 41845 - DNA, 690 bp, Artificial Sequence
  Description of Artificial Sequence: Synthetic coding sequence
atgggcaacgccagcttcggcagcaaggagcagaagctgctgaagagactccgactcctgccagccctcctcatcctgcgggcatttaagccgcaccgtaagatcagagattaccgagtcgtggtggtgggcacggccggggtcgggaaaagcacgcttctgcataaatgggccagtggcaattttagacatgagtacctgcctacgatagagaatacttactgccagctgctgggctgctcccatggcgtgctgagcctgcacattaccgacagcaagagcggggacgggaatagggccctgcagcggcatgtcatcgcacgtggccacgcgtttgtgcttgtgtactctgtgacgaagaaggaaacactggaagagctgaaagcattctacgaattgatctgcaagattaagggtaataacctgcataagtttcctatagtactggtaggcaacaaatcagatgacactcatcgtgaagttgctctgaatgatggcgccacatgtgcaatggaatggaactgcgcctttatggagatctcagcaaaaactgatgtgaacgttcaggaactctttcatatgctgctcaattacaaaaaaaaacccacaactgggctgcaggaacccgagaaaaagtcacagatgcctaatactaccgagaagctactggataagtgcattataatgtag

SEQ ID NO: 41846 - DNA, 501 bp, Artificial Sequence
  Description of Artificial Sequence: Synthetic coding sequence
atgggccccgaggccctgagcagcctgctgctgctgctgctggtggccagtggagatgctgacatgaagggtcacttcgaccccgccaaatgtcgatacgccctcggcatgcaggatcggactattccagacagtgacattagcgcaagcagttcatggtcagacagtacagcagcccggcacagtcgactggaatcatcagacggcgatggggcttggtgcccggcggggtctgtattcccgaaggaagaggagtaccttcaggtggatctacagcggcttcacctagttgctttggtaggcacacagggcaggcatgctggcggcttgggtaaagaattttcaagaagctatcgccttcggtacagcagggatgggcgacggtggatggggtggaaagatcgctggggccaggaggttatatccggaaatgaagatcccgaaggcgtcgtgctgaaagacctaggcccacccatggtcgccaggctcgtgcggttctag

SEQ ID NO: 41847 - DNA, 420 bp, Artificial Sequence
  Description of Artificial Sequence: Synthetic coding sequence
atgggccccgaggccctgagcagcctgctgctgctgctgctggtggcttcaggggacgccgacatgaaagggcattttgaccccgctaaatgccgttacgcccttggcatgcaggatcggactataccagactctgacattagcgcatcttcgtcttggagcgattctacagccgcccgccattcaaggctcgaaagtagcgacggtgatggggcctggtgtcccgccgggagtgtgtttcctaaggaagaagagtacctgcaagtcgatctgcagaggcttcacctggtggccttggttggcacccagggcagacatgccggaggactgggcaaggagtttagtaggtcatataggctgaggtatagcagagatggccggaggtggatggggtggaaagaccgctgggggcaagagtag

SEQ ID NO: 41848 - DNA, 756 bp, Artificial Sequence
  Description of Artificial Sequence: Synthetic coding sequence
atgggccccgaggccctgagcagcctgctgctgctgctgctggtggcttccggagatgctgacatgaagggacattttgaccctgcaaaatgtagatacgcgctaggcatgcaagacaggactattccagattccgacatatccgcttccagcagctggtctgattcgaccgccgcacgtcattctcgcctggaatccagtgacggcgatggcgcctggtgccctgcgggcagcgtgttccctaaggaagaagagtatctgcaggtggatctgcaacgcctccatctggtggcccttgtaggcactcagggaaggcatgcaggcggcctgggaaaggagttctctcgctcttacaggttgcggtattcccgggatggacgacgttggatggggtggaaagatcggtggggccaagaggtcattagcggcaatgaagaccccgagggagtcgtgctaaaggatctcgggcctcccatggtagctagactggttagattttaccccagggccgacagagttatgagcgtttgtcttcgcgttgaactgtacgggtgcctgtggagggacggcctgctaagctacaccgcccctgtggggcagactatgtacttaagcgaggccgtctatttgaacgatagtacttacgatggacatactgtgggtggactgcagtatggaggattgggccagttggcagatggcgttgtgggcttggatgattttaggaaaagccaagagctgcgggtttggccttag

SEQ ID NO: 41849 - DNA, 420 bp, Artificial Sequence
  Description of Artificial Sequence: Synthetic coding sequence
atgggccccgaggccctgagcagcctgctgctgctgctgctggtggcatccggcgacgccgacatgaaggggcatttcgaccccgccaagtgtagatacgcattggggatgcaagaccggactatacccgatagcgatatctccgcttcgtccagttggtctgactccacggccgccaggcattcccgcctcgagtcttcagacggtgatggcgcctggtgccccgccggctccgtgtttcctaaagaggaagagtacctgcaggtggatctgcagcggctgcatctcgtggcgttggtaggtacacaggggaggcacgctggcggactcgggaaagagttctctcggagctatagactacggtatagtcgtgatggacgccggtggatgggttggaaagataggtggggtcaggagtag

SEQ ID NO: 41850 - DNA, 756 bp, Artificial Sequence
  Description of Artificial Sequence: Synthetic coding sequence
atgggccccgaggccctgagcagcctgctgctgctgctgctggtggcttcaggcgacgcagatatgaagggtcacttcgaccctgcaaaatgtcgctacgccctgggaatgcaggataggaccatccccgactccgatatttctgcctcctcatcatggtctgatagcacggctgccaggcactccagactggagtcttctgatggcgatggcgcctggtgtcctgcaggctccgtctttcccaaggaggaggagtacctccaggtcgatttgcagaggctgcacttggtggcattggtgggcacccagggcagacacgctgggggcctggggaaagagttttccaggtcatacagactccgctactcacgcgacgggcggcgctggatgggatggaaggacaggtggggccaggaggtgatcagtggcaatgaggaccccgaaggcgtggttctgaaggacctcgggccccccatggtggctcgactggtgcgtttctaccctcgggccgatcgggttatgtcggtgtgccttagagttgagctgtacggttgtctctggagggatggattactctcttacactgccccggtcggtcaaacgatgtatttatccgaagccgtttacctcaacgattctacatacgacgggcataccgtcgggggcctgcagtacgggggccttggccaattggccgatggggttgtgggcctggacgattttcgcaagtcccaggagctccgggtctggccctag

SEQ ID NO: 41851 - DNA, 420 bp, Artificial Sequence
  Description of Artificial Sequence: Synthetic coding sequence
atgggccccgaggccctgagcagcctgctgctgctgctgctggtggcctctggcgatgcagatatgaaaggacattttgacccagccaagtgccggtacgcactgggtatgcaggatcggaccattcccgatagcgacatttcagcctcatcatcatggagtgactcaaccgccgctagacatagtagattagaatcaagcgatggcgacggcgcgtggtgccccgcaggctcagtcttcccgaaggaggaagagtacctgcaagtggatttacagcgccttcaccttgttgcgctggtggggacgcaggggcggcacgccggcggattgggcaaagaattcagtaggtcctatcgccttaggtattctagagacggacgccgctggatgggctggaaagatcgttggggtcaggaatag

SEQ ID NO: 41852 - DNA, 756 bp, Artificial Sequence
  Description of Artificial Sequence: Synthetic coding sequence
atgggccccgaggccctgagcagcctgctgctgctgctgctggtggcatctggcgatgcggatatgaaggggcacttcgatccggctaagtgtcggtacgctctcgggatgcaggatagaaccattcctgatagcgacattagcgcgagctctagttggtctgactcaaccgcagccaggcatagtcggcttgaaagctccgacggtgacggcgcatggtgtcccgctgggtccgtctttccaaaggaggaggagtatctgcaggtagatctgcagagactgcaccttgttgctttagttgggacacaggggcggcacgcggggggattaggaaaagaattctcacggtcatatcggcttcggtacagtcgggacggccggcgctggatggggtggaaggatcggtggggacaggaggttatctctggaaacgaagatcccgaaggagtcgtcctgaaggatctaggcccgcctatggtcgctaggcttgtgaggttctacccccgggcggacagggttatgtccgtatgcctgcgcgtggaactttacggttgcttatggcgcgacgggctcttatcctacaccgcccctgtgggacagaccatgtatctttcagaggccgtctatctgaacgattcaacctatgacggacacactgtgggagggctgcagtacggagggctgggccagttggctgacggcgtggtcgggttagatgacttccgcaaatctcaggaattacgcgtctggccctag

SEQ ID NO: 41853 - DNA, 756 bp, Artificial Sequence
  Description of Artificial Sequence: Synthetic coding sequence
atgggccccgaggccctgagcagcctgctgctgctgctgctggtggcaagcggcgacgcagatatgaagggccatttcgatcccgccaaatgccggtatgccctcggcatgcaggatcggactattcctgatagcgatatcagcgcctccagttcatggagcgacagcacagcggccaggcattcccgcctcgagagctctgatggagacggtgcatggtgccctgccggatccgtgttcccgaaagaggaggaatacctgcaggtcgatttacagaggttgcatctggttgccttggtgggaacccagggccgccatgcgggcgggctggggaaggagttctcccggagttacagacttcgatattctcgagatgggcggagatggatgggttggaaagatcgatggggccaggaagtgattagtgggaatgaagacccagagggcgtggtgctcaaggatctcggcccaccaatggtcgctcgccttgtacgattctatccgcgagccgatcgcgtgatgtcagtttgcctccgcgttgaactttacgggtgcttatggagagatggcctcttgtcctataccgcccctgtgggccaaaccatgtacctatctgaagctgtatatctgaacgatagcacctatgatgggcacaccgtgggaggactgcaatatggtggactcggtcaactggccgatggagtagtgggcctcgatgatttccgcaaaagccaggaattgcgcgtctggccttag

SEQ ID NO: 41854 - DNA, 420 bp, Artificial Sequence
  Description of Artificial Sequence: Synthetic coding sequence
atgggccccgaggccctgagcagcctgctgctgctgctgctggtggcctctggtgacgctgatatgaaagggcacttcgatccagctaaatgtcgatatgcccttgggatgcaagatcgcacaatcccagactccgacatctctgcttcaagttcttggtcagacagcactgcagcgagacactcgagattagagagcagtgatggggatggcgcttggtgtccagctggctccgtattccctaaggaagaggaatatctccaagttgacttgcagcggttgcacctggttgctctcgtcggaacacaaggccgccacgctggcggcttgggaaaggagttctcaaggtcataccgcctgcggtacagtcgcgatggacgtcgctggatgggctggaaagatcggtggggccaagaatag

SEQ ID NO: 41855 - DNA, 192 bp, Artificial Sequence
  Description of Artificial Sequence: Synthetic coding sequence
atgggccccgaggccctgagcagcctgctgctgctgctgctggtggcatcaggtgacgccgacatgaaaggccactttgacccagccaagtgcaggtacgccttaggtatgcaagatagaacaattccggactccgacattagcgcgagtagttcatggtcagatagtaccgctgcgcgtcactcaaggtag

SEQ ID NO: 41856 - DNA, 756 bp, Artificial Sequence
  Description of Artificial Sequence: Synthetic coding sequence
atgggccccgaggccctgagcagcctgctgctgctgctgctggtggcttcaggagacgcagatatgaagggccatttcgaccctgctaaatgccggtacgccctgggaatgcaggacagaaccattccggactccgacatcagcgcttcatccagctggtccgattccactgcagcgcgtcacagccggttagagagcagtgatggagacggtgcatggtgtcccgccgggtccgtgtttccaaaagaagaagagtacctgcaagtggatctccaacggctccatctggtcgcccttgtcgggacgcaggggaggcatgccggtggcttgggcaaagagttctctcgctcctacagactccggtatagccgagacgggcgccgctggatgggatggaaggatagatgggggcaggaagtcatcagcggcaatgaggatcctgaaggcgtagtgctaaaggacctaggacccccgatggtggccagactggttaggttttatccgcgggcggatcgagtaatgtctgtatgccttcgagtggaactgtatggctgcctctggagggacggactgctgtcgtataccgcccccgttggacaaactatgtatctgtccgaagccgtgtacctcaacgacagcacctatgacggccataccgtgggaggtctgcagtatggggggctaggccagcttgccgacggcgttgttggcctggatgattttcgcaagagccaggaacttcgcgtctggccctag

SEQ ID NO: 41857 - DNA, 420 bp, Artificial Sequence
  Description of Artificial Sequence: Synthetic coding sequence
atgggccccgaggccctgagcagcctgctgctgctgctgctggtggcctcaggagacgccgacatgaagggtcattttgaccctgctaaatgccggtacgccctgggtatgcaagatcgcacaatccctgactctgacatttccgcatctagctcctggtccgatagtactgccgcgcgacacagtcggctcgagagttctgacggagatggtgcctggtgcccagcgggctctgtctttcccaaagaggaagaatacctgcaggtggacttacagcgcttgcatctggttgcactagtgggtacccagggacgccacgccgggggcctgggtaaagaattttcccgatcctataggctacgctatagtagggacggccgacgttggatgggttggaaagaccggtggggacaggaatag

SEQ ID NO: 41858 - DNA, 420 bp, Artificial Sequence
  Description of Artificial Sequence: Synthetic coding sequence
atgggccccgaggccctgagcagcctgctgctgctgctgctggtggcctcaggggacgccgatatgaaaggtcatttcgaccccgccaagtgccgctacgccctgggtatgcaggaccgtacgatacccgactccgatatttctgcctcttccagctggagcgatagcactgcggccagacatagccggttggagtctagcgatggcgatggtgcatggtgtcccgccgggagcgtgttccctaaggaggaagagtacctgcaggtagatctccaacggcttcaccttgtggcccttgtgggaacgcaggggagacacgccggggggctaggcaaggagttctctaggagttaccggttgaggtactctagggacggacgcagatggatgggttggaaggatcgatggggacaggagtag

SEQ ID NO: 41859 - DNA, 192 bp, Artificial Sequence
  Description of Artificial Sequence: Synthetic coding sequence
atgggccccgaggccctgagcagcctgctgctgctgctgctggtggctagcggcgacgctgacatgaagggccatttcgatccagccaaatgtcgctacgctctggggatgcaggatcggacaatccccgattccgatatttctgccagcagttcttggtcagattcaaccgctgcaaggcattcacgttag

SEQ ID NO: 41860 - DNA, 630 bp, Artificial Sequence
  Description of Artificial Sequence: Synthetic coding sequence
atgggccccgaggccctgagcagcctgctgctgctgctgctggtggctagcggcgacgcagatatgaaaggacactttgatcccgccaagtgccgctatgcactggggatgcaggataggactatacccgattccgacatttctgcttcaagctcctggtccgatagcaccgccgctaggcacagccgattggagagctccgacggtgatggggcgtggtgtcctgccggcagcgttttcccgaaagaggaagagtacttgcaagtggacctgcaacggctgcacctggttgcactcgttgggacacagggccggcacgcaggaggcctcggtaaagaattttcaaggtcctaccgcctacggtatagtagagatggcaggagatggatgggatggaaggatcgctggggccaggaggtaattagcggaaacgaggacccagagggggtggttctcaaggatctcggccccccaatggtggcgcggctggtgcggttctaccccagggctgatagagtgatgtctgtttgcttgcgcgtcgagctgtatgggtgtctttggagagacggactgctgagctacaccgctcctgtgggtcagaccatgtatctttccgaagcagtgtattag

SEQ ID NO: 41861 - DNA, 420 bp, Artificial Sequence
  Description of Artificial Sequence: Synthetic coding sequence
atgggccccgaggccctgagcagcctgctgctgctgctgctggtggcctccggggatgcagatatgaagggacactttgacccagccaagtgccgctatgctttaggcatgcaggaccgcacaatcccagactccgatattagtgcctctagttcttggagcgactcaaccgccgctcgtcacagtcggctcgagtccagtgacggagacggcgcttggtgtcccgccggctccgtcttcccaaaagaggaggaatatctccaggtggacttacaaaggcttcacctcgtggcgctcgtcggaacccagggtcgtcacgctggtggcctgggaaaagagttctcccgtagttataggttgcgctactctagggacggtcgcagatggatgggatggaaggatagatgggggcaggaatag

SEQ ID NO: 41862 - DNA, 420 bp, Artificial Sequence
  Description of Artificial Sequence: Synthetic coding sequence
atgggccccgaggccctgagcagcctgctgctgctgctgctggtggctagcggggatgctgacatgaaaggacattttgatccagctaaatgtaggtatgccctgggcatgcaagacagaactatcccggatagtgatatctcagcaagcagctcatggtctgatagtactgccgccagacactcccgcctggagagcagcgacggcgacggggcctggtgtccggcggggtcagtatttccgaaagaggaggagtaccttcaggtggatctgcagcgcctgcacctggtcgcgctggttggcacacaaggccgccacgcggggggtctcgggaaggagttctcacgaagctatagattgcgatattcccgcgatggtcggcgctggatgggctggaaggaccgctggggacaggaatag

SEQ ID NO: 41863 - DNA, 420 bp, Artificial Sequence
  Description of Artificial Sequence: Synthetic coding sequence
atgggccccgaggccctgagcagcctgctgctgctgctgctggtggcttcgggcgacgccgacatgaaggggcatttcgatcccgccaaatgtcgatatgcgttgggtatgcaggatcggaccatcccagactccgatatcagcgcttcctctagctggtccgattctacggcagctaggcactctaggctggagtccagcgatggcgacggtgcctggtgcccagccggaagtgtcttccccaaggaggaggagtacctgcaggtcgacctgcagcgactgcaccttgttgcccttgtcggaacgcagggtcgtcacgccgggggattggggaaggagttctcaaggagctatcgattaaggtactcaagggacggaagaaggtggatgggttggaaggaccggtggggtcaagagtag

SEQ ID NO: 41864 - DNA, 144 bp, Artificial Sequence
  Description of Artificial Sequence: Synthetic coding sequence
agcgaggccgtgtacctgaacgacagcacctacgacggccacaccgttgggggcttacaatacggtggcctcggacagctagccgatggggtagtggggctggatgacttccgaaaatcccaggaactacgggtgtggccgtag

SEQ ID NO: 41865 - DNA, 444 bp, Artificial Sequence
  Description of Artificial Sequence: Synthetic coding sequence
atgggccccgaggccctgagcagcctgctgctgctgctgctggtggcaagtggggatgcggatatgaaaggacactttgacccagcaaaatgtaggtacgcactgggcatgcaggatcggaccattcctgattctgatatcagcgcatcttcttcgtggtctgactcaactgccgcgaggcattcaaggctcgagtcttccgatggggatggcgcttggtgtccagccgggagtgttttccctaaagaagaagagtatctgcaggtggatctccagcgccttcacctagttgcactggttggaacacagggtaggcacgcaggagggctagggaaggagttttcccgatcctatcgactgaggtactcacgagacggccgccggtggatgggctggaaggaccgttggggccaggaagtgattagcggaaatgaagatccatag

SEQ ID NO: 41866 - DNA, 420 bp, Artificial Sequence
  Description of Artificial Sequence: Synthetic coding sequence
atgggccccgaggccctgagcagcctgctgctgctgctgctggtggcatcaggcgatgccgacatgaagggccattttgatccggcaaaatgtcgctacgctctgggaatgcaagatcggaccatcccagactctgacattagcgcttcctccagctggtctgacagtactgccgccaggcatagcaggctggaatcatccgatggagacggcgcttggtgtcctgctggatcagtctttccgaaggaggaggaatatctacaagttgacctccagaggctgcacctcgtggcgctggtcggtacccaaggacggcacgcaggcggcctcgggaaggagttttcgcgttcgtatcgactgcgctactcaagagacggaaggcgttggatggggtggaaggacagatggggacaggagtag

SEQ ID NO: 41867 - DNA, 756 bp, Artificial Sequence
  Description of Artificial Sequence: Synthetic coding sequence
atgccccacctggccagcctgttcaccgccagcagccggtgctgcccccatccgctgaggccagaggggtctggcgccatgggccctgaggccctctcttctctactgttgctcttgctcgtggcttctggggatgcagatatgaaggggcacttcgaccctgccaaatgccggtacgcccttggcatgcaggacaggactatccccgattctgacatctcggcctcatcctcatggtcagattctaccgccgctcgccactcccggttggaaagcagcgatggtgatggcgcctggtgcccggccggatcagtgttccccaaggaggaggagtacctccaggtggacctccagcgcctacacctagtggctctcgttgggacccagggccgacatgccgggggtctaggaaaggagttctctagaagctatagactgaggtacagtagagacgggagacgctggatggggtggaaggacagatgggggcaagaagtcatctctggtaatgaagaccctgaaggcgtggttctgaaggaccttggtccccctatggtagctcggttagttagattctatcctcgggccgatcgcgtgatgtcagtgtgcttacgcgtggaattgtatggatgcctgtggcgtggggaatggttaagttttctgggcatttgcttcctgagcaggggcctagaaggcggcgagtgcggagaatgggcctcgaggatccccagtccggcaggtaagctgagtctatag

SEQ ID NO: 41868 - DNA, 1620 bp, Artificial Sequence
  Description of Artificial Sequence: Synthetic coding sequence
atggtgcccggcgcccggggcggcggcgccctggcccgggccgccgggcgtggattactcgccctgttactggctgtttccgcccctctcagacttcaggccgaagaactgggagacggctgtggtcatctcgttacctaccaggactctgggaccatgacatctaagaattacccgggcacataccccaaccacaccgtgtgtgaaaagaccattaccgtccctaaaggcaaaaggctgatattgcgcctgggagacctagacatcgaaagccagacatgcgcatcagactacctgctgtttacttcatcgagcgatcaatatggaccttactgcgggagcatgaccgtacctaaagaactgctgctcaatacatccgaggtgactgtgaggttcgagtccggcagccatattagtggtcggggttttctcttgacttatgcatcatctgaccaccccgatctgatcacctgcctggaaagggccagtcattacctcaagaccgaatattccaagttttgtccggctgggtgtcgggatgtcgccggagatataagcggcaacatggtcgacgggtaccgggatacgtctctgctctgtaaggccgccatccacgccgggataatagcagacgaattgggagggcagatatctgtgctccagcggaaaggcattagccggtacgaagggatcttggccaacggcgtgttaagcagggatggcagtctgtcagataagaggtttctgttcaccagcaacggctgctcccgctcgctgtcctttgaacctgacgggcaaatacgggcgtcctcgagctggcagtcagtgaatgaatctggtgaccaagtgcactggtcccccggacaggcacgactacaggatcaggggccttcctgggcctccggcgacagctcgaacaaccacaagcctagggagtggctggagattgatctgggcgagaagaaaaagattacaggaatcagaacgacaggatccacccaatcaaacttcaatttttatgtcaaaagcttcgtgatgaactttaagaacaacaactctaagtggaagacctacaagggcatcgtaaataatgaagaaaaggtctttcaggggaacagtaactttagagaccctgtccagaataattttatcccccccattgtcgcaagatatgtacgagtggtgccacagacctggcaccagaggattgcacttaaggtggaactgattggttgtcagattactcagggaaatgactctctggtgtggagaaagactagccagtcaacgtccgtctctaccaagaaggaggatgaaaccattactcgacccattcctagcgaagaaacttctacaggaattaacattaccactgtggccatccccttggtgctgcttgtggtactggtcttcgcagggatgggcattttcgcggcattcagaaagaaaaagaagaaggggtcgccttatgggtcagccgaagcacagaaaacggactgctggaaacaaatcaagtaccccttcgcacgccatcagtccgccgagttcaccatcagctatgacaacgagaaagagatgactcagaagctcgatttgatcacctccgatatggcaggatag

SEQ ID NO: 41869 - DNA, 2148 bp, Artificial Sequence
  Description of Artificial Sequence: Synthetic coding sequence
atggtgcccggcgcccggggcggcggcgccctggcccgggccgccggtcgcggccttctggcccttttgttggccgtgtccgccccactgagactgcaggccgaggaactcggggacggctgcgggcacctagtgacttatcaggactcgggcacgatgaccagcaagaattatccaggaacctacccaaaccacaccgtctgcgaaaaaacaattactgtcccaaaggggaaaaggctcattctgagactgggagatctggacattgagtcccagacgtgcgctagcgattacttgctttttaccagctcgtcagaccagtacggtccatattgtgggagtatgacagtccctaaggagttgctattgaacacatccgaggtaacagtgaggtttgaatccggaagccacatcagtggcaggggcttccttctcacgtacgcatcatctgaccatcctgacctcattacatgccttgaaagggcatctcactatctgaagacggagtactcaaagttctgtcctgcaggatgtagggatgtggctggggacatctccgggaacatggtcgacggctatcgtgataccagcctcttgtgtaaagctgccatccatgctggcattatagctgacgaactcggagggcaaattagtgtgctccagagaaagggcatctctcggtatgagggcatcctcgccaacggagtgctgtcccgggatggctcgctctctgataagcggttcctcttcaccagtaacggctgctcacggagtctgagtttcgaacccgacggccaaattcgagcatcgtcctcctggcagtcagtcaacgagtctggagatcaggttcattggagccccggtcaggccaggcttcaagatcaagggccctcttgggcctctggcgacagttcaaacaatcacaagcctcgggagtggctggagattgacctgggcgagaagaagaagattactggaataagaaccaccggaagcacgcagtccaatttcaacttctatgtgaagtctttcgtgatgaacttcaagaacaacaattccaagtggaaaacctataagggcatagtgaataacgaggagaaagtctttcaggggaactctaatttccgcgatccggtgcaaaataacttcataccccctattgtggcacgctacgtccgggtggtgccccagacttggcaccagcgcatcgcactgaaggttgagttgattggatgtcaaattacacagggcaatgattccctagtgtggaggaagacgagtcagtccacctctgtatcaaccaagaaagaggatgagaccatcactcgaccaatccccagcgaagaaacctccactggaatcaacataactacggtcgccatccctttagtgctgctggtggtccttgtgttcgccggtatgggcattttcgctgcatttcgtaagaagaagaagaagggaagtccctacgggtccgcggaagctcagaagaccgactgctggaaacagattaagtacccgtttgcgcgtcatcagagcgccgaatttactatctcatatgataatgaaaaggagatgacacagaagctggatctgattacctctgacatggctgattatcagcagccgttgatgatcggtaccggaacggtgacaagaaagggtagcaccttcagacccatggatactgacgctgaagaagcaggtgtgtctacagatgccgggggacactacgattgtcctcaacgcgccggacgtcatgagtatgctctgccgctggctccacccgagccggaatatgctacacctattgtagagcggcacgttttacgagcccacaccttttcagctcagtcaggctacagagtgccaggtccacagccagggcacaaacattctttgtccagtggggggtttagcccggtcgccggcgttggcgctcaggatggcgactatcaaaggccacactccgcccagccggctgatagggggtatgaccgacccaaagctgtgtctgcactggccacggaatcaggtcatcctgactctcagaagccacccacccaccccggaacttcagactcatattccgctcctagggattgtctgacccctctaaatcagaccgctatgactgctctcctatag

SEQ ID NO: 41870 - DNA, 1551 bp, Artificial Sequence
  Description of Artificial Sequence: Synthetic coding sequence
atggtgcccggcgcccggggcggcggcgccctggcccgggccgccggccggggtttgcttgctctcttgcttgcagtgagcgctccattgaggctccaggccgaggagctaggcgatggctgtggccatctggtcacataccaggacagcggaacaatgacaagcaaaaattatccaggaacctatccaaatcataccgtctgcgaaaagacaatcaccgtgccaaaggggaaacggctcattttgagacttggtgacttagacatagagtcccagacttgcgcatccgactacttgctgtttacatcctcctccgaccagtacggaccatattgcggcagcatgaccgtacctaaggagcttctgctcaacaccagcgaagtgacagtacggtttgaatctggaagtcacatttccgggaggggatttcttttgacctacgcctcttctgaccaccccgacctgattacttgcctcgaaagagccagccactacctcaagaccgaatactcgaaattctgtccggctgggtgcagggacgtagccggcgacatcagcgggaatatggtagacggatatcgggacacctccttactctgcaaggcagcaatccatgccgggataatagccgacgagctgggaggacagatctccgttctgcagcgaaaaggcatatcaagatatgaggggatcctcgccaatggggttttgtctagagatggttcgctttctgataaaaggttcttgttcactagcaacggcataaacatcaccaccgttgcaataccattagttctgttggttgtgctggtgttcgccggcatgggaattttcgccgcttttagaaaaaagaaaaaaaaaggctctccatacggaagtgccgaagcccagaaaaccgattgctggaagcaaattaagtacccatttgccaggcaccagtccgccgagttcaccattagttacgacaatgagaaagaaatgacccagaaactagacttaatcaccagcgatatggcagattatcagcagcccctaatgattgggacaggaacagtgactagaaagggcagcacatttaggcccatggacacggatgccgaagaggcgggtgtttcaactgatgccggtgggcattatgactgtcctcagcgggccggcagacatgaatacgctctgccactggctcctcccgaaccagagtacgccacaccaatagtcgagcggcatgtcctgcgggcccatactttttccgcccagtccggctaccgggtccccggtccacagcctggccacaagcattcattgtcatcgggggggtttagccctgtagccggagttggagcccaggatggggattaccagagaccccactcggcccagccagctgacagaggatatgatcgccccaaggcagtgagcgctctggctactgaatccgggcatcctgacagccagaagccaccgacacatccaggaacctcggactcgtacagcgccccccgcgactgccttacgccccttaaccagacagccatgacggcactgctttag

SEQ ID NO: 41871 - DNA, 618 bp, Artificial Sequence
  Description of Artificial Sequence: Synthetic coding sequence
atgaacttcaagaacaacaacagcaagtggaagacctacaagggcatcgtgaacaacgaggagaaagttttccagggaaactcgaactttagggatccagtgcagaataattttatacccccgattgttgccaggtacgtgagagttgtgccacagacctggcaccagcggattgccctgaaagttgaactcatagggtgccagatcactcagggtaatgatagtctggtttggcggaagacttctcagagtacaagtgtgagcacaaagaaggaggacgaaacaatcacgcgacccatcccctcggaggaaaccagtacaggaatcaacattacaacggtggccatccctctcgttctgctggtagtcctggtgtttgcagggatgggtattttcgcagcattccgcaaaaagaagaagaaggggtccccttacgggagcgcggaggctcagaagacggactgttggaaacagattaaatatccctttgccaggcaccagagtgccgagttcacgataagctacgacaatgagaaagagatgacccagaagttggatttgattactagcgacatggccgcaagtccagaaccagtgtctgagcctctccccccctag

SEQ ID NO: 41872 - DNA, 2328 bp, Artificial Sequence
  Description of Artificial Sequence: Synthetic coding sequence
atggccagccgggccgtggtgcgggcccggcggtgcccccagtgcccccaggttcgcgctgctgctgcggcaccagcttgggccgctctgcctttgagtcgctcattaccaccttgctcgaactcctccagcttttctatgcccttgtttcttctgcttctcctcgtgctactgctgctgctggaggacgccggagctcaacaaggtgatggctgcggccatacggtgctgggccctgaatcaggcacactcacttctatcaactatcctcagacttaccctaactcaacggtctgtgaatgggagatccgcgtaaagatgggtgagcgggttcgaattaagttcggagatttcgatatcgaggatagcgactcctgtcacttcaattacttgagaatttacaacggaatcggcgtctctcggacagagattggaaagtattgtggtctgggcttgcaaatgaatcactcaattgaatctaaaggcaacgaaatcactctgctgttcatgtctgggattcatgtgagcgggcgggggtttctggcctcctactcagtcatcgataaacaggatctcattacctgcctcgatactgcatctaattttttggagcctgaattttctaaatactgcccagccggttgccttctgccctttgctgagatctctggaacaataccacacggctaccgggactcatctccactgtgtatggctggagttcatgcgggcgtcgtgtctaatacgctgggcgggcagatctcagtggtcatatcaaagggaatcccgtactacgaatcttctctggctaacaacgtgacctccgtagtggggcatctctctactagcctctttacttttaaaacatccgggtgttatggcactctgggcatggagagtggagtgattgccgacccccagatcacggcctccagtgtgctggaatggaccgatcacaccggtcaggagaattcctggaaaccaaaaaaagcacgcctgaaaaagcccgggcccccctgggccgcctttgcgactgacgagtaccagtggctgcagattgatctgaataaggaaaagaaaatcaccggtatcattactacaggttctaccatggttgaacacaactactatgttagcgcgtatcgcatcctttacagtgacgatggccagaagtggaccgtgtaccgtgaacccggagtggagcaggacaagatctttcaggggaataaggattatcaccaggatgtgcggaataacttccttcccccgatcattgcccgcttcatccgggttaaccccacccagtggcagcaaaagattgccatgaaaatggagttactggggtgccagttcattcctaagggcagaccccctaaactgacacaaccgcctccaccacggaatagcaacgacttaaagaatactaccgcaccacccaagattgcgaagggtcgggccccaaagtttacccagcctctgcagccaaggtccagcaacgagttcccggcccaaactgaacagacgaccgcgtctcccgatattagaaatacgacagtgacgcctaacgtgaccaaagacgttgctctggctgctgttctggtcccagtcttggtcatggtgctcaccacgctaatcctgatcctggtttgtgcttggcattggaggaatcgcaaaaagaaaaccgaaggcacctatgatctgccttattgggatcgggccgggtggtggaaaggcatgaagcagttcttgccggcaaaagctgtggaccatgaagaaactcctgtgagatacagttcgtccgaggtgaaccacttgtcacctcgggaggtgacgacagtactacaagcagacagcgccgagtatgcgcagcccctggtcgggggcatagtgggcacactacaccaacggtcaactttcaagcccgaggaggggaaagaagccgggtacgctgaccttgacccgtataattcaccaggacaagaggtttaccacgcttacgcagagccgctcccaattacgggacctgagtatgcgacacccatcataatggacatgtctggccaccctactactagcgtggggcagccgagcacttctaccttcaaagccacaggtaatcagcctccccctctggtcgggacatacaataccttgctcagcagaacagactcctgctcctccgctcaagctcagtacgacacacctaaggctggaaagccgggcctccctgccccggacgaactggtgtatcaggtgccacaatccacccaagaggtctccggtgctggaagagacggtgaatgcgatgtgtttaaggagatcctctag

SEQ ID NO: 41873 - DNA, 2370 bp, Artificial Sequence
  Description of Artificial Sequence: Synthetic coding sequence
atggccagccgggccgtggtgcgggcccggcggtgcccccagtgcccccaggttagggcagccgccgctgcccctgcctgggcggcactgcctctcagccgctccctgcccccttgttccaactcctcatccttctccatgcccttgttcctgctactgctattagtgctgctccttctgctggaagacgcaggagcacagcagggagacggctgtggccacacggttcttggccccgagagtggaaccctgacttcgatcaactacccccagacataccctaattctaccgtctgtgaatgggaaattcgtgttaagatgggcgagcgcgtgaggataaagtttggggactttgacattgaggattctgatagctgccacttcaattatctgagaatttataacgggatcggagtcagtcgaacagagataggaaagtattgcgggctgggtcttcagatgaatcatagtatcgagtcgaaggggaacgaaattacactactctttatgagcgggattcacgtctccggtagagggttcctggcaagctattccgtgatcgacaaacaggacttaatcacgtgtttagacaccgcatccaattttttagaacctgagtttagtaagtactgtccggccgggtgtttgctgcctttcgccgagatttctggaacaatccctcacgggtaccgagattcctccccattgtgcatggctggggtacacgccggcgtggtgtccaatactctgggaggccagatttctgtggtcatttctaaagggatcccatactacgagtcgtcactggcgaataatgttacttccgtggtaggtcacctttctacttctctgttcacgttcaagacaagcgggtgttatggcactctcgggatggagtctggcgtgatcgcagacccgcagattacagctagttctgtgctggagtggaccgaccataccggacaggaaaatagctggaaaccaaagaaggctagattgaaaaaacccgggccgccctgggctgcgtttgccaccgatgagtaccagtggcttcaaatcgacctgaacaaagagaaaaaaatcactggcattatcaccactggctctaccatggtggaacataattactacgtctccgcctacaggatcctgtactccgatgacggccagaaatggaccgtctacagagaacctggagtggaacaagataaaatctttcagggaaacaaggattaccaccaggatgtgaggaataatttcctgcccccaattatagctaggtttatccgagttaatcccacacaatggcaacagaaaattgccatgaaaatggagctgctggggtgtcagtttattcctaagggccgcccgccaaaacttacacagcctccacctccgagaaacagtaatgatctgaagaataccactgccccacccaagatcgcaaaggggcgggcccctaaatttacccagcccttacagcctcggtccagcaatgaattcccagcgcagacagagcagacaaccgcatctcccgacattcgaaacacaacagtcaccccaaatgtgacaaaagacgtcgcacttgccgcagtcctcgtgcctgtgttggtcatggtcctaacaactctcattttgattctggtgtgcgcctggcattggcggaatcggaaaaagaaaactgagggcacttacgatcttccctattgggaccgggccggcttttacctgatggtgagtctcgcgtgtcggcacaatgaaggatggtggaagggtatgaaacagttccttcctgccaaggctgttgaccacgaggaaactccagtccggtattcctctagcgaagtgaatcatctgtcgcctcgggaggtcactacagtgctgcaggctgattcagctgagtacgctcaacccctggtcgggggtattgtcggcacattacaccaaaggtccaccttcaagcctgaggaggggaaggaggcaggttatgcggatcttgatccatacaattcccctggacaggaagtgtatcatgcctacgccgagccactccctatcacaggccccgagtacgctacgcccattatcatggacatgagcgggcaccctacaacctcggttggtcaaccaagtacctcaactttcaaggctaccggaaaccagccccctcccctcgtcgggacctataatacactgctcagccggacagattcctgcagcagtgcccaggctcagtatgacacgcctaaagcaggtaaacctggactgccggcccctgacgaactcgtctaccaggtcccacaaagcacccaggaagtttcgggggctggaagggatggcgagtgcgacgtctttaaagagatcctctag

SEQ ID NO: 41874 - DNA, 1140 bp, Artificial Sequence
  Description of Artificial Sequence: Synthetic coding sequence
atgcccctgttcctgctgctgctgctggtgctgctgctgctgctggaggatgccggagctcagcaaggagacgggtgcgggcacacggtcctcggtccagagtcaggcactctgacgtccatcaactatccacaaacctacccaaacagcaccgtttgcgagtgggaaattagggtgaaaatgggcgaacgggtaagaatcaaatttggggacttcgatatcgaggatagcgactcctgtcatttcaattacctgaggatttacaatggcattggagtgagcagaacggagattggaaagtactgcggtctcgggctgcagatgaaccattcaattgagagtaagggaaatgagatcacattgctctttatgtcagggattcacgtatcaggcagaggctttttggcctcctactctgtcatcgataagcaaggaagcaactatctgtttggtcactgcattcagttctggaacctctcctcaggcaaatattgccctgccgggtgcctgctgccattcgccgaaatatccggtaccattcctcacggctatcgggattcatctcctctgtgtatggcgggagtccacgccggtgtggtgtccaatacactcgggggccagatttcggtcgttatctctaaggggatcccctactacgaatccagcctcgctaataatgttacctcggtggtgagcgtgtctctgctcatggtctttatcctcttcttcgtctccggttgctacgggaccctgggcatggagagtggagaccgaggatcatctaacaactcaatagtgctcgagtggactgaccacacagggcaagaaaactcttggaaacctaagaagcaagccgaaaagacctggaccgcactgggctttgcgaccgacgagtatcaatggctgcagatagatttaaataaggagaaaaaaataaccggcattatcaccacaggaagtaccatggtgaccatcaccatgtgtctgcccacggagtcctgtacagtcatgatgggacggaatgggctctgcactgaatccctggttgagcaggataagatctttcaaggcaacaaggattaccaccaggatgtgcggaataacttcctgcctcccataatcgccaggtttataaggtag

SEQ ID NO: 41875 - DNA, 1884 bp, Artificial Sequence
  Description of Artificial Sequence: Synthetic coding sequence
atgaacctgatcttccacaaggacatcctgttcggcatccccgccaataaagtacctcaggacgagtggacaggttacacaccgcgcggcaaggacgatgaaattccatgccggcggatgaggtcaggctcttacatcaaggcgatgggtgatgaggactccggtgattccgatacaagcccaaaaccttcccccaaggtggctgcccgaagggagagctatcttaaagcaacacagccctccttgacagagctgaccacattaaagatctccaatgagcatagccctaagctccaaatcaggagtcattcttatctgagggcagtcagtgaggtttccataaaccgttcactagatagtctggaccctgccgggcttctgactagccccaagttccgatcacgaaacgagagctatatgagagcaatgagcacaatcagtcaggttagcgagatggaagtcaacggccagttcgaaagcgtctgcgagtctgtcttcagtgagctagagtctcaggcagttgaggcgttggacctccccatgcctgggtgttttagaatgagatctcactcttacgtcagagccatagaaaaggggtgtagtcaggatgacgagtgcgtgtccctgaggagttcgtcgccccctcggacgactaccacagtcaggacaattcagagtagcactgtgagcagctgtatcacaacatataaaaaaaccccaccccctgtgccaccccgcacgactactaagccttttatttcaataaccgctcagagttctaccgagtcagcacaggacgcctacatggatggtcagggccagcggggggatatcatatcacagtccgggctcagcaattcaacagagagtctagatagcatgaaagcgctcacggccgctattgaagccgcgaacgctcaaattcacggtccggccagccagcatatgggtaacaacaccgccactgtaacgactaccacaacgatcgctacagtaactaccgaggaccgaaagaaggaccacttcaagaagaaccgatgcctgagcattgggatccaggtcgatgatgctgaagaaccagacaagacaggcgagaacaaagcgccatccaagtttcagagtgtcggcgttcaagtggaggaggaaaagtgctttcgaaggttcactagatccaacagcgtcaccacggctgtccaagcggacctggatttccacgacaatctcgaaaatagcctggagagtatcgaagataactcttgtccaggacctatggcacgccagttctctcgcgacgcctctacttcaacagtgagcattcagggcagtggcaaccactatcatgcttgcgccgcggacgatgacttcgacacagattttgatccttcaatactcccacctcccgatccttggatagacagcattactgaggaccccttggaggctgttcagagaagtgtttgtcatcgcgacggacactggtttctcaaacttctacaggcagagagagaccgtatggaaggctggtgccaacagatggaaagagaggagcgggagaacaaccttccagaagatatcttaggtaagatcaggactgctgtgggatcagcacaactcctcatggctcagaagttttatcagttccgcgagctgtgcgaggagaatctgaatcctaacgcacacccgaggccgacttcccaggacctggctggattttgggatatgctgcagctcagcattgaaaatataagcatgaaattcgatgagctccaccaattgaaagccaacaattggaagcaaatggatcctctggacaagaaggtggagcagtgtcggttttgcatggttcatctgaaaacatgcaccaacacaggacagtccaagtag

SEQ ID NO: 41876 - DNA, 2082 bp, Artificial Sequence
  Description of Artificial Sequence: Synthetic coding sequence
atgatcgacctgttcaaggccgagtgggtgagcagcgtgtgcgtgcaggtgagcagaaacggacgcacggaccaggttccccaagatgaatggacaggctacacaccacgtggaaaagatgacgaaatcccatgcagacggatgcggagtggcagttacattaaggcaatgggggacgaggacagcggcgacagcgacacatcccctaaaccctctcctaaggtcgccgcccggagggagagctatctcaaggccacccagccctccttgacagagctgaccacacttaaaatcagtaacgagcactccccaaagttgcagataagatcccattcttatctccgcgcagtcagcgaagtgagcataaacaggagcctcgactccctggaccccgccggtctgctcacgtcacccaagtttagatcccggaacgaatcttacatgcgggctatgagtacgatttcccaggtgtccgaaatggaggtaaacgggcaatttgagagcgtgtgcgagtccgtcttcagcgaattggaaagccaagccgtagaagcactggacctgcccatgccagggtgctttagaatgcgctcccacagctacgtccgcgcgattgagaagggttgctcccaggatgatgaatgtgtgtcacttcgtagctcatcacctccacgtactactactacagtgcgcaccatccagtcctcaacgggggtaataaagctgagcagtgccgtggaggtcagcagctgtatcacaacatacaaaaaaacccctcccccagtgccgcccagaactacgaccaaacccttcatctcgatcacagcacagagctctacagaatcagcgcaagacgcttacatggacggccaagggcagcgtggggacatcatctcacaaagtggactgagcaacagcacagagtcgctggactcaatgaaggctctcacagccgcgatcgaggccgccaatgcgcagatccacgggcccgcctctcagcatatggggaataacactgctaccgttactactactacaactatcgccaccgttacgactgaggatcggaaaaaggaccactttaagaaaaacaggtgccttagtataggaattcaggtcgacgatgctgaggaaccggataaaaccggggagaataaggctccatcgaagttccaatcagttggcgtgcaagtggaggaggagaagtgttttagaaggtttacccgctctaattctgtaactaccgcagttcaggccgacctagatttccatgataacctcgagaattcccttgaatctatcgaagacaattcctgtccaggtcctatggcccgacagttctcccgcgacgctagcaccagtacggtgtctatacagggatccggaaaccactatcatgcttgcgcagctgacgatgacttcgacacagactttgatccgtctatactgccccctcctgatccctggatcgatagtatcacagaagatccattggaggccgtgcagagatcggtgtgtcatcgtgacgggcattggttcttgaaattactgcaggctgagcgcgacaggatggaaggatggtgtcagcagatggagcgggaagaacgggaaaacaacctcccagaggatattctgggaaaaatccgaacagctgtaggaagcgcccagctcctaatggcacagaaattctatcagtttcgtgagttgtgtgaagagaacctgaatcccaacgcccatcctaggcctacttcacaggatctcgccggcttctgggacatgctccaactgagtatcgagaatatttctatgaaattcgatgaactgcatcagttaaaggcaaataattggaaacagatggatccactcgacaagaaagagagaagggccccacctccagtgcccaaaaaacctgcaaaaggccccgcacccctcatccgggaacgctctttggaaagctcccagcgacaggaagctcgtaaacggcttatggctgctaagagagccgcttccgtgcgtcagaacagtgccactgagagcgcagagtcgattgaaatatacattccagaagcccagacacgtttatag

SEQ ID NO: 41877 - DNA, 2052 bp, Artificial Sequence
  Description of Artificial Sequence: Synthetic coding sequence
atgatcgacctgttcaaggccgagtgggtgagcagcgtgtgcgtgcaggtctcacgtaacgggagaaccgaccaggtgccccaggacgaatggaccgggtataccccacgcgggaaggatgacgagattccttgcaggaggatgcggagcggcagttacatcaaagccatgggcgatgaagatagtggagactctgacactagccccaagccttccccaaaagtcgccgctcggcgggaaagctacttgaaagccacccagccaagcctcaccgaactcactacactgaagatcagcaatgaacactcacctaaattgcagatcaggtctcactcctatctgagggcagtttcggaggtgtccatcaacaggtctttggacagcctcgacccggcagggctccttacaagtcctaaattccggagccgcaacgagtcctatatgcgggctatgtcaaccatctcacaagtaagcgaaatggaagttaacgggcaattcgagagcgtttgtgagagtgtgttttcggagctggagtctcaggctgttgaggcgttagacctcccaatgcctggctgtttccgtatgcgaagccactcctacgtacgggccatcgagaagggctgctctcaggatgacgagtgcgtgtctctgcgctcctcgtcgccgccccgtactacaaccacggtacgcacaatccaatcaagcacggtgtcttcatgtattacaacatataaaaagacacctcccccagtaccaccacgcaccacaaccaagccttttatttccatcactgcccaaagtagcactgagtcagctcaggacgcctatatggacggacaaggccagcgcggagacataatatcccaatctggactctctaattcaactgaatccctcgattccatgaaggcgttgactgcggcgattgaagccgctaatgcccagattcatggacccgcttctcaacatatggggaacaatacagccactgtaaccacaaccaccacgatcgctaccgtaacaacggaagacaggaagaaagatcatttcaaaaaaaatagatgtctaagcataggtatccaagtggacgatgccgaggaacctgacaagacaggggaaaacaaagccccgtcaaagtttcagagcgtgggagtccaggtcgaagaagagaagtgtttccggaggtttacccgctccaatagcgtcacaactgccgtgcaggcggacctggatttccatgataatctcgagaatagcctggaatccatcgaggacaactcatgtcctggcccaatggcaagacagtttagccgcgatgcgtccacctctaccgtcagcatccagggatctgggaaccattaccacgcctgcgctgcagatgatgacttcgacacagattttgacccaagtattctccccccgcctgatccctggattgacagcatcaccgaagatccccttgaagcagttcagcggtccgtatgccaccgtgatggccactggttcttgaaacttctgcaggccgagcgggaccgaatggaaggctggtgtcagcagatggaacgtgaagagcgcgagaataatctgccagaagacatcctcggtaagattcgcaccgccgtggggagtgcgcagttgttaatggcacagaagttctatcagtttcgcgagctgtgcgaggaaaacttaaatcccaatgcccacccgaggcccaccagccaggacctcgcgggcttttgggatatgctgcagttatcgattgagaacatttcgatgaagtttgatgagctgcaccagctgaaggctaacaattggaagcagatggaccccttggataaaaaagaaagaagagccccgccccctgtacctaagaagcccgccaaagggccagccccactgattcgggagagatccctggagtcttctcaacgccaggaagctagaaaaagactcatggccgctaaaagggctgcttctgtaagacagaactctgccactgaatccgcagaaagcatcgaaatttatatcccggaggcccagacccggctatag

SEQ ID NO: 41878 - DNA, 2790 bp, Artificial Sequence
  Description of Artificial Sequence: Synthetic coding sequence
atgaagggcctgagcggcagccggagccaccaccacggcgtgacctgcgactctgcctgcgacagtctgagccatcacagcgaccgcaagccctatctgctttcacctgttgagcaccaccccgcagaccatccgtattatacacagaggaactctttccaggcagagtgcgtcgggcctttttctgatccgctggcatcaagtacttttcccaggcggcattatacttcacaacaagagctcaaagacgagtgtgccctggtgcctcgaaccctagctactaaagccaatcggataccggccaaccttctggaccaattcgagaggcagctgcctctttcccgggacggctaccatacgcttcagtacaagagaacagccgtggaacatagaagtgatagcccaggcagaattaggcacctggttcacagtgtacagaagttgttcaccaagagccattccctcgagggaccttccaaagggtcagttaacgggggtaaggcctccccggacgaagcccaggctgccagatacggaaaacggtctaaaagtaaggaaaggcgcgccgagcctaaggcccgaccaagcacttccccgggatggtggtcgtccgacgataatttagatggtgatatgtgtatctaccacgctccaagcggggttatgactatgggacggtgtcctgatagatcagcgagtcagtattttcttgaggcctacaacacaatctccgagcaagctgttaaggccagtcgcagcaacaatgacgttaagtgcagcacatgcgcgaacctgcccgtgtcgctggacacaccactgttgaaaaaatccgcgtggtcctcaacattaactgtcagtcgtgcccgagaggtgtatcagaaagccagtgtcaacatggatcaggcaatggtcaaatccgagagttgtcagcaggagagaagttgtcagtacctgcaagtgcctcaagacgaatggacagggtacaccccaagggggaaggacgatgaaattccctgtcgccgcatgaggtcaggtagttacattaaagcaatgggagatgaagacagcggggacagtgacacatctcccaaacccagcccaaaggtagctgcacgaagagaaagctacctaaaggcaacgcagccgagcttaactgaacttacgacattaaagatctcaaacgaacactcccctaagctgcagatcagatcacattcttatctccgggccgtcagcgaggttagcatcaatagaagtctggacagtctcgaccccgccggcctgctaacctcgcctaagttccgcagtcggaatgagtcctacatgcgggctatgagtaccatctcccaggtgtctgagatggaggtcaacggccagtttgagagcgtttgtgaaagcgtcttttccgaactcgagtcccaggcagtcgaagccctagatcttcccatgccaggctgtttcagaatgaggagtcactcctatgtgagagctattgaaaagggttgtagccaggatgatgagtgcgtttcactgagatcaagctctccacctcgcactaccacaactgtaagaaccatccagtcttccactgtgtccagctgcatcaccacttataaaaaaacccccccccctgtccccccccgcactacgaccaaacctttcattagtatcacagctcagagcagcaccgagtcagcacaagatgcctacatggacggccagggacagaggggcgatattatatcccaaagcgggttgagcaactcaactgagagtctggattctatgaaagctctcacagctgccatagaggccgccaatgcgcagatccacgggccagcgtctcagcatatgggcaataacacagccaccgtgacaacaacaaccaccatcgcgacggtgaccactgaggataggaaaaaagaccatttcaaaaaaaaccgttgtctttccatcggcatacaggttgatgacgccgaagaaccggacaagacgggcgagaacaaggctcccagtaaattccaatcagtcggggtacaggttgaagaggagaaatgcttccgtcgattcactaggagcaactccgtgaccactgctgtccaggccgacctggatttccacgacaatctggagaattcactggagtctattgaagataattcgtgcccaggtccaatggctagacaattctctcgggacgcatcaacctccactgttagcatccaagggtctggcaatcactaccacgcttgcgccgcagatgatgactttgatacggatttcgatccatcaatactgccacctcctgacccctggatagatagcattaccgaagaccccctggaagctgtccagcgctctgtatgccaccgggatggacattggtttctgaagttgctccaggcggaacgggaccgaatggaaggctggtgccagcagatggaaagggaggagagggagaacaatttgccggaggatatcctgggaaagatccgaaccgcggttgggtccgcacagctgctgatggcacaaaagttttatcagtttcgggagctgtgcgaggaaaatcttaacccaaatgcccacccaagacccaccagtcaggatctggctgggttctgggatatgctgcaattatcgatcgagaacatcagcatgaagttcgacgagctgcaccagctgaaggccaataactggaagcagatggatcctttagataagaaggtcgaacagtgtcggttttgtatggtgcacctgaaaacctgcactaacaccggtcagtccaaatag

SEQ ID NO: 41879 - DNA, 2934 bp, Artificial Sequence
  Description of Artificial Sequence: Synthetic coding sequence
atgaagggcctgagcggcagccggagccaccaccacggcgtgacctgcgactcagcatgtgactctttgtcacaccacagcgatcgaaagccttacctcttgtctcccgttgaacatcatccagcagaccatccgtactacacacaacgcaatagcttccaggctgaatgcgtggggccttttagcgatcccctcgcatctagcacctttcctcgtcgtcactacaccagtcaacaggagctaaaggatgagtgtgcacttgtacctcgcacacttgcaactaaagctaaccggatccccgccaaccttctcgaccagttcgaaagacagctccctctatctagggatggctaccataccctgcagtacaagcggacagcagtcgagcataggtcagactctccaggcagaatccgtcatcttgtccattctgtgcagaagctctttacaaaatcccatagtctagagggcccctcgaaaggcagcgtgaacggcggcaaggcatcaccggatgaagcccaagctgcgcgatacggcaaaaggagtaagtctaaagaaagacgcgctgagccaaaggccagaccatcgacgtcacccgggtggtggtccagcgacgacaatcttgacggcgatatgtgcatctaccacgccccatcgggggtgatgactatggggcggtgcccagatcgatctgcatctcagtattttctggaagcctataacaccataagcgaacaggcagttaaggcctcccgcagtaataatgatgtgaaatgttccacctgtgctaatctccctgtgtcactagacacgcctctcctcaagaagtccgcttggtcatccacactgacagtgtcaagagccagagaggtgtaccagaaagcgtctgtgaacatggatcaagccatggtgaaatctgaatcatgccagcaggaacgctcctgtcagtacttgcaggtcccgcaagacgagtggacgggttatacccctcgcggaaaggatgatgaaattccgtgtcgccggatgaggtctggcagttacatcaaggcaatgggcgacgaggacagcggtgattccgacacttcccccaaaccctccccaaaggtggctgctcgccgggagtcctatctgaaggccacacaacctagtctgaccgagctgaccactctgaagatcagtaatgagcatagtccgaagttacaaattaggtcacattcatatttacgggcagtgtcagaggtatctatcaataggtcccttgacagtctcgacccagcgggccttctgacaagccccaaattcaggtctcgcaatgaaagctacatgcgggcaatgtccaccatttcgcaagtgagcgagatggaagtcaatggacagttcgagtccgtgtgcgaaagcgtgttctcagaactggaatcacaggcggtcgaggcgcttgatctgcctatgccagggtgtttccgcatgagatcccattcatacgtgcgggcaatcgagaaaggatgttcacaagacgatgagtgtgtctcacttcggagtagctcacctccacgcactacaacaaccgttaggacaattcagtcatccacggtaagttcatgcataacaacctacaagaagacccctccacccgtaccacctagaaccacaacaaagcctttcatctcaattacagcccaaagtagcacagagtctgctcaggatgcttacatggacgggcaaggacaaagaggagacatcatctcccagagtggcctgagcaactctactgaatctcttgactctatgaaggcactgaccgccgctatcgaagccgccaacgcacaaatccacggacctgcatcgcaacacatgggaaataataccgccacggtgactaccacgaccaccatcgcaacggttaccaccgaagacagaaaaaaagatcacttcaaaaaaaatcgctgcctaagtatcgggattcaagtagacgatgccgaagaacccgataaaaccggagagaacaaggcccccagtaagttccagtctgtgggagtgcaagttgaggaagaaaagtgcttcagaagatttacgagatccaatagtgtgactaccgctgtccaggcagatctggatttccacgacaatcttgagaactctctggagtccatcgaggataattcctgcccaggacccatggccaggcagttctctcgcgacgctagcacgagtaccgtgtcaatccagggaagcgggaatcattaccacgcttgtgctgctgatgacgatttcgacaccgatttcgacccttcaatactacctccgcccgacccctggatcgacagcatcaccgaggacccgcttgaggccgtccagcgctcggtttgccacagggatggacattggttcttgaagcttctgcaggctgagcgcgatcgcatggaggggtggtgtcagcagatggaacgcgaagagcgagaaaataatttgcccgaagacatcctgggcaagattcgcactgctgtgggttcggcccaattactgatggctcaaaaattctaccagtttcgcgagctctgtgaggaaaacctgaaccctaatgcccatccccgccccactagccaggacttagcagggttctgggatatgctgcagcttagtattgaaaatatctcgatgaagttcgatgagctgcatcaactgaaggccaacaattggaagcaaatggacccactcgacaagaaagagcgcagagctccccctccagttccaaaaaagccggccaagggccctgcacccctgatccgggaaagatccttggagtctagtcagcggcaggaggcgaggaagaggttaatggctgctaaacgggccgcctctgtgcgccaaaacagtgcaacagaaagtgctgagtctattgaaatttacatcccggaggctcaaaccagattgtag

SEQ ID NO: 41880 - DNA, 2028 bp, Artificial Sequence
  Description of Artificial Sequence: Synthetic coding sequence
atgaacctgatcttccacaaggacatcctgttcggcatccccgccaataaagtgccacaggatgagtggacaggctacacacctagaggaaaagatgatgagatcccgtgccggaggatgaggtccgggtcttatataaaggccatgggtgacgaggacagcggcgacagcgacacatccccaaagccatcacctaaggtcgcagcacggcgcgagtcgtatctcaaagctacacagccttccttgaccgagctgactacactcaaaatctctaatgaacactctcccaaactgcagatcaggtcccactcatacctgcgtgccgtttccgaagtgtctattaacagatccctggattccctggacccagccggcttgctaacttctcccaaattcaggagtagaaatgaatcttacatgcgtgctatgagtacaattagccaagtgtcagagatggaagtgaacgggcagtttgagagtgtgtgtgagagcgtgttttccgaacttgagtcccaagcagttgaagccttagatctgcccatgcctggttgttttagaatgcggtcccattcttatgtgcgggctatcgagaagggctgctcccaagatgacgagtgcgtctccctccggagcagttcccccccaagaacaaccacaaccgtgaggacaattcagtcttcgactgttagttcttgtatcactacatacaagaagacccccccgcccgttccaccccggaccaccactaagccatttatctcaatcaccgcccaatcgagtaccgagtcggctcaggatgcctatatggatggccagggacagcgaggcgatattatctcccaaagcgggctgtccaattctacagaaagcttagattccatgaaggctctgaccgccgccatagaggctgccaacgcacagatacatggtcccgcgtcacagcatatgggtaataatactgcaacggtgaccacaacaaccaccatagcaacagtaacaacagaggatagaaagaaagatcacttcaaaaagaataggtgcttgagtatcgggattcaggtcgatgatgctgaagaaccagacaagactggagaaaacaaagcaccatccaagttccaaagcgtcggggtgcaagtggaggaggagaagtgttttcgaagatttacacgatcaaattccgtaactactgctgtgcaggctgatttagattttcatgacaacctcgagaattctctggaatctattgaggacaactcatgtcctggccccatggccaggcagttcagccgggacgcatctaccagcaccgtctccatccagggatccggaaaccactatcacgcatgcgccgccgacgacgatttcgacacagatttcgatccaagtatccttccacccccggacccatggattgactccatcaccgaagacccactcgaggcggtgcaacggagtgtctgccatcgggacggccattggtttcttaaacttctgcaggcggagagagacagaatggaggggtggtgtcagcagatggaaagagaagagagggagaacaatctgcccgaggatattttaggcaaaattaggactgcagtcggctcggcgcagctgctcatggcccaaaagttctatcagtttagagaattgtgtgaggaaaatcttaatcctaacgcccacccacggcctactagccaagacctggcaggattctgggacatgctgcagctaagcattgaaaatatcagtatgaaatttgacgagcttcatcagctgaaagcaaataattggaagcagatggaccctttggataagaaggaacgacgcgcacctccgcctgtgcccaagaaaccagccaagggcccagctcctttgattcgtgaaaggtctctcgaaagctctcagagacaagaggcccggaagaggctgatggcagccaaaagagccgcaagtgtgcgccagaatagcgcgactgaatcagcagagtccatcgaaatctatattccggaagctcaaactcgtctctag

SEQ ID NO: 41881 - DNA, 2790 bp, Artificial Sequence
  Description of Artificial Sequence: Synthetic coding sequence
atgaagggcctgagcggcagccggagccaccaccacggcgtgacctgtgactctgcatgcgattccctctctcatcatagcgacaggaagccttatctgctctctcccgttgagcaccaccctgccgaccatccatattatacgcagcgcaactcatttcaggccgagtgcgtgggtccttttagcgatccactggccagcagcacattccctaggcgccactacaccagccagcaagagctaaaggatgagtgtgccctggtgccccgcactttggcgaccaaagcaaaccggatccccgctaatctcctggaccagttcgagaggcagctacccttgagtagggacggttatcataccctgcaatacaagcgcaccgctgtcgaacaccgttcagacagtccggggcgcatccgtcatttagtacatagtgtgcagaaactattcaccaaatcccacagcctcgaaggcccaagtaaaggcagcgtgaatggagggaaagcaagccccgacgaagcccaagccgcaaggtatggcaaaagatctaagagcaaggaacggagagctgagcccaaagcccgcccatccacctctccaggctggtggtccagtgacgataacctggatggagacatgtgtatctatcacgctccctccggggtcatgacaatgggtcggtgccctgaccggagtgcatcccagtactttttagaggcttataatacaattagtgaacaggccgtgaaagcatccaggtcaaacaatgatgtgaaatgctccacttgcgccaacttgccagtgtccctggatactccactattaaagaaatcagcgtggagctccaccttaaccgtgtcccgggcacgagaggtgtaccagaaggccagtgttaatatggaccaggctatggttaaatctgagtcctgccagcaagaaagaagctgtcagtacctgcaggtgccacaggacgagtggactggctacacaccaagaggtaaagatgatgagattccttgtaggcggatgcggtctgggtcctatatcaaggcgatgggggacgaagatagtggcgactccgacacatccccaaaacctagcccaaaagtggctgcgagaagggagagttacctcaaggccacgcagcccagtttaactgagctgactaccctcaagattagcaacgaacattcgcctaagttgcagatacggagccacagctatctccgtgcagtaagtgaggtgtctattaatcggtctctcgattcattggaccctgccgggctgttgaccagcccgaagtttcgatctcgcaacgaatcttatatgcgggccatgtccactattagtcaggtctctgagatggaggtgaacggacagtttgaaagcgtttgcgagtccgtgttcagcgagctggagagccaggccgtggaggccctggacctgcctatgccaggctgttttcgcatgcgatcacattcttatgtccgggccatagaaaagggctgttcccaagatgatgaatgtgtgtccctgcgctcttcctcaccgcctaggaccacaacgacggtgagaaccattcagtccagcacagtttcctcctgcataaccacctacaagaagacccctcctcctgtgccgccccgcaccaccaccaaaccgtttattagcatcaccgcccagtcatctacagaaagcgcacaggacgcatatatggatgggcagggacaaagaggggatatcatcagccagagcggcctgtcgaactccaccgaatctctggatagcatgaaagcactcactgccgctattgaagctgctaatgcccagatccacggtccagcatcccaacatatgggtaataacaccgcaacagtaacaacaactaccacgattgcgacagtcaccacggaagaccgaaagaaagaccattttaaaaaaaatcggtgtttgagtatcggcatccaggttgatgacgccgaagagccagataaaacaggggaaaataaagctcccagcaaatttcagtcagttggcgtacaagtggaggaggaaaaatgctttcggcgtttcactcggtccaactcagtgacaactgctgtacaagccgacctggactttcacgataatctggaaaattctcttgaatctattgaggataacagctgccctgggcctatggcacgccagttcagccgtgatgcgtccacatccacagtcagcattcaaggcagtggtaaccattaccatgcttgcgctgcagacgacgacttcgatacagacttcgacccttccatccttccgcctccggatccctggattgacagtatcactgaagatcccttggaggcagtacaaaggtcagtttgccatagagacggccactggttccttaagcttctacaggctgaaagagatcggatggagggttggtgtcagcagatggaacgcgaggagcgcgaaaacaatttgcccgaggacattttagggaaaataaggactgcggtggggtccgcccaactgcttatggcccagaagttctatcaattccgggagctgtgcgaagaaaatttgaaccccaacgcccatccccgccctacctcccaggatcttgccggattctgggatatgcttcagctgtctattgagaatatatccatgaagtttgatgaattgcatcagttgaaggccaataactggaagcagatggacccactcgacaaaaaggtggaacagtgccgcttttgtatggtccatctgaagacatgcacgaacacaggacagtcaaagtag

SEQ ID NO: 41882 - DNA, 1986 bp, Artificial Sequence
  Description of Artificial Sequence: Synthetic coding sequence
atggacctgaagaccctgaagctgttcaacagccagctgcggtgcggatggctgctgtatatctggaacaaggcttttatggcacaccttcgggtgcctcaggatgagtggaccgggtacacacccaggggaaaagacgacgaaataccttgtcggagaatgcgctccggatcttacataaaggcaatgggtgacgaagattcgggagattcggatactagtccaaaacccagccccaaagtcgccgccagaagagagagttatctaaaggccacccaaccttcactcactgagcttaccacacttaaaatcagcaacgaacatagcccaaaactccagattagatcgcactcatatctccgcgcagtgtccgaggtttccatcaacaggtccctagactccctggaccctgctggcctgctcacctctccaaagtttcgctcaagaaatgaaagctatatgcgtgctatgagcacaatctcgcaagtgtcggaaatggaagttaatggccaatttgaatctgtatgcgaatcagtatttagtgagttagagagtcaggccgtggaggctctggatctgcctatgcccggatgctttaggatgcgttctcattcatatgttcgagctatcgaaaaaggatgcagccaggacgacgagtgtgtgagcctgcgcagcagctctccacccagaaccactaccacagtgcgaaccatccaatcaagtaccgcgcagtctagcactgagtccgcccaggatgcctacatggacggccagggacagagaggagatatcatctcacaatccggtctctctaactctaccgaaagtctcgactccatgaaggcgttgacagccgccatcgaagccgcgaatgcgcagattcacggaccggcaagccagcacatgggaaacaacaccgccaccgtgaccacgaccaccaccatcgccacagtgaccaccgaggaccgtaaaaaagatcacttcaaaaaaaaccggtgcttatccattggcatccaagtcgatgatgctgaggagccagataaaacgggcgaaaataaagcacctagcaaattccagtctgtcggagtacaagttgaagaagaaaagtgcttccggcgatttaccagatcaaattctgtgaccaccgctgtgcaagcggacttggattttcacgataacctggagaatagtcttgaatctatcgaggacaacagttgcccgggcccaatggcacgtcagttcagcagagacgcatcgaccagcaccgtctccattcagggcagcggtaaccattaccacgcttgtgccgccgacgatgattttgataccgattttgatccctctattcttcccccacccgatccatggatcgacagcatcaccgaagaccccctggaggccgtacagaggagcgtatgccaccgtgacggccactggttcttgaagctactgcaggccgaacgtgaccgcatggaagggtggtgtcaacaaatggaaagggaggaacgtgagaataacttgccagaagacatactgggaaagattcggacagccgtgggctccgcccagttgcttatggcccaaaagttttaccagttcagagagctgtgtgaagaaaatctgaaccctaatgcccacccgcgccctacctcacaggacctggcagggttttgggatatgctgcagttatctatcgaaaatatctccatgaagttcgatgagctgcaccagctcaaggctaataactggaaacagatggaccccctagacaaaaaggagaggcgcgcaccgccgcccgtacccaagaagcccgcgaagggcccggcacctctcatccgggagagatctctcgaatcatctcaacggcaggaggctaggaagaggttgatggctgccaaacgggcagccagcgtgaggcagaactcagcgactgaaagcgctgaatccatcgagatttacatacctgaggcacagacccgattatag

SEQ ID NO: 41883 - DNA, 2058 bp, Artificial Sequence
  Description of Artificial Sequence: Synthetic coding sequence
atgaacctgatcttccacaaggacatcctgttcggcatccccgccaataaggtaccccaggatgagtggacaggctacacccctagaggtaaagatgacgagatcccttgtcgtcgcatgcgtagtggatcatatataaaggcaatgggagatgaggactctggcgacagcgacacgtccccaaaaccatcacctaaggtggctgctagaagggaaagttacttgaaggctacacagccttcattaactgagcttactaccctgaaaatctctaatgaacacagtcctaagctgcagattagatctcactcctatttgcgagcagtgtctgaggtgagcatcaatcgtagcctggatagcctcgatcccgccgggctactgacttcgccaaagttcagatctagaaatgaaagctacatgagggcaatgtccacaatatctcaggtcagcgagatggaggtgaacggacagtttgagtctgtctgtgagtctgtcttctccgagctggaatcccaggccgtcgaagcccttgacctgcccatgcctggctgtttcaggatgcggtcccactcctacgttcgcgcaattgagaagggttgttctcaggacgatgagtgcgtgagtctgagatcatcatccccccctagaaccaccaccaccgtgaggactatccagtcctcaactggggtaatcaaactcagcagtgccgtggaagtcagtagctgcataactacctataaaaagactcctcctccagtgccaccacgcacaaccaccaagccctttatttctataacagcccagtcctccaccgagtccgctcaagatgcctacatggacggacagggacagagaggcgacataatttcccagtctggcctcagtaacagcacggaatccctcgattctatgaaggcactgactgcagctattgaagcggctaatgcgcagatccatgggcccgccagtcagcatatgggaaataatacggccactgtcacaaccaccaccactatcgccacagtcactaccgaagaccgaaaaaaggatcattttaagaaaaataggtgtctatccataggaatccaggtggatgacgccgaggaaccagacaaaacaggagaaaataaagccccttcgaaattccaatctgtgggggtccaggtcgaagaagagaaatgctttcgccgtttcactcgcagtaacagtgttactacagccgttcaagcagatctggattttcacgataaccttgagaactctctggagtctattgaagataacagttgccccgggcccatggccaggcaattttcacgggacgccagtacctccaccgtctccatccagggttctgggaatcactatcacgcatgcgccgcagacgatgatttcgataccgacttcgaccccagcatcctccctccccctgacccatggatagatagtatcacagaggaccccttggaagcagtccaacggagcgtctgccatagggatggccattggtttttgaaactgctgcaggcagagcgagatagaatggaagggtggtgccaacagatggaaagggaggagcgagaaaataatctgccagaggatattcttgggaagatcaggacggctgtgggttctgcccaattactcatggcacaaaagttctatcagttcagagaactttgcgaggaaaacctgaatcccaatgcgcatccccggccaacgtctcaggacctggccggattctgggacatgctccagctgtctatcgagaatatctcaatgaaatttgacgagctgcaccagctgaaagctaacaactggaagcagatggaccccctggacaagaaggagcggcgagccccacctccagttcccaagaagcccgctaagggccccgccccgcttatacgggaaaggtcgctagagtcctctcagaggcaggaagctaggaagcgtctcatggccgccaaacgcgcagcctccgtgcgccagaactctgctaccgagagtgcggagtctatcgagatctacattccagaagcgcagacccgcctatag

SEQ ID NO: 41884 - DNA, 2196 bp, Artificial Sequence
  Description of Artificial Sequence: Synthetic coding sequence
atgggcagcgagaaggacagcgagagcccccggagcaccagcctgcatgccgctgcccctgatccaaagtgccggtccgggggtaggaggagacggctgaccctgcactcagtgttctccgcgtccgctcgcgggcggagggcaagggcgaagccacaggcagaaccacctccccccgcagcccagccccctccggcccctgcgcctgccgccgcccagggacccccccccgaggctcttcctgcagaaccggctgcggaggcagaggccgaagccgcggcagcagctgcagagccaggatttgatgacgaagaggcggctgaaggcggaggtccaggagccgaagaagtggagtgtccattatgtctcgtacgacttccgccagagcgggcacccaggcttctgtcatgtcctcatcgttcctgccgcgattgtctaagacactatctccgcctcgagatttccgagtcgcgcgtcccaatttcctgcccagagtgttccgagaggctgaatccacatgatatacggctgttgctggctgatcctcccttgatgcataagtacgaggagtttatgctgagaagatacctggcgtccgatccggattgcagatggtgcccagctccagactgcggctacgcggtcattgcatatggctgcgcttcctgccccaaacttacctgcgagcgcgagggctgccagactgagttctgctaccactgcaaacagatctggcatcctaaccagacttgcgatatggcacggcagcagcgggctcagacattgcgtgtccgcacaaagcacacaagcggactgagttatggccaagaatccggaccagacgacatcaaaccatgtcctcggtgctccgcatatattatcaaaatgaatgatggtagctgcaaccacatgacttgtgcagtgtgcggatgcgagttttgctggctgtgcatgaaggagatcagtgatcttcattacttgtccccatcaggctgtacattctgggggaagaaaccttggagtagaaaaaaaaagatcctgtggcagctgggtacattgatcggcgctcccgtgggaatttctttgatcgcaggaatcgctatcccagccatggtgattggaattcccgtgtatgtggggaggaaaatccatagccgctatgaggggcgcaagacctccaagcataagcggaatctggctattaccggaggcgtcacactctctgtgatcgcttctccggtcatagcagcagtcagcgtggggatcggagtgcctataatgctcgcatacgtctatggtgtcgtaccgatttcattatgtcggggaggaggctgcggcgtgtcaacggccaacgggaaaggcgtaaaaatcgagtttgacgaggacgacggacctataacagtggcagatgcctggagggccttaaaaaacccaagtataggtgagtcttccatcgagggactgacgtctgtgctgagcacctccggcagcccaactgatgggctaagcgtgatgcaaggcccctacagtgaaacagcctcctttgcagcactctcagggggcacgctttctggcgggattctgtctagtggaaagggaaaatatagccgattggaagtgcaggcggacgttcagaaggagattttccccaaagatactgcgtccctcggagctatcagcgacaacgcatctacacgggctatggcaggaagcattatctcaagttacaatccccaggaccgtgaatgcaataatatggagatccaggtcgacattgaagctaagccttcacactatcagctcgtttcggggtcctcaacagaagattccctccatgtgcacgcccagatggccgaaaatgaagaggagggtagcgggggcggtggttcggaggaggatcccccatgtaggcaccagagctgcgagcagaaagattgcctggcctcgaagccttgggatattagcctggcgcaacctgaaagtattcgctctgaccttgagtcttcagacgcacagtccgatgacgtgcccgacataacatcagatgagtgtggctctcctcgctcacacacagcagcatgcccctccacacccagggcacagggggccccctcaccgagtgcccacatgaacctaagtgccctggccgagggtcaaacagtccttaaaccagagggtggagaagccagggtctag

SEQ ID NO: 41885 - DNA, 2940 bp, Artificial Sequence
  Description of Artificial Sequence: Synthetic coding sequence
atgcggggctaccacggcgaccggggcagccacccccggcccgcccgatttgccgatcagcaacacatggacgtgggccccgctgctagagccccttatttgctggggtctcgcgaggctttctcaactgaaccccggttctgtgccccgcgcgccgggttgggtcacatttctcccgagggccccctgagtctgtcagaagggccaagcgtgggacccgagggaggtccagcgggtgccggagtgggtgggggaagctcaacctttccgcggatgtatcccggacaaggacccttcgatacatgtgaggactgcgtcgggcatccacaaggaaaaggagcccccagattgcctccgactctgctcgatcagttcgagaaacagcttcccgttcagcaggacggatttcacactcttccttaccagcggggcccggcgggagctggacccgggccagcacccggcaccgggacggccccggagccgaggagtgagagcccgagccgcattagacatctggtgcactccgttcagaagctgttcgccaagtcccactctttggaggccccgggcaagagggattataacggacccaaagcagaggggagggggggaagcggcggcgattcttaccccggtcctggttctggaggcccacacacatcccatcatcaccaccaccatcaccaccaccaccaccaccagagccgtcatggaaaacgaagcaaatcgaaggaccggaagggcgacggcaggcaccaggccaagagtaccgggtggtggtcgagcgatgacaatctcgacagcgactccgggttcctggcgggtggacgaccaccaggtgaacccggaggtccgttttgcctcgaaggacccgacggatcatatagggaccttagttttaaaggccggtcaggaggtagcgagggacggtgtctggcctgtacgggtatgtcaatgtccttagatggtcaaagcgtcaagaggtccgcctggcatactatgatggtgtctcagggcagagacggatatccaggtgcaggccccggcaagggcctgctggggccagaaaccaaagctaaggcgaggacctaccactaccttcaggttccccaggacgactggggagggtatcccacaggcggaaaagatggagagatcccctgccgccgtatgcgctcaggtagctacatcaaggctatgggagatgaagaatctggagattccgatgggtctccgaaaaccagccccaaggctgtggcgcggcgttttaccacccggagatcctccagtgtagaccaggccaggattaactgttgcgtgccccctaggatccatcctcgctcttcaatcccgggctactcgcgaagcctgacaaccgggcagctgtctgacgagttaaaccagcagctggaagctgtatgtggctctgttttcggagagttggagtcccaggccgttgatgctctcgacctgcctggttgctttcgcatgagatcacattcatatctcagggccatacaggcaggttgttctcaagatgacgactgtttgcctctgctggcaaccccggctgccgtcagtggccggcctgggagttccttcaactttaggaaggcgccaccaccgattcctccaggcagtcaggctccccctcggatctctataaccgcccagagctccacagacagtgcgcacgaaagctttactgcagccgaagggcccgctaggcgctgcagctccgccgacggcctggatggccccgcaatgggcgctcgcacactggaattggcgcccgttccacccagggcttcacccaagcctccgacactcattatcaaaactattccaggccgggaggaacttcgttcactcgctagacagaggaagtggaggccctccattggggtacaagtcgagactattagcgattcagacaccgagaacagatccaggcgcgagtttcacagcatcggtgtacaggtggaggaggacaaacgaagagctaggtttaagaggagtaatagtgtcacggccggggttcaggctgacctggaactcgagggactggctgggcttgctaccgttgcaactgaggacaaggcgctccagtttggccgcagttttcagagacacgcttccgaaccccagccaggaccacgggcccctacatattcggtctttcgtaccgtgcacacccagggccagtgggcatacagggagggctatcctctgccctatgagccacccgccacagatggctctcctggacctgcccccgcccccacacctggccctggagccggcaggcgggactcttggattgagcgaggttctagatccctgccagactcgggcagagcctctccttgcccgagagacggcgagtggtttattaagatgttaagggctgaggtcgaaaaattggagcactggtgccagcagatggagcgggaagctgaagattacgagttgcctgaggagattttggaaaaaatccgaagtgcggtggggagcacacagctgttgctgagtcagaaagttcaacagttttttcgtctgtgtcagcagagtatggatcctactgcattccctgttccaaccttccaggatctcgcaggcttttgggatctgctgcagctgagtatagaagacgtcaccttgaaattcctcgagctgcaacaactgaaagccaatagctggaagctgctggagcccaaagaagaaaagaaagtgccaccacctatccccaaaaagccgttaaggggaagaggtgtgcctgttaaagagcgatccctcgacagcgtcgataggcagcgccaggaagccaggaagagactcctggcagccaagagagccgcctccttccgtcacagctccgcaaccgaatctgccgatagtatagaaatttacattccagaggcccagaccaggttgtag

SEQ ID NO: 41886 - DNA, 798 bp, Artificial Sequence
  Description of Artificial Sequence: Synthetic coding sequence
atgagcatgagcctggacggccagagcgtgaagcggagcgcctggcacacaatgatggtaagtcagggccgggacggataccctggtgcaggacctgggaaggggctgttgggtcccgaaacgaaagctaaggcaagaacctaccattatctccaggtacctcaggatgactgggggggttaccctaccggaggcaaggacggagaaattccatgccgacggatgaggtccggaagttatatcaaagctatgggcgacgaggaatctggagactccgacgggagccccaaaacgtcgcctaaggcagtggccaggcggtttacgacacggagaagttcgtcggttgaccaggcccgcataaactgctgcgtccctcccaggatacatcctagatcgtcaataccaggttatagccggtcattgactaccggacaactgtctgacgagctcaatcagcagatggaacgcgaagctgaggactatgagctgccggaagaaatcctcgaaaaaatcaggtccgcagttgggagtacgcaactccttctgtcccagaaggtgcagcagttctttcgactgtgtcagcagtctatggacccaactgctttccccgtgcctacttttcaggacctggccgggttctgggacctcctgcagctatccatcgaagacgtgaccctgaagtttttggagctgcagcaactaaaggcaaactcatggaaactgttagagcctaaggaggagaaaaaggtcccacctcccatccccaccagaccccctgggccttcgcatagtagatag

SEQ ID NO: 41887 - DNA, 2211 bp, Artificial Sequence
  Description of Artificial Sequence: Synthetic coding sequence
atggccggcagcagcaccggcggcggcggcgtgggcgagaccaaggtgatatatcatttagacgaggaggagactccctatcttgttaagatccctgttcccgccgaaaggatcacattaggagatttcaaaagtgttctgcagcgccctgctggcgcaaagtatttcttcaagagcatggaccaggacttcggagtagttaaggaagaaataagtgatgacaacgctagactgccgtgtttcaacggaagagtggtctcttggctcgtgagctcggataacccccagcccgagatggctcctcccgtccacgagcctcgggccgagctggccccaccggctccgccactccccccgctccctcctgagcgcacttccggcatcggtgatagccgacccccctcgtttcaccctaatgtgagtagctcccatgaaaacctagagcccgaaaccgagactgagtcagtagtgtccttgagacgggagaggccaaggcggcgcgactcgagtgagcacggcgcgggaggtcataggaccgggggcccatcacggctagagcgacatctcgctgggtatgaatcttcctctaccctaatgacaagcgagctggagtctactagcttaggcgactcggacgaggaggatacgatgagtcgcttttcctcaagtacagaacagagctcagcctcacgcttgctgaagaggcacaggagacggaggaaacagaggccacctagactggaaaggacgagtagtttttccagcgttacagatagtactatgtctctgaacattattaccgtcacattgaatatggaaaagtataatttcctcgggatatcaattgtggggcaatccaatgagcgcggggacggcggtatctatataggaagtattatgaaagggggggctgtcgctgccgatggtcgtatcgaacctggcgacatgctgcttcaggtaaacgatatgaactttgaaaatatgtctaatgacgatgccgtgagggttctgcgcgatatcgtgcataaaccaggacccattgtccttacggtcgccaaatgctgggacccaagcccacaagcatattttacacttccacgtaatgagcccatccaacccatcgatcccgctgcgtgggtgtcccacagtgccgccctcaccggcacattccccgcatacccagggagctcttcaatgtcaactattacttccgggtcttccctccctgatggctgcgagggccgcgggctatccgtgcacaccgatatggcttctgtcacaaaagcgatggcggccccggaaagtggcctcgaggttcgcgatagaatgtggctgaaaataacaatccccaacgcatttctgggtagtgatgtggtggattggctgtatcatcatgtggaggggttccccgaacggagggaagccagaaaatacgctagtggtttgttgaaggcaggcctgattaggcatactgtgaacaagattacattctctgaacagtgttactacgtctttggggacctgagtggaggctgcgagtcttatttggttaatctgtcactgaacgataacgacggtagttcaggcgcgtccgaccaggataccctcgctccccttcctggggccacaccctggcctcttttgcccacattcagctaccagtatccggcgcctcacccatactctccccaacccccaccttaccacgaactcagctcttatacgtacggaggcgggtctgcgtccagccaacactctgaaggtagccgcagttctgggtcaacaaggtcagatggaggagccgggcggacggggagaccagaagaacgcgcaccagagagcaaatccgggtccgggagtgagtcggagccttcttcccgtggaggctcccttaggaggggcggtgaagcatccggaacctcagacgggggaccgccaccaagtcgcggttcaaccgggggagctcccaacttgagagctcacccaggtttgcatccatatggccctcctccaggtatggccttgccatacaaccctatgatggtagtgatgatgccacctccaccaccacccgtaccccccgcagttcagccgccaggagcgccaccagtgcgggacctgggcagtgttccacccgaactcactgccagccggcagtcttttcatatggccatgggcaacccttcagagtttttcgtggatgtgatgtag

SEQ ID NO: 41888 - DNA, 4575 bp, Artificial Sequence
  Description of Artificial Sequence: Synthetic coding sequence
atggccatgagcaacggcaacaacgacttcgtggtgctgagcaactcttctattgcaacctccgcagctaatccctcaccactcactccttgcgatggagatcatgcagcacagcagctgaccccgaaagaagccactcggacaaaggtttcccccaacggctgcctacaactgaatggcacggtgaagtcaagctttttaccgctggataaccagagaatgccccagatgttgccacagtgctgtcacccatgtccctaccaccacccgctcaccagccattcttcccatcaagaatgtcaccccgaagcaggcccagctgcgccaagtgccttagcaagctgctgcatgcagcctcactcagaatactctgcttctctctgccctaaccatagtcctgtctatcaaaccacttgctgtctgcagccaagcccctccttttgcctgcatcacccttggccggatcactttcagcatcagcctgttcagcagcacatagcaaatatcagaccgagtaggccattcaaattgccaaagagttatgccgcattgatcgccgactggccagtagtagtactgggaatgtgtactatgtttatcgtcgtgtgtgcactggtgggagttctggtcccagaattgcctgattttagtgatccccttctcggatttgagcctcgcggtaccgccatcggccaaagactcgtcacctggaacaatatggttaaaaatacaggatataaagccacccttgctaactaccccttcaaatatgcagatgaacaagctaaaagccatcgcgacgataggtggtcggatgaccactatgagcgtgagaaacgggaagtcgattggaacttccataaagactcctttttctgcgatgttcccagtgaccgatattccagggtggtcttcacatcttcagggggcgaaactctgtggaacctgcccgccatcaaaagcatgtgcaacgtggacaattctaggattcgatcccatccgcagtttggcgacctgtgtcagcgcacgaccgccgcctcgtgttgcccctcctggacgctagggaattacatcgcaattctcaataaccgcagcagttgccaaaaaatcgtcgaacgagacgtgtcccatacattgaagctcctccggacttgtgctaagcactatcagaacggaacactgggtcctgattgctgggacatggctgctcggcgaaaggaccagctcaagtgtacaaatgtccctcggaagtgcaccaaatataatgctgtctatcagatactccattacctggttgataaggacttcatgacccccaaaaccgctgattatgcaactcccgccctgaagtacagcatgctcttctcaccgacagagaaaggggaaagcatgatgaacatctacctcgacaactttgaaaactggaacagctcagatggcgttactacaatcacgggcattgagttcggcataaaacacagtctttttcaggattacttgctgatggataccgtgtacccagctattgccattgtcatcgtgctactggtcatgtgtgtgtacacaaaaagcatgttcattaccttgatgacaatgtttgccattatcagctctctgatcgtgtcctattttctttaccgcgttgtgtttcattttgagttttttccgttcatgaatctgaccgccctcattatcctggttggcattggagcagacgatgcctttgttctatgcgatgtgtggaattatactaaattcgataagccccacgctgaaaccagcgaaacagtaagcattactcttcagcatgccgctctgtctatgtttgtcacctctttcacgaccgccgcagctttctatgccaactacgtgtcaaatataaccgccatacggtgctttggtgtgtatgctgggactgcaatcctcgtgaactatgtgctgatggtaacgtggctcccagcagtggttgtccttcacgagaggtatctgctgaatatcttcacttgcttcaaaaagcctcagcagcaaatctacgacaataagtcttgctggacagtcgcctgtcagaaatgccacaaagtcttgttcgcgatctcagaggcctcccgcatctttttcgagaaagtcttgccgtgcatagtgatcaagttcagatatctctggttattttggtttctggcactgaccgtgggaggggcttatatagtatgtattaatcctaagatgaaactcccctcattggaattatccgagtttcaggtgtttagatctagccatcccttcgagcgatatgatgccgaatataagaaactgtttatgtttgaacgagttcatcatggggaagagctgcacatgccaatcacagtgatctggggagtgtctcctgaggataatgggaaccctctgaaccctaagtccaagggcaagctgacactggactcatcctttaacattgcttcccccgcatcacaggcatggatcctccacttctgtcagaagctgagaaaccagacatttttctatcagacagacgagcaggacttcacctcctgttttattgagacttttaagcagtggatggaaaaccaggactgtgacgaacccgctttgtatccatgctgttcccattggtcttttccatacaagcaggagattttcgagctgtgcattaaacgagcgataatggaactggagagatccacaggctatcatctggatagtaaaacccccggccccagatttgatatcaatgacacaatcagggcagtcgtgcttgagttccagagtacgtatctgttcaccctggcctacgagaagatgcaccagttctacaaggaagtggactcctggatctcatcagaactgagttcagcgcccgaaggactcagcaacggatggtttgtgagtaatctcgagttctacgatttgcaggatagccttagcgacggaactctaattgcaatgggactgagcgtcgccgtggccttctccgtaatgctgctgaccacatggaatattatcattagcctgtatgcaattatttccattgcagggaccatctttgtaacagttggatcgttggttttactgggatgggaactaaatgtcttggagtccgtcaccatctctgtcgcggttggactatctgtggatttcgctgtgcactatggtgtcgcctacagactcgcacctgatcctgatcgcgagggtaaagtcatcttcagtttgtctcgcgtcggaagcgcgatggccatggctgcattaaccactttcgtagccggcgcaatgatgatgcccagcacagtattggcttacacccagctcggtacattcatgatgcttatcatgtgtatatcttgggcatttgctacattcttcttccagtgtatgtgtcgctgcctgggaccccagggtacttgtggccagatccccctgcccaaaaaactgcagtgcagcgcgttcagccacgctctaagcacctccccgagtgacaagggtcagtcaaagacccatacaattaacgcttatcaccttgacccacgcgggccgaagtcagagctggaacacgagttctatgagctggagcccctggccagccatagttgtactgcccctgaaaagacaacatatgaggagactcatatctgtagcgagtttttcaactcacaagctaaaaatctcggcatgcccgtccacgcggcttataattcggaactcagcaagtcaaccgagtcagatgctgggagcgctctgttacagccccccttagaacagcacaccgtgtgtcacttcttcagtctgaaccagcgctgttcctgtcccgatgcctacaaacatctaaactatggacctcacagctgtcagcagatgggagactgcctgtgccaccagtgctcaccgacgacgagttccttcgtgcagatccaaaatggtgtcgcgccactgaaagccacccatcaggcggttgaaggtttcgtgcaccccatcacgcacatccatcattgcccttgcttacaagggcgcgtcaaaccagccggaatgcagaactctcttccacgtaatttctttctgcatcccgtccagcacatccaagcccaggaaaagatcggtaagaccaatgtgcatagccttcaaaggagcatcgaggaacatttacccaagatggccgaaccatcatcctttgtgtgcaggagcaccgggtctctgctgaaaacgtgctgtgacccagaaaacaaacaacgtgaactgtgcaagaaccgtgacgtgagcaatctcgaaagttctggaggtacggagaataaggctgggggtaaggtcgaactgagcttgtcgcaaactgacgctagcgtgaattctgaacacttcaaccaaaatgagcctaaggtgttgtttaaccatctaatgggcgaagctggatgtcggagctgcccaaacaatagccaatcttgtggtaggatcgtgcgtgttaaatgtaattccgtcgattgccagatgccaaacatggaggcaaacgtgcctgctgtgttgactcattcagagctctccggagaatctctgctgattaagactctgtag

SEQ ID NO: 41889 - DNA, 555 bp, Artificial Sequence
  Description of Artificial Sequence: Synthetic coding sequence
atggccatgagcaacggcaacaacgacttcgtggtgctgagcaactccagcatagcaacttcagcagccaacccaagccccttgaccccttgtgacggcgatcacgcagcccagcagcttaccccgaaagaggccacgaggaccaaggtttctcctaatggctgtctgcagctgaacggaacagtgaagtcatctttccttccactcgataatcagcggatgccccagatgcttccccagtgttgtcacccatgcccatatcatcaccccctcacgtcacactcctctcatcaggaatgccatcccgaggcaggccctgcagctccctctgctctggcgtcatgttgcatgcagccccactctgagtacagtgcatctctttgccctaatcatagtccggtgtatcagacaacctgctgtctgcagccttccccatctttttgccttcaccatccatggccagaccactttcagcatcagccagtgcaacagcacatcgccaacatacgcttcacaaggaaaaccaaatgcgcaagctggcttctacagatgtag

SEQ ID NO: 41890 - DNA, 4206 bp, Artificial Sequence
  Description of Artificial Sequence: Synthetic coding sequence
atggacggcgacagcagcagcagcagcggcggcagcggccccgccccaggtcctggaccagaaggggagcagcggccagagggagagcctctggcacctgatgggggctcgcccgacagtacacagacaaaagcagtgcctcccgaggcatccccagagaggagctgttctctgcactcttgccccctcgaggatccctcgagttcctcagggccacccccaaccacttccaccctgcagccagtgggtccatcctctcccttggcccctgcccacttcacgtatcctagagcccttcaagagtatcagggcggctccagcctgcccggcctgggcgatagggcagcactgtgctctcacggatcaagcctgtctccctcacccgcgccctctcagcgggacggcacctggaaaccacccgctgtccagcaccatgtggtgagtgttaggcaggaacgggcatttcagatgcccaaaagttattcccagctgatcgccgagtggccggtggccgtcctaatgttatgcttagccgtcatatttctgtgcactctggcggggctactgggagcccgtttacctgatttctcaaaacccctgttaggcttcgagcctcgcgataccgacattggatcgaagctcgtggtttggcgcgccctacaggccctgaccgggccgcgaaaactgctctttctcagcccagatttagagctcaactcctcctcatctcacaataccctgagaccagctcctcggggctcggctcaggaatctgcggttcgaccacggcgcatggttgaaccgctcgaggaccgccgccaggaaaatttcttctgtggtcctcccgagaagagttacgctaaactcgtgttcatgtcaactagtagcggcagcctgtggaacttgcacgccattcatagcatgtgtcgaatggaacaagatcaaatccggagccatacctcctttggggccctctgccaacggacagccgctaaccagtgctgcccatcctggtctttgggcaattacttagcagtgctaagcaatcgctcctcctgtctcgatacaacccaggccgacgccgcgagaactctcgccctactgcgcacatgtgccctgtattatcacagcggagctcttgtgccctcttgcctcggtcccggtcagaataagagtcctcgttgtgcacaggtccctacaaagtgttcacagtctagcgcaatttaccagctgctgcacttccttctcgatcgagacttcctgagtccccagaccacagactaccaggttccgtcactcaaatactcactgcttttcctacctaccccgaagggagctagtctcatggacatttacctcgaccgacttgcgaccccatggggactggcagacaactacactagcgtgactgggatggatctgggcctgaagcaagagcttctgcgacacttccttgtccaggataccgtgtatcccttactggcgctcgtagccatctttttcggtatggctctatatctccgctccctttttctaactttaatggtgcttctgggcgtgctagggagcctccttgttgcctttttcctgtaccaggttgcgtttagaatggcgtactttccatttgtaaatcttgcggccctcctgttgctatcttccgtatgtgccaaccataccctaatattcttcgacctttggcggctgagcaaatctcagctgccatctggcggcttagctcagagagtggggcgcacaatgcaccacttcggatacttgctcctcgtgagtgggctgactacaagtgccgctttttacgccagctacctgtcaagattgccggccgtgcgctgcctcgcgctgtttatggggacagccgttctggtccacctggctctgaccctcgtgtggcttcccgcgagtgcagtgttacacgagaggtacctcgctcggggatgcgccagacgagcacgaggaagatgggagggctctgctccacggcgcctgctgttggctcttcacaggcgtctgcgaggcctgcgtcgggccgcggccggcacatccagactgctgttccaaagactcctcccgtgtggcgttatcaagtttagatatatctggatctgttggttcgccgccctcgctgctggcggggcatacatcgccggggtatccccccggcttcgactcccaaccctaccacctcccggtggccaagtgtttcgcccatcacatcctttcgagcgatttgacgcagaatacaggcaattattcctgttcgaacagcttccccagggcgaagggggacacatgccagtggtgttggtctggggagtcctcccagtcgatactggcgatcccctggatcccaggtcgaattcgtctttagtgcgagaccccgcgtttagcgcctccgggccagaggcccagcgctggttgctggctctctgtcaccgggctcgaaaccagtccttttttgacactctgcaggaaggatggcctaccctctgcttcgtggaaacgctccagagatggatggagagcccgagctgtgccaggctcggaccggatctgtgttgcggtcattctgactttccttgggcacctcagttttttctccactgtctcaaaatgatggccttggagcaggggccggatggcactcaggatctggggcttcggtttgacgcccatggaagtctggccgctttagtcctacagtttcagacgaactttcgcaactctcccgactacaatcagactcagttattttataacgaggttagtcactggttagctgctgaactcggaatggcaccgcccggcctccggagagggtggttcacttctcgcttagagctttattcactccagcactccctgagtacagaacccgctgtggtccttggcctagctcttgctttggcattcgctactttgttgctcggaacctggaatgtcccgctgtcattattctctgtcgccgccgttgctggcactgtactactcactgtcggcctgttggtgttactggagtggcagcttaatacagctgaagcactcttcttatcagcttccgtcggactctccgtagattttaccgtaaattactgcatttcttatcatctgtgccctcaccctgacagactctctagagtcgccttctcgctccgccagacatcctgtgccacagctgtgggtgctgccgcactcttcgctgccggcgtcttaatgctgcccgcaacagtactgctttacaggaagctgggcattattctaatgatggtcaagtgtgtcagttgtggcttcgctagtttcttctttcagagtctgtgttgttttttcgggcccgagaagaactgtgggcaaattttatggccatgtgcgcatctcccgtgggatgccggcacaggagaccctggtggtgagaaagccggcaggccaagacctggatcagtgggcggcatgcctggtagttgctccgagcagtatgagctgcagccccttgctagacgcagatcgccaagctttgatacctccaccgctacttctaaactttcccataggccctcagttctgtcagaagatcttcaattacacgacgggccctgctgttctcgcccccctccagcccccgccagcccacgcgagcttctcctggaccatcaggcagtgttctcccagtgcccggccttgcagacgtcatctccgtacaaacaggccggtccgagccccaaaacccgggcgcgccaggacagccagggggaagaagcagagccgctccctgcgagtcccgaagctcctgctcacagccctaaagcaaaggctgccgatccacctgacggattctgttccagtgcgtccacgcttgaagggctatctgtcagcgacgaaacttgcctgtctacctcagagccaagtgcacgggtgccagattccgtgggcgtgtctccagacgacctcgatgacaccggtcagcctgtgttggaacgggggcaattgaatgggaagcgggataccttatggctggcattacgcgagactgtgtacgatccttcgttacccgccagccatcacagctccttatcgtggaagggacgcggtggtccgggcgatggctcacccgttgttttacccaatagccagcccgatttgccagatgtctggctccgcagaccatccactcatacatccggatacagcagctag

SEQ ID NO: 41891 - DNA, 1416 bp, Artificial Sequence
  Description of Artificial Sequence: Synthetic coding sequence
atgggcggcacccaggtgaagtgcctgaccagccccagccccatccacagtgctaaatccgagtcaattatcacccagagcgaggagaaagccgactttgtgatcataccagctgaagggattgagaatagaacagaggggacggacagccccctatctagagactggagaccgggccctggtacctacctcgaaacctcctgggaagagcaattactggagcaacaggaatatcttgaaaaggagatggaagaggctaaaaagatgatttccggcctgcaggcgttgctgctcaatggttcactgccagaggatgagcaagagaggccgttggccctgtgtgagccgggggtaaatcccgaagaacagttaataatcatccagtccagactggaccagagcatggaagagaaccaggacctgaagaaggaactcctaaagtgtaagcaagaggctaggaacttgcaaggcataaaggatgcattgcagcagaggctgacacaacaggacacctctgtcttacagttgaagcaggagctcttgcgcgcgaacatggataaggacgaactgcataaccagaatgtggatctccaaagaaaactggacgagcgcaacagactcctgggagagtataagaaggaactggggcagaaggacagacttctgcagcaacatcaggccaagcttgaagaggcactgcgcaaactaagtgatgtatcttatcaccaggtcgacctggaacgcgagttggaacataaagacgtcctcttagctcattgcatgaagcgtgaggccgacgaagcaactaactataattctcataatagtcagtctaatggctttcttttgccaacggcaggaaaaggcgctaccagcgtgtctaatcgcggcacttccgacctccagcttgtgagagatgcgctgcgaagcctgcggaatagctttagcggccatgatccacagcaccacacaatcgatagcctcgagcagggaatcagtagtctcatggaaagactccatgttatggagacacagaagaaacaggaacgaaaagtccgggtgaagagccccagaacccaggttggctcagagtacagggaatcctggcctcccaactccaagctccctcatagccagtcatcgccgacggtgtcatctacctgcaccaaggtgttgtacttcaccgatcgctctctgaccccattcatggtaaacattcctaagaggctcgaggaggttactttgaaggactttaaagcagccatcgacagggagggtaaccataggtaccattttaaagcccttgatcctgagtttgggactgtgaaggaagagatctttcacgacgacgacgccatccctgggtgggaagggaagatcgtggcatgggttgaggaggaccatggggaaaactag

SEQ ID NO: 41892 - DNA, 2049 bp, Artificial Sequence
  Description of Artificial Sequence: Synthetic coding sequence
atgctggcctgcctgacccggggcaacctgctggacgtgctgcaggaagggttcaatgaacagcagctccaagcgtacgttgcctgggtgaacgcccaactcaagaagcggccagccgtgaaaccggtgcaggatttaaggcaagatctacgcgatggcgttattctggcatacctcatcgagatcgtggccggagagaagctgagtggcgtccaactctcccccgggaaccagcaggagatgaaaaacaacgtggagaaggtgttacagtttgtcgcttctaaaaagatccggatgcatcagacttctgccaaggacatagtagatggcaacctaaagtcaattatgcgtctggtgctggcactggcagcacatttcaaacccggaagcagccgcacggtaaaccagggtcgtgacagcagagctcccctccaatcacaccgtccccactgcgctacagctgtcgcgcagggcgccgccgcagcgctggcggatgtgtgtcacgatatgtcaagaagtggacgagacgtgttcagatataggcagcgcaattcgagcatggatgaagagatcgagaatccgtactggtcagtccgcgccctagtgcagcagtacgagggtcagcagcgatccccgtcagaaagcagctgttccagcctgacaagcccctcaccgatacactcagccaagagtgagtcaatcatcacgcaatccgaggaaaaagctgatttcgtgataattccagctgaaggaatcgaaaacaggactgaggggacagatagtcctctgagccgtgattggcgaccgggacccggaacgtatctggaaacctcatgggaagagcagctactggagcagcaagagtatctcgagaaggagatggaagaggccaaaaagatgattagcgggctccaagcccttctgttgaacggttctctgccggaggacgaacaggaacgccccttagctctttgtgagcctggggtgaaccctgaagagcagcttatcatcatacagtccaggctagaccagagcatggaagagaatcaggatcttaaaaaggagttactgaaatgcaagcaggaggctagaaacctgcagggcatcaaagacgcccttcagcagcggctaacccagcaagacaccagcgttctgcagttgaagcaggagctgctgcgggccaatatggataaagatgaactgcataaccagaacgtggacctgcagaggaagctggacgaaaggaatcgattattgggcgagtataaaaaagaactgggccagaaggaccggctcctacagcagcatcaggctaagctggaagaagccctgaggaagctaagtgacgtgtcttaccaccaagtggatctggagcgggaactcgaacataaggacgtcctgttggcccattgtatgaaaagagaagccgacgaagccacgaactacaactcccataatagccaatccaacggatttctgttgcccactgccggaaagggggctacatctgtctctaaccgggggacatctgatttgcagctggtccgtgacgctctcaggagcctgcgcaattctttcagcggccacgaccctcagcaccacaccattgatagcctggaacagggaatatctagtctgatggaacggttgcacgtgatggaaacacagaaaaaacaggagaggaaagtgcgtgtgaagagccccaggactcaggtggggtccgagtaccgtgaatcctggcctcccaattccaagttgccgcatagtcaaagtagccctacagtctcaagtacctgtaccaaggtactttattttaccgaccgtagtcttactcctttcatggtcaacatcccaaaacgccttgaggaggtaacacttaaggactttaaggccgcaattgaccgagagggcaatcaccgctaccatttcaaggcccttgacccagagttcggcacagtaaaggaggagatctttcatgacgatgatgccatacccggctgggagggcaagatcgtcgcttgggtcgaagaggaccatggggagaactag

SEQ ID NO: 41893 - DNA, 660 bp, Artificial Sequence
  Description of Artificial Sequence: Synthetic coding sequence
atgctggcctgcctgacccggggcaacctgctggacgtgctgcaggaaggcttcaatgagcaacagctgcaggcttacgtggcctgggtgaacgctcaactgaaaaaaaggccagccgtcaagcctgtgcaagatctcaggcaagatttgagagatggagtgattctggcttatcttatcgaaatcgtagccggggagaagctaagcggggtacaactgtcccccggaaatcagcaagagatgaagaacaatgtagagaaggtcctgcagttcgttgcttccaagaaaatcaggatgcaccagacaagcgccaaggacatcgtggacggcaatctcaagagcataatgaggctcgtgctggcgctggcggcccattttaagcccggcagttccagaactgttaatcaggggagagactcgagggcccctttgcaaagtcatcgcccccactgcgctacagccgtcgctcagggagcagctgccgcattggccgacgtctgccacgatatgtcaagaagcgggcgggatgtctttagatataggcagcggaattctagcatggatgaagaaatagaaaatccctattggtctgttcgggccctcgtgcagcagtacgaaggtcagcagcggagtccgtcagaaagtagctgttccagatag

SEQ ID NO: 41894 - DNA, 1140 bp, Artificial Sequence
  Description of Artificial Sequence: Synthetic coding sequence
atggagggcaaccgggacgaggccgagaagtgcgtggagatcgcccgcgaggccctgaacgcgggtaatagggaaaaggcccagagatttctacagaaagctgagaagctctacccgctgccctcagccagagctctcctcgagatcattatgaagaacggatccacagcagggaactcccctcactgtagaaaaccatccggcagtggagatcaatcaaaacccaattgcacaaaggactccaccagcgggagcggtgagggcggtaaaggatacaccaaggatcaggtggacggggtcttaagcattaacaagtgtaaaaattactatgaagtcctcggtgtcacaaaggacgccggcgatgaagatctcaaaaaggcttatcgaaagctagctcttaaattccaccctgataagaatcacgcccccggcgctactgacgcttttaaaaagattggaaacgcctacgcggtcctgtccaacccagagaaaagaaagcaatacgacttgacagggaatgaggaacaagcctgtaaccatcagaataatggacggttcaacttccatcgcgggtgcgaggctgacatcacacctgaggatttatttaacattttcttcgggggcgggtttcccagcggctcagtacactccttctctaatggacgggccggttacagtcagcagcaccagcaccggcattccggccatgaaagagaggaagaacgtggagatggtgggttttccgtgttcatacaacttatgcccattatcgtcctgatccttgtgtccctgctgagccagctcatggtctctaatcccccctattcactctacccccggtctggaacggggcagactatcaagatgcagacagaaaatctgggggtggtttattacgtcaataaggacttcaagaatgagtataaggggatgctacttcaaaaagtagagaagtccgtggaggaagactacgtgaccaatatccgaaacaactgctggaaagaaaggcagcagaagactgacatgcaatacgcagccaaggtgtaccgcgacgacaggctgcgcaggaaggccgacgccctaagtatggataattgcaaggagctggagagactcacaagcttgtataagggaggatag

SEQ ID NO: 41895 - DNA, 1014 bp, Artificial Sequence
  Description of Artificial Sequence: Synthetic coding sequence
atgggcaaggactactactgcatcctgggcatcgagaagggcgcctccgatgaagatattaaaaaggcctaccgaaagcaagcgctgaaattccatccggataaaaataagagcccacaagcagaggaaaaatttaaagaggtcgccgaagcttatgaagtcctctcagaccccaaaaaaagagagatctatgatcagttcggcgaagagggcttgaagggaggggccggcggcaccgatggccaaggcggcacattccgctatacctttcatggggaccctcacgcgacatttgccgccttcttcggcgggagtaaccctttcgaaatattttttggacgcagaatgggcggtggcagagatagtgaagaaatggagattgacggtgatcctttttcggcctttggattctcaatgaatggttatccccgggacaggaattccgtgggtccctctaggctcaagcaagacccacccgttatccatgagttgcgcgtgtcgctcgaggagatctatagcggatgtaccaagcgtatgaagatatcacgcaagagactgaatgctgatgggcgctcttatcgaagtgaggataagatacttacgatcgagattaagaagggatggaaggagggaaccaaaatcaccttccccagggaaggagatgagacaccaaacagtattcctgctgacattgtgtttattattaaagacaaggatcaccccaagtttaagcgggacgggtctaacattatatacaccgcaaaaataagcctgcgcgaagccctttgtggctgcagtatcaacgtaccaaccctcgacgggcggaacatacccatgtccgttaacgacatagtgaaacccggcatgagaagacgcatcattggctatggcctgccctttcctaagaaccctgatcaaagaggagacctgctgatcgagttcgaggttagcttccctgataccattagttcttcctcgaaggaagtcctgcgcaaacatctgcccgcgtcctag

SEQ ID NO: 41896 - DNA, 519 bp, Artificial Sequence
  Description of Artificial Sequence: Synthetic coding sequence
atgggcaaggactactactgcatcctgggcatcgagaagggcgccagtgacgaagatatcaagaaagcatatagaaagcaggctctcaaatttcacccggacaagaacaagtcaccccaggctgaggaaaagtttaaagaggtggcagaggcatacgaggtcctgagtgacccaaagaaaagggagatctacgatcagttcggtgaagagggcttaaaaggaggtgccggcggtaccgacggacagggggggacattccggtataccttccacggggacccccatgctactttcgcggctttctttggtggaagcaatccattcgaaatcttttttggacggcgcatgggaggcggccgcgactccgaggagatggagattgacggcgatccattttccgcattcggattttctatgaacggatatcccagagaccgaaattcggttggcccctcacgactgaaacaagacccacccgtgattcatgaactgcgcgtgtctcttgaagagatctactag

SEQ ID NO: 41897 - DNA, 1083 bp, Artificial Sequence
  Description of Artificial Sequence: Synthetic coding sequence
atgggcgcccccctgctgagccccggctggggcgccggcgccgccggccggcgctggtggatgctgctggcccccttacttcctgctctgctgctggtgaggcccgccggggctctggtagagggactgtattgcggcactagagactgctatgaggtgctcggggtctctcgaagcgcaggaaaagcagagatcgctcgagcttataggcagctggcaaggaggtaccaccctgatcgctacagaccacaacccggagacgagggtcccggacggaccccccaatctgcagaagaggctttcctactggtggctacggcatacgaaactcttaaagatgaggagacccgcaaagattatgactacatgcttgaccacccagaagagtattattcccactactatcactattactctaggcgacttgcacccaaggtggatgttcgggtggtgatcctcgtgagcgtgtgtgcaatctccgtctttcagtttttcagctggtggaattcttacaacaaggccatctcctatctggctactgttccgaagtatagaatccaggccaccgaaatcgctaagcagcaggggctgctgaagaaggctaaggaaaaggggaaaaataaaaagtccaaggaggaaatcagagacgaggaggagaacatcattaagaacataatcaagtccaagatagatattaaggggggctaccagaaaccgcagatttgcgacctgctgctcttccagattatccttgcccccttccacctgtgtagttacatcgtgtggtactgccgatggatttataattttaacattaaaggaaaggagtatggtgaggaagagagattgtatataatccgtaaatccatgaagatgtcgaagagtcagttcgactctctggaagaccaccagaaggaaacttttctgaaacgcgaactgtggattaaagagaattacgaagtttacaaacaggagcaggaagaggagcttaagaaaaagctcgcaaacgacccacgctggaagcgttaccggcgttggatgaagaacgaaggccctgggcggctgacattcgttgatgattag

SEQ ID NO: 41898 - DNA, 462 bp, Artificial Sequence
  Description of Artificial Sequence: Synthetic coding sequence
atgggcgcccccctgctgagccccggctggggcgccggcgccgccgggcgccgatggtggatgctgttggcacctctcttacctgccctgctcctagttcgacctgccggagctttggttgagggactttactgcgggacgcgggattgttacgaagttctaggcgtgagccgaagtgccggcaaggccgaaatcgctcgggcatacagacaactcgcgagaagataccatcccgatcgctaccggccacaacctggggacgaagggccagggagaaccccccagtcggccgaggaagccttcctactcgtcgctaccgcttatgaaaccctgaaggtgtcacaagctgctgccgagctgcagcaatattgcatgcagaatgcatgcaaggacgcccttctggtcggagtacccgctggcagcaatccattccgcgaacccagaagctgtgcattgctgtag

SEQ ID NO: 41899 - DNA, 330 bp, Artificial Sequence
  Description of Artificial Sequence: Synthetic coding sequence
atgaccgccccctgcagccagcccgcccagctgcccggccggcggcagctggggctcgtaccatttccacccccaccacctagaacccccctcctgtggttgctcttactcctcttagcagccgtcgcccccgcccggggatgggagtcaggcgacttagagctgttcgacttggtggaggaagtacaactgaatttttaccagttcctcggtgttcagcaggacgcatcatccgcggatattcggaaagcttaccgaaagctgtccttaacactgcacccagacaagaataaggacgagaacgccgagacgcagttccggcaagtgtag

SEQ ID NO: 41900 - DNA, 1665 bp, Artificial Sequence
  Description of Artificial Sequence: Synthetic coding sequence
atgaccgccccctgcagccagcccgcccagctgcccggccggcggcaattaggcctcgttccttttcctccaccacctcccaggaccccactactgtggctgctgctcctcctgcttgccgccgttgcacctgcccggggctgggagtccggagatctcgagctctttgacctggtggaggaggtacagttgaacttctatcagttcctcggcgtccagcaagatgctagttccgccgatattcgcaaggcttaccggaagctgtccttaactctgcatcccgacaagaacaaggatgagaacgctgaaacacagtttcgtcagctggtcgccatctatgaagtgctgaaagatgacgagaggcgacaacggtacgatgatatcttgatcaacggcttgcctgactggaggcagccggttttctattaccgtagagtacggaaaatgagcaatgctgagttggccctccttctgttcattattctgacggtcgggcattacgctgtggtctggagtatctatctagagaaacaactagacgagttgttgagccgcaagaaaagagaaaaaaaaaaaaaaacaggaagcaagagtgtggacgtgagcaaactgggggcctctgaaaaaaacgagcggctcctgatgaagcctcagtggcacgatctgctcccatgtaagctaggaatctggttttgtctgacactgaaggccctgccacacttgatccaggatgcagggcaattttacgccaagtataaggagacaagactcaaggagaaagaagacgcactgacaaggactgagctagaaacccttcagaagcagaagaaggtgaagaaacctaagcctgaatttccagtctacaccccgcttgagactacctacatccaatcctatgatcatggaacgagtattgaggaaatagaagaacaaatggacgattggttggaaaatcgcaataggacacagaagaaacaggctcctgaatggaccgaggaggatctcagccagcttacaagaagcatggtgaagtttccgggggggacccccggacgctgggagaaaatcgcccacgaactggggagaagtgtgaccgacgtcacaaccaaagccaagcaactgaaggattccgtgacgtgcagccccggcatggtccgactgtcagagctgaagtctacggtgcagaactctaggcctatcaagactgccacaacactgccagatgacatgataacgcagcgcgaggatgccgaaggcgttgcggccgaggaagagcaggagggggacagcggcgagcaagagactggagctacagatgcccgaccccgccgcagaaagccagcccgccttctcgaagcgacagctaaaccagaacccgaagagaaatcccgcgcgaaaaggcagaaggacttcgatattgcagaacagaatgagtcttctgacgaagagtcgctgcgaaaagagcgcgcccgcagtgctgaagaaccctggacccagaaccagcagaaactactggagctggcactgcagcagtatccccgcggttcctcagacagatgggataaaatcgctcggtgcgtgcctagtaagtccaaggaggactgcatcgcacgatacaaactcctggtggaacttgtgcaaaagaaaaagcaggctaaatcatag

SEQ ID NO: 41901 - DNA, 351 bp, Artificial Sequence
  Description of Artificial Sequence: Synthetic coding sequence
tgaggccggcggcagctgggcctggtgcccttcccccccccccccccgcgcactcccctgctatggctcctgctgctacttctggcagccgtcgcccctgcccgtggctgggaatctggcgatttggagctcttcgatctcgtcgaagaggtgcaacttaatttttatcagttccttggtgttcagcaggacgcctcttcggcagatattagaaaggcctaccggaagctgagcttgacattgcacccagacaaaaacaaagacgagaacgcagagacacagtttcggcagctcgtcgcaatctatgaggtccttaaggatgacgagaggcggcagcgtatgaactactag

SEQ ID NO: 41902 - DNA, 1524 bp, Artificial Sequence
  Description of Artificial Sequence: Synthetic coding sequence
atggccaccgccctgagcgaggaggagctggacaacgaggactactactcgctgctcaatgtgcgaagagaagcttcgagtgaggagctcaaagcagcataccggcggctctgcatgctatatcacccggacaagcacagagaccctgaactgaagtcacaggcagagagactctttaatcttgtgcaccaggcatacgaagtcctgagtgatccacagactagagccatctatgacatttatggaaaacgcggactggagatggaaggctgggaagtggttgagcgtcggagaactcctgcggagatccgcgaagagtttgaaaggctgcagagagagcgcgaggaacggagactgcagcagcggaccaatcccaaggggactatatccgtgggcgtggatgccactgatctcttcgatcgctacgacgaagagtatgaggacgtctcaggctcttccttcccccagatcgaaattaataaaatgcacatctcacaatccatcgaggccccactgacagctacagacactgcgatactatcgggatccctgtcaacccagaatggcaacggtggagggagcatcaacttcgccctgaggagagttacttctgccaaaggatggggcgaattagaatttggcgcaggtgatttacagggccctttgttcggactcaaacttttccggaatttgactccacgctgcttcgtgacaacaaattgcgcattgcaatttagctcgcgaggcattagacccggcctgactaccgtgctggcccggaacttagacaagaacactgtcgggtacctccagtggagatggggcatacaatcggccatgaatacctccatcgttcgagatacaaagacgagtcactttactgtggctctccagctgggaattccccatagtttcgctctcatttcctatcagcacaagttccaagacgatgatcagaccagagtgaagggcagtctgaaagcgggcttctttggcacagtggtggagtacggagcagaaaggaagatcagcagacattctgtgctgggcgccgccgtgagcgtgggcgttccgcagggggtcagcctcaaggtaaaagagctggaaaagcagagagagagcgctgccaccgatgtcttacaaaagaagcaggaagccgaatccgctgtgagactgatgcaggagagtgttcggcgtattattgaagccgaggaatccaggatgggccttattatcgtaaacgcctggtacggcaagtttgttaacgacaaaagtcggaaaagcgagaaggtaaaggtgatagacgtcactgtccccctgcagtgccttgtcaaagattctaaactcatcttaacagaggcatccaaagctggcctgcccggtttctacgacccgtgtgtaggtgaggaaaagaacctgaaagtgctctatcagttcagaggggtgctgcatcaggtaatggtgctggacagcgaggccctgaggattccaaagcagtcccataggattgacaccgacgggtag

SEQ ID NO: 41903 - DNA, 957 bp, Artificial Sequence
  Description of Artificial Sequence: Synthetic coding sequence
atgctgtaccaccccgacaagcaccgggaccccgagctgaagagccaagcagagcgtctttttaacctggttcatcaggcctatgaggttttaagcgatccacagacacgggctatttatgatatttacgggaagcgcgggctcgaaatggagggctgggaggtggttgagcgacgaaggaccccagcagagatccgggaggagtttgagcgtctgcagcgcgagcgagaggagaggcgactgcaacagcgcactaatcccaagggcactatatctgtcggtgtcgacgccactgacctgttcgaccgatatgacgaagagtacgaagacgtgtctggcagttctttcccacagattgaaatcaataagatgcatattagccagagcatcgaggcacccttaaccgcaaccgatactgccattctcagtgggtcgttgtcaacccaaaacggaaatggcggcggtagcattaatttcgcgctgaggagggtcacatcggctaagggatggggcgaactggaatttggcgctggcgacctgcagggtccactatttggcctgaaattgtttagaaatctaacaccccgttgctttgtcacgacaaattgcgccctccagtttagcagccgaggtattagacctggcttgacgacagtgctggcccgcaaccttgacaaaaacactgtgggatacttgcagtggcactgctcatcgccacttctgcaggtccaacggccccaccgtaacacccgcgcatgtgcacccgaacctagcttccgaccctttcttcatgttccgacgtgggatgccgagtgttccggtgcccgcacaccttctacagcttggacgagtgctgccgtgaagcttagagaagcctgcctgtctggacccggtagtggctcacatcaacttttgctgttaactccaaggagtaaacggcggaccggaggtggatag

SEQ ID NO: 41904 - DNA, 1410 bp, Artificial Sequence
  Description of Artificial Sequence: Synthetic coding sequence
atgaaggtggtggagcggcggcggacccccgccgagatccgggaggagtttgagaggctgcaacgagaacgagaagagagacgccttcagcaaagaaccaatcccaaaggaactatttccgtcggggtggacgccacagacctgttcgataggtatgacgaggagtacgaggatgttagtggctcttccttcccccaaattgagataaataagatgcatatctcacagagtatcgaagcacctctgactgccaccgacacagccattctgtccggtagcctctccacacagaacggtaatgggggggggtccattaattttgcactgcggcgtgtcaccagcgccaagggctggggagagctggagtttggggcaggagatttgcagggcccactctttggactgaagctgtttaggaatctgacaccacgttgttttgtgaccactaattgtgccttgcagttcagcagtagggggatcagacctgggttaacaaccgtgctagctcggaacctggataagaacacggtcggttacttacagtggaggtggggcattcagtccgcaatgaataccagtatcgtccgtgataccaaaacttctcactttactgtcgctttgcagctgggcatcccacacagctttgccttaatctcataccaacacaagtttcaagatgacgaccagacccgcgtgaagggcagccttaaggctggtttctttggcacggttgtagaatacggggcagagagaaaaattagccggcacagtgttctgggggctgccgtctctgtcggcgtacctcagggcgtctctctcaaggtgaagctgaaccgggcgagccaaacgtacttctttcctattcatctgaccgaccaactcctcccttccgctatgttctacgcaaccgtgggcccactggtcgtctactttgcgatgcatcgattaattatcaagccctatctgcgggcccagaaggagaaggaactcgagaagcagcgggagtcggccgcgacggacgttctacagaaaaagcaggaggccgagtcggcggtcagactcatgcaagagagcgtgcggcggatcattgaagcagaggaaagtcggatgggactcatcatcgtgaatgcctggtacgggaaatttgtcaatgacaagagtcgaaaatctgaaaaagttaaagtgattgacgtgaccgtccctttgcagtgcctggtaaaggatagtaaactcattttaaccgaggcatcaaaagcaggcttaccaggattttatgacccctgcgtgggggaagaaaagaatttgaaagtcctctaccaattccggggggtgttgcatcaggtcatggtcctcgactccgaagctctgagaattcctaagcaatcccatcggatcgacacagatggatag

SEQ ID NO: 41905 - DNA, 1680 bp, Artificial Sequence
  Description of Artificial Sequence: Synthetic coding sequence
atggccaccgccctgagcgaggaggagctggacaacgaggactactactcactcctgaatgtccgacgggaggccagcagcgaggaattgaaggccgcctatagacgactctgtatgttataccacccagataaacaccgtgatccagagcttaagagccaggccgaaaggctgtttaatctggtgcatcaggcctacgaggtgctaagtgacccccagacgcgagcaatttatgatatatatggaaaacggggcctcgagatggagggctgggaggtggtagagagacgccggacccctgcagagattcgcgaggaatttgaacggctccagagagaaagggaggagagacgccttcaacagcgaacgaaccccaaaggaaccatttctgttggcgtggatgcgaccgacttgttcgacagatatgatgaggagtatgaggacgtatccggctcgtcattcccccagatcgagattaataagatgcatatttctcagtccatagaagccccactcaccgccactgacactgccattctcagcggaagtctctccacccagaatggcaacggaggcggcagcattaattttgctctccgacgtgtaacctccgccaagggatggggagaacttgagtttggtgcgggagacttgcaaggccccctgttcggcttaaagctcttcagaaacctcacccctagatgctttgtcaccactaattgcgccttgcaattttctagcaggggaatccgccccggcctcacaaccgttctggcacgtaaccttgataagaacactgtgggctacttacagtggagatggggcatccagtccgccatgaatacatcaatagttcgggacactaagacttcacactttacggtagctctccaactcggcatccctcacagttttgccttgatttcctatcaacacaaatttcaggatgacgatcagacgcgggtaaagggctcactaaaagccgggttttttggcacggtggtggagtatggggccgagaggaagatttcccgacactccgtacttggcgccgcggtctctgtgggtgttccacagggagtttctttaaaagtgaagctaaaccgcgcatcacagacatatttttttccaatccacctgacagatcagctacttccatccgccatgttttatgccacggtcggacctttggttgtttatttcgcaatgcatcggctcatcataaagccctacctgcgagcccaaaaagagaaggaacttgagaaacagcgtgagagtgccgccactgatgtcctgcagaagaaacaggaagcagaaagcgctgtgaggctgatgcaggagtctgttcggcgcatcatcgaggccgaggaatccagaatggggctgattatcgtcaacgcatggtacggcaaatttgtgaatgacaagagtcgcaagtctgagaaggttaaggtaatcgacgtaactgttcctctgcaatgcttagtgaaagactccaaattgatattaacagaggcatccaaagctgggctgccaggcttttatgatccttgcgtgggagaggaaaagaacctcaaggtcctctaccaatttcgaggagtgctccatcaggtgatggttctagattccgaggcccttcgcattcccaaacagagccataggatcgacactgacgggtag

SEQ ID NO: 41906 - DNA, 975 bp, Artificial Sequence
  Description of Artificial Sequence: Synthetic coding sequence
atggccaccgccctgagcgaggaggagctggacaacgaggactactacagtctcttaaatgtacgacgtgaagcttcctctgaggaactaaaggctgcttaccgcaggttgtgcatgttgtatcacccagataaacaccgcgatccagagctgaagtcacaagctgaacgccttttcaatctggtacatcaggcctacgaggtgctgagcgatccccagacccgggcgatctatgacatatacggcaagagaggcctcgagatggagggttgggaggtagtggagaggaggcgcacacctgcagaaatccgggaggagttcgaaaggctgcagcgggaaagggaagagaggagactacaacagcggaccaacccaaagggaacaatttccgttggcgtggacgcgactgacctgttcgatagatacgatgaggagtacgaggacgtttctgggtctagcttcccacagattgaaatcaacaagatgcacatcagccagtctatcgaagctccactgactgccactgacacagccatcctgtcaggtagtctgagcacgcaaaacggcaatgggggtggatccataaattttgcattgcgcagggttaccagtgcgaagggatggggcgaacgcatgacggattgtctgattattggactgattgacatctgtcagagatgcagccctcagcctgcctcagcaagctgtcgcctttgttgctgccacgtaacccttcttgagctttacatacccgtgcccagccggaccaccgccgtgtcttcttttcccatttgctttgtgacaactaattgcgcattgcagttttcatctcgcggcattcggcctggactgaccaccgtgctggctcggaacctggacaaaaatacagtagggtacctgcagtggagatggggcatccagtcagccatgaatacatctattgtccgcgacacaaaaacgtcccactttacgtag

SEQ ID NO: 41907 - DNA, 999 bp, Artificial Sequence
  Description of Artificial Sequence: Synthetic coding sequence
gccagcagcgaggagctgaaggccgcctaccggcggctgtgcatgctataccaccccgataaacatcgcgacccagaacttaagagccaggccgagcggttattcaacctcgtccaccaggcctatgaggttctaagcgatccccagacacgagctatttatgacatatatggcaaaagggggctcgagatggagggctgggaggttgttgaaaggaggagaacccccgcagagattagggaggaatttgaacgcttgcagagggaacgggaggagcgcagactgcagcaaagaacaaatcccaaagggacaatttcagtgggcgttgacgctacggatctgttcgaccggtacgatgaggagtatgaggatgtgagcgggtcttcctttccacagatcgagatcaataaaatgcatatatcacagtctatagaagcaccacttacagccaccgacacagctatcctgtcaggttccctctctactcagaacggcaacggtggcgggagcattaatttcgccttgcgtcgcgtgacgtccgcaaaaggttggggcgagctggaattcggcgctggcgatctgcagggcccattgttcggcctgaagctgttccgcaatctcactcccaggtgctttgtgactactaattgcgcattgcagttctctagccgtggcatacgtccaggccttactaccgtgctggcgcgcaatctcgataaaaatactgtgggataccttcagtggcactgcagctcccctctgcttcaggtgcagaggccacacaggaataccagggcctgcgccccagagccaagttttcggcccttccttcacgtacccacctgggatgctgagtgctctggagccaggacccccagcactgcgtggacctcagctgcagtgaaactgagagaagcctgccttagtggtccgggttctggatctcatcagctgctgctgctcaccccacgctctaaacgcagaaccgggggtggctag

SEQ ID NO: 41908 - DNA, 1566 bp, Artificial Sequence
  Description of Artificial Sequence: Synthetic coding sequence
atgctgtaccaccccgacaagcaccgggaccccgagctgaagagccaggctgagcggctgtttaatttggtccatcaggcctacgaggtgctttcagatcctcagacccgagccatctacgacatttacgggaaacgaggtctggagatggaggggtgggaagtggtcgaacgtcggaggacccccgcggagatcagggaagaattcgagcggctccagcgggagcgggaggagcgtcgcctacagcagcgcacaaatcctaagggaaccatatctgtcggggtagacgccaccgacctcttcgatcggtacgacgaggagtatgaagacgtgtcaggctcctcatttccccaaatcgaaatcaataagatgcatatctctcaatctattgaggcccccttgacggccaccgacacagctattttaagcggttccctctctacgcagaacgggaacggcggagggagcatcaattttgctctgagaagagtgacatctgcaaagggctggggggagctggagtttggggccggagatttacaggggccactgtttggactgaagttattcagaaatctaacccccagatgctttgtcactacgaattgcgcattgcagttttcgtctagaggcatcaggcccggcctgacaacagttctggccaggaaccttgataaaaacacggtgggatatttacaatggcgctggggcatccagtccgccatgaacacctctattgtacgtgatacaaagaccagccactttacggtagcacttcagctcggcatcccccattcctttgctcttatttcataccagcataaattccaggatgatgatcagacccgagtgaagggctccctgaaagcgggcttttttggcactgtcgtcgagtatggtgccgaacggaaaatctctagacactcggtattgggcgcagcagtctctgtcggagtcccacaaggcgtgtcccttaaagtcaagctgaaccgcgcttcacagacatacttctttccgattcacctgactgaccagctgctgccttccgcgatgttttacgccaccgtgggcccccttgttgtgtacttcgccatgcaccgactcatcatcaaaccttatctccgggctcagaaagaaaaggagctggagaagcaaagagagtctgccgctacggacgttctccagaaaaaacaggaagctgagagcgcggtccgtcttatgcaagaaagcgtgcgccggataatagaagcggaagagtcacggatgggactcatcatcgtcaacgcctggtatggcaaattcgttaacgacaagagcagaaaatcagaaaaagttaaagttattgacgtgaccgtccctctccagtgtctggtgaaggacagtaaacttatcctgactgaggccagcaaggcgggcttgcctggcttctacgacccgtgcgtgggtgaggagaagaacctaaaagtgctttatcagtttcgaggggtgctgcaccaggttatggtactggattccgaggcccttaggattcccaagcagagtcatagaatagacaccgatgggtag

SEQ ID NO: 41909 - DNA, 2109 bp, Artificial Sequence
  Description of Artificial Sequence: Synthetic coding sequence
atggcccagaagcaccccggcgagcggggcctgtacggcgcccaccattcagggggcgcatctctccgaacactgggcccgagcgtcgaccccgagattccctctttttctggattgagggattccgcaggaaccgcaccaaatggaacacgttgcttgaccgagcattctggacctaagcatacccaacatcctaatcctgcacactggctggacccctcccacggcccccctggggggcccggacctccccgcgatgctgaagatccagatcagtctgagacttcttccgaagaggagagcggggtagatcaggaattgtcaaaggagaatgagacagggaaccaaaaggacgggaactcttttctgagcattcctagcgcttgcaactgccaaggaacacctggcatccccgagggcccgtactcagagggaggcaatggctctagtagtaacttttgtcatcattgcacctccccggccctgggcgaggacgaactcgaggaggaatacgacgatgaggaaagcctgaagttcccaagcgacttttctagagtctcctccggcaagaagccgccttctaggcggcagcgccacaggttcccaacaaaagaggacaccagggagggaggtagaagagacccgagatcccccgggcgccatagactcggcaggaagaggtctcaggcggataagcgtaaaggtttgggcctatggggcgctgaagagctctgtcaattgggacaggccgggttttggtggttaatcgagcttcttgtgctagtcggagagtacgtcgagacctgcggacatttgatctacgcctgccggcaattgaagtcatcagacctagacctgttccgtgtgtggatgggcgtgtggaccggccggctaggtggttgggctcaggtaatgtttcaattccttagtcagggcttttactgcggcgtggggctattcacgcggtttctcaagctgcttggagccttgttgctcctcgctcttgccctctttctaggttttctccagctcggatggcgcttccttgttggacttggcgaccggttaggctggcgggacaaagctacctggcttttctcctggctcgactcacccgcactgcaacgatgcctcacgttgttgcgtgactcaaggccatggcagagactggttcggatcgtgcagtggggatggttggagctgccttgggtaaaacagaacatcaaccgccaagggaatgcacctgttgcctcagggaggtattgccagcccgaggaggaggtagcacgcctcctgaccatggccggagttccagaggatgagctcaatccgttccatgttctgggggtggaagccaccgcctcggatgtcgaactaaagaaagcctaccggcaactggcagtgatggttcacccggacaagaaccaccaccccagggctgaagaagctttcaaagttctcagggccgcgtgggatatcgtgagcaacgcagaaaagcgtaaagaatacgaaatgaagcggatggccgagaatgagctaagcagaagtgtcaatgagttcctgagcaagctgcaggatgacctcaaggaggctatgaacaccatgatgtgctccagatgtcagggcaagcatcgccgattcgaaatggacagggagccaaaatccgctcgttattgtgctgaatgcaatagactccatccagctgaagagggtgatttctgggccgaaagcagcatgctgggactaaagattacctacttcgctctcatggacggcaaggtctacgacataaccgaatgggccggatgccaacgagtgggtatctccccggacacgcatcgagtgccttaccatatctcttttggctcgcgaattcccggcacgagggggcggcaaagggctacgccagacgctccccccgcagacctccaggactttttgagccgaatcttccaggtgcctccgggccaaatgcctaacggcaacttttttgctgctccacaacctgcccccggggctgccgccgccagcaagcctaatagcaccgtgcctaagggtgaggccaaaccaaagaggaggaaaaaggtccgcaggccatttcaacgctag

SEQ ID NO: 41910 - DNA, 2109 bp, Artificial Sequence
  Description of Artificial Sequence: Synthetic coding sequence
atggcccagaagcaccccggcgagcggggcctgtacggcgcccaccacagcggaggcgcgtccttgcggaccctaggccctagtgtggatcccgagattccttccttttccgggctgcgggatagcgctggaaccgcgcccaatgggacacggtgcctcacagagcactccgggcccaagcatacacagcacccgaatccagctcactggctggacccctcacatggccccccaggtgggccaggtccacctagggatgccgaagaccccgaccagtccgaaaccagctccgaagaagagtctggcgtggaccaagaattgagtaaagaaaacgagacaggaaatcaaaaggatggcaatagctttctgtcaatccccagcgcctgtaattgccaaggcactcctggaatacctgagggaccttatagtgaagggggcaatggcagttcgagcaatttctgtcaccactgtacctctccggcccttggggaagacgagcttgaggaggagtacgacgacgaagagtctctaaaatttccctctgacttttccagagtgtcctcaggcaagaagccaccctcacgcagacaaaggcacaggtttcctacaaaagaagatacacgtgagggggggcggcgggatccccgctctccgggcagacaccgtctggggcgcaagcgctcgcaggcggacaaaaggaaaggattaggattatggggagctgaggagctttgccaacttggacaggccgggttttggtggctcatcgagttgctggtgctagtgggcgagtacgtggaaacctgcggacaccttatctatgcttgtagacaacttaaaagttccgatctggatctgtttagagtgtggatgggggtctggacagggagacttggaggttgggcccaggtaatgttccagtttctgtctcaaggcttttactgtggtgtgggactgtttacgcggtttcttaagttattaggcgccctcctgctgctagccctcgccctattcctcggctttttacagctgggttggcgcttcctagtgggtttgggggaccgattgggttggcgcgacaaggctacatggctcttctcctggcttgactcaccagcactccagcgctgtcttaccctgctaagagatagcaggccttggcagcgactggtgcggattgtccagtggggatggttggagctgccctgggtgaagcagaacatcaatcggcagggaaatgctcctgtagcatccggcagatactgccaacctgaggaagaagtggccaggcttttgactatggcaggtgttcccgaagatgaactaaaccctttccacgtactgggcgtcgaggcaacggccagcgacgtcgagctgaaaaaggcctacaggcagcttgctgtgatggtccatcccgacaaaaatcaccatccaagggcagaagaggcatttaaggtgctgagggccgcatgggatatcgtttccaacgcagaaaagcggaaggagtatgagatgaaacgaatggctgaaaatgagctgtccaggtcagtcaatgaattcttgtcaaagttgcaggatgatctaaaagaagccatgaatacaatgatgtgtagccgctgccaggggaagcataggcgcttcgaaatggatcgcgaacctaagagcgcaagatactgtgcagagtgcaatagattacacccggcggaagagggcgatttctgggcagaatcgagtatgctgggcctcaagattacttacttcgcactgatggatggtaaggtctatgacatcactgagtgggcaggatgtcaacgagtgggcatctctccagatacgcatcgagtgccatatcacatatcctttgggtcgagaatccccgggacccgtggtcgtcagcgcgcaactcctgacgctccccccgcagatctccaggatttcctgtcacgcatttttcaggtcccaccggggcagatgcctaatggcaactttttcgcagctccccagcctgcgcctggggcggcagcagctagtaagccgaattcaaccgtgccaaaaggcgaggccaagcccaagaggcggaaaaaagtgagaagaccctttcaaagatag

SEQ ID NO: 41911 - DNA, 2109 bp, Artificial Sequence
  Description of Artificial Sequence: Synthetic coding sequence
atggcccagaagcaccccggcgagcggggcctgtacggcgcccaccactccgggggcgcttctctcagaaccctcggtccttccgtggaccctgagattccatccttctccggtctgagggactccgcagggactgcgcctaatggaacccgctgcctaaccgaacattctggtcctaaacacacacagcatcccaaccccgctcattggctggaccccagtcatgggcctccgggaggaccaggcccacccagagacgcagaagacccggaccagagtgaaacctcatcggaagaggagtccggagtcgaccaagagctaagcaaagagaatgagacgggcaatcaaaaggacgggaatagtttcctctctatcccctcagcctgtaattgtcagggcactccaggcatacccgagggtccatactctgagggaggtaatggctcttcatcaaacttttgccatcattgtacctcacccgccctgggtgaggatgagctggaggaggaatatgacgacgaggagagccttaaattcccctctgacttttctcgtgtttcgagcggaaaaaaaccaccctcccgtcggcagcggcatcgcttcccaactaaagaagacaccagagaagggggaagacgggaccctaggagcccgggaagacaccgcttaggtcggaagcgcagccaggccgataaacggaagggcttgggactctggggtgcagaggaattatgccagctcggacaggccgggttttggtggctgatagagttgttggtgctggtcggagagtacgtggagacgtgtggacatcttatatatgcatgtcgacagctcaagagcagcgacctggacttgtttcgagtgtggatgggggtgtggaccggacgcttaggtggctgggcacaggtgatgtttcaatttctgtcccagggattctactgtggggtgggcctgttcaccaggtttctcaagctgcttggggcgctgcttttactggctttggccttattcctcggcttcctacagcttggctggcgtttcttggtcggtcttggggaccggctcggctggagagataaggccacctggctgttcagctggctcgactcgcccgccttacaacggtgtctgacccttttgagagatagtaggccttggcaaaggctcgtgcgtatagtgcagtgggggtggctggagttaccgtgggtgaagcaaaatataaatagacaagggaatgcccccgtagcctctgggaggtactgtcaacctgaggaagaggtcgccaggctgctgacgatggccggggttccagaagacgaactgaacccattccacgtgcttggggtagaggctaccgcctccgatgtggaactaaaaaaggcctaccggcagctggcagttatggtccaccctgataagaatcaccaccccagagcagaggaggcatttaaggtgctgagggcagcctgggacatcgtcagcaacgctgagaaacggaaggagtacgagatgaagagaatggctgaaaacgagcttagtagatcagtgaacgagttcctgtccaaactgcaggatgatttaaaggaggcaatgaacacgatgatgtgctcgaggtgccagggcaaacacagaaggtttgagatggatagggaacctaagtccgcaagatactgcgctgagtgcaatagactgcatcctgcggaagagggcgatttttgggctgagagcagcatgctgggtcttaagataacttattttgctttgatggacgggaaggtgtatgatatcactgaatgggctgggtgtcagagggttggcattagcccggacactcaccgggtgccctatcacatcagtttcggtagtcggatcccgggaacacgtggtagacagagagctacccccgatgctccacctgccgacctgcaggactttctatccaggatctttcaagtgcctccagggcaaatgccgaatggcaacttcttcgcagccccacagcccgccccaggcgctgcagcagcaagtaaaccaaacagcactgtacctaaaggggaggctaagccaaaaagaagaaagaaggttagacgcccctttcaacggtag

SEQ ID NO: 41912 - DNA, 1239 bp, Artificial Sequence
  Description of Artificial Sequence: Synthetic coding sequence
atgggcgtgtggaccggccggctgggcggctgggcccaggtgatgttccagttcttgtcacagggcttctactgtggagttggactgttcacccgtttcttaaagttactgggggccctcctgctcctagcgctggccctgttcctaggctttctccagctcggctggaggttcctcgtgggactcggagataggctggggtggcgagacaaggcaacatggctgttctcatggctggactcgccggccctccaacggtgtctgacgctgctgagggattcacgaccttggcagagattagtgagaattgttcagtggggctggttggagttgccctgggttaagcagaatattaacaggcaggggaacgcgccggtggcttcgggtcggtactgtcagcctgaggaggaagtggcacggctgctaactatggccggcgtacctgaagatgagctcaacccatttcacgttctcggggtggaggctacagcttccgacgtggagctcaaaaaggcctatcgccagttggctgttatggtgcatccagacaaaaaccatcatcctcgcgccgaggaggccttcaaggtacttcgagctgcatgggatatcgtgagcaacgccgaaaagaggaaagagtacgagatgaaacgtatggcggagaatgaattgtcgcgctccgtgaatgagtttctttctaagctgcaggatgatctcaaagaggctatgaatacaatgatgtgctccagatgtcaaggtaagcacagaaggttcgagatggaccgcgagccgaaatccgccaggtactgcgccgagtgtaatcgattgcaccccgccgaagagggggacttctgggccgagtccagtatgctcggcttaaagattacatactttgcacttatggacggcaaagtctatgatattaccgagtgggcggggtgccagcgcgtgggcatctcaccggacacccacagggtcccataccacatctctttcggatctaggattcctggaaccaggggacgccaacgcgcaacaccagacgccccaccagctgatctccaagacttcctgtctaggatcttccaggtgcctccaggccagatgcccaatgggaacttctttgctgccccccaacctgcgcccggggcagccgccgcttccaagcctaactccacagttcctaagggcgaggccaagccgaaaaggcgaaagaaggtgcgccgtccattccaacggtag

SEQ ID NO: 41913 - DNA, 576 bp, Artificial Sequence
  Description of Artificial Sequence: Synthetic coding sequence
cggaagcggatggccgagaacgagctgagccggagcgtgaacgagtttctgtccaagctgcaagacgaccttaaggaggccatgaacacaatgatgtgctctaggtgccagggcaaacacagaaggtttgaaatggacagggagcctaagagtgccaggtattgtgccgagtgcaaccgtcttcatcccgccgaagagggcgacttttgggccgaatctagcatgctcggtctaaagattacctacttcgcactcatggacgggaaagtatatgatattacggagtgggcgggctgccaacgcgtggggatatccccagatacccatcgcgttccatatcacatctccttcggcagcaggataccaggtacccggggacgccaacgcgctacacccgacgctccacccgcagacctgcaggactttttatcccggatatttcaggttccccccggccaaatgcctatggggaccagtcttcagctgctgagtctccctctggaaccattgcagccactgagtcctaccgcccagtaccctcgtgaaaagcctaacctgagtggcggaaggaagtag

SEQ ID NO: 41914 - DNA, 240 bp, Artificial Sequence
  Description of Artificial Sequence: Synthetic coding sequence
atggcccagaagcaccccggcgagcggggcctgtacggcgcccaccactcaggcggggcctccctgagaactctggggccatctgtcgatccggagatccctagtttttccggtctgcgggactcagcaggtacggcaccgaacggcactaggtgcttgacagaacacagtggccctaagcatacccaacatccgaacccggctcattggcttgacccgtcccacggtccccctggctag

SEQ ID NO: 41915 - DNA, 456 bp, Artificial Sequence
  Description of Artificial Sequence: Synthetic coding sequence
atggcccagaagcaccccggcgagcggggcctgtacggcgcccaccattcaggcggcgctagcctacggaccttaggcccaagcgtggatcccgaaatcccctccttctccggcctccgagacagcgctggtacggcacccaatggaacaagatgtctcacagaacatagcggcccgaagcacacgcagcaccccaaccccgcccattggttagatccctctcatggacctccggggggacccggaccgccacgagatgccgaggaccctgaccagagcgagaccagttcggaagaagagtcgggcgtggatcaggagctttccaaagagaacgagacaggcaaccagaaagacggcaactctttcttgtcgatcccttctgcatgtaattgccagggtacaccagggatacctgagggtccctatagcgagggggggaatggatcgagttcgtag

SEQ ID NO: 41916 - DNA, 453 bp, Artificial Sequence
  Description of Artificial Sequence: Synthetic coding sequence
atggccgcccggggcgtgatcgcccccgtgggcgagagcctgcggtacgcagagtaccttcagccaagtgcaaaacggccagacgccgacgttgaccaacaacgactggtaaggagcctgatcgctgtggggcttggtgtggcggctctggccttcgcaggaaggtatgcttttcgcatctggaagcctctggaacaggtgattacagagaccgccaaaaagatctctaccccttcgttttcctcttactacaaaggcggcttcgagcagaaaatgtctaggagagaagccggcctcatcctgggggtctctcccagtgctgggaaggccaaaatcagaaccgcacacaggagagtaatgatcctgaaccaccctgacaaaggaggaagtccttatgtggcagccaagatcaatgaggcaaaagaccttctcgaaactactactaagcattag

SEQ ID NO: 41917 - DNA, 1788 bp, Artificial Sequence
  Description of Artificial Sequence: Synthetic coding sequence
atggaggtgcggaagctgagcatcagctggcagttcctgatcgtgctggtcctaattttacagatcttgtccgccctagactttgacccgtacagagtactgggggtgtccaggacggcatcccaggccgacatcaagaaggcgtacaagaagttggcccgggagtggcaccctgataagaacaaggacccgggcgcagaggacaagttcatacaaatcagcaaagcatatgagatactgtctaacgaggaaaaacgtagcaattatgatcagtacggcgacgccggagagaatcaggggtaccagaagcagcaacagcaacgggaataccgtttcagacattttcacgagaacttctacttcgacgaatctttctttcacttcccgtttaactctgagcggagggactccatagacgaaaaataccttcttcatttcagccattatgtgaatgaggtcgttccggattccttcaaaaagccctatttgataaagataacctccgactggtgttttagctgtatccatatagaacccgtgtggaaagaagttatccaggagctggaagaacttggggtggggattggcgtggtgcacgccggatacgagagacgcctagctcaccatcttggagcgcattctacaccaagcattctggggataattaacgggaaaataagcttctttcacaacgccgttgtgcgggaaaaccttcggcagtttgttgagtctctgcttccaggtaatttggtggaaaaggtgactaacaaaaactacgtcaggtttctgtcagggtggcagcaggagaacaaaccacatgtactcctgtttgaccaaacgcccatagttcctctcctatacaaactgacggcgtttgcttataaggattacctttccttcgggtatgtttatgttggcctgaggggcacggaagaaatgacgcgccgctacaacattaatatctacgcacctacactgcttgtgtttaaggagcatataaaccgcccagctgatgtaatccaagcaagagggatgaaaaaacagattatcgacgacttcatcactcgaaacaagtatctgctggctgctcgactgacttctcagaaactcttccatgagttatgtccagttaagagatcccaccgccaacgtaagtattgtgtcgtcctcctgaccgctgaaactactaaactcagtaaaccatttgaggcgtttttatcgttcgcccttgcaaacacccaggacactgttagattcgtccatgtgtatagcaataggcaacaggagtttgctgatactttactacctgactccgaagctttccagggcaagtctgcagtttctatacttgaaaggcgcaacacagcaggacgtgttgtgtacaaaacgctggaggacccttggattggtagtgaaagtgacaaatttatcctgctgggctatttggatcagctgaggaaagaccccgctctgttgtcaagtgaagcagtactgcccgatctgacagatgagctggcaccagtctttctgctgcgatggttttatagtgctagtgattacatttccgattgctgggactcgatctttcacaacaactggagagaaatgatgcccctgttgtccctgattttcagcgcattgtttatcctattcggtaccgtcatagtacaggctttctccgatagtaatgacgagcgcgagagctcccccccggaaaaggaagaggcccaggaaaagactggtaaaacagagccctccttcacaaaggagaattccaggttcctctag

SEQ ID NO: 41918 - DNA, 2349 bp, Artificial Sequence
  Description of Artificial Sequence: Synthetic coding sequence
atggaggtgcggaagctgagcatcagctggcagttcctgatcgtgcttgttctgatcctccagattcttagcgcactggattttgacccatacagggttctgggcgtgtcacgaacagccagtcaggcggacattaagaaggcctacaagaagttagcccgcgaatggcaccccgacaaaaataaagaccccggtgccgaggataagttcattcagatttctaaggcttacgagattctctctaatgaagagaaaaggtcaaactatgaccagtacggtgatgcaggggagaatcaaggatatcagaagcagcagcaacagagagagtatcggttccggcactttcacgagaacttctacttcgatgaatcatttttccacttcccgttcaattccgagaggcgggacagtatcgacgagaaatacctactgcatttttcccactacgtcaacgaggtcgtcccagattccttcaaaaagccctatttaatcaagataacttctgattggtgtttcagttgtatacacatcgaacccgtgtggaaggaagtaatccaagaactcgaagaactcggagtgggtattggcgtcgtccatgccggttacgagaggagactggcccatcacctgggggcccacagcacgccttcgatactcgggataatcaacgggaagatatcgttcttccataacgctgtggtaagagagaatttgcgccagttcgttgagtctctcctgcctggcaatctggtggagaaagtaacaaacaagaattacgtacgatttctgagtggctggcagcaagaaaacaagccgcatgtccttctgttcgaccagactcccatcgtgccactcctgtacaaattaacggcttttgcctacaaagattatctctcattcgggtacgtctatgtgggattacgcggaaccgaagagatgaccagacgctacaatatcaacatttatgcacccacactcctggtattcaaggaacacattaacaggcccgctgatgtcatccaggcccgcgggatgaagaaacaaattatcgacgactttattacaagaaataaatacctgctggcggccagactgacctcacagaaactgttccatgagctgtgtcccgtcaaaagaagtcacaggcagcgtaagtactgtgtggtcctgcttaccgctgaaactactaagttgtccaaaccttttgaagcgtttctgtcattcgctctcgccaacactcaggatacagtccgcttcgtacacgtctacagcaaccgccaacaggaatttgcggacaccctgctgccagacagtgaggcattccagggcaagtccgctgtttccattctggaaaggaggaatacagccgggcgcgtcgtctataaaacgcttgaggacccatggattggcagcgagtcggataaattcattctcttgggttacctagatcagctgaggaaggaccctgcgctgctgagtagcgaagcagttctgccagacctaacagatgagctggcccccgtttttcttctcagatggttctactcagctagcgactatatctccgattgttgggattctattttccacaacaactggcgagagatgatgcccctgttgtccctcattttttcagcattgtttattctatttggtacagtgatcgtacaggcttttagtgatagtaatgatgagcgcgagtctagcccaccagagaaggaggaggctcaggagaagaccggtaagaccgagccttctttcacaaaagagaattctagtaaaattccgaagaaaggcttcgtcgaagtgacagaacttacggatgtgacctacacaagtaacctggtgcggctccggccgggacacatgaatgtagtgctaatcctgtcaaattccactaaaacaagtctgttgcagaaatttgctctggaagtgtatactttcacaggatccagctgcctccacttttcatttttatcccttgataaacatcgggaatggctggaataccttctcgaattcgctcaggatgccgcccccatacccaaccagtacgacaagcattttatggagcgtgattacaccgggtatgtcctggccctaaacggacataaaaaatacttttgtctatttaagcctcagaagaccgttgaagaagaagaggccatcggttcttgctccgatgtggactctagtctataccttggagaatctagaggcaagccatcctgcggtctgggctctaggccgattaaggggaaactctccaaactgagtctgtggatggagcgactgctcgaagggagcctgcagaggttttatataccctcatggcccgaacttgattag

SEQ ID NO: 41919 - DNA, 1968 bp, Artificial Sequence
  Description of Artificial Sequence: Synthetic coding sequence
atggaggtgcggaagctgagcatcagctggcagttcctgatcgtgcttgttctgatccttcagattctctctgcactggattttgatccttatagagtcctcggggtctccagaaccgcctcacaagcagatattaagaaggcttataagaagctggctcgcgaatggcaccccgataagaataaagatcctggagccgaagacaaattcatccagatttcaaaagcttatgagatacttagcaacgaagagaagagaagcaactacgaccaatacggagacgccggcgagaaccagggataccaaaaacagcaacagcagagggagtatcgattcagacatttccacgagaatttttatttcgatgagtcattctttcactttccattcaatagcgaacggagagactcaatcgatgaaaagtatctgctccatttttctcattatgtcaatgaggtcgtgccggattcctttaagaaaccgtacctcatcaagatcacttccgactggtgtttttcttgcattcatatagaaccagtatggaaagaggtcatccaagaattggaagagctgggtgtgggtatcggtgttgtacacgctggatacgaaagacgtctcgcccatcacctaggcgcacatagcacaccctctatcttgggtatcatcaatggcaagatcagcttctttcacaacgcggttgtgcgtgagaacttacggcagttcgtcgaatccttgcttccaggtaatctggtggaaaaggtgacaaacaaaaactacgtgcgattcctttctgggtggcagcaggagaataagccacatgtgcttctgtttgaccaaacacctattgtgccactgctgtacaaactaacagcatttgcctataaagactatttgtccttcgggtatgtttacgtgggcttaaggggcacagaggagatgaccaggcgctacaacatcaacatctacgctcctaccctgctagtctttaaggagcacattaatcgccctgccgatgtgattcaggcacggggaatgaaaaagcagatcattgacgacttcattactcgtaataagtatctgttggccgccagactcacaagccagaagctttttcacgaactgtgccctgtgaagcggtcacatagacagcgcaaatattgtgtcgtcctgctgacagctgaaaccactaagctgagcaagccgttcgaggcctttctgtctttcgcacttgctaatacacaggacacggttagattcgtgcatgtctattctaatagacaacaagagttcgccgacactctcttgccggatagcgaagcctttcagggtaaaagcgctgtcagcattctggagagacgcaacacggccggtagggtagtgtataagactctggaagacccgtggattggctctgagtctgataaatttatcctgctgggctatctagaccagttgcggaaggacccagccctcctgtccagtgaagccgtcctccctgatctaaccgatgagctagcccccgtgttccttctcaggtggttttacagcgctagcgactacatttctgactgttgggatagcatttttcacaataattggcgtgaaatgatgcccctcctttcccttatatttagcgccctgtttattctcttcggtacagtcatcgtccaggccttttcagactcaaacgacgaacgagagtcctcaccccccgaaaaagaggaggcacaggaaaagaccggaaaaaccgagccctcattcactaaggagaactcctcgaagattcctaagaaggggtttgtggaggtgaccgaattgactgatgtgacctacacgtcaaacctcgttcggctacggcctggacacatgaacgtagtcctgatcctgagtaattcgactaagacctccttactacagaagtttgcccttgaggtatacactttcacaggcaagattatccgatggtag

SEQ ID NO: 41920 - DNA, 1788 bp, Artificial Sequence
  Description of Artificial Sequence: Synthetic coding sequence
atggaggtgcggaagctgagcatcagctggcagttcctgatcgtgctggtgttgattctgcagatcctcagtgctttagacttcgacccatatagggtcctgggagtttcgaggaccgctagccaggccgatattaagaaggcctacaagaaactggctcgcgagtggcatcctgacaaaaacaaagacccaggagctgaagacaagtttattcagatttccaaggcttatgaaatcttatccaatgaagaaaagcgcagcaattatgaccagtatggcgatgccggcgaaaatcaaggttaccagaaacagcagcagcagcgtgagtaccgatttcgccactttcacgaaaatttttatttcgacgagagcttcttccattttccatttaattcagaacgccgtgatagcattgatgagaaatacctgctgcatttcagtcactatgtcaatgaggtggtcccggacagtttcaaaaaaccatacctcattaagatcacatccgactggtgctttagctgtatccatatcgagcctgtgtggaaagaggtgattcaggagctagaggaactgggagtggggatcggagtggtgcatgctggctatgaacgaaggctcgctcaccacctgggggcccatagcacaccttcaatcttgggaatcattaatggaaaaatcagcttctttcacaatgccgtggtgagggaaaatctgaggcaatttgtggagtctctgctgcctggcaacctagtagagaaagtgacaaacaaaaactacgttcggttccttagtgggtggcaacaggagaataaaccgcacgtcctgctgttcgatcagactccgatcgtgccgttgctctacaaactaaccgccttcgcttataaggattatctgagtttcggttacgtgtacgttgggctgaggggcaccgaagaaatgaccaggagatataacatcaacatctatgccccaaccttgctagtgtttaaagaacacatcaatcgtcctgcggacgtgatacaagccagggggatgaaaaagcagattatcgatgattttataactcgcaataagtacctgctggccgcgcggttgaccagccagaagctcttccacgagctttgtcccgtaaagcggtctcacagacagaggaagtactgcgtggtgctgctcaccgccgagacaacgaaactgtctaaaccctttgaagcgtttttgagcttcgcattggcgaacactcaagacactgtgcgtttcgtgcacgtgtactctaatcgccagcaggaatttgctgacacgttgctacctgattctgaagcttttcagggtaaatcagccgtgtccatcctcgagcggaggaataccgcaggccgggttgtttataagaccttggaggatccatggataggttcagagagcgacaagtttatcctcctggggtatctagaccagctgagaaaggacccagcgctgctgtcaagcgaagccgtcttgcctgacttgaccgatgagctggcccccgtctttctgctgcgttggttctattccgcatccgattatatctccgattgctgggacagtatattccacaataactggagagagatgatgccacttctgtccctcatcttctccgccctgttcattttatttgggaccgtgatcgtgcaggctttcagtgattccaatgatgaaagggaatcctctcccccagagaaggaagaagctcaggagaaaacaggaaagactgaaccttctttcacaaaagaaaacagccgcttcctgtag

SEQ ID NO: 41921 - DNA, 1077 bp, Artificial Sequence
  Description of Artificial Sequence: Synthetic coding sequence
atggccgccaccctgggcagcggcgagcggtggaccgaggcctacatagacgctgttaggcgaaacaagtaccctgaggatacgccaccggaatcccatgacccttgcgggtgctgtaattgcatgaaagcacagaaggaaaagaaatccgagaacgaatggacccaaacgcggcagggcgagggaaactccacgtacagtgaggagcagctactgggcgtccagcggatcaaaaagtgcaggaactattatgaaatactaggcgtctccagggatgcctcagacgaggagctgaaaaaggcctaccggaagcttgctttgaagttccaccctgacaagaattgcgcccccggggctaccgacgcatttaaagccattggcaacgcgtttgccgtgctctcaaatccggataaacgtctgcgctacgacgagtacggcgatgaacaagtcacattcaccgcaccaagagccaggccgtacaattactatagagattttgaggctgacattacccctgaggagctcttcaacgtattcttcggcggacatttccccaccgggaacatccatatgttctccaatgtaactgatgatacctactattatcggagaagacacaggcacgagagaacgcagacgcagaaagaagaggaggaagagaaaccccaaaccacctacagtgccttcatacaactgttgcccgtgctggtcattgtgattattagcgtgatcacccaattgttggctaccaatccaccatactccttgttttataaatctaccctgggctacaccatcagcagagagacgcagaatctgcaggtgccatactttgtggacaagaactttgacaaggcttataggggcgccagtttgcatgacctggagaagacaattgagaaggactatatagattatattcagacatcatgttggaaagagaaacagcagaagtccgaactgacaaatttagcaggcttatacagggacgagcgactgaagcagaaggcagagtccctgaagttggagaactgcgaaaagctgagtaagttaattggattgagaagaggcgggtag

SEQ ID NO: 41922 - DNA, 78 bp, Artificial Sequence
  Description of Artificial Sequence: Synthetic coding sequence
atggccgccaccctgggcagcggcgagcggtggaccgaggcctacatcgacgccgttcgacggaataaatatccttag

SEQ ID NO: 41923 - DNA, 522 bp, Artificial Sequence
  Description of Artificial Sequence: Synthetic coding sequence
atggccgccaccctgggcagcggcgagcggtggaccgaggcctacattgacgctgtgcgtcggaacaagtaccctgaggacacacccccggagtctcacgatccttgtggttgttgcaactgcatgaaggcgcagaaagaaaagaagtcagagaacgagtggacacagacgcggcagggcgaagggaatagcacctactctgaggagcagctgctcggcgtccagcgcattaaaaagtgtagaaactattacgagattctgggagtttcacgggatgccagtgatgaggagcttaagaaggcctaccgaaagctcgccctgaagttccaccccgacaaaaactgtgcccccggcgccaccgacgcttttaaagcgatagggaacgcttttgctgttttgagcaatcccgacaagagactcaggtatgatgagtacggggatgaacaagtcacatttactgcacctcgcgctagaccctacaattactacagggattttgaagctgatataactcccgagtag

SEQ ID NO: 41924 - DNA, 546 bp, Artificial Sequence
  Description of Artificial Sequence: Synthetic coding sequence
atggccgccaccctgggcagcggcgagcggtggaccgaggcctacattgacgcagtgcgcagaaataaataccctgaggatacccccccagagagccatgacccatgtggatgttgtaactgtatgaaagcacaaaaggaaaaaaagagtgaaaatgagtggactcagaccagacagggtgaaggaaattccacctatagtgaggagcagctgctcggcgtccagcgtataaagaaatgtaggaattactatgagatcctcggagtgagtagggacgcatcagacgaggaattaaagaaagcatacagaaaactcgcactgaaatttcaccccgacaagaactgtgcccctggagccaccgatgcctttaaagcaatcggcaacgccttcgccgttctgagtaatcctgataagagattgcggtacgatgaatacggtgatgaacaggttacctttacagccccacgagcccgcccttataactactaccgcgatttcgaagccgacatcactcctgaagaattgttcaatgtattcttcggatag

SEQ ID NO: 41925 - DNA, 1026 bp, Artificial Sequence
  Description of Artificial Sequence: Synthetic coding sequence
atggccaagggcctgctggtgacctacgccctgtgggccgtgggcgggcctgcaggcttacatcatttgtacctcggccgggactctcacgctttactgtggatgctcacacttggagggggcggtctcggctggttgtgggagttttggaagctccctagtttcgtggcacaggccaatagagcacaaggacagcgccaaagcccccgtggcgtcactcctcctctgtctcctatcaggttcgctgcccaggtgatcgtaggcatctactttggtctagtcgcactgatttctttgtcatccatggtcaatttttacatcgtggcattgccgctggccgtgggactgggtgtgttgctcgtcgccgcagtgggaaatcagaccagcgatttcaagaacaccctggggagcgcgtttctgacgtcccccattttttatgggcggcccatcgcaattctgccaatctctgttgccgcgagcatcactgctcagcggcatcggcgatacaaagcactcgttgcgtcggaacccttgtccgttcgtctgtaccgcctaggtctggcatacctcgccttcaccggacccctcgcatatagcgcactttgtaacaccgcagcaacgctatcgtacgtggcagaaacattcggctcttttttaaattggttcagtttcttcccgctactgggaaggctgatggaatttgtgttactgcttccgtatcgcatttggaggctgctgatgggcgagactggttttaattcgtcctgcttccaagagtgggccaaactttatgagttcgtccactcattccaggacgaaaaacggcagctggcttatcaggtgctgggtctctccgaaggcgccacgaacgaagaaatacaccgctcctaccaggagcttgtcaaagtctggcatccggaccataacctagatcagaccgaagaagcacagagacattttcttgagattcaagccgcatacgaagtgctgtctcagccaagaaaaccgtgggggtctaggcggtag

SEQ ID NO: 41926 - DNA, 1026 bp, Artificial Sequence
  Description of Artificial Sequence: Synthetic coding sequence
atggccaagggcctgctggtgacctacgccctgtgggccgtgggcggaccagctggtttgcaccacttatatctgggcagagactctcacgcattgctgtggatgttgactctgggcggcggtggcttgggatggctgtgggagttttggaaactgccatcgttcgtggctcaggccaatagagctcagggacaaagacagtcgccacggggcgtgaccccgccactctcccctatccgatttgccgcccaggtaatcgtggggatctactttgggctggtcgccttgatatccctctcgagcatggttaacttttatatcgtagcgctgcccctcgcggtggggctgggtgtcctgttggtcgccgcagtggggaatcagacctcagatttcaagaacacccttgggtccgcattcttgacttcacccatcttctacggccgaccaatcgcaattctaccgatatcagtggctgcgagcatcaccgcacaacggcacagaagatataaggccctggtcgcttctgagccattatcagttagactttacaggttggggctggcatacctggcattcaccggtccactggcttactcagccctgtgcaacaccgcagcgaccctaagctacgttgctgagaccttcggctcatttttgaactggttctcattttttcccctcctcggcagattgatggagttcgtccttctgttgccctacaggatctggcggttgcttatgggcgaaactgggttcaacagctcctgcttccaggaatgggcaaaactttacgaatttgtccacagctttcaggatgaaaagaggcagctagcgtatcaagtccttggcctgtcagagggcgcaacaaatgaggagatccatagatcatatcaagagcttgtgaaagtttggcatcccgatcacaacttggatcaaaccgaggaagcccagcgccacttcctggagattcaggctgcctatgaggtactgagccaacctcgcaagccatgggggtccagaagatag

SEQ ID NO: 41927 - DNA, 681 bp, Artificial Sequence
  Description of Artificial Sequence: Synthetic coding sequence
atggccgccatgcggtggcggtggtggcagcggctgctgccctggagactcctgcaggcgcgcgggttccctcagaattccgctccgtcactgggccttggcgctagaacgtacagccaaggggattgctcgtatagccggaccgcgctttacgatttgctcggagtgccatctaccgctacccaggcccagataaaggccgcctattatcgccaatgctttctctaccatcctgatcgcaatagcggcagcgccgaggccgcggaaaggtttacaagaatctcacaggcttatgtagtgctgggctcagccactctccggaggaagtacgatcgtgggctactctctgatgaggatctacgaggacccggagtgagaccatcccggaccccggcacctgaccccgggtccccccgaacaccccccccgacctcgagaacgcacgatggtagcagagcctctccgggggctaacagaaccatgtttaacttcgacgccttctatcaggcgcattatggggaacagttggagagggaaaggcgactgcgagctcggagagaagctctgagaaaaaggcaagagtatcgcagcatgaagggtttgcggtgggaggacaccagggacacggccgctatttttctcattttctcaatctttatcatcatcggtttttatatttag

SEQ ID NO: 41928 - DNA, 522 bp, Artificial Sequence
  Description of Artificial Sequence: Synthetic coding sequence
atgcggtggcggtggtggcagcggctgctgccctggcggctgctgcaggcacgcggattccctcagaatagtgctcctagcctggggctcggtgccaggacatactctcaaggcgactgtagctacagtcgcaccgccctctatgacttgttgggggtgccgagtacagctactcaggcacagattaaggccgcttattaccgccagtgcttcctgtaccaccctgataggaatagcggaagtgcagaagccgctgagcgctttacacggatatcacaggcatatgttgttttgggctctgccactctcagacggaagtacgaccgcggcttattgagcgacgaagacttgaggggtccgggggtcagacccagtcgtacccctgcacctgacccaggttctccaaggacaccaccccccacctcccggtccatgaaaggactgcgctgggaggataccagagataccgctgctatttttctcatttttagtatttttattatcatcggcttctatatctag

SEQ ID NO: 41929 - DNA, 726 bp, Artificial Sequence
  Description of Artificial Sequence: Synthetic coding sequence
atgccccccctgctgcccctgcggctgtgccggctgtggccccggaatccaccctctagactgctgggggctgccgccgggcaacggagtagacccagtacctattatgaactgctgggggtacaccccggagccagcactgaagaagtgaagcgagccttcttcagcaagtccaaagagctccacccagacagggatcctggaaatcccagtctgcacagtagattcgtcgaactgagcgaggcttacagagtgttgagccgagaacaatccagaaggagctacgatgaccagctccggagcggaagtcccccaaaatctcctagaacaaccgtgcatgacaagtcagctcaccaaactcattcaagctggacacccccaaacgcccaatactggtcccaatttcactcagtgagacctcagggtccacaactccgccagcagcagcataaacagaataagcaggtcctggggtattgtttgctactgatgctggctggcatggggctgcactatatcgcctttcgtaaggtgaaacagatgcatttgaacttcatggatgagaaggatagaatcattacagcgttctacaacgaggctagagcacgggcgcgggccaacagaggcatattgcagcaagaacgccagcggctggggcaacgccaacctcccccctctgagcccactcaagggcccgagattgtgccacggggagccggtccatag

SEQ ID NO: 41930 - DNA, 537 bp, Artificial Sequence
  Description of Artificial Sequence: Synthetic coding sequence
atgctgcggaccgccctgcggggcgccccccggctgctgagccgggtacagccaagggcaccctgcttgaggcggttgtggggcagaggggcaaggccggaggttgccggaagacgccgggcttgggcatggggatggcgaagaagttccagcgaacagggccctgggcccgcagccgccctcgggcgcgtggaggccgcgcactaccagctggtttatacttgtaaagtatgtggaacaaggagctctaagagaatctccaagcttgcatatcatcagggcgtagtcattgtgacatgtccggggtgtcagaatcatcatattatcgcagacaatctcggctggttttccgacctgaacggcaaacgcaacatcgaggaaatactcacagcacgcggggagcaagtccacagagtggcaggcgagggcgccttggagctggtgcttgaagccgctggagcgccaacatcaactgctgcgccagaagcgggcgaagatgagggtccaccaagtcctggcaagacagaaccctcctag

SEQ ID NO: 41931 - DNA, 1617 bp, Artificial Sequence
  Description of Artificial Sequence: Synthetic coding sequence
atgacccgggagtgccccagccccgcccccggccccggcgcccccctgtccggctccgtcctcgctgaggctgctgttgtgtttgccgttgtccttagtattcatgctacagtttgggataggtacagttggtgcgccgttgccctagctgtacaggcgttctacgtgcaatataagtgggatcgactgctccaacagggctctgccgttttccagtttagaatgagcgctaacagcggtcttctgccagctagtatggttatgcctttgctggggttggtaatgaaagaaagatgccagacggccggcaatccattttttgagagattcggcatcgtcgtcgctgctacaggcatggcggtggccctgttttcatccgttctcgccttaggcatcacgagacccgttccaacgaatacttgtgtgattctggggctcgccggaggagttattatttatatcatgaagcactccctgagcgtgggcgaggtaattgaagtgctggaggttctgctgatattcgtttatctgaacatgatcctcctgtatctgctcccccggtgctttactcccggtgaagcattgctcgttctcgggggtattagcttcgtgctgaaccagttgattaagaggagcctgaccctggtggaatcacagggggatcccgtggacttctttctcctcgtggtggtcgtgggcatggttctgatgggcattttcttctctacactgtttgtctttatggactctggaacctgggcctcgagcattttttttcatttgatgacctgtgtactgtccctgggcgtggtgctgccttggctgcatcgccttattagacgaaatcctctcctgtggcttttgcaattcctgtttcagaccgacacacggatttacctgttggcctattggtctctgttggctacgctggcttgcctggtagttttatatcaaaatgcgaagcgttcttcctctgagagcaaaaagcaccaggctcccaccatcgcacgaaagtattttcatctcattgttgtggctacatatatacctggcatcattttcgatagacccctgttgtacgttgcggccactgtctgtctggctgtgttcattttcctggaatatgtccgctactttaggatcaagcccctgggacacacactacggtccttcctaagtttgttcctggatgaacgtgattccgggccgctgatcctcacacatatatacctgttactcgggatgagcctccccatatggcttattcccaggccatgtactcagaaaggcagcctcggcggcgctcgtgcattggtcccctacgcgggggttctagcagttggcgtgggtgataccgttgcttccatatttggatccacaatgggtgagataagatggccgggcacaaagaagacatttgagggcaccatgacatccatattcgcccaaattatatcggtcgcgctgatcctcattttcgactccggggtggatcttaactacagttacgcctggatcctgggttctatctctaccgtgtccctgctagaggcatacacgacacaaattgataacttattattacctttgtacctcctcattctgctgatggcatag

SEQ ID NO: 41932 - DNA, 801 bp, Artificial Sequence
  Description of Artificial Sequence: Synthetic coding sequence
atgacccgggagtgccccagccccgcccccggccccggcgcccccctgagtgggtccgtactagctgaggccgccgtggtgtttgccgtagtgctgtccatccatgccaccgtttgggatcggtatagttggtgtgcggtggcactcgccgtgcaggcattttatgtacagtataaatgggaccgtttactccagcaaggatctgctgtcttccagtttcgcatgtccgcgaattcgggactcctcccggcctcaatggtcatgccgcttcttggcttggtgatgaaggagcgctgtcagactgctgggaatcccttctttgagaggttcggtattgttgtggccgcaacaggaatggccgtagcactcttcagtagcgtcctggctcttggtattacacgtccagtacccactaacacctgtgttattttagggctcgcgggcggcgttataatctacattatgaagcattcactcagcgtcggagaagtgatcgaggtactggaggtgctgctgatctttgtctatctgaatatgattttactttacttgctgcccaggtgttttacccctggagaagcgttgcttgtcctggggggaatcagttttgtgctcaaccagctcattaagaggtccctgactctggtggaatctcaaggggacccagttgatttttttctgttggtcgtggtggtgggcatggtgttaatgggcatttttttcagtacactgtttgtattcatggattccggcaccagaccccctcctagtccggagagcatttccacaagtctgtggtag

SEQ ID NO: 41933 - DNA, 717 bp, Artificial Sequence
  Description of Artificial Sequence: Synthetic coding sequence
atggccgccgacggccagtgcagcctgcccgccagctggcggcccgtcactctaacccatgttgagtaccccgctggagacctgtcaggtcacctgctggcctacctgtccttgtcgccggtcttcgttattgtgggattcgtgacactaattatctttaaaagagagttgcacactattagctttctggggggcctggctttgaatgagggcgttaactggctcatcaaaaacgtcatacaagagccacggccatgtggcggcccgcacaccgctgtggggacaaaatatggtatgccctcctctcactcacagttcatgtggtttttctccgtctattcttttctgtttctctacttacggatgcaccagactaacaatgccagattcctggacctgctgtggcggcacgtgctctccctaggactccttgctgtggccttcttggtctcttactccagagtgtacctgctataccatacctggtcccaggtcttgtacggtggaatcgcaggaggcctgatggcaatagcctggttcatctttacacaggaggttctgacacccctgttcccaagaatcgctgcctggcccgtgagtgagtttttcctgatccgggatacaagtctgatacccaacgtgctgtggttcgaatatactgtgacacgggccgaggcgcggaacagacagcgcaagcttggcaccaagttgcagtag

SEQ ID NO: 41934 - DNA, 588 bp, Artificial Sequence
  Description of Artificial Sequence: Synthetic coding sequence
atggccgccgacggccagtgcagcctgcccgccagctggcggcccgtcactctgactcatgtggaatatcccgccggcgacctcagtggacatcttctggcctatctgagtctgagtccggtatttgttatcgttggctttgtaaccctgattatttttaagcgcgagcttcacaccatcagtttcctcggggggctggccctgaatgaaggtgttaactggctcatcaaaaatgttattcaggaacccagaccatgcgggggtccgcatacagccgtgggaaccaagtatggcatgccatcaagtcactcgcaatttatgtggtttttctcagtttattcttttttgtttctgtacctgcggatgcatcagaccaataatgcccgtttcctggatctcctgtggcgccacgttctatctttaggactcttagccgtcgcctttcttgtgagctattcccgcccagtgtcagagttcttccttatcagagatactagtctcattcccaatgtgttgtggtttgagtacaccgttactagagccgaggcccgtaatcgccaaaggaaattgggaaccaaactacagtag

SEQ ID NO: 41935 - DNA, 294 bp, Artificial Sequence
  Description of Artificial Sequence: Synthetic coding sequence
atgcccagcagccacagccagttcatgtggttcttcagcgtgtacagctttcttttcctgtacctgcgtatgcaccaaaccaataatgcccgctttctcgatctcctgtggaggcacgtgctttctcttggcctactggccgttgcattcctggtaagctattcccggcccgtgagcgagttctttctaatcagagacacctccctcatcccaaacgtcttgtggttcgagtacaccgtcacccgggccgaagcgcggaaccgccagcggaaactgggtaccaagctccagtag

SEQ ID NO: 41936 - DNA, 1227 bp, Artificial Sequence
  Description of Artificial Sequence: Synthetic coding sequence
atgtgggccttcagcgagctgcccatgcccctgctgatcaacctgattgtgagcttattgggtttcgtagccacagttaccctgatacccgccttcaggggacacttcatcgccgccagactgtgtggtcaggatctgaacaagacgagccggcaacagattcctgagagtcagggcgtcatttctggggctgtgttcctcatcattctgttctgttttatccctttccccttcctaaattgcttcgtcaaggagcaatgcaaggcattcccccatcacgagtttgtggctctgattggggctctgctcgccatatgttgcatgattttcttaggttttgccgacgacgtgttgaacttgcgctggagacacaaattacttctgcctacagctgcttctctcccactcttaatggtgtactttactaatttcgggaacaccaccattgtggtgcccaaaccttttcgccccattcttggcctccacctagatctggggatactctactatgtatatatggggctacttgccgttttttgcacaaatgctattaatattcttgcaggcatcaacggccttgaagccgggcaaagccttgttataagcgccagcatcattgtatttaaccttgtggagctggagggagattgtcgcgatgaccacgtttttagcctctactttatgataccgttctttttcacaacactgggactactataccataattggtatccttcacgtgtgtttgtcggcgacacgttttgttacttcgccgggatgactttcgccgtggtcgggatcctcggacatttcagcaaaaccatgctcctgttctttatgccccaggtttttaactttctttattccctgccccagctactccacatcattccatgtccccgacataggatccctcgccttaacattaagaccggcaaactcgaaatgagctattccaaattcaagactaaaagtctctcctttctgggaacattcatcctgaaggtcgccgaatcactgcagctcgtaaccgttcaccaaagtgaaactgaggacggggaattcacggagtgcaacaacatgaccttaattaatctgttactgaaggtgctgggccccattcacgaaaggaacttaaccttgcttctgttactgttacagatcctgggttccgccatcaccttctctattagataccaactggtcagacttttctatgacgtgtag

SEQ ID NO: 41937 - DNA, 1227 bp, Artificial Sequence
  Description of Artificial Sequence: Synthetic coding sequence
atgtgggccttcagcgagctgcccatgcccctgctgatcaacctgatcgtcagcctgttggggttcgttgcaaccgtgacacttatacccgccttccgaggccatttcatcgcagcccggctttgcggacaggatctgaacaagacatctagacagcagatccctgagtctcagggtgtgatctcgggagcagtctttttgatcatcttgttctgttttattccgtttccctttttaaattgctttgtgaaagagcaatgcaaggctttcccgcatcatgaattcgtggcattaatcggggccctactcgccatctgttgcatgatttttctgggattcgcagatgatgtgctcaatttgcgctggcgccacaagctgcttctccctactgccgccagccttcccttgctgatggtctattttaccaacttcgggaatacaaccattgttgtgcctaagcccttccgccctatcctcggcctgcatctggatcttggcattttgtattacgtctatatgggtctgctggccgtattttgtactaatgccatcaatattctcgccgggatcaatggacttgaagctggacagtctctggtcatttcagcttctatcatagtgtttaacctcgttgaactggaaggagactgtcgggacgatcatgtcttcagtctttacttcatgattcccttcttttttaccactttgggactgctgtatcataactggtacccaagccgggtgttcgtgggggacacattttgctacttcgctgggatgacctttgccgtggtgggcattctgggtcacttctcaaagactatgctgttattctttatgcctcaggtcttcaacttcctgtactctctccctcagctactacatataataccttgtcctagacatcggatccctagactgaatattaaaactggtaaattagaaatgtcctactcgaaattcaagactaaatccctatcattcttaggtacctttatcttgaaggtagccgagagtctccagctcgtgactgtccatcaatccgaaactgaagacggcgagtttacagagtgcaataatatgactttgataaaccttcttcttaaggtgcttggccccattcacgaaagaaacctgacactactgctccttctgctacagatcctgggcagcgcgatcacattctcaattcgataccagttggtaaggcttttttacgatgtgtag

SEQ ID NO: 41938 - DNA, 984 bp, Artificial Sequence
  Description of Artificial Sequence: Synthetic coding sequence
atgatcttcctgggcttcgccgacgacgtgctgaacctgcggtggagacataaactgctcctgccaacagccgcatctctgcctctgctcatggtgtatttcaccaactttggtaacacaacaattgtagttccaaagcctttccggcccattctagggctgcatctcgatcttggcattctatactacgtgtacatgggattgctcgctgtgttctgcaccaatgctattaatatactagctggcattaacgggctggaggcgggacagtcgcttgtcatctcagccagcataatcgtgtttaacctagtagagctggaaggagattgtagggacgatcacgtgtttagtttgtatttcatgatcccgttcttctttaccaccttgggcctgctctatcacaactggtatccgagtcgagtatttgtcggcgacaccttttgttatttcgccggaatgacatttgcggtagtcgggatcctcggacattttagcaagacaatgctgctgttttttatgccacaagttttcaactttctgtacagcctaccacaattgctacatatcatcccgtgccctagacacagaattcctaggttaaacattaaaacagggaagctagaaatgagctacagcaaattcaagaccaaatcactgagcttcctcggcacatttatccttaaagtggccgaaagtctgcagctggtgacagtgcatcagagcgagaccgaggatggtgagtttaccgagtgtaataacatgaccctgattaatctgttgttgaaggtactggggccaattcatgagcgcaacctcacattgcttctcctgctgctccaggttagaatgggcattgagtttatcccgccatgtttaccattttgcgtgattttgacgcccgtgcacttttcactacagattcttggatcggctattacatttagcatcagataccagcttgtgcgcctgttttatgacgtctag

SEQ ID NO: 41939 - DNA, 255 bp, Artificial Sequence
  Description of Artificial Sequence: Synthetic coding sequence
atggccaccggcaccgaccaggtggtgggcctgggcctggtggccgtcagtctgataatctttacttattacaccgcctgggtaattttgctacccttcatcgatagccagcacgtcatccataagtactttctgccaagggcatacgccgtagctattcctctcgccgctggccttctgctcctgctgttcgtgggtcttttcatctcatatgtcatgttgaaaaccaagagagtgacgaaaaaggcccagtag

SEQ ID NO: 41940 - DNA, 393 bp, Artificial Sequence
  Description of Artificial Sequence: Synthetic coding sequence
atggccaccggcaccgaccaggtggtgggcctgggcctggtggccgtcagtcttatcatatttacctattatacagcctgggttatcctgttacccttcattgattcacagcatgtcatccacaagtacttcctccctcgagcttatgcagttgccattccacttgcagcaggtctgcttctgctgctgtttgtcggtaagagcagccctccacctttggatcccgggcagggctttggcaagacaccccccctgaacatgttaccacattttggcggggcagggtcctgcctaccaagaacccacccctggggtttccccgtacacccatctcgtctgcccgtatccaacttatgggtttcctggtgtccacgtctgtttggtctacagtag

SEQ ID NO: 41941 - DNA, 7110 bp, Artificial Sequence
  Description of Artificial Sequence: Synthetic coding sequence
atgaacaccgaggagctggagctgctgagcgacagcaagtaccggaactacgtggctgccattgacaaagcactgaagaactttgaatattcctcagaatgggccgaccttatctctgcactcggcaaactgaataaagtgcttcagaacaatgccaagtaccaggtcgtcccaaaaaaactgactataggcaagcgactggcccagtgcctacaccctgccctgcctggcggcgttcaccgaaaggcgctggagacatacgaaattatctttaagatcattggtcctaagcggcttgcgaaagatctatttttatactcgagcggactgttcccactgctcgcaaatgctgctatgtctgtaaaacctacactgctgagtctgtacgaaatatactatctgcctctgggtaagacgctaaagccaggcctgcaaggtctgcttaccggtatcctgccgggactggaagaagggagtgagtactatgagaggacaaacatgcttctggaaaaggtggccgctgccgtggaccaatctgcattctattctgcactgtggggtagtttgctgacaagtcccgcggtccggctgccaggaatcacatatgtgctcgcccatttaaaccgaaagctgtctatggaggatcagctgtacatcatcgggtcagatatagagctcatggtcgaggctgtctcaacaagtgtccaggatagttctgtgctcgtgcaacgctcaacacttgatttgatcttgttttgttttccttttcacatgtctcaggccaccaggcccgatatgatccgaattctctcagctgcactccacgtcgtcctgagaagagacatgagcctgaaccgcagattatatgcttggctgctcggaccccggagcacccggcactcgaatccagaggaacacgcgacctactactttactacatttagtaaggaactgttggtccaggctatggtgggaatcttacaggtgaacgggtttggagaagagaacaccctgatgcaggacctgaagccctttcgaattctcatatctctgttggacaagcctgaactggggccggtgatattggaggatgttctgattgaggtgttcaggaccttgtactcccaatgtaaggccgagctggatcttcagacggagcctccattttcaaaagaccacgctcagctaagtagcaagcttagggagaacaagaaaacggccgagctgatcaaaaccgccaacttgctcttcaacagcttcgaaccctactatatgtgggattacgtagcacgctggtttgaggagtgttgccgtaggacgctgcacgtgcgactccagatcgggcccggggacagcaacgacagcagcgagttgcaacttactaacttttgtcttttggtagactttctgcttgacatcgtcagtttagagacatatatagagattcagaccgagcacttaccccagctgttgctaaggatgatatcagcactgacttctcacttgcagacattacatctgagcgaactgactgattcacttcgcttatgttccaaaatcttgtccaaagtccaaccgccgctcctgtcagcatccacggggggagtgctacagtttccaagtggacagaataattccgtgaaggagtgggaggataaaaaggtctcttcggtctcacatgaaaatccaactgaggttttcgaggatggagaaaatccaccttcatctcgtagcagtgagtctggtttcactgaattcattcagtatcaagccgatcgtacagatgatattgaccgcgagctgtctgaaggacagggtgctgcagcaatcccgattgggtctacatcttccgagacagaaacagcatctacggtcgggagcgaagaaactatcatccagacaccgagcgtggtcacacagggaactgcgactagatccagaaaaacagcgcaaaagaccgccatgcaatgctgcctagagtacgtgcaacagttcctaacccgcctcattaacttgtacatcattcaaaacaattctttctcacagagtctcgcgaccgaacaccagggggatctggggagagagcagggagagacaagtaagtgggatcggaacagccaaggcgatgtaaaggagaaaaacatttctaagcaaaaaacatcaaaggagtacctctcagcttttctggctgcatgtcagctctttctggagtgctcttcttttcctgtgtatatagccgaaggtaaccacacatcagaactccgatccgaaaagttggaaactgactgtgaacacgtgcagccgccccaatggctccaaaccctgatgaacgcctgcagccaggcgtccgacttttctgtgcagtccgtggcaatctctctggtgatggacctggtaggcttgacccagtccgttgctatggtgactggcgaaaatatcaacagcgttgagcctgctcagcccctctcgcctaaccagggacgcgtggcagtggtgattcgtcctccgttaactcaggggaacctgcggtacattgccgagaagactgagttttttaaacacgtagctctgacactgtgggaccagctcggagacggcaccccccagcaccatcagaagagcgtggaactcttctatcaactccacaacttggtgccttctagctccatctgtgaggacgtcatatctcagcagctcactcacaaggacaagaaaatccgaatggaggcccatgccaagttcgctgtgttatggcacctaacccgtgacctccatattaacaaatcatcatccttcgtgaggtcctttgatcggtccctcttcatcatgctggactccctcaatagtctcgacgggtcaacatcttctgtagggcaggcctggctgaatcaagtcctccagcgtcacgacattgccagggtgttggagccactgctgcttttattactgcatcccaaaacccagcgagtgtcagtgcaaagagtccaggctgagcgatactggaataagtccccttgttaccccggagaagaatccgacaagcatttcatgcagaattttgcttgttccaatgtcagtcaggtccagcttatcacatcgaagggcaatggggagaagccactgacaatggacgaaattgagaacttcagtcttaccgtcaatcctctgtcggatcgactgagtctgctgagcaccagctcagaaacaattccaatggtggtgtcagatttcgatctccccgatcagcaaatcgaaatactgcaatcgtctgattctgggtgctcccagagctcagctggcgataacctttcatacgaagtggacccggagacagtaaacgctcaagaagactcccagatgccaaaggagtcctcccctgatgatgacgtccagcaggtggtctttgatctgatttgcaaagtggtcagcggccttgaagttgaatctgcttcagttaccagccagctcgaaattgaagcaatgcctcccaaatgcagcgatatcgaccctgatgaggaaacaatcaagatcgaagacgattccatccagcagagccagaacgctttgttatcgaatgaaagcagccagttcctgtccgtgtcagccgagggaggacatgaatgcgtggctaatgggatctccagaaactctagctctccttgcatttcgggcaccacgcacactctgcacgacagcagcgtggcatcgattgagaccaaaagccggcagcgctctcattcaagtatacagttctcatttaaggagaaactatccgaaaaagtgtcggagaaggaaactatcgtaaaggagagcgggaaacagcccggcgctaagccaaaagtgaaactcgctaggaaaaaagatgatgataagaaaaaaagctccaacgagaaactgaaacagacaagtgtgttcttcagcgacggcctggatctagagaattggtattcatgcggggagggtgacatctccgagatcgaaagtgatatgggatctcccggttcacgcaaaagtccaaacttcaacatccacccattgtaccaacatgtgcttctgtatctccagctgtacgacagctctcgtaccctgtatgccttctctgccataaaggctattctgaaaacaaaccccatcgcattcgttaacgctatcagcacaacttccgttaacaacgcttacactcctcagctgagcctgttgcagaatctcctggcccgccacagaatctcagtgatgggcaaagatttctacagtcatattccagtggattcaaatcataactttaggagctccatgtatatcgagatcttaatctcactctgcctttattatatgaggtctcactaccctacccatgtaaaggtcaccgctcaggatttgatcggcaatcgcaatatgcaaatgatgtctatcgaaatcttaacactgctgttcaccgaactagctaaggttatcgaatcatcagccaagggctttccatcattcatttcagatatgttatcaaaatgtaaagtccagaaggtcatcttgcactgcttgttatcctcgatctttagtgcccaaaagtggcactcagagaagatggccggcaagaaccttgttgccgtggaagaggggttcagtgaggactctctcattaacttctctgaggacgagttcgacaatggctcaacactacagtcccaactgctcaaggtgctccagcggcttatagttttagaacatagggttatgaccatcccagaggagaatgaaacaggattcgatttcgtcgtgagcgatctggagcacatctcaccacaccaacctatgacatctctacagtatcttcacgcacagcctatcacatgccagggaatgtttttatgtgccgttatccgggctctccatcagcattgcgcctgtaaaatgcacccccaatggattggcctgattactagcaccttgccatatatggggaaggtcttacagcgggttgtcgtctcggttacattacagctgtgtagaaacctggacaacctgattcagcagtataagtacgagaccggactgtccgactctcggcccctgtggatggccagcatcattcctccagacatgatccttaccctgctggagggaattacagccatcatccattattgcctcttagaccctacaacccagtaccatcagctgctcgtcagcgtggatcagaaacacctgtttgaggccagaagcgggatcttgagcatcttgcatatgatcatgtcctccgttacacttttatggagtatcctccaccaggctgatagctcagagaaaatgacaatcgctgcatcagcctctctaaccacaatcaacttaggcgctaccaaaaacctgcgccaacagattctggaacttcttgggcctatctcaatgaaccatggtgtgcacttcatggctgcgatagcatttgtttggaacgagaggcgtcagaataagactactacacgcacaaaagtgatacctgcagccagcgaggagcagctcctgctcgtagaactcgtgcgttctatctcagtaatgagggccgaaacggtaattcagaccgtaaaggaggtactcaagcagcccccagccattgccaaagacaaaaaacacctctcactcgaggtttgcatgcttcagttcttctatgcatacatacagagagtgctgaacgagtttataatgaagaaccccagcctagaaaataagaaggatcagagggatcttcaggacgtcacacacaaaatagttgacgccatcggcgcaatagcaggttctagtctagagcagactacgtggctgcggcggaacctcgaggttaaaccatcaccgaagatcatggtggatgggacgaatctggagagcgacgtggaaggcattctggttaagcacctcggcctgctgagtgtactggcccatctgctagacatggtgttttactctgacgaaaaagagcgcgtcatccctctacttgtgaacatcatgcattatgtcgtgccctatctgaggaatcatagtgctcacaacgcaccgagttatagagcatgtgtgcagcttctttccagccttagtggctatcagtacacacggcgtgcgtggaagaaggaagccttcgatctcttcatggatccctcctttttccagatggacgcctcctgtgtcaaccattggagagccattatggacaacctgatgacccacgacaagaccacctttagggacctgatgacacgcgttgctgtggctcagagctcctcgcttaacctgttcgcaaatagggacgtagagctcgagcaacgagcgatgttactaaaacgccttgccttcgccatattctctagtgagattgaccagtaccagaaatatttgccagatattcagggcatccctgtttccaagtgggtgcagttactgactgccctgagtccagcctatcgcaccagcgggccgtctgtcgcaggactcgagaccacctacactgggggcaatggattctcgacttcatacaattctcaacgatggcttaacctgtacctgagtgcatgcaagtttcttgacctagcattagcgctgccctccgagaatctgccacagtttcagatgtacagatgggccttcatacccgaggcgtcggacgatagtggcctagaggtcagaaggcaaggcattcaccagagggaattcaaaccctatgtcgttcggttggcaaaactgctgagaaagagagccaaggacaaggaagaggattttaagactgtaatcctggaagggctggaaatggctaagcatcagaagaatcctgaagaggacaatagcggccgtaccctgggttgggagccgggccatctactgctaactatatgtacggtgaggagcatggagcagttgttgcccttcttcaatgtgctgagtcaggtgtttaattccaaggtcacctctagatgtggtgggcactccgggagccctattctgtactccaacgctttccccaataaggatatgaagctggagaatcataaaccttgcagctcaaaggccaggcagaaaatagaggagatggtcgaaaaggatttcctcgaagggatgattaagacatag

SEQ ID NO: 41942 - DNA, 7398 bp, Artificial Sequence
  Description of Artificial Sequence: Synthetic coding sequence
atgaacaccgaggagctggagctgctgagcgacagcaagtaccggaactacgtagcagccatcgataaagccctgaaaaattttgagtacagcagcgaatgggccgaccttatatccgctctggggaagctgaacaaggtcttacagaacaacgccaagtatcaggtcgtgcctaaaaagttgaccatcggtaaacgcctcgcccagtgcctgcaccctgccctcccaggaggcgttcacagaaaggcacttgagacctacgagatcattttcaagatcataggtccgaaacgtttagcgaaggatctttttctgtacagcagtggcttgtttccactattagctaatgcagccatgagcgtgaaacctacattgctgtcgctctacgagatctactatctgcccttgggcaagactttgaagcccgggctgcaaggtttgctgacaggcattctgccagggctagaggagggatccgaatattacgagaggactaatatgttgctggagaaagtcgccgccgccgtggatcaaagtgccttttattctgccctgtgggggtccctgctgaccagcccagctgtgagactgccaggtattacctacgttctggctcatttgaatcgtaaactctcaatggaggatcagctctatatcatcggctctgacatagaactgatggtcgaggcggtaagcacttctgtacaggactcttctgtgcttgtgcagcggtcaacgttagatttgatcctattctgtttccccttccacatgtcacaggcaactcggcccgacatgataaggattctttccgctgccctgcacgtagttctgcggagagacatgtcactgaaccgcagactctatgcctggctgctcggatttgataataacggcgccatcatcggccccaggtccacccgccacagcaacccagaggagcacgcaacctactattttaccaccttctcaaaagaactcttagtgcaggcaatggtagggattctgcaggtgaacggatttggcgaggaaaacactctgatgcaagaccttaagccattcagaattctcatcagcttactcgataagccagaactcggccccgtgatcctggaggatgttctcatcgaagtattcaggactctgtactcccaatgtaaggcagaactggatttgcagaccgagccacccttttcaaaggatcatgcccagctaagcagcaaactcagagaaaacaaaaaaaccgcagaattaataaagactgcaaatttgttattcaatagcttcgaaccgtactatatgtgggactatgtcgcgcggtggttcgaagagtgctgccgtcgcaccttacatgttcgcctccagatcgggccaggtgatagtaatgactcttccgaactgcagctcacaaatttttgcctcttggtagactttctgctggacatcgtaagccttcccacacgttcaatgcgtgtactgtgccaggaaacctacattgaaattcagacggagcacctgcctcagctactgctgcggatgattagcgctttgacatcccatctgcagaccctgcatcttagtgagctaactgatagtctacgcctatgctcaaagatactttccaaagtgcagcctccccttctgagcgcctcaacagggggagtgctccaatttccctcaggacaaaataatagcgtcaaggagtgggaggataaaaaagtctctagtgtgagtcacgagaatccaactgaggtgtttgaggatggggaaaacccgccgtcctctagatcgagtgaatccggattcacagaatttattcaataccaggcagataggaccgacgacattgacagagagctcagcgaggggcagggagccgctgccatcccaattgggtctaccagtagtgagacagagaccgcctccaccgttgggagcgaagagactatcatacagaccccaagtgttgtgactcagggcacagctacaaggagtcgcaaaaccgcccagaagactgccatgcaatgctgtctggagtacgtccagcaattcttgacgagactcataaacctgtacatcatacagaacaattcatttagtcaatctcttgcaactgagcaccagggtgatctgggccgcgaacagggggaaaccagtaagtgggacagaaacagtcaaggcgacgtgaaagaaaagaacatctcgaaacagaagacttcgaaggaatacctgtctgcgttcctcgctgcttgccagctgtttttagagtgtagttcctttccagtgtacatcgctgaagggaatcacacctctgagctgcgaagcgaaaagctggaaacagattgtgaacacgtgcagccgccccagtggctacagacactgatgaacgcatgttcacaagccagtgatttctccgttcaaagtgtcgcgatctccctggtcatggatctggtaggacttacacagtcggttgcaatggtaaccggcgaaaatataaattctgtcgagcccgcacaaccattgtctcccaaccaaggcagagtcgccgttgtgataagaccaccgctgacgcaggggaatctgaggtacattgctgaaaaaacagagttcttcaaacacgtggcactcacactctgggaccagctgggcgacggaaccccccagcaccaccagaagagtgttgagctgttctatcagttacacaatctcgtgccctcgtcttccatatgtgaggacgtgatctcacagcagctgacacataaagacaaaaaaatcaggatggaggcccacgcaaaatttgccgtgctctggcatcttactagggatctacatatcaacaagagctctagctttgtgcggtcgttcgaccggtcgcttttcattatgctggattccttgaactctcttgatggaagtaccagttctgtgggccaagcctggctgaaccaggtgttacagcgccacgacattgcacgggtgctggagcccctgttactacttttgttgcaccccaaaacacagagagtatcggttcagcgggtgcaggcggaacggtactggaacaagagtccttgctaccctggtgaagaatccgataaacactttatgcagaacttcgcttgctctaacgtgtctcaagtgcagttgatcacaagtaagggcaacggagaaaagcccctgaccatggatgagattgaaaacttctctttaaccgtgaaccccctgagcgacaggctctctttactctctacatcaagcgagaccatccccatggtcgtgtcagacttcgatctccccgaccaacagatcgagatactgcagagcagcgacagtggctgttcacagagtagcgcaggcgacaacctatcatatgaggttgatcccgagactgtgaatgctcaggaggacagccaaatgccaaaggaaagctcacctgatgatgacgtgcagcaggtggtgtttgatctcatttgcaaagtcgtgtcagggctggaggtagagtccgccagcgtcacatctcagttagagatcgaagcgatgccaccaaaatgctcggacattgatccggacgaggaaaccattaagattgaagacgactccatacagcagtcacagaatgctctattatcaaatgaaagcagccagttcttatccgttagtgccgagggaggacacgagtgcgttgccaacggcatatctaggaactctagttccccgtgcatttctggaacgactcatactctgcacgacagctcagtggcctccatcgagacaaagagccgtcagagaagccattcctctattcaatttagttttaaagaaaaattgtcagaaaaggtctccgagaaagagacgatagtgaaggagtccggcaagcagccgggggccaaacctaaggtcaagctcgcccgaaagaaagacgacgacaagaagaaaagcagcaatgaaaagctgaaacagacgagtgtgtttttctccgatgggcttgacttagagaactggtacagctgcggggagggtgacataagcgagatagagagtgacatgggatctcccggcagcagaaagagcccaaactttaacattcacccactgtatcagcatgtgttactgtacctccagttgtacgacagctcccgcaccctgtacgccttcagcgccatcaaagccatcctcaagacaaatcccattgctttcgtgaatgcaatctccaccacctcagtgaataatgcctacactccgcagttgagtctgttgcaaaacctgctggctcggcatcggatttccgtgatgggtaaggatttctactcccacattccggttgactccaatcacaactttaggtcgtccatgtatatcgaaatcttgattagcctgtgcttatattacatgcgctcccattatcccactcacgtgaaggtgactgcccaggacttgatcggcaaccggaatatgcagatgatgtcgatcgagattctcactcttttatttactgagttggccaaggtgatcgagagtagtgccaaaggcttcccgagcttcatcagcgatatgctgtccaagtgcaaagttcaaaaggtcatcttgcactgtctgctgagctcgatattcagcgctcagaagtggcacagcgaaaagatggcaggcaagaatttggttgcggtcgaagaagggtttagcgaagattctttaattaacttctccgaggacgagtttgacaacggatccaccctgcagtcccagcttctaaaggtcctgcagaggcttatcgtgctggagcaccgggtcatgacaattccggaggagaatgagactgggtttgacttcgtcgtatcagacctagagcatatttcacctcatcagccaatgacgagcctccagtacctccacgcacagccaatcacctgccaagggatgtttctctgtgcggtgatacgggcgttacaccagcactgcgcctgcaagatgcacccccaatggatcggactaatcaccagtacacttccatacatggggaaggtcctgcagcgggtggttgtgtctgtcactctgcagctgtgcaggaatctggataacttaatccagcagtataagtatgagacagggctgtctgattctcgtccgttatggatggcatccatcatcccccccgacatgattctaaccctacttgaaggaatcactgctattatccattattgcctgctcgatcctacgacccagtatcatcagctgctggtatctgtggatcagaagcacctgtttgaagcacgatcaggtatcctgtcaatcttacatatgatcatgtcttccgtgactttgttgtggtctatccttcaccaagccgattcttcagaaaaaatgaccatagctgcatcagcatctctgaccacaatcaatctaggcgctacgaagaacctgaggcagcagattctggagttactgggccccatcagcatgaatcatggcgtacacttcatggcggcgatcgccttcgtttggaacgaaaggcgccagaacaaaacaacaacaaggaccaaggttatacctgccgcatccgaggagcaacttctgcttgtggaactggtccgtagcatctctgtcatgcgcgcagagaccgtgatccagaccgttaaagaggtgttgaagcagcctccagctattgcaaaggacaaaaaacatctaagcttggaggtttgtatgctccaattcttttacgcgtatatccaacggatacctgtgccaaaccttgttgactcgtgggctagcttgctgattctcctcaaggatagtattcagctttccttacctgctccaggtcagtttctgattcttggcgtgcttaatgagttcattatgaaaaatccttccctcgaaaacaagaaagaccagcgggatctgcaagacgtgacccataaaattgttgatgctattggtgctatagcaggtagttccctggagcagactacgtggcttcgccgcaatctcgaagtaaagccctccccaaagattatggttgacggcactaatttggagagcgatgttgaggatatgttaagccctgccatggaaaccgccaatatcactccctccgtgtacagcgttcacgcactcaccctgctgagtgaggtcctggcccacctgctggacatggtattttattctgacgagaaggagcgagttatacctcttctcgtgaacattatgcattacgtggtaccttacttgaggaaccattcagctcataacgctccatcgtatcgggcctgtgttcagttgctgtctagcctgagcggataccagtatactcgccgggcctggaaaaaggaggcttttgatctgttcatggatccaagcttctttcaaatggacgcttcatgtgtgaatcattggagggcaatcatggataatctcatgacgcacgacaagaccacattcagagatctgatgaccagggtcgccgtggcacagtcttcctcactcaatctttttgccaatagagacgtggagctggaacagagggccatgcttctgaagaggctcgcctttgctatcttcagctccgagatcgaccagtaccagaagtacctcccagatatccaggagagactcgtggagagccttagactcccacaggttcccaccttacattcccaggtcttcttgttcttccgggtcttgctgctgcggatgagtccccagcatctgacctcactctggccaacaatgattacagaacttgtgcaggtgttcctcctgatggagcaagaattaaccgccgatgaagatatcagtcgcacatctggcccctccgtggccgggctggaaaccacatacaccggaggtaatggcttctcaacctcttacaacagccagaggtggcttaacctctatctgagcgcatgcaagtttctcgatctggcgttggcccttcccagtgagaatctgccgcaattccagatgtacaggtgggcgtttatccccgaggcctctgacgactccgggctggaggtccgcagacagggtattcatcagagggaattcaaaccctatgtcgttcggctcgcaaagctactgaggaagagggcgaaaaagaacccagaggaagataactccggaaggaccctggggtgggagcctgggcacctacttttgaccatttgtaccgtccgctccatggagcagctgctccccttcttcaacgtgctctcacaggtgtttaatagcaaggtgacctcgagatgtggaggacacagcggttcacccattttgtactccaatgcattcccaaataaggatatgaaacttgagaaccacaaaccttgcagctcgaaagctcgacaaaaaatagaagagatggtcgaaaaggacttcttagagggtatgatcaaaacatag

SEQ ID NO: 41943 - DNA, 7110 bp, Artificial Sequence
  Description of Artificial Sequence: Synthetic coding sequence
atgaacaccgaggagctggagctgctgagcgacagcaagtaccggaactacgtcgcagccatcgataaagctctcaagaatttcgaatactcaagtgaatgggccgacctgatatccgccctcggcaagctgaacaaggtattgcagaataatgccaaataccaggtggtacctaaaaagctgactataggaaaacgcttagcccagtgcctacatcctgccctaccaggaggagtgcacaggaaggccttggagacctacgagatcattttcaaaattatcggacccaaaaggctggctaaagacttgtttctgtattcgtcgggcttgttccccttgctggccaatgccgctatgtccgtcaaaccgaccctactttccctgtacgagatttactacctccccctcggaaaaactctgaagccaggattgcaggggctcctgaccggcattctcccgggtctggaagaaggcagtgaatactacgagagaaccaacatgcttctcgagaaggtggcagcagccgtggatcagtccgctttctactccgcgctgtggggctccctcctcacaagtccagctgtcaggctccctggcataacctacgtgctagcccatctgaataggaagctgagcatggaagatcaattgtatattataggttccgacatcgagctcatggtggaagcagtgtctaccagcgtgcaggacagtagcgtcttggtgcaaagaagtactctggacctgatactgttctgcttcccttttcatatgtcacaagctacaagacctgacatgatccggatactcagcgctgccctccacgtagtactccggcgagacatgtccctgaacaggcggctgtacgcatggctcttgggacctagatccactagacatagcaaccccgaggagcatgccacctattactttacaacattcagcaaggagctgctggtccaggcaatggtcggcatccttcaggtgaatggcttcggggaggaaaatacgctgatgcaggacctgaagcctttccgcattctgatcagtctgttggataaacctgaattgggaccagtgattttagaagacgtacttatcgaagtcttcaggaccctctacagccagtgcaaagcagagttggatctgcagacagaaccccccttttcgaaggatcatgctcagctgagttccaagctgagggaaaacaaaaagacagcagagctgataaagaccgcaaatctgctgtttaacagctttgaaccatattacatgtgggattatgtggcaaggtggttcgaagaatgttgtcgcaggaccttgcacgtgagactgcaaattggcccaggtgattccaacgactcttcagaattacagctaacgaacttttgtctgttagtcgatttcctcctcgacattgtttccctggagacctatatcgagattcagaccgagcatttgcctcagctgctgctccggatgattagcgcattgacctcccacctgcaaaccttacatttaagcgaactaacggacagcctgcggctatgttcaaagatcttatcaaaggtgcagcccccactcctatcagcttcaaccggcggggtgctccagtttccttccgggcagaacaactcagtgaaggagtgggaagataaaaaagtgtctagcgtctctcacgaaaatcctacagaggtttttgaggatggcgaaaacccaccttcatcacgctcttccgaatccggatttactgagttcatccagtaccaggcagatcgtactgacgacattgaccgggaattatccgagggacagggcgcagctgccatccccattggatccacttcatccgagactgagacagcatctactgtcggctctgaggagactattatccagactccttccgtggtgactcaggggaccgcaaccaggtctagaaaaacagctcagaagaccgctatgcagtgttgcctcgagtatgtgcagcagttcctcacacgtctgattaacctttatatcatacagaacaactcattttcacagtcactggcgaccgagcaccagggggacctcggcagggagcaaggagagacgtccaaatgggaccgaaactcccagggggatgttaaagaaaagaacatctcaaagcagaagactagtaaggagtacctttcggcttttcttgccgcctgccagctattcttggaatgtagtagtttccccgtctatatagcagaagggaatcacacctccgagttaaggagtgaaaagttagaaaccgactgtgaacacgttcaaccaccccagtggctgcagacactgatgaacgcgtgctctcaggcctcagacttcagcgtgcagtctgtggctatttctctggtcatggatcttgtgggtttaacccagtccgtcgccatggtgactggggaaaatataaactctgtggaaccagcacaacccctgagccctaatcaggggcgggtggccgtggttatacgacctcccctgacccaaggaaacctaaggtacatcgctgagaagacagagttctttaagcacgtggcccttaccctatgggaccagctcggtgatggaacaccacaacaccaccagaaaagtgtcgaactgttttaccagctccacaacttagtgccctctagttccatctgtgaagacgtgatcagtcagcaattaacccacaaagacaaaaaaatacgtatggaggctcacgcaaaatttgcagttctgtggcatctgacacgcgatctgcatatcaacaagtcttcctcattcgtccgatcctttgaccggtccctgttcatcatgctggattcccttaattccctggacggctctacttcatccgtgggacaggcatggcttaaccaggtcctgcagcgccacgacatcgcaagagtgctggaacctctcctcctattgctactgcacccaaaaacccagcgggtgtccgtccaaagagtccaggccgagaggtattggaacaagtcaccttgctaccccggcgaggagagcgacaaacactttatgcagaatttcgcctgctctaatgtcagtcaggtacagcttatcacgtcaaaagggaatggagaaaagcctctcaccatggacgagatagaaaactttagtctcactgtgaatcccctttccgatcggctttccttgctgagcacatcaagcgaaaccattcctatggtagttagtgacttcgatttgcccgatcagcaaatcgaaattctccagtccagtgacagcggctgcagccaatcctctgccggtgacaacctgagttacgaagtggaccctgagaccgtgaatgcacaggaggattcccaaatgccaaaggagtccagtcctgacgatgacgttcaacaagtcgtgtttgacctgatttgtaaggtcgtatccgggctggaggttgaatctgcgagcgtcactagccagctagagatagaggctatgccccccaagtgctcagacatcgaccctgatgaagagacaatcaaaatcgaggacgatagtatccagcagagtcaaaacgctttgttatcaaacgaatcatcccagttcctgtcagtcagcgccgaaggggggcacgaatgtgtggccaacggcatctctaggaacagctcaagcccttgtattagtggcacaacccataccctacatgattcctccgttgcatcgatcgagactaaatcacgtcagaggagccactcctctattcagttctctttcaaggaaaaactgtcagagaaagtgtcggaaaaagaaaccattgtaaaagaatcgggaaaacagcctggagcaaaacccaaagttaaacttgcaagaaagaaggatgacgacaaaaaaaaaagttcaaatgaaaagctgaaacaaacatccgtctttttctctgatggacttgacctggagaactggtattcttgcggagagggggatatttccgagattgaatctgatatgggcagcccgggctcccgtaagtcccccaatttcaacatccacccgctataccagcacgttctgctgtaccttcagctctatgactcttcccgcacactgtatgccttcagcgctattaaagctatcctgaaaacgaaccctattgcgtttgtgaatgcaatctcaaccacgtctgtcaacaatgcttacacccctcagctgtccctcctgcagaatctgcttgcccgccacaggattagcgtgatgggaaaggatttctatagccatatcccagtagactcgaaccacaatttcagaagttcaatgtatattgagattttgatcagtctctgcctttattatatgaggagccactaccctacgcacgtcaaggtgactgcgcaggaccttatcgggaataggaacatgcagatgatgtccattgagatattgactctacttttcacagagcttgcaaaggtcatcgagtcgagcgcgaagggctttccatcctttatttcagatatgctttccaaatgtaaagtgcaaaaggtcatcctccattgcctactgtcctccatcttttctgcccaaaaatggcacagtgaaaagatggcgggaaaaaacttggttgctgtggaagagggcttttcagaggactcccttatcaattttagtgaggacgagttcgacaacggttccacactgcagtcacagctcctaaaggttttacaacgactcattgttctggagcaccgggtaatgacaatcccagaggagaacgagacgggttttgacttcgtggtgtcggatttggagcacatctccccacaccagccgatgacatctctccagtacctccacgctcagccgattacttgtcaaggaatgtttctctgcgccgtgatccgggccctccaccagcattgcgcatgcaaaatgcacccacagtggatagggctcatcacctccaccctgccttatatgggtaaggttcttcaacgtgtggtggtgagcgttactttgcagctgtgtcggaatctggacaacttgattcagcaatacaaatatgaaaccggcctctcggactctcgacccctatggatggcttctattattccgcccgacatgatcctgacattgctcgaaggcatcaccgcaatcatccattattgtctcctggaccccactacccagtatcatcagctcctcgtctcagtagaccaaaaacacctatttgaggcacggtctggcatcctgagtatcttacatatgattatgtcctcagtgacactactgtggagcatcctgcaccaggctgattcttctgagaagatgacaattgctgcctctgcaagcctcactacgattaatttgggggcaacgaagaacttgaggcagcagatactggagcttctgggacctatctctatgaatcacggagtacattttatggcagcaatcgcgtttgtatggaatgaacggaggcagaacaagacgaccacaagaacgaaggtgattcccgctgccagcgaggagcagctgttactcgtggagctggtcagatcaatctctgtcatgcgcgcagagaccgtcatccagaccgttaaagaggttctaaaacagccaccagcaatcgcaaaagacaaaaagcacctgtccttagaggtgtgtatgcttcaattcttttacgcatacatccagagagtgctcaatgagttcataatgaaaaatccaagcctggaaaataagaaggaccaacgtgacttacaggacgtgacccacaagatcgttgacgcaatcggcgccatcgccggctcatcactggaacagactacatggctgcggagaaatcttgaggtgaaaccaagccccaagatcatggtagacggaacgaatctggagtctgatgtggaaggtatattggtgaaacatctaggactgttgtccgttcttgctcatctgctggatatggtgttttactctgatgaaaaagaacgggtgattccacttctcgtgaacataatgcattatgtagtgccttacttacggaaccactccgcccacaacgcgccatcttacagagcatgcgtgcagctcttgtcatccttgtccggataccagtacacgaggcgagcctggaaaaaggaagcctttgatcttttcatggatccgtccttctttcaaatggacgcatcatgtgtgaatcactggagggcaatcatggacaaccttatgacccatgacaagacaacttttcgggaccttatgacgcgtgttgctgtggcacagagctctagtctgaatctctttgccaatcgggatgtcgaattagaacagcgagccatgttgctgaagcggctcgctttcgctattttcagctctgaaatcgatcagtatcagaagtacctgcccgatatccaagggatccctgtcagtaagtgggttcagctactcaccgcgctttcccccgcctaccgcacgtccggcccatcagtcgcagggctcgaaacgacgtatactggtggaaacggatttagcacatcgtataatagtcagcgttggctaaacctgtacctatccgcctgtaaatttctggacctggcccttgcccttccctctgagaacctgccccaatttcaaatgtatagatgggccttcattccggaggcatcagacgacagcggactggaggtcaggcggcaaggaatccaccagagagagttcaagccatatgttgtgcgcttggccaaacttctgcgaaaacgtgcaaaggataaggaagaggatttcaagaccgtgatcctcgagggtttggagatggcaaaacaccagaaaaatccggaggaggataactcaggcaggaccctggggtgggagcctggtcatctgctgctcaccatctgcaccgtgagaagcatggagcaactacttcctttctttaatgtcctgagccaggtctttaatagcaaagtaacttcacgttgcgggggtcactccggatcccctatactctattcaaacgccttcccaaacaaagatatgaaattagagaaccacaaaccctgcagcagcaaggctaggcagaagatcgaggagatggttgaaaaggactttcttgaaggtatgataaaaacctag

SEQ ID NO: 41944 - DNA, 690 bp, Artificial Sequence
  Description of Artificial Sequence: Synthetic coding sequence
atgaacaccgaggagctggagctgctgagcgacagcaagtaccggaattatgtggccgcaatagataaggctctcaagaatttcgagtattccagtgagtgggctgatctcatctctgcactcgggaaattgaacaaagtcctccaaaataacgccaagtaccaggtggtgcctaagaagttaaccattggcaaaaggttggcccaatgtcttcaccctgccttaccaggaggcgtgcatcgaaaggccctcgaaacttacgagatcatcttcaaaatcattggcccaaaacgtttagccaaagatctgttcctgtatagctcaggcctcttccctctgcttgcaaacgccgcaatgagcgttaagcctactctactatcgctttatgaaatctattacctgcccctggggaagacacttaagccaggacttcaagggctgctgaccggaattctaccgggactggaagagggatcagagtattacgaaaggaccaacatgttgctggaaaaggtcgcagccgcagtggaccagagtgcattttactcagcactatggggctccctgctcacgtccccggcagtccgattgccggggataacatacgtcctggctcacctcaatcgcaaactcagtatggaggatcagctctacattatcgggtctgacattgagcttatgaagcagtag

SEQ ID NO: 41945 - DNA, 423 bp, Artificial Sequence
  Description of Artificial Sequence: Synthetic coding sequence
atgcagcggctgaacatcggctacgtgatcaacgtgaccacccacctccccctgtatcactatgagaaagggctcttcaattacaaacggctgcctgcgactgacagcaacaagcagaacctgagacagtactttgaagaagccttcgagttcattgaagaggcccaccagtgtggcaaaggtctgctcattcattgtcaggctggagtgtctagatcggcgacgatcgttatcgcctatctcatgaagcacactcgtatgaccatgaccgatgcttacaagtttgtcaagggcaagaggcctatcatcagccccaacctcaacttcatgggccagctcctggagtttgaggaagatctcaataacggtgtgacgcccagaatcttgactccaaaactaatgggtgtggagaccgtcgtttag

SEQ ID NO: 41946 - DNA, 1449 bp, Artificial Sequence
  Description of Artificial Sequence: Synthetic coding sequence
atgccccccagccccctggacgaccgggtggtggtggccctgagccggccagtgcgcccccaggatctgaatctatgcttggacagctcctatttgggttctgctaatccggggagcaattcccacccgccagtgatcgcaactactgtggtgagcctgaaggcggcaaatttaacctacatgccgagttcctccggcagcgcccgctcccttaactgtgggtgttcttcagcctcctgctgtactgtggccacctacgataaagataaccaagcacagacccaggccatcgctgctggtaccacaaccaccgccatcggaacatcaacgacatgtcccgccaatcagatggtgaataataacgaaaacacgggatcattgagcccttccagtggcgtgggcagccccgtctcgggaacacccaaacaacttgcaagcattaaaataatttatcccaacgacttagcaaaaaagatgacaaagtgtagtaagtcccacctgccatcacaagggcctgtgattatcgattgccgaccctttatggagtacaataaatctcacattcagggagccgttcatatcaactgcgctgacaagatctctcgcaggcgcctccagcaaggtaagataacagttcttgatttgatcagttgcagagaggggaaggattcttttaagcggattttcagcaaagaaattatcgtgtacgacgagaacactaacgagcccagcagggtgatgccgagtcagccgctgcacatcgtgctggagtcccttaaacgagagggcaaagaacccctcgtgcttaaaggcggcttgtcatcatttaagcagaatcacgagaacttgtgcgataactctctgcagctccaggagtgtcgagaagttggcggtggtgccagcgccgcttcaagtttgctgccacagcccatccctacaacgccggacatcgagaacgctgaacttacaccgattctgccattcctgtttttagggaacgaacaggacgcgcaggatcttgatactatgcaacggttaaacatcggctacgtgattaacgtgactacacacctgcctttgtatcattatgagaagggcctgttcaactataagcgactgcccgcaacagattcaaacaaacaaaacctgcggcaatatttcgaggaagcttttgaatttattgaagaagcccaccaatgcggtaaaggacttctgatccactgtcaggctggtgtcagtagatctgctaccattgttattgcctacctaatgaaacatacacgaatgacaatgacagatgcctacaagttcgtgaaaggaaaaaggcctataatcagccccaatctaaactttatgggccagctgctagagttcgaagaggatctgaataatggagtgaccccccgaattctgacccctaagttaatgggtgtggagacggtagtctag

SEQ ID NO: 41947 - DNA, 1284 bp, Artificial Sequence
  Description of Artificial Sequence: Synthetic coding sequence
atgccccccagccccctggacgaccgggtggtggtggccctgagcagaccagtcagacctcaagacttgaatctctgtttagattcgtcctacctgggtagcgcaaatcctggaagtaattctcaccctcccgtcattactacaactgcaattggcacctccactacttgtcctgccaaccaaatggtgaataacaacgagaacacaggatcactttccccctccagtggcgtgggaagccccgtttccggtacccctaagcaattagcctctattaaaatcatataccccaatgaccttgctaagaagatgactaagtgttcgaaaagccatttgccgagccagggaccagtcataattgattgcaggcctttcatggagtacaacaagagccatattcagggagccgtgcatattaactgtgctgataaaatctcgagaaggcgcctccaacaaggcaaaatcacggtcctggatctgataagttgcagagaaggaaaggactcatttaagaggatttttagtaaggagattatcgtctacgacgagaacacgaacgagccatcgagggtgatgcccagccagcctcttcacatcgtcctggaatccctcaaacgtgagggaaaagagcctctggtgctgaagggtgggcttagcagtttcaaacagaaccatgaaaatctgtgcgataatagtctgcaactccaggagtgtcgtgaagtgggtggaggagcatcagcggcgagctcgttgctgccccagcccatcccgactacgccagatattgaaaacgccgaacttacccctattctgccgttcctttttctggggaacgaacaggatgcacaagacctggatacaatgcaaagactgaatattggctacgtgattaacgtgaccacacacttgccactgtatcattatgagaaaggcctgtttaattataagcggctcccggctactgatagtaataagcagaacctcagacaatacttcgaggaggctttcgaatttattgaagaggcccaccagtgtggcaagggcttgcttatacactgccaggcaggcgtatccagatccgctacaattgttatcgcatacttgatgaaacacacccgaatgaccatgacagatgcttacaagttcgtcaagggcaagcgcccaataatctccccaaacctgaattttatgggacagctcctcgagttcgaagaagatttgaacaacggtgtgacacctagaattctgacccccaaactgatgggcgtggagactgtggtgtag

SEQ ID NO: 41948 - DNA, 423 bp, Artificial Sequence
  Description of Artificial Sequence: Synthetic coding sequence
atgcagcggctgaacatcggctacgtgatcaacgtgaccacccacttacccttgtaccactacgaaaagggcctgtttaattacaaacgactgccggcaacagatagcaacaaacagaacctcagacagtattttgaggaagcatttgagttcattgaagaggcgcatcagtgtggcaaggggctcctgatacactgccaggccggagtatctaggagcgccaccattgtgattgcctacctgatgaagcacacacggatgaccatgacagatgcatataaattcgtgaaggggaaaaggccaatcatttcccctaatttgaacttcatggggcagcttctggagttcgaagaggacctgaataatggagtgacccctcggattttgacgccaaaattgatgggtgtggagacagttgtgtag

SEQ ID NO: 41949 - DNA, 888 bp, Artificial Sequence
  Description of Artificial Sequence: Synthetic coding sequence
atgaccgagggcgtgctgcccggcctgtacctgggcaacttcatcgatgctaaagaccttgaccagttggggcgcaataagataacccatattatttccatccacgagtccccacagcctctgctgcaggacatcacctatctacggatcccagtggctgatacccccgaggttcccatcaaaaagcatttcaaggagtgcattaatttcatccattgctgcagactaaatggaggtaactgtctagtccattgctttgctgggataagtcgcagtacaacgatcgttaccgcttacgtcatgaccgtcaccggcctggggtggcgcgacgtgttggaggctatcaaggcaacccggccaattgcaaaccccaatccagggttcagacagcagctcgaagaatttggctgggcttcctctcagaagggcgcaaggcatcggacctcaaagacatccggggcccagtgcccaccaatgacctcagccacatgcctcctagctgccagggtggccctgctgtctgccgccttggtccgagaagctacaggacgtacagcacagagatgccgtttaagccctcgcgctgcagcagagagactgctcggtccaccaccacacgtggcagccggttggtctcctgacccaaaataccagatatgcctttgctttggggaggaggacccaggacccacacagcaccccaaggaacagctcataatggctgatgttcaggttcagctgcgacccgggtccagctcgtgcaccctcagtgctagcaccgaaaggcccgacggctcttccactcctggaaaccctgacggcattacacacctgcaatgtagctgcttacaccctaagcgcgccgcgagcagctcctgtacacggtag

SEQ ID NO: 41950 - DNA, 708 bp, Artificial Sequence
  Description of Artificial Sequence: Synthetic coding sequence
atgggcaacggcatgaccaaggtgctgcccggcctgtacctgggcaattttatagatgctaaggatttggatcagctaggcaggaacaagattactcacatcataagtatccacgaatcacctcaacctctcctccaagatatcacgtatctgaggatcccggtagccgacacaccggaggtgccaataaagaagcacttcaaggaatgcataaacttcattcactgctgtaggctgaatggtgggaattgtctcgtccactgcttcgcgggcatctcccggagcaccacaatcgtgacggcttacgttatgaccgtcaccggattggggtggagagatgtgttggaagccatcaaagcaactcgcccaatcgccaaccctaatccgggttttcggcagcagttagaggagttcggatgggctagtagtcagaaattgcggcggcagttggaagaacgctttggtgagtctccctttagggacgaagaggaattacgggcactgcttcccctttgtaagaggtgcagacagggaagtgccacatccgcaagttctgcagggccccatagcgctgcttcggaaggaacggtgcagcgtctggtccccagaaccccccgcgaggcccaccgtcccctccccttgctggcacgggtaaaacaaacattcagttgtctgcccagatgtttatctagaaaaggtggcaagtag

SEQ ID NO: 41951 - DNA, 264 bp, Artificial Sequence
  Description of Artificial Sequence: Synthetic coding sequence
atgggcaacggcatgaccaagatgcccaagacctggatcagctgggctgagattagatcccacacatctagcctgagcatgtcccacccgtctctgtgttgtagaatctcgccgacgtttgcctctagaagcttaattcctttgcgctaccctagtaagtctacgagtaagaatgtgagcactagcagtacagcagccgctctgatggggggaacagctttgtgcacagccttacaggcaagtttggctgccccccggctgtag

SEQ ID NO: 41952 - DNA, 699 bp, Artificial Sequence
  Description of Artificial Sequence: Synthetic coding sequence
atgaccgagggcgtgctgcccggcctgtacctgggcaacttcatcgatgcaaaggatttggatcagctggggcgtaataagatcacccatattattagtattcacgaaagcccgcagcccctcctacaggatatcacataccttcgcatcccggtggctgacacaccggaagttcctattaagaagcacttcaaggaatgtatcaactttatccactgttgccggctgaatggcggaaactgcctcgtgcactgcttcgcagggatctctagaagcacgactatcgtgaccgcctatgtcatgaccgtcactggcctgggctggcgtgatgttttggaggctatcaaggcaacgagacctatcgccaaccccaatcccggcttccgtcaacagctggaggagttcggttgggcttctagccaaaaattacggaggcagcttgaggagagattcggtgagagcccatttcgagacgaagaagagctccgcgcattactgcccttatgcaaacgctgtagacaaggatctgcaacgtcggcctcctccgctggaccgcatagcgcggcttcggaagggacagtgcagcgcttggtgccgaggactccacgggaggctcacaggccacttccccttcttgcgagagtgaagcagaccttcagctgtctgccaagatgcctctcacgaaaggggggcaagtag

SEQ ID NO: 41953 - DNA, 399 bp, Artificial Sequence
  Description of Artificial Sequence: Synthetic coding sequence
atgaccgtgaccggcctgggctggcgggacgtgctggaggccatcaaagcaacaagacctattgccaaccctaatccaggtttccggcagcagcttgaagagtttggctgggcaagttcacagaagttgaggcgacaactcgaggagagatttggcgagtcccccttcagagacgaagaggaattacgggcactattacccttgtgcaagaggtgtaggcaaggttcggccaccagcgcttcttcagcaggtccccattcggccgccagcgaggggacagtgcagcgactcgtgccacgcacccctcgggaggcacacagacccctgcccctgttagctagagtgaagcagacattcagctgtctccctcggtgcctttcacgcaagggaggcaagtag

SEQ ID NO: 41954 - DNA, 399 bp, Artificial Sequence
  Description of Artificial Sequence: Synthetic coding sequence
atgaccgtgaccggcctgggctggcgggacgtgctggaggccatcaaagcaacgcgccctattgcaaaccctaatcctggatttcgacagcaattggaagagttcggttgggcaagcagccagaagttgcggcggcagctcgaagaaagattcggcgaatccccattcagggacgaagaggaattgagagccctcctccccttgtgtaagcggtgcagacagggctcagcgacaagcgcctcttctgccggtccacatagtgcagcttcagagggtaccgtccagaggctggtgccccgcacccctcgggaggcccacaggccgcttcccttactcgcccgggtcaaacagacctttagctgccttccacggtgtttgtccagaaagggagggaagtag

SEQ ID NO: 41955 - DNA, 282 bp, Artificial Sequence
  Description of Artificial Sequence: Synthetic coding sequence
tgaacccggctgccccccggcggctggagccccgaccccaagtaccagatctgtctgtgcttcggcgaggaggacccaggtccaacccaacatcctaaagagcagctcatcatggcagatgtgcaggtgcagctccggccaggcagttcatcatgtacactgtctgcgtcgaccgagaggcccgacggaagctcaaccccaggcaacccagacgggattacccacctgcaatgctcttgtctgcacccaaagagggccgccagctcgtcgtgcacacgctag

SEQ ID NO: 41956 - DNA, 399 bp, Artificial Sequence
  Description of Artificial Sequence: Synthetic coding sequence
atgaccgtgaccggcctgggctggcgggacgtgctggaggccatcaaggccacacgcccaattgcaaatccaaacccgggatttcggcagcagctggaggagtttggatgggcctcctcacagaagttacggcggcagctggaggaacggttcggtgagtcccccttccgcgacgaggaggagttgagagccctgctgcctctctgtaagcgctgtagacagggaagtgctacatccgccagcagcgcaggtccacattccgcagcaagtgaggggacagttcaaaggctcgtgccgagaactccaagggaggctcatagacccctccccttgctggcccgagtcaaacagaccttttcctgcctgccgcgctgcctgtctcggaaaggcggcaagtag

SEQ ID NO: 41957 - DNA, 2514 bp, Artificial Sequence
  Description of Artificial Sequence: Synthetic coding sequence
atggccaaggccgccgccagcagcagcctggaggacctggacctgagcggggaggaagtgcagaggctcacatctgcattccaggatccagagtttcgtagaatgttttcacagtatgcagaggaattgaccgatcctgaaaacagaagacgctacgaagccgaaataacggcactggagcgtgagcgcggagtggaggtccgattcgtgcacccggagccggggcacgtgctgcgaacgtcgctcgacggagctcggagatgtttcgtgaatgtgtgttctaatgctctcgtgggtgcgccgagcagccgccccggttcagggggggatagaggcgcggctccagggagtcactggtctctcccgtacagcctggcccctggaagagagtatgcgggacgcagttcctcacgttacatggtttatgatgtagttttccatcccgacgccctggccctggcccggagacacgaagggttccggcagatgctggacgcgaccgcgctcgaagcagtcgaaaaacagttcggtgtcaagctcgatcggcgcaatgcaaagaccctgaaagctaaatacaagggaaccccagaagccgccgtgctgcgcaccccactgcctggggttattccagcacgccccgatggcgagccaaagggtccactaccggacttcccgtacccatatcagtatcctgcagcgcctggacctcgcgctccttcgccacctgaggctgccttgcagccggccccaaccgaaccacgttactccgtggtgcaacgtcaccacgtcgacctccaagactatcgatgttctcgtgactcagccccatcgcccgttccccacgaactcgtgattaccattgagttgccgctgctgcgcagtgctgaacaggccgctctggaagtgactagaaaactgctttgtctggattcccgcaaacccgattacagattgcgcttgtcccttccctatccggtggatgacggtcgtggcaaggcgcaattcaataaggcacgacgtcagttggtcgtcacactgcccgtcgtgctgccagcagcccgacgggagcccgccgttgcagtggccgctgcggcgcccgaagaaagcgctgaccgcagcgggaccgatggccaggcttgcgccagcgcccgtgaaggtgaggcaggacccgctagatctcgcgccgaggacggggggcacgatacctgcgtcgcaggcgccgctggatcaggcgtgactactctaggagatccggaggtcgctcccccacctgctgcggccggggaagagcgcgtccccaaacctggtgagcaggacctaagccgacacgcagggtccccccctggcagcgttgaggagccaagtcctggcggcgaaaactctcccggcggcggtggctcaccatgcctgtcttctaggagcctggcctggggaagctcagctggacgggaatcagcaaggggcgacagttcggtggaaacgagagaagaatccgagggtaccggcgggcagaggtccgcctgtgctatgggaggcccaggcactaagagcggcgagccgttgtgcccccccctcctctgtaatcaggataaggaaaccctaaccctgttgatccaggttcctagaattcagccccagtctctccagggtgacctgaaccctctctggtacaagctccgcttcagcgcccaggacctggtatactcattttttttacagtttgctcctgaaaacaagctcagtactacggaaccagtcatttccatcagttctaataatgccgtgattgagcttgccaagtctcccgaatctcacgggcattggagagaatggtactatggagtgaataatgatagcctcgaagaacgcctcttcgtaaatgaggaaaacgtgaacgaattcctggaagaggtcctttcaagcccattcaaacaatccatgagtctgactccgccccttatcgaagtgttacaggtcaccgataacaagatccagataaatgccaaactgcaggagtgcagcaattcggaccagttgcaaggtaaggaagaacgagttaatgaggaaagtcacctgacggagaaggagtacatagagcactgcaacactccaacaacagatagtgattcttccatcgcagtgaaagcactgcagattgattcctttggcctcgtaacctgctttcagcaggaatcactcgacgtgtctcaaatgattttaggaaagtcacagcagccagagagtaagatgcagtccgagttcataaaggagaagtctgctacctgcagcaatgaggaaaaagataacttgaacgagtctgtgatcactgaagagaaggagactgatggcgaccatctgagctcactgctaaataagaccaccgttcataacatccctggtttcgattcaatcaaagagactaatatgcaggacggatccgtgcaggtgatcaaagatcatgtgactaactgtgccttttcattccagaattcactgctctacgacctagattag

SEQ ID NO: 41958 - DNA, 2370 bp, Artificial Sequence
  Description of Artificial Sequence: Synthetic coding sequence
atggccaaggccgccgccagcagcagcctggaggacctggacctgtctggcgaagaagtgcagcggttgacctccgcctttcaagaccccgagtttcggaggatgttttctcagtatgcagaagaattgacagatccagaaaatagaagaaggtacgaggcagaaattacagctctagagagagagcgcggcgtggaagttcggttcgttcacccagagccaggacatgttctcagaacaagccttgatggagcccggcgttgtttcgttaacgtatgctcaaacgccctcgtaggcgcaccatccagtagacccggctctgggggggaccgcggggccgcacccggctcacactggagtcttccatacagcctggcgcccgggcgggaatacgcaggcaggtcgagcagcaggtacatggtttacgatgttgtctttcatcctgatgcacttgcactcgcgcgccggcacgagggtttccgtcagatgctagatgcaaccgcactcgaggcagtggagaaacagtttggagtaaagttagatagacgaaacgctaagaccctgaaggctaagtataaaggcacccccgaagccgccgtgcttcggacacctttacctggtgtaatccccgcccggcctgacggcgaaccgaaaggccccctccccgacttcccttacccctatcagtaccccgccgcacctgggccccgagcccccagtcctccggaagctgcactgcagcccgctcctacagaacctcgatatagtgtagtgcaacgacaccacgtcgatctccaggactatcggtgttctagggattctgcaccatcacctgtgccccacgagctcgtcatcacaatcgaattgcctcttctcaggtctgctgagcaggccgcgctcgaagtcaccagaaagttactgtgtttggactcaaggaaacctgattacaggctgcgcctgtcattgccctacccagtggatgatggaaggggtaaggcacagttcaacaaggcgaggaggcaacttgtcgtcactcttcccgtggtactgcccgcagccaggcgggagccggcggtcgccgtagcggccgccgctcccgaagaatccgcagacaggagcgggactgacggtcaggcctgtgcaagtgcaagagagggcgaggccggtcccgcaagaagcagggccgaagatgggggccacgacacatgcgttgccggcgcggccggatcaggcgtcactacccttggcgatcctgaggtagcccctccaccggcagccgcgggagaagaacgtgtgccaaagccgggcgagcaggatctttccaggcatgcgggcagtccacctggttcagtggaagagccctctcccgggggagagaactctcccggcggaggcggctccccttgcttatcctctcgaagcctggcatggggatcttctgccgggcgagagtcagccaggggagattcctcggtggagacgagagaggaaagtgaaggaaccgggggacaaaggtctgcttgtgccatgggtgggcctgggactaagtcaggggagccattgtgccctccgctgctttgcaaccaggacaaagagaccctgactctgttaattcaggtgccacgcatccagccgcagtcgctgcagggtgatctgaaccccctttggtataaactccgtttttccgcgcaggatcttgtttacagcttcttcctgcagttcgctcctgagaacaaattatctaccacagagcccgtgattagcatatcttcaaacaacgcggtgatagagctagccaagagccccgagtctcacgggcattggcgagagtggtactacggagtcaataacgatagtctggagttgcaggagtgttctaattcagatcagctgcaaggcaaggaagagcgagtaaatgaggagagtcatctgaccgagaaggagtatattgaacactgcaacaccccgaccaccgattctgattcctcaattgcagtcaaggcactccagattgattcatttggattagtgacctgttttcagcaagagtctctggatgtcagccaaatgatccttggaaaatctcaacagccagaaagtaagatgcagagcgagttcatcaaggaaaagagcgccacgtgttccaacgaggagaaggataatctaaacgaatccgtgatcacggaagaaaaagaaactgatggggaccatctctctagcctgctcaataagaccactgtgcataatatccctggtttcgactccattaaggaaaccaatatgcaggatggttcggtccaggtcatcaaagaccatgtgacaaactgcgcgttctcattccaaaactcgcttctttacgacttagattag

SEQ ID NO: 41959 - DNA, 2154 bp, Artificial Sequence
  Description of Artificial Sequence: Synthetic coding sequence
atgagccggcggagccagcggctgacccggtacagccagggcgacgacgatggatcctcttcaagcgggggttcttcagtcgcaggaagccagtctacactcttcaaagatagccctcttcgtacgctgaaacgtaagagttcaaatatgaagcgcttatcacctgctcctcagcttggccctagctccgatgcccatacctcctactattccgaatccctggtgcatgaatcatggtttcccccaagatcctctctcgaggagttgcacggcgatgctaactggggggaggacctccgggtgcgcaggcgacggggcaccggtggctccgagtctagtagagcaagtggcctcgtagggcgtaaagctacagaagactttcttgggagcagttctggttattccagcgaagatgattacgtggggtattcagatgtcgaccagcaatcttcttcttccagacttaggtctgccgtttcacgggccggcagtctgttgtggatggtagctactagccccggaagactgtttcgattactctactggtgggccggcaccacttggtatagactgacaactgcagcctctttactcgatgtctttgtgcttacacgcagattttctagtcttaagacgttcttatggttccttctccccttattgctgctaacgtgcctgacctacggtgcatggtatttttatccgtacggcctacagacattccacccagcccttgtgagctggtgggctgccaaagacagcagaaggcccgacgagggttgggaggcaagggactcctccccccactttcaggcagagcaacgtgtcatgagcagagttcactctttggaaaggcgattagaggccttggctgccgaattttcttctaattggcagaaggaggccatgcggttagagaggttagaattaagacagggcgcacccgggcaagggggtggtggcggcctgtctcacgaagacacgctggcgctcttggaaggtcttgtgagcagacgtgaggcggccctcaaagaagactttaggcgggaaacagctgcaaggatccaggaggaactctctgccttgcgggccgaacatcagcaggatagcgaagatctgttcaaaaagattgtccgagctagtcaggaatcagaggctcgaattcagcagctgaagagcgagtggcaatccatgactcaggagtcctttcaggaatcaagcgtcaaggaactgaggcgtctggaggatcagctggcaggcctgcagcaagagctagcggccctggcgctgaagcagagtagcgtcgccgaggaggtgggtttgctaccacaacagatacaagccgtgagagatgatgtggaaagtcagtttccagcatggataagtcagtttctcgcccggggaggggggggtcgggtgggtctgttacagcgagaggagatgcaagcgcagctccgcgaacttgagtctaaaatcctcacccacgtggcagaaatgcagggcaagtccgccagggaggccgcggcaagtcttagtctgaccttgcagaaggagggggttatcggtgttacagaagaacaagtccatcatattgttaaacaagcgctgcagaggtattccgaggacagaataggtttagcagactatgccctggaatccggaggagctagcgttatttccactcggtgctcggaaacttacgagaccaagaccgcactcctgagcttgttcggcatcccgctgtggtaccattctcagtccccgagggtcatccttcaacctgatgttcatccaggcaactgttgggcttttcaggggccccagggattcgccgtggtgcgactgagcgcacgaatcaggcccacagctgtgactttggagcatgtgcccaaagccctttccccaaactcaaccatctcctcagcacctaaggatttcgccatattcgggtttgatgaagacctgcaacaggaaggcaccttactgggaaagttcacctacgaccaagatggagagcctatccagacattccactttcaggcaccaactatggccacctaccaggtcgttgagctgagaattctcactaactggggtcatccggagtacacctgtatatatcggtttcgggtgcacggagagccagcccactag

SEQ ID NO: 41960 - DNA, 1572 bp, Artificial Sequence
  Description of Artificial Sequence: Synthetic coding sequence
atggccgccgtgggccgggtgggcagcttcggcagcagcccccccggtctgtcctccacctacacaggtgggcctctgggtaatgagatcgctagcgggaacggcggcgcggcggccggcgatgatgaggatggacaaaatctctggtcttgtatcctgtccgaggtttcgacaaggtcaaggtctaagttgccagccggcaaaaatgtgctgttgctcggtgaggatggagctggtaagaccagtctgatacggaaaattcaaggcatcgaggagtataagaagggtcgaggactagagtacctgtacctgaatgtccacgacgaggacagagatgaccaaacacgatgcaacgtatggatcttggatggggacttgtatcacaagggactgctgaagtttagcctggatgccgtgtctctgaaggatacactggtgatgcttgttgtagacatgtccaaaccgtggacggcccttgactctctgcagaagtgggcttctgtggttcgtgagcatgtcgataaactgaaaatccctccagaggagatgaagcagatggagcaaaagcttataagagatttccaggagtatgtggaacctggtgaggacttccccgccagccctcagcgcaggaataccgccagtcaggaggataaagacgattccgtggtcctgccgctaggtgccgacacccttacgcacaacctaggaatccctgttctggtggtgtgcactaagtgtgatgccatttctgtgctggaaaaggagcacgactacagagatgaacactttgacttcattcagagccacattcgcaaattttgcctccagtatggcgctgcgttgatttatacgagcgtgaaagaaaataagaacatagacctcgtttataagtacatcgtccaaaaactctacggctttccttacaagatccctgctgtggtggtggaaaaggatgccgttttcattccagccggatgggacaacgacaagaagatcggcattctccatgaaaacttccagacactgaaagcagaagataactttgaagatataatcacaaagcctccagtccgaaagttcgttcacgaaaaggagattatggcagaggacgaccaagtttttctgatgaaactgcaatctctgctcgcaaagcaacctcctacagctgcaggtagaccagttgatgccagcccaagggtgcccggcggatccccaagaaccccaaaccggtcagtcagttccaatgtggccagcgtgtccccaatcccggcaggaagcaagaagatagaccctaatatgaaagccggtgccacctccgaaggagtgctcgctaacttttttaactcgttgctgtccaagaaaaccggatcacccggcggacccggcgtaagcggcggatcgcccgctggaggcgcaggcgggggttcttctgggctacccccctcaactaaaaaaagcggccagaagccagtgctagatgtccacgctgaactagatcgaattaccagaaaacctgtcactgtgagccccacaactcccacatctcccactgagggagaagcttcctag

SEQ ID NO: 41961 - DNA, 351 bp, Artificial Sequence
  Description of Artificial Sequence: Synthetic coding sequence
atggaggagtaccaccggcactgcgacgaggtgggcttcaacgccgaggaggcacataacattgtgaaggagtgcgttgatggtgtgctggggggtgaggattataaccataacaacatcaaccaatggaccgcaagcatcgttgaacagtcgctgacacacttggttaagctcggtaaagcctacaaatacatagtgacttgcgcagttgttcagaaatcagcctacggctttcacaccgcctcctcctgcttttgggatacaacaagcgacggtacctgcacggttcgttgggaaaacaggacaatgaattgcatagtgaacgtgttcgccatagccatcgtcctgtag

SEQ ID NO: 41962 - DNA, 459 bp, Artificial Sequence
  Description of Artificial Sequence: Synthetic coding sequence
atggaggagtaccaccggcactgcgacgaggtgggcttcaacgccgaggaagcacacaacatcgttaaggagtgcgttgatggcgtgttggggggcgaggactacaatcacaacaatattaaccagtggaccgcttcaatagtggagcagtctctcacacaccttgtcaaactgggcaaggcatacaaatacattgtgacatgcgctgttgtgcaaaagagtgcttacggattccacacggccagtagctgcttctgggacacgacctcggatggcacttgcactgtgagatgggaaaatagaacgatgaattgtggagtgctgctctgcaggcccgggtggtctgccgttatgcagtttagactgactgcaaccagcgccagtcaggtgcaggtgatactgttgcctcagccgccagagtatcttgaactgcaggcccacgcaattacacctggatag

SEQ ID NO: 41963 - DNA, 369 bp, Artificial Sequence
  Description of Artificial Sequence: Synthetic coding sequence
atggcccggagcctgggcgtgctggtggccctgcccttccccctgccagtgggctttaacgcagaagaagcgcataatattgtcaaggaatgcgttgacggagtcctggggggcgaggactacaaccataataatattaatcagtggacggcaagtattgtcgagcagagcttaacgcacctggtgaaactaggcaaggcctacaagtatatcgtgacctgtgccgtggtgcaaaaatctgcttacggattccacaccgcttcttcttgcttctgggatactacatctgacggaacttgtaccgtacgctgggagaatagaaccatgaactgcatcgtgaacgtatttgccatcgccatcgtgctgtag

SEQ ID NO: 41964 - DNA, 1737 bp, Artificial Sequence
  Description of Artificial Sequence: Synthetic coding sequence
atggaccccgacaagcaggacgccctgaacagcatcgagaacagcatatatcgaactgccttcaaactgcaaagcgtccagactttgtgtcagttggatttgatcgatagttcactgatccaacaggttttgctaagacccagcttttgggaagcaaggaaacattcattatctgtacagcaactttcccaggcattgcaggaactctttcagaaagcaagggaggagaaccccgggcaggttcacccccgtgcgcccgagttaaccctttcattactcacaacgatgtataattcaaagggaacaggatttctccaattgatgcccgctgctgcagccctgatcacgctttctggcgactcgcccttgtcgaagtaccgggcacttttccagctatacgcggagaattctcgggggggctacgacagtggcccccgcatgacacgccgggtcctccggaaactgctgacagaccttcagcagattcccacttttgtaggggaatcacgcgctctttgtcccgtggagtcggctacacggtcttgcttccagggggtcctctctcctgccatcaaggaggaaaagtttctctcttgggtccagagtgagcctccaatattactctggctgcctacgtgccaccgcttatcagccgccgagagagtgacacatccagccaggtgtaccttgtgtcgtacattccctattacaggactcagatatcgatgcctgaagtgtctaaacttcgacatttgccaaatgtgttttctatccgggctgcactctaaaagtcaccagaagtcacatccagttattgagcactgtatccagatgtccgccatgcaaaacacaaaattgctgtttcgcaccctgagaaacaatttgttgcagggacggtgtcggaagaaagaggctgcgaggcgccagcaactccttgaccaggtgaacccaaaaggcgtcccccatcacgcccaggcccgtctgcttaagaaacagctgaatcagtataaggataagttacaggcaatctataccagccaggaagaaaggatttgccggtttgaaacccggatccataaacttaaaacaaatcaagactctttatggactaagcttcagcagattaggagggatctacaggcgcgactacagcctcccgggccatctagtagcagctttcagaacgtaggtaataaggtcgaccactcaagcacagagaaagtgccgaaaggcggcgattatctgcagattaagaacgcaacggaagacgccagtaccggagagcccttacctaagctggacgaggtagaccgatcacacaggtcacacaccaacgccgagcacgctctgcggaaccctgagtcaccagagaccactcttcactcaacccgggcacagagtcaaacacagaaaatgccgcagaaggtgataagcgccttgccttcgtaccaggagggcctaaagcaagacatacctaagatggtgccagccgaaatgtcaagcccagccctcgccgccgtggagaagaaggaggccgggaatatcaaggagaggaaggacgagcttgaggaggaggagctgcaggaactgctgtcgaagctgatggacgccttcaacctcgaaacaccctcagggccggaatccagcgtgaacatggacctgtatagtggcgctcagcgcgtctgccgcgccttctctgccttagtcgaccagattgcgctgccaaatctgaagtag

SEQ ID NO: 41965 - DNA, 858 bp, Artificial Sequence
  Description of Artificial Sequence: Synthetic coding sequence
atgaaccggctgcccgacgactacgacccctacgccgtggaggagccttctgatgaggagcctgctttaagcagctctgaagatgaggtggatgtactcctgcatggtacaccggaccagaaaaggaagctaattcgggagtgtcttactggagagagcgaaagctccagcgaggatgaattcgagaaagagatggaggcagaattgaactcgactatgaaaacaatggaggacaagctctcctctctagggaccggatctagctctgggaacgggaaggtcgctactgccccaacaaggtattacgatgatatttattttgatagcgattcagaggacgaagatagggccgtgcaggtgactaagaagaaaaaaaagaaacaacataagattcccactaacgatgagctcctctacgatcccgagaaggacaatcgagaccaggcatgggtggacgcacaacgtcgcggctatcatggactgggcccacaacggagtcgccaacagcaaccagttcccaacagcgacgccgtcctgaactgtccagcatgcatgacaactctctgtcttgactgccagcgacacgagagttacaaaacacagtatcgggcaatgtttgttatgaactgttctattaacaaggaggaagttctccgctataaagcatccgagaacagaaagaaacggagggtacataagaaaatgaggtctaatcgggaggatgctgccgagaaggctgagactgacgttgaagagatttatcatcccgtgatgtgcactgaatgttccaccgaggtggctgtttatgacaaggatgaggtgttccattttttcaacgtgctggcctcacactcttag

SEQ ID NO: 41966 - DNA, 4236 bp, Artificial Sequence
  Description of Artificial Sequence: Synthetic coding sequence
atgctgcggcggatcctgcagcggacccccggccgggtgggcagccaaggttcagatctggactcaagtgctacccctattaacaccgtggatgtgaataacgaaagcagcagcgaaggtttcatctgtccgcaatgcatgaagtcactgggctctgctgacgagttgtttaagcactatgaggcggtccatgacgcgggcaatgactcaggccacggaggggagtcaaatctggccttgaagcgcgacgacgtgactcttctgcgccaggaggtacaggatcttcaggctagtttgaaggaggaaaagtggtacagcgaagaactgaagaaggagctggagaaatatcagggccttcagcagcaggaggctaaacccgacggactagttaccgacagcagtgccgagctacaatcacttgaacaacaactcgaggaggcccagactgagaattttaacattaaacagatgaaagacttattcgagcaaaaggctgcccagctggcaacggagattgcagacattaaatctaagtatgatgaggaaaggtcactacgggaggccgcagaacagaaggttactcggctgaccgaggaactgaacaaagaggcaactgttattcaggacttgaaaaccgaactcctgcaacgtccaggcatcgaggacgttgcagttctcaaaaaggagctagtacaggtgcagactctcatggacaacatgactctagagcgggagcgggagtcagagaaactgaaagatgaatgtaagaagctccagagccagtacgcgagctcagaagctacaatcagtcagcttcgatcagagttagctaaagggccccaggaagtggcagtgtatgtgcaagagctgcaaaaacttaagtcttctgtgaacgagctgactcaaaaaaatcaaaccctgacggagaacctgttgaagaaagaacaggactacactaaactagaggagaaacacaacgaagaaagtgtgtccaagaaaaacatacaggctactctgcaccaaaaggatctggactgtcagcagcttcagtcccgtctgagtgcctcagaaacgtcattgcatcggatccatgtggagctctccgaaaagggcgaagccacccagaaactgaaggaagaactgtccgaggtggaaacaaagtaccagcatttgaaggcagaattcaaacagctgcagcagcagagagaggagaaagagcagcacggcctgcaactgcagagtgagatcaaccagttacactcgaagcttctcgaaacagaacggcagctgggtgaagctcacgggcggctgaaggagcagaggcagctgagttcggaaaagctgatggacaaggaacagcaggtggcagacctgcagcttaaactttcacgattagaagaacagctgaaagagaaggtcaccaattcaactgagttacagcatcaactcgacaaaactaaacaacagcaccaggagcagcaagcactccagcaatctactactgcgaagctgcgcgaagcccaaaatgacctggaacaggtcctccggcagatcggagacaaggatcagaaaatccaaaatctggaagcgctcctgcagaaatccaaggagaatatcagcttgcttgagaaggaacgagaggacctttatgcaaagattcaggccggtgaaggggagacagcggtgctgaaccaactccaagagaaaaatcacacactgcaggaacaggtgacccagctaactgaaaagcttaagaaccagtctgagtcccataagcaggcacaggagaatttgcacgaccaggtccaagagcaaaaggctcacttgcgggccgcgcaggatagagtgctttccttggaaacctccgtgaacgagctaaatagccaactgaacgagagcaaggagaaggtgtcgcagttggacattcagatcaaagccaagaccgagttgctgctgagcgccgaggccgccaagaccgctcaacgggccgacttgcaaaaccacctggacactgctcagaatgccctccaggataagcagcaggagttgaataagattactacacagcttgaccaagtaacagccaagctgcaggataagcaggagcattgctctcaattggagagtcacttgaaagagtacaaggagaaatatctgtccttggaacagaaaaccgaggaactggaaggtcagatcaaaaagctggaggctgactctttagaagtaaaggcttcaaaggaacaggctctgcaggatctgcagcaacagcgccaacttaacacagacctcgaactcagggcaaccgagttgagcaaacagctcgagatggagaaggaaatcgtatcaagtactcgactggacctgcagaagaaatctgaagcactggaatctataaaacagaaattaacaaaacaggaggaagagaaaaagattctgaaacaggatttcgaaacgctgtctcaggagaccaaaatccagcacgaagagctgaacaacagaatacagaccaccgtcacggagctccagaaagttaaaatggagaaggaggctctgatgacagagctgagtacagtcaaggacaaactcagtaaggtctcggacagtctgaaaaactccaaatccgagtttgaaaaagagaaccagaaggggaaagccgccattttggatctcgagaaaacctgtaaagagctgaagcatcaactgcaggtccaaatggagaataccctgaaagaacagaaagaactcaaaaagagcctggagaaggagaaggaagcctcgcatcagctcaagttagaactcaatagcatgcaagaacagctgatccaagcccagaacactctcaagcagaatgagaaggaggagcagcagctgcagggcaacattaatgaactgaaacaaagctccgagcagaaaaagaaacagatcgaagctttgcagggtgagctcaagattgcagtgctgcagaaaaccgaattggaaaataaattgcagcagcaattaacgcaggccgcacaagagctggctgcagagaaggagaagatcagcgttctccagaataattacgaaaagtcacaggagacctttaagcagctacagtctgacttctacggacgggagtcagaactcctggccacccgccaggacctgaagagcgtcgaagagaagctgtctcttgcccaagaagatctaattagcaaccgaaaccagatcgggaaccagaataagctcatccaggaactcaagactgcaaaggctacccttgaacaggatagcgccaagaaagagcaacaactgcaggagagatgtaaggctcttcaggacatccagaaagaaaagtccttgaaggagaaggagttggtgaacgagaagagcaaattggccgagatagaagaaattaagtgtagacaggaaaaggagatcactaaactgaacgaggaactgaaatctcacaaattagaaagcatcaaggagattaccaaccttaaggatgcaaagcagctgctgatccaacagaagctggaactgcagggcaaagctgatagtctcaaagcagccgttgagcaagaaaagcgaaaccagcagattctcaaagaccaggtcaaaaaggaggaggaggaactgaaaaaagagttcattgagaaggaagctaagctgcactcagaaattaaggagaaggaagtgggcatgaaaaagcatgaggaaaacgaagctaagctgactatgcagatcacggcacttaacgagaaccttggaaccgtcaaaaaagaatggcagtcaagtcagaggcgagtgtctgaactcgaaaagcagactgacgaccttcgaggcgaaattgcagtgctcgaggctaccgtccagaataatcaggatgagcggcgggcgctgctggagcgctgcttgaagggggaaggggagatagaaaagttgcagacgaaggtgttagaattgcaacgaaagctggacaatactacagccgctgtgcaggaactgggccgggaaaatcaaagcctgcaaatcaagcacacccaggcactgaataggaagtgggccgaagacaacgaggtgcagaattgcatggcgtgtgggaaaggcttttccgtgactgtgagaaggcaccattgccgccagtgtggcaatattttctgcgctgagtgcagcgcaaagaatgcgcttaccccttccagcaagaaacccgtcagagtgtgtgatgcctgctttaacgatctccaggggtag

SEQ ID NO: 41967 - DNA, 933 bp, Artificial Sequence
  Description of Artificial Sequence: Synthetic coding sequence
ctgcggcgggtggaccacgagacccccggccgggtgggcagccagggttcagacctggattcttccgccacacctataaatacggtcgacgtgaataatgagtcttcatcagaagggttcatttgccctcaatgcatgaaatccttgggttcagcagatgagctgtttaaacactatgaggccgtacatgatgcgggcaacgattcaggccatgggggcgagagcaacctagcacttaagagagacgatgtgaccctcctgcggcaggaggtgcaggacctccaggcatccttaaaggaggagaagtggtattctgaagagctgaagaaagaactagaaaagtatcaggggttgcaacaacaggaggcaaagccagatggcctcgtgaccgattcttctgctgagctccagagtctagagcaacagctggaggaggctcaaaccgaaaatttcaatatcaagcagatgaaggatctgtttgagcagaaggctgctcagttggcaaccgaaatcgccgatatcaagtcgaaatatgacgaagaacggtctctgagagaggccgcggaacaaaaggttacccggttgaccgaggaactgaacaaggaagccaccgtgatccaggacttgaagactgagcttctccagcggccgggtattgaggatgtcgccgtacttaagaaggagttggttcaggttcaaactctcatggataacatgaccttggaacgcgagcgggaaagtgagaaactgaaagacgagtgcaagaagctgcaaagccagtatgcttccagcgaggccactatttcacagttgcgcagtgaactggccaaaggtccccaggaagtcgccgtgtatgttcaggagctgcagaagctgaaatcctcagtgaatgaacttacccagaaaaatcagaagaagaaaaaaaaaaagtag

SEQ ID NO: 41968 - DNA, 1716 bp, Artificial Sequence
  Description of Artificial Sequence: Synthetic coding sequence
atgggccggatcggcatcagctgcctgttccccgccagctggcacttttccatctctcctgtcggttgtcctagaatcctcaacaccaatcttagacagattatggttataagcgtgctggcagcggcggtctcactgctgtatttttctgtagtgattattagaaacaagtacggccgacttactcgggacaaaaagttccaaagatacctagcccgagtcaccgatattgaggccaccgatacaaataaccctaacgttaattatggcatagtggtagactgtgggagtagtgggtccagagtttttgtctactgctggccccgccataatggaaatccccacgacctgctcgacatccgacagatgagagacaagaaccgaaagcctgtggtgatgaaaataaaacccggcatttccgaatttgcgactagccccgagaaagtgtccgattatatctctccactcctgaatttcgccgccgagcatgtgccacgggcaaaacataaagagaccccactgtatatcctttgcaccgctggcatgaggatcctgcccgaatctcaacaaaaggccatactggaagacctgcttaccgacatccctgtgcacttcgacttcctgttttctgatagccacgcagaagtgatttcagggaagcaggaaggagtgtacgcctggatcggcattaatttcgtcctggggcgattcgagcatattgaggacgacgacgaggccgtggtcgaagttaacatcccaggatccgagagtagcgaagccatcgtgagaaaacgaacagccgggattctggacatggggggtgtgtcaacccagatagcctacgaggtcccaaagacagaggaggttgctaagaaccttttggctgagttcaacctgggatgcgatgtccatcagaccgagcatgtgtacagggtttacgtagccacgtttctcggtttcggaggaaacgctgctcgccaaaggtatgaagatagaatcttcgccaacactatccagaaaaataggctcctgggcaagcagactggtctgacacccgatatgccttacctggacccctgtcttcctctcgatatcaaagatgaaattcagcaaaacggacagaccatttacctgcggggcaccggagatttcgacttgtgccgcgagaccattcagccttttatgaataagacaaacgagacacagacaagccttaacggagtttatcagccacccatccacttccagaatagcgagttttacggtttcagcgaattctattactgcacagaagatgtgctgcgtatgggcggggattataacgctgcaaagtttaccaaggccgccaaggactactgcgctactaagtggtccatactcagggaacgcttcgaccgcggcctttatgctagtcatgcagatttgcacaggttaaaataccagtgttttaaatctgcctggatgtttgaagtgttccaccgggggttttctttcccagtcaactacaaaagtctgaaaactgccctgcaggtgtatgacaaggaggtacagtggaccctcggtgccatcctttaccgtacgagatttctgcccctgcggaagataggaatgttgataattccatgttccggagggtgtcccaaactgtgttgcgccgtgtggcaaccaccgccctacggggctacaaaacatctgcagtgtgctgcctggaactag

SEQ ID NO: 41969 - DNA, 1851 bp, Artificial Sequence
  Description of Artificial Sequence: Synthetic coding sequence
atgggccggatcggcatcagctgcctgttccccgccagctggcacttttcaatctccccagtcgggtgcccccggatcctgaataccaatttacggcagatcatggtcattagtgtcctggcagccgctgtctctttattgtacttttctgtcgtcatcattcggaacaaatatgggaggctaacccgtgataaaaagtttcagagatatttggcaagagtcacagacattgaggctactgataccaataaccccaacgtcaactatggaatcgtggtggactgtggaagcagcgggtcacgcgtctttgtttattgctggccccggcataacggaaacccacatgacctgctggatatcagacagatgagggataagaaccgaaagccagtagttatgaaaattaaacccggcatatccgaattcgcaactagccctgaaaaggtctcggactatatatcaccgctcctgaattttgctgccgaacacgttccccgcgcgaagcacaaagaaacccccctctacatcctctgcacggcgggtatgcggatcttgccagagagccagcagaaggctatcttggaagacctgctcaccgatattccggtccacttcgactttctattttcagattcgcatgccgaagtgatcagcggaaaacaggaaggagtgtacgcttggattggcattaatttcgtattgggccgctttgaacacatcgaggatgacgatgaggccgtcgtggaggtgaacattcccggatccgaaagttcagaggctatcgttcggaagcggacagccggaattctcgatatgggcggagtttccacgcagattgcatatgaggttcctaagactgtttcattcgcatcctcgcagcaggaggaggttgccaaaaatctgctggccgaatttaacctaggctgcgacgtgcaccagacagaacacgtgtatagagtctatgtagctacattcctcgggttcggcggaaacgcagctcgccagagatacgaggaccggatcttcgcaaataccatccaaaagaaccgactcctgggaaagcagaccggtcttacgccagatatgccatacctggatccatgccttcccctggacatcaaagatgaaattcaacagaacgggcagacgatttatcttagaggcaccggcgacttcgatctgtgccgagaaaccattcagcccttcatgaataagaccaatgagactcagacttctttaaatggcgtgtatcaaccacccatccacttccagaatagcgagttttacggtttttctgagttttactattgtaccgaagacgttttacgcatgggcggggattataatgcagccaaattcaccaaggcagccaaagactattgcgcgacgaaatggtccattctgcgggaaagattcgatagagggctctatgcatctcacgccgacttgcacagacttaaataccagtgctttaagtccgcatggatgtttgaggtgttccatcgtgggttttccttccctgtgaattataagagcctcaaaacagctctgcaggtatatgacaaggaagtacagtggaccctaggcgcaatcctctataggaccagattcctgccactgcgtgacatacaacaagaggcttttagggcttctcacactcactggagaggcgtatcattcgtatacaatcattatctcttctcaggatgcttcctcgttgtcctgctggccattttgctctacctgctacggctccgtagaatacataggcggactccccgttcctcttctgcagcggccctttggatggaggagggactccctgctcagaacgccccaggaacgctgtag

SEQ ID NO: 41970 - DNA, 1827 bp, Artificial Sequence
  Description of Artificial Sequence: Synthetic coding sequence
atgggccggatcggcatcagctgcctgttccccgccagctggcacttctccatttcacccgtgggatgtcctagaattctcaatacaaacctcaggcaaatcatggtcatcagcgtgcttgcggcagccgtgagcctactgtattttagcgtggttatcatcagaaataaatacggtcggctgaccagagataagaagttccagcgctacttggcacgggtgacggatatcgaggctacagatactaacaatccgaatgtgaactacggcatcgtagtagactgtgggtccagcggctcaagggtcttcgtatactgttggccacgacataatggtaacccacatgacctgttagacatccgccagatgagggacaagaatagaaaaccagtggttatgaaaatcaaacccggtatcagcgagtttgcaacctcccctgagaaagttagcgactatatcagcccacttctaaacttcgctgccgagcacgtgccaagagcaaagcataaggaaactcctctttacatactgtgcaccgccggaatgaggattctgcccgaatctcagcaaaaggctattttggaggatttgctcaccgacattcccgtgcacttcgactttttgtttagcgacagtcatgctgaagtcatttcgggaaaacaagaaggggtgtacgcctggatcgggattaacttcgtcctggggcggtttgagcacatagaagatgatgatgaggccgttgtggaagtcaatatacctgggagtgaaagtagcgaggccatcgtacgtaaaaggaccgccggaattctggatatgggcggcgtgagcacacagatcgcttacgaagtgcccaagactgaagaagtagctaaaaaccttctagcagaattcaatctcgggtgcgacgtgcaccaaacggaacatgtgtaccgtgtatacgtggctactttcctggggtttggcggcaatgcagcccgtcagcgctatgaggatcggatcttcgcgaacacgatacaaaagaatagactgctgggcaagcagactgggctgaccccagatatgccgtaccttgacccctgcttgcctctggacattaaagatgaaatacagcagaacggccagacgatctatttgcgtggaaccggggacttcgatttatgtcgtgagacaatacagccattcatgaacaaaaccaacgaaacccagacctctctgaatggggtgtaccagcctcctattcacttccaaaatagtgagttttacggcttctcagagttttactattgtaccgaagatgttctccggatggggggcgattataacgccgccaaatttaccaaagcagctaaagactattgcgcaacaaagtggagcatcctccgcgaaaggttcgataggggcctgtacgcttctcatgcggaccttcataggttgaagtatcagtgttttaagagtgcatggatgtttgaggtctttcaccgcggttttagcttccctgtaaattataaatcacttaagactgctttgcaagtctacgataaggaggtccaatggaccctaggcgccatactgtatagaacccggttcctgcccctgcgggacatccagcaagaggcttttagggctagccatacgcattggcggggcgtgtcattcgtttacaaccattacttattcagcggctgtttcctggtggtcttactagccatcctgttatatttactacgcctcaggcggatccaccgtcgtacccctcgcagtagttccgctgcagcactatggatggaggaaggactccccgctcaaaatgctcctgggaccctgtag

SEQ ID NO: 41971 - DNA, 1815 bp, Artificial Sequence
  Description of Artificial Sequence: Synthetic coding sequence
atggcccggatcagcttcagctacctgtgccccgccagctggtactttacagtgccaacagtgtcccccttccttcgtcagagagttgctttcctcgggctttttttcatctcatgtttgctgcttctgatgctgattattgatttccgacactggagcgcctccctgcctcgtgatcgacagtatgagaggtatttagccagagttggggagctggaggccacggacacggaagacccgaacctgaactatgggctggtggtcgattgcggaagttcagggtccaggatttttgtgtacttctggccgcggcataacgggaaccctcatgatttactggatataaaacagatgagagaccgcaactcccagcctgtggtgaaaaaaattaaacccggcatctcagctatggccgatacccctgagcatgcatctgattacctaaggcctcttttgagttttgcggcagcgcacgttccggtgaaaaaacataaagagacgccgctgtatattctctgcaccgccggcatgcgactgctgcccgagaggaagcagctggctatcctggcagatttggttaaggacctgcctctggaattcgactttttgttctcacagtctcaggctgaggtgattagcggtaagcaggagggagtgtacgcatggattggcattaatttcgtgttgggccgatttgaccacgaggatgagtcagacgccgaggccacccaggaactagccgctggccgtaggcgcaccgtgggcatactggacatgggaggtgccagtctgcagattgcatacgaggttcctacctctacctcagtgttacctgccaagcaggaggaagcggcgaagatcttactggctgagttcaatctaggttgcgatgtgcagcacacagaacacgtttatcgggtgtatgtaacgacctttctgggcttcggcggtaacttcgcaaggcagaggtacgaagacctggtgctgaatgagactctgaacaagaatcgactgctggggcagaagacagggctaagtcctgacaaccctttccttgatccatgcctccctgtgggtctaactgatgtggttgaacggaatagtcaggtcttgcacgttcggggtcgtggagactgggtctcatgtggggccatgctgtctcctctgctggcgcgatcaaacacaagccaggcaagcctgaatggcatctaccagagtcccatcgacttcaacaattccgagttctacgggtttagcgaatttttctactgtacagaagacgtgctacgcatcggcggccgataccacggccccacttttgctaaggctgcacaggactactgtggcatggcttggtcagtgctcacccagcgatttaaaaatggcctattcagctcccatgcagatgaacataggctgaagtaccagtgttttaagtcagcgtggatgtaccaggttttgcatgaaggcttccatttcccttacgattaccctaacctgagaactgcgcagctggtttacgaccgcgaggtgcaatggaccctgggagccatcttgtataagacgaggtttctgcctttacgcgacctgaggcaagaaggagtaagacaggctcatggcagctggttccgcctctctttcgtgtataatcattacttgtttttcgcgtgtattctcgtagtcctgctcgccatctttctttatcttctgcggctgcggcggatacaccacaggcaaaccagggctagcgcaccccttgacctcttgtggctggaagaggttgtccctatgatgggcgtgcaagtggggccttag

SEQ ID NO: 41972 - DNA, 1377 bp, Artificial Sequence
  Description of Artificial Sequence: Synthetic coding sequence
atgggcctgagccggaaggagcaggtgttcctggccctgctgggcgcttcaggggtctctggactcactgcattaattctcctgctagtggaagctacatctgtgttacttcccaccgatattaaattcggcattgtctttgatgctgggtcaagccatacatccttattcctgtaccagtggctggcaaacaaggaaaatggcacaggtgtggtctcccaagctttggcctgtcaggttgaggggcctgggataagttcgtacacatccaacgcagcgcaggccggcgaatctttgcagggctgcctggaagaggccttggtgttgattcccgaggctcagcaccgaaaaactcccacattcctgggcgcgacagcgggcatgcgcctgctcagccgcaagaactcaagccaggcacgagacatctttgccgccgtcactcaggtcctcggaagatctcctgttgacttttggggggctgagctgttggctggccaggcagagggcgccttcggatggataacagttaattacggacttggcaccctggtgaagtattctttcacaggagaatggatccagccacccgaggaaatgctagtgggcgcactggatatggggggcgcatctacacagattacttttgtccccggaggtcccatccttgacaaaagtactcaggccgacttccggttgtatgggagtgactacagtgtgtacacacattcttacctatgctttggaagagaccagatgctttcccggcttctcgttggcctcgtgcagtcccggcccgccgctttgcttcgtcacccatgttacctatcaggatatcagacaacgctcgctctcggacccctgtatgaaagcccctgcgtccacgccaccccaccattatccctgccacagaaccttacggtggaggggaccggcaaccctggagcctgtgtttccgcaatccgggagctctttaatttctccagctgccagggccaagaggattgtgcttttgacggggtgtaccagcctcctttaagaggacaattttacgtggaggcttcctaccctggacaagaccggtggttgagagactactgcgctagcggactgtatatcctaaccctcctgcacgaggggtatggtttctccgaggaaacatggcctagtctcgagtttcggaaacaagctgggggagtggacattggatggaccctaggatatatgcttaatcttactggcatgatccccgcagatgccccggcacagtggcgtgcggaatcctacggtgtgtgggtcgccaaagtagtgtttatggtacttgcactcgtggctgttgttggcgcggcactagtgcaactgttttggctgcaggattag

SEQ ID NO: 41973 - DNA, 1488 bp, Artificial Sequence
  Description of Artificial Sequence: Synthetic coding sequence
atgggcctgagccggaaggagcaggtgttcctggccctgctgggcgccagtggagtgagcggactaaccgccttgatcttgctgctcgttgaggccaccagtgtgctactgcctacagatattaaatttgggatcgtgttcgacgcagggagcagtcacacctccctattcctgtatcagtggctagcaaataaggagaacgggaccggggtggtatcccaggcgctagcttgccaagtggagggacccgggatcagtagttacacatccaacgctgctcaggccggcgagtctctgcaaggatgtcttgaggaggccctggtactgatccctgaagcccagcaccgtaagacccctacatttctaggagcaacagccggtatgcggctcctctccagaaagaacagctcgcaggctagggacatctttgccgccgtgacacaggttctggggcggtctcctgtggatttttggggcgcggagctgctggccggccaggctgaaggcgcattcggttggattaccgttaattacggactcggaaccctggttaagtactcctttactggagaatggattcagcccccagaggagatgttagtcggggcgctggacatgggcggagcttcaacgcagatcacctttgtaccaggtggccccatactggacaagagcacgcaggctgatttccgactgtacggcagcgactacagtgtttacacccactcttatctgtgctttggtcgggaccagatgctatcacgcctacttgttggcctcgttcaatcaagacctgccgcgctgctacggcacccgtgttatttgagcggttatcagaccacattagctctcggcccgctctacgagtcaccttgtgttcacgcaacaccacctctttctcttccccagaatctgacggtggaaggcaccgggaacccaggcgcctgcgtctcagctatccgagaactgttcaacttcagctcttgtcaaggacaagaagactgtgccttcgacggagtgtaccaaccgccactgaggggtcagttctacgcttttagcaatttctattacaccttccactttctgaacttaaccagtcgccagcctctttccaccgtaaatgctactatctgggaattctgtcagcggccctggaagttggtggaagccagttatcccggacaggaccgctggctcagagactattgtgcatccggtctgtatattctcaccttacttcacgagggatacggcttctctgaagaaacatggccgagcctcgaattcagaaaacaagccggaggggttgatattgggtggacactcgggtatatgctaaatttgaccggcatgattccggctgacgctcctgctcagtggagagccgagtcttacggcgtctgggtcgcaaaggttgtctttatggtgctggcactggttgctgtggtgggagctgccctggtccagctcttttggctgcaggactag

SEQ ID NO: 41974 - DNA, 1488 bp, Artificial Sequence
  Description of Artificial Sequence: Synthetic coding sequence
atgggcctgagccggaaggagcaggtgttcctggccctgctgggcgctagcggggtctcggggcttaccgccctgatactgctgctcgtggaggccacctcagtactactgccaaccgacattaaatttggaatcgtctttgacgctggatccagccacacgtcactattcctttatcagtggctcgcaaacaaggaaaacggaacgggagtggtgtcacaggccctggcttgtcaagtcgaagggcctggtatcagttcctatacctccaacgccgctcaggcaggcgagtcactacaagggtgcttggaagaggctcttgtactaatacccgaggcacaacacagaaagactccaactttcctcggcgcaaccgctgggatgaggctcctgagtaggaaaaacagttcgcaggcaagggatatctttgcggcagtgacacaggtgctagggcgctcccccgtggacttttggggagccgagctgcttgctggccaagcagagggtgcattcggctggattaccgtgaactacggcctcgggacactcgtgaaatactctttcacgggtgaatggattcagccaccagaggagatgctggttggggctctggatatgggcggagccagcactcagattaccttcgtgcctggggggcccatcctggataagagcacccaggctgactttagactgtacggatccgattacagtgtgtatactcatagctacttgtgcttcggcagagaccagatgctgagccgtttgctcgtggggctggtccaatcacgccctgcggccctgctgcgtcacccctgctatctgtccggttaccaaacaacactggcgcttgggcctctgtacgaatctccctgcgttcatgcgacccctccactgtccctccctcagaacctgacagtagaggggaccggtaatcccggagcctgtgtctctgccattcgggagttatttaacttttcgtcctgccagggtcaggaagactgcgcgttcgacggcgtctatcaacctccactgcgggggcagttctatgcctttagcaacttctactacaccttccacttcctgaacctgacctcaaggcagccgttgtctactgttaacgctactatatgggaattctgccagaggccctggaagctggttgaggcatcctaccccggtcaagaccgatggctccgcgattactgtgcttctggcttatacatcttgaccctgttacacgaaggctatgggtttagcgaggaaacatggcctagtctagaatttcgcaaacaggccggcggcgtagacataggatggaccctagggtatatgttaaacctgactggcatgattcctgcagacgcaccagcccaatggcgggccgagtcctacggcgtgtgggttgcaaaggttgtcttcatggtgttggcactggtagcggtcgtgggagccgcactggtccagctgttctggctgcaggactag

SEQ ID NO: 41975 - DNA, 1362 bp, Artificial Sequence
  Description of Artificial Sequence: Synthetic coding sequence
atgaagctgctggtgatcctgctgttcagcggcctgatcaccggcttcagatcagactcgagttctagcctgcccccgaagctgttactcgtctcctttgatgggtttagagcggattacctgaagaactacgagtttccacatctgcagaactttataaaagaaggagtgctggtggaacacgtaaagaacgtgttcattaccaaaacatttcctaatcattattcaatagttaccggcctgtatgaagaaagccacggcatcgtggcgaactctatgtatgatgctgttactaaaaaacatttctcagactcgaacgataaagatcccttttggtggaacgaggccgtgcccatctgggtaaccaatcaactccaggagaacaggtctagcgcagccgcaatgtggcccggaacggatgtccctatccacgacacaatctcctcatatttcatgaattacaacagttctgtgtctttcgaagagcgtcttaataatattaccatgtggctgaacaattctaacccacctgtcacttttgccactctttattgggaggaaccagatgccagtggacacaagtatggtcctgaagataaggaaaacatgagtagggtgttgaaaaaaattgacgacttgattggtgatctcgttcaacggcttaagatgctgggactgtgggagaacctaaatgtcattattacaagcgaccatggcatgacacagtgctcccaggatcggcttatcaatttagattcctgtattgatcactcatactacaccttgattgacctgagtcctgtcgcagctattctccctaaaatcaatagaactgaagtctacaacaagttgaagaattgcagcccccatatgaacgtgtatctgaaggaagacattccaaatcgtttctactaccagcataacgataggatccaaccgatcatcctggtcgctgatgaagggtggaccatcgtgctcaatgagtcgagccagaagctgggggatcacggctacgataattctctaccttcaatgcacccttttctggctgcgcatggacccgctttccacaagggttacaagcatagcaccatcaatattgttgatatctatcctatgatgtgtcacatcttgggactaaaaccgcatccgaacaacggtacttttggccatacaaaatgcttgctggtggatcagtggtgcatcaacctgcccgaagctatcgcaatagtcattggctcattactggtcctcaccatgcttacttgcctgatcatcataatgcagaacagactgagcgtaccaaggcctttctcacgactgcagctgcaggaggatgacgacgaccccctgatcggctag

SEQ ID NO: 41976 - DNA, 1362 bp, Artificial Sequence
  Description of Artificial Sequence: Synthetic coding sequence
atgaagctgctggtgatcctgctgttcagcggcctgatcaccggcttccgttccgattctagcagttccctgcctcctaagctgctgctggtgtccttcgatggatttcgcgccgattatttgaagaattacgagttcccacacctccagaattttatcaaagagggggtgctggtagaacatgtgaagaatgtcttcattactaagacattccctaaccactacagcatcgtcactgggttgtacgaagagtctcatgggattgttgccaactcaatgtatgacgctgtgaccaagaagcacttcagcgacagcaacgacaaagaccctttttggtggaatgaagccgtccccatatgggtgactaaccagctgcaggaaaatcgatcctcagccgctgccatgtggccgggaacagatgtgcccatccacgacaccatctctagttatttcatgaactataattcttcagtctctttcgaagaaaggctgaataacatcaccatgtggctaaataactccaacccccctgtcacattcgcaaccctctattgggaagagccggacgctagcggacataaatacggaccagaggataaggagaatatgagcagggttctcaagaaaattgacgacctcataggtgacctggtccagcgtctcaagatgctcggcctgtgggagaacttgaacgtgatcatcacgtccgatcatggcatgacccaatgcagccaggatcgcctaatcaatttggactcctgtatcgaccacagttactacaccttaattgatctctctccggtagcagctattctgcccaagatcaaccggaccgaagtatacaataaactaaagaactgtagcccccatatgaatgtgtatcttaaagaggatatcccaaaccgcttttattaccagcataacgatcggattcagcccataatcctggtggccgacgaaggttggaccatcgtactgaatgaaagctcgcagaagcttggcgatcatggctacgacaattccctgccctctatgcatcctttccttgccgcccatggaccggctttccacaagggctacaagcactctacaatcaacattgtggacatatatccaatgatgtgccacattctagggttaaagccccacccgaataatgggacttttggccataccaagtgcttactagtcgatcaatggtgcatcaacctgccggaggccattgcaatcgttatcggatccctgttggtgctgactatgctgacctgccttataattattatgcagaaccgcctctcagtgccaaggcctttcagtcgattgcagctacaggaagacgatgacgaccccctgattggctag

SEQ ID NO: 41977 - DNA, 1377 bp, Artificial Sequence
  Description of Artificial Sequence: Synthetic coding sequence
atgcggggcctggccgtgctgctgaccgtggccctggccaccctgttagcccctggtgcgggggcacccgttcagtcccagggaagccagaacaagctgctcctggtgtcttttgacgggttcagatggaactacgaccaagatgtcgacacccctaacctggatgccatggctcgagatggcgtgaaggccagatacatgactcctgcattcgttactatgacctctccatgtcacttcactctagtgacggggaaatatattgagaaccacggggtcgtgcacaacatgtactataacacaaccagtaaagtgaagctgccttaccacgcaactctgggtatccaaagatggtgggataacgggtctgtccccatctggattacagcacagagacagggtctgcgcgcaggctcattcttttatccaggaggcaatgtcacctaccagggggtggctgtgactcgaagcaggaaggagggaatcgcccataattataaaaacgagaccgaatggcgagcgaatatagatacggtcatggcatggtttaccgaagaggatctggacctggtgaccctgtacttcggtgaacctgacagtaccggccacagatatgggccagagtcaccagagaggcgcgagatggttaggcaggtggatcgaactgtagggtacctgcgagaatcaatagccaggaaccacttgaccgacaggttaaacctcatcatcacatctgatcacggaatgaccactgtggataagcgggcaggcgatcttgtggaattccacaagttcccgaattttacattccgggacatcgagtttgaactgctggactatggacccaacggcatgttacttcctaaggagggccgcctcgaaaaagtgtatgatgcattgaaagatgcccatcctaagctccacgtgtataaaaaggaggccttcccagaggcatttcattacgcaaataatccaagggttacgccgttgctcatgtactccgatctaggttatgtgatccatggccgcattaacgtccaattcaataatggagaacatgggtttgacaacaaagatatggacatgaagactatctttcgagcagtgggaccctccttccgcgctggattagaggtcgaacccttcgagagcgttcacgtgtatgagcttatgtgccgactgctgggaatagtcccagaggccaacgacggccatctggcaacactcctgcctatgcttcacacggaaagtgccctccctccggacggtcggccaacactgctcccaaaaggtcgctccgcactgccaccatcctcccggccactgctggttatgggtctcctgggcactgtcatcctgctgtctgaagtggcctag

SEQ ID NO: 41978 - DNA, 1305 bp, Artificial Sequence
  Description of Artificial Sequence: Synthetic coding sequence
atggccgccgccgccggcagctgcgcccgggtggccgcctggggcggaaaattgcgaaggggcctggccgtcagcagacaggctgtgaggtctcccggaccccttgctgccgctgtggccggggcggcattagctggggcaggcgccgcatggcaccacagccgagtgagcgtggccgccagagatggcagcttcaccgtttctgcccaaaagaatgtcgagcacgggattatttatataggcaaaccatctcttcgtaagcagaggttcatgcaattttcatcattagagcatgaaggcgagtactacatgaccccaagagactttctattttcagtcatgtttgagcagatggaacggaagacaagcgtcaagaaactcacaaagaaagatattgaggacaccctgtctgggatacagacggcaggatgtggatccacattcttccgcgatctcggcgataagggactgattagttatactgaatacttgtttctgctaacgatactgaccaaacctcatagtgggttccatgtggccttcaaaatgctggataccgatgggaacgagatgatcgaaaagagagagttcttcaagttacaaaaaatcatctctaaacaggacgacctgatgacagtgaaaaccaacgagaccggatatcaagaagccatcgtcaaggaaccagaaataaatacgaccctgcagatgcggttttttgggaagagggggcagaggaaattacactacaaagaattccggaggtttatggagaacctgcaaacagaaattcaagaaatggagttcctccagttctccaaagggttgtctttcatgcggaaggaggatttcgctgaatggttactgttctttaccaataccgagaacaaagatatttattggaaaaacgtgcgtgaaaaattaagtgccggagagagcatctctctggatgagtttaaaagtttttgtcattttaccactcacctggaagactttgcaattgcgatgcaaatgttcagcctggcccacaggcccgtgcgcttggctgagtttaagcgcgccgtgaaggtggcaacaggccaggagttgtccaacaatatactggacaccgtcttcaagattttcgacctcgacggagatgaatgccttagccacgaagaatttcttggcgtgctcaagaataggatgcaccgagggctctgggtgccacaacaccagagtattcaagaatattggaagtgtgtcaaaaaggaaagtattaagggggtgaaagaagtgtggaaacaggccggaaaggggctgttctag

SEQ ID NO: 41979 - DNA, 1593 bp, Artificial Sequence
  Description of Artificial Sequence: Synthetic coding sequence
atggccgccctgcggcggctgctgtggccccccccccgggtgagcccccccctttgcgcccatcagccactgctaggaccttgggggcggccagctgtgacaacccttggattacctggacgccctttctcttctagagaagatgaggagagagcagttgctgaggccgcatggcggagacgtaggagatggggagagctttccgtggcagccgccgctggcggaggcctggtcggacttgtctgttaccagctgtacggggatccccgagcaggttcacctgccaccggccgacccagtaaaagcgccgctaccgaacctgaggacccccccagggggcgcgggatgctccccattccggtagccgccgccaaggagactgtcgctattgggagaacagatatagaagacctagacttatacgctacgtcccgcgagaggcggtttcggctgttcgcgtccattgagtgtgaggggcagcttttcatgacaccctatgactttatattagcagtgactacggacgagcctaaggtcgctaagacttggaagtccctctcaaaacaggagcttaaccagatgctggccgaaaccccaccagtctggaaaggctcaagcaagctcttcagaaacctgaaggagaagggcgtgatctcctacactgaatacctattcctactatgcatactgacaaaaccccatgctggcttccggattgcattcaacatgtttgatacagacggcaatgagatggtggataagaaggaatttctcgtactccaggaaatatttcgtaagaaaaacgaaaaaagagaaattaagggtgacgaagaaaaaagagctatgctcaggttgcagctgtatggctaccattcccctaccaattccgtgctgaagactgacgccgaggaattggtcagcaggtcctattgggatacattgaggcgcaatacgagccaagcactgtttagcgatcttgctgagcgggcagacgatatcacctcattggttaccgacaccacactgcttgtacatttttttgggaaaaagggtaaggccgagttgaattttgaggacttctaccgctttatggacaatctccagaccgaggtgttggagatcgagttcctgtcttactccaacggtatgaacacaatttccgaggaggactttgcacacatcctgcttcgttatacaaacgttgaaaacacttccgtatttttggagaacgttaggtactcaatcccggaagagaaaggcatcacgttcgacgagttcagatccttcttccagtttctgaataacctggaggacttcgccatcgctctgaacatgtacaactttgccagtaggagcattgggcaggacgagtttaagcgggcagtttatgttgctacgggtttaaagttctcacctcatctagttaataccgtgtttaagatttttgacgttgacaaagatgaccaattaagctacaaggagtttatcggtattatgaaagaccgacttcatcgaggattccgagggtacaagacagtgcagaaatatcctacttttaaatcatgcctaaaaaaggagcttcacagtagatag

SEQ ID NO: 41980 - DNA, 534 bp, Artificial Sequence
  Description of Artificial Sequence: Synthetic coding sequence
atgttcaagcagtacgacgccggccgggacggcttcatcgacctgatggagttaaagttgatgatggagaagctaggggcgccccaaacccacctggggttgaagaacatgattaaagaggtcgacgaggattttgattctaagttgtcctttcgggaatttctcctcatcttccgtaaggccgctgctggtgagttgcaggaggacagcggactgtgcgtccttgcacggctctctgaaatagatgtctcatccgagggagtgaaaggagccaagagcttttttgaggctaaatggaattgggtctgcaggtgggccccacggactgggtcgcggggatcaggatggcagcaactcgaaaggctgcctagctccgctctggcgctccaacaaccacaaaatatcggcccaggtcaccagcgcgtacagcctttaagaggcggagaccaaggcagggccggcgggaaggaagaagcggggggaggtgacgaggccgccgagagtggccttcaaggagctgccgtgcatctgtag

SEQ ID NO: 41981 - DNA, 723 bp, Artificial Sequence
  Description of Artificial Sequence: Synthetic coding sequence
atggccaccgacgagctggccaccaagctgagccggcggctgcagatggaaggcgagggcggtggagagacaccagagcaacctggcctcaatggagcagcagccgccgctgcgggggcacctgacgaagccgctgaagccttaggcagcgctgactgcgagctaagtgctaaacttttacgccgggccgatcttaatcaggggatcggggagccacagagtcccagcagacgggtcttcaatccatataccgagttcaaggaatttagccggaagcagataaaggacatggaaaagatgtttaagcagtacgatgcgggccgcgatggcttcattgacttaatggagttgaagcttatgatggagaagcttggcgcacctcagacccacctcggactcaagaatatgataaaggaagtagacgaagattttgattcaaagcttagctttagggagtttctccttatctttcgcaaagctgccgcaggagagctgcaggaggatagcggattgtgtgtgctggcacgcctttcagaaattgacgtgtccagtgagggcgttaaaggggcaaagtctttcttcgaagcgaaagttcaggccatcaacgtgtcgtcacgttttgaggaagagatcaaagccgagcaggaagagcgcaagaaacaggctgaggagatgaagcagaggaaagcagcctttaaagaattacagtctaccttcaaatag

SEQ ID NO: 41982 - DNA, 540 bp, Artificial Sequence
  Description of Artificial Sequence: Synthetic coding sequence
tgaaagatgttcaagcagtacgacgccggccgggacggcttcatcgatctgatggagctgaagctgatgatggagaaactcggagcaccgcagacacacctggggcttaagaacatgatcaaagaagttgatgaagactttgactccaagctgagcttccgggaattcctgctcatttttcggaaggcagccgcaggggaattacaggaagactctggcttatgtgtactggctagattgagtgaaatcgatgtctcttcagaaggtgtgaagggcgcaaagtccttttttgaggccaaatggaactgggtatgcaggtgggctcctaggacaggatcacgaggctccggatggcagcagcttgagcgcctcccatccagcgctttggcactgcaacagccgcagaacatcggtcccgggcaccagcgcgtacaaccattgcgcggaggtgatcagggacgcgccggagggaaagaggaggcggggggcggagatgaagccgccgagtccggtctgcagggggccgccgttcacttatag

SEQ ID NO: 41983 - DNA, 2073 bp, Artificial Sequence
  Description of Artificial Sequence: Synthetic coding sequence
atgaagcggctgcccctgctggtggtgttcagcaccctgctgaactgttcatatacacagaactgtaccaagaccccttgcctgcctaatgccaaatgtgaaatccgcaacggcatcgaggcttgctattgtaacatggggtttagcggcaatggcgttacaatctgcgaagacgacaatgagtgtggtaacttgactcagtcatgtggagaaaatgccaattgcactaataccgagggaagctattactgtatgtgcgtaccaggcttcaggagctcttccaaccaggaccgtttcatcacaaatgacggtacggtttgtatcgaaaatgtgaatgcaaattgccaccttgacaacgtttgtatcgccgccaacatcaacaaaacactgaccaaaatccgttctattaaagagccggtcgccctcctgcaagaagtgtatcgcaacagcgtcacagacctgtcccctaccgacatcatcacctacattgagatcttggctgagtcttcttcactgttgggatataaaaataatactatctccgccaaggacacgctctctaatagtaccctgaccgaatttgtcaaaaccgtgaacaacttcgtgcagagggatactttcgtagtgtgggacaagctaagcgtgaaccacagacgaactcacttgacaaaactgatgcataccgtggaacaggcaacccttcgcatcagtcagagttttcagaagaccaccgagtttgacaccaattcaactgacatcgccttaaaggtgttcttcttcgatagttataatatgaaacacattcacccacatatgaatatggacggagattatatcaacatattcccaaaaagaaaagctgcctacgacagcaacggtaacgttgctgtagcttttgtgtattacaaatcaatcggcccactactgagctcctctgataactttttgctaaagccacaaaactacgacaattccgaagaagaggagcgggtaatatcctctgtcataagcgtgagcatgagctcaaacccgcccactctgtacgagctggaaaaaataacgtttactctgtcacaccggaaagtgaccgatcgatatagatcactgtgcgccttctggaattactccccagataccatgaacggcagttggtccagtgaaggatgcgagctgacttattccaatgagacacacacgagttgccggtgtaatcacctgactcattttgccatcctgatgagttccggccctagtattggcattaaggattacaacatcctgacacggatcacccaattgggaatcatcatttctctcatctgtcttgccatatgcatcttcactttctggttcttctctgaaattcaatccaccagaacaacaatccacaaaaacctgtgttgctctctttttctggcggagctggtattccttgtggggattaataccaataccaataaacttttctgctcaataatagcgggcctcttgcactattttttcctagcagcctttgcatggatgtgtattgaaggcatacatctctatctcatcgttgtcggtgtgatttataacaaaggatttctccacaagaatttctatatcttcggatatctctcaccagcagttgtggttggcttctccgctgcactgggataccggtattatggaactaccaaggtgtgctggctgagcaccgagaataacttcatatggtcgttcattggccctgcttgcctcatcatcctggtcaaccttctggcgttcggtgttattatttataaagtttttaggcatactgccggtctcaagccagaggtgagttgctttgagaacattagatcctgtgccagaggcgctctggctctactgttcctcctgggtactacatggattttcggagtgttgcacgttgttcacgccagtgtggtgactgcctacctgttcacagtatctaacgccttccagggtatgtttatttttcttttcctttgcgtcctgtctaggaagatccaggaggaatattaccgcttgtttaagaatgtcccatgctgtttcggctgcttaaggtag

SEQ ID NO: 41984 - DNA, 450 bp, Artificial Sequence
  Description of Artificial Sequence: Synthetic coding sequence
gtggtggtgggcttcagcgccgccctgggctaccggtactacggcaccactaaggtgtgctggttgtccaccgaaaacaacttcatttggtcattcataggccctgcttgtctcattattctggtgaacttactagcttttggtgttatcatatacaaagtgtttcggcacaccgccggattgaaaccagaggtgtcttgtttcgaaaatatccggagttgcgccaggggggccctggctcttctgtttctgcttggaacaacctggatctttggagtgctgcatgtggtgcacgcctctgtggtgacagcctacttgtttacggtatcaaatgcctttcagggcatgttcatttttctgttcctgtgtgtactgtccagaaaaattcaggaggagtactaccggctgttcaagaacgtgccgtgctgctttggctgcctttcctgctag

SEQ ID NO: 41985 - DNA, 2472 bp, Artificial Sequence
  Description of Artificial Sequence: Synthetic coding sequence
atgggcggccgggtgttcctggtgttcctggccttctgcgtgtggctcaccttgccaggagccgagacacaggacagccggggctgcgcccgctggtgcccccaggactcttcctgtgtgaatgcaaccgcttgtcgttgtaacccaggcttttcgtctttttctgagatcattacgacgccaatggaaacgtgcgacgacatcaacgaatgcgcaactctcagtaaggtcagctgtgggaaattttcagactgttggaacacagaaggaagctatgactgcgtgtgctcccccggatacgagcctgtctcaggagctaaaacgtttaagaatgagagcgaaaatacttgccaggatgtggacgagtgtcagcaaaaccccagactgtgcaagagttacgggacatgtgtgaacaccctcggaagttatacgtgccagtgcctgcccggttttaagcttaagcctgaggatcctaagttatgcactgatgtaaacgagtgtacgtctggacagaacccatgtcactcaagcacccattgcctcaataatgtgggatcttaccaatgtcggtgtcgccccggatggcagcccatcccaggcagccctaatggacctaataacacagtgtgcgaggacgtggacgaatgcagttcagggcagcatcaatgtgattcatcgaccgtgtgctttaatactgtcggctcctatagctgtaggtgtaggcccgggtggaagcctcgtcacggcattccaaataaccagaaagacacagtgtgcgaagatatgacattcagcacttggacaccacctccaggtgttcattcgcagaccctctcgcgcttttttgataaagtccaggatctcggaagagactacaaacccggtcttgccaacaataccattcagagtatccttcaagcactcgacgaactgctggaagctccaggggacttggaaactcttcctcgcctccagcagcactgtgttgcttcacacctcctggatgggctggaagacgtgctgcggggtctgtccaagaatctgagcaatggcttactcaacttctcctatcctgccggcaccgagctgtccctagaggtccagaaacaagttgacagatctgttacgctgcgccagaaccaagctgtcatgcaattggactggaaccaggcccaaaagagcggggatcccggcccaagcgtggtaggtctagtcagcatacccggcatggggaagcttttagcagaagccccattggttctggagccggagaaacagatgttgctgcacgagacacatcagggactgctacaggatggttcaccaattctcctgtccgacgtcattagcgctttcctgagcaataatgatacccagaacctgtcttctccagtgacttttaccttttcacatcgctccgtgattccaagacagaaggtgctgtgcgtgttctgggagcacggccaaaatggatgcgggcactgggcaactacaggctgttccaccatcggaactcgggacacctcaacaatctgccgatgcacgcacttgagctcttttgcagtgcttatggcccactatgatgtgcaggaagaggatccggtgttgactgtaatcacttacatgggtctctctgttagtcttctctgtcttttgttagctgctctgacttttctgctttgtaaggcaatccagaatacatctacctcccttcatctccagcttagcttgtgtctcttcctggcccatctcctctttctcgtggccattgatcagactggccataaggtgctctgcagcataatcgcgggcacactgcactatctgtacctcgccactctgacttggatgctccttgaagccctgtacttgttcctcactgcccgcaaccttacagtagtaaactacagtagcatcaatagattcatgaaaaagctgatgtttcccgttggatacggcgtgccagccgtgaccgttgctatctccgccgcaagtagacctcacctttatggcacccccagcagatgttggctgcagcccgagaaagggttcatatgggggttcctaggccccgtgtgcgcaatcttttctgtgaacctggttttgtttctggtcaccctgtggattctgaaaaatcgccttagttccctaaattctgaagtctctacactacggaatacaaggatgcttgcatttaaggctactgcacaactgttcatactgggctgcacctggtgtctcgggatcttacaggttggaccggccgcacgcgtgatggcctacctgttcacgatcataaacagcctgcagggcgtattcatatttcttgtgtattgcctattgtcacaacaggtccgtgaacagtatggtaaatggtccaagggcatcagaaagcttaaaactgaatctgagatgcacactctgtcctccagcgctaaagctgacacttccaagccaagcactgtcaattag

SEQ ID NO: 41986 - DNA, 2472 bp, Artificial Sequence
  Description of Artificial Sequence: Synthetic coding sequence
atgggcggccgggtgttcctggtgttcctggccttctgcgtgtggctgactctgccaggcgccgagacccaggatagccgtggctgcgccagatggtgccctcaagattcatcctgtgtgaatgccactgcatgccgctgcaaccccggcttttcatcctttagcgaaatcataaccacaccgatggaaacatgtgatgatatcaacgaatgtgcaaccctatctaaagtttcttgcggcaaatttagtgactgctggaataccgagggttcatacgactgcgtgtgttcaccaggatatgagccagtgagtggggcaaaaacatttaagaatgaatctgagaacacctgccaggatgtggatgagtgtcagcaaaaccctcgtctgtgtaagtcctatggaacttgtgtgaataccctgggatcttacacatgtcagtgtttgccaggcttcaagctgaaacccgaggatccgaagctatgtaccgacgtcaatgagtgcacctctggccaaaacccttgtcacagcagcactcactgtctgaacaatgttggttcataccaatgcaggtgtagacctggatggcagcccatccctggatccccaaatggaccgaataatacagtgtgtgaggacgttgatgagtgtagttcaggacagcaccagtgtgattccagcacggtgtgcttcaatactgttggctcgtattcctgtaggtgtcggcccgggtggaagcctcggcacgggatcccaaacaaccagaaggatacagtctgtgaagatatgacattcagcacttggaccccccctcccggcgttcatagccaaactctttcaagattttttgataaggttcaagatctgggtcgtgactacaaaccaggcctggccaataatactattcagagtatcttgcaagcgctagacgagctcctggaggccccaggcgatctagagacactcccccgtctgcagcagcactgcgtggcctcacacctgctggatgggctggaggacgtgctgcggggcttatctaagaacctgtctaacggactgcttaactttagctatcccgctggaaccgagctctctctcgaggtacaaaaacaggtggataggtccgtgaccctgcgacagaaccaggcagtgatgcaactggactggaatcaagcacagaaatcgggggatcccgggccatctgtggttggactggtttctatacctggaatggggaagttactcgccgaggcacccctggttctggaacccgaaaagcagatgctcctccacgaaacacatcaggggctgctacaggatggatctcctattctgctcagcgatgttatttctgccttcctgagcaacaacgatacacagaatctcagcagcccagtgacatttacattttcacatcgttctgtgattcctaggcagaaagtgctgtgtgttttctgggaacatggacagaatggctgcgggcactgggccaccaccggatgttcgaccatcggtaccagagatacctccactatctgtagatgcactcatctgagctcattcgccgtgctgatggcccactatgacgtccaagaagaagatccagttctgaccgtcatcacttatatgggcctatctgtctcattactctgtctgctgctggccgccctgacattcctgttgtgtaaggccatccagaataccagcacaagccttcacctccagctgtccctgtgtctgttcctggcacacctgctgttcctagttgccattgaccagacaggtcacaaggtgctctgtagtattatcgcggggaccctacattatctgtacctggccacgcttacttggatgcttttggaagccctttatctgttcctgactgcaaggaatctgaccgtggtgaactactctagcatcaatagattcatgaagaagctcatgtttcccgtgggctacggggttccagctgtgaccgttgccatctcggccgcatcacggccgcatctatacgggaccccatccaggtgctggctgcagcccgagaaaggattcatctggggcttcctgggccctgtatgcgcaatcttttccgtgaacctggtgttgttcctcgtgacactgtggattttaaagaatcggctttcaagtctgaactctgaggtcagcacactgagaaatactcggatgctcgctttcaaggcaacagctcagctgttcatcttgggatgcacctggtgtcttgggattttgcaggtgggcccagccgcgagagttatggcctacttgttcaccattattaacagcctacagggcgtttttatttttttagtgtattgtctgctctcacaacaggtgagggaacagtatggaaaatggtcgaaagggattcggaagctgaaaacggaaagcgaaatgcacaccctgtcctcctcagctaaagctgacaccagcaaaccgtcaaccgtgaattag

SEQ ID NO: 41987 - DNA, 2325 bp, Artificial Sequence
  Description of Artificial Sequence: Synthetic coding sequence
atgggcggccgggtgttcctggtgttcctggccttctgcgtgtggctgaccctccctggcgcggaaactcaggactcccgcggctgtgctcgctggtgccctcaagactcctcttgtgtgaacgctacagcgtgtcggtgcaaccctggtttttctagtttttcggagatcatcacaacccctatggaaacttgcgacgatattaatgaatgtgcaacactgagtaaggtgagttgcggcaaattctccgactgttggaatactgagggcagctacgactgtgtctgcagtcctggttatgaacccgtttcaggtgccaagacatttaaaaatgaaagcgagaatacttgccaggatgtggacgaatgtcagcaaaatccccgactgtgtaaatcttacgggacttgcgttaatactctgggctcgtatacctgccagtgtctcccagggtttaaactcaagcccgaagatccaaagctttgtacagatgtggatgagtgctctagcgggcagcatcaatgtgacagtagcactgtttgcttcaacacagtgggcagttactcttgcaggtgtcgcccaggttggaaaccacgtcatggtattcctaacaaccagaaagataccgtttgcgaggacatgacttttagcacgtggacacccccccctggtgtccactcacagacgctgagccggtttttcgacaaggtccaggatctgggcagagactacaagcctgggttggccaacaataccattcagtccatactgcaggcgctcgatgagctgttagaagcccccggagaccttgagacactccccagactccagcagcactgtgtggccagccatctgctcgacggcctggaagatgtgctgcggggcctctccaaaaatcttagtaacggcttgttgaattttagctatcccgccgggaccgaactgagtctggaggtgcagaagcaagtcgatcggtcggtgactctcagacagaatcaagcggtcatgcagctggactggaatcaggctcaaaagagcggcgacccaggtccatctgtggttggtctggtgtctatcccggggatgggtaagctgctagcagaggccccccttgtgttggaacccgagaagcagatgttgctccacgagacgcatcaagggctgttgcaggacggaagccctattctgctgtctgacgtcatttcagcattcctgtccaataatgatactcagaatctttcgtccccagtcacctttactttctcccacagatcagtaatcccaagacagaaggtcctgtgtgttttctgggagcatggtcagaacggctgtgggcactgggctacaactggatgttccaccataggcacccgcgacactagcacaatatgcaggtgcacccatctttcctcgtttgccgtcttgatggctcattacgacgtgcaggaagaagaccctgtgctaacagtaataacctatatgggcttgagcgtgtcgttgctctgcttactgctcgccgccctcacgttcctgctctgcaaagccatacagaacaccagtaccagtctgcatttgcagctctccttgtgccttttcctggcccatctactcttcctggttgcaatcgaccaaactggccacaaggtgttgtgtagtattatcgcgggtacattgcattatctctacttggccacactgacatggatgctgctggaagccctgtatctcttcttgacagcccgaaacctgacagtcgtgaactattcctcaatcaatagatttatgaaaaagcttatgtttcctgtcggctatggcgtcccagccgtcacggtcgcgatcagtgccgcctcccgtcctcacctgtatggaactccatcgcgctgttggctgcaaccagagaaaggtttcatctggggtttcttaggaccagtatgtgccatcttttctgtcaacctcgtgctgttcttagtcactttgtggattctcaagaacagactgagtagtcttaattcggaagtatcaactctgcgcaacacccggatgctggccttcaaagctacggctcagctgtttatcctgggctgcacctggtgcctagggatcctgcaggttggccctgcagcaagggtgatggcctacctttttactattattaactctctgcagggtgtcttcatctttcttgtttactgcctgcttagccaacaggtgcgtgaacagtacggcaaatggtctaagggcataaggaagctcaagaccgagtctgagatgcacacattgagcagtagcgccaaagctgacacctccaagcctagcacagtaaactag

SEQ ID NO: 41988 - DNA, 2046 bp, Artificial Sequence
  Description of Artificial Sequence: Synthetic coding sequence
atgggcggccgggtgttcctggtgttcctggccttctgcgtgtggctcacccttccgggagccgaaacgcaagactcccgtgggtgcgcaagatggtgccctcaggacagctcttgcgttaatgccacagcgtgccggtgcaatcccggcttttcttcatttagcgaaatcatcacaacccctatggagacctgcgacgatatcaatgaatgtgctactctgtccaaagtctcttgcgggaaattcagtgactgctggaataccgaagggtcatacgactgtgtctgctcccctggctacgagccagtgtcaggagcaaaaacctttaaaaacgaatccgagaatacttgtcaggacatgaccttctcgacatggacacctccaccaggcgtacattcacagaccctcagcaggttttttgataaggtccaggatctcggtagagattacaagcccgggctagctaataatactattcaaagcattttacaagcgttagacgaactgctcgaggccccaggcgatctggagacactgccaaggctgcagcagcattgcgtagcttctcacctccttgatggtctggaggatgtgctgcgtggtctctccaaaaacctgtccaatggacttttgaattttagctatcctgctggtactgaactgtcccttgaggtccagaaacaggttgatcggtctgtgaccctgagacagaatcaggcagtgatgcagttagactggaaccaggctcaaaagagcggcgatcctggaccgtccgttgtgggcctggtgtcaatcccggggatgggaaaattactggcagaagccccacttgtcctggaacctgagaaacagatgttgctccacgaaactcaccagggattactgcaggatggctcgccgatactgctttccgatgtcataagtgcctttctgtccaacaacgatactcagaacctgagttcgcctgtcacatttaccttctcacaccggtcagtcatccctaggcaaaaggtcctgtgtgtcttctgggagcacggtcaaaatgggtgcggtcactgggccacaactggatgctctaccattgggacccgtgacacatccactatctgccgctgtactcacttatcgagtttcgctgtgctgatggcccattacgacgttcaggaggaagatccagtgctgactgtgatcacgtacatgggcctctctgttagcctgctgtgccttctgctggccgcgctgacatttcttctgtgcaaggctatccagaatacatccacctccctgcacctccaactgagtctctgtctgtttttggctcatcttctgtttctggtggccatagatcaaaccggacacaaagtcctgtgtagcatcatagctggcactctgcactacctctatttggcgacattaacatggatgctgctcgaggctctatatctgtttctgaccgctcggaatctgaccgtagtcaactactcgtcaattaatagatttatgaaaaaattgatgttccccgtcggctatggcgtgccggctgtgacagtagccatatctgcagcaagcaggccacatctttacgggacccctagcaggtgttggctgcagcccgagaagggcttcatttggggtttcctggggccggtgtgtgcaatatttagcgttaaccttgtactgttcctggtaacgctgtggatcctcaaaaatcgcctttcttcacttaatagtgaagtctcgactctcagaaatacacgaatgctagcttttaaggccactgcccagctgttcatcctcgggtgcacctggtgcctgggcatcctgcaggtggggccggcggccagggttatggcctacctcttcacaatcataaacagcttgcaaggcgttttcattttcttagtgtactgtctactgtctcagcaagtaagggagcagtacggcaagtggagcaagggaattcggaagttgaagaccgagtcagagatgcacacgctctcctcctccgccaaagctgatacctcaaagccttcaactgtgaactag

SEQ ID NO: 41989 - DNA, 2193 bp, Artificial Sequence
  Description of Artificial Sequence: Synthetic coding sequence
atgggcggccgggtgttcctggtgttcctggccttctgcgtgtggttgacactgccaggggccgagacccaggattcccgggggtgtgcccggtggtgtccacaagactctagctgtgtgaatgctactgcctgtcggtgtaatcccggcttttcttctttctccgagataattactacaccaatggagacttgcgacgatatcaatgaatgtgccacactgtctaaggtcagctgcgggaaattcagcgactgttggaacaccgaaggcagctacgactgcgtgtgcagtcccgggtacgaacctgtatcgggcgccaaaacatttaagaatgagtctgagaacacatgtcaagatgtggatgagtgttcttccggacagcatcagtgtgatagttctacagtctgcttcaatactgtgggatcctactcatgtcgctgtcgacctggctggaaacctcggcacggtatccctaataatcaaaaggacactgtgtgtgaggacatgacattctccacctggaccccccctccgggagtacactctcagaccctttcccgcttcttcgacaaggtgcaggatctcgggcgtgattacaagccgggtctagctaataatactatccaatccatacttcaggctctggacgaacttctcgaggcgccgggggatctggaaaccctgccgaggctgcagcagcactgcgtagcgtcccatttattggacggactggaagacgtcttgcgaggactgtctaaaaatttgtccaatgggctgctcaacttttcgtaccccgccggtaccgagctcagcctagaagtccagaagcaggtggatcgcagtgtaacccttaggcagaaccaggccgtcatgcagctggattggaaccaggcccaaaagagcggggaccccggaccctctgttgttgggctcgtgagtattcctggcatgggtaaactgctggccgaggctcctctggtgcttgagcctgagaagcagatgctcctgcacgaaactcaccagggtcttctgcaggatggtagcccgattctgctttccgacgtgatatcagccttcttatctaacaacgacacgcaaaacctaagcagtcccgttacctttacatttagccatcggtccgtcatcccacgacaaaaggtgctgtgcgtgttctgggagcacggacagaatgggtgcggacactgggccacgaccggatgctccacgatcggcactagagatacctctaccatttgtcgctgtactcacctgagttcgttcgccgttctgatggcgcattacgacgttcaagaagaggatccagtgctcaccgttatcacgtacatgggcctctcggtctccttattatgtctgttgttggccgccctgacatttctgctatgtaaagccatccagaacacttctacatcattacacctgcagctgtccctatgccttttcctggctcaccttctatttctggtggctattgaccagaccggccataaagtcttgtgctccataatcgccggcactctgcactacctgtaccttgccactttgacctggatgctattggaagccctgtacctgttcctcacagctcggaacctaacggttgtgaattactccagcatcaacagatttatgaaaaaattgatgttcccagttggatacggtgttcccgcagtgaccgtggctatttccgctgcctcaagacctcacttatatggcacgccttctcgctgttggctccagcccgagaaggggttcatctggggatttttggggcccgtctgtgcaatcttttcagttaacttagtacttttcctcgtgactctttggatccttaagaatagattgagttctcttaatagtgaagtgtctaccctgcgaaatacacgaatgttggcctttaaggccaccgcccagctatttatcctggggtgcacctggtgtcttggtatacttcaggtaggacccgctgcacgcgtgatggcttatctctttacaattattaactccctgcagggagtgttcatttttctcgtgtactgcctgctcagccaacaggtgcgggaacagtacggaaaatggtcgaagggtattaggaagctaaagactgagagcgaaatgcacaccctgagttcatctgccaaagccgacacctccaaaccgagtacagtgaattag

SEQ ID NO: 41990 - DNA, 720 bp, Artificial Sequence
  Description of Artificial Sequence: Synthetic coding sequence
atgggcggccgggtgttcctggtgttcctggccttctgcgtgtggttaacgctccctggagctgagacccaggatagccgaggatgcgcgcggtggtgcccacaggattcatcctgcgttaacgcaacagcttgccggtgcaatcctggcttcagctctttctcggagatcatcaccaccccaatggaaacctgtgacgacattaacgaatgcgctactctttcaaaagtgagctgtggaaagtttagcgattgttggaataccgagggaagttacgactgcgtatgctcccccggatacgagccggtatctggagctaaaaccttcaagaatgagagtgaaaatacatgtcaggacgtcgatgagtgccagcagaaccctcggctgtgtaagtcatacggtacttgtgtgaatacactagggagttatacttgccagtgtttacccggttttaaactgaagcctgaggatcccaaactttgtaccgatgttaacgagtgcacatctgggcagaacccatgccactctagcactcactgtctcaacaatgtcggctcctaccagtgtcggtgccggcctgggtggcaacccatacccggctctcccaacggacctaacaataccgtgtgtgaggggagggaactgcggagccatgtgccacgcgacccgcaaacctccgatcacatgtttaatggcgctcacaccaaccaggccgagtag

SEQ ID NO: 41991 - DNA, 1140 bp, Artificial Sequence
  Description of Artificial Sequence: Synthetic coding sequence
atgggcggccgggtgttcctggtgttcctggccttctgcgtgtggttaaccctgcccggagctgagacccaagacagccgcggctgcgctaggtggtgccctcaagatagcagctgcgtgaacgccacagcatgtagatgcaacccaggatttagttcattctccgagatcatcacaacacccatggagacatgtgatgatatcaacgaatgtgcaactctgtccaaggtgagctgtggaaaattctccgattgctggaatacagaggggtcctacgactgtgtttgcagccccgggtacgagccagtgtcaggagcaaaaacattcaagaatgaatctgagaatacttgtcaggacgttgacgagtgccaacaaaacccaaggttgtgcaagagctatggcacatgcgtcaataccctgggctcctatacctgtcaatgccttcctggttttaaactcaagccggaagatcccaagttgtgcaccgacgtggacgagtgttctagcggccagcaccagtgcgactccagtactgtttgttttaatactgtggggtcgtacagctgtcgatgcaggcctggatggaagccgagacacggtataccaaacaaccagaaagacacagtgtgtgaggatatgacattttccacatggacgccaccacctggggtgcattctcagacattatcacgtttttttgacaaagttcaggacctgggacgtgactataaacccggactggccaacaacacaattcagagcatcctgcaggccctggacgaactgttggaggccccaggcgatttggagactcttccgcgcctgcaacaacactgcgttgcctcccatctcctggatggcctggaggatgtgctacggggtctgagcaagaacctaagcaacggcctgctcaactttagctaccccgctggcaccgaactcagcctagaagtgcaaaagcaggttgatagatccgtcacactacggcagaatcaggccgtcatgcagctggattggaatcaggctcaaaagtcaggagatcctggcggcgggagtcgggctgactgtcaccatctgcatggcgccgaacggctttcagccgtgcctccccctggtggacctcatttttccccagtctag

SEQ ID NO: 41992 - DNA, 678 bp, Artificial Sequence
  Description of Artificial Sequence: Synthetic coding sequence
atgaccttcagcacctggacccccccccccggcgtgcacagccagacgttgtcccggttcttcgacaaagtccaagacttaggaagggattataaaccaggcctcgcaaataatacaattcagagtattctgcaggccctggacgaactgctcgaagcacccggcgatttggaaactctcccccgcttgcagcagcattgcgtggcttctcatctgttagatggactggaggacgttcttcgtggactctccaagaacttaagcaacgggctcctgaacttctcctatcccgctggcaccgaactgtctttggaagtacagaaacaggtcgataggagcgtgacactgaggcaaaatcaggccgtgatgcagctggattggaaccaagcccagaagtctggcgaccccgtctcagaccctgaaactgaaggagccctttgtctgttaggggcgtggccagagtggatgtggagcctcggacaccatcgattgcagcacaaccgccatcagcggcaccagcaccacctgccattgcatccccccgagcagctgtgcagaccacacgggcctctacgatgcgcggggggcggttccagagccgactgccaccacctccacggtgccgagagactctccgccgtgccccccccagggggcccacactttagccccgtctag

SEQ ID NO: 41993 - DNA, 2298 bp, Artificial Sequence
  Description of Artificial Sequence: Synthetic coding sequence
atgggcggccgggtgttcctggtgttcctggccttctgcgtgtggctgacactccccggagcagaaacacaggatagtcgaggatgcgcaaggtggtgcccgcaggatagctcctgcgtaaatgccaccgcttgccggtgcaaccctgggttttctagcttcagcgagatcattaccacccccatggaaacgtgtgatgacattaatgagtgtgcgactctatctaaggtttcttgcgggaagttctctgattgctggaataccgaagggtcatacgactgcgtgtgttccccgggctatgagccagtgtcaggcgcaaagacctttaagaacgaatccgagaacacctgccaggacgtcgacgaatgccagcagaatccacggctatgcaagtcttatgggacatgcgtaaacacactggggtcatacacctgccaatgtctcccagggttcaagctcaaacccgaggatccaaaactgtgcactgacgtgaatgaatgtacatctggtcagaatccctgccattcttctactcattgcctgaataatgtgggcagttatcagtgtcgatgccggccagggtggcagccaattcccggatccccaaacggtccaaacaacaccgtgtgtgaagacgtggatgaatgctcgtctggccaacaccaatgtgatagcagcaccgtgtgttttaatactgtgggaagctattcttgccgatgtaggcccggttggaagcctcggcacggcatccccaataaccagaaggataccgtgtgcgaggacatgacatttagcacctggactccccctccaggggtacactctcagacgttatccaggttcttcgacaaggtgcaagatctgggccgggattataaacctggtctcgccaacaacaccattcaaagcatcctccaggctctggacgaactgctggaggcacccggggacctggaaaccctccctagacttcaacagcattgtgtggctagccatctccttgatggtcttgaagatgtgctgcgcgggttgtcaaaaaacttaagcaatggtttgctgaatttctcctaccctgctggtaccgagctatccctggaggtgcaaaagcaggtagaccggtcggtgaccctgcggcagaatcaggcagttatgcagctggattggaatcaggcccagaagtctggagatcccggacccagcgtagtggggttggtgagcatccctggcatgggaaagctccttgctgaagcccccctggtgttggaacccgaaaaacagatgctgctgcatgaaactcatcagggtctcctgcaagacggctctcccatcctactgtcagatgtcatctcagcgtttcttagcaataatgacacacagaacctgtcgagcccagtaaccttcacattttctcacagagaagaggacccagtcttgactgtgattacttacatgggcctctctgtctcattgctgtgtctgctgctagccgctctcaccttcttgctgtgtaaggctattcagaacacctccacttccctgcacctacagctgtcattgtgtctgttcctagcccaccttctttttctggtggcaattgaccagactggccacaaagttctgtgctccatcattgccggaacccttcactacttgtacttggctacccttacatggatgcttcttgaggccctctatttgtttctgacagcccgcaacttgacagtagtgaactatagcagtatcaatagatttatgaagaagcttatgtttccagtaggctacggggtacccgccgtgacggtggcaatatccgcagcatcaaggccccatttatacgggacaccgagccgctgctggctccagccagaaaagggcttcatctggggttttctcggtccagtgtgtgctattttctcggtcaacctggtactttttctggttacgctctggatcttgaagaataggctgtcttctctgaattctgaggtgagcactctgcggaacaccaggatgctggccttcaaggcgacagcacagttgtttatattgggatgtacctggtgcctgggaatcctccaggtgggacctgctgctagggtgatggcctacctcttcaccataataaactctctccagggcgtgttcatctttctggtttactgtctcctatctcaacaggttcgagagcagtacggcaaatggtctaagggtatcaggaagctaaaaaccgaaagtgaaatgcacacactctcttcatccgctaaagccgatacttctaagccatcgactgtgaactag

SEQ ID NO: 41994 - DNA, 2439 bp, Artificial Sequence
  Description of Artificial Sequence: Synthetic coding sequence
atgggcggccgggtgttcctggtgttcctggccttctgcgtgtggctcaccttacctggcgctgaaacccaggactccaggggatgcgctagatggtgccctcaagacagctcttgcgtcaacgcaaccgcatgcagatgcaatccaggtttctcaagttttagcgaaatcattactaccccaatggaaacatgtgacgacattaatgagtgtgcaacgctctctaaggtgagttgtggtaagtttagcgattgttggaataccgaggggtcttacgactgtgtctgctcgccaggctacgaaccagtttcaggagcaaagacttttaagaatgagagtgagaatacctgccaagacgtggacgaatgtcagcagaacccccgcctgtgtaaatcatatggaacttgtgtcaacaccctcggcagctatacctgccagtgccttccaggcttcaagcttaaacctgaggacccgaagttatgcacggacgtgaacgaatgcacatctggacaaaatccttgtcacagttctacccactgcctcaacaatgtcggatcttatcagtgccggtgccgccctggatggcaacctatccctggcagccccaacggcccaaacaacaccgtgtgcgaagatgtggacgagtgctcaagtggccagcaccaatgcgactcctctaccgtgtgctttaataccgttggaagttactcatgcagatgccgacccggctggaagcctagacacggaatccccaataaccagaaggacacagtttgcgaggatatgaccttttccacctggactcctccaccaggcgtccattcacagaccctttcccggtttttcgataaggtacaggacctgggccgggactataagccaggcctggccaataatacaatccaatcaatccttcaggcactggacgagctgcttgaagcgccaggggacttagaaactctgccacgacttcaacagcattgcgtcgcctcccaccttctcgacggcctggaggacgtgttgaggggcctgtccaaaaacctctctaacgggttgcttaacttctcatacccagccggcactgagctgtctcttgaagtccaaaaacaagtcgacagaagcgtgaccctgagacagaaccaggctgtcatgcaactcgattggaaccaggcacaaaaatcgggggacccagggatgggtaaactgctggcggaagcgcccctagtgttggagccggagaaacagatgttgcttcatgagactcatcagggcctactgcaggacggcagtccgattctgctctcggacgtcattagcgcattcctaagcaacaacgacacccagaacctgagctcacctgtgacatttacattcagccaccgttccgtgataccccgtcagaaggtgctgtgtgtcttttgggaacacggccaaaatgggtgcggccattgggccaccacagggtgctcaactatcgggactagggacactagcacaatttgtaggtgcacccatctatcaagtttcgccgtgcttatggctcattatgacgtgcaagaggaagaccctgtgttaaccgtgatcacatacatggggttgagcgtttccctgctgtgccttcttctggccgccttaacatttcttctgtgcaaggccattcagaatacaagcaccagcctgcatctccagctatctttgtgccttttcctggcccatcttctgtttttggttgccattgatcaaactgggcataaggtgttgtgttcaattattgcaggaaccttgcactatttgtatcttgccacgctcacatggatgctcctggaggccctctaccttttcctgaccgctcgcaacctaaccgtggtcaattattcatctattaacagattcatgaagaagctaatgtttccagttgggtatggcgtgcccgctgtcactgtggccatttccgcagccagcagacctcatctctatggtaccccatcccgttgttggttgcagcccgagaaggggtttatttggggtttcttagggcccgtctgcgccatcttctccgtaaatctcgtactcttcttagtgacactatggatccttaagaatcgcctgagctccctcaattccgaagtgtcgactctgcgtaatactaggatgttggccttcaaggccaccgcccagctgttcattcttgggtgtacctggtgtcttggtatcctgcaggtgggtcctgcagctagggtcatggcatacctcttcaccattatcaatagcctgcagggtgtgttcatattcctggtgtattgtttactgtctcaacaagtgcgggaacagtacggtaaatggagcaagggaatccggaagttgaagacagagtctgaaatgcacaccttgagctcctccgccaaagctgatacatcaaagccttcaacggttaactag

SEQ ID NO: 41995 - DNA, 2874 bp, Artificial Sequence
  Description of Artificial Sequence: Synthetic coding sequence
atgtacggcagcgcccggaccatcaccaacctggagggcagcccctccaggagtccacgcctgcctagaagtcctcgattgggacacaggcgcacctcgtctggggggggtggaggcacagggaagacactgagcatggaaaatattcagagcctgaatgcagcgtatgctaccagtggaccaatgtacttgtccgaccacgagggcgttgcgagcacaacctacccaaagggcactatgaccctgggtagagctacgaatagagccgtgtatgggggccgtgtaactgcaatgggcagctcacccaatattgcctcagccgggttgtcccacaccgacgttctgtcatacaccgaccagcacgggggtctcacaggttcgtcccatcatcaccatcaccaggtgccttcaatgctcagacaggtcagggatagtaccatgctcgacttacaggcacagctgaaggagttgcagcgggaaaatgatctcctgaggaaagagctcgacatcaaagactctaagctagggtcatccatgaattctatcaagaccttctggagtcctgaacttaaaaaggagagagtgttgcgcaaggaagaggcggctcgcatgtcagttctgaaagaacagatgcgggtatcgcatgaagaaaaccaacacctgcagcttactatacaggcacttcaggatgaactcaggacgcagagagacctaaaccatctgctacagcaggagtccggaaacaggggcgctgagcacttcacaatcgagctgactgaggagaacttcagacggctccaggccgagcatgacagacaggctaaagagctgtttctgctgagaaaaaccttagaggagatggagttacgcatcgagacacagaagcaaaccctcaatgcccgggatgagagtattaagaaactgctcgaaatgttacagagcaaaggcctgccctccaagtctctcgaagatgacaacgaacggactagaagaatggctgaggccgagagtcaggttagtcatctcgaagtaatccttgatcaaaaggaaaaagagaacatacacctgcgcgaagaactgcaccggcggagtcagctgcagccagaacctgccaaaaccaaagctctccagacagtaatcgagatgaaggacacaaagattgcaagccttgagaggaacatccgggatctggaggatgagattcagatgttaaaggccaacggagttctgaacaccgaagatagagaggaagagatcaaacagatagaagtttataagagccacagcaaattcatgaagaccaagatcgatcagttgaagcaagaattgtctaaaaaggagtccgagctcttggccctccaaaccaaactggaaaccttaagcaatcaaaatagcgactgcaagcagcacatcgaagttttaaaagagtccctgactgccaaagagcagcgagccgccatcttgcagacagaagtggatgcgcttcggttgcgattggaagagaaggaatcctttctgaacaaaaaaacaaagcagttgcaggaccttacagaagaaaagggcactttggccggggagattcgggatatgaaagacatgctggaagtgaaagaaagaaaaattaatgtcctccagaaaaagatcgagaacctgcaagagcagttgagggacaaggacaaacagctcaccaatctaaaggaccgcgtgaagagcctccagaccgacagttcaaatacagacactgcgctggccacgcttgaggaggccctgagcgagaaggaacggattattgagcgcctcaaagaacagagggagagggatgacagagagcgtctggaggaaattgaaagcttcaggaaggagaataaggacctgaaggagaaagtgaacgcgctgcaggcagagctcacagaaaaggagagcagcttaatcgatctgaaagagcacgcttcctctttggcctccgccggtctaaaaagagactctaaactgaaatccttggaaatcgcaattgaacaaaagaaggaagagtgttctaagctggaggctcagctgaaaaaggcacacaatatcgaagatgatagtcggatgaaccctgagtttgcagatcagataaagcaattagacaaggaagcttcctattatcgcgatgagtgtggtaaggcccaggctgaagtcgatcgactcctcgaaatccttaaagaggtggagaatgagaagaacgataaagacaaaaaaatagccgaactggagtctctaactctgcggcacatgaaggaccagaataagaaagtcgcaaatctcaaacacaaccaacaactggagaaaaagaagaatgcccagttactggaggaggtgcggcggcgtgaagattcaatggccgacaactctcagcacttgcagatagaagagctgatgaacgccctggaaaagacaaggcaggagctcgacgccactaaagctcggctggctagcacccagcagagcctggcggaaaaggaggctcaccttgctaatttgaggattgagaggcggaagcagctcgaggagattttggagatgaagcaggaggctctactggcagccataagcgagaaggatgccaatattgctctgttggaactgtctgccagcaaaaagaagaagactcaagaggaagttatggccctcaagcgtgagaaggaccggctggtgcaccaactcaagcagcaaacacagaacagaatgaaactcatggcagacaactatgacgatgatcaccaccactatcaccatcatcatcatcatcatcatcaccgatcccctggtagatcccagcactctaatcaccgcccatccccagatcaggacgacgaagaagggatatgggcctag

SEQ ID NO: 41996 - DNA, 2874 bp, Artificial Sequence
  Description of Artificial Sequence: Synthetic coding sequence
atgtacggcagcgcccggaccatcaccaacctggagggcagcccctcacgttctcctagactgcctcggagccctaggctcggccacaggcggacgtcctctggtggggggggcggaaccggcaaaaccttgtccatggagaatatacagagcctcaacgcagcgtacgccacatccggaccaatgtatctttctgaccacgaaggcgtggcctccaccacttatcctaaaggcaccatgaccctagggagagccactaaccgagccgtttacggcggacgggtgactgccatgggatcttccccaaatattgcttccgctggcctgagtcacacggacgtgctgagttacaccgaccagcatggaggcctgactggctcaagccatcatcatcaccatcaggtcccttccatgctgaggcaggtccgtgactccaccatgttggatttgcaggcccagctgaaagagttacaacgtgaaaacgacctcctccggaaagagctcgacatcaaggacagtaaactggggagcagtatgaattctatcaagaccttttggagcccagagttaaaaaaagagcgtgtactgaggaaggaagaagcagcccggatgagcgttctgaaggaacagatgcgagtctcccatgaggagaaccaacacctgcagctgaccatccaggctctgcaggatgagctacgtacccagcgcgacttgaatcacttgttacagcaagagtcggggaaccggggcgccgaacacttcaccatcgaactcacagaggaaaacttcagaagactgcaggcagaacacgatcggcaagccaaggaactttttctgttacgtaaaaccttagaggaaatggagcttcgaattgaaacacaaaaacaaacattgaacgctagagatgaatccattaaaaaactcctggagatgctccagtctaaggggttgcctagtaaaagtctggaggatgacaatgaacgaacaaggcgcatggccgaagctgagtcgcaggtcagccacctggaggtcattctcgatcaaaaagaaaaggagaatatccatctcagggaggagctgcatagaaggtcccaacttcagcccgagcccgcgaagaccaaagctcttcagaccgtgatcgagatgaaggacacgaagatcgcctccctcgagagaaacatccgggacttggaagatgagatacagatgctgaaagccaacggggtgttgaacaccgaagaccgagaagaagaaatcaagcagattgaagtttacaagagtcattctaaattcatgaagacaaagattgatcagctgaagcaggaacttagcaagaaggagtcagaacttctcgcactgcagactaaattagaaacactgagcaaccagaacagcgactgcaagcagcatattgaggtcctaaaagagagcttgaccgccaaggagcagagggccgccatcttgcagactgaggtggacgcacttaggctaagactcgaagaaaaggagtcctttctgaacaaaaagaccaagcagctgcaggatcttacagaagagaaaggcacacttgcaggcgagatccgagacatgaaagacatgctggaagtcaaggagaggaaaattaacgtcctgcaaaagaagattgaaaatctgcaggaacaactgcgcgacaaggacaagcagttaacaaacctaaaggatagggtcaagagcctgcagaccgactccagtaacaccgatacagccctggccaccttggaggaagctctttcggagaaagagcgcatcattgagcgccttaaagagcagcgcgagcgcgatgatagagaacgtcttgaagagatcgagtctttcaggaaagaaaacaaggacctgaaggaaaaggtaaacgctctgcaggctgagttaactgagaaagaatcttcactgattgatttaaaagagcacgcttcatccctcgcctctgctggtctgaagcgagactccaagttgaaatctctcgagatcgctattgaacagaagaaagaggagtgctctaagctggaagctcagctgaagaaagctcataacattgaagatgatagtcgtatgaatccggagttcgctgatcagatcaagcaactcgataaggaagcctcctactacagggatgaatgtggaaaggcgcaggcagaagtcgacaggcttctggagattcttaaagaagtggaaaatgagaagaacgataaagataagaagatcgcagagctggaaagcctgactttaagacatatgaaagaccagaacaagaaggtagcaaatctgaaacacaatcagcagttagaaaaaaagaaaaacgcacaactgttagaggaggtccgccgtagagaggactcaatggctgacaactcccagcacctccagatcgaagagctgatgaatgcattagagaaaacccgacaagagctggatgcaaccaaggcccgcctggcttcaacccagcaatccctggcagagaaagaagctcacctcgccaacctgcgtatcgaacggcgcaagcagctggaggagatcctggaaatgaaacaggaggccttgctggcggccatcagcgagaaagacgcgaatattgcactgctagagctgtcagcttcaaagaaaaaaaaaactcaggaggaagttatggcgctcaagagggagaaagaccgacttgtacatcagctaaaacagcagacccagaaccggatgaagctgatggccgataattacgacgatgaccaccatcactatcaccatcatcatcatcaccaccaccataggagccctggacggtcccagcactccaaccatcgcccctcccccgaccaagacgatgaggaagggatctgggcatag

SEQ ID NO: 41997 - DNA, 1587 bp, Artificial Sequence
  Description of Artificial Sequence: Synthetic coding sequence
tgacggagccagctgcagcccgagcccgccaagaccaaggccctgcagacagtgattgagatgaaagatactaagatcgccagcctcgaacgcaatatcagggatcttgaggacgaaatacaaatgctaaaggccaatggggtcttgaataccgaagatcgcgaagaagagatcaagcagattgaggtatataagtcccactccaagttcatgaagacaaaaattgatcagttgaagcaggagctgtcaaagaaggaaagcgaactgctcgctctccagaccaagttggaaacactaagtaaccagaactccgactgtaagcagcatattgaggtccttaaggaatctctgactgctaaggaacagagggcggccatcttgcagaccgaagtggatgccttaagactaaggctggaagaaaaggagtcttttctcaacaagaagacaaaacagctgcaggacctgaccgaagaaaagggtactctggcaggcgagatccgggatatgaaggacatgctggaggtcaaggaacgcaagatcaatgtactgcaaaagaagattgagaatttacaagaacagttgcgtgacaaggataagcaattgaccaatttaaaagatcgggtcaaaagtcttcagactgactcttcaaacactgatactgctctggcgaccctcgaagaagccctgtcagaaaaggagagaataattgagagactgaaagagcagagggagagggacgatcgtgaacgcctggaagagatcgagtccttcaggaaagagaataaagacctcaaggagaaggtcaacgctctgcaggctgaactcactgaaaaagaatcatcactgatcgaccttaaagagcatgcttctagcctagcgtctgcaggtctgaaacgggactcaaaacttaagagcctcgagatagccattgaacaaaaaaaagaggagtgttctaaactcgaagcacagcttaaaaaacaggccgaacagctgtttaatcagatgtataaccccgcccacaatatcgaagacgacagccggatgaaccccgagttcgccgaccagataaagcaactggacaaggaggcttcatactatcgggacgaatgtgggaaagcacaagctgaagtcgataggctcctggagatccttaaagaggtcgagaacgaaaaaaatgacaaggacaagaaaatcgctgaactggaaagacatatgaaggaccagaacaaaaaagtcgctaacctgaagcataatcagcagctggagaagaagaaaaacgcacagctccttgaggaggtgagacgacgtgaggattctatggcagataactcccagcatctgcagattgaggaactgatgaatgcccttgagaagacaagacaggagttagacgctacaaaggccaggctggcttccacccagcagagtctggccgaaaaagaagcacatctggctaatctaagaatagagcgccgcaaacagctggaagagatccttgaaatgaaacaggaagcgctcctggcggctatcagtgagaaagatgccaatatagcactacttgaactctccgcctcaaaaaagaaatag

SEQ ID NO: 41998 - DNA, 984 bp, Artificial Sequence
  Description of Artificial Sequence: Synthetic coding sequence
atgcgggccctgcccggcctgctggaggcccgggcccggaccccccgactgctactgctgcagtgcctgctcgcagctgcgaggccctcatctgctgacggaagcgccccagactcacctttcacatctccccccttgcgtgaagagatcatggccaacaatttcagcctagagtctcataacatcagcctgacggagcattctagcatgcctgttgagaagaacattaccctggagcggccatccaatgttaaccttacatgtcagttcacaacctctggcgacctgaatgccgtgaatgtgacctggaagaaagatggagaacagttggaaaataactacctcgtaagcgctacgggctccacattgtatacgcagtaccgcttcaccataatcaatagcaagcaaatgggctcctacagctgtttttttagggaagagaaggaacagcggggtaccttcaattttaaggtgcccgaactgcacgggaaaaacaaacctttaataagctacgtaggagattctactgtcctgacatgtaaatgccagaactgcttcccgctgaactggacctggtattcctcgaatggtagcgtcaaggtgccagttggcgtccagatgaacaagtacgtcattaatggaacatatgcgaacgagacgaaactgaagatcacccagcttctcgaggaggacggagagtcgtactggtgtagagccctgttccagttaggagagagtgaagagcatattgagctagtggtgctctcctacctggtgcccctgaagcccttcctcgttatcgtcgccgaagtgatcctcctagtggcaactattctgctatgcgagaagtatacccaaaaaaaaaagaagcattcagacgaagggaaggagtttgagcagatcgagcagctgaagtcagatgacagcaacggcattgagaataacgtaccgagacacagaaagaacgagtctctcggccagtag

SEQ ID NO: 41999 - DNA, 621 bp, Artificial Sequence
  Description of Artificial Sequence: Synthetic coding sequence
atgggcgccgagtgggagctgggcgccgaggccggcggcagcctgctgctctgcgctgcattacttgcagcaggctgcgccctgggcctcagactgggacgcgggcagggcgccgcggacaggggagcccttatctggttatgttacgatgcgctggtacattttgccttggagggccccttcgtttatttgagtctcgtcggcaatgttgctaacagtgacggcctcatcgcatctctgtggaaagaatatggcaaagccgacgcacgatgggtgtatttcgatcccaccatcgtctctgtggaaattttaacggttgctctggatggcagcctggcccttttccttatctatgcgattgtcaaggaaaagtactatcgtcattttctgcagattaccctgtgtgtatgcgaattatatggctgctggatgacgttcctcccagagtggttaacgcgctcccccaatcttaacacaagtaattggctgtactgctggctgtatctctttttcttcaatggtgtatgggtgcttatcccgggtttgttgctgtggcaaagctggcttgaattgaaaaaaatgcaccagaaggagacatcttccgttaagaaattccaatag

SEQ ID NO: 42000 - DNA, 261 bp, Artificial Sequence
  Description of Artificial Sequence: Synthetic coding sequence
atgggcgccgagtgggagctgggcgccgaggccggcggcagcctgctgctctgtgctgcactcctggccgcaggctgtgccctcggactccgtctggggcgcggacagggagcggccgacaggggagcattgatatggctgtgttacgacgccctagttcacttcgccctcgagcgagtcggcaagacaaccaaccaggaatctgcgggtgtgctggggagcacagagtggaacttcaagaacacagacaagctgttgtag

SEQ ID NO: 42001 - DNA, 1257 bp, Artificial Sequence
  Description of Artificial Sequence: Synthetic coding sequence
atggccaccagcgagcagagcatctgccaggcccgggccagcgtgatggtctacgacgatacatcaaagaagtgggtgccaataaagcctggacaacagggattcagccgcattaatatataccacaatacagcaagcaacacatttagggtggtgggggttaaactccaggaccagcaggtcgtgataaattattctatcgttaagggactcaagtataaccaggctaccccaaccttccaccagtggcgtgatgctaggcaggtttacgggctgaactttgcatcaaaagaagaagcgaccactttcagtaacgccatgttatttgcgttgaacatcatgaactctcaagaaggcggaccatccagccaacgccaggttcagaatgggcctagtcctgacgagatggatattcagaggcgccaagtaatggagcaacaccaacaacagagacaggagtcattagagcggaggacctctgctacagggccgatcctaccacccggccacccgtcttcagcggcttctgccccagtgtcttgttcggggcctccccctcctcctcctcccccagtcccccccccccctacaggcgcgactcctccccctcctccccccctgcctgctggaggtgctcagggaagctcccatgatgaatcctctatgtcaggtctagctgcggcgatcgcaggtgccaagcttcggagagtacagagacctgaggatgctagtggaggctcatccccctcaggaacttctaagagtgatgcgaatcgggctagtagcgggggtggcggaggtggactgatggaagagatgaataaactgcttgccaagaggaggaaagctgcctctcagagcgacaaacccgctgaaaagaaggaagacgaatcccagatggaagatccctctacctcaccatctccggggacacgggctgcctcacagcctccaaattcatccgaagccgggagaaaaccatgggaacgcagtaattctgtcgaaaaacccgtgtcctctatattgtccaggactccttccgtcgctaagtcccctgaagcaaagagccccctacaaagccagccacactcacggatgaagccagcaggatccgtcaatgacatggcgttggacgcgttcgacctcgatcggatgaagcaggaaatcctggaggaagtcgtgcgggagctgcacaaggtaaaggaggaaattattgacgctatcaggcaagaactctcaggcataagtacaacctag

SEQ ID NO: 42002 - DNA, 1251 bp, Artificial Sequence
  Description of Artificial Sequence: Synthetic coding sequence
atgagcgagcagagcatctgccaggcccgggccagcgtgatggtgtacgatgataccagtaagaaatgggtacctataaagcctggtcaacagggattcagccgtattaacatctaccataatacagcctccaacacattcagagtcgtaggcgtgaaactgcaagaccagcaggtagtcattaactactcaatcgtgaaaggtctgaaatataatcaagccacccctacgttccatcagtggagggacgcacggcaagtttacggcttgaactttgcctctaaggaggaggcaaccactttttcaaacgcgatgttgttcgccttgaacatcatgaactcacaagaaggcggtccgagttcacagcgccaggtacagaacgggccctcccccgatgagatggatatccagcgacggcaagttatggagcagcaccaacagcaacgacaagagtcactggagcggagaacctctgctaccggtccgatcctccctccaggacatccctcatcagcagcctcagctccggtttcttgtagcgggcctccaccaccgcctccccctcccgtccctcccccacctaccggagcgacaccacctccccctccaccgctccccgctggcggggcacaggggtccagccacgacgaaagcagcatgtccggactggcagcagccatagcaggcgctaagctccgtcgagttcagaggcccgaggacgcgagcggtgggtcaagtccctctggcacgtctaagtccgacgcaaatcgggccagcagcggagggggggggggaggactcatggaagaaatgaacaaactgctggctaagcgcaggaaggccgcttctcagtctgataagccagcagagaagaaagaggatgagtctcagatggaggacccttcaacgagcccgtcacccggcacacgggcggcgtcgcagccacctaatagctccgaggccggtcggaaaccatgggagcgatcgaacagcgttgaaaagccagtaagctctatacttagtcgtaccccatctgttgccaagagccccgaggcgaaatcccctctccagagccagccacattcccggatgaagccggccggaagcgtgaatgacatggcattagatgcattcgacctcgatcggatgaagcaagagatcttggaagaagtggtgcgcgagttgcataaggttaaggaagaaatcattgacgccattcgtcaagagctttccgggattagcactacttag

SEQ ID NO: 42003 - DNA, 1146 bp, Artificial Sequence
  Description of Artificial Sequence: Synthetic coding sequence
atggccaccagcgagcagagcatctgccaggcccgggccagcgtgatggtttacgatgatacctcaaaaaaatgggtgccaataaaaccaggccaacaggggttctcccgaataaatatctatcacaatacagcatctaatacttttagagtcgtcggggtgaaacttcaggaccagcaggttgtgatcaattattccattgtgaaagggttaaagtacaaccaggccacgcctacttttcaccagtggcgagacgcgcggcaagtctatggtttgaatttcgcctccaaagaagaagcaacaacgtttagtaacgcaatgttatttgctttaaatatcatgaattcacaagagggaggtccttcctcccagaggcaagtgcaaaacgggccctcaccagacgaaatggacattcagcgcaggcaggtgatggagcagcaccagcaacagagacaggaaagtctcgagagaagaacgtctgctacaggaccaatcctccctccaggccatccttcgtccgccgccagtgccccggtctcatgctcaggagctccaagtggactggccgccgccatcgccggcgctaaactgagacgcgtgcagaggcccgaggatgcgagcggaggtagtagcccctccggaacctccaagtctgatgccaatcgtgcatcttcaggcggaggtggcggcgggctgatggaggagatgaacaaactgttagctaaaagacggaaagcggccagccagagtgataagcccgcggaaaaaaaggaggatgaaagccaaatggaggatcctagcactagtccttccccaggtacaagggcagcaagccagcctcctaattcttctgaagccgggaggaagccatgggagaggtctaattctgtggaaaagcctgtctcttcaatactgtcacgcacaccctccgttgccaagagtccagaggccaagtcacccctccagtctcagccacactcacgtatgaagcccgcaggcagcgtgaatgatatggctctcgacgcattcgatctcgaccgaatgaagcaagagattttggaggaagttgttcgggagctccacaaagtgaaggaggagattatcgatgctatcagacaggagctgagcggcatcagcactacatag

SEQ ID NO: 42004 - DNA, 1173 bp, Artificial Sequence
  Description of Artificial Sequence: Synthetic coding sequence
atgttcgccttcgaggagttcagcgagcagagcatctgccaggcccgcgcctctgtgatggtctatgatgacactagcaaaaaatgggtccccatcaaaccgggacagcaaggtttcagccgcattaatatctaccacaataccgcgtccaacacttttagggtagtgggagtgaagcttcaagaccaacaggtggtgataaactactcaatcgtcaagggtctcaagtacaaccaggctacccctacttttcatcagtggcgcgatgccaggcaagtgtatggcttgaactttgcaagcaaagaagaagctaccacgttctcaaatgccatgctgtttgctctcaatatcatgaacagtcaagagggagggccaagctctcagaggcaagtccagaatggaccgtcccctgatgagatggatattcagagacgccaagttatggagcaacaccaacaacaaagacaggagtctctcgaacgccgaaccagcgctacaggacctatccttccaccagggcacccgagctctgctgcgtcagccccagtgtcttgctctggacctccccccccaccccctcctcctgtcccccccccccctacaggcgccacccctccacccccaccaccactgcccgcaggtggcgctcagggttcctcacacgatgaatctagcatgtctgggctggctgctgccatagcaggcgccaagcttcgtagggtccagcgccccgaggatgcctccggaggcagttctccttcaggcacctccaaatccgatgccaaccgggcaagctcaggaggggggggcggcggtctcatggaggaaatgaataagttactggccaagagacgcaaggctgcctcccaaagtgacaagcccgcagaaaagaaggaagacgagtcgcagatggaagacccatcaaccagtccatccccaggcaccagagccgccagtcagccccccaactcctctgaggcaggacgaaaaccctgggagcgatccaactcggtcgaaaagcccgtaagctccatattgtctagaacaccatccgtcgcgaagagcccagaagccaagtcaccgctacaatcccagccacacagccgatacaggacaacacttctgctgacttgcccgcctggattcggcgcccctttgagtcccgttccatag

SEQ ID NO: 42005 - DNA, 639 bp, Artificial Sequence
  Description of Artificial Sequence: Synthetic coding sequence
ccccccccccccccccccgtgccccccccccccaccggcgccaccccgcccccacctcccccattacccgctgggggggcacaaggctcatcccacgacgaaagctcaatgagtggactcgctgctgcgattgctggtgctaagttaaggcgcgtgcagaggcccgaggatgcatcagggggttctagtccctctggtaccagtaaatccgatgccaacagagccagtagcggtggtggcggcggaggtctgatggaagaaatgaacaaactgctggctaaaagaaggaaggctgcctctcaaagtgataaaccagcggagaagaaagaggatgaaagccagatggaggacccatctaccagcccttcaccaggaactcgagccgcttcccaacctcctaactcctccgaagctggacggaaaccatgggagaggtccaacagtgtggaaaagcctgtgtcttccattctttcccggatgaagccagcaggtagtgtcaacgatatggccctcgatgctttcgacctggatcggatgaaacaggagatactggaagaggtggtccgtgagttacacaaggtaaaggaggaaattatagatgctatccggcaggagttgtcaggcatttctaccacctag

SEQ ID NO: 42006 - DNA, 1617 bp, Artificial Sequence
  Description of Artificial Sequence: Synthetic coding sequence
atgggcctgctgctgctggtgctgatcctgacccccagcctggccgcgtaccgtcacccagactttccactgttggagaaagcacagcaactgctccagagtacaggaagtccctactccactaattgttggctttgtactagcagctccacagaaactcctggcaccgcctacccagcttccccacgcgaatggacctctatcgaggcggagttgcacattagttaccgctgggacccaaatttaaaaggcctcatgcgacccgctaactctcttttgagtaccgtgaaacaggattttccagatataaggcaaaaacctccgatcttcggacccatattcactaacatcaaccttatgggtattgcccccatttgcgtaatggcaaaacgcaaaaatggtacgaacgtgggaaccctcccctccacagtgtgtaatgtgacttttacagtggactccaatcagcagacttatcagacatatacacacaatcagttcagacatcagccaagattcccaaaaccgcccaatataacgttcccccaggggaccttgctggacaagtcatcccgtttctgtcaagggcggccctcctcgtgctccacccgtaatttttggttccgtcctgccgattacaatcagtgtctccagatctccaacctttctagcacagctgagtgggtcctgctcgaccagactcgcaatagcttattctgggaaaataagactaaaggagccaaccagagtcagacgccatgcgtgcaagttctggctggtatgacaatcgctacttcataccttggaataagcgccgtgtcagagttctttggcacatcactgacaccactgttccattttcatatctccacttgtctcaaaactcagggtgcattttacatttgtggacaatcgatccatcagtgtctgcccagcaactggaccggtacctgtactatcgggtacgtgacacctgacattttcattgccccaggcaacctgagcttaccaatcccaatatacggcaattccccactaccgagggtgaggcgcgcaatccacttcattccactgctagcagggctggggatcctcgccggaacaggaacaggcatcgcgggcatcacaaaagcgagtcttacttactcacagctcagcaaggagatagctaataacattgacactatggccaaggctttgacaaccatgcaggaacagatcgactctctggcagccgttgtgctgcaaaatagacgcgggttggatatgttgacggcggcccagggtggcatctgtctggcccttgacgaaaagtgctgcttctgggtgaatcagtctggcaaggtccaggataacattcgtcagctacttaaccaagcgtctagcctcagagagagggccacccaggggtggttgaattgggagggcacttggaagtggtttagctgggttctgcccctgacaggacctctcgtatctctcctgctgctgctgcttttcggcccatgtctgttgaatttaatcacccaattcgtcagcagccgtctgcaggctattaagctacagaccaacctgagcgcagggcgtcatcccaggaatattcaggaaagccctttttag

SEQ ID NO: 42007 - DNA, 1617 bp, Artificial Sequence
  Description of Artificial Sequence: Synthetic coding sequence
atgggcctgctgctgctggtgctgatcctgacccccagcctggccgcatacaggcatccagatttccctcttctagaaaaagcgcaacagctgctgcaatcaaccggctctccttactccacaaattgctggctttgcaccagttcgagtactgaaacccctggtacagcctaccctgctagccctcgcgagtggaccagcatagaggcagaacttcacattagctatcggtgggatccgaacctgaaaggtctgatgagacccgcaaacagcctgctcagcacggtcaaacaagacttcccggatatcagacagaaacccccaattttcgggccaatttttactaacatcaatctgatgggtatcgcccccatttgtgtaatggccaaacgcaaaaatggtacaaacgtgggaacgttaccttctaccgtgtgtaatgtgaccttcacagtcgactcaaatcaacaaacatatcaaacatacacacataatcagttccgacaccagccaagatttcctaaaccacccaatatcacattcccgcagggtacacttctggacaaatcctccaggttctgtcagggaagaccatcctcctgttctactcgcaatttttggtttaggcccgccgattacaaccagtgtctgcagattagcaacctcagctcgacagcagagtgggtgctgctagatcagacacggaactccctgttctgggagaacaaaaccaagggtgcgaaccagagccagacaccttgtgtccaggtgctggccggaatgaccattgctacctcttatctagggataagcgccgtgagtgagttttttggtacatccctgacacctctgtttcatttccacatttctacctgcctcaagactcagggggccttctacatctgtgggcagagcatccaccagtgcctgccctccaattggactggcacctgcaccatagggtatgtgactcccgatatcttcatcgcaccgggcaaccttagcttgccaatccctatttacggaaattcgcccctcccacgggttcggcgcgcaatccatttcatacccttacttgccgggctgggaatattggccgggacaggcaccggcatcgccggtatcaccaaagcttcattgacatatagccagctgagcaaagaaattgcgaacaatattgacactatggccaaggcactgaccaccatgcaggagcaaattgattctcttgcagccgtggtactgcagaatagacgaggactcgatatgttgactgccgcccagggcggaatatgcctggcattggacgagaagtgctgtttctgggtgaaccagtccgggaaagtgcaagataacatcagacaattactcaaccaggcgtccagtctcagggagagggctacacagggatggctgaattgggaggggacctggaaatggttttcttgggtgttgcccctcactggaccactcgtcagtctgctcctcctgctcctgttcgggccctgtctcctcaatcttattacacagtttgtgtctagcagacttcaggcaatcaagctccagactaatctatctgccggccggcacccaagaaacattcaggagtcacctttctag

SEQ ID NO: 42008 - DNA, 1617 bp, Artificial Sequence
  Description of Artificial Sequence: Synthetic coding sequence
atggccctgccctaccacatcttcctgttcaccgtgctgctgcccagctttaccctgacagccccaccgccatgccgctgtatgacatctagctcaccctatcaagaatttctgtggcggatgcagcggcccggtaacattgatgccccttcctaccggtccctgagcaaaggcacacctacattcaccgctcatactcacatgcctcgaaactgctaccatagtgccacgctttgtatgcatgccaatacccattattggaccggcaaaatgattaatccctcctgcccggggggtctcggggtgacagtttgctggacatatttcactcagactggaatgtcagatggcgggggcgttcaagaccaggctcgagagaagcatgttaaagaagtgatctcccagctgactcgcgtccacggaacatcttccccatataaaggcttggacctgtccaagctgcacgagactctgcgcactcacacaaggttagtcagtcttttcaacaccacacttacaggactccatgaggtgtccgctcagaaccctaccaactgctggatttgtctgccgttaaactttagaccttacgttagtatccctgtccctgaacaatggaacaatttttccacagagatcaataccactagcgtgctggtgggacccctcgtctcaaatctggaaatcacacacacctctaatctgacgtgtgtcaagttcagcaatacaacttacacgactaactcccagtgtatccggtgggtgactcctcccacacagatcgtctgtctgccttctgggatcttcttcgtttgcggcacctctgcctatcgatgtcttaatggaagttccgagagcatgtgcttcctttctttcctcgtgcctcctatgaccatctacactgagcaggatctgtacagctacgtgataagcaaacctcggaacaagagggtgcctatactcccatttgtcattggcgcaggcgtgctgggagcactgggcaccggaattggggggatcacaacttcgacccagttttactataagctgtctcaggagttgaatggcgacatggaaagggttgccgattcacttgtaacccttcaggaccagctcaactccctcgctgcagtggttctgcagaatagaagggcactagacctactgactgcagagcgaggtgggacctgcttgttcctgggcgaagagtgctgttactacgttaaccagtctggaatcgtgaccgagaaggtgaaggaaattagggatcggatccagagacgcgctgaggaacttcgtaatacagggccgtggggactcctatctcaatggatgccttggattctccctttcttgggccccctggctgcgattatactgctgttgttatttggcccctgtatctttaaccttctggtcaacttcgtgagctcgaggatcgaagcagttaaattgcagatggaacctaaaatgcagagtaagacgaagatctaccgcagacctctggacagaccagccagccccagatctgatgtgaacgatatcaagggcacgccacctgaggagatttctgccgcccaacccctcctgcggcctaactctgcaggctcttcttag

SEQ ID NO: 42009 - DNA, 1710 bp, Artificial Sequence
  Description of Artificial Sequence: Synthetic coding sequence
atgggcagcaccctgggctgccaccggagcatcccccgggaccccagcgacctgtcacatagcagaaagtttagtgctgcttgtaatttttccaatattttagtgaaccaggagcgcctcaacataaatacagcgaccgaggaggagctgatgaccctgcccggagtgacgcgcgctgtcgcacgaagcatcgttgagtatcgtgagtacatagggggcttcaaaaaggtggaggacctggctctggtttctggggtcggcgcaaccaaattagagcaagtcaaattcgagatttgcgtcagcagcaagggcagttccgcccagcattccccgtcgagccttcgccgagacctgctcgccgagcagcagccacatcatcttgcaacagccgtgcccctgaccccaagagtcaatatcaataccgctaccccggcccagttgatgtccgtgagaggcctctctgaaaagatggctctgtctatcgtcgatttcagacgggaacacggcccatttcgctcagtcgaggacctggttcgcatggatggaattaatgcagcgttcctagaccggattaggcaccaggtgttcgcagagaggagtcggcccccatcaacccacaccaacggtggactgaccttcacagccaaaccacaccctagcccgacatcgctcagtctgcagagcgaggacctggatctgccacccggcggacccacgcagatcatttccactcgcccatccgtcgaggccttcggcgggacacgcgatggtcgaccagtcctccgattagccacttggaaccttcagggatgctccgttgagaaggccaacaatcccggtgtgagggaggtggtatgcatgacgctgttggaaaatagtattaagctcttggccgtccaggaacttctagatcgggaggctctcgagaagttttgtactgaactaaaccagcccactttgcccaatatccggaagtggaagggaccaaggggctgttggaaagccgtggtggccgagaagccatcctcccaactgcagaaaggggctggctacgccggattcctctgggacgcggcagccggtatggagctgagagatgctggatcccaggagtcgtcaccctccaacggccacggcaagctggccggtcccagtccgtatctggggaggtttaaagtcggctctcatgacctgaccttggtgaacctacacctcgcagccttgacgctgctggggtcagaaaacccctccaagaatcactctgacggccaccggctagccagctttgcccagacactgcaggaaaccctgaagggtgaaaaagatgtcatcattctcggcgattttggacagggacctgatagcaacgactacgacatcctcagaaaggaaaagttccatcatctgattccagctcacacatttacgaacatcagtacaaaaaatccacagggcagtaaatctcttgacaatatctggatctccaaatcactcaaaaaagtattcactgggcattgggctgttgtccgagagggattaactaacccctggatccccgataactggtcctggggcggcgttgcttcagagcactgtcctgtcctggccgagttttataccgaaaaggactggagtaagaaggacgctcccaggaacggcagcggcgtggccttggaacggagcgaggccaatattaaacacgagagatag

SEQ ID NO: 42010 - DNA, 1710 bp, Artificial Sequence
  Description of Artificial Sequence: Synthetic coding sequence
atgggcagcaccctgggctgccaccggagcatcccccgggaccccagtgacttgagccactcccgcaagttttccgctgcctgcaacttttcaaacatccttgtgaaccaagagcgactgaacattaacaccgcgaccgaagaggaactgatgaccctcccaggggtgaccagggccgttgcgcggtcaattgtggagtatcgggagtatataggggggttcaaaaaggtggaagatcttgccttggtgtcaggggtgggtgcgactaagctggagcaggtgaaattcgaaatttgcgtgtcttccaagggcagcagtgcccagcactcccctagctccctgcgcagggacttgctagcagaacagcaacctcaccacctggctaccgccgtgcccctcacgcccagagtcaatattaatactgcgacacccgcacagctcatgtctgttagagggcttagcgagaagatggccctgtccattgttgactttaggagagaacacgggcctttccgttccgtggaggacctggtccggatggacgggataaacgccgcgtttctggaccgcatcaggcaccaggtgtttgctgaaaggtctaggccccctagcacgcacaccaacggcggactgaccttcacagcgaagcctcacccctctcccaccagcctgtccttgcagtcggaggatttggatttgccccctggaggacctacacagattatttctacccgtccctctgtggaagcatttggggggacaagggacggaagacccgtactccgcttggccacctggaacctccaggggtgtagtgttgaaaaagcaaataatccgggagttcgagaggtcgtatgcatgacactcttggagaactcaattaaactcctcgcggtacaggagttgttagatagagaagctctcgagaagttctgcaccgaattaaaccaacctaccctaccgaacatcagaaagtggaagggtcccagaggatgctggaaggctgttgtcgctgaaaagccatcttcccaacttcaaaagggtgcgggatacgccggctttctgtgggacgctgcagctggcatggaactgcgtgacgccgggagccaagaatcctcacctagcaacggtcacggcaaactcgccggaccatctccctatctaggtagatttaaagttggatctcacgacttaacattggttaatctgcatctcgcagctctcactttactcggctccgaaaatccctccaagaatcacagcgatgggcacaggcttgctagctttgcgcagaccttgcaggaaacactgaaaggggaaaaagacgtgattattttgggcgattttggtcagggccccgattccaacgattatgacatactccggaaggaaaagtttcaccatctgatcccagcacacacgtttacaaacattagcaccaagaacccgcagggctctaagtcattggataatatttggatttccaagagcctgaagaaagtctttacgggccattgggctgttgtgagggagggattaacaaacccctggattccagataactggtcatggggtggggttgcttctgagcattgtccggtcttggctgaattttatacagaaaaagattggtcaaagaaggatgctccgcggaacggatctggagttgcactggaaagatcagaggccaacatcaagcacgaacgctag

SEQ ID NO: 42011 - DNA, 822 bp, Artificial Sequence
  Description of Artificial Sequence: Synthetic coding sequence
atggaggccgcccccagccggttcatgttcctgctgttcctgctgacttgcgagcttgctgcggaggtggccgcagaagtggaaaaaagctcagacggaccaggcgctgcccaggaaccaacctggttgacagatgtcccggccgcaatggaatttatcgccgcaactgaagttgccgtaatcgggttctttcaagatctcgaaatccccgctgtgcctattctgcattctatggtgcaaaagttccccggggtttcattcggcatttctacagattccgaggtgctaacacactacaacatcacaggcaacactatttgtctctttcggctcgttgataacgaacagcttaacttagaagacgaggatattgagtcaatcgacgcaactaagctgtcgcgatttatcgagatcaactctttgcatatggtgaccgaatacaatcccgtaactgttataggccttttcaactctgtaattcagatccacctgctactgattatgaataaggctagcccggaatacgaggagaacatgcaccgctaccaaaaggcagcaaagctgttccaaggcaagattctttttatcctcgtggactctggcatgaaagaaaacggtaaggtgatttcatttttcaagctcaaggaaagccaactgcccgccttagccatttaccaaaccctggatgacgagtgggataccctcccaaccgcagaagtgtcggtggaacatgtccagaacttctgcgacggattcctctcaggcaaactgttgaaagagaacagggaatcagagggcaagaccccaaaggtggagttgtag

SEQ ID NO: 42012 - DNA, 2934 bp, Artificial Sequence
  Description of Artificial Sequence: Synthetic coding sequence
atgcccgcccggcggctgctgctgctgctgaccctgctgctgcccggcctgggcatcttcgggtcaacatcaacagtgacattgccagaaacattacttttcgtgtctaccctcgacggcagcctgcacgccgtgtccaaaaggaccggaagcattaagtggacactgaaggaggaccctgttcttcaggtgcccacacatgtggaagagcccgcattcctgcccgatccaaatgacggctctttatatacgctcggaagcaagaacaacgagggcctgacaaagctgccgttcacgatccctgagctggtgcaggctagcccttgccgctcatcagatggtatcctctacatgggaaaaaaacaagatatctggtacgtgatagatctcctcacgggcgagaagcagcaaacactgtcgagcgcattcgctgatagtctttgtccgtctacttcactgctctatctgggtagaactgagtatacaattactatgtatgacaccaaaactagggaactccggtggaacgccacatatttcgactatgccgcgtctctgccggaggatgatgtcgactataagatgagccacttcgtgagcaacggcgacggacttgtggttacagtggacagtgaaagcggcgacgtgctgtggattcaaaactatgcctctccagtagtggccttttatgtctggcagcgagaaggtctacgcaaagtgatgcatatcaatgtggctgtggagacccttaggtatttgacatttatgtcaggggaagtcggacgaatcactaaatggaagtatccatttccaaaagaaacagaagccaaatcaaaactgacaccgacactctacgtgggaaaatacagcacctcactgtacgcctcgcccagcatggtgcatgagggcgttgcagtagttcctcgaggctcaacgctgcccctcctcgagggtcctcagaccgatggggtcacaatcggtgacaagggggaatgtgttattacgcccagcactgacgtgaagttcgaccccgggctgaagagcaaaaataaactgaattaccttcggaactattggttactcatcgggcatcatgagactccactgtccgcttccaccaagatgctggagagatttccaaataatctgcccaagcatagagaaaatgtgatacccgcagactccgagaaaaagtctttcgaggaggtgattaaccttgtcgatcaaacctccgagaacgcacccactaccgtaagcagggacgtcgaggaaaaacctgcacatgcacctgccagaccagaagctcctgtcgatagcatgctcaaagacatggccaccataatactctcgactttcctgctgatcggttgggtcgcgttcatcatcacgtatccactgagtatgcatcagcaacagcaactgcagcaccagcagttccagaaggagttggaaaagatccagctcctgcaacagcagcagcagcagttaccattccaccctccgggtgatacggctcaggatggagaactcctcgacacctctgggccttacagcgagagtagcggtacgagttctcctagcacaagtccacgggcttccaatcactcactttgcagtggatcaagcgcgagcaaagcggggtcctcccccagtctggagcaagacgatggtgacgaagagacctccgtcgtaatcgtaggtaagattagtttttgtcccaaggatgtgcttggacacggagctgagggtaccattgtttaccggggcatgtttgataatcgcgacgtagccgttaagcggattctgcctgagtgttttagttttgccgatcgcgaagtacagctgctccgcgagtcagacgagcaccctaacgtgattaggtatttctgcacagaaaaggatcgccagtttcagtatatcgctatcgagttgtgcgccgccaccctgcaggagtatgtggagcagaaagactttgcccatcttgggctggaacctataaccctgctccaacaaacaactagcgggcttgcacatctgcactcgttgaatatcgtgcacagggatctgaaaccccataacatcttgatttcaatgccgaatgctcacgggaagatcaaggccatgatctccgactttggtctgtgcaagaagctggctgtgggacgccattctttcagtaggaggtctggcgttcctggcactgaggggtggattgcccctgaaatgctgagcgaggactgcaaggagaaccctacctatacagttgacatcttcagtgcaggatgcgtgttttactatgtcatttccgagggaagccacccattcggaaaaagcctgcagcgccaggctaacatcctcttgggcgcatgtagcctggactgcctgcaccctgagaaacacgaggacgtcatcgcacgagaactgatagagaagatgattgcgatggaccctcaaaaacggccatcagcaaaacacgtgctgaaacacccttttttctggagcctcgagaagcaactgcagttcttccaggacgtgtccgacagaatcgagaaggagtcactcgatgggccaattgtgaagcagttagaaaggggggggcgcgccgtagtgaaaatggattggagagagaatattacggtgcctcttcagacagacctccggaaattcagaacgtataaaggaggaagcgttagagatctgcttcgagctatgcgcaacaagaagcaccactatcgcgagttgcccgccgaggtccgcgagacgctgggtagtttgcctgacgacttcgtctgttatttcaccagtaggtttcctcacttattggcacacacctaccgagcgatggaactctgctctcacgaaagactctttcagccatactactttcacgagccccccgagccccaacccccagtcaccccagatgccctctag

SEQ ID NO: 42013 - DNA, 873 bp, Artificial Sequence
  Description of Artificial Sequence: Synthetic coding sequence
atgcccttcgacttccggcggttcgacatctaccggaaggtgcccaaggacctcactcagccaacgtacacaggcgctatcataagtatctgttgttgcctcttcatcctgttcctgtttctgagcgaactgacggggttcattacaactgaagtagtgaatgaattatatgttgacgaccccgataaggacagcggcggcaagatcgacgttagtctgaacatatctttgcccaacttgcactgtgagctggtgggtctggatatacaggacgagatgggccgccatgaggtagggcacatcgacaattccatgaaaatccctttgaacaacggggccgggtgcaggttcgaggggcagttctcgatcaataaagtcccaggtaatttccacgtctccacccacagcgcaacagctcagccccagaatcctgacatgacccacgtgatccacaagctgtcgttcggcgacacactacaggtgcagaacatccacggcgccttcaacgctctcgggggagccgataggctcacctccaatcctctggcatctcatgactacatcctgaagattgtgcctaccgtctatgaggataagagtggcaagcaacgctactcttatcagtacaccgtggcaaataaagagtacgtagcctacagccacaccggacgcattatccccgccatttggtttcgatatgacctgtcccccatcaccgttaagtacaccgagcgcagacagccgttgtatcggttcatcaccaccatctgcgctatcattggcggaactttcactgtggcgggaattttagatagctgcattttcaccgcttcagaagcatggaaaaaaatccagctgggaaagatgcactag

SEQ ID NO: 42014 - DNA, 108 bp, Artificial Sequence
  Description of Artificial Sequence: Synthetic coding sequence
tgatgcagcaccgccaacggcgagaaggacagcatcaccctgatcagcatgaagaacattaatatgaataacggcaagcagtcccttagtgccgagaaggtcctgtag

SEQ ID NO: 42015 - DNA, 219 bp, Artificial Sequence
  Description of Artificial Sequence: Synthetic coding sequence
atgggcaccgccggcgccatgcagctgtgctgggtgatcctgggcttcctgctctttaggggccataattcgcagcctaccatgacacaaactagtagttcccaaggcggacttgggggtctgagcctcactactgagccagtgtcaagtaaccccggttatattcccagctcagaagctaaccggccctcacacctgtcctctacaggtaccccctag

SEQ ID NO: 42016 - DNA, 768 bp, Artificial Sequence
  Description of Artificial Sequence: Synthetic coding sequence
atggccagccccggcgccggccgggccccccccgagctgcccgagcggaactgtggctacagggaggtcgagtattgggatcagagataccagggagccgccgactcagctccatatgattggtttggcgacttcagttcatttcgtgcactgctcgagccggaactacggcctgaggacagaattcttgtgctggggtgcggaaatagcgctctgtcttacgagctgtttttgggtggattcccgaatgtaaccagcgtcgattatagctcggtcgttgtggctgcaatgcaggcacgccacgcccacgttcctcagcttaggtgggagaccatggatgtgcgaaaactggattttcccagcgcctcatttgatgtagtgctggagaagggtacgttggatgcattgcttgccggggaacgcgacccttggacagtctccagcgagggggtgcatacagtggatcaggttctgtctgaggtgagtagggtgttagttccgggaggccgctttatcagtatgacaagtgctgccccgcactttagaacgaggcattacgcgcaggcttactacggatggagtctgagacatgccacttatggcagtggattccatttccacttgtatctcatgcataagggcgggaaactgagcgtcgcccagttggcacttggagcgcagattctgagcccgccaagaccaccaacctctccttgttttctgcaggattccgatcatgaggattttctttcagccattcagctgtag

SEQ ID NO: 42017 - DNA, 2211 bp, Artificial Sequence
  Description of Artificial Sequence: Synthetic coding sequence
atgaacgtggccctgcaggagctgggcgccggcagcaacgtgggcttccaaaaaggaaccaggcagttgctgggcagtagaactcagctcgagcttgtgcttgcaggggcttccctgctccttgcagctcttctattaggatgtcttgtggccctgggcgtccagtaccaccgagacccatctcatagcacatgtctaacagaggcttgcataagagttgccggtaaaatccttgaatctctggatcgcggagtgtccccctgcgaggatttttatcagttcagctgcgggggatggatccgcagaaatccgctgcccgacggtcgatctcgatggaacactttcaacagcttatgggatcagaaccaggccattttgaagcacctcctggagaataccaccttcaactccagttccgaggccgaacaaaagactcagagattttacttgagttgcttgcaggttgagagaattgaagagttgggcgcacagccactaagagatctcatagagaagattggcggatggaacatcacagggccatgggaccaggacaactttatggaagtcctcaaggctgtcgctgggacctaccgagcgaccccattcttcaccgtatacatcagcgccgacagtaagtcttctaattccaacgtgattcaagtggaccaaagtggtcttttcttaccctccagggattattacctgaatcgcaccgctaacgagaaagttcttacagcttatctagactatatggaggaactcggcatgttgctgggcgggcgcccaaccagcacgcgagaacaaatgcagcaggtcctcgaactcgagatccagctggccaatatcactgtgccacaggatcaacgccgcgacgaggaaaagatttatcataagatgtctatctctgagctgcaggctctggccccgtctatggactggctcgaatttctgtcattcttactctcccctctggagcttagcgacagtgagcccgtcgttgtctacggaatggattatttgcaacaggtgtcagaactgattaaccggacagaaccctccatccttaataattacttaatctggaatttggtgcaaaagactaccagctcactggatagaagattcgaaagcgctcaggaaaaattgctggagacactgtatggcactaagaagtcttgcgtacctagatggcagacgtgcatttcaaatacggatgacgcgctgggtttcgcgctgggctcgctctttgtgaaggctaccttcgatcgacagtccaaagagattgcagagggcatgattagcgagatcagaaccgctttcgaggaggccttaggacagctggtctggatggacgaaaagacccgccaggccgctaaggaaaaggccgatgcgatctatgacatgattggctttccagacttcattctggaaccaaaggagctggacgacgtatatgacggctacgagatatccgaggattcttttttccaaaatatgctaaacctgtataatttctctgctaaagtgatggcagaccaactgcgcaagccgccctctagagaccagtggtcgatgaccccccagacggtcaatgcatactacctccctaccaagaatgagatcgttttccctgctggtatcctccaggccccgttttatgcaagaaaccaccccaaagcgctgaattttggtggtatcggggttgtcatgggtcatgagctcactcatgcgttcgacgaccagggcagagagtacgataaggagggaaatctgaggccttggtggcagaatgagtctctggctgcctttagaaaccacacagcgtgtatggaggaacagtacaaccaataccaggtcaatggcgagcgcttgaatgggcgccagacactgggagaaaacattgccgataatggaggactcaaagcggcctacaacgcatacaaagcatggctgaggaagcacggcgaggagcaacagcttcccgctgtgggcctaactaaccaccagctgtttttcgtaggcttcgcccaggtgtggtgtagcgtccgaacccctgagagcagtcacgagggattagtcacggacccccattccccggctaggttcagagttctaggaacgttaagcaatagcagggattttctcagacatttcgggtgtccggtcggctcacctatgaatcctggccagctgtgtgaggtttggtag

SEQ ID NO: 42018 - DNA, 2652 bp, Artificial Sequence
  Description of Artificial Sequence: Synthetic coding sequence
atggccagccccggcgccggccgggccccccccgagctgcccgagaggaactgcggctaccgggaagtggaatattgggaccagcgttaccaaggcgcggcagactcagctccttatgattggttcggcgacttttcgtcgtttcgagctctgttggagcctgaactgaggccagaagatcggatcctggtcctgggctgtggaaatagtgcgttgtcctatgagctgtttctggggggcttccctaacgttacttccgtggactactcgtccgttgtggtcgccgccatgcaagcccgtcatgcccacgttcctcagctgaggtgggaaactatggacgtgaggaagctcgacttcccaagcgcaagcttcgacgtggtgttggagaagggcaccctagatgcactgctcgcgggcgagcgggatccttggactgtgtcatcagagggggtccacacagttgatcaagttctctctgaagtgggatttcagaaggggaccagacagcttctcggctctcggacacagctcgaattagtccttgcaggggcctctctgctgctggcggccctactgttgggctgtctggtggcactgggggtccagtatcatcgagaccccagccactctacatgtctgactgaagcctgcattcgtgttgcaggaaagatcctggaatctctggacaggggagtgtccccctgcgaagatttctatcagttcagctgtggcgggtggatccgtagaaatcctctgcctgacggcagaagccgatggaacacattcaatagcttgtgggaccagaatcaggccattctgaaacacttattggaaaacaccaccttcaacagctcatctgaggcagaacagaaaacgcaaaggttctacttgagctgtctgcaagtggaaaggatcgaggaactgggcgcacagcctcttagagacttgatcgagaaaatcggtggctggaacatcacaggtccctgggatcaggataatttcatggaagtgctaaaggccgtggccggaacttatagggcaactccgttctttacagtttacatctctgccgattcaaagtcctcaaacagtaatgtgattcaggtggatcagtccggtctgtttctgccctcccgggattactacctcaatcgcaccgccaacgagaaagtccttactgcatacctggattacatggaggagctgggcatgctcttaggggggcgtccaacttcaacccgggagcagatgcagcaggtgttggagcttgagattcagctggccaacatcactgtgcctcaagaccagaggcgggacgaagagaaaatatatcacaagatgagtatatctgagcttcaggctctggcccctagtatggactggctggagtttctttcttttctgctaagtcctctggagctaagtgacagcgagccagtggtcgtttatggtatggactacctgcagcaggtgtccgaactcattaatcgtacggagccatctatactgaataactacctgatttggaatctggttcaaaaaaccacatcatcactcgatcgccggttcgagtctgcccaggagaagctgctggaaacattatatggcaccaaaaaatcatgcgtcccccgctggcaaacctgcatttccaacacggatgacgccctgggattcgctctggggtcactttttgtgaaggccacattcgataggcagtcaaaagagatcgctgaagggatgatctctgagattcggacagcctttgaggaggcccttggccagttggtttggatggacgaaaagaccaggcaagcagcaaaagaaaaggcagatgcgatttacgatatgattgggttcccggacttcattcttgagccaaaggaactggacgatgtgtatgacggctacgagatttctgaagattccttttttcagaacatgttgaacctttataatttttctgctaaagttatggccgaccagctgaggaaacccccaagccgtgatcaatggagcatgactccccagaccgtgaatgcttactacctccccacaaagaatgagatcgttttcccagcaggaattctgcaagctcctttttatgcgcgtaatcatcctaaggccttgaactttggtgggatcggggtagtaatgggccatgaattgacccatgctttcgatgaccaagggcgggaatatgacaaggagggaaatttaagaccctggtggcagaacgagagcctggccgcatttagaaaccacactgcctgcatggaggagcagtacaatcagtatcaggtgaacggcgagcgccttaacgggcgccagacgctgggtgagaatattgcagacaatggcggcctgaaggcagcgtataacgcatacaaggcttggttgcgaaagcatggcgaagaacagcagctgccagccgtaggcctgaccaatcaccagctcttcttcgtcggattcgcacaggtgtggtgctctgttcgcactcccgaatcctctcatgaagggctcgtaaccgacccccactcgcctgcccgatttagggtccttgggactctatcaaactcccgcgattttctccggcactttggctgtccagtagggtcccccatgaatcccggccagctgtgcgaagtgtggtag

SEQ ID NO: 42019 - DNA, 2298 bp, Artificial Sequence
  Description of Artificial Sequence: Synthetic coding sequence
atgaacgtggccctgcaggagctgggcgccggcagcaacatggtggagtataaaagggctactctacgagacgaggatgcccccgagactcccgtcgaggggggggcgtcccctgatgcaatggaagtagggttccagaaagggaccaggcaactgcttgggtctcgaacgcagttggaactggtgttggctggtgcatcactgctccttgccgcattgctcctgggttgtttggttgctttgggcgtgcaataccaccgcgatcccagccacagcacctgcctgaccgaagcatgtattcgggtagccgggaagattttggaatctttggatcgtggcgtgtctccctgcgaagatttttatcagttttcttgtggaggttggatcagacgaaaccctctcccagatggacggagtcggtggaatacctttaactctttatgggaccagaatcaggctattttgaagcatttgctggagaatacaacctttaattcatcctccgaggctgaacagaagactcaacggttttacctcagttgtctgcaggtcgagagaattgaggagcttggcgcccagccactgagggacctgatcgagaaaataggggggtggaatattaccgggccctgggatcaggataatttcatggaggtccttaaggccgtggcagggacctatcgggccacacctttctttactgtgtacatttccgcagacagtaaatccagcaactccaacgtaatacaggtggaccagtccggcctattcctgccgtctcgagactactatcttaaccgtacagcgaacgagaaagtcctaaccgcctacctggactacatggaagaattggggatgctgctgggcggcagacctacctctactagggagcagatgcagcaggtattggaattagaaatacagctggctaacatcaccgtcccccaggatcagcggagggacgaagagaagatttaccacaaaatgtccatttccgagctccaggccttggcaccatcaatggactggttggaatttttgtcattcctgctgtcacctttggagctgagcgattcagagccagttgtggtttacgggatggactacttacagcaggttagcgagctaattaacaggactgaaccttcaatcttgaacaactacttaatttggaatctggtacagaaaaccacctcatctttggaccggaggttcgaatctgcccaggagaaactgctggaaaccttgtatggaactaagaaatcatgcgtgcctagatggcagacctgcatctctaacaccgatgacgccctcggcttcgcactgggcagtctgtttgtgaaggctaccttcgaccggcagtccaaagaaatcgcggaagggatgataagtgaaattaggacagcttttgaagaagcattaggacagctggtgtggatggatgaaaagacgcgtcaggctgccaaagagaaagctgacgctatctacgacatgattggttttcctgatttcattcttgagccaaaagagctggatgacgtatatgatgggtacgaaatcagcgaagatagcttttttcagaacatgctgaacctttacaatttttccgccaaggtgatggcagaccagttgcggaaaccacctagcagggaccaatggagcatgaccccgcagaccgtcaacgcatattatctgcccacgaaaaatgagatcgtgttcccagctggaatattgcaggcgcctttctatgctcgcaatcatccaaaggcccttaactttggaggtattggggttgtcatgggtcacgagttgactcacgccttcgatgaccagggccgagagtacgacaaagagggaaatctaagaccttggtggcagaacgagtcgttggcagcctttcggaaccacacagcctgcatggaagaacaatacaatcagtaccaagtcaacggagagcggctgaatggaagacagactctgggggagaatattgcagataacggtggacttaaggcagcttataacgcttacaaagcttggctgcggaaacatggagaagagcaacagttaccagccgtaggcctaacaaatcaccagctattctttgtggggtttgctcaggtatggtgcagcgtaaggactccggaaagctcacacgaaggcttggtaactgatcctcactctccagctcgttttcgcgtcttaggaaccctgtctaattcgcgggactttctccgacacttcggctgtcccgtggggagccccatgaatcctgggcaattgtgcgaagtatggtag

SEQ ID NO: 42020 - DNA, 2436 bp, Artificial Sequence
  Description of Artificial Sequence: Synthetic coding sequence
atgaacgtggccctgcaggagctgggcgccggcagcaacatggtggagtacaaacgagctactcttagagacgaagacgcccccgagacacccgtggaaggcggggcgtctcctgatgcgatggaggtggggaagggcgcaagcccctttagtccgggaccctctccaggtatgactcctgggacacccaggagctccggactgttttggagagttacctgtcctcacctgagatccatttccgggttgtgttcccgcaccatggtaggcttccaaaagggcaccaggcagctgctcggctcacggacacaactcgagcttgtcctggctggcgcatcactgctgctcgccgccctcctgttgggatgtctggtcgccctgggcgtgcagtaccaccgagacccaagccactccacctgtctgaccgaagcttgcatccgagtcgctgggaaaattttagaaagtctcgatcgcggagtgtcaccatgcgaggacttctatcagttcagctgcgggggctggatcagaagaaaccccttgcccgacggcagatctagatggaatacattcaactctctgtgggaccagaaccaagccattttaaaacaccttctggagaataccacatttaactccagcagcgaggctgagcaaaaaacccagagattctacctcagctgcctccaggtggagcggatcgaggaactgggggcccagcctctcagagacctgattgagaagatagggggatggaacatcaccggaccgtgggaccaggacaatttcatggaggtactgaaagctgtggcaggaacatatcgggctactcccttcttcaccgtttacatctcagctgactcaaaatcgagcaattctaatgtaattcaggtggaccaatcagggctgtttctcccttcaagggactattacctgaataggaccgccaacgagaaggtcctcactgcttacctcgactatatggaggaactcgggatgctcctgggaggcagacccactagcacccgcgaacagatgcagcaagtcctggaacttgagatccagctggcaaatattaccgtccctcaagatcagaggagagacgaggaaaaaatttaccacaaaatgtccatcagcgagttgcaggctttagccccatctatggactggctggaatttctgagctttctactcagtcctcttgagctgtccgactctgagcctgtcgtggtgtatgggatggactatcttcagcaggtgagcgagcttatcaacaggaccgaaccgtcaatcctgaacaattaccttatttggaatttggtacagaagacaacttcttctcttgacaggagatttgaaagcgcccaggagaagctccttgagacattatatgggaccaagaagtcttgtgtgcctcgctggcaaacgtgcatcagtaacaccgacgacgcactcggcttcgcgttaggatcactgttcgttaaggcaacgtttgatcggcaatccaaagaaatcgctgaggggatgatcagcgaaatccgcacagcgttcgaggaagccctgggacaattagtctggatggacgagaagacgaggcaggccgccaaagagaaagcggacgctatatacgatatgattggctttcccgatttcattctggagcctaaggagctggatgacgtgtatgatgggtatgagatctctgaagactcgtttttccaaaatatgctcaacctgtataacttctctgccaaggtcatggctgatcagctccggaagccaccttctcgggaccaatggagcatgacaccacagacagtgaatgcttactacctgccaactaagaacgagattgtgtttccggcgggaattttacaggccccattttacgcccggaaccatcctaaagcgctcaatttcggcggcatcggggtcgtaatggggcacgaactgacacatgccttcgacgatcagggccgggagtacgacaaagagggaaacctgcggccatggtggcagaatgagtctttggctgcattccgaaatcacactgcgtgcatggaagagcagtataaccagtatcaggttaacggcgagaggcttaacggtaggcagactttgggcgaaaatatcgcagacaatggcggcttgaaagccgcctacaacgcatataaagcctggcttcgcaagcacggggaagagcagcagctgccggctgtggggctgactaatcatcagttgtttttcgtggggttcgcacaagtgtggtgttctgtcaggacacccgaaagtagccacgagggattggtcacagacccgcacagtccggctcgctttcgcgttctgggcacccttagcaactcaagggactttctgcggcactttggctgtccagttggatcccctatgaatccagggcaattgtgtgaggtgtggtag

SEQ ID NO: 42021 - DNA, 786 bp, Artificial Sequence
  Description of Artificial Sequence: Synthetic coding sequence
atgctgcgggtgctgtgcctgctgcggccctggcggcccctgcgggcgcgcggctgcgcaagcgatggggcggcaggcgggagcgagatccaggtgcgtgctctggccggacccgaccaaggtatcacggagattttaatgaatcgcccctcggcacgaaatgcattgggcaatgtttttgtgagtgagctgctggaaacattggcccagctgcgggaagatagacaggttcgggtgttattatttagaagtggtgtcaagggtgtgttttgtgcgggagctgacctcaaggagcgtgaacagatgtcagaggccgaagtcggagtcttcgtgcaacggcttcgcgggttaatgaacgacatcgcttcttcggccgtaatgggattgattgagaccacccgtggcctactgccaggagctggtggaacacagcggctgcctagatgtctgggagtcgccctggccaaagagctgatttttacaggccgacgtttaagcggaacggaggcacatgtgctgggcttagtcaaccacgccgttgcccagaatgaggagggcgatgcagcataccaaagggcaagggctctagctcaggagatcctgcctcaagctcctattgctgtccgacttggcaaagtcgcgatcgacagggggaccgaagtcgatatcgcaagtggcatggcaattgagggaatgtgctacgcacagaatattcccactcgtgaccggttggaggggatggctgcatttagagaaaagcggactcctaaattcgtaggcaagtag

SEQ ID NO: 42022 - DNA, 879 bp, Artificial Sequence
  Description of Artificial Sequence: Synthetic coding sequence
atgctgcgggtgctgtgcctgctgcggccctggcggcccctgcgggcccgaggatgcgcctctgatggggcggcaggaggctctgaaatacaagtgcgcgccctcgcgggccccgatcaggggattacagaaatcctgatgaacagaccctcagccaggaacgctttgggaaacgtatttgtttctgagctcctggaaaccctagctcagttgagagaagaccggcaggtgagggtcttgctattcagatcgggagttaagggagtattttgtgccggcgcggatctcaaggagcgtgaacaaatgagtgaagcggaagtaggggtgtttgtgcagcgcttacgcggactgatgaatgacatagccgctttccctgctcccactatcgcagcgatggacggattcgccctcgggggcggcctggagcttgcccttgcatgtgatcttagagttgccgcctcgtccgccgtgatgggtcttattgagaccacccggggtttactccctggagccggcgggacccagcgccttccacgctgcttaggggtcgctctggcaaaagagcttatctttacaggcagacggctgagcggaaccgaagcccacgtgctggggctcgtgaaccatgcagtggcacagaatgaagagggggacgccgcgtatcagagggcccgcgccctggcccaggaaatcctgcctcaggccccaatcgcggtgaggcttggaaaagttgccatcgacaggggaaccgaggtggacatagcttcaggtatggccattgagggtatgtgttacgcacagaatattccaacacgggacaggcttgaggggatggcggcattccgcgagaagagaaccccgaaatttgttggtaaatag

SEQ ID NO: 42023 - DNA, 741 bp, Artificial Sequence
  Description of Artificial Sequence: Synthetic coding sequence
atgaaccggcccagcgcccggaacgccctgggcaacgtgttcgtgagcgaactgctagaaacgctggcccagctccgggaggacaggcaagtccgtgtgcttttgttcaggtccggcgtcaagggagtattctgcgccggggcggatcttaaagaacgagagcaaatgtcagaagccgaagtgggagtctttgtacaaagactgaggggattaatgaatgacattgctgcctttcccgcccccacgatagctgccatggacggcttcgcactggggggggggctcgagcttgcgctcgcctgtgacctgcgggtggctgccagctccgcagtgatgggactcatcgaaaccaccagaggtctactgcctggtgctgggggaacacagaggctgccaaggtgcctgggagtcgccctcgcaaaagagctcatcttcactggtaggaggctgtctggaacggaggctcatgttttagggctcgtcaaccatgccgtggcccagaacgaagagggtgacgctgcataccagcgagcacgcgccttggcccaggaaatactaccccaagcccctattgcggtgagactgggcaaagtggccattgaccgcgggacggaggtggatatcgcctcaggtatggcgattgaagggatgtgctatgcacagaatattccaacgagagacagactggagggtatggccgcctttcgcgagaagcgcacgccaaagttcgtcggcaagtag

SEQ ID NO: 42024 - DNA, 384 bp, Artificial Sequence
  Description of Artificial Sequence: Synthetic coding sequence
atgaaccggcccagcgcccggaacgccctgggcaacgtgttcgtgtctgagctgttggaaactttggcacagctcagagaggacagacaggtgagagttctgctcttccgatccggcgtcaagggggtgttctgtgctggtgcagatttaaaagagagagagcaaatgtccgaagccgaggtcggcgtcttcgttcagcgcctacgcggcttgatgaacgacatcgctgccttcccagctccaactatcgccgccatggacggtttcgccctgggagggggactagagctggctctcgcctgcgatttgcgggtggcaggaactgggcccgggctgggggccgggggaggggcgagagagtcgggggtgagcgagaccgggtag

SEQ ID NO: 42025 - DNA, 660 bp, Artificial Sequence
  Description of Artificial Sequence: Synthetic coding sequence
atgctgcgggtgctgtgcctgctgcggccctggcggcccctgcgggcaaggggatgcgccagcgatggcgctgccggcgggagcgaaatacaggttagagccttagcagggcccgaccagggcatcactgaaatactgatgaacagaccgtcagccaggaacgcactggggaatgtgttcgtgtcggagctgcttgaaacacttgcacaactacgagaggacaggcaggtgcgcgtgctactgttccggtcgggtgttaagggtgtcttttgcgcgggggcggatctgaaagagagagagcaaatgtctgaggctgaggtgggcgtgttcgttcaaagattgaggggcctgatgaatgatatcgctagctccgccgtcatggggctgattgaaactacacgcggcctcctacctggcgccgggggtactcagcgcctgccacggtgcttgggtgtcgcactggctaaggaactgattttcaccgggcgaaggctttccggaactgaagcacacgtgctgggactcgtgaaccatgcagtagcccagaacgaggagggtgatgccgcctaccagagagctagagctcttgcccaggaaattttgcctcaggtggatatcgcctcaggaatggccatagagggaatgtgctatgcacagtag

SEQ ID NO: 42026 - DNA, 912 bp, Artificial Sequence
  Description of Artificial Sequence: Synthetic coding sequence
atggccgccgtggccgtgctgcgggccttcggcgccagcggccccatgtgtttgagaaggggtccttgggcgcagttgcccgcacgtttctgctctcgagaccctgctggcgcgggcagaagagagagcgagcccaggcccacatcagccaggcagctcgatggtattcgaaacattgtattatccaaccctaaaaagcggaacgcactgagtttagcaatgctgaagtctcttcagtctgacatccttcacgatgccgactcaaatgacctcaaggtgatcatcattagcgctgaaggacctgtcttcagcagtgggcacgacctgaaggagctcaccgaggaacagggccgagattatcacgccgaggtgtttcagacctgcagcaaagtgatgatgcacattcgtaaccacccggttcctgtgattgcaatggtgaacggcctagcagcagcggccggttgccagctagtggcctcctgcgatatcgcagtggcctccgataagtcctctttcgctactccgggcgtcaatgtgggtctcttctgttcaacacccggagtggctctggcgagagcagtgccaagaaaggttgctctggagatgctttttactggtgagccaatttctgcccaggaggcgctgctgcatggtttgctatcaaaggtagtacccgaggcagagttgcaagaggagacaatgcgtatcgctagaaagatagctagcctgagcaggccagtggttagccttgggaaggccacgttttataaacagctaccccaggacttggggacagcctattatctcacctctcaggcaatggtggataatctggcactgcgcgacggtcaggaaggaattaccgcttttctgcagaaacgaaagccagtgtggtctcacgaaccggtgtag

SEQ ID NO: 42027 - DNA, 726 bp, Artificial Sequence
  Description of Artificial Sequence: Synthetic coding sequence
atggccgccgtggccgtgctgcgggccttcggcgccagcggccccatgtgtctgcgcagagggccttgggcccagctacccgcaaggttttgtagtcgggatcccgccggcgccggcagaagggagagcgagcccaggcctacctcggccagacaattagatggcattagaagtgctccagggcgggcaggcagtagtagatggtgtagagtgggggtgcgcgcccctcctttgacacgtggcggccctggcgagcctgaaccacggctgcgcccttggggagggaatagcccctgcccaggacctggccctgggagtgaaacaaggagaaatattgtgctgtctaacccgaagaaacgcaatgctttgtccctggccatgcttaagtctttacaatcggacatattacatgacgccgattcaaacgatcttaaagtgattattattagtgccgaagggcccgtttttagcagcggtcacgacctgaaagagctaaccgaagaacaagggcgagattatcacgctgaagtgtttcagacatgtagcaaggtgatgatgcacatacggaatcatcctgtccctgtgatcgccatggttaacggacttgcagccgctgcaggatgtcagctggtcgcttcctgcgacatcgctgtggcatccgataaaagctctttcgccaccccaggagtcaatgtggggctcttctgctccaccccaggggtgtag

SEQ ID NO: 42028 - DNA, 501 bp, Artificial Sequence
  Description of Artificial Sequence: Synthetic coding sequence
atgctgaagagcctgcagagcgacatcctgcacgacgccgacagcaacgatctgaaagtgattatcatcagtgctgaaggccctgttttttcaagtgggcacgatctgaaagagttgaccgaagagcagggcagggattaccacgccgaggtgttccagacctgctccaaggtcatgatgcatatccggaaccacccagtgcccgttatcgccatggtgaacggtctcgcagctgccgccggatgtcagttggtcgccagctgcgatatcgctgtggccagtgacaagtcgtcctttgcaacacccggagtgaacgtgggcctgttttgttctacccctggtgtggcactcgcgagggctgtacccaggaaagttgctctcgaaatgttgttcacgggagaacccatctcagctcaggaggctttactgcatggactcctgtctaaagtcgttcccgaggcagaattacaggaggagaccatgcggatcgcacggaagtag

SEQ ID NO: 42029 - DNA, 909 bp, Artificial Sequence
  Description of Artificial Sequence: Synthetic coding sequence
atggccctggtggccagcgtgcgggtgcccgcccgggtgctgctgcgtgcaggagccagactgccaggggcggccctggggcggaccgagcgcgctgcgggcggaggagatggtgctcggagatttggtagtcagagagtgctggtagaacctgacgcgggcgccggagtggctgtcatgaaattcaagaatccaccagttaattccttaagcttagagtttctaactgagctagtgattagcttggaaaagctggaaaatgataagagctttcgaggggtgatactgacgtccgatcgaccgggtgtattttcagccggcctggatctcacggaaatgtgcggtcgatctcccgcgcactacgctggctattggaaggccgtgcaggagctgtggctgcgactgtatcagagcaaccttgtactagtgtccgcgatcaacggcgcgtgtccagctggaggatgccttgtggcactgacatgcgattatcgaattctggccgataatccccggtactgtatcggcctgaacgagacccaactcgggatcattgctccattctggctgaaagatactctggagaacaccatcgggcaccgcgccgccgagcgggctctccagctgggactgttgttcccacccgccgaggccctgcaggtaggtatcgtggaccaggtagtgccagaggagcaggtacagagcacggccctaagcgccattgctcaatggatggccatcccagaccacgccagacagttaaccaaagcaatgatgaggaaggctacagcctcgagacttgtcactcagagagatgccgatgtccaaaactttgtgagcttcatctcaaaagacagcattcagaagtctcttcagatgtatttagaacggttaaaggaggagaagggttag

SEQ ID NO: 42030 - DNA, 858 bp, Artificial Sequence
  Description of Artificial Sequence: Synthetic coding sequence
atggccctggtggccagcgtgcgggtgcccgcccgggtgctgctgagggccggagcccggctgcctggtgcagctttgggtagaaccgagagagcggccggcggcggggatggcgctcgaagatttggatcacagcgggtccttgttgagccggacgctggcgccggcgtcgcagtgatgaaattcaagaaccccccagtgaattccctttctctcgagtttctcacagaattggtgattagtctagagaagctggagaacgataagagctttagaggcgtcatcttaacgagcgatcgccctggcgttttctcagcggggctggacctaaccgaaatgtgcggacggtcaccagcccactacgccggatactggaaggcggtgcaggagctgtggctcaggctgtaccagagtaatcttgtgctggtgtctgcaatcaatggtgcttgcccggcagggggttgtctcgtagccttgacctgcgattatcgaatcctcgcggacaaccccagattgaaagacacactggagaatacaattggccacagagccgcagagcgggcccttcaattgggactgttgttcccaccagcagaggcacttcaggtgggtatagtggaccaagtggtccctgaagaacaagtgcagagcaccgccctgagcgccatcgcccaatggatggctattcccgaccacgctaggcagttgaccaaggctatgatgcgcaaggccacagcctcccgtctcgtaacccagcgggacgcagacgtgcaaaacttcgtgtcgtttattagcaaagattcaattcagaagagccttcagatgtatttggagaggctcaaggaggagaaggggtag

SEQ ID NO: 42031 - DNA, 1095 bp, Artificial Sequence
  Description of Artificial Sequence: Synthetic coding sequence
atgaaccggaccgccatgcgggccagccagaaggacttcgagaacagtatgaatcaagttaagcttcttaagaaggatccgggcaatgaagtgaagcttaagttgtatgctctatacaagcaggctaccgagggtccctgcaacatgcccaaacctggagtgttcgacctaatcaacaaagccaaatgggacgcatggaacgccctgggctctctgccaaaggaagccgccagacagaactacgttgatttggtctctagtctgtccccctcactcgaaagcagttcccaagtagagccgggtaccgaccgaaagagcaccggcttcgaaactttagtggtcactagcgaagacggtatcactaagatcatgttcaaccgccccaagaaaaaaaatgcaatcaacacagagatgtatcacgaaatcatgcgggctctgaaagctgccagcaaggatgacagcattatcacggtgttgacagggaacggcgactactacagttccggtaatgatctgactaattttacggatatccccccagggggggtcgaagagaaggccaagaacaacgcggtactgctccgagagtttgttggctgcttcattgacttccccaagcccctgatcgctgtggttaacggccccgcggtaggcatatcagtgacactcctgggattgtttgacgccgtatacgcctcggaccgggccacatttcatacacccttctcacatttaggacaatcccccgagggatgcagttcatatacattccctaagatcatgagtccagctaaggctacagaaatgctgatcttcggcaaaaagctcacagccggggaggcctgtgcccaaggactcgtgaccgaagtctttcccgactccacattccagaaggaggtttggactcggctaaaggcttttgctaagctcccaccaaacgcgttgagaatctctaaagaggtcattcggaagcgggaaagggagaaactccacgccgtgaatgcagaggagtgcaacgtattgcagggaaggtggctgtccgatgagtgtaccaacgccgttgtcaatttcctctcgcgaaagtctaagctgtag

SEQ ID NO: 42032 - DNA, 1185 bp, Artificial Sequence
  Description of Artificial Sequence: Synthetic coding sequence
atggccatggcctacctggcctggcggctggcccggcggagctgcccctcctctctgcaggtcacttccttcccagtggttcaactgcatatgaacagaacggccatgcgcgctagccagaaggatttcgagaactctatgaaccaggtgaaactgctgaagaaagatcctgggaatgaagtcaagctgaagctctacgctctttacaagcaggctaccgaaggcccttgtaacatgccaaagcctggcgttttcgacctgattaataaggccaagtgggacgcttggaatgctctcggaagtctgcccaaggaagccgcgcgacagaactacgtggacctggttagctctttatctcctagtctggagtcaagttctcaggtcgaacccggcacggatagaaagtcaaccggattcgagaccttagtggtcacctcagaggacggaatcaccaaaattatgttcaaccgcccaaagaaaaaaaacgccatcaataccgaaatgtaccatgagatcatgcgcgctctgaaggctgctagcaaggacgatagcatcattaccgtgcttaccggaaatggggactattattcttcaggaaatgacctgactaacttcacagatatcccccctggcggggtggaagagaaggccaagaacaacgctgtgttgctgcgggaatttgtagggtgcttcattgacttccctaagcctttaatcgccgtcgtgaacggacctgccgttggcatctcggtgaccctgctggggctgtttgacgctgtgtacgcaagcgatcgggctacatttcatacgcctttcagccatttgggccaaagtcctgaaggctgcagcagttacacgtttccaaagatcatgtcacctgccaaagcgaccgagatgttgatctttggcaaaaaactgactgctggagaggcctgtgcccaggggcttgtgaccgaggttttccctgacagcacatttcagaaagaagtgtggacaaggctcaaggccttcgcaaagctcccccctaacgcactgcgaatcagcaaagaggtgattaggaaacgagagcgcgaaaagctgcacgccgtcaatgccgaagaatgcaacgtgctgcagggacgctggctgtcagacgaatgcaccaacgcagtagtcaatttcctgagtcggaaatcaaagttgtag

SEQ ID NO: 42033 - DNA, 1095 bp, Artificial Sequence
  Description of Artificial Sequence: Synthetic coding sequence
atgaaccggaccgccatgcgggccagccagaaggacttcgagaactcaatgaaccaggtcaagctcctgaagaaggatcccggcaatgaggtgaaattgaagctttacgcgctgtataaacaggctacagaagggccttgtaacatgcccaaacccggtgtgtttgatctcattaacaaggccaagtgggatgcctggaacgcactggggtctttgcccaaagaagcagcgagacagaactacgtcgacttggtctcttcgttaagcccatcattggagtcttcatctcaggttgaacctgggactgataggaagtccaccgggttcgaaacacttgtggtgacttcggaggacggtatcacgaaaatcatgttcaatcggccaaagaaaaaaaatgccatcaacactgaaatgtaccacgaaatcatgcgggccctcaaagccgcttctaaagacgattccattataacggtgctgaccgggaacggggactactactcgagcggaaatgacctcaccaattttacagatatcccgcccggcggggtggaagagaaggctaagaacaacgcggtgctcctgagagaatttgtaggatgttttattgattttcccaagcctttgatcgctgtggtgaatggccctgctgtgggcatctcagtgaccctgctgggtctattcgatgctgtgtacgcatccgaccgcgccacatttcacacacccttttcccatctgggccagtcccccgagggatgtagctcctacacgttccccaaaatcatgagccccgccaaggctaccgagatgctgatttttggaaaaaagctgactgcgggtgaggcctgcgctcaaggcctggtgaccgaagtgtttcccgacagcacttttcagaaagaggtttggacacggctgaaggcctttgccaagctgcctcccaacgcactacgtatttctaaggaagtgatccggaagagggagagagagaaactgcacgcagtgaatgctgaagagtgtaatgtgttgcaaggtagatggctgagcgacgagtgtactaatgctgtggtcaattttctttctcgtaaatccaaactgtag

SEQ ID NO: 42034 - DNA, 684 bp, Artificial Sequence
  Description of Artificial Sequence: Synthetic coding sequence
atgtaccacgagatcatgcgggccctgaaggccgccagcaaggacgatagtatcattactgtacttacgggcaatggcgactactattctagcggtaacgatctcactaattttactgacatcccgcccgggggggtagaggaaaaagccaagaataatgcagtactgctccgcgaatttgttggttgtttcatagacttcccaaagcctctgattgctgttgtaaacgggcccgcagtgggcatcagtgtcactctgttggggctttttgacgcggtttacgcatccgatcgggcaacctttcacactccattcagtcatctggggcagtctcctgaaggctgttccagctatacgtttccaaagataatgtcaccagcgaaagcaaccgagatgctcatcttcggcaagaaactgaccgccggagaagcatgtgcgcagggactggtcaccgaggtgttccccgatagcacgtttcagaaggaggtgtggactaggctcaaagcctttgctaagctgccacctaatgctctgcggatatcaaaggaggtgatccgcaagagggagcgggaaaagctccatgcagtcaacgccgaggagtgtaacgtactccaagggcggtggctttccgatgaatgcactaacgcagtcgtgaatttcttgtcgcggaagtctaaactctag

SEQ ID NO: 42035 - DNA, 1095 bp, Artificial Sequence
  Description of Artificial Sequence: Synthetic coding sequence
atgaaccggaccgccatgcgggccagccagaaggacttcgagaactcaatgaaccaagttaaactcctgaagaaggacccagggaacgaggtcaagctgaagttgtacgcgctgtacaaacaggctactgaaggaccttgtaatatgcctaagccgggagttttcgaccttattaataaagccaagtgggacgcctggaacgccctgggttctctcccaaaggaggctgccagacagaattacgttgatctggtcagtagtttgagcccaagtctggagagcagtagtcaggttgaaccaggcaccgaccgcaaaagcactggcttcgaaacccttgtcgtaacctctgaagacggcataaccaaaatcatgttcaataggccgaaaaaaaagaacgcgattaacacagagatgtatcatgagatcatgagagcactgaaagctgcatcaaaagatgactcaataatcacagtgttgaccggaaacggggactactacagttcaggtaatgacctaactaacttcacagacattcctcctggtggggtggaggaaaaggccaaaaacaatgccgtgctgctgcgagagtttgtcggatgtttcattgactttcctaaaccattaatcgcagtagtgaacggtcctgccgtgggcattagtgtgaccctgctcggactctttgacgcagtatacgcatctgaccgggccacctttcatacgccgttctctcacttaggacagagccctgaaggttgtagctcttataccttccccaagattatgtcccccgcaaaggctacagaaatgcttattttcggcaagaaactcacggctggggaagcctgcgcacaggggcttgttaccgaagtgtttccagacagcacgttccaaaaggaggtttggacacggctgaaagccttcgcaaaacttccccccaatgcgctccgtatttccaaggaagtaattcgcaaacgcgaaagggaaaaactccacgctgtcaacgccgaggaatgcaatgttctgcagggacgttggttaagcgatgagtgcacgaacgccgttgtgaacttcctgtcgcgaaagagcaagctgtag

SEQ ID NO: 42036 - DNA, 2961 bp, Artificial Sequence
  Description of Artificial Sequence: Synthetic coding sequence
atggccggcatcttctacttcgccctgttcagctgcctgttcggcatttgtgacgcagtgacgggatcccgggtttatcctgccaatgaggttaccctcttggacagccggtcggtgcagggcgagcttggatggatcgcttcacccttggaaggcggctgggaggaagtgagcatcatggacgaaaaaaacactccaatcagaacctaccaagtgtgtaatgtgatggaaccatcccagaacaactggcttagaacagattggatcacgagggaaggtgcccagcgagtttacatagaaattaaattcactctccgggattgtaacagcctgcccggtgtgatgggtacctgcaaggagacattcaatttgtactactatgaaagcgataacgataaggagcgcttcattagggaaaaccaattcgtgaagatagacaccattgcagccgacgaatctttcacgcaagtggatataggtgatcgaatcatgaagctgaataccgaaatcagagatgtgggccccctgtctaagaagggattttaccttgcttttcaggatgtcggcgcatgcatcgccctggtgtcagtgagagtgttttataaaaagtgtcctctgacagtcagaaaccttgcacagttcccggacaccatcacgggggctgacacatccagtctggtcgaggtgaggggtagctgcgtgaataactctgaagagaaagatgtccccaaaatgtattgcggcgccgatggggagtggctggtaccaataggcaattgtctgtgtaatgcgggccacgaagaaagatcaggggaatgccaagcctgtaaaatcggatactataaggcactctccacagatgcaacatgtgctaagtgcccaccccactcatacagcgtttgggaaggagccacgtcctgcacatgcgatcggggattctttagggccgataatgacgccgctagtatgccttgcacgagacccccctccgctccactgaacctgatctcaaatgtcaatgagacctctgtgaacctcgagtggagctccccccaaaacaccggcggccgccaagacatatcatacaatgttgtgtgcaagaaatgtggggccggggaccccagtaaatgccgcccctgtggtagtggggttcactatactcctcagcagaatggtttgaaaaccaccaaagtgtctatcacagatctactcgcccacacgaattatacctttgaaatctgggctgtcaacggcgtgagtaagtacaaccctaatccagatcagagtgtgtctgtgactgtcactactaaccaggctgctcccagttctatcgccctcgtgcaggcaaaggaggtaacgcgatactcggtggcgctggcttggctcgagccagatcgtcccaatggtgtcatcctggagtatgaagttaaatattacgaaaaggatcaaaacgagagaagctacaggattgttcgaactgcagctcgaaacacagatatcaagggcctgaacccactaacgtcatacgtgttccacgtccgagcaagaacagccgctgggtacggcgatttttccgagcctttggaggtcaccactaacaccgtgccatctcgtatcattggggacggggccaacagcacagtcttactggtgtccgtgtcaggcagtgtagtcttagttgtcattctcattgcagcttttgtgatctcccgcaggcggagtaaatactctaaggccaagcaggaggccgatgaagagaagcatctgaatcagggcgttcgcacttatgtcgaccccttcacttatgaggacccgaatcaggccgtacgggagtttgccaaagagatcgatgcgtcttgtatcaagattgagaaagtgattggcgtcggagagttcggggaggtgtgctcaggtagactaaaggtgccaggtaagagagagatctgtgtggctattaagaccctgaaagccggctataccgacaaacagcgtagggattttctgagtgaagcgtctatcatgggtcagtttgaccaccctaatattattcaccttgagggggtcgtgacaaagtgtaaacccgttatgataattactgagtacatggagaatggaagcttggatgctttcctccggaaaaatgacggcaggttcactgttatccagctagtgggtatgctacgaggaattggctccgggatgaaatacctttccgatatgtcatatgtgcatcgcgacctggctgccaggaatattttggtgaactctaatctcgtttgtaaggtgtccgactttggcatgagcagagtgctagaagacgacccagaggcggcttacacaacacggggcggcaaaatcccaatcaggtggacagcccccgaggccatagcttacaggaagtttactagtgcctcagacgtctggtcatatggcatcgtcatgtgggaagtcatgagctatggagagagaccctactgggatatgtccaaccaggatgtcatcaaggccattgaggaaggctacagactgccccctcctatggattgcccaatcgctctgcaccaattgatgttagattgctggcagaaagagaggtccgatcgtcctaagttcggtcagatagtgaatatgctcgataagctaatacggaatcctaattcactgaaacggacaggcactgaaagcagccgccctaacaccgcgcttctggacccctctagtccggagttctcagccgttgtctcggtgggcgattggttgcaggcgattaagatggacaggtataaagacaactttacggcagcaggctataccacactggaggccgtagttcatgtgaaccaggaggacctggcacgcatcggtatcaccgcaatcactcaccagaataaaatcctctcatcagtgcaggctatgaggacccagatgcaacaaatgcatggccggatggtgccagtgtag

SEQ ID NO: 42037 - DNA, 2808 bp, Artificial Sequence
  Description of Artificial Sequence: Synthetic coding sequence
atgaagtgggaggaggtgagcatcatggacgagaagaacacccccattcgtacctatcaggtatgtaacgttatggaacctagtcagaacaactggctacggaccgactggattacacgggagggcgctcaacgcgtatacatcgagattaagttcaccctccgggattgcaacagcctcccgggcgtgatgggcacctgcaaggagaccttcaatttgtactattacgaatctgacaacgacaaggagaggtttatcagagagaaccagtttgtgaagatcgatactatcgctgccgatgagagctttactcaggtagatataggcgaccgaataatgaaactgaacactgagatcagagatgtgggacctctgagcaagaagggattttatctcgctttccaagatgtgggtgcatgcatcgccctggtgtccgtgcgtgtgttctataaaaagtgccccttaacagtgcggaaccttgcccaattccccgacaccattacgggagccgacacaagtagccttgttgaagtgagaggatcttgtgtgaataattccgaggagaaggatgtgcctaaaatgtactgcggcgccgacggggagtggcttgtccctatagggaattgcctgtgcaatgcgggccacgaggaacgctcaggagagtgccaggcctgcaagattgggtattataaggccctctcgaccgatgcaacctgcgccaagtgcccgcctcatagctattcagtatgggagggagctacctcttgtacctgcgataggggattctttcgggcagataatgacgctgcttccatgccttgtacccggcccccatccgccccactgaatctgatcagcaacgtaaatgagactagcgtgaacctggagtggagtagtccccaaaatacaggtggtcggcaagatatttcatacaacgtagtttgtaaaaaatgcggcgcaggtgacccaagcaaatgtaggccatgcggctctggggttcactacacccctcaacaaaatggtttgaaaacaactaaagtcagcattacggacttgttggcccatactaactacacattcgagatttgggcggtgaatggcgtgtcaaaatacaatcctaatcccgaccaaagcgtctcagtcaccgtgacaactaatcaagctgcgccctcaagcatagctcttgtgcaagctaaagaggtgaccagatatagcgttgccctggcatggcttgagccggatcgtcccaacggagtaatccttgaatatgaagtaaagtactacgagaaagaccagaacgaacgtagctaccgaatcgtcaggactgcagcccgaaacacagacattaagggcttgaaccccctgacctcctatgtgttccacgtgcgagcaagaaccgccgccggctacggggacttctccgaacctctggaggtaaccacaaacaccgtgccgtcccgcattatcggggacggagccaacagcactgtactgctggtgtccgtgagcggatccgtggtgctagtggtgattttaattgcggcgtttgtgatcagccgacggcgcagcaagtattccaaggccaagcaggaagcagacgaggagaagcacctcaatcaaggggtgcgcacctatgtagacccttttacatacgaggaccctaatcaagcggttagggaatttgccaaggaaatagacgcatcctgcattaaaattgaaaaggtgatcggggttggcgaattcggagaggtgtgctcagggcgattaaaagtccccgggaaaagagagatctgtgtggctattaaaacattgaaggctggttacactgacaagcaaagacgggactttctgtcagaggcttccattatgggtcagttcgatcaccccaacatcattcatttagagggcgtagtgacaaagtgtaaaccggttatgatcattactgaatacatggaaaatggaagccttgatgcttttttgaggaaaaacgatggcaggtttacagtgattcagttggttggcatgttgcgtggcataggatctgggatgaagtacctgtctgacatgtcttatgtgcaccgcgacttggccgctaggaatatcctggttaacagtaacctagtctgcaaggtgagcgacttcgggatgagccgtgtgctggaggatgaccctgaagcagcttatacaacccgaggaggtaagattcctattcgatggacagccccagaagccatcgcctatcggaagtttactagtgcttccgatgtatggagctacggcatcgtgatgtgggaagtcatgtcatacggagaaaggccatactgggacatgtccaaccaggacgttattaaggctattgaagagggctatcgcctcccccccccgatggactgccctattgcattgcatcagctaatgctagactgttggcaaaaagaaaggtccgatagacccaaattcggacaaatcgtgaacatgctggacaagctcatcagaaacccaaactccctaaagagaaccggcacagaaagttcaagacctaacaccgccctcctggacccaagctcacctgagttttcagccgtggtgtctgtcggtgattggttgcaggcgattaaaatggatagatacaaggacaattttaccgcagcaggctatacaacgctcgaggccgttgtccacgtaaatcaggaagatcttgctcgtatcgggattactgcaataacccaccaaaataagattttaagcagcgtgcaagctatgcgcacccagatgcagcagatgcacggcaggatggtgcctgtctag

SEQ ID NO: 42038 - DNA, 2850 bp, Artificial Sequence
  Description of Artificial Sequence: Synthetic coding sequence
atggccggcatcttctacttcgccctgttcagctgcctgttcggcatctgcgacgccgtgacaggatccagagtctaccctgcaaacgaagttacactcttggacagccggtcagttcagggcgaacttgggtggattgccagccccctggagggcggatgggaagaggtgtcaatcatggatgaaaaaaacacccccatcaggacatatcaggtctgtaacgtcatggagccctctcagaataattggctgaggaccgattggattaccagagaaggtgcccagagggtctacattgagataaagtttaccctcagggactgcaacagcctcccaggcgttatgggtacatgcaaggagacctttaacctgtattactatgaatcagacaacgacaaggagagatttattcgggaaaatcagttcgtcaagatagacaccatagccgccgatgagtcttttactcaggttgatatcggcgaccgaattatgaagctaaacaccgagattagggatgtcggtcccctgtcgaaaaaggggttctacctcgcatttcaggacgtgggggcctgtattgccttagtgagtgttcgagtattctacaagaaatgccctcttaccgtgcgcaatctggctcaattccccgacaccatcaccggagctgatactagcagtttggtggaagtgcgcggatcctgcgtaaacaattcagaagaaaaggatgtccctaaaatgtattgcggcgcagacggagaatggctggtaccaataggaaattgtctctgcaatgcgggacatgaggagagaagcggggaatgccaagcctgcaagatcggctactataaggcactgtctaccgacgcaacttgcgctaaatgccctcctcattcctactctgtttgggagggcgctaccagctgcacttgtgatcgagggttcttccgggctgataacgatgccgcctccatgccatgcactagacccccgagcgcacccttaaacctcatttctaatgtgaacgagacctctgtcaatctggagtggtcctccccccaaaacaccggcggacgccaggatatttcttataacgtagtatgtaaaaaatgcggcgccggggatccaagcaaatgtcgcccgtgcgggtccggagttcattatacccctcaacagaatgggctcaaaacgaccaaggtcagcataaccgatctgctagcacatactaactacacctttgaaatatgggctgtgaatggcgtcagtaagtacaaccctaaccctgaccagagtgtcagcgtgactgttacaacaaatcaagcagcaccaagctcaattgcactggtgcaggccaaggaggtcaccaggtactccgtggccctcgcatggcttgagcccgatcgtcccaatggtgtcatcctagagtatgaggtgaaatattatgaaaaggatcagaacgaacgctcataccgcatcgtgcgcacagcagccagaaataccgatatcaagggcttgaatcccttgacaagctatgtctttcatgttcgggctagaactgcagccggatatggcgactttagtgagccgttggaggtgactacgaacactgtgccctccaggatcatcggcgatggggcgaactccaccgtgctgcttgtatccgtgtccggatccgttgttttggtggtgatactgattgctgctttcgtcataagccgaaggaggtcaaaatatagcaaggcaaaacaagaagccgatgaagagaagcatctgaatcaaggtgtgcgcacgtatgtcgaccccttcacttacgaagatccaaatcaggcggtcagagaattcgctaaagagatcgacgccagttgtatcaagatcgagaaggtgatcggtgtgggtgagttcggagaggtgtgtagtgggcggctgaaggtccctggcaagcgagaaatttgcgtagcaatcaaaaccttgaaagcaggatacactgacaagcagagacgcgatttcctcagcgaagccagcataatggggcagtttgatcatcctaacataatccacctcgaaggcgtcgtcaccaaatgtaaacctgttatgatcataacagaatatatggagaatggaagcttggacgcgtttctaagaaaaaatgacggtcgatttactgtgatacaactggtgggaatgctgcgcgggatagggagcggtatgaagtatctcagtgatatgtcttacgtgcacagagacctggccgccaggaatattctcgtaaactctaacctcgtctgcaaggtctcggattttggcatgtcccgtgtcctcgaagatgaccctgaggctgcctacactactcgtggtggaaagatcccgattcgatggacagcacctgaggcaattgcctatcgaaagtttacaagtgcatccgatgtttggtcctacggtattgttatgtgggaagtgatgtcttacggagagcgaccttattgggacatgtcaaatcaggacgtcatcaaggccatcgaggaagggtacagactccctccaccgatggactgccccattgcactgcatcagctgatgctcgactgctggcagaaagagaggtcggatagaccaaaattcgggcaaatcgtcaatatgctagataaattgatccgaaaccccaattcactcaagcgcacaggcaccgaatctagcagacccaacacggctctgctggatccttcaagtcctgagttttctgctgtcgtgagtgtgggcgattggctgcaggccatcaagatggaccgttataaagacaacttcaccgccgctgggtacaccacactggaggccgttgtccacgtcaaccaggagtag

SEQ ID NO: 42039 - DNA, 2961 bp, Artificial Sequence
  Description of Artificial Sequence: Synthetic coding sequence
atggccggcatcttctacttcgccctgttcagctgcctgttcggcatttgtgacgcagtgactggctcacgagtataccccgcaaacgaggttaccttacttgattctagaagtgttcagggcgagctcggctggatcgcgtcgcccctggaaggtggctgggaagaggtgtccatcatggacgaaaaaaatactccgatcaggacatatcaggtatgtaacgttatggagccttcccagaataattggttacggaccgactggattactagggagggtgcccagcgagtatatattgaaatcaagttcactttgcgcgactgcaactctctccccggggtaatggggacttgcaaggagacttttaatctgtattactatgagtctgataatgacaaggaacggttcataagagagaatcagttcgtgaagatcgacaccattgctgccgacgagtccttcacccaggtcgatatcggcgaccgtattatgaagctgaataccgaaatccgggacgtgggcccactgtccaaaaagggtttttatctcgcattccaggacgtcggggcctgtatcgctctggttagcgtccgcgtgttctacaaaaaatgtcccttaacagtccgtaacctcgcccagttccctgatactatcactggagccgacacatctagtcttgtagaggttaggggcagctgcgttaataattccgaggagaaagatgtgccaaagatgtactgcggcgctgatggggagtggctagtgcctataggtaattgtctctgcaacgcaggacatgaagaacggtcgggcgaatgtcaggcatgtaagataggatattataaagctttatccactgacgctacctgtgctaagtgtccacctcatagttattccgtgtgggaaggcgccacgagctgtacttgcgacaggggctttttccgggccgataatgatgcagcctccatgccatgtacaaggcccccatccgctcctcttaacttgatctcaaacgtgaacgagactagcgtgaacctggagtggtctagcccccagaatacgggtggtcggcaagacatttcctacaacgtagtttgcaagaagtgcggagccggagatccctctaagtgccgcccctgtggcagcggggttcattataccccacagcaaaatggtctgaaaaccacaaaggtgagcatcaccgacctcctggcccatactaactacacgtttgaaatttgggccgtaaatggcgtgtccaagtacaaccccaatccagaccagagtgtgtccgtcactgtaacgaccaaccaggcagcccctagcagcatagctttagtgcaggccaaagaagtgacgcggtattcagttgcattggcttggctcgagcccgaccgaccaaacggggtgatccttgagtatgaagttaagtattacgagaaagatcagaacgaaaggtcatacagaatagtccgcacagctgcgaggaatacggacataaaggggctgaacccgctgacaagttatgtgttccatgttagggctcgcaccgccgcaggttatggggacttctccgaacccctcgaggtcactacaaacacagttcctagtcggataatcggggatggcgccaattctaccgttctactggtgtccgtcagtggctccgtcgtgttggttgtgattctgatagccgcgttcgtgataagcagaaggaggtctaagtacagcaaagctaaacaggaagccgatgaagaaaagcacctgaaccagggtgtgaggacgtacgtggacccctttacgtatgaggatcccaaccaggctgtgagggagtttgccaaagaaatagacgcctcgtgtatcaagatcgagaaagtgatcggcgtgggggaattcggagaggtgtgttccggccggctgaaggtgcccggcaagcgcgagatctgtgtggctatcaagaccctgaaagccggatacacggacaagcaacgtagggactttctgagcgaggcatctatcatgggtcaattcgatcatccaaatatcatccatctcgagggggtggttaccaaatgcaagccggtaatgatcattactgagtatatggagaatggatcacttgatgcatttctaagaaagaatgatggccgctttacagtgatccagctggtgggcatgctgcgtgggattggtagcggcatgaagtacctgagcgatatgagctacgtccaccgggacttagccgcaaggaacatcctggtgaattccaacctcgtttgtaaggtgagcgactttggcatgagtagggtgctggaggacgacccagaagccgcatacacaactcgcggcggtaaaatcccaattaggtggaccgcacctgaggcaatagcctaccgcaagtttacatcagcctctgacgtttggagttatggaatcgtaatgtgggaagttatgagttacggtgagcgcccctattgggacatgtctaaccaggatgtcatcaaggccattgaggaaggctacaggctacccccacccatggattgccctatcgctttgcatcaactgatgttggattgctggcagaaagagcgatcagatcgccccaagtttggtcagatcgtgaacatgttggataagctcattaggaacccgaatagtcttaagcgtacaggaacggagtcctccagacccaacaccgccctgctggatccctctagtcccgaatttagcgccgtggtgtctgtcggggactggctacaggccataaaaatggatcgctacaaagataatttcacagctgctggctacacgacgctggaggcagtggtgcatgtgaatcaggaggacctagctagaattggtatcacggccataacgcatcagaataagatcctttcaagcgtgcaggccatgcgcacccagatgcagcaaatgcacggacggatggtgcccgtgtag

SEQ ID NO: 42040 - DNA, 276 bp, Artificial Sequence
  Description of Artificial Sequence: Synthetic coding sequence
atggccggcatcttctacttcgccctgttcagctgcctgttcggcatttgcgatgctgtgactggcagcagagtgtatccagcgaatgaggtcaccctcctggattcgaggagtgtacagggagaattaggttggatcgcttctcctctggaaggcggttgggaagaagtgtcaataatggatgaaaagaacacaccgatccggacatatcaggtgtgcaacgtcatggagccatcccagaacaactggctaaggacagactggattactcggtag

SEQ ID NO: 42041 - DNA, 450 bp, Artificial Sequence
  Description of Artificial Sequence: Synthetic coding sequence
atggccggcatcttctacttcgccctgttcagctgcctgttcggcatttgcgacgcagtgaccggaagtagagtctatcctgcgaatgaggtaaccctgctggactcccgaagtgtccaaggcgagctggggtggatcgcctccccattggaaggtgggtgggaggaggtgagtatcatggacgaaaaaaatactcccattcgaacctaccaggtctgcaatgtgatggaaccatcacagaacaactggctgcgcacggattggattactcgcgagggagctcaaagagtctacatcgagatcaagttcaccttgagagattgcaactctctgccaggggtgatgggcacctgcaaggagacattcaacctgtactactacgaatctgacaacgacaaagagcggtttatccgtgagaaccagtttgtcaagatcgacactatcgcctag

SEQ ID NO: 42042 - DNA, 840 bp, Artificial Sequence
  Description of Artificial Sequence: Synthetic coding sequence
atggtgttccagacccggtaccccagctggatcatcctgtgctacatttggcttctcagattcgcccataccggagaggcacaagccgccaaggaagtactcctcctggacagtaaagcacagcagaccgaactagaatggatctcctcgccgcctaacggttgggaggaaataagcggtctggatgagaattacactcccattaggacctaccaagtatgtcaggtgatggaacctaaccagaataattggctgcgcaccaactggattagtaaaggcaacgcgcagcgaatttttgtagaacttaagttcactctgagggactgcaactcactgccgggcgtactgggtacttgtaaagaaacatttaatctttattactatgagaccgattatgataccgggaggaacatccgagaaaatctatatgttaaaatcgacacaattgctgccgatgaaagctttactcagggagaccttggcgaacgtaagatgaagttgaacaccgaagttagagagataggacctctctccaagaagggcttttatctcgcgttccaggacgtgggagcgtgtatcgcattagttagcgtgaaggtttactataagaaatgttggtctatcattgagaacttggccatttttcctgatacagtcaccggcagcgagttctcgagccttgtcgaagtgcgcgggacatgtgtctccagcgccgaagaggaggcagaaaacgccccgagaatgcattgctcggctgaaggagagtggctcgtaccgattggcaagtgtatctgcaaggctgggtaccagcagaagggagacacctgcgagcggaagtag

SEQ ID NO: 42043 - DNA, 2997 bp, Artificial Sequence
  Description of Artificial Sequence: Synthetic coding sequence
atggtgttccagacccggtaccccagctggatcatcctgtgctacatttggctcttgaggttcgcacatacaggcgaagcccaggccgccaaagaggtcctccttctggactctaaagctcagcaaacagaactggaatggattagctccccccccaatggatgggaagagatcagcgggctggacgaaaactacactcctatacgcacttatcaggtgtgtcaggtgatggaaccaaaccagaataactggctgcggacaaactggattagcaaaggcaacgcacaaagaatttttgtggagttgaagttcacactgcgcgattgtaactctctaccaggtgtgctgggtacgtgcaaggagacctttaacctgtattactatgaaactgactacgacaccgggagaaatatccgggagaacctgtacgtcaaaattgatacgattgccgcagatgagtctttcacccagggggacctcggtgaaagaaagatgaagctcaacaccgaggtgagggaaatcggccccctgtctaaaaaagggttttatcttgcatttcaggatgtaggagcttgtatcgccctcgtcagcgtgaaggtgtactataagaagtgttggtcaatcatagagaacttagccattttccctgacaccgtcacaggcagtgagtttagctccctggtggaagtgcgcggaacatgtgtgagctcagcggaagaggaagcagaaaacgcgcctcgcatgcactgcagtgcggagggagagtggttggtccccatcggaaagtgcatttgtaaagccggctaccagcaaaagggcgacacttgcgagccttgcggaagggggttctacaagtcctcaagccaagatcttcagtgctcccggtgccctactcactccttctctgacaaagagggcagctcgaggtgcgagtgtgaggacggatactacagggcgcccagtgatcctccttatgttgcctgtacccggcctccaagtgccccccagaacttgatttttaacatcaaccagacaaccgtgagcttggaatggagccctccagcagataacggagggcggaacgacgtgacatatagaatactctgtaaacgatgctcatgggaacagggcgagtgtgttccctgcggaagcaacattgggtacatgcctcagcagacaggtttggaggacaattacgtgaccgtcatggacctgttagcccacgcaaactatacctttgaagtggaggccgtaaatggcgtttcagaccttagccgcagtcagcgactctttgccgccgttagtatcactactggacaagccgcaccatcccaagtgagcggtgtgatgaaggaaagagtgctgcaacgatcagtcgagctttcatggcaagagccggagcatcccaacggcgtgatcacagaatacgagatcaagtattacgaaaaagatcaacgagagcgtacatactcaacggttaagacgaaatccacttccgcttccattaacaatttaaagcctggaacagtttatgtgttccagatccgagcatttacggcggctgggtatgggaattacagcccccgcctggatgtggccactctcgaagaggcaactggtaagatgtttgaagcaaccgccgtttcgagcgaacagaatccagttattataatcgccgtagtggccgttgctggtactatcatcctagtgtttatggtgtttgggtttattataggacgccgccactgcggctatagcaaagccgaccaggaaggtgatgaggagttatacttccacttcaagttccccggaacaaagacatacatcgatccagaaacctacgaagacccgaaccgggctgtccatcagttcgctaaagagctggacgctagctgcatcaagatagagcgggtaattggagccggtgagtttggcgaggtctgctctggccgcctgaagctccccgggaagagagacgtcgcagtcgcaatcaagaccctcaaggttggctacaccgagaagcagcgtagggacttcctttgtgaagcctctatcatgggccagttcgatcacccaaatgtggtgcatcttgagggggtcgtgactcgggggaagcccgtgatgattgtgattgaattcatggaaaatggcgctttggatgctttcctgcgaaagcacgatgggcagttcactgtgattcagcttgtcgggatgctgcgcggtatcgctgccggaatgcgctaccttgctgacatgggctatgttcaccgagacctggccgccagaaacatcctcgtcaatagcaacctcgtctgtaaggtctctgactttggcctctctagggtaatcgaggatgaccctgaggcagtgtacaccaccactggaggcaagattccggtgcggtggactgcccccgaagctattcaatataggaagttcaccagcgcaagcgatgtgtggtcctacggcattgtaatgtgggaggtaatgtcttacggagaaagaccctactgggacatgtcaaatcaggatgtgatcaaagccatcgaggagggatacaggctgccggctcctatggattgccccgccggtctacaccaactgatgctggactgttggcagaaggagcgtgccgagcggccaaagttcgaacagatcgtggggattttagacaagatgattcgaaatcctaatagtctgaagaccccactcgggacatgctcacgacctatctcgccccttctggaccagaatacccctgacttcacaacgttctgcagtgttggtgagtggctgcaggccattaagatggagcggtacaaagataacttcacagccgcgggctataattccctggaatccgtggcccgtatgacaatagaagacgtaatgtccctgggcattacactggtgggccatcagaaaaagattatgtcttctattcaaacaatgcgcgcacagatgctgcatctgcacggtactggaatccaagtgtag

SEQ ID NO: 42044 - DNA, 687 bp, Artificial Sequence
  Description of Artificial Sequence: Synthetic coding sequence
atgctgcacgtggagatgctgaccctggtgttcctggtgctgtggatgtgcgtgttcagtcaagatcctgggagcaaggcggtggccgatcgctatgcggtctattggaatagttctaaccccaggttccagaggggggactatcatattgatgtctgtattaacgattaccttgacgtattttgccctcattatgaagacagtgtacctgaagataagactgaacggtatgtgctgtacatggtgaattttgacgggtattctgcttgcgatcataccagcaagggatttaagagatgggagtgcaaccgccctcatagcccgaatgggcccctgaagttcagtgaaaaattccagctgttcacgccattttccctgggctttgagttcaggcctggacgggagtatttttacatttctagcgctattccagataacggcaggagaagttgtctcaaactcaaggtcttcgtgagaccgaccaacagttgcatgaagacaatcggagttcacgaccgggtctttgacgtgaatgacaaagtcgagaatagcctggagcctgctgacgacaccgtccacgagtcagccgagccctcccgtggcgagaatgcggcacaaacaccgaggataccctcacggctgcttgccatcctcctgttcctcctggccatgctattgaccctgtag

SEQ ID NO: 42045 - DNA, 2595 bp, Artificial Sequence
  Description of Artificial Sequence: Synthetic coding sequence
atggccgcccccctgatccccctgagccagcagatccccaccggcaatagcctctatgagtcctactataagcaggtcgatccagcctacacaggacgggtgggagctagtgaagccgccctttttctcaagaaaagcggcctctcggatatcattctcggtaagatatgggatctagccgacccggaaggcaagggcttcctagacaagcaggggttctatgtcgccctcagactcgtggcttgcgcacagtcaggacacgaggtgacgctctcgaatctgaatttgtccatgcctccacctaaatttcacgatacatcgtctcctctgatggtgacacctcccagcgccgaagcccactgggccgttagagtagaagaaaaggccaagtttgatggcatcttcgagagcctcctccctatcaacggactgctgtccggggataaagtgaagcctgtattgatgaacagcaaactgccactggacgtgctgggccgcgtctgggacctgtccgacattgataaagatggccacctggatcgcgacgagttcgccgtggctatgcatctagtctatagggctctggaaaaggagcccgtgccctccgctctgccaccttccctgatccctccaagcaaaagaaaaaagactgttttccccggggcagtgccggtactccctgcttctccaccccctaaggacagtctgcgcagcacaccttctcacggtagcgtgtcctcactcaactctaccgggtccttaagtccaaaacactctctgaagcagactcaacctaccgttaactgggtggttcctgtcgccgataaaatgagattcgacgaaatctttttgaaaacagatctggatctggacgggtatgttagtggccaggaagtgaaggagatctttatgcattcaggactcactcaaaatcttctagcccatatatgggcattagccgatactaggcaaaccggcaagcttagtaaggatcagttcgctctggctatgtactttatacagcaaaaagtgtctaagggtatagatccgccccaggttttgtcccctgacatggtgccaccgtcggaaaggggaacccccggccccgacagctccgggagcctgggctccggagagtttaccggtgtaaaggaacttgatgatatctcccaggagatcgcccagctgcagagggagaagtattctctcgaacaggatattcgcgagaaagaagaagcaatccggcagaagacaagtgaggttcaagagttgcaaaacgacctcgatcgcgagacttcgagtcttcaagagctggaggcacagaagcaggacgcacaggaccgcttggacgagatggaccagcaaaaggctaaactgagggatatgttgagcgacgtgcgccagaaatgtcaggatgaaacacagatgataagtagccttaagacccaaattcagtcccaagagtccgacttaaaaagtcaggaagacgacctgaatagagctaaaagcgaactgaatcggttgcagcaagaagaaacacagctcgagcaatcgatacaggccgggagagtccagttagagacaatcatcaaatcgctaaagtctacgcaggacgagatcaatcaggcacggtcaaaactgtcccagctccatgaatctagacaggaagcccaccgcagtctggagcagtacgaccaggttctcgatggcgctcacggcgccagtctcactgatctcgcaaacctgagcgagggtgtctccctcgctgagcgtgggagctttggggcaatggacgaccccttcaagaataaagcattgctgttttctaacaatacacaggagttgcacccagacccttttcagaccgaagacccatttaagtccgatccctttaaaggcgctgacccctttaagggggatccatttcagaacgatccgttcgcagaacagcagaccactagtacagatccctttggcggcgacccattcaaggagagtgacccctttcgaggttctgcaaccgacgattttttcaagaaacagacaaaaaacgacccttttaccagcgatccctttacaaagaacccttcgttgccaagcaaactggatccgtttgagtcttccgacccttttagctcatcctctgtgagcagcaagggaagtgatcccttcgggactctggatccattcggcagtggatccttcaatagcgctgaaggattcgcagacttcagtcagatgtcaaaaccacccccctccggccctttcacaagttccctggggggggcagggtttagcgatgaccccttcaagagtaagcaggatacccctgcactaccccctaagaaaccagcccccccccggcccaagcctccatccggcaagagtacccccgtgtcccagctgggcagtgccgattttccagaggctcctgatccttttcagcccttgggagccgactctggcgacccttttcaatctaaaaagggattcggtgacccctttagcgggaaggacccctttgtgcctagtagcgctgccaaaccatctaaggcgagcgcttccggatttgcggattttacctcagtcagttag

SEQ ID NO: 42046 - DNA, 2733 bp, Artificial Sequence
  Description of Artificial Sequence: Synthetic coding sequence
atggccgcccccctgatccccctgagccagcagatccccaccggcaattccctgtatgaatcttactacaaacaggtggacccggcatatacagggagagtcggagccagtgaagctgccttgttcctgaaaaagagcggactttcagacataatcctgggtaagatatgggatcttgctgaccccgagggcaaaggattcctggacaagcagggattttacgtagctttaagactcgtggcctgtgcacaaagcggacatgaggtgaccctgtccaacttgaatttatctatgccacctcccaaatttcacgacacctcctcacctctaatggtaacccccccaagtgctgaggcccactgggctgtgagggtcgaagaaaaggctaaattcgatgggattttcgagtctctgctgccaattaatggactgctgtctggtgacaaggtgaaacctgtgcttatgaacagtaagctgcccctcgacgtgctggggcgagtgtgggacttgtctgatatcgacaaagatggacatctagatagagacgagtttgcggtggcaatgcatctagtgtaccgggcattggagaaggaacctgtccccagcgccctgccgccctctctgattccaccgtcaaaacgaaagaaaacagtattccccggggcagttcctgtgcttcctgctagtccgccccccaaagacagccttcgctcaaccccatcacatgggtcagtgagcagccttaatagcaccgggagcctgagtcccaaacacagcctcaagcagacccagcctactgttaactgggtcgtgccagtggctgataagatgagattcgatgagatattcctgaaaaccgacttggacctggatggttatgtgagtggacaggaagtcaaggaaattttcatgcatagtgggctgacacagaacctactggcccatatttgggcactggcggataccagacaaacaggcaaactaagcaaggaccaattcgctttggccatgtactttatacagcagaaagttagcaagggcatagaccctcctcaggtgctgagcccagatatggtgcccccgtctgagcgcggaacccctggtcccgatagcagtggcagtctgggttctggagagtttactggcgtgaaagaactcgacgacatttcgcaggagattgcacagctccaacgcgaaaagtattcgctagagcaggacatacgcgaaaaagaggaagccatccggcagaagacttcagaagtgcaggagctgcagaatgatttggatagggagaccagttcactgcaggagctcgaggcgcaaaaacaagatgcccaagaccggctggatgagatggaccagcagaaagctaaactgcgcgacatgctttccgacgtgcgccaaaagtgtcaagatgaaacccaaatgatctcgtccttaaaaacgcagattcagtcacaggaatccgaccttaagtcccaggaggatgatctgaatcgcgctaaatcggagctgaaccgacttcagcaggaagaaacacaactggaacagtccatccaagctggccgcgtccagttagagactatcatcaagagcctcaaatccactcaggacgaaataaatcaggccaggtcaaagctgtcgcaactgcacgaatctcggcaagaagcccataggtctctcgagcaatatgaccaggtgttggacggggctcacggcgccagcctcactgatctggcaaatctcagcgagggcgtgagtttggcggagcgcgggagtttcggtgcaatggacgatccattcaaaaataaggctctcctgttttccaataatacccaagagttgcatcctgatccctttcagaccgaggacccattcaagagcgacccctttaaaggggccgatccatttaaaggggatccatttcaaaatgatccatttgccgaacagcagacgacatcaactgatccattcggcggtgaccccttcaaggagtcagatccttttaggggttctgctacagacgatttcttcaagaagcagactaaaaacgacccctttaccagtgacccattcactaagaatccgagtctgcccagtaagctagatccatttgagagctccgacccattcagtagttcctctgtatcatctaagggttctgaccctttcgggacattggacccatttgggtccggctcatttaacagtgccgaagggttcgcggacttttcacagatgagcaagcccccgccttctggaccgtttacttctagtctgggaggagcaggatttagcgatgatcccttcaaaagtaaacaggataccccagccctaccaccgaagaagccagccccgccccggcccaagccgccaagcggcaaatcaacccccgtttcccagttaggatcggctgatttcccggaagctcctgaccctttccagccactgggagccgactcgggggatccctttcagtcaaagaaagggttcggcgatccgttctcaggaaaggacccgtttgtgccatcctccgccgcaaagccctcgaaggcctcagctagcggctttgccgatttcaccagcttcggaaatgaagagcagcagctggcttgggccaaacgggaatcagagaaggctgagcaggaaagacttgccagactgcgtcgccaggagcaggaagacctcgaattggcaattgccttatccaaagctgatatgccagctgcctag

SEQ ID NO: 42047 - DNA, 2265 bp, Artificial Sequence
  Description of Artificial Sequence: Synthetic coding sequence
atggccgcccccctgatccccctgagccagcagatccccaccggcaattccctgtacgaatcttattataagcaggtggaccctgcttacacaggaagggtgggtgcgagcgaggccgctctctttctcaagaaatcgggactgagtgatatcattttgggtaagatctgggatttggcagatcccgagggcaaaggctttctggataagcagggattctatgtagcattgaggttagtagcgtgcgcccagtcggggcatgaagtgaccctctccaatctgaacctcagtatgccgccaccaaaattccacgacacgtcgagtcctttaatggtgacccccccttctgcagaggctcactgggcagtgagagttgaagaaaaagctaaattcgacggaatctttgagtctctgttgcctatcaacggcttgctgtcaggcgacaaggttaaaccagtgttaatgaacagtaaactcccacttgatgtgctggggcgagtctgggacctgagcgacatcgacaaggacggacacctggaccgtgacgagtttgctgtggcgatgcacctggtttatcgggctctggaaaaagaacctgtgccctccgcgctgcctcctagcttaatacctccgtctaaaaggaaaaagaccgtcttccctggcgcagtgccagtactcccggcaagccctcctcctaaagacagtctgcgttctaccccctctcatggatccgtatcgtctctgaacagtactggaagcctgagcccaaagcatagtcttaagcaaacgcagcccactgttaactgggtggtgcctgttgcagataaaatgcgctttgatgagatttttctgaagacagatctggacctagatggttatgtgtcggggcaggaagtgaaggagatcttcatgcactcaggactcacgcagaatctgctcgctcacatctgggcattagcagacactcgccagacagggaagctgagcaaggatcagttcgctttggctatgtactttatccaacagaaagtgtccaagggtattgatcctccccaagtgttgagtcccgacatggtgcccccttcagagcgaggtactccgggtccggatagcagcggttccctaggatctggggaattcactggagtcaaagaactggacgatataagccaggagatcgctcaactgcagagagaaaagtactcgctggagcaagacatcagggaaaaggaggaagccattcgtcagaagacctcagaggtccaggagctgcagaatgatctcgatcgggaaacctcctccctccaggaactggaagcacagaagcaagacgcacaagatcgcctagacgaaatggatcagcagaaggcaaagctgcgcgacatgctgtcagacgtgaggcagaagtgtcaagatgagacccagatgattagctctctgaagactcagatccaatcccaggaatccgacctgaaatcccaggaagacgatctcaatcgcgctaaaagcgagctgaataggctgcagcaggaagagacacagttagagcagtctattcaagctgggcgggttcagttggaaacgataatcaaatccctcaaatccacccaggatgagatcaatcaggcgaggtccaaactgtctcagttacatgaatcccggcaggaggcccatcgttcactagagcagtacgatcaggtgctggacggagcccacggggcatccctgacagaccttgctaatctgagcgagggcgtgagcttggccgagagagggagttttggcgccatggatgatccgttcaaaaacaaagccttgctcttttctaacaacacgcaggagctccatccagaccctttccagacagaggacccgttcaagtctgacccattcaaaggcgctgatccttttaagggagacccattccaaaatgacccatttgcagagcagcagacgacatccacggaccccttcggcggggatccgtttaaagagtccgatccttttcgcggctcggccacggatgatttctttaagaaacagacgaagaacgaccccttcacctcggatccattcacaaagaatccttctctgccctccaagctcgacccgttcgaaagctccgatcctttctcttcatcttccgtaagcagcaagggcagtgaccccttcgggacactggacccttttgggagcggctcctttaactctgcagagggtttcgcagatttcagccagatgtccaaagtgaaagtgcacctgtag

SEQ ID NO: 42048 - DNA, 1806 bp, Artificial Sequence
  Description of Artificial Sequence: Synthetic coding sequence
atggccgcccccctgatccccctgagccagcagatccccaccggcaattctctctacgagtcatactacaaacaagtggaccccgcctacaccggacgggtgggcgcaagtgaagccgcgctatttctgaagaagtctgggttgagcgatatcattctcgggaagatatgggatcttgccgatccggaaggaaagggctttctagacaaacagggcttctatgtcgcattgcggcttgtggcctgtgcccagagcggccacgaggtcacactgtcaaacttaaatctgtcaatgcccccacctaaatttcacgacacttcttcacccctgatggtaacccccccgagcgccgaagcgcactgggcagtccgggtagaagaaaaggccaagttcgacggtatctttgagagcctattgccaattaacggccttctttctggcgacaaagtgaagccagtgctgatgaactctaagttacccttggacgtactcggaagagtgtgggatctgagtgacatagacaaggatgggcacctggatagggacgagttcgcagtcgcgatgcacctcgtgtacagagcactcgaaaaagaacccgtaccaagtgcccttccaccctcattgatacccccctctaagaggaagaagaccgtgtttcctggggcagttcccgtcctgcccgcctctcccccacctaaagactctttgcgcagtacacctagtcatgggtccgtgtctagtctcaactctacgggcagtctttccccgaaacactctctaaaacagacccaaccaactgtgaattgggtggtgcctgtggccgacaaaatgcggttcgacgagatctttctaaagacagatctcgatctggacggatacgtctctggccaggaagtgaaagagattttcatgcacagcgggttgacccagaatttgttggctcacatttgggcgctcgctgatacccggcagaccggcaaactgtctaaagaccagttcgcgctggccatgtatttcatccagcagaaggtgtctaagggcatcgacccaccacaggttttatccccagatatggtgccaccgtcagaacggggaacccctgggccagactcatcaggctctttgggctccggggagtttacaggagtgaaggagctggatgacatctctcaggagatcgctcagctgcagagggagaaatattctctggagcaagatataagagagaaggaagaagctattaggcagaaaactagcgaggtgcaggagttgcagaacgaccttgatagagaaaccagcagcctgcaggaattggaggctcagaagcaggacgctcaggaccgcctggatgagatggaccagcagaaagccaagcttagggacatgctcagcgatgtcagacagaagtgtcaagatgaaacccagatgatttctagtctgaagacccagatccaaagccaggagagtgatctgaagtcccaggaggatgacctaaaccgggcaaaaagcgagctcaaccggctgcaacaagaggaaactcagctggagcagtccatccaggcaggccgcgtacaactggaaactataatcaagagtttgaagtccacccaggacgaaattaatcaggcccgcagcaaattgagccagctacatgagtcacgccaggaagctcaccgctcgcttgagcagtacgaccaagtgctcgacggagcccatggtgctagtttgacggatcttgctaacctgtcagaaggagtttctctggctgagagaggctcattcggcgcaatggttaaagtcgaatag

SEQ ID NO: 42049 - DNA, 1824 bp, Artificial Sequence
  Description of Artificial Sequence: Synthetic coding sequence
atgtggatgacccccaagcggagcaagatggaggtggacgaggccctggtgtttcgacccgagtggacccaaagatacttggtcgtggagcctccggaaggggacggcgccctctgccttgtctgtcgtcgcctgatagtcgcaaccagggagagagacgtacgacgccactacgaagctgagcatgaatattacgaacgttacgtggctgacggcgaaagagccgccctggtcgagcgcctccggcaaggggatctccccgttgcttcattcactccagaagagagagctgcccgcgcaggactcggcctgtgccggcttctggcactgaaaggacgggggtggggcgaaggagactttgtgtaccagtgcatggaagtgcttctgcgagaggtcttgccagaacacgtgagcgtgctccaaggagtggacttgagtcccgacatcacgcgccagcggattctctctattgaccgcaatctgagaaaccaattgttcaatagagctcgggattttaaggcatacagcctcgctctcgatgaccaggccttcgtggcctacgaaaactatctgctggtgtttataaggggggtcggaccagaattggaggtgcaggaggacctgcttaccatcatcaacttaacccaccatttcagtgtaggtgctctaatgagtgcaattttagagtccttacagaccgcaggactatccctccagagaatggtaggcctgacaaccacccacaccttgcgcatgatcggtgagaatagcggattagtgagctacatgcgcgaaaaagccgtcagccccaactgctggaatgtgatccattacagtggttttttgcatttggagcttctctcatcttacgatgtagacgtgaaccagattataaacacaatttctgagtggattgtgttaattaaaaccaggggggttaggcggccggagttccagactctgctgacagagtctgaaagcgagcatggagaaagggttaacgggcgttgtttgaacaactggctccgtcgaggcaaaactttaaagcttatattcagcctgcgaaaggagatggaggcctttttagtgtcagtaggggctaccactgtgcacttttccgacaagcaatggctttgtgactttggattccttgtggatattatggaacacttgagggaactctctgaggaattaagggtcagcaaggttttcgccgctgccgcgtttgaccatatatgtacattcgaagttaagcttaacctgttccaacgccacatcgaggagaagaacctgacagattttcccgccctccgagaggtcgtcgatgagctcaagcagcaaaataaagaggatgaaaagatcttcgaccccgatagatatcagatggttatctgtaggctccagaaggaattcgaaagacacttcaaggatttgcggttcattaaaaaggaccttgagctcttttccaacccattcaacttcaagcccgagtatgccccaatcagcgtacgcgtggagctcacaaagctccaggccaataccaacctctggaatgaataccgaatcaaggacctaggccagttctacgctggcctgagtgctgagagctaccccatcatcaagggagtggcctgcaaggttgcaagcctttttgattctaaccagatctgtgagaaggcgttcagttacctgacacgaaaccagcacaccttgagtcagccgctgacagacgagcacctccaggctcttttcagggttgcaaccacagaaatggagccggggtgggatgacctcgtgagagagcggaatgagtcaaacccctag

SEQ ID NO: 42050 - DNA, 1089 bp, Artificial Sequence
  Description of Artificial Sequence: Synthetic coding sequence
atggcccggctgcgggactgcctgccccggctgatgctgaccctgcgttctctgctgttttggtctcttgtgtattgctattgcggcctttgcgcctccatccacctgctgaagttgctatggagcctgggtaaagggcccgctcagacctttaggagacctgccagggagcaccccccggcttgtctttccgatccatcactggggacacattgctacgtgagaatcaaagactcagggctcaggtttcactatgttgcagcgggcgaacgagggaagcccttaatgctgttgttgcacggttttccggagttctggtacagctggaggtaccagctgagggagttcaagtctgagtacagagttgtggccttggatctgagagggtatggcgaaaccgacgcccccatacaccgccaaaactataagctcgactgcttaattaccgatatcaaggacatactggactccctgggatattccaaatgcgttctcattggacacgactgggggggcatgatcgcatggttgatcgctatttgttatcccgagatggtcatgaagctgatcgttataaacttcccgcacccgaacgtctttaccgagtatatcctacgtcatcccgctcagctgctcaagagcagttattactacttttttcagattccgtggtttcccgaattcatgttctcgataaacgactttaaagtcctcaagcatctgttcacttcccatagcacgggtattgggagaaaagggtgccagctgacaaccgaagatctagaggcttacatttatgtcttttcacagcccggggcgctgagcgggcccatcaatcattacagaaatatcttcagctgccttcctctcaagcatcatatggtcacaactcccactttactactgtggggtgaaaatgacgcatttatggaggttgaaatggcagaagttaccaagatttatgtgaagaattactttagactgaccattctctcagaagcctcacactggttgcaacaggatcagccagatatagtgaataaactcatatggacattcttaaaggaagagacacgaaaaaaagactag

SEQ ID NO: 42051 - DNA, 1974 bp, Artificial Sequence
  Description of Artificial Sequence: Synthetic coding sequence
atgcagtggcgggccctggtgctgggcctggtgctgctgcggctgggcttgcacggcgtcctctggctagtgttcggacttggccctagtatgggattttatcagaggtttcctctgtcctttgggtttcaacggttgagaagccccgacgggcccgcgtctcctacttccggccctgtgggacggccagggggcgtttcaggaccttcctggctacaacctccgggaaccggtgctgcccagtcaccacgcaaggctcccagacggcccggccccgggatgtgtggccctgctaattggggctatgtcctgggaggtcgtggacgtggacctgacgagtatgagaaacggtactccggcgcattcccaccacaactgagagcccagatgagagacctcgcacgggggatgtttgtattcggatacgacaactacatggcacacgcctttcctcaagacgagctaaatcccatacactgccgcggacgggggcccgataggggtgatccttctaatttgaacattaatgacgtccttggaaattacagcctgacccttgtggatgctcttgacacactggcaatcatgggaaatagcagcgaatttcagaaggccgtcaaactcgttataaatacagtgtcatttgataaggactctactgtccaggttttcgaggcaacaatccgggtcctgggaagtcttctgtctgcgcaccgaattatcaccgatagtaagcagccattcggagatatgaccatcaaagattatgacaacgaactcctatacatggcacatgatctggcggtgcggttgctcccagcatttgagaatacaaagaccggtatcccttaccctcgggtgaacctcaagacaggagtgcctcccgataccaataacgagacctgcacagccggagcagggtctctcttagtggagtttggaatcctcagcagacttttgggtgattctacatttgaatgggtggcgcgccgcgccgtaaaagcactgtggaacctgagatccaacgatactgggctgttgggcaatgtggtgaacatacagacaggacactgggtgggtaagcagagcgggttgggcgctggcctggactctttttatgaatacctactcaaaagctacatattattcggggagaaggaagacctggagatgttcaatgccgcttaccagtccatccagaattatctgagaagaggtcgcgaagcatgcaacgagggtgaaggcgatccaccactttatgtaaacgtgaacatgttttcgggacagctgatgaatacttggatcgactcacttcaggctttttttccaggcttgcaggtgctgattggagatgttgaggacgcgatttgtctccacgccttttactacgctatctggaagagatacggcgctttgcctgagagatacaattggcagctgcaggcccctgacgtgctgttctaccccctgcgtcccgaactcgtggagtccacctacttactttaccaggccactaagaatcccttttaccttcacgttggcatggacattctgcaatccttggaaaagtatacaaaggtgaaatgtggttatgcaaccttacaccacgtcatcgataagtcaacggaagaccggatggagagtttcttcttgtcagagacatgcaaatatctgtatttactgtttgacgaggataatcctgtgcataagtcggggacacggtacatgtttacaactgagggccatatagtttcggtggatgaacacttgcgagaactgccctggaaagaatttttctcagaggaaggcggtcaggaccaaggcggaaaatctgtgcatcgacctaagccccacgaattgaaagtgattaacagctcttccaattgtaaccgggtaccggatgaaagacgctactctttacccctgaagtcaatatacatgaggcagatagatcaaatggtaggtctcatttag

SEQ ID NO: 42052 - DNA, 639 bp, Artificial Sequence
  Description of Artificial Sequence: Synthetic coding sequence
atgcactggatccacctgcaggtgctgggcagcctgctgagcgcccaccgcattataaccgactccaagcagcccttcggcgatatgacaattaaagattatgataatgagctcctgtatatggcccacgacctggccgtacgactgttgccagcctttgagaacacgaaaaccggaatcccctatccgcgtgtgaatcttaagaccggggtcccaccagataccaataatgaaacttgtacagccggtgcgggtagcctgctcgtcgaatttggaattctgagtaggctgttaggcgactccacttttgagtgggtggcacgtagagccgtgaaggcactgtggaaccttcgctcaaacgacactgggctacttgggaacgtggtgaatattcaaactgggcactgggttggtaagcaatctggtctgggcgccggcctcgattctttttacgagtatctgctcaagagttacattctcttcggcgaaaaagaagaccttgaaatgttcaacgctgcctaccaaagcattcagaactatctgaggcgaggacgcgaggcatgcaatgaaggggaaggagatccccctctgtgccaacgcgagcatgttcagtgggctgccgatgagcatcttgactag

SEQ ID NO: 42053 - DNA, 1131 bp, Artificial Sequence
  Description of Artificial Sequence: Synthetic coding sequence
atgggcaacagcagcgagttccagaaggccgtgaagctggtgatcaacaccgttagtttcgacaaggacagcaccgttcaggttttcgaagctacaattcgcgtgttaggctctctgcttagcgcccatcgaatcataacagactctaaacagcctttcggagacatgaccataaaagactatgacaacgagttactttacatggcgcacgatctggctgtgcggttactccccgcatttgagaataccaagaccggcattccctacccccgcgttaatctgaagacaggggtgcctccggacaccaataacgagacctgcacagcgggagctggaagccttctggtggaatttggtattctgagccggcttctaggagacagtacattcgaatgggtggcacggcgggcagtgaaggccctctggaacctgaggtccaatgatactggcctgcttggcaacgttgtgaacatacagaccgggcattgggtcggaaaacagagtggcctcggtgcggggctggatagcttctacgaatacctgctcaagtcctacatcctatttggggagaaggaggacctggagatgttcaacgccgcctatcagagcattcagaactacctgcgacggggacgggaggcttgtaatgaaggagagggggaccccccactctatgtgaatgtcaacatgttctcagggcagttgatgaacacttggattgacagtctacaggcgttttttccagggttgcaggtcttgataggagacgtggaagacgcgatctgtcttcatgcattctattacgccatttggaagaggtacggcgctctgcccgaaaggtacaattggcagctgcaggcccctgatgtcttgttctacccgctgcgcccagagctcgtggagtcgacctacctgctgtaccaggccactaaaaacccattctacctgcacgtgggcatggacattctacaaagtttggaaaaatacaccaaggttaagtgcgggtatgctacactccatcacgtcatagataagtcaaccgaggatcgcatggagtctttctttcttagtgagacttgcaaatacctctacctcgtgtgtgtcctgcaggacgagccccgcaacatatag

SEQ ID NO: 42054 - DNA, 2799 bp, Artificial Sequence
  Description of Artificial Sequence: Synthetic coding sequence
atgagcgaggccggcggccggggctgcggcagccccgtgccccagcgcgccaggtggagacttgtggccgccactgccgcattctgcctggtgtcagctaccagcgtctggaccgccggagccgaaccaatgtccagagaggaaaagcagaagctcggaaatcaggtgctcgaaatgttcgaccacgcctacggaaactacatggagcacgcttatccggctgatgagttgatgccactaacctgcagaggacgcgtcaggggccaggagccctcccgaggggacgtggatgacgccctgggcaaattcagcctcactttgattgattctctcgacacgctcgtggtcctgaacaagaccaaagaatttgaagacgcggtgcggaaggtccttagggacgtgaatttggataatgacgtcgtagtgtccgtcttcgagaccaacatacgcgtactagggggcctcctcggaggccacagtctggcaattatgttaaaagagaaaggagagtacatgcaatggtacaatgacgagctactgcagatggctaagcagctaggctacaaattactgcctgcttttaacacgacaagcggactgccttatccacggataaacctgaagttcggaattcgtaagcctgaagctagaacgggtactgagacagacacgtgcaccgcttgcgccggtactttgatcttggaatttgctgcactgtcccgcttcactggcgctaccatttttgaggaatatgctcggaaagctctggattttctgtgggagaagcgacagagatcttcaaatttggtgggcgtgactatcaacatccatacgggggattgggtcaggaaagactccggcgtgggcgccggaattgacagctactatgaatacctgctgaaggcttatgtgctgctcggggacgatagttttctggaacgcttcaacacccattacgatgccatcatgcggtatatctcacaaccgcccctgttgctggacgtgcacatacataaacccatgctgaacgcccgcacttggatggacgcactattggccttcttccctggtctacaggtcctgaagggggatataagacctgcaatcgaaacccatgagatgctgtatcaagtgattaagaaacataattttctgccggaagcattcacaaccgatttccgcgttcactgggcccagcacccactgcggccggagtttgccgagtcaacatactttctctacaaagcgacaggagatccatattacttggaagtgggtaagacactgatcgagaatctcaacaaatacgctcgagtgccctgcggctttgctgcaatgaaagatgtccgtaccgggagtcacgaggatcgcatggatagttttttcctcgccgagatgtttaaatacctatatcttctatttgcagacaaagaagacattatttttgacatagaggactatatcttcacaacggaagctcaccttctgccgctctggctctctacaactaaccagtcaataagcaagaagaacacgaccagtgaatataccgagctggatgatagcaacttcgattggacttgtccaaacacccaaatactcttccccaacgatcccctttacgcgcagagtatccgagagccgctcaaaaacgtggttgacaagagctgccccagagggatcatacgagtggaggagtctttccgatctggcgccaaaccgccactgagggccagagacttcatggccacaaatcctgagcacttggagatccttaaaaagatgggggtctccttgattcacctgaaagacggcagggtgcagttggttcagcatgcaattcaggctgctagctccatcgatgccgaggatggactgcggttcatgcaggagatgatcgaattgtcttcacaacaacaaaaagagcagcaactgccgcctcgggctgtccagatcgtgtcacacccatttttcggtcgagtagtccttaccgctgggcctgcccaattcgggctagacctctcaaagcataaagagactagaggatttgtagcctcatcaaaaccaagcaacggctgtagcgagcttactaaccctgaggcggtcatggggaagattgcactgatccaacgaggccagtgtatgtttgccgagaaggcaaggaatattcaaaatgcgggcgctataggtggaattgtaatcgatgacaatgaaggatccagctcagatactgccccactgtttcagatggcgggtgatggcaaggatactgacgacatcaaaattcccatgctgttcctttttagtaaggagggctccattatactggatgccatcagagaatacgaagaagtggaagtgctgttatcggacaaagccaaagatcgggacccagagatggagaatgaggagcagccctccagtgaaaacgactcccagaaccaaagcggagaacagatcagtagctcaagtcaggaggtggatttagtggaccaggagagcagtgaagaaaactctctgaacagccacccggaaagcctgagtcttgccgacatggataacgccgcctccatcagtccgagtgaacagacatcaaatccaaccgagaatcacgagacaaccaatctgaatggggaatgcactgacctcgacaatcaactgcaagaacagtccgagaccgaggaggatagcaatcccaacgtctcttggggcaaaaaggtgcagccaatcgactctatactcgcagactggaatgaggacatcgaagcctttgagatgatggagaaggatgagctctag

SEQ ID NO: 42055 - DNA, 2718 bp, Artificial Sequence
  Description of Artificial Sequence: Synthetic coding sequence
atgagccgggaggagaagcagaagctgggcaaccaggtgctggagatgtttgaccacgcctatggaaattatatggaacacgcctatcctgccgacgagctcatgcccttgacctgtaggggaagggtcaggggccaggagccttcacggggagacgtggacgacgccctgggtaagtttagcttgaccctgatcgattcacttgacacacttgtcgtcctcaacaagacaaaagaattcgaagatgcagttcgaaaagtgttacgtgacgtcaacttggataatgatgtggtggtctcagtgttcgaaactaacatccgggtactgggagggctgctgggcggacactctctggctattatgctgaaggagaaaggtgagtacatgcagtggtataacgacgaacttctccagatggccaagcaactgggctataagctgctgccggctttcaataccaccagcggcttaccataccccaggattaatttgaaatttgggatccgcaaaccagaggcgagaacaggcacggaaactgacacatgcaccgcgtgcgcaggcactcttattctggaatttgctgccctgtccaggttcacaggggcgactatttttgaagaatatgctcgtaaggcccttgattttctctgggagaaaagacagagatcgtcaaacctggtcggtgtgacaatcaacattcataccggcgactgggtgagaaaggattcaggcgttggagccggaattgattcatactacgagtatctgttgaaggcatatgtactgctgggagacgacagcttcctggaaagattcaacacacattacgacgctattatgagatacatatcacagccccccttgctgctcgatgttcatatccataaacccatgctcaacgctagaacttggatggacgccctgctcgcattttttccaggtcttcaggtgttaaagggagatattcgtcctgccatcgagactcacgaaatgctgtatcaggtgatcaaaaaacataattttttacctgaagcgtttactactgattttagagtacactgggcccagcatcccttacgcccagagttcgcagagtcaacatactttctgtacaaagccactggggatccctactacctggaagtggggaaaaccctcattgaaaacctgaataaatacgctcgagtgccatgcggattcgcggccatgaaggatgtaagaaccggctctcatgaggacaggatggactcttttttcctggctgagatgttcaagtatctttacttgctatttgcagataaagaagacattatcttcgatatcgaagactatatttttacaaccgaagctcatctgttacccttgtggctctctaccaccaatcagtccataagtaagaagaatacaactagcgaatacaccgagctagatgattccaacttcgactggacatgtcccaatactcagattctgttcccaaacgaccctctgtatgcccagagcattcgcgaaccactaaagaacgtggtcgacaagtcctgcccgcgagggattatcagggtggaggaatcttttagaagcggagccaaaccccctcttcgtgctcgcgacttcatggcaactaaccctgaacatttggagattctgaagaaaatgggggtttctttaatccatctgaaagacggacgagttcaactggtccagcatgcgatccaggccgccagttccatcgacgccgaagacggactgcgctttatgcaggaaatgatcgaactgtcctcgcaacagcagaaagaacagcagctgcctccgcgtgctgttcagatcgtcagccatccattcttcggacgcgtagtcctgactgccggtcctgcacagttcgggcttgatctgagcaaacacaaagaaacacgcggcttcgttgctagtagcaaaccctcaaatgggtgctccgagctcacaaatccagaggccgtgatgggtaagatagccctcattcagagagggcagtgcatgttcgctgaaaaagctaggaatattcagaacgccggtgctattggcggtatagtgatcgacgacaacgaagggtccagcagcgatacagccccactgttccaaatggcgggcgacgggaaagataccgatgacatcaagatacctatgttattcctgttctcaaaagagggttcaattattcttgatgctatacgcgagtacgaggaagtcgaggtgctgctctcggataaggctaaagaccgggccgcaattttgaagggaaaaatgatcccatcatatattattaatagcaaccccgaaatggaaaatgaggaacaacccagtagcgaaaacgacagccagaaccagtcaggcgaacaaatatccagtagctctcaagaagtggatctcgttgaccaagagagctcggaggaaaactcactgaattctcaccccgagtccttgtctctggctgatatggataatgccgcgtcaatctcaccttctgaacagaccagtaatcccacagagaaccacgaaactaccaacttaaatggcgagtgcaccgacttagacaatcagttacaggagcagtcagaaacggaggaagatagcaacccaaatgtgagctggggcaagaaggtccagcccatcgattccatcctggccgactggaacgaggatattgaggccttcgaaatgatggagaaagatgagctctag

SEQ ID NO: 42056 - DNA, 1314 bp, Artificial Sequence
  Description of Artificial Sequence: Synthetic coding sequence
atggccgcccccagctggcggggcgcccggctggtgcagagcgtgctgcgggtgtggcaggtgggcccccacgtagcaagagagagggtgattccattctctagcctgctcggatttcagcgtaggtgcgtgtcctgtgtcgcgggaagtgcgttcagcggacctcggctcgcgagcgcctcgaggagcaacgggcagggaagtgccctggatcacttcctaggcttttctcagcctgattcaagtgtgactccctgcgtgcccgcggtctccatgaatagggatgaacaagacgtgcttctggtacaccaccctgatatgccagagaacagtagggtactgcgcgtggtgctactcggagcccctaacgccgggaaatccacactaagcaatcagctgctgggccgcaaagtatttcctgtgtctcggaaagtgcacacaactaggtgccaggcgctgggagtcattaccgagaaggagacccaggttattttattggatacacccggcatcatctccccaggtaaacaaaagcgccatcacctcgaactgtctctcctggaggatccttggaagtcaatggagagcgccgatttggttgtcgtactggtcgacgtcagcgataaatggaccaggaatcagctctccccccagctcctcagatgccttacaaagtatagccaaattcctagcgtcctcgttatgaacaaggtggactgcctcaaacagaagtccgttctcttggaactcaccgctgccctaactgaaggcgtcgtcaatggcaaaaagctcaagatgcgacaagcgtttcactctcaccccgggacccattgtccatcccctgccgtgaaagacccaaacacgcaatccgtgggcaacccgcaaagaattggctggccacacttcaaggagatctttatgctctccgctctctcacaggaggatgtcaagactctaaagcagtacctgttgacgcaggcacagccaggaccgtgggagtaccatagcgctgttttaacatcccagacacctgaagaaatctgtgcaaacatcattcgagagaaactgcttgagcatctgccccaggaagtgccatataacgtccagcagaagacagctgtctgggaggagggaccaggcggcgagctggtcatccagcagaaactgctagtgcccaaagagagctacgtgaaacttttgattggcccgaagggacacgtgatttctcagattgctcaagaggccgggcacgatctcatggacattttcctgtgcgacgttgatattcgattgtcagtaaagcttctgaaatag

SEQ ID NO: 42057 - DNA, 732 bp, Artificial Sequence
  Description of Artificial Sequence: Synthetic coding sequence
atgagccggatgagcagctggagcatcaccctgatctgcctgcggatccctgggagctatgaatggtcatcctgggagcctcgcatgcaaggaagccagcactccccaactagctattgggctgagcgatgtagcctgtttcccggaaggtgtattctgctggccgcaaagctttggggttcatctcagcgtcgtcgaccaagatggtgggtacctactaagggggtcctggaaaccggccaacgagtgaaattgcgcggttccccgctccccagcgccctaaagaagatgatggtaacatttatttacatcctgttggatacgccgggtatcatttcccccggcaaacagaaacgacaccatctggagctgtcccttttggaggatccctggaagtcaatggagtcagcagatctggtggttgtcctggttgacgtgtcagataagtggacccgaaatcagcttagcccccaactcctgcgatgcctaacaaagtatagccagattccctccgttctggtaatgaacaaggtcgactgcctgaagcaaaaatcagtgctgctcgaattgactgctgcccttacggaaggagttgtaaacgggaagaagttaaagatgcgccaagcttttcactctcaccccgggacacattgtccatctccagcagtgaaggacccgaatacacagtccgttggcaaccctcagagaatcggctggccccactttaagtag

SEQ ID NO: 42058 - DNA, 1167 bp, Artificial Sequence
  Description of Artificial Sequence: Synthetic coding sequence
atggaggccctgggcaagctgaagcagttcgacgcctaccccaagactctcgaagacttccgggttaaaacctgtggtggtgcaactgttaccatcgtgtctggccttctcatgttgctgctattcctgagtgaattacagtattatcttactacagaagttcaccccgaattgtacgtggataaatcccgtggggacaagctcaaaattaatatcgatgtcctgtttcctcacatgccctgcgcctacctgagcatagatgctatggatgtagcaggtgagcagcagttggatgttgaacataacctcttcaagcagagattggacaaagatggaattccagtttcttccgaggccgagcgccatgaacttgggaaggtagaagtgaccgtattcgatcctgacagcttggatcccgacagatgcgaatcctgctacggcgccgaagctgaagatatcaaatgctgcaacacctgcgaagatgtgcgggaggcttatcgcaggcgaggctgggcatttaaaaacccagacacaatagagcaatgcaggagagaagggtttagccagaagatgcaggaacagaagaatgagggatgtcaggtgtacggcttcctggaagtcaacaaggtagccggtaactttcatttcgccccaggcaagtctttccagcaaagtcacgtacacgtgcaaggggaagaagtccacgacttgcagagtttcggattagataatatcaacatgacgcactacatacagcacctgagctttggggaagactacccaggcatcgtgaaccccctggaccacactaatgtcactgcccctcaagcatcaatgatgtttcaatattttgtgaaggtggtgcccacagtgtacatgaaggttgacggggaagtgctaagaacaaaccagttctcagtcacccgacatgaaaaagtcgcaaacggactactaggagaccaagggttgccaggggtctttgtgctctacgaactcagcccaatgatggtaaagctgaccgagaagcaccggtcttttacccactttctcactggtgtttgtgccatcatcggaggcatgtttaccgtggccggcctaattgacagcttaatataccattccgccagggcaattcagaagaaaatcgatctgggaaagactacatag

SEQ ID NO: 42059 - DNA, 1152 bp, Artificial Sequence
  Description of Artificial Sequence: Synthetic coding sequence
atggaggccctgggcaagctgaagcagttcgacgcctaccccaagaccctcgaagacttcagagtgaagacctgcggtggggccacagtcactattgtcagcggactattgatgctcctgctctttctctccgaattgcaatattacctaaccaccgaggtccatcccgaactctacgtggataagagtagaggggataagctgaagatcaatatagatgtcctctttcctcatatgccatgcgcttacttgagcatagacgccatggatgtggcaggcgagcagcagttagatgttgagcacaatctgttcaagcagcgtctagacaaggacggcatccccgtctcatctgaggctgagagacacgaactgggcaaggtggaggtcacagtcttcgaccccgatagcctggacccagatagatgtgagtcctgttacggtgctgaagctgaagacatcaaatgttgtaatacgtgcgaggatgtgcgggaagcctaccgccggcggggctgggccttcaaaaatccagacaccatcgaacaatgccgccgggagggattttcccaaaagatgcaggagcagaaaaatgaggggtgccaggtctacggctttctggaagtgaacaaagtggccggcaactttcactttgcaccaggcaaaagcttccagcagagtcacgtacacgtgcacgacctccagagcttcggactcgataatatcaatatgacccattatatccagcacctgtcttttggcgaggattatcctggcattgtgaatcccctggaccacaccaatgtgacagcccctcaagcctccatgatgttccagtacttcgtcaaggtggttcccactgtgtacatgaaggtagatggtgaggtcctaaggactaatcagttcagcgttacccgccatgagaaagtggccaacgggctcttaggcgaccaagggctcccaggagtgttcgtcctctatgaactctcccccatgatggtcaagctgaccgagaaacaccggagcttcacacatttcttgaccggggtatgtgcgatcattggtgggatgttcacggtagcaggcctcatcgattcactgatctatcactctgctcgcgctatccaaaagaaaatcgatctcggtaaaacaacctag

SEQ ID NO: 42060 - DNA, 597 bp, Artificial Sequence
  Description of Artificial Sequence: Synthetic coding sequence
ctgagcgtggccttcagctgctgctacggcgccgaggccgaggacatcaagtgctgtaatacgtgtgaagatgtaagagaagcgtatcgcagaaggggctgggcatttaaaaaccctgacaccatcgagcagtgtaggagagaaggcttcagccagaagatgcaggagcaaaagaacgaggggtgtcaggtgtatggcttcctggaggtcaataaagtggccggcaacttccacttcgcccccgggaaatctttccagcaatcgcatgtccacgtgcatgatctgcagtcttttggcctggataacataaacatgacccattacattcaacatttatcttttggcgaagactaccctgggatcgttaatcccctagaccacactaatgtcaccgcccctcaggcctcaatgatgttccagtattttgttaaggtggtgcctaccgtatacatgaaagtggatggcgaagtgctccgcacaaaccaatttagtgttacacgtcacgagaaggtcgctaatggactgctcggggaccagggcttgccgggtgtgttcgcgcatcttccgcttagcacaagtcacccagaggagaactag

SEQ ID NO: 42061 - DNA, 1167 bp, Artificial Sequence
  Description of Artificial Sequence: Synthetic coding sequence
atggaggccctgggcaagctgaagcagttcgacgcctaccccaagacgcttgaagattttcgtgtgaagacttgtggaggcgccaccgtcacaattgtgtcgggtctcctgatgctgctactcttcctttccgagctgcaatattatttaaccaccgaggtacatccagagttgtatgtggataaatctcgaggcgacaaactcaaaatcaatatcgatgtattatttccccatatgccctgcgcctatcttagcattgacgccatggatgtggccggcgagcagcagctcgatgtggagcacaatctcttcaaacaaaggttggataaggatgggatcccagtgtcgagtgaggctgaacgacacgaacttggcaaagtagaggtgacggtgttcgaccccgattccctcgatcctgatcgctgtgaatcatgctatggagcggaagcggaagacatcaagtgctgtaatacctgcgaggatgttcgagaggcctaccgccggagagggtgggcattcaaaaaccccgacaccatcgagcaatgccggagagaggggttcagccaaaaaatgcaggagcaaaaaaacgagggctgccaggtgtacggctttctggaggtaaacaaagtggctgggaacttccacttcgctccaggaaagagtttccagcagtcacatgtgcacgttcacgcagtggagattcatgacctgcaatctttcggcctggacaacataaacatgactcactacatacagcatctgtcatttggtgaggactaccctggaatcgtcaatcctttggaccataccaacgtaaccgcgccccaggcatccatgatgtttcagtattttgtgaaggtagttcccactgtttacatgaaagtcgacggcgaggtactgaggactaaccagtttagtgtaacccgacacgaaaaggtggccaacggtctcctgggcgatcagggtctacccggggtctttgttttgtatgaactgagtccaatgatggtcaagctgaccgagaagcacaggtcattcacccatttcctcacaggagtctgtgccattatcggaggcatgttcacggtagccggtctaatcgattcgctgatttaccactctgctcgggccattcaaaagaaaatcgatctgggaaagaccacatag

SEQ ID NO: 42062 - DNA, 1197 bp, Artificial Sequence
  Description of Artificial Sequence: Synthetic coding sequence
atggaggccctgggcaagctgaagcagttcgacgcctaccccaagacccttgaagactttcgcgttaagacatgcgggggggcaactgtcacaattgtctcaggtttactcatgcttctgcttttcctctctgagctgcagtactatctaacaacagaggtccaccccgagctgtatgttgataaatccagaggggataagctgaagattaacatcgacgttctattccctcacatgccttgtgcttacctcagtattgatgccatggacgttgcaggcgagcagcagctggatgtggagcacaacctttttaaacaaaggttagacaaggatggaataccagtgtcctcagaggctgaacgccatgagttaggtaaagtcgaggtgactgtgtttgatccagattctctggatcctgatcgctgcgaatcttgctatggcgccgaggcagaggacattaaatgctgtaacacttgcgaggacgtgcgggaagcctacaggcgccggggctgggccttcaagaaccctgatactatcgagcagtgcaggcgcgaaggcttcagccagaaaatgcaggagcaaaagaacgagggatgccaggtttacggcttcttggaagtgaataaagtcgccgggaacttccatttcgccccgggaaagagctttcaacagagtcatgtgcacggttgcgtgtgcaggctgaaaatgatagccaggtctttggcttgtgtacacgaccttcagagttttggattagacaatatcaacatgactcactacatccagcatctgtcttttggcgaggactacccaggcattgttaatccactggaccacaccaacgtgacggccccccaggcaagcatgatgttccaatacttcgtaaaggtggtgcccaccgtgtacatgaaggtggacggagaggtgctgaggacaaaccagttttcagtgacacgacacgagaaggtcgccaacggactgctaggagatcaggggctgccgggcgtattcgtcttatacgagctcagcccaatgatggtgaagttgactgaaaagcacaggagctttactcacttccttacgggagtgtgcgctatcatcggcggaatgttcaccgtggccggactcatcgactcgttaatctaccactccgcccgtgcgattcagaagaagatcgatttggggaagacaacctag

SEQ ID NO: 42063 - DNA, 1407 bp, Artificial Sequence
  Description of Artificial Sequence: Synthetic coding sequence
atgggccggggctggggcttcctgttcggcctgctgggcgccgtgtggctcttaagttccggccacggggaggagcagccacccgagactgccgcccagcgctgcttttgccaggtgagcggttatttagacgattgtacttgtgatgttgaaactatagatagatttaataactatcgattgttccccagattgcaaaagctgctagagagtgactattttcggtactataaagtaaacctgaagcgaccttgccctttttggaatgatatctctcagtgtggccgaagggattgcgcagtgaaaccttgtcagtcggatgaagtccccgatggaatcaagtctgccagttataagtattcagaagaagccaacaacctcattgaagagtgtgagcaggcagagaggctgggcgccgtggacgaatcactgagcgaagagactcagaaggcggtactgcagtggacaaaacatgacgactcttccgataacttttgcgaggcggatgacatccagtctcccgaagctgagtacgtcgacttgctgctgaacccggagcgctacactggctataaggggccagatgcttggaagatttggaatgtaatttatgaggaaaattgctttaagcctcagacaataaaacggccgttgaacccactagcatcaggacaaggtacttccgaggaaaatacattttactcctggctggaaggtttatgcgtggaaaaacgcgcattctatcgcttgattagcggacttcatgctagcatcaatgtccacctcagcgccagatatttgctccaggaaacatggctggagaaaaagtggggacacaatattaccgagttccagcagcgtttcgacgggatcctgacggagggagaagggcctcgccgcctgaagaacctctactttctgtatcttattgagcttagggctctgtctaaagtcctacctttcttcgaacggcctgactttcagctctttaccggaaataaaattcaagacgaggaaaacaaaatgctgcttctggagattttacacgagatcaagagtttcccactacacttcgatgaaaatagtttctttgccggggacaaaaaggaggcccacaagcttaaggaagactttagactacacttccgcaatatttcccgcataatggattgcgtgggctgtttcaagtgtaggctatgggggaaactgcagacccagggcctgggcaccgcattaaagattctgttctccgagaaactgatagctaatatgcctgaatcaggacccagttacgaattccacttgacacgtcaggaaatcgtttccttattcaacgcctttggcaggatctctacgtccgtgaaagaactggaaaatttcaggaatttgctccagaatattcactag

SEQ ID NO: 42064 - DNA, 522 bp, Artificial Sequence
  Description of Artificial Sequence: Synthetic coding sequence
tggggccccaacatcaaggagttcaagcaccggttcgaccccgtggaaacgaagggagagggaccgaggcgcctgaagaacctgtacttcctgtatctgattgaacttagagctctgtctaaagtggccccgtattttgagaggtctatcgtggacctctacactggaaacgcggaggaagatgcagataccaaaacacttttgctgaacattttccaggacaccaagtcatttcccatgcatttcgacgagaagtccatgttcgcaggagacaaaaagggagcaaaatctcttaaagaggagtttagactgcacttcaagaatatatctaggatcatggattgtgttgggtgtgacaagtgtcgtctgtggggcaagttgcagacccagggccttggcacggccctaaaaatcctgttcagtgaaaaggagatacagaagctgccagagaactctccctctaagggcttccagctcactcgacaggaaatcgtggctcttctgaacgcttttgggcgatag

SEQ ID NO: 42065 - DNA, 435 bp, Artificial Sequence
  Description of Artificial Sequence: Synthetic coding sequence
atgagccagggcgtgcggcgggccggcgccggccagggcgtggccgctgctgtgcagttgctggtgactctctcctttctgaggagtgtggttgaggcccaggttaccggcgtgctcgacgattgcctctgcgacatcgactctatcgacaatttcaacacatataaaatctttccaaagatcaaaaaactgcaggagcgcgactattttagatactacaaggtgaaccttaagcgcccctgtcccttctgggccgaggatggacactgcagcattaaagactgtcacgtcgagccctgtcccgaaagtaaaattcctgtgggaattaaagccggacactccaacaagtatctgaagatggctaacaacactaaggagcttgaggactgcgaacaggcaaacaagctaggcgctatcaattccacgctgcgatag

SEQ ID NO: 42066 - DNA, 1404 bp, Artificial Sequence
  Description of Artificial Sequence: Synthetic coding sequence
atgagccagggcgtgcggcgggccggcgccggccagggcgtggccgccgccgtgcaacttcttgttactctgtcgtttctgagatcagtggtagaggcgcaagtgactggagtcttggatgattgtttatgcgatattgatagtattgacaactttaatacatataagatatttcccaaaatcaaaaaactccaggagcgcgactattttcgctattataaagtgaaccttaaaagaccctgtccattttgggcggaagatggccattgctcaattaaggattgtcacgtggagccctgccccgagtccaagatccccgtggggatcaaggcagggcacagtaataagtacctgaaaatggcaaacaacacgaaagagttggaggactgcgaacaggccaacaaactgggggccataaactcgactctgagtaaccagtccaaggaggctttcatcgattgggcgcgctacgacgattcacgtgatcatttctgtgaactggatgatgagagatcacccgccgctcaatatgtcgacctgctgctgaacccagaacggtacaccggctataaaggcacaagcgcatggagagtatggaattcaatctatgaggagaattgcttcaaaccccgaagtgtgtacaggccactcaaccccctggcacccagtaggggtgaagatgatggtgagagtttttatacctggttggagggcctgtgtctggaaaagcgcgtgttttacaaactcatctcaggactgcatgcttctattaacttgcacctatgtgccaattatttgctggaagaaacatggggcaagcccagctggggcccaaacattaaggagtttaaacaccgctttgacccagtggagactaagggagagggccccagaaggttgaaaaatctgtacttcctgtacctaatcgagctgagggctcttagtaaggtagcaccttacttcgagcgctcaatagttgacttatatactggcaacgcagaggaagacgccgatacaaaaacccttttactgaatattttccaggataccaagtcctttcccatgcattttgatgagaagtccatgttcgcaggtgacaaaaagggcgccaagagtctgaaggaagagtttcgtctccacttcaaaaatatctcaaggatcatggactgtgtgggctgcgataaatgcagactctgggggaagctccagacccaaggcttgggaacggccctgaaaattctcttttccgagaaagaaattcaaaaactgcctgaaaattcaccttctaagggtttccagctgacaagacaggagattgttgcactcttgaacgcctttggtcgattgtccacatcgattagagatttacagaactttaaagttctgctgcagcatagtcgatag

SEQ ID NO: 42067 - DNA, 216 bp, Artificial Sequence
  Description of Artificial Sequence: Synthetic coding sequence
atggccaacaacaccaaggagctggaggactgcgagcaggccaacaaacttggtgcaattaatagtacactgtctaaccagtctaaagaggccttcatcgactgggccagatatgatgattctagagaccatttctgtgaactggatgacgagaggtcaccagctgcacagtatgtcgacctcctgttaaaccccgaaaggtataccgggtactag

SEQ ID NO: 42068 - DNA, 702 bp, Artificial Sequence
  Description of Artificial Sequence: Synthetic coding sequence
atggagctgcccaccaagcccggcaccttcgacctgggcctggccacttggtcacccagctttcagggcgaaacccatcgtgcccaggccagaaggagagacgtcggccgtcagctgcccgaatataaggctgttgtggttggcgcatctggagtgggaaaatctgctttgactatccagctgaaccaccagtgctttgtggaggaccatgaccctacaatccaggatagttattggaaagagcttacccttgattccggcgattgcatactcaatgtgctggatacagccgggcaggccattcatcgagccctgagggaccagtgcctggccgtatgcgacggggtgcttggcgtgttcgcattggatgacccgtctagccttattcaactgcaacaaatttgggccacatgggggccacatccagcacagcctctggtcctggtgggcaacaaatgcgacctcgtgacaacggccggcgatgcacatgctgctgcagctgccctggcccattcctggggagcccattttgtggaaacttctgctaagacccgtcagggggtggaagaggctttctcactcctcgtgcacgagatccagcgcgtgcaggaggctatggcaaaagaaccaatggcacgctcatgcagggaaaagacacggcatcagaaggccacctgtcattgcggctgttcggtcgcttag

SEQ ID NO: 42069 - DNA, 2178 bp, Artificial Sequence
  Description of Artificial Sequence: Synthetic coding sequence
atggccatggccatgagcgacagcggcgccagccggctgcggcggcagttagagagtgggggcttcgaagcccggctttacgtgaagcagcttagtcagcagagtgacggagaccgggaccttcaggaacatcgacagcgaatccaggcactggccgaagagacagcacaaaacctaaagcggaatgtataccagaattaccggcaattcatagaaacagcccgggagattagttacctcgagtcagagatgtatcagctcagccacctgttaacggagcagaagagctccttagagagcatcccactgaccctgctgccagccgcggctgcagccggagccgctgcagccagtgggggcgaagaaggcgtgggaggagctggcggacgcgatcaccttcgcgggcaagccggctttttcagcaccccaggcggggcttctcgagatggcagcggccctggagaagaaggcaagcagaggaccctgactactctgctcgagaaggtggaaggatgcaggcacctccttgagacgccagggcagtatctggtttataacggagatcttgtggagtacgacgccgaccacatggcccagctccaaagggttcatggttttctcatgaatgattgcctgcttgtggccacatggttgccacagaggaggggaatgtacaggtacaatgccctctacagcttggacggtttggctgttgtgaatgttaaggataacccgccaatgaaggacatgtttaaacttctgatgtttcctgagtctcggatcttccaagccgagaacgcaaagatcaagcgtgagtggctcgaggtgctagaggacacaaaacgcgcgctcagcgagaaacgcaggcgtgaacaggaagaagctgccgcccccagagggccgccccaagtgacgtccaaagccaccaacccttttgaagacgatgaggaggaagaacctgccgtgccggaggtggaagaggagaaagtggacctgtcgatggagtggatccaggagttacccgaagacctagacgtgtgcatcgcccagcgggatttcgagggcgctgtggacctgctcgacaagctaaatcactatcttgaagataagccctctccaccacccgtgaaagagctgagagctaaagtggaggaaagagtcaggcagctgaccgaggtgctcgtctttgaattgtccccagacagatcactgagaggaggaccaaaggctacccggagggctgtctcccaattaatacgcttgggacagtgcactaaagcatgcgaactctttctgcgtaacagagccgccgccgtgcatacagctatccgccagctcagaattgagggcgccacgctactctacatccacaaactctgccatgtgttttttaccagtctcctggaaacagctagagagttcgagattgactttgctggaacagattccggttgctattctgcctttgttgtgtgggcccggtctgccatgggaatgtttgtagacgctttcagtaagcaggtattcgatagcaaagagtcactatcaacagccgccgaatgcgtaaaagtcgccaaggagcactgtcagcagcttggtgatatcggattggacctgaccttcattatccacgccctgctggtgaaagatatccaaggtgcattacactcctacaaagagatcatcatagaagctaccaagcatagaaatagtgaggagatgtggcgaaggatgaacctcatgactcctgaagccctcggcaaacttaaagaagaaatgaaatcttgcggcgttagcaatttcgagcagtacacaggagacgattgctgggtgaatctgtcatatacagtggttgcttttacgaagcagaccatgggatttctcgaggaggcccttaagctgtatttcccagagctgcacatggttctgctcgagagcctcgttgaaattattttggtagccgtacagcacgtggactactccctgcgctgtgagcaggaccccgagaaaaaggcctttatccggcagaatgcttcttttctgtacgagacggtccttccggtggttgagaagaggtttgaagaaggggttggaaaacctgccaaacagttgcaggacctgcgcaacgcgagtcgtctgatccgggtgaaccccgagtcgacaacatcagtggtatag

SEQ ID NO: 42070 - DNA, 2166 bp, Artificial Sequence
  Description of Artificial Sequence: Synthetic coding sequence
atgagcgacagcggcgccagccggctgcggcggcagctggagagcggcggatttgaagctcgactgtatgtgaagcagctgtctcagcagagcgatggagatcgcgatctgcaggaacacaggcagcggatacaggccctagcagaggaaactgcccagaacctaaaacgtaatgtgtatcagaactaccgacagttcattgagacagcacgggagattagctatcttgagagcgagatgtaccagctatcacaccttctcacggagcagaaaagctctctagagagcatccccctgacgctgctgccagcggcggctgcagcgggtgctgctgcagcctctggcggggaagaaggcgttggcggagcaggcggaagagaccatctgcggggccaggccgggtttttcagcacacccggcggtgctagcagagacggctctggcccgggtgaagaagggaagcagcgcacactgaccacactgctagaaaaagttgaagggtgccggcatctgttggaaactccaggtcagtacctggtttataatggagacttagtcgagtacgacgcggaccatatggctcagctgcagagagtacacggatttctcatgaacgactgcctgctggtggccacgtggctgccgcagcgcaggggaatgtaccggtacaacgctctctatagcctcgacggattagcggtggtgaatgtcaaagacaatcctccaatgaaagacatgtttaagctactgatgtttcccgaatcaagaatcttccaggccgagaacgccaagattaaacgcgagtggctcgaggtgctggaggacacgaaacgcgcactgtcggaaaaaagacggcgggaacaggaagaagccgcagccccacgggggcctcctcaggtcacttcaaaggctacaaacccgtttgaggacgacgaggaagaggaacctgccgtgcccgaagtggaggaagagaaggttgacttgagtatggaatggatccaggaactgccagaggatctggacgtctgtatcgcccaaagggacttcgagggtgcagtcgatcttctcgacaagctcaatcactatcttgaggacaagcctagcccaccccccgttaaggagcttcgcgcaaaagtggaggagagagtgcgtcagcttactgaagtactcgtcttcgaattgtctcccgatagatcacttaggggaggcccaaaggctaccagacgcgctgttagtcagctgatcagattagggcagtgcacaaaggcctgcgagctattcttacgcaaccgtgcagctgccgtgcataccgctattaggcaacttcggatagaaggtgcaactctcctttatattcataagctgtgccatgtattctttacaagtctcctcgagactgccagagagtttgaaatagattttgcaggcacggactccggctgttactctgctttcgtggtttgggcaagaagcgctatgggcatgtttgtggatgcgtttagcaaacaggtttttgattctaaagagagcctctccacggctgccgagtgtgtcaaggttgccaaagagcattgccaacagcttggcgacatcgggctggacctaacgttcattatccatgctctgctggtcaaggacattcagggcgctcttcattcatacaaagagatcattatcgaggctactaagcaccgaaatagtgaagagatgtggcgcagaatgaacctgatgaccccagaagctctcggcaagttgaaggaggagatgaaaagttgcggggtttcaaattttgaacagtacactggcgatgattgctgggtcaatctctcttacacggttgtggcattcactaagcaaacaatggggttcctcgaggaggcgctgaagctctacttcccagagctgcacatggtacttctcgaaagtcttgtggagatcatcttagttgcggtgcagcatgtggactatagcctccggtgcgagcaggacccggaaaagaaggcatttatcaggcagaacgcatccttcctgtatgaaaccgtcctccctgtcgtggaaaagcgtttcgaagaaggcgtgggtaagcctgcaaagcagttacaggatctgcggaatgcctccagattaatccgggtgaaccctgagagcacaacatctgtcgtatag

SEQ ID NO: 42071 - DNA, 3345 bp, Artificial Sequence
  Description of Artificial Sequence: Synthetic coding sequence
atggagcggagccccggcgagggccccagccccagccccatggaccaacctagtgctccatccgatcccactgaccagccaccggcagcacatgctaaaccggacccaggtagcggaggacagccagcaggaccaggggctgcaggtgaagctctggcagtgctaacgtccttcggacggaggctccttgttctaattccagtgtatctggcaggagcagtaggcctgtcagtgggctttgtgctcttcgggctcgcattgtatttagggtggagaagggtccgggatgagaaggagcggtcactgcgggcggcccgacagttgctagacgatgaggagcagctgaccgcaaagaccttatatatgtctcaccgggaactacctgcttgggttagcttcccggatgttgaaaaagcagagtggctcaacaagattgtcgctcaagtttggccgtttctagggcaatacatggagaagctactggccgaaacagtcgcacccgcagtgaggggctccaacccccacctgcagactttcaccttcacccgggtggaattgggcgagaaaccactcaggatcattggtgtcaaggtgcaccccggccagagaaaggagcagattcttctggatctgaatatcagctacgttggcgatgttcagattgatgtggaggttaaaaagtacttctgtaaagctggggtcaaagggatgcagctccatggcgtgcttcgcgtgatactcgagcctttgatcggcgatttgccatttgtgggcgctgtgagcatgtttttcattaggaggcccaccctggatattaattggactggcatgacaaatcttttagacatccccggtctgagctcgttgtccgatacaatgattatggacagcatcgcagctttcctcgttctgccaaaccgcctgttagtgcccttggttcctgatctccaggatgtggcccagcttagaagccctctgccacgggggatcatccgcattcacctgctcgccgctcggggcttgtcatcgaaggacaagtacgtgaaaggcctgatcgagggaaagagtgatccttacgctttagtcagactgggtactcaaactttctgctctcgggtgatcgacgaagagctgaacccccaatggggcgaaacgtacgaggtcatggttcatgaggtccctggacaggagattgaggtggaggtctttgacaaagaccctgataaggatgactttctgggcaggatgaaattggacgtgggtaaggtgctccaggcctccgtgttagacgactggtttccccttcaggggggtcaagggcaagtgcacttgagactggagtggttgagtctgctttctgatgccgaaaagcttgaacaggtgttacaatggaattggggggtgtcatcacgtccagatcctccatcggcagccatcctcgtggtctatctcgacagggcccaagaccttcccatggttaccagtgaactttatccaccgcagctgaagaagggtaataaagagccaaacccaatggtccagctttccatccaggacgtcacacaggagtccaaggccgtctactccactaattgtcctgtctgggaggaggcatttcggttcttcctgcaagaccctcagtcgcaggagcttgacgttcaagtgaaagacgatagtcgagccctcactctgggcgcactgaccttgcctctggcacgcctattgaccgctcctgaattaatcttggatcagtggttccagctttcatcaagcgggcccaattcccgcctatacatgaagctagtaatgcgcatcctgtatctcgattcctcagaaatctgtttccctacggtgcctgggtgccccggggcctgggacgtggattctgagaatccacagcgcggctccagtgtggacgccccccctaggccatgccacacaactcccgactctcagtttggtactgagcatgtccttcgaattcacgtcttagaggcacaggatctgatagctaaagatagatttctgggcgggttggtaaaaggcaagtccgacccttacgtgaagttgaagttagcaggtagatcctttaggagtcacgtggtgagagaagatttgaatccccgctggaatgaggtgtttgaagtgattgtcacatcagtccccggccaggaacttgaagtggaggtattcgacaaagacctggacaaagacgacttcctcggtcgctgtaaggtgcgtctgaccaccgttctgaattcagggttccttgatgagtggctgactttagaagatgttccctctggacgactgcacctcaggttggagaggctgacaccacgtcccactgcagctgagctggaagaggtactgcaagtaaactcactgatacaaacacagaagtctgcggagctggccgccgctttgttgagtatatatatggaacgagcggaggacttacctctaagaaaaggaaccaaacatttgtctccttacgcaacccttaccgtcggggattcatcgcacaaaacaaagacaatctctcagacaagcgctcctgtttgggacgagtctgcatccttcctcattcggaagcctcacaccgaatctctggagcttcaagtccgcggtgagggcaccggtgtactcggcagcttgtcactccccctgagcgaactgctggtcgccgatcagttatgcctcgaccgctggttcacacttagctcaggacagggacaggtgttgctccgcgctcagttaggtatactggtgtctcagcactctggcgtagaagctcacagtcacagctattcccattcttcctcctcactgagcgaggagccagaactaagcggaggcccaccacatataaccagttccgccccagagctgaggcagcggttgacccacgtagacagtccactcgaggcaccagctggacctctgggccaagtcaaacttacactttggtactactccgaagaacgaaagctcgtatccattgttcacggttgcagatcattgcgccagaatgggcgtgatcctcctgacccatatgttagcctgctgctgctgcccgacaagaacagaggcaccaagcggaggacttcccaaaagaaacgcaccctttccccagagtttaacgaaaggttcgagtgggagctgccacttgacgaagcacagcgaaggaagctggacgtctccgtcaagtctaattccagcttcatgtcccgggaaagagagctcctgggcaaagtgcaacttgatctggccgaaacagacctgagtcagggggtggctcggtggtatgacctgatggataacaaagataaaggttcctcctag

SEQ ID NO: 42072 - DNA, 3315 bp, Artificial Sequence
  Description of Artificial Sequence: Synthetic coding sequence
atggagcggagccccggcgagggccccagccccagccccatggaccagccctcagcaccaagcgaccctacggaccaaccgccagccgctcatgctaagcccgaccctggaagcggggggcagccagcaggaccaggagcagccggcgaggccctggcagtcctcacctcattcggaagacggcttctcgtgttaattcccgtgtacctggctggtgctgtggggctctcagtcggctttgtgctgtttggactggcgctgtacctgggatggagaagggtacgggatgaaaaagaaaggagcctgagagccgcaagacaattgcttgatgacgaggagcagttgacagcaaagactttgtacatgtctcacagagagctcccagcctgggtgtcctttcccgatgtggaaaaggccgaatggctcaacaagatagtggcacaggtctggccctttctgggacaatatatggaaaaattgctcgcagagacagtcgcgcctgccgtgagggggtcgaatcctcatcttcagaccttcactttcacaagggtggaattgggtgagaaaccactccgtatcattggcgtcaaggtccatcccggtcagcggaaggaacagatccttcttgatttaaacatcagttatgtcggagacgttcagatcgatgtggaggtgaagaaatatttttgcaaggcgggcgttaagggtatgcaactccatggcgtgctacgggtaatcttggagccactgatcggcgatctcccctttgtgggtgcagtgtctatgttcttcattcgcaggccaactctggatattaactggactggcatgaccaatctgctagacatcccggggctgtcttcactgtccgataccatgataatggattcaatagccgccttcttagtactgcctaaccgcctactcgtgccgctcgtgcccgatctgcaagatgtggctcagcttaggagccccttgcccagggggatcatacggatccatcttctggctgcgcgaggtctgtcctcaaaggacaagtatgtcaagggactgatcgaaggcaagtctgacccttatgctttagtgaggttggggactcaaactttctgcagccgtgttattgacgaggagctgaatcctcagtggggtgaaacgtatgaggtcatggtccatgaggttccaggccaggaaatcgaggtggaggtgtttgataaggaccccgacaaagacgattttctcggtagaatgaaactggatgtcggaaaagtgctccaggctagtgtgttggacgattggttcccattgcagggcggccagggacaggttcacctgagactcgaatggttgagtcttttgtccgatgcagagaagctggagcaagtactgcagtggaactggggcgtttccagtcgcccagacccgccctccgctgctattttggtggtctatctggatagagctcaggacttgccattaaagaagggcaataaagagcccaatcccatggtgcaattgagtattcaggatgtcacccaggagagtaaggcggtgtattctaccaattgccctgtctgggaggaagcttttaggttcttcttgcaggacccgcaaagccaggagctagatgtgcaggtgaaggatgatagtagggccctgactctgggtgctcttaccctgccgctggccaggcttctcaccgctcctgaactcatcttggaccaatggttccaactgagctcatcaggacctaattctaggctgtatatgaaactggttatgcgaattctgtacttagattctagcgagatctgcttccctaccgtccccggatgtcctggggcctgggatgtcgatagtgaaaacccacagcgcggctcctctgtggacgcacctccgcgaccatgccacacaaccccggacagccagttcgggacagaacatgtgcttaggattcacgtgctggaagcacaggatttgatcgccaaggatagattcctcggaggccttgtgaaaggcaaatcggacccatatgttaaactgaagttggccggccgttcattcagatcacacgtagtacgcgaagatttaaacccacgttggaacgaggtattcgaggtgatagttacctccgtcccagggcaggagttggaggtggaggtatttgacaaggatcttgacaaagacgattttttggggcgttgtaaagtgaggctgaccactgtcttaaactctggcttcctggatgaatggcttaccctcgaagatgtgccctccggtcgcctgcatctcagactggagaggctgaccccccggccaaccgccgctgaacttgaggaggtgttgcaggtcaactccttaatccaaacgcagaaatctgccgagctggctgcggcattgctaagcatatatatggaacgagctgaggatctgcccctgagaaaggggacaaagcacttgtccccatacgctacactgacagtgggcgacagcagccacaaaacaaaaacgatttcacaaacaagcgctcccgtttgggacgaatcagcgagctttctgattcgtaagccccacacagagtccctggagttgcaggtgaggggcgaggggacaggcgtcctgggcagtctcagtcttcccctgtccgagctcctggtcgccgaccagctgtgtcttgatcgatggtttaccctcagttcaggccaaggtcaagtgctgctaagggcgcagctaggtatcttggttagtcagcattccggggtggaagctcactctcactcatacagtcactcctcatccagtctgagcgaggagcccgaactgtcggggggacctccccatatcacttctagtgcccctgagctgcggcaaagattgactcacgtggattccccgctagaagcgcccgccggcccgctggggcaggtgaagctgactctgtggtactattccgaggaaaggaagctagtgtctatcgtgcatggatgtcggtcgttgaggcagaacgggcgcgatccacccgatccctacgtcagcctgttgctcttgccagataagaatcgtgggacaaaaagaagaacaagccagaagaagcggactctgtctccagagttcaacgaacgattcgagtgggaactccctttggacgaggcccaacgtcgaaagcttgatgttagtgtaaagtcaaattcaagttttatgtcacgagagcgggagctgcttggcaaggtgcagctggacctggcagaaacggacctcagccagggcgtggccaggtggtacgacttgatggacaataaggataaaggtagcagctag

SEQ ID NO: 42073 - DNA, 3177 bp, Artificial Sequence
  Description of Artificial Sequence: Synthetic coding sequence
atggagcggagccccggcgagggccccagccccagccccatggaccagccatcagcaccttccgatccgactgatcagccacccgctgcacatgccaagccagaccctggaagcggcggccagcccgcgggccctggcgccgcgggtgaggccctagccgtgctgacgtcgtttggccggaggcttctggttcttatacctgtttatttagcaggcgctgttggactgagtgtgggcttcgtgttattcggtctggccctgtacttgggctggcgaagagtgagagatgaaaaagaacgcagcctgagggcggcgaggcagttgttggatgatgaaaagcttctagcggaaactgtggcccccgctgtcagaggttccaatcctcatctccagacgtttacctttacccgggtcgaactgggagagaagccgctgagaattatcggagtgaaggtgcaccccggccaaaggaaagaacagattctgctcgacctgaatatcagctatgtgggagatgtgcagattgacgtggaggtcaaaaagtatttctgcaaggccggagtaaagggaatgcagctccatggcgttctgcgggtcattttggaacctctgatcggggacctgccctttgtgggagctgtgagtatgttttttattaggagacccaccctggatatcaactggacaggcatgactaatctgctggacatacctggcctgtcgtcgctgtccgacaccatgattatggactcgattgccgctttcctggtcctgccaaataggctcctggtgccactggtgcctgacctacaggacgtcgcacaactgaggtccccgctgccacgcgggattattaggattcatttactggccgctcggggattgagctccaaagataaatacgtgaagggacttattgaagggaagagcgacccctatgccctcgtgcggcttgggacacaaaccttctgtagcagagtgattgacgaggagctgaacccacagtggggcgagacgtatgaagtcatggtgcatgaagtgcccggccaggagatcgaggtggaagttttcgacaaggacccagataaggacgactttctgggacggatgaaactcgatgtgggcaaagttctacaggcctcagtcctggacgattggtttcctttacaggggggtcaggggcaagttcacttgaggcttgagtggttatccctgctatccgatgctgaaaaactcgaacaggtactgcagtggaactggggagtctcttcgaggcccgaccctccctctgcggctattctggtggtgtatctggacagggcccaggacctgccacttaagaaagggaacaaagagcctaaccctatggtccagttatcaatacaggacgtgactcaggaatcaaaagccgtatacagtacaaattgccctgtatgggaggaggcctttcgcttctttctacaggacccacagagtcaggagctcgatgtgcaggtaaaggatgattctagggctttaactctgggcgctctgaccctgcctctggctagacttttaacagctcccgaactcatcctggaccaatggtttcagttgtcttctagtggacctaatagcagactctatatgaaactcgtgatgaggatcttgtatcttgacagttcagagatttgctttccaacggtgccgggctgtccaggagcatgggacgtagattccgagaacccccagcgcggatcaagcgtggacgcccctccaagaccttgtcacaccacccctgactcccaatttgggaccgagcacgtgctccggatccatgtgctcgaagcccaggacctcatcgccaaggacaggtttctgggaggactcgtgaaaggaaagagcgacccctacgtgaaactgaagttggcaggcaggtccttcagaagccacgtcgtcagagaggacctcaatcctcggtggaatgaggtctttgaagtgatcgtcacaagcgtgcctgggcaagagctggaagttgaggtctttgacaaagacctcgataaagacgacttcctgggccggtgtaaggtaaggctgaccactgttctaaacagtggattcctggacgagtggctcaccctggaagatgtaccttctggccgcctgcatctgaggctcgagcggcttactccacgtccaacagctgcggaactggaagaagtcctgcaggtaaactcgctgatacagacccaaaaaagtgcagaactggcggcggcgctcctgtcaatttatatggaacgcgcggaggatcttccactcagaaaggggaccaaacaccttagtccctatgctaccctgacagttggcgattcatctcacaagactaaaacgattagccaaaccagtgccccagtgtgggacgagagtgcctcattccttatccgtaaaccacacaccgagtccttagagctccaggtccgcggtgagggaaccggtgtcctggggagccttagcctgccactgtcagagctgttagtggcagatcagctttgtctggacaggtggttcaccctctccagcggccaaggccaggtgcttttgagagcgcaattgggcatcttggtgtcacaacacagcggcgtcgaagcgcattctcactcatattctcacagctcatctagcctctctgaggagcctgagctcagtggcggaccaccccatatcacatcttccgcccctgagttgcggcagcgtctgacccatgtggactcaccactggaggcacccgcagggcctctcggacaggtgaaattaactctgtggtactactctgaggaacgtaagttagtcagtattgtgcatggctgcaggagtctgagacagaatgggagagaccccccagacccctacgtctcattgctgctgcttcccgataagaaccgaggaacaaaaagaaggacgtcccagaagaagaggaccctttccccagaattcaatgaaagattcgagtgggagctaccccttgacgaggcacaaagacggaaactcgacgttagcgtgaaatccaacagctcctttatgagtcgtgagagggaactcttggggaaagtgcaactcgatctagcagaaacggatctgagtcagggcgtagctaggtggtacgatctcatggataacaaggacaaaggcagttcatag

SEQ ID NO: 42074 - DNA, 3345 bp, Artificial Sequence
  Description of Artificial Sequence: Synthetic coding sequence
atggagcggagccccggcgagggccccagccccagccccatggaccagccatccgcaccaagcgatcctaccgaccagcccccagcagcccatgccaaacctgacccggggagtggtggacagcctgccggcccgggcgcggctggggaagccttagccgtactcacttctttcgggcgccggctgctcgtcctgatcccagtttacctcgccggcgcagtcgggctttcagtgggcttcgtgctgttcgggctggcactctacctgggctggcggcgggtgagagacgagaaagagcggtcactgagagccgctcggcaactgcttgacgatgaggagcagttaactgccaaaacactgtacatgtcccaccgagagctgccagcctgggtctccttccccgacgtagaaaaggccgagtggctgaataagatcgtcgcccaagtctggccctttctgggccagtatatggaaaagttattagccgagaccgtcgcgccagcagtgcgtggcagcaatcctcatctgcaaaccttcacattcacccgggtcgagttaggcgagaaaccgctcagaattataggggttaaagttcatcctgggcagcggaaggagcaaatactcttggatctcaatatctcttatgtgggggatgtgcagattgatgtggaagtcaaaaagtatttttgtaaggcaggggtcaaaggcatgcagctgcatggcgtgctgagagtaatcttggagcctctcatcggcgaccttcccttcgtcggtgctgtgtccatgttttttattaggcggcccacgttggacatcaactggacaggcatgactaatctgctggacatccctggcctgtcgtctctatctgacaccatgattatggacagtattgccgcattcctcgtgctgccgaatcgtctgcttgtgccacttgtccctgacctgcaagacgtggctcagttgcgctctccactgccgcggggcattattaggatacaccttctggccgctaggggcctctcttcgaaggacaaatacgtgaaaggtctgatcgagggtaagtccgacccttacgcactggtcagacttggaacccaaacattttgcagccgggtcatcgacgaggagctgaacccccagtggggcgagacctatgaggtgatggtacatgaggtgccaggacaggaaatagaagtggaggtattcgacaaggatcctgataaagacgatttccttgggagaatgaagctcgatgtcggcaaggtgcttcaggcttccgttctcgacgactggttcccactgcagggcgggcagggtcaggttcacttgcggctagagtggctctccctgctatcagatgctgagaagttggagcaagtgctccaatggaattggggcgtaagttcccggccagaccctccgtctgctgccatcctggtcgtttacctcgatcgcgctcaagatttacctatggtgacctccgaactgtaccccccacaattgaagaaagggaacaaggagcctaatccaatggtgcaactctccatccaggacgtgacacaggagtccaaagccgtgtactctacaaattgccctgtgtgggaagaggcttttcgcttttttttgcaggacccccaaagccaggaattggacgtgcaggtcaaagatgactcacgggcactgacgctgggggctttgactcttccacttgccagacttctcactgcccctgagttaatacttgaccagtggtttcaactctccagctccggccctaattctcggctgtatatgaagctggtgatgcgtatcctgtatctcgacagcagcgagatttgtttccctactgtgcccggatgcccaggggcctgggatgtggattctgaaaacccacaaagaggctcaagcgtggatgctccaccccgcccttgccacacaacaccagatagccagtttggcaccgaacacgtcctcaggatccacgtgctggaagcccaagatctgattgccaaagatagattcctaggcggtctggtcaaggggaagagtgacccatatgtcaagctcaagctggctggtcggtctttccggtcgcacgtagtgagagaggacttgaatccgcgatggaatgaggtgttcgaagtcatcgtgacttctgtgcctggtcaggagctcgaggtcgaagtattcgataaagatctcgataaggacgactttctggggcgctgcaaggtcaggcttaccacggtgctgaattctggcttcctggacgaatggctaacattggaagacgtaccaagtggacgactgcacctgcgacttgagcgccttaccccaagacccacagcagctgagctggaggaggtgctgcaggtgaacagcctaatccaaacccaaaaaagtgccgagctggctgccgccctgctgagtatctacatggagcgcgcagaggatcttcctctgcggaagggcaccaaacacctctctccttatgccaccctgacagttggcgatagtagccacaagaccaaaacaatctcccagaccagcgccccagtttgggacgagtccgcctcattcttgattagaaagccccacacagaatcgcttgagcttcaggtaaggggagagggaactggagtgctcggctcattgtcattgcctctttctgagctcctggtcgcagaccagctctgccttgatcgttggttcactttgagtagcggtcagggtcaggtccttctgagagcccaattggggatacttgtctcgcagcattcaggagtggaagcccacagccattcctattctcacagttctagctcgctttcggaggaaccagagttatctggtggaccccctcacatcacatccagcgctcctgaactgaggcagaggctgactcacgtcgatagcccgctagaagccccggccggtcctctcgggcaagtcaaactgacgttatggtactattcagaagagcggaagctggtgtcaattgtccatggctgccgctctctgcggcagaatggccgggacccccctgatccttatgtgtcactccttcttctgcctgacaagaacagaggcacaaaaagacggaccagccagaaaaagagaactttaagccccgaatttaacgagaggttcgaatgggagctaccgctggacgaggctcagcgtcggaagttggacgttagcgtgaagagcaatagttcgtttatgtcccgggagcgagagctgctgggcaaagtgcagctcgatctcgctgaaactgacctgagccagggagtagcgcgttggtatgaccttatggataacaaagataaggggtcgagctag

SEQ ID NO: 42075 - DNA, 2661 bp, Artificial Sequence
  Description of Artificial Sequence: Synthetic coding sequence
atgcgggccgaggagccctgcgcccccggcgcccccagcgccctgggagcccagcgcacgccagggcccgagctgcggttatcgtcccagcttctgccggaactgtgcaccttcgtcgtgagagtgcttttctacctgggccctgtctacctcgccggatatttaggattgtcaatcacctggttgcttctgggcgctctgctatggatgtggtggcggaggaaccgccgcggtaagcttggccgactggctgccgcattcgaattccttgataatgagcgagaattcatcagtagggaactgcgaggccagcatctgcccgcctggattcactttccggatgtggagagagtcgaatgggccaataaaattatttctcagacatggccctacctgtccatgataatggagtctaagttcagagaaaagttagagcccaagatccgtgagaaatcgattcaccttcggacattcacattcactaagctgtactttgggcagaagtgccccagggtgaatggggtgaaggcccacaccaatacttgcaaccgtagacgcgtaactgtggacctgcaaatctgttacattggggactgtgagatctccgttgaactgcaaaagattcaggcgggggtgaacggaatccagctgcagggcacccttcgcgtgattctcgaacccttactcgtagataagccgtttgtgggcgccgtaacagtgtttttcctacagaaaccgcacctgcagattaactggaccggactgacaaacttgctagacgcgcctgggattaatgatgtgagcgacagcttgctggaagaccttatagccactcatcttgtccttcctaaccgggtaacagtgcccgtgaagaagggactggatctgacaaatcttcgattccccctaccttgtggcgtcattagggtccacctcttggaagcggaacaacttgcccaaaaggataacttcctgggccttcgagggaagtctgacccttatgctaaagtgagcatagggctccaacactttcgctctagaactatataccgcaaccttaatccaacctggaacgaggtgttcgaattcatggtgtatgaagtccccggccaagatttggaggttgacctttacgatgaagacaccgatagagacgatttcttggggtcactccaaatttgcctgggcgacgtgatgacaaaccgcgtggtggatgaatggttcgtgctgaacgataccacctcaggccggttgcatctgcgcctagagtggctcagccttctgaccgaccaggaggtgctgacagaggaccatggcggactgtccactgctatcttagtcgtgttcctggagtctgcatgcaatctgccgcgcaacccctttgactacctgaacggagagtatcgagccaaaaaactttctaggtttgctcgtaataaggtgagcaaagaccctagttcatacgtcaaactcagtgtcggcaaaaagacacacacctctaagacatgtccccataataaggaccccgtttggtctcaggttttttcattctttgtccacaacgtagcaacggagcgactgcacctcaaggttcttgacgatgatcaggaatgcgccctggggatgcttgaggtccctctgtgccagatcctcccctacgcagatcttactctggaacagcgtttccagctggatcattctggcctggactcactgatttccatgcgcctcgtgttacggttcctacaagtcgaggaaagagagcttgggtccccttacacaggacccgaagctttaaagaaagggcctcttctcattaagaaggttgcaacaaatcaaggccctaaagcacagccacaggaggaaggaccaacagatctcccttgcccgcccgatccagcctctgatactaaagacgtgtcgagatcaactacgacaacgactagcgccacaacagtggcaacagagcctacgtcacaggaaacaggacctgaaccgaaaggtaaggattccgccaaacgcttctgtgaaccaattggggagaaaaaatcacctgcgactatcttcctgactgtacctgggcctcattccccgggtcctattaagagtccacggcctatgaagtgcccagcgagtccattcgcgtggccccccaagaggctggcaccttccatgtcctctcttaactccctcgcgagcagttgcttcgaccttgctgatatttcattgaatatagaaggcggtgatctcaggcgcagacaattgggcgagatccagctgactgtgcgatacgtatgcctaagaaggtgcttgagcgtcctcatcaatggttgcaggaacttgaccccttgtacaagtagcggcgctgatccttacgtgagggtgtacttgctgcctgagagaaagtgggcctgtaggaagaaaacaagcgttaagcgcaagaccctcgagccgctgtttgacgagacatttgagtttttcgttcccatggaggaggtcaaaaaacgttcactggatgtggctgttaagaatagccggcctcttggcagtcataggcgcaaggagttaggcaaggtcctgattgacctctctaaagaggacttgatcaaaggttttagccaatggtacgagctgaccccgaatggccagccccgcagctag

SEQ ID NO: 42076 - DNA, 2463 bp, Artificial Sequence
  Description of Artificial Sequence: Synthetic coding sequence
atgctgcggctgggcctgtgcgccgccgccctgctgtgcgtgtgccgtcctggagccgttagggccgattgttggctgatcgaaggggataagggttatgtctggctggccatatgcagccagaatcaacctccctatgaaaccattcctcagcacatcaatagtaccgtgcatgatctacggctcaatgagaacaaactgaaggctgtgctctactcgtcattgaatcgattcggcaaccttacggacctaaatcttacaaagaacgagattagttatatcgaagatggggcatttctcggccaatcatctctccaagtgctgcagcttggttacaataagctgtctaatctgactgaaggtatgctgaggggtatgtcacgcctccagtttctgttcgttcagcataacctgatcgaggtcgtcactcctaccgctttttctgagtgtccctctttgatatctatcgacctctcctccaacagactgtctcgtctggacggggctacattcgcctccttggcctcactcatggtctgcgaattagctgggaaccccttcaattgcgagtgtgatctctttggtttccttgcctggctggtagttttcaataacgttactaagaattatgaccgcctccagtgcgagagcccaagggagtttgccggataccccctccttgtgcccagaccataccactccttgaacgccataactgtgcttcaagccaagtgcaggaatgggagtctaccggccagacccgtctcccaccccacgccatactctacagatgcgcagagagaaccagatgaaaatagcggcttcaatcctgatgagatattgagcgtggaaccccctgccagctctaccacagatgcaagcgctgggcccgccatcaagctacaccatgtcacctttacatcagcgacactggtagtaattattcctcatccatactccaagatgtacatcttagtccagtataacaattcctacttcagcgatgtgatgacattgaaaaataagaaggagattgtgacgctggacaagctgagggcccacacggaatacacattttgtgtgacgtccctgcggaactctaggaggttcaatcatacctgcttaactttcacaactcgtgacccagtgcccggtgacctggccccatctacttccaccactacccactacattatgactatacttggctgtctgttcggcatggttatcgtcctgggcgcagtctattattgcctgcgaaaaagaaggatgcaggaagagaaacagaagagtgttaacgtcaagaagacaatccttgaaatgcggtatggggccgacgtagacgcaggatcgatcgttcatgccgctcaaaagttaggcgaaccacccgtgttgcccgtgtcgcggatggcttcaattccaagcatgattggggaaaaactcccaaccgccaaaggactggaggctggtctagacacgccaaaggtcgccactaagggcaactacattgaggtgcggaccggcgccgggggggatggcctggcgagacccgaggatgatctcccagacttagagaatggccagggctcagctgccgagatctccaccattgccaaagaagtggataaggttaatcagataatcaacaactgtattgatgccctcaaacttgattctgctagttttctgggagggggctccagctcaggggatcccgagctggcttttgaatgtcagtcattgccagctgcagcggccgcttccagcgccacgggcccgggagccctggagaggccaagttttttgtcgccaccctacaaggaaagttcccatcatcctctgcagagacagttgtctgcggacgccgctgtgacaagaaagacgtgttctgtctcttcaagcggctctatcaaaagtgcaaaagtattttccctggatgttcctgaccatcctgcagcgaccggcctggcaaaaggagattctaagtatatcgagaagggcagccctctgaactctcctctggaccggctccctctggtgcccgccgggagcggcggcggatccgggggcggcggcgggattcatcatctcgaagtgaaacctgcctatcactgtagtgagcaccgacactctttccccgcactgtattacgaggagggagcagacagcctatcccagagagtgtcctttctaaagcctctgactaggtcaaagcgcgactcaacttattcccaattgtctccgcgccactactactccggctacagttcttccccagaatactccagcgagtctacacacaaaatctgggagaggttcaggccttacaaaaagcaccatagagaggaagtgtatatggctgcaggccacgcactccggaaaaaggtacagtttgctaaagatgaagacctgcatgatattctggattactggaagggtgtgtccgcacagcagaaactgtag

SEQ ID NO: 42077 - DNA, 2463 bp, Artificial Sequence
  Description of Artificial Sequence: Synthetic coding sequence
atgctgcggctgggcctgtgcgccgccgccctgctgtgcgtgtgcaggccaggagcggttcgcgctgattgttggttgatcgaaggcgataagggatacgtctggctagccatctgctcacagaaccagcctccttatgagaccattccacagcatatcaatagcactgtacatgacctgcgtctcaatgagaataaattgaaagccgttctatatagctcattgaaccgcttcggcaacctaaccgacttgaacctaactaaaaacgagatctcttacattgaggatggggctttcttggggcagtcatctcttcaggtgctacagttaggttacaacaaactcagcaacctgaccgaaggaatgcttcgcggcatgtcccggctgcaatttctgtttgttcagcataatctgatcgaggtagtcacacctacagccttctccgaatgcccgtctctcatttccatcgatttatctagcaacaggctctcccgcctcgatggcgcgacattcgcctcactcgcaagcctgatggtctgcgagcttgcaggaaatccttttaactgtgaatgcgacctgtttgggttcctggcctggctggtggttttcaataacgtcacgaagaattatgatcgcctgcagtgcgagtctccccgcgagttcgccggctaccccctgctggtcccgcgtccttatcacagccttaatgccattacggtgcttcaagctaagtgccgcaatggcagtctgcctgcaaggcctgttagccatccgaccccatactctaccgacgcccagcgagagccggatgaaaatagtggctttaaccctgatgaaatcctcagcgtggagcccccggcatctagcactacagacgcatccgccggacccgccatcaaactgcaccatgtcaccttcacgagcgcaaccctggtggttatcatcccccatccctatagtaaaatgtacatcctggttcagtataataacagctatttttcggatgttatgacactgaaaaataagaaggaaatcgtgactctggacaaacttagggctcacacagagtacactttctgcgtcaccagtctgcggaactctagacggttcaaccacacctgtctgacattcactacaagggacccggtgcctggcgatctggcacctagtacaagtacaactacccattacattatgaccattctcggctgcctcttcggtatggttatcgtgctgggtgccgtctattactgcctaagaaaacgtcgaatgcaggaagaaaaacagaagtctgtgaatgtgaaaaagaccattctggagatgcgttatggagcggacgtagacgccggctcaatcgtccatgctgcccaaaagctgggcgaacctcccgtgctccctgtgagtcgcatggccagcattccttcaatgatcggtgagaagttgcccaccgctaagggcctggaagcggggctggacacacccaaagtggccacaaaaggcaattacatcgaggttcgaactggcgccggaggagatggtctggcccgaccagaggatgacttaccagacctggagaatggccaggggtccgctgctgaaattagcaccattgccaaagaagttgacaaggtcaaccagattatcaacaattgcatcgacgctctgaaactcgatagcgcctcattcctggggggcggctcttctagcggagaccctgagctggcgttcgagtgccagagcctgcccgccgctgcagctgcttcttcagctacaggacctggcgctctggaaaggccgagctttcttagcccaccctataaagagtcgtcgcaccaccccctgcaaagacaactgtcggcagacgctgccgtcactcgtaaaacatgttcggtatcgagcagcggcagcatcaaaagcgcaaaggtattttctctggatgtgccggatcacccagcggcaactgggcttgctaaaggcgattcaaagtacattgagaaaggctccccattgaactctccccttgacagactccctctggtgccagctggaagcggggggggttcgggcggcggggggggtatacatcatctggaggtcaaaccagcctatcactgcagcgaacatagacattcttttccggccctgtactacgaggagggagctgactcgctgtcgcagcgcgtcagttttttgaaaccactcacaaggagcaagcgtgatagcacctacagtcagctgtccccgcgtcattactactccggttactcctcatcccccgagtactcttctgaatccacacataagatctgggaaaggtttaggccatacaagaagcatcatagagaagaggtttatatggctgccggtcacgcacttaggaaaaaggtccagtttgctaaggatgaagatctgcatgacattctggactactggaagggggtaagcgcccagcagaagctgtag

SEQ ID NO: 42078 - DNA, 558 bp, Artificial Sequence
  Description of Artificial Sequence: Synthetic coding sequence
atggtgggcctgcggtggtggaaccacatcgacgaggacggcaagagccactgggtcttcgagtcgcgaaaggagtcaagccaggagaacaaaactgtttctgaagcagagtctaggattttttggcttggtttgattgcctgttctgtcctgtgggtgattttcgcattcagtgccctgtttagcttcactgtcaaatggctcgccgtggttatcatgggggtcgtgctccagggtgcaaacctttacggctacatccggtgtaaggtgagatccaggaagcatttgacttcaatggctacaagttacttcgggaagcaatttcttcgtcaacgccgctccaggcacatcgctcagactggactaaaggtgcttggatcccgcgacccaccagcgagtgctttccagtctgccggcatcactggcgtctccaggtgcccgggccatcccagcagaaagttccaccaggactcgcaaaaaactctggatttccctgggtcatacctgaagaatatgacccccggccgcccaatgtccccaatacccttgcgacagtag

SEQ ID NO: 42079 - DNA, 864 bp, Artificial Sequence
  Description of Artificial Sequence: Synthetic coding sequence
atgccccccctgtgggccctgctggccctgggctgcctgcggttcggctcagctgtgaatctccagccgcaactggcctcggtcacgttcgccactaataatcctaccctcacaaccgtggcattagaaaagcctctttgcatgtttgatagcaaggaggcccttacgggcacccatgaggtgtacctgtacgtcctcgtggatagcgcaatatctcggaatgccagcgtccaggattccacaaacaccccattgggtagcaccttcctgcagaccgaagggggcaggacaggaccatacaaggccgtggcatttgatctgataccatgctcagacctgccttccttagatgccatcggcgatgtcagcaaagcaagccagatcctgaacgcctatctagtcagagtcggggccaatggaacatgtttatgggatcctaacttccaaggtctgtgtaatgcacccctttctgccgctacggagtaccggtttaagtacgtgctggtaaatatgtcgacgggcctggtggaagaccagactctttggtcggacccgattcgcaccaatcagcttacaccatacagcaccatcgatacttggcccggcagacggagtggcggaatgattgttatcacctccattctgggctcactccctttctttctcctggtcggtttcgctggtgctatcgcactgagcctcgtagacatggggagctccgatggcgagacgacacatgactcacagatcacccaagaggcagtgcccaaatccttaggcgcatctgagtcatcgtacacctctgtcaaccgtgggcccccactcgatcgggcagaagtttactcgtcaaagctacaggattag

SEQ ID NO: 42080 - DNA, 528 bp, Artificial Sequence
  Description of Artificial Sequence: Synthetic coding sequence
atgaagtacggcgtgctgcacatccacggcctgtacaccgacccctgtggggttgttttggatccctcagggtacaaagatgttacgcaagatgccgaggtgatggaggtgctacagaacctctatagaactaaatccttcttgttcgtgggatgtggcgaaacattacgggatcagatcttccaagctctgttcctgtacagcgttcctaacaaggtcgatctcgagcactacatgttggtcctgaaagagaatgaggatcactttttcaagcaccaggcagacatgctgcttcacggtattaaggtggttagctatggggattgcttcgaccacttccctggatacgttcaggatctggccactcagatttgcaaacaacaatctcctgatgccgatagagtggattcgaccactcttctggggaatgcttgtcaggattgcgccaagcggaagctggaagagaacggaatagaggtctcaaagaagcggacccagagcgacactgacgacgctggtggcagctag

SEQ ID NO: 42081 - DNA, 420 bp, Artificial Sequence
  Description of Artificial Sequence: Synthetic coding sequence
atggacagcgtggagaagaccaccaaccggagcgagcagaagagccgtaaattcctgaagtccctgattcggaaacagccacaagaactcctcctggtgattggaaccggtgtgagtgccgccgtggcgcccggcattcctgctctgtgtagttggagatcctgtattgaagccgtcatagaagctgcagagcaactcgaggtgttacacccaggcgacgtggcagaattcaggcgcaaagtgactaaggatagggacctgctggtggtcgcccatgacctcatcagaaagatgtctccccgcaccggagatgccaaaccttcattttttcaggactgtttaatggaggtttttgacgacttagagcagcatatcaggtcgcctgtggtattgcaaagcatactgtcacttatggactag

SEQ ID NO: 42082 - DNA, 1074 bp, Artificial Sequence
  Description of Artificial Sequence: Synthetic coding sequence
atggacagcgtggagaagaccaccaaccggagcgagcagaagagccggaaattcctgaagtcactgatcaggaagcagccccaggaacttctgctggtcatcggcacaggtgtgtcagccgcagtggcacccgggattcctgccctctgcagttggagatcctgtatagaggctgtaattgaggctgccgaacagctggaagtgctccatccaggagacgtggctgaattcaggagaaaagtaaccaaggatagggatctgctggtggtcgcacacgaccttattcgtaagatgtcgccccggacaggcgacgcgaagccctcattttttcaggactgtttaatggaagttttcgacgatctggaacagcacatcaggtctcctgtggtcctgcagtctatcctctcactcatggataggggagcgatggtattgacgacgaactatgacaatctgctcgaggcgtttggccgcaggcagaacaaacccatggaatcactcgatttgaaagataaaaccaaagtgctggaatgggctagaggacacatgaaatacggggtgcttcacatccacggcctttacaccgatccctgcggggtggtgctggacccctctgggtataaggacgtgacgcaagatgccgaggtgatggaggtcctgcagaatctgtatcggactaagtcattcctcttcgtggggtgcggagaaaccttgcgcgatcagattttccaagcgctattcctgtactccgtaccaaacaaggtggatttagaacactatatgctggtcctgaaagagaatgaagatcacttctttaagcaccaggcggatatgcttttgcatggtattaaagttgttagctatggcgattgtttcgaccactttccagggtatgtccaagacctcgccacacaaatatgtaaacaacagagtccagacgcagacagagttgactcaactacgctgttaggaaacgcctgtcaggactgcgcaaagagaaaactagaagagaacggtatcgaggtatcgaagaaaagaacacagtccgatacagacgacgccgggggttcctag

SEQ ID NO: 42083 - DNA, 822 bp, Artificial Sequence
  Description of Artificial Sequence: Synthetic coding sequence
atggaccccgtgcccggcaccgacagcgcccccctggccggcctggcctggtcctccgcctcagctccgccaccaagaggtttctcagccatctcatgcacagtggaaggtgcgcccgcgagtttcggcaagagctttgcacaaaaatctggctactttctctgtctttcatccctcggaagcctggaaaaccctcaggaaaacgttgtggccgatatccaaattgtcgtagacaaatccccccttcccctagggttttctcctgtctgcgacccaatggattctaaggccagcgtgagcaaaaaaaagcggatgtgcgtcaaactgttgccattgggcgctactgacactgccgttttcgacgtgcgcctgagtggaaagaccaaaaccgtgcctggctatctcagaatcggcgacatgggaggctttgcgatctggtgcaagaaggccaaagcccctaggccagtccctaagccgcgtggactgagccgtgacatgcaggggctgagcttggacgccgcctcccagccctctaaaggcggacttctggagcggaccgcctcaagactgggcagcagggcttcaacactacggaggaacgattccatatacgaagctagttcactctacggcattagcgctatggacggagttccatttacactgcaccccagattcgagggcaagagctgctcgcctctggcgttttccgcttttggggatctcaccatcaagtccctcgccgacattgaggaggaatacaactatggcttcgtggtggaaaagaccgcagcagccaggttgccgccctcagtgtcttag

SEQ ID NO: 42084 - DNA, 702 bp, Artificial Sequence
  Description of Artificial Sequence: Synthetic coding sequence
atggaccccgtgcccggcaccgacagcgcccccctggccggcctggcctggtcttccgcctccgcaccgcctcctagaggattcagtgctattagctgcactgttgagggggcccccgcctcttttggcaaaagcttcgctcaaaaatctggctacttcctgtgtctcagctctctgggatctttggagaatccccaagagaacgtcgtagcagatatccagatcgtggtggataaaagtccactgccactcggcttctcccctgtgtgtgaccctatggattcaaaagcatcagtgtcaaagaaaaaaaggatgtgtgtgaaactccttcctttaggtgccacggacactgctgtctttgatgttaggttgtcaggcaagactaaaacagtgcccgggtacctacgtatcggaaaggggggattgctggaaaggactgcaagtcgcttaggctccagggcctctactctgcggaggaacgactccatttatgaagcaagtagcttatatgggatctctgcaatggatggtgtaccgtttacactgcacccacggttcgaggggaagagctgttccccgttagcgttctccgcctttggagacctgaccataaaaagcctggcagacatagaggaagagtacaactacggtttcgtcgtcgaaaagaccgctgccgctcggcttccgccctccgtcagctag

SEQ ID NO: 42085 - DNA, 822 bp, Artificial Sequence
  Description of Artificial Sequence: Synthetic coding sequence
atggaccccgtgcccggcaccgacagcgcccccctggccggcctggcctggtcctccgccagcgcccccccgccccgaggattttcagcgatctcttgcacagtagagggcgctcctgcgagtttcgggaaaagctttgcacagaaaagcgggtacttcctgtgtctttcaagccttggctcactggagaacccacaggaaaacgtggtagctgacatccaaattgtcgtggataaatctccgctgccccttggattttctccagtttgcgacccgatggacagcaaggcgtccgtgagcaaaaagaagaggatgtgtgtgaagcttctgcctcttggggctaccgataccgctgttttcgacgtaagacttagtggcaaaactaagacagtcccaggctacctgagaatcggggacatgggagggttcgccatctggtgtaaaaaggccaaggcccctaggccagtgccaaagccaaggggattgagcagggacatgcagggcctttcacttgatgcagcttcacagccgagtaaaggcggcctcctggaaaggacagcttccagactggggtcccgcgcttcaaccttgcgccgcaacgactccatctacgaagcctcctcactatatggaatttccgccatggacggcgtgcctttcacattgcacccccgtttcgagggaaaaagctgctccccgctggccttttccgccttcggggacctgactatcaagtctctcgccgatatcgaggaagagtacaattatggttttgtcgtggagaagacagccgccgctagactgccacccagtgtcagctag

SEQ ID NO: 42086 - DNA, 960 bp, Artificial Sequence
  Description of Artificial Sequence: Synthetic coding sequence
atgcggagctgcttctgcgtgcggcggagccgggaccccccccccccccagcctccccccccgccccctcagcggggcacagatcagtcaaccatgccggaagtgaaagatctgtctgaagcgttaccagagacttcaatggacccaattaccggcgtgggggtggttgcctctaggaatcgggccccaaccggatacgatgtggtcgcccaaacagccgacggggtggacgctgacctgtggaaagacggcctcttcaaatctaaggtgacccgctatctttgcttcacacgaagttttagcaaggaaaactcgcacctgggcaatgtgctcgtggatatgaaacttatcgatatcaaagatacccttcctgtaggtttcatcccaattcaggagactgtcgacacacaggaggttgctttccgaaagaagcggctttgcataaaattcattcctcgtgatagtaccgaggctgctatctgcgatattcggattatgggacggaccaagcaggccccgccccagtacacttttattggggagctgaactctatgggcatttggtatagaatgggcagagttcccagaaaccacgattcctcgcagcccaccaccccaagccagagctccgcagccagtactcctgctcccaatctgccccgccacatctccctgaccctaccagcaaccttccgagggcggaattctaccaggaccgactacgaataccagcacagcaacttgtatgccatttcagctatggacggcgttccctttatgatctcggagaaattcagttgcgttccagaatcgatgcagcctttcgaccttctaggtatcaccatcaagagccttgcagagatcgagaaggaatatgaatatagcttccggacggaacagagcgctgccgcccgtcttcccccatcccccacacgttgtcagcagatcccacagtcctag

SEQ ID NO: 42087 - DNA, 618 bp, Artificial Sequence
  Description of Artificial Sequence: Synthetic coding sequence
atggacaccggcctgagcagccagcccagcgaggaggaccagagcaccatgccagaggttaaagatctgagtgaggccctcccggagacctccatggatcctattaccggagtgggcgtcgtcgcaagtcgaaaccgagctccaacaggatacgacgtcgttgcgcaaaccgccgacggcgtggacgcagatctgtggaaggacggactgttcaagagtaaagtgacaagatatctttgtttcacaagaagcttttcgaaagagaactcccatctgggtaatgtactggttgacatgaagcttatcgatattaaagatactctgcctgttggattcatacccattcaggagacagtagacacacaggaggtggcattccgtaagaaacggctctgcatcaaattcattccaagagatagcactgaggcagccatatgcgacattcgtattatgggaagaactaagcaagcaccgccccagtatacatttataggcgaactcaatagtatgggcatttggtatagaatggggagagtccctcgcaatcatgactctagccagcctacaacgcccagtcagtcaagcgcggcatctacccccgcccccaatctaccttag

SEQ ID NO: 42088 - DNA, 915 bp, Artificial Sequence
  Description of Artificial Sequence: Synthetic coding sequence
atggacaccggcctgagcagccagcccagcgaggaggaccagagcaccatgccggaagttaaagatctgtccgaagccctccccgagacctccatggatcccataactggagtaggggttgtagcgagcaggaatagggcacctacagggtatgatgtcgtggcacagacagcagacggagtggatgccgacctgtggaaggacggcctcttcaaatccaaggtcacccgctacttatgttttacaaggagcttctcaaaagagaattcccacctgggaaatgttctagttgacatgaagctcatcgacattaaagataccctcccagtcggcttcattccaattcaggagaccgttgacactcaggaagtggctttccgaaaaaagcgactctgcattaagtttatcccacgcgattccactgaagctgccatctgcgacattaggattatgggtaggactaagcaggctccccctcagtataccttcattggtgaacttaacagcatgggcatttggtataggatgggaagagtgccgcgtaaccacgactccagccagcccaccacaccctctcagtcttcagccgcgagtaccccggcacctaatctgccccgccacatatccctgacgctgccagccacattccgggggcgcaattccaccagaacagactatgaataccagcatagcaatctgtacgcaatcagtgctatggacggggtaccttttatgatctctgaaaagttctcttgtgtgccagaaagtatgcagccgttcgacctactgggcatcacaatcaagtctctcgccgaaatcgaaaaagaatacgagtatagcttccgcacagaacagtcggcagccgctaggctgccgcctagtcctactagatgccagcagataccccaaagctag

SEQ ID NO: 42089 - DNA, 645 bp, Artificial Sequence
  Description of Artificial Sequence: Synthetic coding sequence
atggaggcccccgcccacggcctggagccctgcggctggggcgcctgctggttagtatgctacacagtgggccgccgggccggctcatggctgcgcagctgggcagggcccccctggaggttccctgagaccaagccctcagtgagctctgtgcagggacgccgtttggaggccagacggagagtagcccaaaccgcagacggggtggacgccgacctgtggaaggatgggctctttaaatcaaaggtgactcgttatctctgttttactcgctcatttagtaaggagaattcccacctgggaaacgtgctggtcgacatgaagttaattgacatcaaggacacactgccagtcggcttcatccccatccaggagacagtagacacgcaggaagtggcatttaggaaaaagcgactctgcatcaaatttatacctagggattcaacggaggcagccatctgtgatatcagaattatggggcgcacaaagcaggccccccctcagtacaccttcattggcgagctcaactcaatgggcatctggtaccgcatggggagggtcccccgcaaccatgattcgtctcagccgactactccgtctcagagtagcgccgcttccactcccgctccaaatttgccaaggtag

SEQ ID NO: 42090 - DNA, 666 bp, Artificial Sequence
  Description of Artificial Sequence: Synthetic coding sequence
atgcggagctgcttctgcgtgcggcggagccgggaccccccccccccccaaccgcccccgcccccccctcagcgcggcaccgaccagagcacaatgcctgaggtgaaagacctcagcgaggctctacccgaaacgtctatggatccaattacgggggttggagtggtggccagtaggaatagagcaccaactggatatgacgtggtcgcacagactgcagacggggtcgacgcagacctgtggaaggacggtctgttcaaatcaaaagttactcgttacctgtgcttcacacggagtttctctaaggaaaacagccatttgggaaacgttcttgttgacatgaaacttatagacatcaaagataccctgcccgtcggttttattcccatccaggaaacggtcgatacccaggaggttgcctttcggaagaaacgtctgtgcataaagtttatccctcgcgacagcacggaagccgcaatctgtgatattcgcatcatgggcagaacgaaacaggcgccgccacaatatacatttatcggagagttgaatagtatggggatctggtatcggatgggtcgggtcccgagaaatcacgattcttctcagccaactacaccaagtcagtcttcagcggcaagtacgccagccccaaatctgcctcgctag

SEQ ID NO: 42091 - DNA, 2787 bp, Artificial Sequence
  Description of Artificial Sequence: Synthetic coding sequence
atgggcggcagcgccagcagccagctggacgagggcaagtgcgcctatattagggggaagaccgaggctgccattaagaatttcagcccgtattactctcgccaatacagcgttgcattctgtaaccatgtgcgaacggaggtggagcagcagcgtgacctgacatcacaattcctcaagacaaagcctccactggctcctggaacaattctgtacgaggccgagctcagccaattttccgaggatataaagaagtggaaagagcgctatgtcgtggtgaaaaacgactacgctgtcgagagttacgagaacaaggaggcttaccagagaggagccgcaccaaagtgccgtatcttgcccgccgggggtaaagtcctgacaagtgaggacgagtataatttgcttagcgaccgccatttcccagaccccttggcatcgtccgaaaaagagaacactcagcccttcgtagtgttgccaaaagagtttccggtctatctttggcaaccgtttttcaggcatggatacttctgcttccatgaagcggccgaccagaagcgcttttctgcattgctgagcgactgtgtgcgacacctaaaccacgattatatgaaacagatgacattcgaagcacaggcgtttttagaggccgtacagttctttagacaggagaagggtcactacggttcttgggagatgatcacaggcgatgaaattcaaattctgtcgaatctggtgatggaggaactgctgcctactttgcagacagatcttcttccaaagatgaagggcaagaagaatgataggaagcggacgtggttggggctgctggaggaggcatataccctggtccagcaccaggtgtctgaaggtctgagcgccctgaaagaggagtgccgagctctgaccaagggcctcgagggcacaataagaagtgacatggaccagatcgtgaactccaagaactatctcatcggaaaaattaaagccatggtagctcaaccggctgaaaaaagctgtttagagagcgtgcaaccttttttggcgtctatcctggaggagttgatgggtcccgtatcgtcaggattttctgaggtgagggtactgtttgagaaggaggtcaatgaagtctcgcagaactttcaaaccactaaggattcagtgcagctcaaggaacacttagacaggctgatgaatctccccctgcactcggtgaagatggaaccttgctacacaaaagtgaacttactgcatgaacggcttcaggaccttaagagccggttccggtttccacacatcgacttggtcgtccagaggacccaaaattacatgcaggagctcatggagaacgccgtgttcacctttgaacaactgctcagcccgcacttgcagggagaggccagcaagaccgccgtagcgatcgagaaagtgaagcttagagtcttgaagcagtacgactatgattctagtacaattcgaaagaaaatttttcaggaggccctggtgcagatcactttgcccaccgtgcagaaggctctggcatcaacatgtaagccggaactgcaaaaatacgagcagttcatcttcgccgatcacacaaatatgattcacgttgaaaacgtgtatgaggagattctgcatcaaatattgctcgacgaaaccctgaaggttatcaaagaagccgctatcctgaagaagcacaatttgtttgaagacaatatggcattgccatctgagagtgtgagcagccttactgacctgaagcctccgacgggcagcaatcaggcaagccctgcgcgcagagcaagcgccatccttcctggagttctgggatccgaaaccctgtccaatgaagtcttccaagaatccgaggaagaaaagcagcccgaggtcccctctagcctagccaaaggtgaaagcttgtccctgcccggtccgtcgcccccccctgatggtacagaacaagtgatcatcagtagggttgacgaccccgtggtcaaccccgtggctacagaagatacagccggccttcccgggacttgcagtagcgaactcgaatttgggggcacactcgaggacgaggaacccgctcaagaggaaccagaacccataacagcttcgggatccttgaaggcgcttagaaaattactaaccgcctccgttgaggtcccagttgattccgcacccgtgatggaagaggacacgaacggagagtctcacgtgcctcaggaaaacgaggaggaggaagagaaggagccctctcaagctgccgcaattcacccagataactgcgaagagtccgaagtgtccgagcgggaagcgcagcccccgtgtcccgaagcccatggtgaggagctgggtggcttccctgaggtggggagtccagcctctccaccggcctcagggggccttaccgaagagccattgggccctatggagggagaactgccaggtgaagcctgtactctgactgctcacgaaggacggggcgggaagtgtaccgaagagggtgacgcttcccagcaggaagggtgtacgctgggttctgacccaatatgcttgtccgagagccaagtgtcagaggaacaggaagagatgggcggacagtctagcgcagctcaagccacagcttccgtaaacgcagaagaaataaaagttgctaggatccatgaatgtcagtgggttgtcgaggatgcaccgaatcctgatgtcttgctttcccataaggacgacgtcaaagagggtgagggcgggcaggaatcattcccagaactaccctcagaggagtag

SEQ ID NO: 42092 - DNA, 303 bp, Artificial Sequence
  Description of Artificial Sequence: Synthetic coding sequence
tgagccgtggccatcgagaaggtgaagctgcgggtgctgaagcagtacgattatgattcatctaccatccgtaagaagattttccaggaggccctggtgcagatcacattgcccacagtacagaaggccctcgcctctacctgcaaaccagagctgcagaaatacgaacagtttatttttgctgatcacacaaacatgatccacgtcgagaatgtgtacgaggagattctgcatcagatccttctggacgagacattgaagggcgcatacattcctatcaagtgctcttccctaaagtcgtag

SEQ ID NO: 42093 - DNA, 1632 bp, Artificial Sequence
  Description of Artificial Sequence: Synthetic coding sequence
atggccagcggcggcggcggcggcaacaccggcgccggcggcggcccagggatgggcttgagcctcggcctgggcctagggctgtcactcggcatgagcgaggccacgtctgaggcagaggaagaggccgcaacagctgaagcagtgggcaggctggctaccaccctgtggctgagactcaggggatgggaagccgtcttggccgcagcccagcgcctgctcgtctgggaaaagcccttacattcgctagttaccgccgccgccctcaacgggctgttctggctattaagcagtagcagcctgcgaccttttttcctgctttccgttagcctgctggcttattttctgctagatctgtggcagccccgttttctaccggacgtatccgcaagctctccagaggaaccccactcagactctgaaggcgcgggctccggagctagaccacatctgttgtcagtccccgaactgtgtaggtacttagcagagtcctggttgacctttcagatccatttacaggagctgctgcagtataagagacagaacccagctcagttttgcgtgagagtgtgttctggctgcgcagtcctggcagtactcggccattacgtgccagggatcatgatctcatacattgtcctgctttccatcctgctgtggcctctggtggtctaccacgagcttattcagaggatgtatacacgcctggaacctttgttaatgcagctcgactattcgatgaaagcggaggcaaacgcgctccatcacaagcacgataagcgtaagaggcaagggaaaaatgctcctccgggcggagacgagcccctcgcagagacagaatccgagtcggaggccgagctcgccgggttcagtcctgtggtggatgtcaaaaagacagcactcgctctggctatcaccgattccgaactctctgatgaagaggcaagcattctggagagcggaggcttcagcgtgtcacgggccacaacaccccagctaaccgatgtctccgaagaccttgatcagcagtctttaccttcagaacccgaagagactttaagccgcgacctgggcgagggtgaagaaggagagctcgctcctccagaggatctgttggggagaccacaagccctgtcacggcaggccctggacagcgaagaggaggaggaggacgttgccgcgaaggagaccctcctcaggcttagtagcccactgcacttcgtgaatactcacttcaatggtgcagggtcaccccctgacggcgttaagtgttcacccggaggaccggtggagactctgagccccgaaactgtgagcgggggtctcacggctctgcctggcaccctctcaccacccctgtgtctggtcggttccgatcccgcgcctagcccttcaattcttcccccagttccgcaggactctccgcagccccttcctgcacctgaagaagaagaggcgctgaccaccgaggactttgagctgctcgaccagggcgagctggaacagctgaatgccgaactaggcctggagcctgaaacgcctcctaaacctccggacgctccaccattgggaccggatatccacagtttggtgcagagcgatcaggaggcccaagcagtggccgagccatag

SEQ ID NO: 42094 - DNA, 906 bp, Artificial Sequence
  Description of Artificial Sequence: Synthetic coding sequence
atgatcagctacatcgtgctgctgagcatcctgctgtggcccctggttgtctaccatgaactgattcagcgcatgtatacaaggctggaaccgctgctcatgcagttagattattctatgaaagccgaagcaaatgctcttcaccataaacatgataaacggaagcgacaggggaaaaatgcaccacctggtggggacgagccactggccgaaacggaatcagagagtgaagcggagcttgctggattctctcccgtggtcgacgttaaaaagactgccctagcgctggccatcaccgacagcgaactgtcagatgaagaagctagcatcctcgagtccggcggattctccgtgtcccgggccaccacgcctcaactgaccgacgtctccgaagacctagaccaacagtctctgccctccgagcctgaggaaaccctgtcacgcgatcttggcgagggggaggagggagaacttgcccctccggaggatctccttggaaggccccaggctctgtcgcgacaggctttagattcagaggaagaagaagaggacgtagctgctaaggagactctgctgcgactttccagccctttgcactttgtgaacacgcacttcaacggcgcgggatcacccccagacggagtcaaatgctcaccaggaggaccagtggagaccctttcaccagagacagattcaccgcagccactgcctgcccccgaagaagaggaagccctgactaccgaggatttcgaacttcttgatcagggcgaactggaacagcttaacgcagaattagggttggaacctgaaaccccacctaaaccaccagatgcccccccactgggccccgatatccatagcctggtccaatctgaccaagaagcgcaggctgtagccgagccctag

SEQ ID NO: 42095 - DNA, 1401 bp, Artificial Sequence
  Description of Artificial Sequence: Synthetic coding sequence
atggccgaggccgagggcgtgcccaccacccccggccccgccagcggatcgacattcaggggacggcgtgacgtgagcggctcctgggagcgcgatcagcaggttgaggccgcccagcgcgctctagtcgaggtgctgggaccctatgaaccattgctctctcgcgttcaggctgccttggtatgggagcggccagcgcgcagtgccctctggtgtttaggcctcaatgccgctttctggttcttcgccctgacttccctgcggctcgtgttccttctggcctttggtctgatgattattgtttgcattgatcaatggaagaacaagatttggccagaaattaaggttccacgtccagacgcactggacaatgagtcttggggcttcgtacatccccggttgttgtctgtgcccgaactctgccaccacgtggcagaggtttgggtatccggcacgattttcatccgtaacgtgctgctgtttaagaagcaaaaccccggcaaattttgccttttgagttgcgggatcctcaccttcctggcggtattgggacgatacgtgccaggactgctgctgtcttatctgatgctggtcacggtgatgatgtggcctctagcggtgtaccaccgcctgtgggatcgggcctatgttagactgaagccagccctccagagattggatttcagcgtgagaggctatatgatgtcaaagcagagagaacgccagttacgccggcgcgccctgcatccggaacgcgcaatggacaaccacagcgacagtgaggaagagctggccgctttctgcccccagcttgatgacagcactgtagctagggagctcgccatcaccgacagtgagcatagtgatgcagaagtgtcctgcaccgataatggcacatttaacctgtcgagagggcagacccccttgactgagggctccgaggatttggatgggcacagtgaccctgaggaatctttcgcccgcgatctaccggactttccttctattaatatggacccagctggtcttgatgacgaagacgatacatctataggaatgcccagcctcatgtatcggtcaccgccaggggctgaggagccacaagcgccaccggcatctagagatgaggccgccttaccagagctgctcctgggcgcactaccggtcgggtctaatctgaccagtaacttggcatcattggttagccagggcatgattcagcttgcactctcaggtgcaagtcagcctggtccgtctggagcccccgctcagcgtgccacacgtggctttctgcgttccccatcttcagatctagataccgatgcagagggcgatgacttcgagctgttagaccagagcgagttgtcccaactcgaccctgccagcagccggtctcattag

SEQ ID NO: 42096 - DNA, 816 bp, Artificial Sequence
  Description of Artificial Sequence: Synthetic coding sequence
atgctggtgaccgtgatgatgtggcccctggccgtgtaccaccggctgtgggaccgggcctacgtgaggctcaagcctgcattgcagagactggacttcagcgtacggggctatatgatgtctaagcagcgcgaacggcagctgcgacgccgagcgctacatcctgaacgagctatggacaaccactctgactccgaggaagagctcgccgcattctgcccacaactggatgattcgacagtggctcgcgaattggccattacggactccgagcactcagacgccgaagttagttgcacggataacggcacctttaacctaagtagggggcagaccccgctgactgagggcagcgaggacttggacggccacagcgacccggaggagtctttcgcaagagacctgccagattttccttctatcaacatggacccagccggcctagatgatgaggacgacactagcattggcatgccctcattaatgtataggtcacccccaggagcagaggagccccaagcccctcctgcgtcccgcgacgaggccgcactcccagagctcctgcttggagcactcccagtgggctcaaacttgaccagcaacttggcaagcctggtctcccaggggatgattcagttagccttatcgggagcctcacagccgggccccagcggtgcccctgctcaacgcgctactaggggatttctcaggagccctagtagcgatctggacacagacgccgagggagatgacttcgaattactggatcagtccgagctgtcacagttggatcctgcctcctctcggtcccactag

SEQ ID NO: 42097 - DNA, 3960 bp, Artificial Sequence
  Description of Artificial Sequence: Synthetic coding sequence
atgaccgaggtgcaggccatggtggagttcagcgtggagctgaacaagttctacaatgtggatctcttccagagagggttctaccagatcagagccagcatgaaaatacccagcaggattccacaccgagttgaggcctccctcctgcacgctaccggtatgaccctggccttccctgccagcgtccacgactccctgatttgttccaaaacctttcagatactgtataaaaacgaagaggtcgtgttgaacgatgtcatgatatttaaagtgaagatgctcctcgatgagcgtaagattgaagaaaccctggaggaaatgaactttttgttgtccctcgatttacactttaccgatggagactattcggccgacgacttgaatgccctccagcttatatccagcaggaccctgaagcttcacttttctccacatagaggtcttcaccaccacgtaaatgtcatgtttgattattttcacctgtccgttgtctctgtgactgtgcatgccagtcttgtcgctttacaccaaccgttgatcagcttccccaggccagtaaagacaacctggctgaatcgcaatgcaccggcccagaataaagactccgtaattcccactctcgagtctgttgtgttcggaatcaactataccaaacagctgagccccgacggatgtagttttatcatagccgattcattccttcaccacgcgtacagattccactacaccctctgcgctactctgctcctcgcgttcaaggggctgcatagctacttcatcacagtcaccgaagagattccaagttgccagaagcttgagcttgaggagatggatgtggaagctcgtctgactgagctgtgcgaagaagtgaaaaagatagagaacccagatgagctggcagaactcatcaacatgaatttagcacagctgtgcagtctactgatggccctgtggggtcaattcctcgaagtaatcactcttcatgaggagctgaggattctgttggctcaggagcatcacaccctacgcgttcggcgattttccgaagcttttttttgctttgaacatccaagggaggcagcaatagcatatcaggaactgcatgcgcagtcccacctccagatgtgtacagcgatcaaaaatacgagcttctgcagctctctgccccccctgccgatcgagtgtagtgagctggatggcgatctcaacagtctacccataatatttgaagaccgctacctggacagcgtgacagaggggaagttagatattagtcaagacgacagtgagattacccagatggagcataacctggccagccgcaggtcgtcagatgattgtcatgatcatcagaccacacccagcctcggcgtgagaacaatagagattaagcccagtaataaggaccccttctccggagagaacatcactgtgaagctggggccttggactgagctgaggcaagaggagatcctggtcgataatctgcttcccaactttgagtctctggaaagcaacggaaagtctaaaagcattgagattacattcgaaaaggaggcactgcaagaggcaaaatgtcttagcatcggtgaaagccttaccaagctgaggtcaaatctccctgccccaagtacaaaggaataccacgttgtggtgagcggcgatacaatcaaactcccagacatttcagctacctacgcatcctccagattcagcgattcaggcgtggagtcagagcccagcagcttcgctacgcaccctaatacagatctggtgttcgagaccgtgcaggggcaaggcccttgtaactctgaacgcttgttcccccagctgctcatgaaaccagattacaatgttaaattctccctgggaaaccactgcaccgagagtacaagtgccatctcagagattcagtcatcactcacttccatcaatagcctgccatcggacgatgagttgtcccccgacgagaattctaaaaaaagtgtggtaccagagtgtcatctgaatgactctaagactgttctaaatctgggaacgaccgacctcccaaagtgcgacgacactaagaagagcagcataactttacagcagcagagtgtagtcttcagcggcaatcttgataacgagaccgttgccatccacagccttaatagctcaattaaggaccccctgcagttcgtattttccgatgaagagacaagcagcgatgtcaagtcatcctgtagcagtaagcctaatctggacaccatgtgtaagggcttccagtctccagataagtctaacaactcaacaggaaccgctatcacactgaacagcaagttgatctgtctcggtacaccttgcgtgatttccgggtcgatatcctccaataccgatgtgtcagaggatcgcactatgaaaaaaaattcagacgtccttaatttgacacagatgtattctgaaattccaacagtagagagcgagacacatctcggcacttctgacccgttttccgcaagtactgatatagtgaagcaaggcctggtggaaaattacttcggttcccagagcagtactgacatctccgatacttgcgcagtgagttacagtaacgccctgagtccgcaaaaggagactagcgaaaaggagatttccaatttgcagcaggagcaggataaagaagacgaagaggaagaacaggaccaacagatggtccagaacgggtactatgaagagacagactactccgctctggatggcaccatcaatgctcattacacttctcgcgacgagttgatggaagagcgcttaaccaagtcagaaaagattaactctgattacctcagagacggtattaacatgcccacagtttgtaccagcggctgtctctcctttccctcggctccgcgggaatcgccttgcaacgtgaagtactcctccaaatcaaaatttgacgccatcactaaacagccgagtagcacatcgtataactttaccagcagcataagctggtacgaatcgtctcccaagccacagattcaggcatttctgcaggcaaaggaagagttaaagctcctgaagcttccaggtttcatgtactccgaggtgcctctcctcgccagtagcgtgccctatttttccgtggaggaagaggacggctcagaagatggcgtccatctgatagtctgtgttcatggactggacggaaattctgccgacctaagactggtgaagacctacatcgagttaggtttacccggcggcagaattgactttctgatgtcggagcgcaaccagaatgatacattcgcagattttgattccatgacggataggttgttggacgaaattattcagtatatccaaatctactccctgacagtgagcaaaatatcgtttattggtcacagtctgggaaatctgatcattaggtctgttcttacccgtccacggttcaaatattacctgaataagctgcacactttcctctcactgagcggccctcatcttggcactctctataactcctcagccctggtgaatacaggcctttggttcatgcagaaatggaaaaaaagtggaagcctcctccaacttacctgtagagatcacagcgaccctcggcagacattcctctacaagctaagcaacaaggccgggctacactatttcaagaacgtagtccttgtcggatctttgcaggatagatatgttccttatcacagcgctagaatagagatgtgcaagaccgcccttaaggataaacagtctggccaaatctacagcgagatgatccataaccttctgagacccgtgctgcaaagtaaggactgtaacttggtccggtacaacgtgattaacgcactccccaacaccgctgacagcctgatcggacgcgcggctcacattgccgtcctggattcggagatcttcctcgagaagtttttcttggtggccgcattgaaatactttcagtag

SEQ ID NO: 42098 - DNA, 3909 bp, Artificial Sequence
  Description of Artificial Sequence: Synthetic coding sequence
atgaccgaggtgcaggccatggtggagttcagcgtggagctgaacaagttctacaacgtggatctgttccagcgtggaaagaccttccagatcctttacaagaacgaggaagtggtgttgaatgatgtgatgatttttaaggtgaagatgttactagacgagcgcaagattgaagagaccttagaggaaatgaatttccttctcagcctggacttgcacttcaccgatggggattacagcgcggacgatcttaatgctctgcaactgatatcgtcccggacactgaagctccactttagtcctcaccgaggattgcaccaccatgttaacgtcatgttcgattactttcatttgtcagtcgtgagtgtgacagtccatgcctcgttggttgccctccaccagcctctgatttcctttcccagacccgttaagacaacatggctgaaccgcaacgcccccgctcagaataaagattcggtgatcccaacccttgagagcgtcgtgtttgggatcaattacacgaagcaacttagcccagacgggtgctccttcattattgcggatagtttcctacaccacgcgtatcgcttccactacaccctatgtgcaactttgctgcttgcctttaagggtctgcattcatacttcattacagttaccgaagagattccaagctgccagaaactcgagctcgctaaagcaaacatgcagctcctgtacgaaaggctgctgaggaggaagcagctcagaacacagaaggacaaccatctggaggagatggatgtggaggctagacttacggaactgtgcgaggaggtcaaaaagatagagaatccggacgagctcgctgagctaatcaacatgaacctcgcccaactttgctctctgctgatggctctgtgggggcaatttctggaagtgatcacgttacatgaggagctcaggattctgctggctcaggagcatcacaccttgagagtacgaagattcagtgaggcgttcttctgctttgaacacccacgcgaagctgctattgcttatcaggagctccacgcacagtcacacttgcaaatgtgcaccgccattaagaacacatctttttgcagtagcctgcccccacttccaattgagtgtagcgagctggatggggaccttaattccctgcccatcattttcgaagatagatatctggattcagtgaccgagggcaagcttgacatctctcaagatgacagcgagatcacccagatggagcataacctggcctctcgtagatcctccgacgactgtcatgaccaccagacaacgcctagcctgggtgtgcgtactatcgaaatcaagcctagtaataaggaccctttttctggggagaacattacagtcaagctgggcccttggaccgagctacggcaggaggagattctcgtggataatttactccctaatttcgagagtctagagagcaatggcaagtctaagagtatagaaattacgtttgagaaggaagcacttcaggaagccaaatgcctctctattggtgagagcctcacaaagctgaggtctaacctgcctgcacccagcactaaagagtaccatgtggtggtgtcaggggacactatcaagctgcccgacatatctgcgacatatgcctcatccaggttctctgattcaggcgtcgaaagcgaaccaagttccttcgctactcaccccaacaccgacttggtgttcgaaacagtccagggacagggaccgtgtaactccgagcggctgttcccccagctgctcatgaaaccagattataatgtgaaattcagccttggcaatcactgcaccgaatctacctcggcaatctctgaaattcagagcagccttacttctattaacagcctgcccagcgacgacgaactctcacccgatgagaacagtaaaaagtctgtcgtgcccgaatgccatcttaatgactctaagacggtgctgaaccttggcaccacagatcttcctaagtgtgacgataccaagaagtcctcaataactctgcagcagcagagcgtcgtattcagtggtaatctggacaatgaaaccgtcgctatccattcacttaattcatcgatcaaagatcccctgcagttcgtgttttcggacgaagaaactagttcagacgtcaagagctcctgctccagtaagccgaacttggatacgatgtgtaaaggcttccagtctccggataagagtaataacagcaccgggacggctatcactctcaattctaagctaatatgccttggtacaccttgcgtcatatccgggtccatatcttccaacacggacgttagtgaggaccgtaccatgaagaaaaattcagatgttctaaatctgactcaaatgtacagcgagattccaactgtagaatcagagacccacctcggcacgtccgaccccttttctgcctcaaccgacatcgtgaagcaaggtttagtggagaactatttcggatcccagtctagtaccgatatatcagacacctgtgctgtcagttacagtaacgctctgtccccacagaaggaaacctctgagaaggaaattagcaatctccaacaggagcaggataaagaagatgaggaggaggagcaggatcagcagatggtgcagaatgggtattacgaagagactgattacagtgccctggatgggactattaacgcgcactacacctctcgcgacgagctgatggaggagcggttgactaaatccgaaaaaattaatagtgattatttgcgggatgggatcaatatgcccactgtttgtacatccgggtgtctcagcttcccatctgcgccccgggagagtccatgtaacgttaagtacagcagcaaatccaagttcgatgccataacaaaacagccatcgagcacaagctacaacttcactagctccattagctggtacgagagctcgccaaagccacagattcaagcctttcttcaagcgaaggaagagctgaagctcctgaagcttcctggttttatgtacagcgaagtgcccctgcttgcatccagcgtgccttatttctctgtcgaggaagaggatggatctgaggacggcgtgcatctgatcgtgtgtgtgcatgggctcgatggtaatagtgccgacttgaggttggtgaagacctacatagagctgggcttgcctggaggacggatcgatttcctgatgagtgaaaggaaccagaatgacacttttgctgactttgacagcatgacagataggctgctagatgagatcatccagtatattcagatctacagcctgaccgtctccaaaatctcgttcatcggccacagtctgggcaatttgatcatccggtccgtgcttactagaccaagattcaagtactacctcaataagttgcacactttcctgagcctgagcggcccccatctaggcactctatataactcgtccgccctggtgaacaccggtctgtggttcatgcagaaatggaagaagagtggcagtctgctccaacttacatgcagggatcacagcgacccacgacaaacatttttgtataagctgagtaataaggctggtctccattacttcaagaacgtagtcctcgttgggtccctccaggacagatatgtcccatatcactcagctaggattgagatgtgcaaaacagcgcttaaagataaacaaagtgggcagatatacagcgaaatgatccacaatctgttgagacccgttctgcagtccaaggattgtaacctcgtgcgttacaacgttattaacgcattacccaatacagccgacagcctgattggacgggccgcccacatcgctgtactggactccgagatctttctggagaaattcttccttgtggccgcattgaagtatttccagtag

SEQ ID NO: 42099 - DNA, 4548 bp, Artificial Sequence
  Description of Artificial Sequence: Synthetic coding sequence
atgaccgaggtgcaggccatggtggagttcagcgtggagctgaacaagttctacaacgtggacctgttccagcgcggtttctaccagattagagctagcatgaagattccgagccgcatcccccatagagtggaggcctcacttctacacgcaaccggcatgactttggcattcccagcaagcgtgcacgactcacttatatgttccaaaaccttccaaattctgtataagaatgaagaagtggtccttaatgatgtgatgattttcaaggtgaagatgcttctggatgagaggaagatcgaggaaaccctagaggaaatgaactttctgctctcactagatctccatttcaccgatggggattatagcgcagatgacctgaatgctctccaattgattagttcccgtacgctcaaattacatttttcaccacacagaggcctgcatcaccatgtgaacgtaatgtttgactattttcacctcagtgttgtgagcgtcactgtccacgcgtcccttgtggccctacatcagccactgatcagctttccacgccctgtgaaaaccacatggctgaatagaaatgccccagcacagaacaaagactccgtgatccctacactcgaaagcgtggtgtttggcatcaactacacaaaacagcttagcccagacggctgtagtttcatcattgcggatagcttcttgcatcacgcctatcggttccattacacactatgcgctactctgctcctggccttcaaaggattacacagttactttataactgtcactgaggaaatcccctcctgccagaagttggagctggaagaaatggatgtcgaagcaaggttaactgaactttgcgaagaagtaaaaaaaattgaaaaccccgatgagctcgccgagctgatcaacatgaaccttgcgcagctgtgcagcttgcttatggcactgtggggtcagtttttggaggtgattaccctccatgaagaattacggattctgttggctcaggaacaccacaccttacgggtgcggaggttttcagaggcctttttctgctttgagcacccacgagaggctgcaatcgcctaccaggaactccacgcacaatcacacttacaaatgtgtacagccatcaagaatacatccttctgcagctctttgccaccactgccaattgaatgctcagagctggacggggatctaaatagcttgcccataattttcgaagataggtacctggactcagtcactgaggatctggatgctccttggatgggtattcagaatttacagcgatcggaaagcagcaaaatggacaagtatgagacagaggagtcctcggtggctgggttgtcttccccggaacttaaagttcgtcctgccggagcaagctccatctggtacaccgagggcgagaaacagctcaccaagtctctaaagggcaaaaacgaagagagcaacaaatccaaggtgaaagttaccaaactgatgaagaccatgaagtccgagaatacaaagaaactgataaagcagaattccaaagactcagtagttttggttggctacaagtgcctaaagagcacggcaagtaacgatctaattaaatgttttgagggcaatccctcccacagccaaaaggaaggcctcgaccccaccatctgcggttacaattttgaccccaagacctatatgcgccagaccagccaaaaggaggcttcctgcttgcccacaaacactgaaagaacagagcagaagtcccctgatatcgagaacgtgcagcctgaccaatttgaccctcttaacagtggcaacctcaatctgtgcgctaacctgtcgatctctggaaagctggacatttcccaagacgacagcgaaatcacccaaatggaacacaacctggccagccggcgctcgtccgatgattgccacgatcatcagactacaccctcactgggggttcgtacaatcgagatcaagccttctaataaagacccatttagtggtgagaacatcactgtaaagctggggccctggactgaactccgccaggaagagatactggtcgataaccttctccccaacttcgagtccctggaatctaatggaaagtccaaatccatcgagatcacctttgaaaaagaggccttgcaggaggccaagtgcctgtctattggtgagtctctgaccaagttaaggagtaatctacccgcacctagcacaaaagaataccatgtggtggtgtctggcgacaccatcaagttgccagatatctccgcgacttatgccagtagtagattctctgactctggagtggagtccgagccaagctctttcgctacacaccctaacactgatcttgtcttcgagaccgtccagggtcagggcccctgtaactcagagaggctttttcctcaattacttatgaaacccgattataacgtaaagttctctctgggtaatcattgcacagagagcacgagcgccatttcagaaatccagtcaagcttgacgagcattaacagcctgccttctgacgatgagctgagtcccgacgaaaactcgaagaagtccgtggtgcccgaatgccacctgaatgatagcaaaaccgtattgaatctgggcacaaccgatttaccaaagtgcgatgatactaaaaaatcgtccataactttgcagcagcagagcgtggtattctcaggaaacctcgataacgagacagtcgccatacactcactgaactcgtcaattaaagacccactgcagttcgtgttctccgatgaggagacatcgtctgacgtgaagagctcctgcagctctaaacccaaccttgacacaatgtgtaaagggtttcagtcccccgataagtccaataattccaccgggaccgccatcaccctgaattctaaactgatatgcctgggaacgccatgtgtgatctcaggctcaatttcaagcaacactgacgtatctgaggaccggactatgaagaaaaattccgacgttctgaacttgacccagatgtattcagaaatcccaaccgtggagtccgagacacacttaggaacttcagaccccttttcagcaagcacagacatagtgaaacaaggcctcgtcgaaaattacttcgggtcccagagtagcacggacatttctgatacctgtgcggtgtcctacagtaacgccctttccccccaaaaggaaacaagcgagaaggaaatcagtaatttgcagcaggagcaagacaaggaagacgaggaagaggagcaggaccagcaaatggttcaaaatggctattacgaggaaactgattattccgcgctggacggcacaataaacgcccattacacctcacgtgatgaactgatggaggagcggctgaccaaatctgaaaagatcaactctgactatttgcgcgacggaataaatatgccaacagtgtgcacatcaggctgcttatccttccctagcgcccctcgggaatcaccatgcaacgtgaagtattccagcaagtcaaagttcgatgcaattaccaagcagccgtcttccacatcttataatttcacttcctccataagctggtatgaaagctctccaaagcctcagattcaggcattcctccaggctaaagaagagctcaaattgttgaaactgcccggattcatgtactcagaggtaccactcctggcctcttctgtgccgtatttttccgtggaagaggaagacggcagcgaagatggcgtacacttaattgtgtgtgttcatggcctggatggcaactccgccgatctgcgtttggtgaaaacgtacatagaactgggcctccctgggggccgcattgattttcttatgtcagaaagaaatcagaacgatacatttgctgatttcgactcgatgacggatcggctgttggatgaaatcatccagtacattcagatctattccctaaccgtcagcaagatcagcttcattggacactccctagggaacttgattatacggtcagttttgacaagaccgcgttttaagtattaccttaataagttgcatacctttctctctctgagcggccctcacttgggtaccctgtacaattcctcagccctggtgaacacagggctatggtttatgcagaagtggaagaaatctggcagcctgctgcagctgacatgccgcgatcacagcgatccgcgccaaactttcctttacaagttatctaataaggccggactacactatttcaagaacgtggttctggtggggtcgttgcaggaccgctacgtcccatatcactcagcccggatagagatgtgcaagactgcacttaaagataagcagtctggtcagatctatagcgaaatgatacataatctgcttcgtccagtactccagagcaaagactgcaatctggtgcggtacaatgtaatcaacgccctgccaaacaccgctgattctctgatcggccgggctgctcatatagccgtgctggacagcgaaatctttttggaaaaattctttctagtggccgcactgaagtattttcagtag

SEQ ID NO: 42100 - DNA, 3909 bp, Artificial Sequence
  Description of Artificial Sequence: Synthetic coding sequence
atgaccgaggtgcaggccatggtggagttcagcgtggagctgaacaagttttataacgtggatcttttccagcgggggaagacgtttcaaatcctttataagaacgaagaggtcgtgctaaacgacgtgatgatcttcaaagtaaagatgcttctcgacgaacgcaaaatcgaggaaacactggaggagatgaatttcctgctctcactggatcttcacttcacggacggcgactattctgctgacgatcttaatgctctgcaactgatctcttctcggacactgaaacttcatttctctccccaccgcgggttgcatcaccacgtaaatgtgatgttcgactactttcatctgagtgtagtctctgtgaccgttcatgcttccttggtcgccctgcaccagcctttgatcagtttccctaggccagttaagactacatggctgaatcgcaatgccccagcacaaaataaggactccgtgatacctacccttgagtccgttgttttcgggatcaattataccaaacagttgtcaccggatggttgctcgtttatcatagcagacagcttcctgcatcacgcataccgcttccactatactctttgcgcaacactgctgctggcctttaaagggttgcacagctactttattacagtaaccgaggagataccatcatgccagaagctcgagctggcaaaagcaaacatgcagctgctctacgagcggctcctgagacgcaagcaattaaggacgcaaaaggataatcacctcgaggaaatggatgtggaggcccgccttactgaactgtgcgaagaggtgaaaaagatcgaaaatcccgacgagctggctgagctgataaacatgaatcttgcccagctgtgctccctgctcatggccctgtggggacagtttctagaggtaatcacactccacgaggagctgaggatactcctcgcccaggaacatcataccctccgggtgcgacgcttcagtgaggcgtttttctgtttcgagcatcctcgggaagccgctatcgcctatcaggagttacatgctcagagtcaccttcagatgtgtacagctatcaaaaatacctcattttgttcttccctgccaccactccctattgagtgcagtgaattagatggggacctcaacagtctgcctattatctttgaggaccgataccttgactcagtcaccgaaggaaagctggatatcagccaggacgacagcgagatcactcaaatggaacacaacctggcaagtcgacggtctagtgacgattgccacgatcaccagacaacacctagcctcggcgtacggaccatcgagatcaagcctagcaataaagatcccttctctggagagaatattaccgtcaaactcgggccttggactgaattgaggcaggaggaaatcttggtcgataacctgctgcctaactttgaatcgctcgaaagtaacggcaagtcaaaaagtatcgaaattacatttgaaaaggaagctctgcaggaagccaagtgcctttctataggtgagtctttaactaaactaaggagcaatttgccagccccgagcaccaaggagtatcacgtcgttgttagtggcgacaccattaaactgcccgatatttccgcaacgtacgcatcatcaaggttttcagactcgggtgttgaaagcgagccctctagtttcgcaacacacccgaatacagatctagtctttgagacagtgcagggccaggggccctgtaactccgagcggctgttccctcagttgttaatgaaacctgattacaacgtgaaattcagcctagggaaccattgcacagagagcacaagcgccatttccgagatacagtcctccctgacatcaatcaattctcttccctccgatgacgagttgtctcccgatgaaaacagcaaaaaatctgtggtgccagaatgtcaccttaacgactcgaagaccgtgcttaaccttgggaccactgacctgccaaagtgtgatgacacgaagaagtcatccattacactgcaacagcagtccgtggtcttttccgggaacctagacaacgagacggtggctatccattcccttaatagttccattaaagatccgctccagttcgtattttcggatgaggagacgagctctgatgtaaagagcagttgcagttcaaagccaaatctggataccatgtgcaaggggtttcagtccccggacaaatctaacaattccactgggaccgctattaccctcaatagcaaactgatatgtctggggactccgtgtgtcatctccggaagcatcagctccaacaccgacgtatcagaagaccgaactatgaagaagaactctgacgtattaaacttgacacagatgtactcagaaattccaactgtggaaagcgaaacccacctggggaccagtgatcctttttccgcttccactgatatcgtaaagcagggcttggtggaaaattacttcgggagccagtctagtactgacatctccgatacttgcgcagtgtcttacagtaacgctctgtccccccagaaggaaacttcagagaaagagatttccaacctgcagcaggaacaagataaggaagatgaggaggaggagcaggaccagcagatggttcagaatggctattacgaggaaactgactattccgctctcgatggcaccataaatgctcactacacatcccgggacgaattaatggaagagcgacttactaagagtgaaaagatcaacagtgactacctccgggacgggatcaacatgcctaccgtttgcacgtccggctgcctatcctttcctagcgccccaagagaaagcccttgcaatgtgaagtatagttcaaagtcaaaatttgacgcaattacgaaacaaccgtctagcacaagttacaatttcactagctccatttcgtggtacgaatccagccctaagccacagatccaggcttttctacaggccaaagaggaacttaagctgctgaagctcccagggtttatgtatagtgaagtaccactcctcgcctcgtcagtcccatatttcagcgtcgaagaggaggacggcagtgaagacggagtccatctgatagtctgtgtccatggattggacggaaactccgctgacctccgcctggtcaagacttacattgagctgggcttgcctggcggccgcatcgatttcctcatgagcgagaggaatcagaacgacacattcgccgactttgactctatgaccgatcgactccttgatgaaattattcagtatatacaaatctactccttaaccgtgtctaaaatatcttttatcggtcattctctcggaaacctcattattcggtccgtgttaacacggccacgcttcaaatactacttgaataagttgcacaccttcctgagcctgtccggtcctcacctgggtaccctgtacaattcaagtgccttagtgaataccgggctgtggtttatgcagaagtggaagaaatccggatctctgctgcagctgacttgtcgggatcactccgacccccggcagacatttctgtataagctgtccaataaggctggcctgcattacttcaagaacgtggttctcgttggatcattgcaagatcgttatgtgccataccactcggcccggatagagatgtgcaagactgccctcaaagataaacagtcaggacagatctacagtgaaatgattcataacttgttgcgtcctgtgctccagagcaaggattgtaatctggtgcgctacaatgtgatcaacgccctccctaatacggccgatagcctgattggcagggctgctcacatcgccgttctggacagcgagattttcctggaaaagttttttttggtcgccgctctgaagtactttcagtag

SEQ ID NO: 42101 - DNA, 153 bp, Artificial Sequence
  Description of Artificial Sequence: Synthetic coding sequence
atgaccgaggtgcaggccatggtggagttcagcgtggagctgaacaagttctataacgtggacctctttcagagagggttttatcaaattcgcgccagcatgaagatcccgagcagaatcccacacagagtggaagcaagtttgctgcactag

SEQ ID NO: 42102 - DNA, 96 bp, Artificial Sequence
  Description of Artificial Sequence: Synthetic coding sequence
atgaccgaggtgcaggccatggtggagttcagcgtggagctgaacaaattttataacgtggacctgtttcaaagaggcttctatcagatccgttag

SEQ ID NO: 42103 - DNA, 1518 bp, Artificial Sequence
  Description of Artificial Sequence: Synthetic coding sequence
atgaccgaggtgcaggccatggtggagttcagcgtggagctgaacaagttctataacgtcgatctgttccagaggggattttatcaaatccgcgcgtcaatgaagatcccatcacggattccacacagggttgaagcgagcctccttcacgccacaggcatgacgcttgcctttcccgcaagcgttcatgattccctgatctgctctaagacgtttcagatactgtataaaaacgaagaggtggttctcaatgatgtgatgatctttaaagtgaaaatgcttctcgacgagcgtaagatagaagagacattagaggaaatgaactttctgctgtcactcgacctgcattttaccgacggcgattacagcgctgatgatctgaatgcactacagctaatctcttctaggacactgaagctgcactttagcccccacagagggttgcaccatcatgtgaatgtgatgtttgactacttccaccttagcgtggtaagtgttaccgtccatgccagtctggtagccctgcaccagccactgatcagcttccccaggcccgtcaagaccacttggctgaatcgaaatgcacccgcacagaacaaagatagcgtgattccaacactggaatcggtggtgttcggcataaactacacaaagcagctctctccagacgggtgcagctttatcattgccgacagttttctgcaccacgcttaccggtttcactatacactgtgcgccaccttattactagcctttaaaggtctgcacagttattttatcacagtcactgaggagatcccatcttgtcagaaacttgagctagaagagatggacgtcgaggctcgactgaccgaattatgcgaagaagttaaaaagattgagaaccccgacgagctggccgagctgatcaatatgaatctcgctcagctgtgtagtctactgatggccttgtggggacagtttttggaggtcattactctgcacgaagagttgaggattctgctagctcaggagcaccatacacttagggtccggaggttctcagaggcgtttttctgtttcgagcatccgagggaagccgcgatcgcttatcaggagttacatgcacagtctcacctccagatgtgtactgccattaagaacacaagcttctgctcctctttgccgcctttgcccatcgaatgtagtgagctggacggggatcttaattcgctgcctatcatcttcgaggaccgttatctggactctgtgacagaggaccttgatgctccctggatgggtattcagaacttacagcggagtgaatcttccaagatggataaatacgagaccgaagaaagctcagtggctgggctctccagccccgagctgaaagtgaggcccgcaggtgcatcaagtatctggtacactgagggcgaaaagcaactgaccaagtccctgaagggtaaaaacgaagaaagcaacaaatctaaggtaaaagtcacgaagctgatgaaaactatgaagtctgaaaattag

SEQ ID NO: 42104 - DNA, 462 bp, Artificial Sequence
  Description of Artificial Sequence: Synthetic coding sequence
atgagcgagatccagggcaccgtggagttcagcgtggagctgcacaaattttataacgtggacctattccagcgggggtattatcagatcagggtcacccttaaggtgagttcacggatcccacataggctaagtgcctcaatcgccgggcagactgagagctcctcccttcatagcgcatgcgtgcacgatagcaccgttcactctcgggtcttccagattctctaccgcaacgaagaggtgccaatcaacgatgctgtggtgttccgtgtgcatttgctgcttggtggcgagagaatggaggatgcgttgtcagaagtagatttccagctcaaggtggatttacatttcaccgacagtgagcagcagctgagggatgtcgccggtgcccctatggtcagttcaaggaccctggggcttcatttccatccaagaaatggccttcaccatcaggtcccatag

SEQ ID NO: 42105 - DNA, 4221 bp, Artificial Sequence
  Description of Artificial Sequence: Synthetic coding sequence
atgagcgagatccagggcaccgtggagttcagcgtggagctgcacaagttttacaacgtggatctcttccagcggggctactatcagattcgtgtgactctcaaggtctcatccaggatcccccaccgtctgtctgcatctattgcggggcagaccgagagctccagcctgcactccgcatgcgtgcacgatagcacagtacactctcgggtctttcagatcctgtatcggaacgaggaggtccctataaacgacgctgtggtctttcgcgtgcacctgcttctaggaggagaaagaatggaggacgccctttccgaggtagacttccagctgaaggtggacctgcattttacagattccgaacagcagctgcgggatgtcgcaggagccccgatggtgagttctaggactcttggattacatttccacccccgcaatgggttgcatcatcaggtaccggttatgtttgattatttccacttatccgttattagcgtcacagttcacgcagcacttgtggcgctgcagcaacccttgatttcattcactcggccaggtaggggaagctggcttggaaagggcggacccgacaccggacaggagcaatctataattagtctggaaaatcttgtttttggcgcaggatactgcaagcctacaagctcagaaggttctttctacataacaagcgagaactgcatgcaacacgcacataaatggcatagagatttgtgcttgttgcttcttcacgcctaccgtgggctgcgactacacttcctggttatcatgcgcgatatccctgaactgcctcatacagagctcgaggcgctggccgtagaggagacactatctcagctttgcagtgagctacaaatgttaaataatcccgaaaagatcgcggagcagatcagcaaggatttagcgtggcttacttcccatatgatgacactgtggacccagttccttgacaccgtgaccctccattcacaagtcacgacctacttgacacaagagcaccataccctgagggtgcgacggttctctgaagcgtttttttacatggaacatcagaagcttgctgtcctgacttttcaagagaatttgatccagacgcactctcaactttcattagacatccggaattcagaatacctgactagcatgcctcccttgcctgcagagtgtctcgatatcgacggcgattggaatactcttcctgtgatcttcgaggacaggtacgttgactgccctgcgacgggtcacaacttgagcgtgtacccaaacttcgatgttccagttaccagtcccaccatcatgaatctcaaagacaaggaggataattgcatggtgaactccaacctgagcttccgggaggacctcgtcctgtccacgattaagccctcacagatggactccgatgaagaggtgataagatgccctgagcccggggagaatgtggctacccaaaaccatatggatatgtgctctgagtcccaagtgtatattagcatcggcgagtttcagaacaaagccggtgtcccagaggatgaatgctggacaggacaaacatctgatgccggaacatatcctgtcgcagacgtcgatacaagtcggagatcccccggccctgaggacgggcaggcaccagtcttgacgtacatagatgtgaagtctagtaataagaatccctcgcgggccgaaccgctggtagccttcaatgctcaacatgaaagcaggagtagtcgagataagtacggtctcgacaggacggggttgtcgaaagtggtggtgggggggtcacatcagaacgcgatatctagcgacaagacaactcttcacgagctttctacccttggcaaaggaatcgaccaggaagggaagatggtgcttctgagcctaaagctgacaccatctgagccttgcgatcctttaagcagcacgctgcgtgaaccactggacatacgctcgtccctaaaagattcacacaccgaggagcaggaagagctaagtgtgctctccggagttatcaagcggtctagttctatcatcagtgatagtggcatagagtcagaacctagctcagttgcctggtccgaggcgaggtcgcgcgcactggagctccccagtgatagggaagttctccacccttttgtgcggcgtcacgccttgcaccgcaattcactggaggggggacacaccgagtctaataccagtttgccttccggcatacaggctagtttgacttctatttcctctttaccttttgaagaggatgaacgcgaggtggcactgacgaaactgacgaaatcagtgtcagccccccatatctcatccccagaggaggctgcggaggacgctgacacaaagcagcaagacggcgggtttgctgagcccagtgacatgcatagtaaatcacaggggagcccaggatcatgcagccagctctgcggagactccggcaccgacgcaggggccgatcacccccttgtcgaaatcgtgctagatgccgacaaccagcagggcccaggctatattgatatcccaaaaggaaagggtaaacagtttgacgcacagggacactgcctgcctgacggacgtactgagaataccccaggagtagaaactaaggggctgaaccttaaaatcccacgtgtgatcgcgctggaaaaccctcggacacgaagtctgcacagggcactggaggagacacctaagggcatgccaaaggacctcaatgtgggacagcaggccctgagcaatagtggcatttcagaggtcgaaggcttgagccaacaccaggtgccggaactgagctgcacgtcagctgccgatgcaataaacaggaactctacggggcaacagtctcaatctggcagcccttgtataatggacgacacagctttcaacaggggcgtcaatgctttcccagaggctaaacacaaagcaggaaccgtgtgcccaacagtcactcactccgtgcatagccaggtgctgaagaatcaggaactgaaagccggcacctccattatggggtcacacttgacgagtgctgagacctttacgttagactccctcaaagccgtggaagtcgtgaaccttagcgtgtcatgtaccgccacatgccttccgttttcaagtgtcccgaaggaaacccccgcacgggctgggttttcatccaaacaaacactcttccccatcacccaccaacccctagggagctttggcgtggtatcaacccatagcagcactctggatgaagaggtatccgaacggatgttctctttttaccaggctaaggaaaagttcaagaaagagctgaagatagaaggctttctgtacagtgatctgaccgtactggctagcgacatcccctattttccacccgaggaagaggaggagaacctggaggacgggattcacctggtcgtatgtgtccatggcctcgatggtaactccgccgacctgagactggtgaaaacttttatcgagctggggttgccaggggggaagcttgacttcctaatgagcgagaagaaccagatggatacttttgcagattttgacacaatgaccgaccgacttctggacgagatcattcagcacattcagctctacaacctctcaataagccggatctccttcataggccatagtttgggcaacatcattatcagatctgtcctgacccgaccacggttcaggtattatttaaataaactccacacatttctctctctgtctgggcctcacctcggcactctctataacaactccacgctcgtgtctacaggtttatggttgatgcagaaactgaaaaagtctgggtccctgctgcagctgacctttagagacaacgcagacctgcgtaagtgcttcctttaccaactgtcccagaaaaccggactgcaatacttcaagaacgttgtgctggtagctagcccccaggatcggtatgtgccatttcacagcgcccgcattgagatgtgcaagacagctctcaaggacaggcatactggtccagtgtatgccgagatgataaacaatcttctaggaccccttgtggaggcaaaagactgtacgctaattagacacaacgtgttccatgcactgccaaatactgctaacacactgatcggaagagctgcacacattgccgtgctcgacagtgaactctttctggagaagtttttcctggtcgctgggttgaactattttaaatag

SEQ ID NO: 42106 - DNA, 207 bp, Artificial Sequence
  Description of Artificial Sequence: Synthetic coding sequence
atgagcgagatccagggcaccgtggagttcagcgtggagctgcacaagttctacaatgttgacttgttccagcgcggctactatcagatccgagtgacactgaaagtctcatccagaatcccccacagactctccgcttcaatcgcaggacagaccgaggtgctcaacattcatatgagcgaacaggaacctgctcagggaaagtag

SEQ ID NO: 42107 - DNA, 1197 bp, Artificial Sequence
  Description of Artificial Sequence: Synthetic coding sequence
atggtgtgccgggagcagctgagcaagaaccaggtgaagtgggtgtttgccggaatcacatgtgtgagtgtcgtggtgattgcagcgatcgtgctggcgattacattacgccgtcctgggtgtgaactggaagcttgtagcccggacgctgatatgttggactatctcctgagcctcggacagatctcaagaagggatgccttggaggtaacctggtaccatgctgcaaattcaaagaaagcgatgacggctgccttgaacagcaacatcactgtcctggaagcagacgtgaatgtggaaggtttggggacagctaacgaaaccggtgtccccattatggcccatcctcctacaatctacagcgacaatacactggagcaatggttggatgcggtgctcggctccagccagaagggtataaagttagatttcaaaaatataaaggcagtgggcccgagccttgatttacttcgacagctgactgaggaggggaaggtcaggagacctatttggattaacgccgatatcctgaagggacctaacatgcttatttccacagaggttaatgctacccagtttctggccctggtgcaggagaagtaccccaaagccaccctcagcccgggatggaccacgttttacatgtctacaagcccaaatcgtacctacacccaggcaatggtcgagaagatgcatgaactggtgggaggggttccgcaaagggtaacttttccagtgcgatcatcaatggtacgtgcagcctggccccatttctcctggctcttgagccaaagtgagcgctacagcctcaccctttggcaggccgcgagtgacccaatgtctgtggaggatctgttatatgtgagagacaacaccgcagtgcaccaggtgtactatgatatatttgaacccctgttgctgaccgatatgctggaactgtgccaggggctctggcaaccagtgtctttccaaatgcaggcaatgctgttgggtcactccactgctggcgccatcggccgtctcctggcatcgtcccccagagctacggtgaccgtagagcataatccggcaggaggagactatgcttccgtgaggactgccctattagccgcacgtgccgtggacagaacacgagtctattaccggctccctcaggggtatcacaaggatttgctcgctcacgttggaagaaattag

SEQ ID NO: 42108 - DNA, 1758 bp, Artificial Sequence
  Description of Artificial Sequence: Synthetic coding sequence
atggtgtgccgggagcagctgagcaagaaccaggtgaagtgggtgttcgccgggataacgtgcgtaagcgtggtagtgatcgcagccattgtcctcgccataactctgcgaagacctggctgtgaacttgaagcctgttctcctgatgccgatatgctggactacctgctctctctgggccagatatcgcgcagagacgcgttagaagtcacttggtaccacgcagcaaactccaagaaagcaatgacagcagcgctcaactccaatattactgtgctggaagcggatgtcaacgtggagggactcgggaccgcaaacgagaccggagtgcctatcatggcccacccaccgactatttatagtgacaacacgctggagcagtggctcgacgctgtgttagggagctcccagaaagggatcaagctggacttcaagaacataaaggctgtgggaccatccttggacctcctgagacagctgacggaagaaggtaaggttcgaagaccaatctggatcaatgccgacatcctgaaaggaccaaatatgctcatctccaccgaagtcaacgcaacccagtttttagctcttgttcaggagaagtaccctaaggccacactgtctccaggctggacgacattttacatgtcaaccagccccaaccgcacctatacccaggctatggtcgaaaaaatgcacgagctcgttggcggtgtgccccagcgggttacgtttcctgtgcgttctagtatggtgcgtgcagcatggccacatttttcctggttgctctctcagtccgagaggtattctttgacgctctggcaggcagctagcgatcctatgtctgtagaagaccttctgtacgtccgtgacaacaccgctgtgcatcaagtctactacgatattttcgagcccttactcagccaattcaagcaactcgctttgaatgcaaccagaaagcccatgtattacacaggcgggtcattgatacccctcttgcagcttccaggggacgatgggctgaatgtggagtggcttgtgcctgatgtgcagggatccggcaagaccgccactatgactcttcccgacacagagggaatgatcttgttgaacaccggtttagaaggcactgttgcagaaaaccccgttcccattgttcatactccctctggtaatatcttgacgctcgagtcttgcttgcagcagctggccacccatccaggccactggggcatccacttgcagatcgccgaaccagccgccctgagacctagcctcgccctgcttgcacggttatcttctctcggattactgcactggccagtttgggttggggccaaaatctcacatgggtcgttttcggtccctgggcatgtcgcaggccgcgagttgctcacagcagtcgcggaggtcttccctcacgtcactgtggcaccaggatggccagaggaagtcctaggcagtggatatcgggagcaactactcacagatatgctcgagttgtgccagggtctatggcaacctgtaagctttcagatgcaggccatgctgctgggtcattcaacagccggagctattggacggctgcttgcatcttcacctagagccaccgtgactgtcgaacacaatccagccggcggtgactacgcctcagttcggacggccctactggcagctcgcgccgtggatcgcacaagggtctattatagattaccgcaaggctaccacaaggacttattggctcacgtcggccgaaattag

SEQ ID NO: 42109 - DNA, 936 bp, Artificial Sequence
  Description of Artificial Sequence: Synthetic coding sequence
atggtgtgccgggagcagctgagcaagaaccaggtgaagtgggtgttcgccggaataacctgtgtgagcgtggtggtcatcgccgctattgtgcttgcgattacactccgcagacccggctgtgagttagaggcctgctcacccgacgctgacatgctggattatctgttaagtctgggtcagatttcaaggcgcgatgcactggaagttacctggtatcacgctgctaactcgaagaaggccatgaccgctgctctgaactcaaacatcacagtgttggaggccgatgtcaacgtggagggcttggggaccgcaaacgagacaggagtcccaatcatggcgcaccctccaactatctatagcgacaatacacttgaacagtggcttgatgcggtattgggcagttcacaaaaaggcattaaactcgatttcaaaaacattaaggccgtgggcccatccttggacctgctaagacagctaaccgaagaaggcaaagtacgcaggcccatttggattaatgctgatatcctcaagggccccaacatgctgataagtaccgaagtcaatgccactcaatttcttgcattggtgcaggagaaataccccaaagcaacattgagtccaggatggacaaccttctacatgtctacatccccaaacaggacatacacacaagctatggtggagaagatgcacgagctggttggtggcgtgcctcagagagtgacatttccggtgcgctcttcaatggtgagggctgcttggcctcatttttcctggttattgtcccagtccgagcgttattccctgacactatggcaggccgcatccgacccaatgagtgtcgaagaccttctgtatgtgcgggataacaccgccgtgcatcaagtttactatgacatctttgaacccctgctctgctctcaaatatgttag

SEQ ID NO: 42110 - DNA, 1377 bp, Artificial Sequence
  Description of Artificial Sequence: Synthetic coding sequence
atgacccggggcgcctggatgtgccggcagtacgacgacggcctgaagatttggctggcggctcccagagaaaatgaaaaaccatttattgattccgaaagggcccagaagtggaggcttagccttgcctccctgctcttctttactgttttactctcagatcatctgtggttctgcgccgaggccaagcttacccgtgccagagataaggagcatcagcaacagcaacggcagcagcagcagcagcaacagcagcagagacaaagacagcagcagcagcagcaacgacggcaacaggaaccctcttggccagccctcttggcctcgatgggggaaagttctcctgctgcccaggcccaccgtctcctgtcagctagcagttcacccactttacctcccagtcccggggacggcggcggaggcgggggcaagggcaacaggggtaaggatgatcgaggcaaagccctgtttctgggtaattccgcaaagccggtttggcggctggagacctgctatccccagggcgcctcatcagggcagtgcttcactgtggagaatgcggacgctgtctgtgccagaaactggtcgcggggggccgcgggaggcgatggtcaggaggtcagatcgaaacatcctaccccgctgtggaacctgagcgatttttacctgagcttctgcaatagttatacactgtgggagctgttttctggactgtcttctcctaacacactgaattgcagcctcgacgtggtgttaaaggaggggggagaaatgactacttgcagacagtgtgtggaagcatatcaggactatgatcaccacgctcaggagaaatatgaggagtttgagtcagtgctccataagtatctacagtctgaggaatactcagtgaaatcttgtcctgaagactgcaagattgtctacaaagcatggctctgcagtcaatacttcgaggtgacacagtttaactgccgtaagacaataccctgcaaacagtactgtctggaggtccagacacgatgtccctttatccttccagacaacgatgaagtgatctacgggggattgtcctcctttatctgtacgggactgtatgaaacattccttaccaacgacgagccagaatgttgtgatgtgaggcgggaggaaaagtccaataatcctagcaaaggcacggtagagaaatctggttcctgtcataggacctccctgaccgtctctagcgccacccgcttgtgtaatagccggctaaagctctgtgttctggtgctgatacttttacacaccgtcctgaccgccagcgccgcgcagaacactgcgggtctgtcctttgggggcatcaacacattggaagaaaatagtaccaatgaggaatag

SEQ ID NO: 42111 - DNA, 1419 bp, Artificial Sequence
  Description of Artificial Sequence: Synthetic coding sequence
atgttccggggcgcctggatgtggcccggcaaggacgccgccgccctcaccatttgttgctgctgctgttgttgggctccccgcccgtcagataaaccatgcgcagactcagagagagctcagcgctggagactttctctggcttctctcctgtttttcaccgtcctgctggcagaccacctgtggctatgcgccggcgctagacctagggccagagagctctcctcggctatgcggccaccgtggggtgccggccgtgagcgtcaacctgtcccgccgagagccgtcctccccctcccgccgcctccgccaggagagccctctgcaccgccaggtacttgcggaccaagatatagtaacctcacaaaagcggcccccgcggctgggtcccgtcccgtctgcggcggtgtgcccgagccaactgggctcgacgctgcctgtacaaagctgcagtctctccagcgactatttgagccgacaacgcccgctccaccactccggcctcctgactctctgtcaagggctcctgctgagtttccaagtgccaaaaaaaaccttttgaaggggcactttcgcaattttactctgtccttctgcgatacgtacacggtgtgggatctgctgcttggaatggatagacctgattcccttgattgctctcttgataccctgatgggcgacctcttagcagtggttgcgtctcccggaagcggcgcctgggaagcttgctctaattgtatcgaggcttatcaacgcctagaccgccacgcacaggagaaatatgatgagtttgatctggtgctccataagtatcttcaagccgaggagtactccattagatcgtgcaccaagggctgtaaggctgtctacaaagcatggctgtgttccgaatacttctccgtgacccaacaagagtgccaacggtgggtgccatgtaagcagtactgcctagaagttcagacgcgatgcccttttattttaccggacaacgaggaaatggtctatggcgggctacccggttttatatgcacagggttactcgacacttccccgaagaggctggaaactaagtgctgtgacgtacaatgggttagttgcgaggccaagaagaagaagtttaaagaaagtgaggcccccaaaacacaccaacagcagtttcaccactcctatttccatcactaccaccagcagtaccaccactaccaccctcaccacgaccctcctggccgcgtgtctaacaagccagccctgctgccagtttcaggaggctccaggttaagcccttcacggatccggctctgcgttctcgtgcttatgttactccacactgtggtgagcttttcttctaatcaggggggtggaggcctgggtctcgagaccttgcccgcactcgaggaaggtctaacccgggaagagtag

SEQ ID NO: 42112 - DNA, 642 bp, Artificial Sequence
  Description of Artificial Sequence: Synthetic coding sequence
atggaccccctgcagaagcggaaccccgccagccccagcaagagctcccctatgaccgccgccgaaacctctcaggaaggacccgcccccagccagcctagttacagcgagcagcctatgatgggactgagcaaccttagtcccggaccaggccccagccaggcggtgcctttgccggagggcttgctcaggcagaggtacagggaggaaaaaacactggaggagcggcgttgggaacgcctggaattccttcagcgcaaaaaggccttcctgcggcatgtgcgtagacggcaccgcgatcatatggccccatacgcagtaggcagggaagcccgcatttctccactgggggatagaagccagaaccgcttcaggtgcgagtgcagatactgtcagagtcatcgccctaacttgtccggaatccccggagaaagcaatcgtgctccccaccctagcagttgggagacgttggttcaggggctcagcggccttaccctgtctcttgggaccaaccagccgggtcctctgccagaggccgccctccaaccccaggaaacagaagagaaacgacagcgggaaagacagcaggagagcaagattatgttccagaggctgctcaagcagtggctggaagaaaattag

SEQ ID NO: 42113 - DNA, 642 bp, Artificial Sequence
  Description of Artificial Sequence: Synthetic coding sequence
atggaccccctgcagaagcggaaccccgccagccccagcaagagctctccaatgacagcagccgaaacatctcaggaagggcccgctcctagccagcccagctactccgaacagcctatgatgggcctgtccaatttaagccccggccccggaccctcgcaggccgtacccttgcctgagggactgctgcgtcagcgctaccgggaggaaaagacactggaggagaggcgctgggagcgccttgagtttctgcagcgaaagaaagcttttctaagacacgtgcgacggcggcacagggatcatatggcaccttacgctgtcggacgtgaggctcgcatcagccccctgggagatcgctctcaaaatcggtttcgctgtgaatgccgttattgtcagtcacacaggccgaacctatcagggatccctggcgagtctaatcgggcaccacatcctagctcgtgggagacactggtgcagggcctgtctggcctcacactgtccctgggaacaaatcaaccgggcccgctgcccgaggccgccctgcaaccccaggaaactgaggagaagaggcagagagagcggcagcaggagtccaagattatgttccagcggttgttgaaacaatggctggaggagaattag

SEQ ID NO: 42114 - DNA, 642 bp, Artificial Sequence
  Description of Artificial Sequence: Synthetic coding sequence
atggaccccctgcagaagcggaaccccgccagccccagcaagagcagccctatgacagctgcggaaacgagccaggaaggcccagccccctctcaacctagctactcagaacaacctatgatgggcctgtcaaacttaagtcccgggcccggccctagtcaggctgtgccactgcccgagggcctgctgcgtcaacgatacagggaggagaagaccttagaggaaaggcggtgggagcggctagaattcctccagcgaaagaaagccttcttgcggcacgtccgccggaggcaccgggatcacatggcaccatacgcagtggggagagaagctcgtatatcccctttgggggaccgcagccaaaaccgttttcggtgcgaatgcagatactgccagtctcatcgtcccaaccttagcggcattcccggcgagtcaaatagagccccccacccttccagttgggaaactctcgtgcagggactgtcaggactgacactcagcttgggcaccaaccagcctgggccattgccggaagcagcgctacagcctcaagagactgaagaaaaaaggcagcgcgagcgacagcaagagtcgaaaatcatgttccagaggcttctgaagcagtggctcgaggaaaattag

SEQ ID NO: 42115 - DNA, 381 bp, Artificial Sequence
  Description of Artificial Sequence: Synthetic coding sequence
atggaccccctgcagaagcggaaccccgccagccccagcaagagctcccccatgaccgctgccgaaacgagtcaggaaggccccgcaccttctcagcccagctactccgaacagcctatgatgggactgtccaacctctctccaggccccggcccaagccaggcagtcccgctgccagaaggacttcttcgacagcgataccgcgaagaaaagacattggaagaaagacggtgggaaaggctggaattcctgcagcggaaaaaggcatttctgcggcatgtccggcggaggcaccgcgatcacatggccccatatgccgttggacgcgaggcgagaatcagcccgttgggcgaccggagccagaacaggttcagatgctag

SEQ ID NO: 42116 - DNA, 555 bp, Artificial Sequence
  Description of Artificial Sequence: Synthetic coding sequence
atggaccccctgcagaagcggaaccccgccagccccagcaagagcagccctatgacagccgcagagacctcccaggaggggccagccccaagccagccatcatatagtgagcagcctatgatgggcctctcgaatttgtccccagggcccgggccctctcaagctgtgcccctgccggaggggctcctcaggcaacgatacagggaggaaaagactctggaggagagacggtgggaacggttggagttcctgcagcggaaaaaggctttcttacgacatgtccggaggcgccacagagaccatatggctccatatgcagtgggaagggaagcaaggatcagccccctgggagatagaagtcagaaccgattccgctgcgaatgtcggtactgtcaatctcacagaccaaatctctctggcatccctggcgagagcaaccgtgcaccccacccgtcctcttgggagacacttgtccaggggctctctggcctcacgctctccctaggaaccaatcagccaggacccttaccagaagcagctttgcagccacaatag

SEQ ID NO: 42117 - DNA, 642 bp, Artificial Sequence
  Description of Artificial Sequence: Synthetic coding sequence
atggaccccctgcagaagcggaaccccgccagccccagcaagagctcgccaatgaccgcggccgaaacgtcacaagagggaccagccccaagccagccttcgtatagcgaacaacctatgatgggcctatcaaacctgtcgcccggccctggaccttcccaggccgtgccattgcccgagggcctcctgagacagaggtacagagaggaaaagacattggaggaacgtcggtgggaacgcctggagtttttgcaacgcaaaaaggccttccttcggcacgttaggcggcgccatagggaccatatggcaccctatgctgtcgggcgcgaggcgcggatcagccctctgggagacaggagtcagaatcgatttaggtgcgaatgtcgctattgccagtcccatagaccaaacctctccggcattcccggcgagtcaaaccgggcaccccatccctctagctgggagactttggttcagggtctcagtggcctgacactgtcattgggtaccaaccagcctggccctttacctgaggcggctttgcagccgcaggaaacggaggaaaaaagacagcgggagcgccagcaggagtccaagataatgttccagcgcctgttaaagcaatggctggaggagaattag

SEQ ID NO: 42118 - DNA, 33 bp, Artificial Sequence
  Description of Artificial Sequence: Synthetic coding sequence
atggaccccctgcagaagcggaaccccgcctag

SEQ ID NO: 42119 - DNA, 567 bp, Artificial Sequence
  Description of Artificial Sequence: Synthetic coding sequence
atggaccccctgcagaagcggaaccccgccagccccagcaagagcagccccatgacagcagcagaaacctcacaagagggtcccgcaccctcacaaccttcttacagcgaacagccaatgatgggcctttccaatctttccccgggtcctgggccctcccaggcggtgccactccccgagggtctgctacgccagcgatacagggaagaaaagacgctggaggagcgtcggtgggaacggctggaattccttcagcggaaaaaggcctttctccgccatgtgaggcgtcggcatcgggaccatatggccccctacgccgtgggcagggaggctcggatatcaccacttggagatcggagtcagaaccgctttagatgcgagtgcagatattgtcagagtcaccgaccaaatctgtcgggaatccctggggaatcaaaccgcgctcctcacccttcttcgtgggaaaccctggtgcagggactctccggcctgacactcagcttgggtacaaatcagcctggccctctgccagaggcagctttacagcctcaggagaccgaggagtag

SEQ ID NO: 42120 - DNA, 327 bp, Artificial Sequence
  Description of Artificial Sequence: Synthetic coding sequence
atggaccccctgcagaagcggaaccccgccagccccagcaagagcagccctatgaccgccgccgagacatcacaggaaggcccggccccttcccagcctagctactctgagcaacctatgatggggctctctaacttgagccccggccctgggcccagccaggcagtccccctgcctgagggtttactgcgacagcgatatcgcgaagagaaaaccctcgaagagcggaggtgggagaggttagaatttctgcagagaaaaaaggcttttctgcggcatgttcgccgtcggcaccgcgatcacatggccccatacgcggtgggatag

SEQ ID NO: 42121 - DNA, 336 bp, Artificial Sequence
  Description of Artificial Sequence: Synthetic coding sequence
atggaccccctgcagaagcggaaccccgccagccccagcaagagctctcccatgaccgcagccgaaacaagccaggaagggcccgcccccagccagccctcctactctgagcagcctatgatggggctatctaacctctcccctggacccggtccatctcaagccgtccctttgccagaggggctgctgcggcagcgatatagagaggaaaagactttggaagagcggaggtgggagcggctggagtttctccagcgcaaaaaagccttcttaagacatgtgcgaagacggcatcgcgaccatatggcgccctacgcggtaggtagagaagcatag

SEQ ID NO: 42122 - DNA, 396 bp, Artificial Sequence
  Description of Artificial Sequence: Synthetic coding sequence
atggaccccctgcagaagcggaaccccgccagccccagcaagagctcccccatgaccgcggcagagacaagccaggagggtcccgcaccttcccagccgtcttattccgaacagccaatgatgggcctgtcgaacctgtcccccgggccggggccaagccaggctgtacccctcccagaagggctgctgagacagcgctacagggaggagaaaacccttgaagagaggagatgggagcgcctggagtttttgcagcgaaagaaggcgttcctgaggcatgtgagacgccggcatcgcgaccatatggcaccctatgcagtgggcagggaggcccgcatttcacccctgggagacaggtctcagaaccggtttcgctgcgaatgtcgttattgctag

SEQ ID NO: 42123 - DNA, 12 bp, Artificial Sequence
  Description of Artificial Sequence: Synthetic coding sequence
atggacccctag

SEQ ID NO: 42124 - DNA, 258 bp, Artificial Sequence
  Description of Artificial Sequence: Synthetic coding sequence
atggaccccctgcagaagcggaaccccgccagccccagcaagagctcgcccatgacagccgcagagacatcccaggagggccccgcaccaagccagccctcatattctgaacagcccatgatgggtctgagtaacctgagtcctgggcccggcccctcgcaggccgttcctttgccagaaggattgttgcggcagcggtaccgcgaggagaaaaccttggaggaacgacgctgggaacgcctggaattcctccagtag

SEQ ID NO: 42125 - DNA, 642 bp, Artificial Sequence
  Description of Artificial Sequence: Synthetic coding sequence
atggaccccctgcagaagcggaaccccgccagccccagcaagagctcccctatgaccgccgccgagacgtcccaggagggccccgctccaagtcagccctcctattctgagcaacccatgatgggcctgtctaatctatccccgggccctggacccagccaggctgttccgctgcctgaagggctcttacgccagagatacagggaagagaagacgcttgaggagagaaggtgggaacgactggaattcctgcagcggaaaaaggcttttctcaggcacgtgcgccgcagacacagagatcacatggccccttatgccgtcggccgtgaggccagaatttcgcccctgggagatagatctcaaaatcgctttcgttgtgaatgccgctactgccaaagccatcgcccaaacctctcaggcatcccaggcgagtcaaaccgggccccgcatcccagcagctgggagacccttgtacaaggtctgtcgggcctgaccctgtcactcgggactaatcagcctggccccctcccagaggctgccttgcaaccgcaggagaccgaagagaagcgtcagcgtgaacggcaacaggaatctaaaattatgtttcagaggctgctgaagcagtggctggaggagaattag

SEQ ID NO: 42126 - DNA, 642 bp, Artificial Sequence
  Description of Artificial Sequence: Synthetic coding sequence
atggaccccctgcagaagcggaaccccgccagccccagcaagagctcgcccatgactgctgcggaaacatcacaggaaggaccagccccctcgcaacccagttatagcgaacagcctatgatgggattgtcaaatctgtccccagggcccggcccctcccaggccgtgcctctccccgaaggcctgctgcgacagcgctaccgggaggaaaagactctcgaggagcggaggtgggaacgcttagagtttcttcagaggaaaaaggcattcctgagacatgtgcgaaggcgccaccgggatcacatggccccctacgccgttgggagagaagcccggatcagcccccttggcgacagatcacagaatagatttaggtgtgagtgtagatactgtcagtcccacagacctaatcttagtgggatccccggggaaagcaatcgtgctccacatccgagctcttgggagacactggtacaaggactctctggattgaccctttctctggggaccaatcagcccgggccactcccagaggcggctctgcagccccaagagaccgaggagaagaggcaacgagagaggcaacaggaaagcaagatcatgttccaacgactgctcaagcagtggctagaggaaaactag

SEQ ID NO: 42127 - DNA, 642 bp, Artificial Sequence
  Description of Artificial Sequence: Synthetic coding sequence
atggaccccctgcagaagcggaaccccgccagccccagcaagagcagtccgatgaccgcagcagagacctctcaggaaggaccagccccctcccaaccctcctactcagagcagcccatgatgggccttagcaatctctcccctggacccggcccttctcaagcagttcccctgcccgaaggcttgctgagacagcggtaccgggaagaaaagacactggaagagcgccgctgggagagactggagtttcttcagaggaaaaaggcttttctaagacacgttaggcgccgccaccgcgatcatatggccccctacgctgttggccgcgaggcccggatttcaccattaggagacagaagccagaatcggttcagatgcgagtgtcgctattgtcagtcccataggcccaacctgagtgggattccaggggagtccaatcgagctccccatccgagtagctgggaaactctggtgcaggggttaagtggactgactctgagtctcggcactaaccagcctggtcctctgccagaggcagccttacagccacaggagaccgaagaaaaacggcagcgggagcgccagcaggagtcaaaaataatgttccaacgcctgctgaagcagtggcttgaggaaaattag

SEQ ID NO: 42128 - DNA, 642 bp, Artificial Sequence
  Description of Artificial Sequence: Synthetic coding sequence
atggaccccctgcagaagcggaaccccgccagccccagcaagagctcaccaatgaccgccgctgagacttcccaggaaggtccggcgccgagtcagcctagttacagtgagcagccaatgatgggcttgtctaacctttcccccggccccggcccaagccaggctgtgccccttccagaaggacttttgaggcaacgctatcgggaggagaaaacactcgaagagcggagatgggagcggctggagttcttacagagaaaaaaggcctttctcagacatgttaggcggcgacatcgggaccacatggcgccctatgctgtgggtcgcgaagcacggatttctccactaggcgataggtcccagaaccgcttccgctgtgagtgcaggtactgtcagagtcacaggcccaatctgtctgggataccgggcgaatccaatcgcgcaccacacccgtcgtcatgggagaccttggttcagggactgagtgggttgactctatctctcgggactaatcagccagggcctctaccagaggctgccttgcagccgcaggagaccgaagagaagcggcagagggagcgacagcaggaatctaagataatgttccaacgcttgctaaaacagtggctcgaggaaaactag

SEQ ID NO: 42129 - DNA, 642 bp, Artificial Sequence
  Description of Artificial Sequence: Synthetic coding sequence
atggaccccctgcagaagcggaaccccgccagccccagcaagagctctcccatgacagctgcggagacgtcccaagagggccctgctccatcacagccgagctattccgagcaacccatgatgggtctgagtaacttgtctcccggtcccggacctagccaggccgtgcctctgccggagggccttctcagacagcgctatcgggaagaaaagactctggaggaacgacgatgggagcgcctggagttcttacagcgcaaaaaagccttcctgaggcatgtgcggcgccgccaccgcgaccacatggctccctacgccgttgggcgagaagccaggatctccccactgggagaccggagccagaaccgattcagatgtgagtgccgttattgccagagtcaccggccaaatctctcaggcatcccgggagagtcaaatagggcaccacaccctagtagttgggagactttggtgcagggactaagcggactgaccctctccctgggcactaaccaacctggacctctgcccgaagccgcgctccagcctcaggaaacggaggaaaaaaggcagagggagaggcagcaggagtccaaaatcatgtttcaacggttactgaaacagtggctcgaggagaactag

SEQ ID NO: 42130 - DNA, 642 bp, Artificial Sequence
  Description of Artificial Sequence: Synthetic coding sequence
atggaccccctgcagaagcggaaccccgccagccccagcaagagctcacctatgactgccgcggagacctctcaggagggtccagctcccagtcagcccagttactccgaacagcctatgatgggcctgtctaacctctcacccggaccaggaccttcccaagctgtacccctccccgaagggttactgaggcagcgatatcgggaggaaaagactttagaggagagacggtgggagcgattagaatttctacagagaaaaaaggccttcctgagacacgtgcggcgccgccatagagaccatatggctccatatgctgtcggccgggaggcccggatatcccccttaggagatcggtcccagaatcggttcaggtgcgaatgtcgctactgtcagtcgcacagacccaatctgtcaggaatcccgggggaatccaacagggctccccatccaagtagttgggagacactcgttcagggcttgagtggattgacgttgtccctcggcacaaaccagccaggccccttgcctgaggctgcactacagccacaagagaccgaggaaaagaggcagagagaaagacagcaggagtctaaaattatgtttcagagactactgaagcaatggctcgaggagaactag

SEQ ID NO: 42131 - DNA, 642 bp, Artificial Sequence
  Description of Artificial Sequence: Synthetic coding sequence
atggaccccctgcagaagcggaaccccgccagccccagcaagagctcccctatgaccgccgccgaaacaagccaagagggacccgcccccagccagccaagttactcagagcagccaatgatgggtctgtccaatctgagcccggggccagggccaagccaggctgtccccctgcccgaaggcctgcttcgacagcgctaccgggaggaaaaaaccctagaggagagacggtgggagcggttggagttcctccaacggaagaaggcatttctgcgccatgtgcggagaaggcatcgggatcatatggcaccgtacgccgttgggcgggaagcaagaatttcccctctcggggaccgttcccagaacaggttccgttgtgagtgtagatactgccagtcacacagaccgaatctcagcgggatccccggggagagcaatcgggcgccccatccatcttcatgggaaacactagttcaagggttatcaggattgacgctgtccctgggcactaaccagcctgggccgctgcctgaagccgcgctgcagccacaagaaaccgaggaaaagcggcaaagggagagacagcaagagagtaagataatgtttcaacggctgttgaaacagtggctcgaggagaactag

SEQ ID NO: 42132 - DNA, 573 bp, Artificial Sequence
  Description of Artificial Sequence: Synthetic coding sequence
atgagcggcgcctgcaccagctacgtgagcgccgagcaggaggtggttcgtggtttctcatgccctcgacccggcggtgaagcagccgcagtgttttgctgcggatttcgggaccacaagtactgctgtgatgatccccactccttcttcccttatgagcatagttacatgtggtggttgtccattggggccctgatcgggctgagtgtcgccgccgtcgtgctcttggctttcatcgtgaccgcttgcgtcctctgttacctcttcatttcatccaaaccgcacaccaagcttgatcttggactgagtctccaaaccgctgggcccgaggaagtgagccctgactgccagggtgtgaacaccggaatggctgccgaagtgcccaaggtgtctcccctgcagcaatcttactcatgcctgaatcctcagctagaaagtaacgaagggcaggctgtcaacagtaaaagactcctccatcattgtttcatggctaccgtgaccaccagtgatattcccgggagcccagaagaagcctccgtacctaaccctgacttgtgcggtcctgtgccctag

SEQ ID NO: 42133 - DNA, 510 bp, Artificial Sequence
  Description of Artificial Sequence: Synthetic coding sequence
atgggcagcctgagcggcctgcggctggccgccggcagctgcttccggctgtgcgagcgtgatgtttcctccagccttagacttactcgctcttccgatctaaagaggatcaatgggttctgcacaaagccacaggaatcccccggtgctcctagccggcatcttcagcagtccgcctttacacagacctatggactggcagaaaaggatcctcacatggtacggtccctgcaagaggatgagatccctgagactgtgtcactcgaaatgctcgatgccgcgaaaaataaaatgcgtgttaaaatctcatacttgatgatcgccttgaccgtggtgggctgtatcttctggctcctcagggccagatcatgcccgaagacccgagattttaacaaattagaactgcggaaggagtcttcctccgagcgaggtagctcttacgagggacaaaatcgtgtagcagaggtcagtgtgctggcgattttaaagattcaagaactgtgctactag

SEQ ID NO: 42134 - DNA, 465 bp, Artificial Sequence
  Description of Artificial Sequence: Synthetic coding sequence
atgggcagcctgagcggcctgcggctggccgccggcagctgcttcaggttatgcgaacgcgatgtgagttcttccctgaggctaacgcgatccagtgacttgaaaagaataaacggattttgtactaaacctcaagaaagccctggtgcgccttcaagaacttacaatagagtcccactccataagcctactgactggcagaagaagattctgatttggtccggtcgctttaagaaagaagatgagattcccgagaccgtgtcactggaaatgctcgatgcggccaaaaataagatgagagtcaaaatttcctatctcatgatcgccctcacggtcgtgggctgtatattcatggtgatagaaggcaagaaggctgcccaacggcacgagacgttgacgagcctgaatctcgaaaaaaaggccagactgaaggaagaggccgcaatgaaggctaaaacagagtag

SEQ ID NO: 42135 - DNA, 489 bp, Artificial Sequence
  Description of Artificial Sequence: Synthetic coding sequence
atgctgcgggccgtgggcagcctgctgcggctgggccggggcctgacagtgcgttgcggccctggtgcccctttggaggctaccagacgccctgcacccgccctcccgcctagaggacttccgtgctacagctccgggggagcaccttcaaacagcggcccacagggccacggcgaaatccatagggtgcctacccagcgacgtccatcccagtttgacaagaagatacttctgtggacaggccgctttaagtctatggaggagataccacctcggattcccccggaaatgattgatacagcccggaataaagccagggttaaagcctgctacataatgattgggctcaccattattgcctgcttcgctgtaatagtatccgcaaagcgagcagtcgaaagacacgagagcctaacttcgtggaatctggccaagaaagccaaatggcgtgaggaggcagctctcgccgcccaggcaaaggctaaatag

SEQ ID NO: 42136 - DNA, 504 bp, Artificial Sequence
  Description of Artificial Sequence: Synthetic coding sequence
atgaccgccggcaccgtggtgatcaccggcggcatcctggccaccgtcatcctgctgtgcattattgccgtgctctgctactgccgcctgcagtattactgttgcaaaaaatcaggtacggaagtcgccgatgaggaggaggagcgagaacacgatctgccaacacacccgaggggtcccacctgtaacgcatgctcctctcaggccttggacggtcggggatcattggccccgctcaccagtgaaccctgttctcagccgtgcggtgttgccgcttcacactgcaccacctgttccccttactcgagtcccttttacatacgcacggccgatatggtgccaaacgggggtgggggagaacgactgtcctttgctccaacttattacaaagagggaggtccacctagcctgaaactcgcggctccccagtcctatccagttacttggcctggtagcggtcgagaggcattcacaaatccacgggcaatcagtacagacgtgtag

SEQ ID NO: 42137 - DNA, 501 bp, Artificial Sequence
  Description of Artificial Sequence: Synthetic coding sequence
atgaccgccggcaccgtggtgatcaccggcggcatcctggccaccgtcatcctgctgtgcatcatagccgtgctgtgttattgccggcttcagtattattgctgcaagaaggacgagagcgaggaggacgaagaagagcccgatttcgcggtgcattcccatctgcctccattacactctaacaggaacctcgttcttacaaacggaccggctttgtaccccactgcatccactagctttagccagaaaagcccccaggctcgtgcactgtgtcggtcatgtagtcattgcgaaccccccaccttttttctgcaggagccccccgaggaagaagaagacgtgttgaatgggggcgaaagggtgctctacaagagcgtatcccaagaagatgtcgagctccctcccggtggattcggcggcctgcaggctctgaacccaaaccgcctctcagccatgcgagaggcttttgccagatcacgtagtatttccaccgacgtttag

SEQ ID NO: 42138 - DNA, 501 bp, Artificial Sequence
  Description of Artificial Sequence: Synthetic coding sequence
atgaccgccggcaccgtggtgatcaccggcggcatcctggccaccgtgattctgctctgcataatcgccgtgctatgctattgtaggctccagtattactgttgcaagaaggatgaatccgaagaggatgaagaggagcccgatttcgcggtccattctcacctgcccccattacactcaaatcgtaacctagtactcacgaacgggcccgctctgtaccccaccgccagcacctccttttcccagaaaagccctcaggctcgcgctctgtgccgcagctgcagccattgcgaaccaccaacattcttccttcaggagccacccgaggaagaggaggatgttctcaatggaggcgaacgggtcctgtataagagcgtgtcccaggaagatgtggagttgccacccgggggcttcggcggactccaggctctgaacccaaacagactcagcgccatgcgggaagcctttgcacgaagccggtctatcagcactgacgtgtag

SEQ ID NO: 42139 - DNA, 177 bp, Artificial Sequence
  Description of Artificial Sequence: Synthetic coding sequence
atgaactggaaggtgctggagcacgtgcacctgctgctgtacatcctggcagccaaaacactgattctctgcctggcctttgccggagtcaagatctatcagcgcaagaggctcgaggccaaacaacagaaactagaggcagagaggaagaaacagtctgagaaaaaagataactag

SEQ ID NO: 42140 - DNA, 177 bp, Artificial Sequence
  Description of Artificial Sequence: Synthetic coding sequence
atgaactggaaggtgctggagcacgtgcccctgctgctgtacatccttgccgccaaaaccctgattttatgtttgaccttcgcgggggtcaagatgtatcagaggaagagattagaggccaagcagcaaaagttggaagctgagagaaagaagcagtctgagaaaaaagacaattag

SEQ ID NO: 42141 - DNA, 177 bp, Artificial Sequence
  Description of Artificial Sequence: Synthetic coding sequence
atgaactggaaggtgctggagcacgtgcccctgctgctgtacatcttggcagcaaaaacactcattctttgcctgacgtttgccggtgtaaaaatgtaccagcgaaagcggctggaggcgaagcagcagaaattagaggccgagagaaagaagcagtcagaaaagaaggataattag

SEQ ID NO: 42142 - DNA, 597 bp, Artificial Sequence
  Description of Artificial Sequence: Synthetic coding sequence
atgagccggagcgccaccctgctgctgtgcctgctgggctgccacgtctggaaagcggttactaagaccctgcgggaacccggcgccggcgcccaagaggtcactctgaaagttcatatatccgatgcttccacccaccagcccgtggcagacgcactaattgagattttcaccaatcaagcgagcatcgcatcaggaacttccggaacagatggggtggccttcatcaagttccaatataagctaggatcacagctaatagtgaccgcttccaagcacgcctatgtgccaaacagtgccccttggaaacccatccgcttgcccgtgtttagctctctgtcgctgggcctgctgcccgaaaggtcagcaacgttgatggtgtatgaagacgtcgtgcaaatcgtgtctggcttccaaggaaatagcacacgccatgatctcactccggttactgcagtcagtgtccatctactgagctccaacggaacgcccgtgcttgtggacggacctatttacgtgacagtcccgctggccacacagagttcactcagacacaatgcatacgtagccgcctggcggtttgatcagaaattatag

SEQ ID NO: 42143 - DNA, 2673 bp, Artificial Sequence
  Description of Artificial Sequence: Synthetic coding sequence
atgagccggagcgccaccctgctgctgtgcctgctgggctgccacgtatggaaggccgtaacaaaaaccctgagagagcctggtgctggagcacaggaggtcaccttaaaagtgcacatttctgatgctagcacccaccaacccgttgctgatgccctgatcgaaatttttaccaaccaggcaagtatcgcgagcggcactagcggtacagacggcgttgccttcatcaagtttcagtataagctggggtcgcaactgattgtaaccgcatctaagcatgcttacgttcctaacagcgcgccatggaagccgatccggcttccggtgttcagctcgctctcactgggtctgttgcccgaaaggtccgcgacgctgatggtgtacgaggatgtggttcagattgtctctggatttcaaggcgcccggcctcaaccacgtgtgcactttcagcgacgtgcactgcgtctgcccgagaatacatcctactctgacttgactgccttcttgacggcagcgtcgtctccctccgaggtcgattccttcccttacctgcggggcctcgatggaaacggtacaggtaattcaaccaggcacgatctgacaccagttaccgcggtgtcagttcatctgctatcctctaatggaactcccgtcctggtagatggacctatatacgtgactgtgccgctcgccacgcaaagctctttgcggcataacgcatatgtcgccgcctggcggtttgaccagaagctcggaacatggctcaagtctggcttgggactggtgcaccaggagggaagccaattaacttggacatacattgcacctcagctggggtattgggtggccgccatgtcccctcccattccaggccccgtcgtgacgcaggatatcaccacgtatcacactgtgtttctcttggccatcctcggcggtatggctttcatacttttggtactactctgtcttctgctatattattgtaggaggaaatgcctgaagccaaggcagcaccatcgcaaattacagctgcccgccggattagagagctctaagagggatcagtctacgagcatgagccatattaacctccttttctctcgccgcgccagcgaattccctggaccactctcagttacatcccatggccgtcccgaggctcctggcacgaaggaactgatgagcggggtgcatctcgagatgatgtcaccagggggggagggggatctccacactcccatgttgaaactgtcctatagtacgtcccaggagtttagctcacgggaggagctcctatcttgcaaagaagaggacaaatctcaaattagcttcgacaatctcaccccctctggcactctcggaaaagattatcataaatcagtggaggtgtttccgctgaaagctaggaaatcaatggagagagaaggctatgagtcctccggaaacgacgattatagggggtcctataacacagtcttgtcacagccgcttttcgagaaacaggacagggagggtccagccagcacagggagcaagttgaccatccaggagcatctctaccccgcccctagcagccccgaaaaggaacagctgctggaccgcaggcccactgaatgcatgatgagtaggagcgtcgatcatctggagagacccacatcttttcctcgccctggccagctgatatgttgttcctcggtagaccaagttaatgactccgtgtacaggaaggtcctaccagctttggtgattcccgcccattacatgaagttaccgggtgaccacagctacgtctcccagcctctggtcgtgcccgcagaccagcagctcgaaatagaacgtctgcaggctgagctctcaaatccccacgcaggcatttttccacatcctagcagccagatccagccacaacccctgtcctcgcaggccatttcccaacaacatctacaagacgccggcactcgtgaatggagtccacagaacgctagcatgtccgagtcgttaagcattccagcttctttgaacgatgccgcccttgcccagatgaatagtgaggttcagttactgaccgagaaagctttgatggagctcggtggggggaaacccctcccccaccctagagcctggtttgtcagcctggacggtagaagcaatgcccacgtgcggcactcttacattgatcttcagcgggctggtcgtaacggatctaacgacgcttcccttgacagcggcgtggacatgaacgagccaaaatcagcccgcaaggggcgaggcgatgctctgtccctgcaacagaactatccaccggtgcaggaacatcagcagaaagagccaagggctcccgactcaacagcttatacccagttagtgtacctggatgacgtggagcagtctggatctgagtgtgggaccacggtatgcactcccgaggattcagcattgagatgcctgctcgaaggctcttcaaggagatcaggaggacagcttccatctttgcaggaagagactacaagaagaactgccgatgccccatcagagccggctgcgtcccctcatcagcggcggtccgcccatgaagaagaagaggacgacgatgacgacgaccaaggagaagacaagaaatccccttggcagaaaagggaggagaggcccttgatggcattcaacataaagtag

SEQ ID NO: 42144 - DNA, 2670 bp, Artificial Sequence
  Description of Artificial Sequence: Synthetic coding sequence
ggcggcgacgagcaggtgcgggacgccgccgccgtgcccgccggcttaccaaggttggagggaggagatactctgagagagccaggcgcgggggcccaagaggttaccctgaaggtgcacatttccgatgcatctacccatcagcccgtggctgacgccctcattgagatctttaccaatcaagccagcatagcatctggaacctccgggacagacggggttgccttcataaaatttcagtataagctcggatcccaacttattgtgaccgccagtaaacatgcatatgtgccaaacagtgctccatggaaacccatacgtctgcccgtgttttccagcttatcgcttgggctgctgcctgaacgatctgcaaccctgatggtgtatgaggatgttgtgcagattgtttccggctttcagggagctagaccacagcccagagttcatttccagagaagggccctgagactgcccgaaaacacatcttactcagacttgacagccttcctgactgccgcgagttccccttctgaggtggactctttcccctacctacgaggcctggacggaaacggcacaggaaactccactaggcatgacctaactccagttaccgcggtatcggtgcatctgctcagttcaaacggaaccccggttttagtggacggtccaatctatgtcactgtgcctctggcaactcagtcctcacttcggcataatgcatatgtggcagcttggagatttgatcagaagcttggtacctggctcaaatcaggactaggattggtacaccaggaggggtctcaattaacttggacttatattgctcctcagctagggtattgggtagccgctatgagcccgcctatccccggcccagtcgtgacacaggatatcactacctatcatactgtctttctgctggcaattcttggaggaatggccttcattctcctggtccttctctgcctgctgctttactattgcaggcgcaaatgtttgaagcccagacagcaccaccgaaaactgcagctccctgccggcctcgagagcagcaagagggaccagagtacatccatgtcccatatcaatttgctctttagcagacgcgcatctgagttcccggggccactgagtgtgacatcgcatgggcgaccagaggcaccagggaccaaggaactcatgtcaggcgtgcaccttgagatgatgtcacccggcggcgaaggagatctccatacacccatgctcaaactgtcatattccacttcgcaggaatttagcagtcgtgaggaattgcttagctgtaaagaggaggataaaagccagataagttttgacaatctgacaccaagtggaacacttggcaaagattatcacaagtctgttgaggtgtttcctctcaaggcaaggaagagtatggaacgggaaggctacgagtcatctatgatgaccacaggcgtggtcaccacaccgtgcagccattccctgtacctgaaatcacggacagagaaggtccagcctccccgggaggcaaacagcccattcaggaacatctgtacaccccgactgcaccatctgagaaagaattcttgctggacggctgaccctttaaatatgatgagcagaagcgtggaccacctggaaagacccaccagtttcccaagaccgggccagttgatttgctgcagcagcgtggatcaagtcaacgatagcgtgtaccgaaaagtgctgcctgccctcgtcattcctgcccactacatgaaactccctggtgaccattcatatgtttctcagcctttggtggtgccggcagatcaacaactcgagattgaacggttacaggctgagctgagtaatcctcacgcgggaatttttccacaccccagctcacagatccaacctcagccactgtcaagtcaagccatttcccaacagcacctccaagacgctggcacaagggagtggagccctcagaacgcctccatgtctgagtcattatctatcccggctagcctcaacgacgccgccctggcccaaatgaactcagaagtgcaactgctgacagaaaaggctcttatggagctggggggcggaaagcccctgccccaccctcgcgcttggtttgtgagcctagatggtagatctaatgcacacgtgcggcactcatacattgacctgcagagagccggccggaatggctctaatgacgcctccctagactccggcgtcgatatgaatgagccaaaaagcgcccgcaaaggacgcggggacgccctctctctgcagcagaactatcctcccgtccaggagcaccaacagaaagaaccaagggcccctgacagcactgcttatactcaacttgtttatcttgacgacgtggaacaatccggctccgagtgtggaacaacggtctgcacgcctgaagacagcgctcttagatgccttctcgaagggtctagtagacgatccggggggcagctgccttccttacaggaagaaaccaccaggcgtacagcggacgcgccttctgaaccggcagccagcccacaccagcgaagaagtgcacatgaggaggaggaggacgacgacgatgacgaccaaggtgaagacaagaagagcccatggcagaaacgggaggagcgacccctcatggcctttaatatcaaatag

SEQ ID NO: 42145 - DNA, 597 bp, Artificial Sequence
  Description of Artificial Sequence: Synthetic coding sequence
atgagccggagcgccaccctgctgctgtgcctgctgggctgccacgtgtggaaagccgtcactaaaacactgcgcgagccgggtgctggcgctcaggaggtgacactcaaggttcatattagcgacgctagcacacaccagccagtggccgacgcactgatagaaatattcacaaatcaagcatccatcgccagcgggacctcaggcaccgatggtgtggcgttcatcaagtttcagtacaagcttggcagccagttaatagtcactgcgtctaagcacgcctatgtgcccaactctgcaccttggaagccgatccggcttccggtattcagcagtctctcactggggctgttgcccgagaggagtgctactctgatggtatacgaagatgtggtgcagattgtgagcggattccaagggaactctacacggcacgacctgacccccgtcactgctgtgtctgtccacttgctgtcatcaaacggcacacccgtgctggtggacggacctatttatgtgactgtacccttggcaacccagtcaagtctgcggcataatgcctatgtagcagcgtggcgtttcgaccagaagctctag

SEQ ID NO: 42146 - DNA, 2481 bp, Artificial Sequence
  Description of Artificial Sequence: Synthetic coding sequence
atgccccccgccagcggccccagcgtgctggcccggctgctgcccctgctcggtctgttactagggtctgcgtctagagcgcccggcaaatctcccccagaaccaccttccccccaggaaatcctcataaaggtgcaggtgtacgtgtctggtgagctggtcccattggccagagccagtgtggatgttttcggcaacagaacgttgttagctgcagggaccactgactcggaaggcgtagctacattgcccctgtcatatcgtcttggcacgtgggtactggtgacggccgctcgcccaggctttttgacaaattctgtgccatggcgggttgataaattacctctctacgctagcgtgtctctctacctgctccctgagcggcctgccacactgattctgtatgaggatctggtgcatattctgcttgggagtccgggcgctcggtctcagccactcgtgcagtttcagcggagggctgccagactgccagtgagctccacatattctcagttatgggcttcactgactccagccagcactcagcaggaaatgcgcgcctttccagcatttttgggcaccgaagcctcatcttcagggaatggctcttggcttgagttgatgccactgacagcggtcagcgtgcacttacttacggggaatggtacagaggtgccgctgtctggccccatccaccttagtcttccagtcccatctgaaacccgcgccttgaccgtgggtacctcaatcccggcctggcgctttgaccctaagagcggcctctgggtcaggaatgggacaggcgtcattaggaaagagggccggcaattatattggacctttgtgtctccccagttggggtattgggtggctgccatggccagtccgaccgctggcttggtgactattacgtccggcattcaggatattggcacttaccataccatcttcctcctaaccattctagcggctctcgcattgctcgtgctgatcctcctgtgcctgctcatttattactgtcgacgccggtgtctgaagcccaggcagcagcacagaaaactgcagctatccgggccctccgatggaaacaagagagatcaggcgacttctatgagtcagcttcacctgatctgtggtgggcccctcgagcctgccccttccggggatcctgaagccccccccccgggaccccttcacagtgcattctcatcaagtcgcgaccttgcatcgagtcgggacgacttcttccgcaccaaaccacgcagtgcgtcacgaccagcagctgaaccaagtggtgcgaggggcggcgagtctgccggtctcaaaggtgctcggtctgccgaggggccagggggactcgagccaggcttggaggagcataggcgtgggccttctggcgcggctgcttttctgcacgagccccccagccctccgccaccattcgaccattacctgggccacaaaggcgcggccgagggtaagaccccggatttcctgctgagtcagagtgtggaccagctggcccggcccccatctctgggccaggcggggcaactcatattctgcggtagcatcgatcacttaaaagataatgtctatcgcaacgtgatgccaacactcgttattccagcacactatgttagactaggcggcgaggccggagcagcgggtgtaggggacgaaccagcacctcctgagggtaccgctcccgggcccgcccgcgccttccctcagccagaccctcaaaggccccaaatgccggggcatagcgggcccggaggtgagggtggcggcgggggcggcgaaggatggggcgctggacgagcagcccctgttagcggcagcgtgactatacccgtgcttttcaacgagtccacaatggcccagttgaatggcgaactgcaggccttgacagaaaagaagctcctcgaactaggcgtgaaaccccatcctcgggcgtggtttgtgtcgctcgacgggagatccaactcccaggtgcgccacagctatattgacctgcaggcaggaggcggcgcaagaagcacagatgcaagcctggacagcggcgtggatgtacacgaggcccggcccgccaggcgtagacccgctagggaggagagagaacgcgcgccgcccgccgcaccccctccccctcctgccccacccagactcgccctctccgaagacactgagcctagcagtagcgaaagccgcaccggtctgtgctcccccgaagataactccctgacccccctcctggatgaggtagccgcaccggaaggtcgcgctgcaactgtacccagagggcgtgggcgaagtcgaggggacagcagcaggtcgagcgcgagcgaactaaggagggatagtctcacctcaccggaggatgagctcggagcagaggtgggggacgaggccggagataagaaaagcccttggcagaggcgtgaggagagacctctgatggtctttaacgtgaagtag

SEQ ID NO: 42147 - DNA, 1284 bp, Artificial Sequence
  Description of Artificial Sequence: Synthetic coding sequence
atggcccggctgtgccggcgggtgccctgcaccctgctgctgggcctcgccgtcgtgctgctgaaggcccgcctggttccggccgccgcccgtgccgaactgtctcgctccgatctgtccctgattcagcagcaacagcagcaacagcagcagcaacagcagcagcagaaacagctggaagaggcagaagaggaacggacggaagtgcccggcgcaacctccacattgacagtgcccgtgtcggtttttatgctgaaggtgcaggtgaacgatatcatctcaaggcagtacctatctcaagctgttgtggaagtgtttgttaactacaccaaaactaactccacggtcacgaagtctaacggggccgtcctcataaaggtgccctataaactgggactgagtcttaccatcatcgcctataaggatgggtacgtgttaaccccactcccatggaaaactcggagaatgcccatttacagcagtgtgacactgtccttgttcccccaaagtcaggctaatatctggttgtttgaggatactgtgctgattacggggaaactggcagacgctaagtcccagccgtctgtgcagttcagcaaagctcttataaagcttccagacaatcatcacatcagtaatgtgactgggtacctgactgtgttgcagcagtttctcaaagtggataacttcctccataccacaggtatcaccctgaacaagcctgggtttgaaaatatcgaactcacacccctagccgctatatgtgttaagatttattccgggggcaaggaattgaaagtcaacgggagtatacaggtgtcacttccattactccgactcaacgatatttccgccggcgataggatcccggcctggaccttcgacatgaataccggcgcttgggtgaatcatggcagagggatggttaaagagcacaataatcacttgatttggacctatgacgccccccacctgggctattggattgctgcccctctccctggaacacggggttccgggataaatgaagattcgaaggacatcactgcctatcatacggtatttcttacagccatcctcgggggaacaatcgtcatcgtcatcggttttttcgctgttcttctatgttactgccgggataaatgcgggacccctcagaaaagagagagaaacattaccaagctggaggtcctaaagcgagaccaaaccaccagcacgacccacatcaatcacatcagaaatagaaggaaaagtttccacgggaaaaatagcggccggttctag

SEQ ID NO: 42148 - DNA, 2481 bp, Artificial Sequence
  Description of Artificial Sequence: Synthetic coding sequence
atggcccggctgtgccggcgggtgccctgcaccctgctgctgggcctggcggtggtactactgaaggctagattagtacctgcagctgcccgcgccgagctctcacggtccgacctatcgttaattcagcagcagcagcagcagcaacagcagcagcaacagcagcaaaaacagctcgaagaagccgaagaagagagaacagaggtgcctggtgccaccagcacattaaccgtgcctgtcagcgtgtttatgcttaaggtccaagtgaatgacattattagtagacagtatttgtcccaggccgtagtggaagtcttcgtgaactatactaagaccaattctaccgtaaccaaatctaatggcgccgttctgataaaagtcccttacaaactcggcttgagtctcaccataatcgcgtacaaagacggttatgtcttaacccccctgccttggaagacccgcaggatgcccatctactccagcgtgacgctcagtctctttcctcagagtcaggccaatatctggctgtttgaggataccgtgctgattaccgggaaattggcggacgcgaaatcccagccatcggttcagttcagtaaagccttaataaagctccctgacaaccatcacatctccaatgtgaccggctacctgacggtactacagcagtttctgaaggtagacaattttttgcatacaaccgggattaccctaaataagccaggctttgagaacatagagctgacccctctggctgctatttgcgtcaagatttatagtggtggcaaagagctaaaagtgaacggatccatccaggtgtcgctgcctctgttgagattgaatgacatctccgctggagatcggatcccggcctggacctttgacatgaacactggtgcatgggttaaccatggacgtggcatggttaaggagcataataaccacttaatttggacctatgatgccccccacttgggctattggattgcagctcccctcccgggtaccagaggatctggcatcaacgaggattccaaggatattacagcctaccatacagtttttctcactgctattttggggggcacgatcgtgatcgtgatcggcttctttgctgttctgttatgttattgccgcgacaaatgcgggactccacagaagcgggagcggaatattactaaactggaggtgctaaagagagaccagactacctctacaacccacatcaaccatataagcaccgttaaggtagccctgaaggccgaggataagagccagcttttcaatgccaagaattcgagttacagtccccaaaagaaggaaccgagcaaagcagagacagaagagcgcgtgtccatggtaaagacacgggacgatttcaagatatataacgaggacgttagcttcctatctgtgaatcaaaacaactactcgcggaaccctacacagtctctggagcctaacgtcgggtctaagcaaccaaagcacatcaacaacaatttatcatcctccttaggtgatgcccaagacgagaaaagatacctgacaggtaacgaggaggcctacggtcgctcccatattcccgagcagctgatgcatatctacagtcagccgatcgcgatcctgcagacaagcgatcttttctctacgccagaacaactgcacacagccaagagcgcaacactgccacgcaaaggacagttagtgtatggccagctgatggagcctgtgaacagagaaaacttcacccagacactccctaagatgccaatccatagtcacgcccaaccgcctgatgcgagggaagaggatatcattctcgagggccaacagtcactcccttcccaagcttctgattggtccaggtatagctcatccctactggagagcgtaagcgtaccagggactctcaatgaggccgtcgtgatgaccccgtttagtagtgagttgcaaggcataagcgaacagacactactcgagttaagcaaaggaaaacctagccctcaccctcgggcctggttcgtgagcctagacggtaaacccgtcgcccaggtgagacatagctttatcgatcttaaaaaggggaaacggacccaatccaatgatacctccctggatagtggggttgacatgaacgagttgcatagttctcgaaagctggaaagggaaaaaacctttatcaagtccatgcatcaacctaagattctgtacctcgaggacctggatttgtctagtagtgagtctggcacaactgtttgctcgcctgaggatcctgccctaagacacattctggatggtggaagcggcgtgataatggaacatccaggagaggagagtcccgggcgcaagtctaccgtggaggactttgaagccaacaccagtcctacgaagagacggggacgcccgccattggctaagagagattcaaagaccaacatttggaaaaaaagggaggagagacccttgatcccgatcaattag

SEQ ID NO: 42149 - DNA, 708 bp, Artificial Sequence
  Description of Artificial Sequence: Synthetic coding sequence
atggagcaggacgaccccgtggaggccctgaccgagctgcgggagaggcgactgggtgcactggagctgctgcaagccgccgccggaagtggtctggcagcctacgctgtatgggcgctgctgcttcagcccggcttccgccgcgttcccttgaggctgcaggtcccctacgtgggtgccagcgccaggcaggtcgaacacgtgttgagccttctgcgtggaaggccaggcaagaccgttgatttgggatcgggagatggtcgtatcgtgctcgccgcccacaggtgtggcctgaggcctgctgtgggctacgaactgaatccttggctggtggcgttggcacgtctgcatgcctggcgtgcaggttgtgctggtagcgtgtgttacaggcggaaggacctgtggaaagtgtcccttcgcgattgtcgaaacgtctccgtcttcctggccccatctgtcttgccattgctagaagacaaactgcgcaccgagttgcctgcaggggcacgcgtggtgtcaggtaggttcccgttgccgacatggcagcctgtcactgccgtcggcgagggactggaccgggtgtgggcctacgacgtccctgaggggggtcaggcaggggaggccgcaagttctcgtatacccattcaggctgccccaggcccctcatctgctcctatccccggaggactcatctcccaagcctcctag

SEQ ID NO: 42150 - DNA, 879 bp, Artificial Sequence
  Description of Artificial Sequence: Synthetic coding sequence
atggcccagcccccccccgacgtggagggcgacgactgcctgcccgcatataggcacctcttctgtcccgatctgctccgtgataaggttgccttcatcaccggagggggatctggcataggtttcagaatcgccgagatcttcatgagacacggatgtcatacagtgattgcttctaggagcctgccccgcgtgctgaccgccgcgaggaagttagcaggcgccacaggacgtaggtgcttaccgctgagcatggatgtgcgtgcccctcccgccgtgatggccgccgtagaccaggcactgaaggagttcgggagaatagatatcttaatcaactgcgccgccggcaatttcctgtgccctgccggggcactatctttcaacgccttcaagacagttatggacatcgacacaagcgggacattcaacgtgtcaagggtgctctacgagaaatttttcagggatcacggcggcgttatagttaatatcacagctaccctagggaaccggggccaggccctgcaggtccacgctggctctgccaaagccgcggtggatgccatgactcggcatctggcagtcgagtggggaccacaaaacatccgcgtcaactctcttgccccagggcccatctccggaactgaaggcctgcggcggctgggaggacctcaggccagtctgagtactaaagtcactgcctcccccttacaaaggttgggaaataagaccgagatcgctcactcagttctttatctcgcaagtcccctggcctcatatgtcaccggtgccgtcctagtcgctgatgggggagcttggctgaccttccccaacggagtgaagggactcccagactttgcctcctttagcgctaagctatag

SEQ ID NO: 42151 - DNA, 702 bp, Artificial Sequence
  Description of Artificial Sequence: Synthetic coding sequence
atggagggcggcggcggcatccccctggagaccctgaaggaggagtcacagagtcgccacgttcttccagcctcctttgaggtgaactctctccagaaatctaactggggctttcttctgactggtctcgtgggcggtacactggtggctgtgtacgcggttgccactccatttgttactccagctcttcggaaagtctgcctgcctttcgtcccggctacaaccaaacagatagagaatgtagttaaaatgctgagatgccgcagaggctccctcgtcgatataggcagcggggatggccgaatcgtgatcgctgccgcgaagaaaggtttcacagccgtcgggtacgaattgaacccctggctggtatggtacagccgctaccgagcctggcgcgagggcgtgcatgggtctgcgaaattttatattagcgacctgtggaaagtcactttctcacagtactcgaacgtggtgatcttcggcgtaccccagatgatgctgcagctggagaaaaaacttgaaagggagcttgaagatgacgctcgtgtgatcgcctgtcggtttccatttcctcactggacaccagatcacgtgactggcgaagggattgatacggtctgggcatatgacgccagtacatttaggggtcgagaaaagagaccttgcacatccatgcacttccaactccccatacaagcatag

SEQ ID NO: 42152 - DNA, 573 bp, Artificial Sequence
  Description of Artificial Sequence: Synthetic coding sequence
atgaaggccagccagtgctgctgctgcctgagccacctgctggcctctgtcctcctcctgctgctgctgcctgagcttagcggtcccctagctgtgctgctgcaagccgctgaggccgctcccggcttgggccctcctgacccccgtcctcgcaccctgccccctctgccaccaggcccaacaccagcgcagcagccaggacgcggattagccgaggccgccggaccacgcggaagcgaggggggtaacggaagcaaccctgtggcaggcctcgaaaccgacgatcacggaggaaaagccggggaggggtctgtcgggggaggactggctgtgtcacccaatcctggggacaagcccatgacacagcgcgcgttaacggtgctaatggtagtgtccggggctgtgctggtttatttcgttgtgagaaccgtgcggatgagaagacggaaccgcaaaactcgtaggtatggtgttctggataccaacatcgagaacatggagctcacacctttggagcaggatgatgaggatgatgacaatacactgtttgacgcaaatcatccccgcaggtag

SEQ ID NO: 42153 - DNA, 480 bp, Artificial Sequence
  Description of Artificial Sequence: Synthetic coding sequence
atgcgggccgtgcccctgcccgcccccctgctgcccctgctgctgctcgcattgttagctgcgcctgctgcgcgggcttccagggctgagagcgtgtccgctccctggccagagcctgaaagagagtctagacctccaccagggcctggcccaggcaatactacaaggttcggcagtggcgccgcagggggaagtggatcgagttcctctaatagttccggtgacgccctcgtgacacggatctccatcctacttagggatctgcccaccctgaaggcggccgttatcgtggctttcgcttttaccactctgctgattgcttgcctgctcctcagagtcttccgtagcggaaaacgattgaaaaagactcgaaagtacgatattatcaccactcctgcggaacgagtggagatggctccactgaacgaagaggatgatgaggacgaggactccactgttttcgatatcaagtaccgttag

SEQ ID NO: 42154 - DNA, 1293 bp, Artificial Sequence
  Description of Artificial Sequence: Synthetic coding sequence
atggccgcccggctgctgcggggcagcctgcgggtgctgggcggccatcgagccccccggcagttgcccgcagctcggtgctctcactcaggcggtgaagaaaggctggagacaccgtctgcgaaaaagttaaccgacattggtatcagacgtattttctcacccgagcacgatatttttcggaaatctgttaggaagttttttcaggaggaagtcataccccaccacagcgaatgggagaaggctggagaagtgagtcgagaggtatgggagaaggccggcaagcagggcttacttggtgtgaatatcgccgagcatttaggcggaatcggtggcgacttatatagcgcagccatcgtttgggaggagcaagcatactcaaactgctcgggtccaggctttagtatccactcagggatcgtcatgtcatatattacaaatcacggatctgaggagcagattaaacattttataccccagatgacagcagggaagtgtattggagccatagccatgaccgagccaggggccggctctgacctccagggaatcaaaacaaatgccaagaaggatggctcagactggatccttaatggtagcaaggtctttatatccaacggttcattatccgatgtagtgatcgtagtcgcagtcacaaaccacgaggccccctcacctgcccatggcatcagcctgttcctcgtggagaacgggatgaagggcttcattaagggacgtaagctgcacaaaatgggcctcaaagcccaggatactgctgagctcttcttcgaagacattaggttacctgcctccgcactgctgggggaagagaacaaaggtttctattacatcatgaaggaactaccacaagagcgcttgctgattgccgacgtggcgatctccgccagcgagtttatgtttgaggaaacaaggaattacgtaaagcagagaaaagccttcgggaaaactgttgcccacctgcagacggtgcagcacaaactcgccgagctgaaaacgcacatttgtgtgaccagagccttcgtggacaattgcctgcagctgcatgaggccaaacgcttggacagcgccactgcttgcatggcgaagtactgggctagcgaactgcaaaactcagtcgcgtacgactgcgtgcagctgcatggggggtgggggtacatgtgggaataccctattgctaaagcttatgttgatgccagagttcaaccaatatatggtggaacaaacgaaattatgaaggagttaattgcaagggaaatcgtatttgacaaatag

SEQ ID NO: 42155 - DNA, 459 bp, Artificial Sequence
  Description of Artificial Sequence: Synthetic coding sequence
atgcggctgcccctgagccacagccccgagcacgtggagatggccctactgtccaacatactcgccgcctatagcttcgtcagtgaaaaccccgaacgtgcagcgttatatttcgttagcggggtatgcattggactggttctgaccttggctgctttagtgattaggatctcctgccataccgactgccgccgcaggcctgggaagaaatttctccaggaccgggagtcttcatcagatagttccgactcagaggacggctccgaagacacagtgtctgatctatctgttaggcgacatcggaggttcgagcgaactctgaataagaacgtatttaccagcgccgaagagctggagcgggcacagcggttggaggagagagaacgaatcatccgggaaatttggatgaatggtcagcccgaggttccaggaacgcgcagcttaaatcgctattactag

SEQ ID NO: 42156 - DNA, 459 bp, Artificial Sequence
  Description of Artificial Sequence: Synthetic coding sequence
atgcggctgcccctgagccacagccccgagcacgtggagatggccctgctgagcaatatcctggctgcctatagtttcgttagcgaaaacccggagagggccgctttgtactttgtgagcggcgtctgcatcggcctcgtcctgactttggccgcactggtgattcgaatttcatgtcataccgactgtcgccgtcgccccgggaagaaatttttacaggaccgggagtcttctagtgactcatccgatagtgaagacgggagcgaagacaccgtgtccgatctcagcgtgagacgccaccggcgtttcgagagaactttaaacaagaatgtattcacctccgccgaggaactggagagggctcagagattagaggagcgggaacgaatcattagagagatctggatgaatgggcaaccagaagtgcccggcacgcggtcgctcaatcgctattactag

SEQ ID NO: 42157 - DNA, 459 bp, Artificial Sequence
  Description of Artificial Sequence: Synthetic coding sequence
atgcggctgcccctgagccacagccccgagcacgtggagatggccctgttgagcaacatcctggccgcctatagcttcgttagcgagaatccagagagagctgcactctactttgtctccggcgtttgtataggactcgtcctcaccctggctgccctggtcattcggatctcctgccacaccgattgcaggaggcgtccgggcaaaaagtttctgcaggacagagaatcctcatcggacagttccgatagcgaggatggcagcgaagacacggtgtccgacttatcggttaggaggcaccgcaggttcgaaagaacactaaacaagaacgtattcacaagtgcagaggaactcgagagagcgcagaggcttgaagaacgcgagcggattatccgcgaaatctggatgaacgggcaacccgaggtgcctggtacccgtagtctgaaccgttactactag

SEQ ID NO: 42158 - DNA, 432 bp, Artificial Sequence
  Description of Artificial Sequence: Synthetic coding sequence
atgcggctgcccctgagccacagccccgagcacgtggagatggccctgctttcaaatatcctggccgcctatagcttcgtcagcgagaacccagaaagagcagcattatacttcgtgagtggggtgtgtatcgggctagtgctgactttggctgccctggtgatcaggatcagttgtcatacagactgtaggaggcggccaggtaaaaagtttcttcaggacagggagtcttcgagcgacagcagtgacagcgaggacgggtcggaagacacagtgtccgatctatcagtacgtcgccatagacggttcgagaggactctgaataagaatgtgtttacctccgccgaagagctggagcgcgctcagcgtctggaagaacgcgagagaatcattcgggaaatttggatgaacgggcagcccgaggtaccatag

SEQ ID NO: 42159 - DNA, 306 bp, Artificial Sequence
  Description of Artificial Sequence: Synthetic coding sequence
atgcggctgcccctgagccacagccccgagcacgtggagatggccctgctgtccaacatacttgcggcatatagcttcgtctctgagaatcctgagagagcggccctgtatttcgtgtctggagtatgcattggactcgtgctgactcttgctgcgctggtgatcagaatctcctgccacacagactgtagacgccggcctgggaagaagttcctgcaagaccgggagtccagcagtgacagttcagacagtgaggatggctcagaagacactgtgagtgatctctcggtgcgccgccaccgctag

SEQ ID NO: 42160 - DNA, 612 bp, Artificial Sequence
  Description of Artificial Sequence: Synthetic coding sequence
atgctgcagcaggacagcaacgacgacaccgaggacgtgagcctgttcgatgcagaggaagaaaccaccaacaggccacgaaaagccaagatccggcatcctgttgcgtctttttttcatctctttttcagagtttctgccattattgtgtgcctgttgtgtgagctactttcaagttcctttataacttgcatggtcaccataattctgcttctttcttgtgatttctgggcagtcaagaacgtgaccggaagattaatggtgggactccgatggtggaatcacatagatgaggacggcaagtctcactgggttttcgagtctagaaaagaatctagccaggagaacaaaaccgtcagcgaagccgaaagtcgaatcttttggctggggttgattgcgtgcagtgtattgtgggtcatattcgcattctctgcactctttagctttactgtgaagtggttggcagtcgtaatcatgggagtcgtgctccagggtgctaatctatacgggtatattcgatgcaaggtgcgctcacgaaaacatctcacctcaatggccacatcatattttgggaaacagttcctgaggcaggtatcggtgttctggatgtag

SEQ ID NO: 42161 - DNA, 642 bp, Artificial Sequence
  Description of Artificial Sequence: Synthetic coding sequence
atgaagcaggccctggtggacgacaccgaggacgtgagcctggacttcggcaacgaagaggagttggcgttcaggaaggctaagatccggcatcctcttgccacattttttcatctgttcttccgcgtgagcgcgatcgtcacgtatgtatcctgtgactggttctctaagtcttttgttgggtgttttgtcatggtattgctcctgctttccctggacttctggagtgtcaagaatgtgacaggccggctgttagtcgggctaagatggtggaaccagatcgacgaggacggcaagtcccactggatttttgaggctcgcaaagtgagtcctaattcaatcgcagccaccgaagccgaggctcggattttttggctggggctgattatatgtccaatgatctggatcgtgttctttttctccacactgttctccctcaaactgaagtggctggctctcgtcgtagctggcatttcactgcaggctgcaaacttgtatggatatatactttgcaaaatgggcggtaatagcgatatcggtaaggtcaccgcaagcttcctgagtcaaacagtgtttcagaccgcctgtcctggggactttcaaaagccgggactcgaaggcctcgaaattcatcaacactag

SEQ ID NO: 42162 - DNA, 567 bp, Artificial Sequence
  Description of Artificial Sequence: Synthetic coding sequence
atgaagcaggccctggtggacgacaccgaggacgtgagcctggacttcggtaacgaggaggagctcgccttccggaaggcaaaaatcagggaccgggtctctaaactgctggcatccgttatcctgctgccatggccccccaaagtacttggccttaagaatgtaaccggccgcctcctcgtcggactaaggtggtggaatcagatagatgaagatgggaaatcacattggatattcgaagctaggaaggttagtcccaactcaatagcggccaccgaagctgaggcgcggatcttctggttggggttgattatctgtccaatgatctggatcgtgttttttttcagtaccctctttagcctcaaactgaaatggcttgccttggtggtggctggtatcagcctacaggcggctaatctgtatggatacatcctctgcaagatgggtggaaacagcgatattgggaaagtgactgcttcatttctgtcacagactgtgtttcagacagcttgcccaggcgacttccagaaacccggcctcgaggggctggagatccaccagcactag

SEQ ID NO: 42163 - DNA, 618 bp, Artificial Sequence
  Description of Artificial Sequence: Synthetic coding sequence
atgctgcagcaggacagcaacgacgacaccgaggacgtgagcctgttcgacgcggaggaagagaccacaaatagaccccgcaaggcaaagatccggcatcctgtggctagtttctttcatctgttcttccgggtctcagccatcattgtctatctgctgtgcggtctgctttcctcttctttcattacctgtatggtgaccatcatcctgttattgtcatgcgatttttgggctgttaaaaacgtgacagggcgactgatggttggtctcagatggtggaatcatattgacgaagatggcaagtctcactgggtgtttgaatctcggaaggaatccagccaggagaataaaaccgtctctgaagccgagtccaggatcttctggttgggtctaattgcctgtcccgtactgtgggtgattttcgcgttctccgcactgtttagcttcagagtcaaatggctggccgtcgttattatgggcgtcgtgctgcagggcgcgaatctctatgggtacattagatgtaaggttaggagcagaaaacacctgacatccatggccacctcctattttgggaagcagtttcttcggcaaaataccggtgacgatcaaactagctag

SEQ ID NO: 42164 - DNA, 786 bp, Artificial Sequence
  Description of Artificial Sequence: Synthetic coding sequence
atgacctgctggctgcggggcgtgaccgccaccttcggccggcccgccgagtggccaggatacctttcacacctgtgcggtcggtcagctgctatggacctggggccaatgcgcaagtcttaccgaggcgacagagaggccttcgaggagacccatcttacctctctcgatcctgtcaagcagttcgctgcttggttcgaggaggctgtgcagtgccctgatattggagaggcaaatgcaatgtgtctggccacatgtacccgcgatggcaagccaagcgctaggatgctacttctgaagggcttcggcaaagatggcttcagattcttcacaaactttgaatcacgcaagggaaaggaactggactccaatccgtttgcttctctggtcttctactgggagcctctgaatcggcaggttagagtggagggtcccgtcaaaaaacttcccgaagaggaggccgagtgctactttcatagtcgccccaaatctagccagattggcgcggtggtgtcccaccagagcagtgtgattcctgaccgggagtatctaaggaagaaaaatgaggaactggagcagttgtaccaggaccaggaggttcccaaacctaagagctggggaggctacgtgctgtacccacaagtcatggagttttggcagggccagacaaacagacttcacgaccggatcgtcttccgtagagggctccctacgggcgattctcctttggggccgatgacacaccgaggtgaggaggactggctttatgagcggctggctccctag

SEQ ID NO: 42165 - DNA, 612 bp, Artificial Sequence
  Description of Artificial Sequence: Synthetic coding sequence
atgctgcagcaggacagcaacgacgacaccgaggacgtgagcctgtttgatgcagaggaggagacaaccaataggccgaggaaggccaagattcggcatcctgtcgcctctttttttcatttgttttttagagtgagtgccattatcgtatgcttactctgtgaactgctctccagcagtttcataacatgcatggtcaccatcattctgttattaagctgtgatttctgggcagtaaagaacgtcaccggaagattgatggtagggttaagatggtggaaccatattgatgaagacggcaaaagccactgggtgtttgaaagcagaaaagagtcatcacaggagaacaaaactgttagcgaagctgagtcacggatcttctggttaggactgatcgcgtgctcagtactctgggtcattttcgctttctctgcactattttcttttacggtcaagtggttagccgtggtgataatgggcgtggtgctccagggagcaaatctgtacggctatatccggtgcaaggtgaggagccgtaaacacctcacatctatggccacaagttactttgggaagcagttcctgcgtcaggtatcagtattttggatgtag

SEQ ID NO: 42166 - DNA, 558 bp, Artificial Sequence
  Description of Artificial Sequence: Synthetic coding sequence
atggtgggcctgcggtggtggaaccacatcgacgaggacggcaagagtcattgggtctttgagtcacggaaagaaagtagccaggagaacaagactgtctccgaagcagaaagccgtattttctggctggggctgattgcctgcagcgtgctatgggtgatttttgctttctccgctttgtttagtttcaccgtgaagtggctggcagtcgtgattatgggggtggtgctgcagggcgccaacctgtacgggtacatacggtgtaaggttaggtcacgaaaacacttgacgagtatggccactagttactttggtaagcagtttctaaggcagaggcgatcacggcacatcgcccagaccggattgaaggtgctgggtagtagggaccccccggcaagtgcttttcaatctgctgggatcactggggtgtcgcgttgtcccgggcacccctcaaggaagtttcatcaggactcccagaagactctggatttccccggttcgtatcttaagaatatgactccaggcaggccgatgtctccgatccccctgcggcagtag

SEQ ID NO: 42167 - DNA, 1110 bp, Artificial Sequence
  Description of Artificial Sequence: Synthetic coding sequence
atgccccccatgctgtggctgctgctgcacttcgccgcccccgccctgggattttatttcagcatctcgtgtccatcaggcaagcagtgccaacaggctctgctgagtggcaatgacatactgctctattgtaactcgagtggcgctcactggtactatctgttcacgcagggtaaaaagggccgcctaacgtcactcactaacatttcaaatatggagattatgcccgaggggagtctgctcatcaaggaccccctgccatctcaaaccggcctgtaccattgttggaacaaaaacgggcgccaggtggtacagtatgagatcgactttcaagatgtcaccacattgcatatcacccacaaggacttgggacagcggccacttcagaacgagacattgcacctaggcagtaagcagttaatcttcacctggtgggagccatggcaggactgcaaccgatgtgaggagcccggcgagtgcaagcgtcttgggtatcggtacatagaagagcccctggaagaggccatgccctgctggctgtatcttggcgaagttctagtctggtcttcgcggcttagaccagaactccaggtggaggcttgccacgtccagtgtactaataatactcagctcagagtcgactacgtgatcttcgataacttccgcctcgatgagaagaccgaattcgtttggcttgactgtcccctgggatcaatgtacaggcctgtcaattggagggccaacgatacccccttgacctgggaatcgcagctgtctggccaggacttcacaacctttttggatcccagcaccggcggaaggcagctgcaggtgttccagccagccgtgtacaaatgtttcgtacagcaggaactcgtggcacaattcaagccagcagcctccctggagacactcgaggctcagtggagggagaatgacgcgcagtggcgtgaggcacgcaaggcgctgcgcggccgcgccgacagtgtgcttaaggggctgaaactggttctgttagttgttactgttctagcactgcttggggcactgttgaagtgcatccaccccagtcctggacgaagatccacgcaggtcctcgtcgtcaagtag

SEQ ID NO: 42168 - DNA, 1620 bp, Artificial Sequence
  Description of Artificial Sequence: Synthetic coding sequence
atgccccccgccggcggcccccgggccccccggcccgccgccctgccccgctcgctgagccgactacgagaatgtccagggcgaagccggattgtcttggccttgggggccacgcagatggccctgggctgtctgatcgttgcagtgtcctttgccgcacttgcgctgaccacatcagcaagagtaagacattcatgcccattctgggccggattttccgtgctactgagcggcctgattggcgtggtgtcatggaagaggcctctgtccctggtgattactttttttatgctgctctccgctgtctgcgtgatgctgaatctcgctgggtctatcctctcctgccaaaatgcccagctggttaatagcctggaagggtgccagctgattaaatttgactctgtggaagtttgcgtctgctgcgaattacagcatcagtcaagcggatgttccaacttaggggagaccctgaagctaaatcctctgcaggagaattgtaacgcagtcaggctgaccctcaaggatctgctctttagtgtgtgtgctcttaacgtcctgagtaccatagtgtgcgcactcgcaacggctatgtgctgcatgcaaatggtatcgtctgacgtgcttcagatgtttctgcctcagaggagtcaccccgccaaccccacctgcgtgactccgcatggaacggtgttgcatcaaacattagatttcgatgagtttattccccctctccctcctcctccttattaccctccggagtacacatgcaccccatccactgaggcgcaaaggggactgcatctggattttgccccttctcccttcggcactctgtacgacgtcgctattaattctccggggctgctgtaccctgccgagctcccccctccctacgaggcggtggtgggccagccgcccgcatcccaggtgacgtccatcggccagcaggtggcggaatccagctccggcgatcccaatacttctgctgggtttagcaccccagtcccagccgacagcacaagcctcctcgtttctgaaggtacagccacaccgggatcctctcccagtcctgacggccctgtcggcgccccagcaccatccgagccagcactccctccaggacatgtgtcccccgaagaccccggtatgggtagccaggtacagcctgggcctggccgagtgagccgaagcactagcgacccaacactgtgtactagtagtatggccggcgacgcgagcagccacagaccaagttgcagtcaagacttggaagccgggctgtccgaagcggtgcccgggtcagctagcatgagtagatcggctaccgctgcatgtagagcccagctttctccagccggcgatcctgacacctggaaaacagaccaaaggccaactccagagccatttccagctaccagtaaggagagacccaggagtctggtggactctaaagcttacgccgatgctagggtgcttgttgccaagtttctcgaacacagccattgtgccctgcccacggaagcccagcacatggtgggggctatgcgactggctgtcacaaatgaggaaaggctcgaagaagaagcagtctttggagctgatgtgcttgaccaggtgtag

SEQ ID NO: 42169 - DNA, 1353 bp, Artificial Sequence
  Description of Artificial Sequence: Synthetic coding sequence
atgatcctgctggtgaacctgttcgtgctgctgagcgtggtgtgcgttctactgaaccttgccggctttattttgggttgccagggagcccagtttgtctcctcagtgccccgatgcgacttagtggacctcggagagggaaagatatgcttctgctgcgaggagtttcagcccgcaaagtgcacagataaagaaaatgcacttaaactctttccagtacagccctgttcagctgtgcaccttttattaaaaaaggtgttgtttgctctctgcgcgctgaacgcgctgacaacaactgtgtgtctggtggctgcagccctgcgctacctgcagatctttgctacacggagatcttgtatcgacgagtcacagatatcagccgaggaggctgaagatcacgggaggatcccggaccctgatgactttgtacccccggtgccgcccccttcctacttcgcaacattttatagttgcacacccagaatgaacaggagaatggtaggtccagatgtcatcccgcttcctcacatctacggcgcccggatcaagggagtggaggtattctgtcctttggacccccctccgccatatgaagccgtggtgtctcaaatggaccaggaacaggggagtagtttccagatgtccgaaggctccgaagctgcagttatcccactggacctgggttgcactcaggtcacccaggacggtgacattcctaacatacctgctgaggagaacgcatctactagcacaccaagcagcactcttgtccggcctatccgttctagaagggctctgccccccctacgcacgagaagcaagtccgaccctgttctgcatccatctgaggagagagcggctcccgtgctgagctgcgaggccgcaacacagacagaacgcagactggacttggcagccgtgactctgaggcgcggactaaggagcagggcatctagatgtagacccagatcattgattgattataaaagctacatggatacaaagctattggtggcacgctttctcgaacagagctcttgtacgatgacaccagacatccatgaactggttgaaaatatcaaaagtgtgctgaagagcgacgaagagcacatggaagaagcgattacatctgccagctttctggagcagattatggcccccctacagccctccacatctcgggcccacaagctgccgtcccgcaggcaacccggactgctccacttacagagctgcggagatctacacacctttacacctgccggccgcccccgagctgagaggagaccgcgcagggtggaggccgagcggccgcattctctgatcggcgtgattcgggaaacagtgctgtag

SEQ ID NO: 42170 - DNA, 858 bp, Artificial Sequence
  Description of Artificial Sequence: Synthetic coding sequence
atggtgggccccgacgtgatccccctgccccacatctacggcgcccggatcaaaggcgtggaagtgttctgtcctctggacccaccccctccctacgaggctgtagtctcgcagatggaccaggaacaggggtcttctttccaaatgagtgaaggaagcgaggcggcagtaatccctctcgaccttgggtgcacccaagttactcaggacggcgacataccaaatatccccgctgaagaaaacgcttctacttccaccccatccagcaccctggtccggcctatcaggtcacgcagagctttaccccctctgcgcacgagaagcaaatccgaccccgttctccacccttctgaggaacgtgcggcccctgtactctcatgcgaagctgctacccagacagagaggagattggatctcgccgctgtcacgctgcggagaggtttgcggtcgcgagcttccaggtgcaggcctcgctccctgatcgactacaagtcctatatggacaccaagctactcgtagcacgctttctggagcaaagcagctgcacaatgacaccagacatccacgagctggtcgagaacatcaaatcggtgctgaagtcggatgaagagcacatggaggaagctatcacgagtgcatccttcctggagcaaatcatggctcctctgcagccgagcactagccgagctcataagctccccagccggcgtcaacctggcctcttgcacctgcagtcttgcggcgatttacacacatttactcctgcaggccgcccacgggcagaaagaagaccccgacgggtcgaggcggagaggccgcacagcctcattggggtcattagagagactgtgttgtag

SEQ ID NO: 42171 - DNA, 714 bp, Artificial Sequence
  Description of Artificial Sequence: Synthetic coding sequence
atgacctgcttcggcccctaccccatcggcaccggcctgcagggcatcaccctgtgctgcttcccctccttttgtaagatgaagtcaaggatgtgtatggcgatctctatttgtcaaatgctctccatgctctcttttgttgtatgcgcttttaggtataggcacatgttcaagagggggtggccgatgggaacttgctgcttgttcctgcccacagccgcaccagtgctgagctgcgaggccgctacccagaccgagaggaggttagatctcgctgcggttacattgaggcgcggactgaggtcgcgcgcgtcccgatgtcgccctcgctccctaatagattataaaagctacatggacaccaagctgctggtagctaggtttttagagcagtcaagctgcacaatgacgccagacatccacgagctggtggagaatattaagagcgttctgaagagcgacgaagagcacatggaagaggcgatcacaagcgcaagttttttagaacagattatggcccctctccagcctagcaccagcagggcacataagctcccttccagacggcagcccgggctccttcatctgcagagctgcggggatctgcataccttcacgccagctggcaggcctcgagccgagagacgtcctagacgggtagaggccgaacgtccacactctctcatcggtgtaattagggaaacagtcttgtag

SEQ ID NO: 42172 - DNA, 1350 bp, Artificial Sequence
  Description of Artificial Sequence: Synthetic coding sequence
gtgctgctggtgaacctgttcgtgctgctgagcgtggtgtgcgtgttgttgaacctggccggattcatactcggctgtcagggggcgcagtttgtctcgagcgttccaagatgtgacctggtggatttgggcgaaggcaagatctgtttctgttgtgaggaatttcagcctgccaaatgcacagacaaagagaatgccttaaagcttttcccggttcagccttgttccgcggtgcacctgctgttaaagaaagtgctctttgcgctgtgcgcgttgaatgcactcacaactacagtctgtttggtcgcagcagccctgagatatctacagatattcgcaacacgcagatcttgcatcgatgagtctcagatctctgcagaggaggcagaagaccatggacgcatccctgatccagatgatttcgtcccgcccgttcctcccccgtcgtatttcgcaaccttctactcatgtaccccaagaatgaatcggaggatggtcggtccagatgttatccctttgccgcacatttatggagctaggataaagggggtcgaggttttctgtcccctcgacccacctccaccctacgaggcggtggtgtctcagatggatcaggagcagggatcctcctttcagatgagcgaggggtccgaggccgcggtcatccccctggatctgggttgcacccaggtaacgcaagatggtgacatcccaaatattccggctgaggagaatgcttctacatccactccgtcaagcacactggtacgcccaattaggtcaaggcgcgcactgccacctttacggacacgatccaagtctgacccggtgctgcacccgtccgaagagcgtgcagcccccgtcctgtcctgcgaagctgctacgcagactgaacgccgcctggacttagccgccgttacacttcggagaggactgcgcagtcgggcttctcgttgccggccccggagtctcattgactataaatcttatatggacacgaaactgttggtagcaaggtttctggaacagagctcctgtacaatgacccccgatatccatgagcttgtagagaatataaaatctgtgttgaagagtgacgaggaacacatggaagaggccattacctctgcatcattcctcgagcaaattatggctcccttgcagccttccacatcgcgggcgcacaagctgccatccaggcgacagccaggactcttgcaccttcagtcatgcggcgacctgcacacatttaccccagctggtagacccagagccgaacggagaccaaggcgagtggaggcagaacggcctcattccctgatcggcgttattcgggaaaccgtgttgtag

SEQ ID NO: 42173 - DNA, 1353 bp, Artificial Sequence
  Description of Artificial Sequence: Synthetic coding sequence
atgatcctgctggtgaacctgttcgtgctgctgagcgtggtgtgcgtccttctcaacttagcaggctttatactcggatgtcagggcgctcagtttgtatcaagcgttcctagatgcgacctggtggacctcggagagggaaaaatttgcttttgctgtgaggagtttcagcctgcgaaatgcacagataaggaaaacgcgctgaagctgttccccgtccagccctgctccgctgttcatttattattgaagaaagtgctctttgccctttgcgctttaaacgcgctgacaaccaccgtgtgcctagtggctgctgccctgcggtacctacagatcttcgctaccagaaggagctgtattgatgaatcgcagatctccgctgaagaggccgaagaccatggaagaatccccgaccccgacgatttcgtacccccagttcccccgccgtcctatttcgccacattctactcttgcactcctcgaatgaatcgcagaatggttggacccgatgtgattcccctgccccacatctacggggccagaatcaaaggcgtggaagtcttctgccctctcgaccccccccccccatatgaggccgtagttagccagatggatcaagaacagggaagctcattccaaatgagcgaaggctccgaggccgccgtgataccgctggacctgggctgcacccaggtgactcaggatggagacatccctaatatccccgctgaggaaaatgcttccacaagtactcctagcagtacactcgtacgaccgatcaggagtcggcgcgcccttccaccgctacgaacgcgaagtaagagtgatcccgtgcttcacccaagtgaagaacgagctgctccagtgctgagctgtgaggccgccacccagaccgagagaaggctcgacttggctgctgtgaccctccgaaggggcttgagatccagggcctccaggtgtagacctcgatccctgattgattataagtcctatatggataccaaactgctggtagccaggtttcttgagcaaagcagttgtacgatgactcctgatatccacgaattggtggaaaatatcaagtcggtgctgaagtcagatgaggagcacatggaggaagctatcacctccgctagcttccttgagcagatcatggcccccttgcagcctagcacaagccgggcccataaactccccagtcggcgccagcccgggctcctacatttgcagagctgtggcgacttgcacacctttacgcctgctggtagacccagagctgagcgcagacccagacgagttgaggccgaaaggccacacagtttgattggggttatccgggagaccgtgttgtag

SEQ ID NO: 42174 - DNA, 1074 bp, Artificial Sequence
  Description of Artificial Sequence: Synthetic coding sequence
atgggcctgcggggcgacagccaggccaccctgttcgacccccagctgcacgacggcagttgcatatgcgagagggtggcttctatcgtggacgtgtcgatggattcaggctctctcgtgctttcggcgattggtgatttgcccggggggagttctccatccgaggattcttgtctgctagaactccagggctccgtgcggagtgttgattatgttctgttccgaagcatacagcggtcccgagccggatactgcctatctcttgattgtgggctccggggaccttttgaggaaagccccctcccgcggaggccccctcgggcagccagatcctactcttgctctgctcccgaggcgccaccgcctctgggtgcccccaccgcggcccgcagctgtcataggctggaaggctggccaccctgggtaggcccttgtttcccagattcaagcggatctcttactccccctggtcatcggccaccccacccggcatcgccacctccgcttctcttgccgaggtcccatagcgatcccggcattacgacgtcatccgataccgctgatttcagggatctttatactaaggttctggaggaggaggccgcaagcgtgagctcagcggacaccgggctctgtagcgaagcctgcctcttccgacttgctcggtgcccatcccccaagctcctgcgagctcggtcagctgagaagagacgccctgtgccaaccttccagaaggtaccccttccgtccggccctgcccccgcacatagcctaggtgatttaaaaggatcatggcctggcagaggtttagtgacccgctttcttcaaatcagccggaaggcacccgacccaagcggtactggtgcacatggtcataagcaggtaccacgatctctatgggggaggcccgggagagaaagcctgcaccttaggagctgtggggacctgtcaagcagttcctgtggtgtctcttgcctggcggccggatggtcagttgtgcctgcccccacggccagcgcgtccactggggctgcaggccgtctgggatccgatctggggttcctctcacactag

SEQ ID NO: 42175 - DNA, 729 bp, Artificial Sequence
  Description of Artificial Sequence: Synthetic coding sequence
atgatgcccagccccagcgacagcagccggagcctgaccagccggccctctactcgcgggctgacgcaccttcggctgcaccgaccatggctgcaagccctcttgacactagggctggtgcaggtccttctaggaattttagtagtgaccttcagcatggtggccagcagcgtgactactactgagtctatcaaacggtcctgtccctcgtgggctgggtttagtaacctgctgttcagcgtgtgtggactgactatctgcgcggccattatatgtaccctctcagccattgtctgttgcatccagatctttagcctcgatctcgtgcacaccttggctccagaacgctctgtgtcaggcccactgggtccacttggttgcacctcaccacccccagcccccctgctccataccatgctggatctcgaagaattcgtgccgcccgtgcctccacctccctactacccacccgaatacacatgctcatcagagacggatgctcaaagcattacgtataatggctccatggattcccccgtgccgctttaccctacggattgcccacccagctacgaggctgtgatggggctgcgcggcggtaaacagatcttggtgccgctgcgaatgagggtggctctgtctgatctgcagggtcattacggacagggaaaaggaatggcccaggtttttaaatatagagtcacgtgtgcctacgctatgggttggtag

SEQ ID NO: 42176 - DNA, 1719 bp, Artificial Sequence
  Description of Artificial Sequence: Synthetic coding sequence
atgatgcccagccccagcgacagcagccggagcctgaccagccggccgtccacaagagggcttacccatttgcgcctgcacaggccgtggctacaggctttgttgactctgggcttggttcaagtgctgcttgggattcttgtcgtcactttcagcatggtcgcctctagtgttaccacgacagagtccataaagcgcagctgcccatcctgggccgggttcagtaatctgctgttctccgtgtgtggcctgactatttgtgccgcaatcatttgcaccctaagtgctatagtgtgctgcatccagatcttttctttggatctcgtccatactctcgctcccgaaaggtccgtaagcggtcccctggggcctctcggctgtactagtccgcctccagcaccacttttgcacacaatgttggatcttgaggagtttgtcccaccggtgccgccgccaccatattatcccccagaatacacatgcagcagtgaaacagacgctcagtctattacttacaatggttctatggattcccccgtccccctgtaccccacagactgcccaccatcttatgaagccgtcatgggcctccgaggggatagccaagccaccctattcgacccgcagttacacgatggctcctgcatttgtgaacgagtcgcttccatcgtggacgtgtctatggatagcggaagcctggtgctcagcgctatcggtgacctgcctggcggaagcagtcctagcgaggacagctgtttactcgagcttcagggaagcgtgagatctgttgattatgttctgttccgaagcattcaacgatccagagctggatactgtctttccttggattgcgggttgaggggccccttcgaagagtcaccattgccccgcaggcccccacgtgctgctcgaagttatagttgttctgcaccagaggctccccccccccttggcgccccaacagctgctagaagttgtcatcgcctcgaaggatggcctccctgggttgggccgtgttttcccgagctgagacgccgcgtgcccaggggcgggggccgccctgcagctgcccctccaaccagggctccaactaggcgattcagtgactcatctgggtcattgaccccaccaggacacagacccccacaccctgcctcaccaccacctttactgctgcctcgaagccattccgaccctgggataaccactagcagcgataccgcagatttcagggatctatataccaaggtgctcgaagaagaagcggccagcgttagctccgctgacactggcctgtgctctgaggcgtgtcttttccgacttgctcgctgtccttccccgaagttgctacgagctcgctcagctgagaagagaagacccgtgccaacttttcagaaggtcccacttccaagcgggccggctcccgcccactcccttggggacctgaagggttcatggcccggaagaggccttgtgacgcgtttcctgcagatttcacgcaaagccccagaccccagcggaaccggcgcacacggccataaacaggtcccccgcagcctgtgggggagaccaggcagggagtctttgcacctacgtagttgtggcgacctgtctagcagcagctccctcaggcgactgcttagtggtaggagattagagcgaggaacaaggccgcactctttaagtcttaatggagggtcccgggaaacaggtctctag

SEQ ID NO: 42177 - DNA, 2007 bp, Artificial Sequence
  Description of Artificial Sequence: Synthetic coding sequence
atgatgcccagccccagcgacagcagccggagcctgaccagccggccttctactcgaggactaacacatcttcggctacaccggccctggctccaagcattactgaccttggggttagttcaggtcttgctcggcatcctagtcgtaacgtttagcatggtagcaagttccgtaacaaccacagagtcaataaagaggtcctgtccctcgtgggcggggttctcgctcgcgttcagcggtgtggttggcatcgtctcctggaaacgccccttcacactcgtcattagtttcttcagtctgctgtctgttttgtgcgtcatgttatccatggctggtagcgtcctgagttgcaagaacgcacagttggcaagggattttcaacagtgcagtctggaggggaaagtgtgtgtgtgctgtccttctgttccactacttcgtccatgtcctgaatccggtcaggaactgaaggtcgctcctaattctacctgcgacgaggcccgcggcgccctgaaaaatctcctattttctgtgtgcggactgacaatatgtgcagcaataatttgtactttgtccgccatagtgtgttgcatacagatctttagcctggatctggtgcacactttggcccctgaacgtagtgtgagtggcccgctggggcccctcggatgcacgagtccacctccagcccccttactgcacactatgctcgacctggaggagttcgtccctcccgtaccgccaccaccgtattatccaccggaatatacctgttctagcgagaccgatgcacaatcaatcacatataacggttccatggacagccccgtgcctctgtacccaacagactgcccaccatcgtatgaggctgtcatggggctgaggggcgatagtcaagctactttgtttgacccccagctgcacgacggctcttgcatttgcgagcgtgtggccagcatcgtggacgtctcaatggactcaggatctctggtgctatccgcaattggggatttaccaggggggtcaagtccatctgaagacagctgtctgctcgagctgcagggtagcgtgcggagcgtcgactacgtactatttagatcaattcagcgttccagagctggctactgtcttagtttggactgcggcctgcgtggcccttttgaggagagccctttaccaagacgtccccccagagctgcacggtcgtattcgtgctcagctccagaggctcccccacccctgggagctcctacggccgcaaggtcatgtcatcgtctggaaggctggcctccctgggtgggaccttgctttcctgagctaagaagaagggtgccgcggggcggaggcaggccagccgccgcaccacccactagagcacccacacgaagattctccgattctagtggatctttgacgccaccagggcatcggcccccccacccagcctccccacccccactgctcttaccgcgcagtcatagcgacccgggtatcaccacgtctagcgatacagctgacttcagggacctgtacactaaagtcttagaagaggaggccgcatctgtatcttcggctgacactgggctgtgctcggaggcctgtctgttccggttagctagatgtcctagccctaagctgctgcgtgcacgtagcgctgaaaagcgaaggccagtacccaccttccagaaagtgccactgccctctgggccggccccggcacatagcctcggggatcttaagggcagttggcccggcagagggttagttacgcgattcctgcagatcagccggaaggcccccgacccatcaggaacaggggcccacggccacaaacaggtgccgaggagtctgtggggtcggcccggccgtgagagtttgcacctgcggtcttgcggcgatctctcatcatccagttcactgaggagacttctaagcgggcgacggctggaaagaggaacacggccacacagtctgagcctcaacggaggctctagggagaccggactttag

SEQ ID NO: 42178 - DNA, 1953 bp, Artificial Sequence
  Description of Artificial Sequence: Synthetic coding sequence
atgatgcccagccccagcgacagcagccggagcctgaccagccggccgtcaacaaggggacttactcatctgcgattgcaccgcccatggttacaggcgctgctcaccctggggcttgtgcaggtcttgctggggattctggttgttacattctcgatggtggcttcctctgtcacaactacggaaagcataaaacgatcctgcccctcatgggcagggttctcaatcagtttcttctcccttctatctgttctatgtgtgatgctgagtatggccggaagcgtgctttcctgcaagaatgcacagcttgctagagactttcagcaatgttcacttgaagggaaagtctgtgtttgctgtccttcagtcccccttcttcggccttgcccggagagtggacaagagctgaaagtagcccccaacagcacctgcgatgaggccaggggtgctctgaaaaatctgctgttttctgtgtgcggcctgactatctgtgccgccattatatgtactctgagcgccatcgtgtgctgcattcagatttttagtctggacctggtgcatacccagctcgccccagaacgttctgtgagcggtcccttagggcctcttggatgtacatccccgcctccagcccctctgctacacaccatgctcgatctggaggagttcgtgccccctgtgcccccacccccttattaccctccagagtacacttgctcctctgagacagacgcccaatctataacctataacgggagcatggattctcctgtgccactatacccaaccgactgcccaccctcatatgaggccgttatgggattaaggggggactcacaggcaacccttttcgacccccagctccacgatggatcctgcatttgcgaaagggtcgccagcatcgtcgatgtgtctatggactctggcagtctggttcttagtgcaatcggcgacctccccgggggttcgtctccctctgaagattcctgcctgctggaactgcagggctcagtcagatctgtggattacgtgctgtttagaagtattcagaggagcagagctggctactgcctgagtctggactgcggactgcgcggccctttcgaagaaagcccactcccccgtcggcctccccgcgccgcccgctcctacagttgtagtgccccggaggcaccaccccccctcggagctccaaccgcagctcggtcctgtcaccgtctagaaggctggcccccatgggtcggaccatgtttccctgagctacgtcggcgcgtgcccaggggagggggcagacctgccgcagccccccccaccagagcacctaccaggagattttcagattcctctggcagcctgacacccccaggtcacagacccccccatccagcttcacccccaccgctgctgttgccgcggtctcactccgaccccggaatcacaacatctagcgatacggccgattttagagacctgtatacaaaggttctagaggaagaagccgcttctgtcagttccgctgataccggcctttgttctgaggcatgtctgttcagattggcacgatgtccctctcctaagctgctcagggcccggtctgccgagaagaggaggcctgtgcctacttttcagaaagtgcccttaccctcaggtccagcaccagcccactcactaggtgacctcaagggctcttggccgggcaggggcctagtgactagattcctacagataagcagaaaagcaccagatccctctgggaccggggcgcacggacacaagcaggttcccagatctctgtgggggcgacccgggagagaaagcctgcatctgagaagttgtggagacctatcctcctcctcatcattacgtaggcttctttcagggaggcggctggagcgtggcaccaggcctcattccctgtctcttaatggcggctccagagagaccggactgtag

SEQ ID NO: 42179 - DNA, 435 bp, Artificial Sequence
  Description of Artificial Sequence: Synthetic coding sequence
atgatgcccagccccagcgacagcagccggagcctgaccagccggcctagtacccggggtctgacccacctcagattgcacaggccctggctgcaggccctcctgaccctcggtttggtacaggtcttgttgggaatactggtggtgaccttctcaatggtggcatctagcgtgaccacgactgaatccatcaagaggtcctgcccttcctgggccggattttcaaatctgttgttctcagtttgcggtttgaccatctgcgcagcaatcatctgtactctctccgcgattgtgtgctgcatccaaattttctccctggacctcgtccatacacttacctctgggacatttatcccaaaatgtctgagaaagaagctgctcctgttccctctgcaaatacaggggagcgccctgaaacccgcatcatccgcctag

SEQ ID NO: 42180 - DNA, 1560 bp, Artificial Sequence
  Description of Artificial Sequence: Synthetic coding sequence
atgacctgccccgacaagcccggccagctgatcaactggttcatctgctctctgtgtgtgccccgcgtcaggaagttatggtcaagccgaagacctcgtaccagacggaacttgcttctgggcactgcgtgcgcaatttacctcggctttctagtgagccaagtcggaagagctagcctgcaacacggacaggccgcagaaaaggggccccaccggtctagagacaccgcagaacccagctttccggaaatcccactggatggaacgctcgctccgcccgagtctcaaggcaatggatcaactttgcagcctaacgtcgtctatattacacttaggtctaaacgctccaagccagccaatatccgcggcaccgtgaagccaaagcgaaggaaaaaacatgccgtggccagtgctgcacccgggcaggaggcactggtaggtcccagcctgcagccccaggaagcagccagagaggcagatgccgtggcgccgggctacgctcagggggctaacctggtgaagatcggagagcggccatggcgtctggttcgtggaccgggcgtgcgagccggggggccggatttcctgcaaccctcgagcagggagtccaacatacgcatctattcggagtctgctccatcatggttgagcaaggacgatataagacgaatgcgacttctggcagattcagcggttgcaggcttgagacccgtgtcctccagaagcggggccagattgctggtactcgaaggtggagcgcccggcgctgtgctccgatgcggccccagcccttgcggcctgttgaaacaacctctagacatgtcagaggtgttcgccttccacctcgataggattctcggactaaatagaacgctgccatccgtctctcgcaaagcagaatttattcaggacggacgcccatgccctatcatcctctgggacgccagtctgtctagtgcatccaacgatacacacagcagcgttaaattgacctgggggacgtatcagcaactgctcaagcagaaatgctggcagaatggacgagtgcctaaacccgagtcaggctgcaccgaaattcatcatcacgagtggtccaagatggcactgttcgattttctgctacagatctataatcgcctcgacaccaattgttgtggttttaggcctcggaaagaggacgcttgtgtgcagaacggccttcggccaaagtgcgatgatcaaggatctgcagcgcttgcccatatcattcaacggaagcacgatccccgccacctcgtcttcatcgacaacaaagggttctttgaccgcagcgaggataatttgaatttcaagctgctcgaaggcattaaagaattcccagcctccgcagtgtcagttctaaaaagccagcacttgcggcaaaagttacttcaaagcctttttttggacaaagtctattgggagtcccagggcgggaggcagggcatcgaaaagctgatcgatgttattgagcaccgcgccaagatcctgatcacctacataaatgctcatggggtgaaagtcctaccaatgaacgagtag

SEQ ID NO: 42181 - DNA, 1560 bp, Artificial Sequence
  Description of Artificial Sequence: Synthetic coding sequence
atgacctgccccgacaagcccggccagctgatcaactggttcatctgtagcctctgtgtccctcgggttcggaaactatggtcatcacgaaggccaaggacacggagaaatctgctcctggggactgcgtgcgcgatttacctcgggtttcttgttagtcaggtagggagggcttccctgcaacatgggcaggccgcagagaaaggcccacacagatcacgcgacactgccgagccgagttttcctgagatccctcttgatggaacgttggccccaccagaaagccagggtaacgggtcaacacttcaaccaaatgtggtctatattacgctcagatctaagcgaagcaaacccgcgaatattagggggaccgtaaaaccaaagcggagaaaaaaacatgcggtcgccagtgcagcaccaggacaggaggcattggtgggcccctccctgcagcctcaggaggccgcaagagaagccgacgcagtggcaccaggctatgcccaaggggcgaatctagtgaaaatcggagaaagaccatggcgtctcgtacgaggaccaggtgtcagagccggggggccagattttctgcagccatcctcaagggaatctaacattcgcatttatagcgagtcggcacccagctggctgagcaaagacgacattcggagaatgcgtctgttggcagactccgctgtggccgggttgagacctgtctcctctagaagcggtgcgagactgctagtgctcgagggaggggccccaggagcagtcctgcgctgcggtccctccccgtgtggtctgctcaaacagccgctggatatgagcgaagtgtttgcgtttcaccttgataggattctcggcttgaatagaacccttccgagcgtcagccggaaggcagagttcattcaagacggccgcccttgccctattattctctgggacgcctctctgtcgtccgcatctaatgacactcattcctccgtcaagttgacctggggaacgtaccagcagctgctgaaacagaagtgttggcagaatggcagggttcccaagcccgaaagcggatgcactgaaattcatcaccacgaatggtccaagatggcacttttcgactttctgcttcagatttacaatcggcttgacaccaattgctgtggcttccgcccaaggaaagaggacgcatgcgtgcagaatggcttacgccctaagtgcgatgatcagggcagcgctgcgctcgcgcatattatccagcgcaagcatgacccaagacatctggtgttcattgataataagggcttcttcgaccgaagcgaagataatctaaattttaagctgctggagggcatcaaggagttcccagcaagcgccgtatcggtcttgaagagccaacatctgcggcagaaactccttcaatctttattcctggataaggtgtattgggaatcccaggggggcaggcaaggaatcgagaagctgattgacgtgatcgaacacagagccaagatactcatcacctatatcaatgcccacggggtaaaggtgctgccaatgaacgaatag

SEQ ID NO: 42182 - DNA, 1560 bp, Artificial Sequence
  Description of Artificial Sequence: Synthetic coding sequence
atgacctgccccgacaagcccggccagctgatcaactggttcatctgcagtctctgcgtgccgcgagtgaggaaactgtggtcatctagaagacctcggactagaagaaatcttctgcttggcaccgcctgtgctatctacttggggtttctggtctcccaagtaggtagggccagcctacagcatggacaggccgcggagaaggggcctcacagaagtcgagatactgcagaaccttcattcccagaaattccgctcgatgggaccctcgctccgccggaatcacagggcaacggctcaactctgcagcccaatgttgtgtatataaccctgcggtctaaacgttctaaaccggctaacatcagggggactgttaagcctaagcggaggaaaaagcatgctgtcgcctccgcggctcccggtcaagaagccctggttggtcccagcctccagccacaagaggccgcaagggaggcagatgctgttgcaccaggatacgcccaaggagccaacctggtcaaaatcggcgaacgaccctggcggctagtgagaggtcctggtgtgcgggccggaggacctgacttcttgcagcccagctccagagaatcgaatatccgcatatacagcgagtccgctcccagttggctctccaaggacgatataagacgcatgagactgcttgcagactctgcggtcgcgggattgcgtcctgtctcctctaggtccggcgctcgcctcctcgtgttggaggggggagcaccaggggcggtcctccggtgcggaccctcaccctgcggtctgctcaagcaacccctggatatgagcgaggtcttcgcctttcatcttgaccggatcctcggactgaacaggacactgccgtctgtctccaggaaagccgaatttattcaggatggtcggccctgccctatcattctgtgggatgccagtttatccagcgcctccaatgacacacactcatccgtcaagctcacttgggggacctaccagcagctgttgaaacagaagtgctggcagaatggcagggtacctaaacccgagtcagggtgtaccgaaattcaccatcacgaatggagtaagatggccctttttgatttcctgctgcaaatctacaatagattagataccaattgttgtggcttcaggccgaggaaggaagatgcatgcgttcagaacggtctgcgccccaaatgtgacgaccagggctctgccgccctggcccacataatccaaaggaagcatgacccaagacatcttgtgtttattgacaacaaaggcttcttcgacagaagcgaggacaatctgaattttaaactactggaagggatcaaagaattcccagcatctgcagtctctgttctgaagagccagcatctgcgtcagaaactcttgcagtcactgtttctcgacaaggtctattgggagtcgcagggagggcggcaggggattgagaaactcatcgacgtcatagagcacagggccaagattctgatcacatatatcaatgcgcatggggtgaaggttctgcctatgaatgaatag

SEQ ID NO: 42183 - DNA, 1584 bp, Artificial Sequence
  Description of Artificial Sequence: Synthetic coding sequence
atgacctgccccgacaagcccggccagctgatcaactggttcatctgctctttatgcgtgccaagagtgaggaagctgtggagtagtaggcgcccacgtacacgtagaaatcttctgttgggtacagcttgtgctatttatctgggcttccttgtctcgcaggtcggccgggcatctttgcagcacggccaggccgccgagaaaggtccacacagatctcgcgacaccgccgaaccctcattccccgaaatcccccttgacggcactttggccccaccagagtcccaaggcaatggctccacactgcagcctaacgtcgtgtacattaccctacgcagcaagagaagtaagccagcgaacattagaggtacagtcaaacctaagagacggaagaaacatgctgtggctagcgcagctccgggccaggaagctttggttggaccctcacttcagccccaggaggcggccagagaagcggacgcagtagcacccggttacgcccagggagccaaccttgtcaagatcggtgagcgaccttggcgtttggtacgaggccctggagtgagggcaggcggccccgatttcctccagccctcctcccgcgaaagtaacatacgaatctactcagaaagcgcaccgagttggctcagtaaggacgacatcaggcgtatgcgcctgctcgcagacagcgccgtcgccggtctcagacccgtgtcttctaggtcaggcgcgcggttactggtgcttgagggcggcgcacccggcgccgtacttaggtgtggaccctctccatgcggactgctcaagcagcctctcgacatgagcgaagtctttgccttccacttggaccggatccttgggctgaatcggactctccccagtgtgtcacgcaaagctgaatttatacaggcggcggcggctgcctgcctcagtatgagacttgctttttttatattccccgcttgggaagatatgagggtacctgggaagtgctgtatcggccacgccagattgacgtggggaacctaccagcagctcctgaagcaaaaatgttggcagaatggaagggttcctaaacctgaaagcggctgtacggagatccatcatcatgaatggagcaagatggcactgttcgacttcctcctccaaatttacaatcggttagacactaattgctgcggatttcgaccacggaaagaagatgcttgtgtgcagaacggattgagacctaagtgcgatgatcagggctcagccgcattggcccatatcatccagcgcaagcatgaccctagacacctggtgtttattgacaacaaaggtttcttcgataggagtgaagataatctgaactttaaactgctggagggcattaaagaattccctgcatccgccgtcagtgtccttaaaagccagcacttgcggcaaaaacttctgcagtcgctgtttctcgataaggtctattgggagagccagggaggccggcaggggatcgagaagctgatcgacgtgatcgagcaccgcgctaagattctgatcacttacataaatgcacacggggtgaaggtgcttccgatgaacgagtag

SEQ ID NO: 42184 - DNA, 996 bp, Artificial Sequence
  Description of Artificial Sequence: Synthetic coding sequence
atgacctgccccgacaagcccggccagctgatcaactggttcatctgcagcctctgtgtcccacgggtgcgcaagctttggagctctcggcgacccaggacccgaagaaatctactgcttggaaccgcctgtgctatctacctcggctttctggtgtcccaggtcgggagggcaagcctacagcacgggcaagctgccgagaaagggccccatcgctcccgcgacacagctgagccctcattccctgaaatccccctggatggaacactggccccccccgaaagccaagggaacggctccacactgcagccaaacgttgtctacatcaccctacggagtaagcgttccaagcccgctaacatacggggcacagtaaagcctaagagacgtaaaaagcatgctgtggcgagtgccgcccctggtcaggaggcattggtgggaccttccctccaacctcaggaagccgcacgggaggctgacgctgtggcccccgggtatgcgcaaggagctaatctggtaaaaatcggtgaacgaccctggcgactagtgcgaggtcctggagtgcgggcaggtggccctgactttctccagccatcttccagggaatccaacattcggatatactctgagtccgcaccatcatggctctccaaagacgatattcgccgcatgcggctactggctgatagtgccgtggctgggttaaggcccgtgagttcaaggtctggcgcaagactgctcgtgctggaaggcggcgctccaggcgctgtgcttaggtgcggccccagcccctgcgggctgctcaaacaaccattggacatgtccgaagtgtttgcctttcatctggatcgcatcctaggccttaatcgcactctgccctcagtgtccagaaaagctgagttcatccaagggaacagatttacatgcttcgttatctgcagctgctggggcttctggttcatcttctttttccccagcctaagcttttcaaagtag

SEQ ID NO: 42185 - DNA, 1608 bp, Artificial Sequence
  Description of Artificial Sequence: Synthetic coding sequence
atgacccccgagagccgggacaccaccgacctgagccccggcggcacccaagagatggaagggattgtgattgtgaaagttgaggaagaggacgaggaagaccacttccagaaagaaagaaataaggtggaaagcagtccgcaagtgctcagtcggtctactacaatgaatgagcgagccctgctaagctcttacttggtggcctaccgcgtggccaaagaaaaaatggctcatactgccgcagagaagatcatccttcccgcatgtatggatatggttcggactatcttcgacgacaagtccgcggataaactgaggactataccactttcagacaacacgatctccagacgcatttgtaccattgcgaaacacctcgaggcgatgctgatcacaagactgcaatcaggtattgactttgccatacagcttgacgaatccactgacattgcttcatgccccacactcctcgtgtacgtacgctatgtgtggcaggatgattttgttgaggatttgctttgttgcctgaacctgaactctcatatcacgggactggaccttttcaccgaattagagaactgcctcctggggcagtacaaactcaactggaaacattgtaagggtatctcatcggacggaactgcgaatatgactggaaagcattcacggctgacagaaaagctgctggaagcaactcacaataacgccgtgtggaatcactgtttcattcacagggaggccctggtgtccaaagagataagtccgtcactgatggacgtgttaaagaatgcggtgaaaacagtaaattttattaagggatctagtttgaattcaaggcttctggagatcttttgctcagagatcggcgttaaccacactcatctgctgtttcatactgaagtgcgctggctgtcccagggtaaggtgctatctcgagtgtatgagctgcgaaatgagatatacatctttttagtggagaagcagtctcacctggccaatattttcgaagacgatatctgggtgactaagctcgcgtacctctcagacatattcggcatactaaatgaactgagcttgaagatgcagggcaagaataatgatatcttccagtatttagaacacatcttggggttccagaaaaccttacttctttggcaggcgcggctcaaatctaaccgccccagttattacatgtttcccactctgctacaacacattgaggagaatattattaacgaggactgcttgaaggagattaagctggagatcctgctgcacctcacatccctgtcgcaaacatttaactactactttcccgaggagaagtttgagagtttgaaggagaacatctggatgaaggacccatttgccttccagaatccagagtcgattatagagcttaatctggagcccgaggaggagaacgaattgctgcagctctcctcaagttttaccttgaagaactactacaaaatcttatccttgtccgcgttctggattaagataaaggacgatttccctctcctgtcccggaagtctatcctccttctgctgccttttacaacgacatatctctgtgagctgggatttagcatcttgacccgctag

SEQ ID NO: 42186 - DNA, 1722 bp, Artificial Sequence
  Description of Artificial Sequence: Synthetic coding sequence
atgacccccgagagccgggacaccaccgacctgagccccggcggcacacaggaaatggagggaattgtcattgtgaaggtggaagaggaagatgaagaggaccactttcagaaggaacggaacaaggtcgaatcttccccccaggtcttgagtagaagcacaacaatgaatgagcgggccctgctctccagctatctcgtagcctatcgcgtagccaaggagaaaatggcgcacacagctgccgaaaaaatcatcctgccggcctgcatggatatggtgaggacaatcttcgatgataagagtgctgacaagctgcgaactatccctctaagtgacaatacgatcagcaggcgaatctgcaccatcgctaagcaccttgaagccatgttgatcacacgcttgcaatccggaatagatttcgccattcagctggacgaatcaaccgacatcgctagttgtcctacgttgttagtgtacgtgcggtacgtttggcaggatgattttgtcgaagatcttctatgttgtcttaatctaaatagtcacatcacagggctggaccttttcaccgaactggagaattgcctgctcggccaatacaagctcaactggaagcactgcaagggaatctccagcgatggcaccgccaacatgacggggaagcattcccggctcacagagaagctgctcgaagccacgcacaacaacgcagtgtggaaccactgtttcattcatcgcgaggcactggtctcaaaggagataagcccaagcctgatggacgtcttaaaaaatgccgtcaaaaccgtaaacttcatcaaaggctcttctctgaacagtcgacttctggaaattttctgcagcgaaattggcgtaaatcacacccacctcctgtttcacaccgaggtccggtggttaagtcagggaaaggtcctaagcagggtgtacgagttaaggaacgagatctacatcttcctggttgaaaaacaatcccacctcgccaacattttcgaagacgatatctgggtgactaagttagcatacctgagcgatatcttcggaatcctgaatgagctctccctgaagatgcagggaaaaaataacgacatcttccagtaccttgagcacatccttggctttcaaaagactttgctcctctggcaggctcgcctaaagtcaaatcgtcccagttactacatgtttcctacgttgttgcagcacattgaggagaacattatcaacgaggattgtctcaaggagataaagctcgagattctgctgcacttgacatccctgtctcagacttttaattattactttcctgaagaaaaatttgaaagtctgaaggaaaacatatggatgaaggatccatttgcctttcagaaccctgaatccattatcgagctaaatctggagcccgaagaggagaatgaactgctgcagctctcatcctcctttactttgaaaaattactataagatcctgtcactttccgcgttctggatcaaaattaaagacgactttccgctgctgagccggaagtccatcttgcttctcttgccattcaccacgacttacctgtgtgaattaggattctctattctgacaaggctgaaaactaagaaacgcaacaggctgaattcagctcccgatatgcgtgtcgctctttcgagttgcgtgccagactggaaagaactgatgaacagacaggctcatccttcccactag

SEQ ID NO: 42187 - DNA, 4008 bp, Artificial Sequence
  Description of Artificial Sequence: Synthetic coding sequence
atgctgagccccaccttcgtgctgtgggaggtgggctaccccctgtatatttatgggtccatattcatcgtgattgtgatcatctggcaggtgaaacgcagtcaccacgaacttagttctgagccgaaaagatcttgctgccggtgccaccagaaggtgagacagagagcacgtgacgccgcttctaccgctcgtagaaggtcacgcgaagaggcggagaaacctcagaagctcctgtccattataaaatcccaggggtggctaccactcgagaggagtgtgcgccggatcttatgtgctgatccctgttgccaaatttgtaacagtgttgctctagagattcagcagctgctagtgggcgaaaataatcagatctccctgacgcttagtggacccctccagggcagtagctgcctggaaatgttatccacatcctctatgagccttgatcagagcttagagtttcactcttggcacaccagggaactttcactgagttccgtgaccccaacactctcccagttgacagatcagaagagtcttacacagtccgcagcacagtccacctacgccgacggtattcaggactactgggctgaccatttgcagctgggacaagagtttcaagtgcctgacgtgttgcgcggcccaaatactatcgcctcctcacgcattgagaagcccagagcaccgctcaaccaagaggagatgacccagtctaacccaagtcttgtccagggcaaccagggccaacatcaccttaactcccaagtatcattgctgtctcttaatccagagacattaaacagaatgcaccccatggcccttcacatggtactgccagcccacttacctttcctgagcccggaagtgttgcgcctgctggaggtccacgtcaagaagtggatgcattttcagcgctggggacttccacggcgggtggaggaaagtctgcgccaactcatgccaaatccccctctgtactatcagcccggtaatgaccaaccggttagttttaatctcaaaaatactccgcaggtctctttacacagattcgagacaattagccttcagacctggtgttcctgtgtggcaggacaacctatccaaaccttttgggtgtcggagtggtcgaccatgaaccccgagcagaggcaccactgtcaacagacaccaaacccaatggctctagccttaccatcacctgcactgaaggcactctctggcccgcatccccagagtggcggccaggacaatgactctggatccgatttacagcagaaatatagccagctgttctgtggcctcccctctctacatagcgaaagcctggtggctacattcatgggatcacagggtttacctaagatcgagaatgtaccgaagcctcccctgaaggacccctttctcttcaatgagctctcgttccctcaactcctgcctaaaacgtcgccccagtcggctccaccttcttcccctctgagccctaactggatgagtccatccgaccatcagagggcccagattaatgtaccttttctcacattagcggaatacgaagccctggaatggcacttactccaaagacaacttcaactccagtggggctggcccgccgcgctgcaaaggagccagcatactcagtgcctgatgcagcacgagccatgcggaaaagcccagtcccctgagaccaccaccgcttctcagaccggcaaatcgatttcagtgctgactcgcgagctgctattctttccagagcacgctaggaagctgctggaatttcacattcagaaacagttaattcggcaccggtggggccttccccagaagatccaacagtctatccagctcctccttacatccacagaccaacagaccgtgtcctcttcctccactgcgttggctaatgtcagcataccccaacctgtggctttggaagcgaatggtgcctgcgacgttctaagtcctattgctgcccctgtgtcaatcccccgtccacatctgctgacccaagttaaggccatcctccagtcacacatcgacagtaaatgcggccagatccaccagggcaagatcccggcctgcgtccaccgttcctgggactgtcgtatcagcggtgtgctggcagtggccccctttccttgcatccccgaaagccaattcttggagctgcagacggcatcagaccccgacctccaccacaaagtgatgccctggatgcccaccgctctggatcagcaacagcaggccctgccaggaaccgtgacagaacatcccaaacttctgcgggttctgtcagtcgaagccatcgagaagctggaaacaaccctaaggcacaagcatcttgcctttctgtctggcctaccggcgttgtactatgtggcactgcccagagctctggcccccgccgttacatctcagagcgtgatcaccgagatggagccctcacctgtggagatcccagcagaacctctgatacagatggtgtcattcgaggagcaatgcatctccctcggaccctgtcctcaggggaataacgagagctgcaccgatgtggcgaaagaattccagcccgccgttccagtcaagggcacaatggaaacgcttcctctggagagtcagactcaccccacatccccccactcccttcagactcatatactgacaaagctgaacttccatttgagaaagaaagtgctcgaaatccaatggggaattccaatcagagctcggaagagtagggaacagacggttgctgccccagagaacatttccacccagaagtcgctcgaatccttgaaccaccaaggggagaccctgttacaagaactccctatcccaccagacactctcccagctccaaacccagaaggggttcatctgaaagagcaactggccaacgatctgaaagcagtgcagcagaaccagaaacagagcaatagcaaagccgtccctcagggaagcgctcactctgtctctaagatctctcagccttccggtgatatgaccgaggcccatatgccttgcgtccaggttgaggcgaatgtcaacaaaccctcgctggaggagccttgtgggcctgaaccccaaagcccgtctaaatctaaagatcctgcccatgtccccatgctggccgggaaccgagaagatcccgaggaaacaaaggccgccagggaccacagggagggcgatgcaggatttggacgcagcagcacccgggaggagcgtagaccagcagaggatcagcggccagctggcatgcttcctaataagacccctcgtggatcatggaggtggtccagaagctttcaccttgccgacccctgccagcactcgccccaacaccatcctcagctcaaactgcctcagctcccccccagagttccaggggagaaggaatctgagaaagaccttcaggatagtcagacaaagcttacagtaatcctggaacctgctactatcccagagaatgctcaaacggtgcttccccaggcctcgcaaggccagccctttctgtcccagccgacccaggcgaaaccactccaaggccagaccctacaggggcaagtgctgcacgggctggtaatgcctgttcatgcacagaagaaacccagcttgaccgagtcatcattcagaaacaagattaagtgttttctgcagcacattaaccccaaaacaaaagggaaaggccatgaggactccatgttctcagctgctgctaaggtggccaagacacgaaaggagaatgtggcaaagagcctggcgcccgccaaatctcctgtcggccgctccaaaactgagaagccgaccgggtgttctaaagcacagagccggcctgcccaaaaactggtcggtcctgcattcctggatggtccccagagccttgatgacaaactccgtttgcatagtcggcagcccggatccgccagtgcactcgggtaccctagacactgccctagacattgcccacgcgaggcttgtgctaacaagcctgggcatcctacctag

SEQ ID NO: 42188 - DNA, 516 bp, Artificial Sequence
  Description of Artificial Sequence: Synthetic coding sequence
atgtggaccctgaagagcagcctggtgctgctgctgtgcctgacctgcagctacgcattcatgttttcttcgctcaggcagaagacttctgagccccagggcaaagtacagtacggggaacacttcaggatcagacaaaatttacccgaacatacccagggctggttgggcagtaagtggctatggttgctgtttgtcgtagttccctttgtcatcctccagtgccagagagactctgagaaaaataaagagcagtccccccccggtcttaggggcggccagctccacagcccacttaagaagaaaaggaatgcgtctcccaataaggactgtgcattcaatacactcatggagctcgaggtcgaactaatgaaatttgtgtccaaggtgcggaacttaaaacgcgcaatggcgacagggtccgggtcgaacttacgtttgcggaagagcgaaatgcctgccgatccttaccatgtcacgatttgcgagatctggggtgaagaaagtagctcttag

SEQ ID NO: 42189 - DNA, 516 bp, Artificial Sequence
  Description of Artificial Sequence: Synthetic coding sequence
atgtggaccctgaagagcagcctggtgctgctgctgtgcctgacctgcagctacgcatttatgttcagttctcttcgccagaagacatcggagccgcagggcaaggtcccctgtggtgagcacttccggatcaggcagaacctccccgaacacacccagggatggctcggttccaagtggctctggctactctttgcagtagtcccgttcgtcatccttcagtgccagagagactctgagaaaaacaaggaacaatctccccccggcctgcgcggattcccgttcaggactcccctgaaaaaaaaccagaatgcatccctctataaagattgcgtttttaatactttaaatgaactagaggttgaactgctgaaattcgtatcagaggttcaaaacctaaagggcgcaatggccaccgggagtggatcaaatctgaagctcagacggagcgaaatgcctgcagacccataccacgtgacaatttgcaagatctggggagaagagtcatcctcttag

SEQ ID NO: 42190 - DNA, 4026 bp, Artificial Sequence
  Description of Artificial Sequence: Synthetic coding sequence
atgatgaaccggaccacccccgaccaggagctggcccccgccagcgagcccgtgtgggaaaggccctggagcgtggaagagattcgtagatctagccaatcttggagcctcgcagccgacgctgggttgctccagttcctccaggagttcagccagcagacgatcagccgcacgcatgagatcaagaaacaggtggacggactgataagggaaactaaagccaccgactgtaggctccataacgtttttaacgacttcttgatgctgtcaaacacacagttcatagaaaacagagtttacgatgaggaagtcgaagagccggtgctgaaagccgaggccgaaaaaactgagcaggaaaagacaagggaacaaaaggaggtcgatctgatcccaaaagtccaggaggccgtgaattacgggctgcaggttctagacagtgccttcgagcagctagacattaaagccggcaactctgacagcgaggaagatgatgctaacggaagagtggagctgatcctggagccgaaggatctctacatcgaccgccccctcccatacctgattggctcaaagctctttatggaacaggaggacgtgggcctgggcgaactatcaagtgaggagggcagcgtgggcagcgaccgcgggtccatcgtggatacagaggaagagaaggaggaagaagaaagcgacgaggactttgctcatcactccgataatgagcagaatagacatacgactcagatgtctgacgaggaggaagacgacgatgggtgcgatctatttgccgattctgaaaaagaagaagaggacatcgaggatattgaggagaacaccaggcccaaacgcagtcgacccaccagttttgccgatgagctcgccgccagaataaaaggagacgctgttggacgtgtagatgaggaaccaactacactcccttccggcgaagccaagccccggaagaccttgaaagagaaaaaggaacgtagaaccccatcagacgacgaagaggacaacctgtttgcccctcctaaactgacagatgaggatttctcacccttcggatctggaggaggtctgttttcaggtggaaaaggactgttcgacgacgaggatgaggagtctgacctattcacggaggccccacaggatagacaggctggggcctctgtcaaggaggagtctagcagtagtaaacctgggaaaaaaatcccggccggagcagtgagcgtttttctaggggatactgacgtgttcggagccgcttcagttcccagcatgaaagagcctcaaaagccggaacagccaaccccaaggaaatccccctacggaccaccgccgaccgggttatttgatgacgacgatggagatgatgacgatgacttcttctctgcccctcattcaaaaccctcgaagaccggtaaagtgcagtcaacagcagatatttttggtgacgaggagggtgatctattcaaggagaaggctgtggctagccccgaggcaacagtgtcccaaaccgacgagaataaagccagagcggaaaaaaaggttactttaagttcgtcaaagaatttgaaacccagcagtgagaccaaaacgcagaaggggctgtttagtgatgaggaagacagcgaagatctcttctccagccagagtgcaagtaaactgaagggggccagtctgctgcccggtaagttgccaacattggtatccctttttgacgacgaagacgaggaggataatttatttggcggtaccgccgccaagaagcaaactctgtgcttgcaggctcagagggaggaaaaagccaaggcttccgaactgagtaagaagaaagcctcggcactcctgttcagcagcgacgaggaagaccagtggaacattccggcatctcagacacatttagcatccgactcacggtctaaaggagagcccagggacagcgggactctgcagtcacaagaggctaaagctgtaaaaaagactagtttgttcgaggaagatgaggaggatgatctctttgccattgccaaagacagccaaaagaagacccagagagtcagcctcctgttcgaggacgatgtcgacagcggtggttccttgttcggctcacctccaaccagtgttcctccagcaaccaagaaaaaagagactgtcagtgaggctcccccactactgttctcggacgaagaggagaaggaggcccagctgggcgtaaaaagcgtggataaaaaggtggagtcagcgaaggaatcattaaagttcggtcggactgatgtggctgaatccgagaaggagggattattgaccagaagtgcgcaggaaactgtcaagcacagcgatctgttctcctcttccagcccctgggataaaggcacgaaacctcgaactaagaccgtattgtcgctattcgatgaggaggaggataagatggaggaccagaatatcatccaagcaccccagaaggaagtgggcaagggtagggatccagatgcccaccctaagagcactggggtgttccaggatgaggagcttctgttctcccacaagctacagaaggataatgatcctgacgtggatctgtttgcaggcaccaagaagaccaaactgctggagccctcagtcggaagtctgttcggcgacgatgaagacgatgatctgttctccagcgccaagtcccagcctctggtccaagaaaagaaaagagtggttaagaaggaccattccgttgattcatttaagaaccaaaagcatccggagtccatacaggggtctaaagaaaaaggtatctggaaacctgaaacgccacaggacagcagcggactggccccattcaagaccaaggaaccatctactcggataggaaagatccaggcaaacttagctataaatcctgccgcactcctgcctacagctgcgagccagatttctgaagttaagcctgtgctacctgaactggctttcccctctagcgagcatcgtcggtctcatggactcgagtctgtgcctgtcttacccggcagcggcgaagcgggagtctcgtttgatctgcccgcccaggccgacacactccattccgccaataagtctcgcgtgaagatgcgcggaaagcgtcggccccagactcgagctgcgcgacgtctggctgcacaggagagttccgagactgaggatatgagtgtgcctcgcggtcctattgcgcagtgggccgacggtgctatttctcccaacgggcatcggcctcagctgcgcgccgcatctggtgaagattcaactgaggaagccctcgccgcagcagccgccccttgggaaggcggaccagttccgggggtggaccgcagtccatttgccaaaagtctgggccattctagaggggaagctgacctctttgattctggcgatatattttccacaggcaccggctctcagtcagtggagaggaccaaacccaaggctaaaattgctgagaatcccgcgaacccgcccgtgggtggaaaggccaagtcgcctatgttccccgctctgggggaggcttcgagtgatgatgacctcttccagtctgccaagcctaaacccgcgaaaaagaccaacccctttccattgctggaagatgaggacgatctgtttaccgaccaaaaagttaagaaaaacgagacaaagagcaattcacagcaggacgttatcctgaccactcaagatatttttgaagacgatatatttgcgaccgaagcaatcaagccaagccaaaaaacacgggagaaagagaagaccctcgagtcgaacctcttcgatgacaacatcgacatcttcgccgacctgaccgtgaagccaaaagaaaagtccaagaagaaggtcgaggcaaaatccatatttgatgacgacatggacgacatttttagctctggaattcaagcaaaaaccactaaacccaaatctagatctgcccaggccgctccagaacctcgatttgagcataaagtttcaaatatctttgacgaccctttgaatgcctttggaggacagtag

SEQ ID NO: 42191 - DNA, 3840 bp, Artificial Sequence
  Description of Artificial Sequence: Synthetic coding sequence
atgatgaaccggaccacccccgaccaggagctggcccccgccagcgagcctgtttgggaacgcccctggtctgttgaggagattcgacggtctagtcagtcctggtccctggcagccgacgctgggctcctgcagttcctccaggaattttcacaacagacaatcagcagaacgcacgaaatcaaaaagcaggtcgacgggctcatacgcgaaactaaggcaactgattgccgccttcacaatgtgttcaatgatttcttgatgctctccaatacccagtttattgagaacagggtttacgacgaggaggtggaggagccagtgttaaaggccgaagcagagaaaacggagcaggagaagacccgcgagcaaaaagaagtggacctcatccctaaggtacaggaagcagttaactacgggcttcaggtgttggatagtgcattcgagcaattggacatcaaggcagggaactcagacagcgaggaagacgatgccaatggccgggtggagctgatcctggaacccaaagacctgtacatcgacaggccgctgccttatctgattgggtctaagctttttatggaacaggaggatgtcgggctgggagagctctcgtctgaggagggaagtgttgggagcgaccgcgggagtattgtggataccgaggaggagaaggaggaagaggaatccgatgaggacttcgcacatcacagtgataacgaacagaacagacacaccacccagatgtcagacgaagaggaagatgatgacggatgtgacctcttcgcagacagtgagaaggaagaggaggacatcgaagacatagaggagaataccagaccaaagaggtcaagaccgacgtcttttgccgacgaactggcagctcggataaaaggggacgccgtggggagggtcgacgaagaaccaaccacactgccaagcggggaagccaaacctaggaagactcttaaagagaaaaaggagagacggaccccaagcgatgatgaggaagataatctcttcgccccgccaaaactcactgatgaagacttttcccctttcggctctggcgggggcctcttcagtgggggcaaggggctcttcgacgacgaggatgaagagtccgatctattcacagaagcaccgcaggacaggcaggctggggcctccgtaaaagaggagagctctagttccaagcccggcaaaaaaattccggccggtgcagtgtcagtgtttctgggggataccgacgtgtttggggccgcctcagtgccctctatgaaagaacctcagaagccagagcagcccacgccccgtaagagcccttatggcccacctcctacgggtctgtttgatgatgatgacggcgatgatgacgatgatttttttagtgcacctcacagtaaaccatctaagacaggtaaggtccagtcaacagccgacatatttggcgacgaagagggcgacctgttcaaagaaaaggcagtcgcctcacctgaggcgacagtttcccaaaccgatgaaaacaaggctcgagctgagaaaaaggttaccctgtcatcctctaaaaatttgaagccgagctctgaaaccaagacccagaaaggtctgttttcagatgaggaagatagcgaggatctgttcagtagtcagtccgcctcaaagctcaaaggtgcctcactcctcccaggcaagctgcctaccctggtgtcgctatttgatgacgaagacgaagaggacaatctgttcggcggcaccgccgccaagaaacaaaccctgtgcttgcaggcacagcgggaggagaaggcaaaggcaagcgaactcagcaagaagaaggcaagcgccctgttgttctcatccgatgaggaagaccagtggaatatccccgcctcccagacccatttagcctccgactccagatcaaaaggcgagccccgagacagcggaacgctgcagagtcaggaagccaaggcggtaaagaaaaccagtctctttgaggaagatgaggaggacgatctctttgctattgcaaaggacagccagaaaaagacccaacgggtcagccttctcttcgaggatgatgtcgatagcggcggatctctttttggttccccccctactagcgtcccgcctgccactaaaaagaaggagactgtctctgaggctcctccgctgctgttctccgatgaggaagagaaagaggcacagctgggcgtgaaatccgtggacaaaaaggttgagagtgccaaagagagcctgaaattcggtaggacagacgttgcagagagtgagaaggagggtctgcttacgagaagcgcacaggaaacggtgaagcactccgacctgttcagcagcagctccccatgggataagggtacaaaaccccggaccaagactgtgctgtccctctttgatgaagaagaagataagatggaggatcagaatatcattcaagcaccccagaaggaagttggcaaaggaagggaccctgacgctcatcccaagtctacaggggtgtttcaagacgaggagcttctgttcagtcacaagctacaaaaggacaatgaccccgacgtggatcttttcgcgggaacaaagaagaccaagctgctggaaccaagcgtgggctcactgttcggtgacgatgaagatgacgatctttttagttcagctaaaagccagccactcgcgaatttggccataaaccctgctgctctgctccctactgctgcatcccagatcagcgaggtcaaacccgtcctgccagaacttgccttcccatccagtgagcacaggagatctcacgggctggagagtgtgcccgttcttcctgggagtggggaagcgggcgtttcattcgatttgcctgcgcaggccgatactcttcattcagcaaacaagtctcgcgttaagatgagaggcaagagacgaccacaaactcgcgcagctcgacgtctcgccgcccaggaatcaagcgagaccgaggatatgtcggtccctaggggcccaatcgcccaatgggcagatggtgcgatatccccaaacggccatcgaccccagctccgggcggcttccggcgaggattcaaccgaggaggctctggcagccgctgctgccccctgggaaggcggtcccgtaccaggagtcgaccggtccccatttgctaagtcactgggtcattctagaggcgaggccgatttattcgacagcggcgacatcttttccacagggaccggctctcagtctgtggagcgcaccaaacctaaggctaaaattgcggagaatcccgccaacccgcctgtaggaggaaaggctaagtctcctatgttccctgctttaggggaggcctccagcgacgacgatcttttccaatctgctaagccgaaaccagcaaaaaaaacgaacccctttccattgttagaagatgaggacgacctgttcaccgatcagaaggtcaagaagaacgagaccaagtcaaacagccaacaagatgtgatcctaaccacgcaggatatatttgaggacgacatcttcgccaccgaagccatcaagccctcacaaaaaacccgggaaaaagaaaaaacgttagagagcaacctgttcgacgataacatcgacattttcgccgatctgacagtgaagcccaaagaaaaatcaaagaagaaagtggaggctaaatctattttcgatgatgacatggatgatatttttagtagcggcattcaagccaaaaccaccaagcccaagtcccgttccgctcaggcggctcccgaaccacgctttgagcacaaggtatccaacattttcgacgatccactgaatgccttcgggggacagtag

SEQ ID NO: 42192 - DNA, 3963 bp, Artificial Sequence
  Description of Artificial Sequence: Synthetic coding sequence
atgatgaaccggaccacccccgaccaggagctggcccccgccagcgagcccgtctgggagcggccatggagcgttgaggagatccggcggtcttcccagtcatggtctctggcagccgatgcaggactacttcagtttcttcaagagttcagccaacagaccatcagtaggactcacgaaattaaaaagcaggtggacggactcatccgagagactaaggctactgactgccggctccataatgtgtttaatgatttcctgatgcttagtaacactcagttcattgaaaacagagtgtacgacgaagaggtagaagagcccgttctcaaggccgaggccgaaaaaaccgagcaagagaaaacgagggagcagaaggaagtcgacctcataccaaaagtgcaggaagcagtgaactacggattgcaagttctggactcagccttcgagcaattagatattaaagcgggaaactccgacagcgaagaggacgatgccaacggccgcgtggagctgatcttagaacctaaagatttgtacatagatcgcccgctgccctacctcataggctcaaagctgttcatggaacaagaagacgtcggtctcggggagctctcctcagaggagggcagcgtcggcagcgatcgaggatcaatcgtggataccgaggaggaaaaagaggaggaagagtctgacgaggacttcgcacatcattctgacaacgagcaaaaccgtcacaccacacagatgtcagacgaagaagaggacgatgacggttgtgacctattcgccgattcagagaaagaagaggaggatatagaggacatcgaggaaaataccagacccaagcgatcccggcccacttcatttgctgacgagctggccgctaggattaagggggacgcggtgggcagggtggacgaagagccaacaactttgcccagtggcgaggctaaaccacgtaagactctaaaagagaaaaaagaaaggagaacgcctagcgacgatgaagaggataacctcttcgccccaccaaagcttacagatgaagacttctcgcccttcggcagtggggggggactatttagtggcggtaaaggcctgtttgatgacgaagacgaagagtctgacctgttcacagaagcaccacaggatcgtcaggcaggagcctccgtgaaggaggagtccagctcatcgaagcctggtaagaagatccccgctggtgctgtatctgtttttctaggtgacacagatgtctttggagccgcatctgtacctagcatgaaggagccacaaaaaccggagcagccaacgccccgtaaatcaccctacggacccccacccactggcctcttcgacgatgacgatggcgatgacgacgacgactttttttccgccccccattcgaagccgtctaaaactggtaaagtgcaatctactgccgatatctttggtgatgaggaaggcgatctgttcaaagaaaaagctgtggcctctcctgaggccacagtgtcccagacagatgaaaataaagcccgggccgagaagaaagtgactctgtcttcgtccaaaaacctgaagccgtctagcgaaactaagacgcaaaaggggcttttttcagatgaagaagatagtgaagatctattcagttctcagtcagccagcaaactcaagggcgcttccctgttgccaggcaagctcccgactttagtaagccttttcgatgatgaagacgaggaagataacctgttcgggggtactgcggcaaaaaaacagactctgtgtcttcaagctcaacgcgaggaaaaagccaaggcctcggagctgtcaaagaagaaagcgagcgcattgctcttctccagcgacgaagaggatcagtggaacatccccgcttctcagactcacttggcttctgactcccgcagtaaaggagaaccgcgcgattccggcacactgcagtcccaggaggcgaaggcagtcaagaagaccagtctgttcgaagaagacgaagaagacgacttgttcgccatcgctaaggacagccagaaaaaaactcaaagagtctccctcttatttgaggatgacgtcgattctggaggaagcctgttcgggagccccccaacctcggtgcctcccgcaaccaagaagaaggaaactgtcagcgaagctcctcctttgctgttcagcgatgaagaggagaaggaggctcaacttggtgtcaaatctgtggacaagaaggtcgaatcagccaaggaatcattgaaatttggcagaacagatgtcgccgagagtgagaaagagggcttgctaactcgatccgcccaggaaacggtgaagcattccgacctgttctctagttcatctccttgggataaggggacaaaacctaggactaagacagtgctcagtttgtttgatgaggaggaggacaagatggaggatcaaaacattatccaggctccccagaaagaagtcgggaagggccgagatcccgacgcacatcccaaatccactggtgtgtttcaggacgaagaattacttttctcccataaattgcaaaaagacaatgatccagacgttgatttgttcgccggtacaaagaagaccaagctgctggaaccgtcagtgggcagtttgtttggtgacgatgaggacgacgacttattttcgtccgccaagagccagccgctggtgcaggaaaagaaacgagtcgtgaaaaaagaccacagcgtcgacagtttcaagaaccagaaacaccctgaaagtatacagggctctaaagagaagggtatctggaagcccgagacaccgcaggcgaacctggctatcaaccccgcagccttgctgccgacagctgcatctcagatatctgaagtgaaacccgtcctccctgagctagcttttcctagctccgagcatcgtcgctctcatggtctcgaatccgtccccgtgctcccaggatcaggggaagctggagtgagcttcgatctgccggctcaggcagataccctgcacagcgccaacaagagtcgtgttaagatgcgggggaagaggagacctcagacaagagccgcccgtaggttagcagcccaggaatcaagtgagacagaagatatgagtgtcccccgcggccccatagctcagtgggcagacggggcaattagtccaaacgggcatagaccccaattgcgagccgcatcaggtgaggattcaacagaagaggccttggctgcagcagccgcgccatgggagggaggcccagtgccgggagtggacaggagccccttcgcaaagtcactgggtcacagtaggggggaagcggacctgtttgactccggtgacatattttcaaccgggacagggagccagtcagtagagcgcaccaaaccaaaggccaaaatcgccgaaaatcccgcaaacccgcctgtgggtggaaaagccaaaagcccgatgtttccggctctaggggaggcatcttcagacgatgatctgtttcaatccgccaagcctaagccagcaaagaagaccaacccgtttccgctgttggaagacgaggatgatctgttcaccgaccagaaggtaaagaaaaatgaaaccaaaagtaattcccagcaggatgtgatccttacaacacaagacatctttgaagacgatatctttgcaacggaggctatcaaaccgagtcagaagactagagagaaagaaaagacactggagagcaacctgttcgacgataatatcgacatcttcgcggacctgacagttaagccaaaggaaaaatccaaaaagaaggtggaggccaaatcgatcttcgatgatgatatggatgacatctttagctcggggattcaggccaaaaccaccaaaccgaagtcgagatctgcacaggcagcccctgaaccaagattcgagcacaaggtctccaatatttttgacgacccactgaacgctttcggcggccagtag

SEQ ID NO: 42193 - DNA, 3762 bp, Artificial Sequence
  Description of Artificial Sequence: Synthetic coding sequence
atgccccggctgagcggcaagagcgtgcgggtgtacgacgaggaggtggaggaacccgtcttgaaggctgaagcagaaaaaacagagcaggaaaaaaccagggagcagaaggaggtcgatctgatccctaaagtgcaggaagccgtgaattacggactgcaggtcctggattcagcattcgaacaacttgacataaaggctgggaactctgattctgaagaagacgacgcgaacggaagggttgaactcatcctggagcccaaggatctgtacatcgaccggccgctaccttatttaatcgggagcaaactgtttatggaacaggaggacgtggggctgggagaactaagttcggaggaaggctcagttggctcagatcggggcagcatcgttgacaccgaagaagagaaagaagaggaagaaagtgatgaggattttgctcaccactccgacaatgagcagaatcggcatacaacacagatgtctgacgaggaggaagatgatgacggatgcgacttgtttgctgattctgagaaagaagaggaggatatcgaggatattgaggaaaataccagacctaagcgctccaggcccacaagctttgctgacgaactggccgctaggatcaagggcgacgccgttggccgcgtagacgaggagcctaccacattaccttctggcgaagcaaaaccccgaaagacactgaaggaaaagaaggagcgccgcacgccctcagatgacgaggaagacaacttgttcgctcccccaaagctaacagatgaggatttctccccttttggatcaggggggggcctattctccggcggaaagggtctgttcgatgatgaggatgaggagtccgatttgttcaccgaagcacctcaggacagacaggcaggcgcatctgtcaaagaagaatcttccagctctaaaccgggcaagaagattccagcgggcgctgtttctgtgttccttggagacaccgacgttttcggggcagcttccgttccttcaatgaaggaaccacagaagccagaacaaccaactccccgtaagagcccttacggccctccccctacaggactttttgatgacgatgatggcgacgatgatgatgatttctttagtgctcctcacagcaagccctctaaaacggggaaggttcagagcactgctgatatctttggggatgaggaaggggatctgttcaaagagaaggctgtggccagcccagaggctactgtatctcagacagacgaaaacaaggcccgggctgagaagaaggtgaccctgagttcaagcaaaaaccttaaaccctccagtgaaaccaaaacacaaaaaggcctgtttagcgacgaggaagactcagaggatttgttttcgtcccagagtgcaagcaaattaaagggcgcgtctctccttcctggaaagctgcccaccctggttagcctcttcgatgatgaggatgaggaggacaacctgttcggtgggacggcggctaagaagcagacattgtgcctccaggcgcagagggaggagaaagcaaaagcgtctgaattatctaaaaaaaaggccagcgcactgctgttctcctcagacgaagaagaccagtggaacatcccggcctcccagacacatctggcctcggactctagaagcaagggagaaccaagggattctgggacactgcaatcacaggaggctaaggctgtgaaaaagacgtccctgttcgaagaagacgaagaggatgacttattcgccatagctaaggatagccagaagaaaacacagcgagtctccctcctcttcgaggacgacgtggactctgggggtagcctgttcggaagcccacctaccagcgtcccccccgcgaccaagaagaaagagaccgtgtctgaggcaccacctctgctgttcagtgacgaggaggaaaaggaagctcagttaggtgtgaaaagcgtcgataaaaaggtggaaagcgctaaggaatccctcaagtttgggcggacagacgtagctgagtcggagaaggagggtctgctgactcgctccgctcaagaaactgtcaaacatagtgatctcttttcctcgtcaagtccatgggataaggggaccaaacctcgcacaaaaacagttctctcactttttgatgaggaggaagacaaaatggaagaccagaacatcattcaggctcctcagaaagaagttggaaagggcagagatcctgatgcacatcctaaatcgacaggcgtttttcaggacgaggagctgttgttcagccacaagctccagaaggataacgatcctgacgtggacttgttcgccggcacaaaaaagacaaaactactggaaccatcggtgggcagtttattcggagacgatgaagacgacgacttgttcagctcggccaagtcgcagccactagtgcaagaaaagaagagagtggttaagaaagatcattcagtggattcattcaagaaccagaagcaccctgaatcaattcagggaagcaaagaaaaggggatctggaagcctgaaacacctcaggattcctccgggctggctcccttcaagactaaggaaccatcaacacgcatcggcaaaattcaggctaatctggccataaatccagctgccctgctaccaaccgccgccagccagatctcagaggtgaagcctgtccttccagagcttgcattcccatcttccgaacaccgccgatctcacgggcttgagtcggtgccagtccttcccggttccggggaagccggcgtcagttttgatctgcctgcccaggcggataccctccatagtgccaataagtcccgagtgaaaatgcggggaaaacgacggccacagactcgggctgctaggcgcttggccgcccaggaaagcagcgagacggaggacatgagcgttccacgcggcccaatcgctcagtgggctgatggcgccatctctcccaatggccaccgtccgcagctgcgcgcagcttccggtgaggactcgaccgaggaggctctcgcagctgcagccgctccttgggagggaggaccggtgcccggagtagatcgctcccctttcgccaagagcctcggacactctcgaggcgaagccgacctgttcgattctggggatattttttccacaggaaccgggagccagagcgtagagaggacgaagcccaaagccaagattgccgaaaatccagccaacccaccggtcggtgggaaagccaaaagcccaatgtttcctgcactgggcgaagcctcttcggacgacgatttgtttcaaagtgccaaacccaagcccgccaaaaaaaccaatcctttccccctgctcgaagacgaggatgatttgtttacagaccagaaagttaagaagaatgaaactaaaagtaactcacagcaggacgttatcctcactacacaagatatcttcgaggatgacatattcgctacagaggccatcaagccaagccagaagacccgagagaaggaaaaaaccttggagtctaacctctttgacgataatatcgacattttcgctgacctgactgtaaaaccaaaagaaaagtctaaaaaaaaagtggaagcaaaaagcatattcgacgacgacatggatgatatctttagctccggcatccaagcaaagaccactaaaccaaaatctcggtcggctcaggccgcccccgagcctaggttcgagcacaaagtgtccaatatctttgacgaccctcttaacgcctttggtgggcagtag

SEQ ID NO: 42194 - DNA, 3204 bp, Artificial Sequence
  Description of Artificial Sequence: Synthetic coding sequence
atgaaccggaccacccccgaccaggagctggcccccgccagcgagcctgtctgggagcggccgtggtctgtagaagagatccgccgctcctctcagtcttggagtctggccgcagatgcaggcttgctccagttcttacaggaatttagccagcaaacgattagccggactcacgaaattaagaaacaggtggacgggctcatacgtgaaactaaggcaaccgattgtagactccataatgttttcaatgacttcctcatgctgtcgaatactcagttcatcgagaatagagtgtatgacgaggaagggagcgtaggttctgacaggggctctattgtggatacggaggaagagaaagaagaggaagagtctgatgaggacttcgcacaccactcagataatgaacaaaaccgccacacaacccaaatgtcagacgaggaggaggacgatgatgggtgtgatctgttcgccgactccgagaaagaagaagaggatatcgaggatatcgaggaaaacacaaggcctaaacgctcccgcccgactagctttgcagatgagctggccgcgcggatcaaaggcgatgctgtcggccgggtggacgaggaaccgacgaccctgccctccggcgaggccaaacccaggaaaaccctcaaagaaaaaaaggagcgccgcactccttcggatgatgaagaggacaacctattcgcacctccaaagctcaccgacgaagatttctctcctttcggatcaggggggggtctgttttccggggggaaggggctgttcgatgacgaggacgaagagagcgatctttttacggaggccccccaggatagacaggccggggccagtgtaaaagaggaaagtagtagtagcaagcctggcaaaaagatcccagccggagccgtctcagtttttctgggggacactgatgttttcggcgctgcatcagtcccatccatgaaggaaccgcagaagccagaacagcccacgccaagaaaatctccatacggacccccacccacagggctgttcgatgacgatgacggtgatgatgatgacgattttttcagcgcacctcacagtaaacctagcaaaaccgggaaggttcagtccaccgccgatatcttcggagatgaggaaggagatctctttaaggaaaaagcggtggcgtcccctgaagcaacagtatcccagacagatgagaacaaagcccgtgcagagaaaaaggtgaccctatctagctccaaaaatctcaaaccttcctccgaaactaagacacagaaggggctgttcagcgatgaggaagactcagaagatttgttttcttcacagagcgctagtaagttaaaaggggccagcttgctgccaggtaaactgcccacccttgtctccctcttcgatgatgaggacgaggaggacaatctattcggaggaacggccgctaaaaagcagactctgtgtttacaggcccaaagagaagagaaggcgaaagcaagcgaactgagtaagaagaaagcatcggctttactgttctcatctgacgaggaggatcagtggaacattcctgcctcacagacccatctggcttctgactctcgctctaaaggcgagcccagagacagcggcacacttcaatcacaggaggcaaaagcagtgaagaagacttccctttttgaagaagatgaggaggacgacctgtttgccatcgccaaggacagtcagaagaagacacagagagtgagccttctgtttgaggacgatgtggattctggcgggagccttttcgggagtccgccaacaagcgtgccgcccgctacaaagaagaaagaaaccgtgagtgaagccccacccctgctcttcagcgacgaggaggaaaaagaagcgcagcttggggttaaatcagtggacaagaaggtagagagcgccaaagaatcccttaaatttggcaggaccgatgtagcagaatctgaaaaggaaggtctccttacccgctcagctcaagaaactgtcaaacatagcgacctgttctcctcatcttcaccgtgggataaaggaactaagccacggaccaagactgtgctgtcactgtttgatgaagaagaagacaagatggaggaccagaacatcatacaggccccgcagaaggaggtgggcaagggcagagatccggatgctcaccctaagtccaccggagtgtttcaagatgaggagctgctattttcacataaattgcagaaagacaacgaccccgatgtggatctatttgctggcaccaaaaagacaaagcttcttgaacccagcgtagggtcactttttggagacgacgaagacgacgatctgttcagcagcgcaaaatctcagcctctggttcaagagaaaaagagagtcgtgaagaaggaccacagcgtggacagctttaagaatcaaaagcatcccgagtcaattcagggaagtaaagaaaaagggatctggaaaccagagactcctcaggattcatctggactggcccccttcaagactaaggaaccgagcacacgtataggaaagattcaggcaaatctagccataaacccggctgccctgctgccgacagccgccagccaaatatcagaagtgaaacccgttctgcccgagctggctttcccctcctctgagcatagaaggtcccatgggctggaatccgtccccgttctgcccggcagcggcgaggcaggtgtgtccttcgatctgccggctcaggccgacaccctacattccgcaaacaaaagtcgagtcaagatgcgagggaaaagaagacctcagacaagagctgcaaggaggctcgccgcacaagagagctctgagacagaggatatgagtgtgccccgcggtcctatcgcccaatgggcggatggagccatatctcctaacggacatcggccacagctgcgagcagcctcaggtgaggactcgacggaggaggccctagctgccgccgctgccccatgggaaggcggtcccgtgcctggggtggatcgctcgcccttcgcaaaatccttaggacatagccggggtgaagcagatctgtttgattcaggcgatattttcagcaccgggactggaagtcagagcgtggagcgcaccaagcctaaagcgaagttcggtaaactgtggccacctcactgtcatatactgctgattaagttctattggaacacctag

SEQ ID NO: 42195 - DNA, 471 bp, Artificial Sequence
  Description of Artificial Sequence: Synthetic coding sequence
agcccctgggacaagggcaccaagccccggaccaagaccgtgctgagcttgttcgatgaagaggaagacaagatggaggatcagaacatcattcaggccccacagaaagaagtggggaagggacgtgaccccgacgcccatcccaagtccactggtgtatttcaagacgaagaactcctcttctcccacaaactccaaaaagataatgatcctgacgtcgacctgtttgcaggtacaaaaaagactaagctccttgaaccctccgtgggctccttgttcggagacgacgaggatgacgaccttttttcgtccgccaaatcacagcctctggttcaggagaagaagcgcgtggttaagaaggaccactccgtggacagcttcaagaaccagaaacatccagagagtatccaagggagcaaggaaaaaggaatctggaagcctgaaaccccccaagttcgcaaccctctgtag

SEQ ID NO: 42196 - DNA, 3672 bp, Artificial Sequence
  Description of Artificial Sequence: Synthetic coding sequence
cgggtgtacgacgaggaggtggaggagcccgtgctgaaggccgaggcagaaaagaccgaacaagaaaagacgcgggagcagaaggaggtcgatctcatccctaaagtccaggaggctgttaactacggattacaagtgttagactcagctttcgagcagttggacataaaggctggtaactcagattctgaggaagacgacgcaaacgggcgtgttgagctcattctggagcctaaagacctttacatagacagaccgttaccctacctcatcggctcaaagctgtttatggagcaagaggacgtagggttgggggagcttagctccgaggagggctcagtgggcagtgatcgggggagtatcgtggatacagaggaggaaaaggaggaagaagagtctgatgaggatttcgcgcatcacagcgacaacgaacaaaacagacatactacccagatgagcgatgaggaggaggacgatgacggctgtgacctatttgcagacagcgaaaaggaggaggaagacatcgaggacattgaggaaaacactcgaccgaagcggtccaggcctacctccttcgcagacgagctagctgctcgcatcaagggagacgccgtcggcagagtcgacgaagagccaacgacacttccaagtggagaggctaaaccaaggaagactttgaaggagaaaaaggagcgaaggacaccctcagatgatgaagaagacaatctctttactcctcccaagcttaccgacgaggatttttctccatttgggtcgggaggcgggctgtttagcgggggcaaaggccttttcgatgacgaagacgaggagtccgatttgttcacagaggcgccacaggaccgccaggcgggcgcatctgtgaaagaggagtctagttcatccaagcccggcaagaaaattccagccggggctgtgagtgtcttcctgggagacaccgatgtctttggagctgcctctgtgcctagtatgaaggagccacagaagccagagcaaccaacacccagaaaatccccatatggccctcctcccaccgggcttttcgacgatgacgatggggacgacgacgacgacttctttagcgcacctcattctaaaccctctaaaactggcaaagtccaaagcaccgccgacatctttggcgacgaggaaggggatctgttcaaggagaaagccgtggctagtcccgaagccacagtgagccagactgatgagaataaggctagagccgaaaagaaggtgacactctctagcagtaagaacttaaaacccagcagcgaaactaagacccagaaagggcttttttctgacgaggaagattccgaggacctgttttcttcacagtcagcatcaaagctgaagggggcgtcgctgcttcccggaaagctgcccacaagcgtgtccctcttcgatgacgaggacgaagaggataatttgttcggcgggacagccgccaaaaagcaaactctctgccttcaggcacagcgggaagaaaaggccaaggcaagcgagctctcaaagaagaaagcgagcgcacttctgtttagttctgacgaggaagatcagtggaacattcctgccagtcagactcacctcgccagtgattcccggagcaagggggagcctagagatagcggcactttacaatcacaggaagcaaaggccgtcaagaagaccagcctgtttgaagaagacgaggaagatgacttattcgccattgctaaagacagccagaagaagactcagcgcgtgtccctcttgttcgaagacgatgtggactcacgagggtccttgtttggatcgccgcctacgtccgtcccacccgctacgaagaaaaaagaaaccgtcagcgaagcaccaccactgctcttctcagacgaggaggaaaaagaagcacaactgggagtgaagtccgtcgacaagaaggtggagtccgcaaaggagtcgttaaagttcggacggacggatgtggcagaatctgagaaggagggacttctcacaaggtcagcccaggaaaccgttaagcatagcgacttgttttctagttccagtccttgggacaaaggcaccaagccgcgcaccaaaaccgtactgagcctgtttgatgaggaagaggataagatggaagaccaaaacatcatacaggccccccagaaggaggtgggcaaggggcgcgacccggatgctcaccctaagagtacgggggtctttcaagatgaggaactgctattttcccataagctgcagaaagacaatgatcccgacgttgacctgttcgccggtacaaaaaagacaaaactattagaaccgagtgtggggagcctgtttggcgacgacgaagacgacgacctctttagttcagcaaagtcccagccgctggtgcaggagaagaagagggtcgttaagaaagaccactctgtcgattctttcaaaaatcagaaacatcccgagtcaatacagggttctaaagagaagggcatttggaagcccgaaactccacaagccaacctggctattaacccggccgcccttctgcctacggccgcttctcaaatctccgaagtgaaacctgttctaccagaactggcattcccatcttcggaacaccggaggagtcacgggctggaatcagtccccgtcttgcctggttctggtgaagctggagtgagttttgacttgccagctcaggcggataccttgcactcagctaacaagtctcgggtaaagatgagaggcaaaagaagaccgcagaccagggcagcccgacggcttgccgcacaggagtctagcgagaccgaggatatgtcggtgccccgcggccctattgcacaatgggccgacggggctatttccccaaatggtcacaggccgcagctccgggccgcgagtggcgaggactctacagaggaggccctcgcggcagccgccgctccttgggaaggtgggccagtccctggcgtggatagatcacccttcgccaaatcactgggtcattctagaggcgaagctgatctgttcgacagtggagatatctttagtacaggaacaggcagtcagtcagtggaaaggactaagccaaaagccaagattgctgaaaaccccgccaatcccccggtggggggtaaggccaaaagcccaatgtttccggccctcggtgaagccagcagcgatgatgatctgttccagagcgcaaagcctaaaccagctaaaaagactaatacattcccactgctggaagatgaagatgatctgtttacagatcagaaggttaaaaagaacgagactaagtcaaacagccagcaagatgtcattcttacgacgcaggacatattcgaggacgacatcttcgccactgaggctataaagccctcccaaaaaacaagagagaaagaaaagaccctggagagtaacctattcgacgacaacattgatattttcgctgacctcacagtgaagcctaaagagaagtcaaaaaaaaaagttgaagcaaagagtatttttgacgatgacatggatgacatcttctcttcagggatccaggccaagacaaccaagcctaagagtagatccgcccaggctgccccagagccccgattcgagcacaaggtgtctaacatttttgatgatcctttgaatgcctttggagggcagtag

SEQ ID NO: 42197 - DNA, 3762 bp, Artificial Sequence
  Description of Artificial Sequence: Synthetic coding sequence
atgccccggctgagcggcaagagcgtgcgggtgtacgacgaggaggtcgaagagccagtgctcaaggctgaggcagagaaaacagagcaggagaagaccagggagcagaaagaggttgacctgatacccaaagtccaagaggctgtgaactacggcttacaggtgttggactctgcatttgagcagctcgacattaaagccggcaattccgattctgaggaggatgacgccaacgggcgggtagaactgattctggagcctaaggatctgtacatcgatagacccttaccctacttaatcggatccaagctttttatggagcaggaagatgtgggtcttggcgagctctcctcagaggagggatccgtgggatccgaccgggggagtattgttgatactgaagaagaaaaagaagaggaggagtcagacgaggattttgctcatcattctgacaatgagcagaatcgccacacaactcagatgagtgatgaagaggaagatgatgacggttgtgatctgtttgcagacagcgagaaggaagaggaagacattgaggatatagaggaaaatacacgtccgaagcggtctaggccaacaagctttgccgatgagctggcggctcgcattaaaggggacgccgtcggcagggtggacgaagaacctaccacgttaccttcaggcgaggccaagcccaggaagacactcaaggaaaagaaagaaagacgcacaccaagtgatgatgaggaagataacctgttcaccccccccaagcttaccgatgaagacttctcacctttcggatccggcggcggcctgttctccggggggaagggattgtttgacgacgaggacgaggagtcagacttgttcacagaggccccacaggataggcaggcaggggccagcgtcaaggaagagagcagttcctccaaacctggcaaaaaaatccccgccggagccgtctcagtcttccttggcgacaccgatgtgttcggcgcggcgagcgtgccgtcaatgaaggaaccacaaaagccagaacagcctacccctaggaagagcccctatggccctcctcccaccggcttatttgatgacgacgatggcgacgacgacgatgatttcttctcggcaccacactccaagcctagcaagactgggaaggtccagagcaccgcggatatattcggcgacgaagaaggggatctgttcaaagaaaaggctgtggccagccctgaagccacggtgtctcagacagatgaaaacaaagcacgagcagaaaaaaaggtgactctctccagcagcaagaatctaaagccctcttccgaaacaaaaacgcagaaagggctcttttcagatgaggaggactcggaagatcttttttcatcccagtccgcttctaagctgaagggtgctagcctgcttcccgggaaactgccaacttcggtttctctgttcgacgacgaggatgaggaggacaacctctttgggggcaccgcggctaaaaagcagacactatgcttacaggcccaacgggaagagaaggccaaggcaagcgagctgagcaaaaaaaaagcctctgccctgctcttcagctccgacgaagaggaccaatggaacataccagcaagtcagacacacctggcgtccgactcaaggagcaagggggagcctcgcgactctgggacactccaatcgcaggaggcgaaagccgtgaagaaaacctctctgtttgaagaagacgaagaagacgaccttttcgcaatcgcaaaggacagccaaaagaagacacagagagtgagccttctgtttgaggacgacgtcgatagtcgcggcagcttattcgggtcacctcccacaagcgtcccccccgctacaaaaaaaaaggagactgtgtctgaggcaccaccactcctattctctgacgaagaagaaaaggaagcgcagctcggggttaaatccgtggacaagaaggtggaatctgctaaagagtcccttaaattcggcaggacagacgtcgcagagagcgagaaggaaggccttctcacacggtctgcacaggagaccgtcaaacactcagatcttttcagctctagctctccatgggataagggcaccaagcctcgtactaagacggtcctgtcactgtttgacgaggaagaggacaagatggaagaccagaacattatccaagcgccacaaaaggaggtgggcaaaggtcgtgaccctgatgcccatcccaagtccacaggcgtctttcaggacgaggaactcttgtttagccataaactgcagaaggacaacgacccagacgtcgacctgttcgctgggactaagaagacaaagctccttgagccttccgttggatcactgtttggggatgacgaggacgatgacttatttagctccgccaagtcacagccgctagttcaggaaaagaagagagtggtaaagaaagaccattccgtcgatagctttaaaaaccaaaaacatcctgagagcatacagggttcaaaagaaaaaggcatttggaaaccagagacaccacaggacagcagcggcttggcacccttcaagacaaaagaacccagcacacgtatcggaaagatacaagccaacctagcaataaatccagccgccctgctgcctactgccgcatctcagattagtgaagtgaagcccgttctccccgaattggcctttcctagcagcgaacatcgtcgctctcacggtttggaatctgtccccgtgctgccggggagtggagaggcaggcgtgagtttcgatctacctgcccaggcagacacactacattccgcaaataaaagccgcgttaaaatgcgcgggaaaaggcggcctcaaactagggctgccaggcgtctggccgcccaggagtcatccgagacagaggatatgtctgtcccaagagggccaattgctcaatgggctgatggagccatatccccgaacggccatcgcccccagcttagagcagccagcggggaggattcgactgaggaggcattggcggctgccgcagccccttgggagggcggacccgtgcccggggtcgaccgctcgccattcgccaagtccctgggccattccagaggagaggccgacctgttcgactccggggatattttcagtactggtaccggctctcagtccgttgagaggactaagcccaaggccaaaatcgcagagaatccggccaaccctcctgttgggggcaaggccaaatcccccatgttccccgcactgggcgaagcctcgtccgacgacgacctcttccagtcagcaaagccaaaaccagcgaaaaagactaataccttcccacttctggaagatgaggatgacctgttcacggatcaaaaggtcaaaaaaaatgagactaagtctaacagccagcaggatgtgatcctgacaacccaggacatatttgaggacgacatttttgcaacagaagctattaaacctagccaaaaaactagagaaaaagagaagactcttgaatccaacctcttcgatgacaatatagacatctttgccgacctgaccgtcaagcccaaagaaaaatccaaaaagaaagtagaggcgaagtccatcttcgacgatgacatggatgatattttcagttccggcattcaggcaaagactacgaagcccaagtctagatccgcccaggcggccccagaaccacgattcgagcataaggtgtctaatatcttcgatgaccctctcaacgcttttggcgggcaatag

SEQ ID NO: 42198 - DNA, 828 bp, Artificial Sequence
  Description of Artificial Sequence: Synthetic coding sequence
gagcccagcgtgggcagcctgttcggcgacgacgaggacgacgacctgttcagtagcgcaaagagtcagcctctggtccaggagaagaagagggtagttaaaaaagatcattccgtggattcctttaaaaatcagaaacaccctgagtccatccaaggtagcaaagagaaaggcatctggaaacccgaaactccacaggatagtagtggactggcccccttcaaaactaaggaaccatccacaaggattggtaaaattcaggcaaatcttgccataaatccagccgccctactgcccacggctgcaagtcaaatctccgaggttaaaccagtgcttcctgaactagcctttccctctagcgagcatcgccggagccatgggttagagagtgtcccggttttgcctggttctggagaggccggcgtgagctttgatctgccagcccaggcagacaccctacactcagcgaacaagtcacgcgttaagatgcgagggaaacgaaggccgcagacgcgagccgcaagacgcctggcagcccaggaatcttctgaaacagaagatatgtctgtgccccggggacccatcgcccagtgggccgacggcgccatctctccaaatggccaccgtccacagcttagggccgccagtggtgaggacagtacggaggaggcacttgctgcggcggccgctccctgggagggcggacccgtcccaggtgtggatcggagtccctttgccaaatcactgggacacagtaggggtgaggcagacctgtttgatagcggggatatcttctcgactggcaccggtagtcaatccgttgaatag

SEQ ID NO: 42199 - DNA, 2769 bp, Artificial Sequence
  Description of Artificial Sequence: Synthetic coding sequence
atgcggaagcggatgatgatggccgtgaccttcagcctgaccctgagaaggcggagaaaaatcttgaggacactgaagaagattctggacttgaaagaggcagatttgcacagactgcagatgagttggctacctgcttcccgcggcatgccatgggtggaatggacgcggagccgccagccctatccccaggaaaaacagaatctgggccgtcacagcaagcggcggcgtaagggagaacttttacagactatgaaacgcatcacgtactctcaccctcccctcacagacgaggacttttctccttttggctcgggaggaggtctgttttcaggcggcaagggtcttttcgacgacgaagatgaggagtctgatcttttcacggaggcacctcaggataggcaggcaggcgccagcgtgaaggaagaaagctcatccagcaagcctggaaagaagatcccggcaggagccgtgagtgtttttctgggcgacacggacgtgttcggcgcagcctcagttcccagtatgaaggaaccacagaaaccggaacagccaaccccaagaaagtccccctatggcccgcctccaactggtctgttcgacgacgacgatggcgatgatgacgacgatttcttttccgctccacatagcaagccctccaagaccggtaaagtgcagtctaccgctgatatcttcggggacgaagagggtgatctctttaaagaaaaggctgtagcctcccccgaagccacagtatcccagaccgatgaaaacaaggctagggccgagaagaaagtgacactgtctagttcaaaaaatctgaagccgagcagcgagacgaaaactcagaagggcctttttagtgacgaggaagacagcgaggacctgttctcttctcagagcgcaagcaaactcaaaggtgcttccctgctgccagggaagttgccaacatctgtttccttgttcgatgatgaggacgaggaggacaacctgttcggcgggactgccgctaaaaagcagacactgtgcctgcaagcccagagggaagagaaggcaaaagccagtgagctttcaaagaagaaagcctctgcgctcctatttagttccgacgaagaggatcaatggaatataccggcctctcagacacatctcgcctctgactcccggtctaagggggagccacgggattctgggactctacagtcacaagaggcgaaggccgtaaagaagacttcattgttcgaggaggatgaagaagacgatctctttgcaattgccaaggattcccagaagaaaacacagagggtgagcctcctgttcgaggatgatgttgatagtcgaggttctctgtttgggagccctcccacatccgtgccacctgccacgaagaaaaaagagaccgtgagtgaagccccccctttgttgttctcggacgaagaggagaaagaagcccagttgggagttaagagcgtcgacaaaaaagtcgagtccgcaaaagagagtctcaaattcggccggactgatgttgccgagagtgagaaggagggtctgctcacacgcagtgctcaggagactgtaaaacattctgatctgtttagcagttcatctccctgggacaaagggactaaaccgcgcactaagacggtgctctccctttttgacgaggaagaggacaaaatggaggatcagaacatcattcaggcacctcagaaggaagtcgggaagggccgcgatccagacgcacatccaaagtccactggagtgttccaggatgaagaactgttattctctcacaagctgcagaaagataatgatccagatgtggacctttttgccggaactaaaaagactaaacttttagagccctctgtaggttcactgttcggtgatgatgaagacgacgacctctttagtagtgctaaaagtcagcctctggtccaggaaaagaaaagagtagttaaaaaagatcattctgtcgactcatttaagaaccagaaacacccagagtcaatccaaggatccaaggaaaagggtatttggaagcctgagactcctcaggactctagtggccttgcaccctttaagacaaaagagccctcaacaaggattgggaaaattcaggctaatctggccatcaacccagccgctcttctccccactgctgcaagccagatctctgaagttaaacctgttctcccagagttagcattccccagctctgaacatcgtcggagtcatggactggaatctgtgcccgtccttcccggctcaggcgaagccggtgtctcctttgacttgcctgcgcaggccgatacactccacagtgccaataaaagcagagtcaagatgagggggaagcgtaggccccagactcgggccgccagacgacttgcggcgcaggagtccagtgaaacggaagacatgagcgtccctcgagggccgattgcacagtgggccgacggtgccatttcccccaatgggcacaggccacagctacgcgcagcgagtggcgaggatagcactgaggaggcccttgctgcagcggcggctccatgggagggtggacctgtgcccggcgtggaccgatctcctttcgccaagagtctcggacactctcgtggagaggcagatctatttgatagtggtgatattttttccaccgggacaggatcccagtctgtggaacgcactaagcccaaggcaaaatttgggaagctgtggcccccgcattgccatatcctgctgattaagttctactggaatacctag

SEQ ID NO: 42200 - DNA, 1533 bp, Artificial Sequence
  Description of Artificial Sequence: Synthetic coding sequence
atggaggaccagaacatcatccaggccccccagaaggaggtgggcaaagggagggatccagatgcccatcctaagtccactggcgtatttcaagacgaggagctgcttttttctcataaactccagaaggataatgaccctgacgtcgacttatttgcaggaacaaagaaaactaaactgcttgaacccagcgttggaagcctgttcggggatgacgaggatgatgacctattttccagcgcaaaatctcagcccctggtgcaggagaaaaagagggtcgttaagaaggaccatagcgtcgattcattcaagaatcagaaacatcccgagagcatccaggggagcaaagagaagggcatttggaagccagaaacgccccaggccaatctggccatcaacccagccgctttgctgccaaccgctgctagtcaaataagtgaggtcaaacctgtgttgcccgaactagcttttccctcctcagagcacagacgctcacacggcctcgaatccgtgcctgtgcttcctggatccggtgaagccggggtttctttcgacctgcctgctcaggctgatacactgcactccgccaacaagagtcgcgtaaaaatgcgcggcaaacgtagacctcagactcgagcagctagacggctggcagcacaagaatcatcggagaccgaagacatgtccgtgcctcggggtcctatcgcccaatgggccgacggggcgatcagtccgaatgggcaccgaccacagctgcgcgctgcctccggtgaggatagcactgaggaagcactggctgctgctgccgccccttgggagggagggccggttcccggagttgatcggtctccattcgccaaaagcctgggccactcccgcggagaagctgatctgtttgattccggggacatcttctctacaggtaccgggagtcaaagtgtggagagaacaaaacctaaagccaagattgcggaaaatccagctaacccgcccgtgggtggcaaagccaagagccctatgttcccagcactcggagaggcttcttcagatgacgatcttttccagagtgctaagccgaagccagcaaaaaagacaaacacgtttccactactagaggacgaagacgacctttttaccgaccagaaggtcaagaagaacgaaacaaagagcaactcgcagcaggacgtgatcctaactacacaggacatctttgaagacgacatcttcgctacggaagcaattaaaccttcccagaagacgagagagaaggaaaaaacccttgagtccaacctgttcgacgataacattgacatcttcgccgatcttaccgtcaagccaaaggagaagtcgaagaagaaggtcgaggcaaagtcaatctttgatgacgacatggacgacatcttttcgtctggtatacaggccaagaccaccaagcccaagtctagatctgcacaggcggcgcctgagccccggttcgagcataaagtaagtaacatctttgacgatccactcaatgcttttgggggtcagtag

SEQ ID NO: 42201 - DNA, 819 bp, Artificial Sequence
  Description of Artificial Sequence: Synthetic coding sequence
atgcagtggaacgtgccccggaccgtgagccggctggcccggcggacctgcttagagccacacaatgctggactgttcggccactgccagaacgtcaaaggcccactcctcttgtacaacgctgaatctaaggtggttttggtgcagggtccccaaaagcagtggctccacctgtcggcggctcagtgcgtggccaaggagcgtaggccgcttgacgctcatccacctcaacctggagtgctgcggcataagcagggtaagcagcacgtaagtttccgtcgggtgttctcatctagcgccaccgcccagggtacaccagaaaaaaaagaggagccggaccccttgcaggacaaatccatctcactataccagaggtttaagaagacttttcgacagtacggcaaggtgttgatacccgtgcatctgattaccagtggcgtgtggtttggcaccttctactatgctgctctaaaaggtgtcaatgttgtgccctttctggagctcatcggactccccgattccgtggtatctatcctgaaaaacagtcaatcaggcaatgccctcacggcttatgccttgttcaagatcgccacccctgcccggtacaccgttaccctgggagggacatccgtaacggtgaagtacctgagatctcacggttacatgagtacacctcctccggttaaagagtatctgcaggaccggatggaggagacaaaagaactcataacagaaaagatggaggagacgaaagataggctgaccgagaaattacaggagacaaaggaaaaagtctcattcaaaaagaaggtggagtag

SEQ ID NO: 42202 - DNA, 819 bp, Artificial Sequence
  Description of Artificial Sequence: Synthetic coding sequence
atgcagtggaacgtgccccggaccgtgagccggctggcccggcggacctgtctggaaccccacaacgcaggactcttcggccattgccagaacgtgaagggaccattgttgctctacaatgctgaatcaaaggtcgttttggtgcagggaccccagaagcagtggctgcatctgtccgccgctcagtgcgtcgctaaggaacggcgtccactggacgctcaccctcctcaaccgggcgttttgcgacacaagcaaggtaaacagcatgtgagcttcaggagagtgttctcttcatcggccaccgcacaggggactccagaaaaaaaggaagaaccggatccacttcaggataaaagcatctctctgtatcaaagatttaagaaaacttttcggcagtacggcaaagtactgattcccgttcatcttattactagtggcgtgtggttcgggactttttactatgcagccctaaagggcgtgaatgtggtgcccttcctcgagttgattggacttccagattcagtggtctctatcctgaaaaacagtcagagcgggaacgcactgaccgcctatgccctttttaagatagccacacctgcccgctacacagtgacactcggtggtacttcagtaactgtcaaatatttgcggtcacacggctacatgtccacacctccacctgtaaaagaatacttacaggaccgcatggaagaaacaaaggagctgattactgaaaaaatggaagaaacgaaagacaggttgactgaaaagctccaagagaccaaggaaaaagtcagcttcaagaaaaaggtggagtag

SEQ ID NO: 42203 - DNA, 579 bp, Artificial Sequence
  Description of Artificial Sequence: Synthetic coding sequence
atggccggcctgctggccctgctgggccccgccggccgggtgggcgctcgcgtaaggcctagagcaacctggctgctgggagcaacagctccttgcgccccaccccctctcgcgttggccttgctaccaccccggcttgatgcccgcctacttagaaccgcccgcggcgactgcagaggacatcaggatccatcccaggccacaggaaccaccggtagcagtgtctcttgcactgaggaaaagaagcagtcaaaaagccagcagctgaagaaaatttttcaggagtatggcaccgtgggtgtctcccttcatataggcatctccctgataagcttgggaatcttctatatggtagttagctcaggtgtggacatgcccgctatccttctcaagctgggattcaaggaatcattggtgcagtcgaagatggcagcaggcacctccacatttgtcgtggcttacgccatccacaagctattcgcccctgtgcgtatttccattacgctcgtatctgtgcccttgatcgtacgctactttaggaaggtgggtttctttaagccgccagcggccaaaccatag

SEQ ID NO: 42204 - DNA, 945 bp, Artificial Sequence
  Description of Artificial Sequence: Synthetic coding sequence
atgtgccccaccctgaacaacatcgtgagcagcctgcagcggaacggcatttttatcaattccctgatcgcagctctcaccattggtggccaacagttattcagctcatctacattcagctgcccgtgccaagtgggcaaaaatttctattacggcagcgcgttccttgtgatccctgcccttatcttgctggttgcaggattcgcattgcgatctcagatgtggactatcaccggcgagtattgttgcagctgtgctccaccataccggaggatcagtccgctggaatgtaagttggcctgcctaaggttcttctcaataacaggacgggccgttattgcacccttgacttggctggctgtcacgttgctgacgggcacctactacgaatgtgctgctagcgaattcgcgtccgtcgaccattacccaatgttcgataatgtctctgcatccaaaagagaagagattctcgccgggtttccttgctgtcgttccgccccgtccgatgtgatccttgtacgggatgagatagccctcctccaccgttaccagtcacagatgctcggatggatcttgatcaccctggccacaatcgctgcgctcgtctcctgttgcgtcgccaaatgttgtagcccattaacgagcctgcagcattgttactggacctcccacttacagaacgagagggagcttttcgagcaagccgcagagcagcattcacgtcttttgatgatgcaccggatcaagaagctgttcgggtttatcccaggctctgaggatgttaagcatatacgcattccctcctgtcaagattggaaggacatcagtgtgcctaccctgctgtgcatgggtgatgacctccagggccactactcctttctaggaaatcgagtggatgaggacaacgaagaggacaggtctagaggcatcgagctgaaaccttag

SEQ ID NO: 42205 - DNA, 387 bp, Artificial Sequence
  Description of Artificial Sequence: Synthetic coding sequence
atgctgggctggatcctgatcaccctggccaccatcgccgccctggtgtcctgctgcgtggccaagtgctgctctcccctgacctccctgcaacattgctattggacatcccacctgcaaaacgaaagagagttgttcgaacaggcagccgagcagcactctcggctgctgatgatgcatcggatcaagaagctattcgggtttattcctgggtccgaagatgtgaaacacatcaggatcccttcttgccaggactggaaagatatctctgtgccaactctgttgtgcatgggagacgatctccagggccattacagcttcctcgggaatagggtcgatgaggacaacgaggaggaccgcagtcgcggcatagagttaaaaccatag

SEQ ID NO: 42206 - DNA, 516 bp, Artificial Sequence
  Description of Artificial Sequence: Synthetic coding sequence
atgttcgacaacgtgagcgccagcaagcgggaggagatcctggccggctttccctgttgccgaagtgccccttccgatgtcattttagtaagggacgaaatcgctctgctgcacaggtaccagtcccagatgctggggtggattctgattacgctcgctacgatcgccgccctggtttcgtgttgtgtcgctaaatgctgtagccctctgacatctctccaacactgttactggacaagccatcttcagaacgagagagagctgtttgaacaagcagcagaacagcacagcaggctcctgatgatgcaccgaatcaaaaagctatttgggtttataccagggtcagaggatgtcaagcacattcgcattccttcttgtcaggactggaaggacatctccgtgccaaccctgctctgcatgggcgacgatttgcaagggcattactcgtttcttggtaatcgagtcgatgaggacaacgaggaagaccgatcccgtggtatcgaactgaagccttag

SEQ ID NO: 42207 - DNA, 513 bp, Artificial Sequence
  Description of Artificial Sequence: Synthetic coding sequence
atggccccccggagcgccaaggagaccttccggatcaaccccaacgtagctgccaatctcagcgccccatctgatgtgatactggtccgcgatgagattgcactgctccacagataccagagccaaatgcttggatggatactcattacactggccacaattgcggccctggtgtcgtgctgcgtcgctaagtgctgcagcccccttacgtcactccagcattgttattggacaagtcacctgcagaatgagcgggaattattcgaacaggccgctgaacagcatagcaggctcctgatgatgcacaggataaaaaagctctttgggttcattcctggctccgaggacgtgaagcatataagaattccttcatgccaagattggaaagacattagtgttcctacactgctctgcatgggcgatgatctccaggggcactatagctttttgggcaaccgcgtggacgaggacaacgaggaagaccgttcccgtggtattgagctgaagccctag

SEQ ID NO: 42208 - DNA, 372 bp, Artificial Sequence
  Description of Artificial Sequence: Synthetic coding sequence
atgctgggctggatcctgatcaccctggccaccatcgccgccctggtgagctgttgcgtcgctaaatgctgttcgccacttactagcctgcagcactgctactggacatcacatctccagaacgagagggagctgttcgagcaggcagccgagcagcactctcgcctgttgatgatgcacaggataaaaaaattgttcggcttcattccggggtccgaggatgtgaagcatatcaggattccgtcgtgccaggattggaaggacatttcagtcccaaccttactatgcatgggcgacgacctccagggacactacagtttcctggggaaccgagttgatgaggacaacgaggaggaccgcagcaggggctag

SEQ ID NO: 42209 - DNA, 930 bp, Artificial Sequence
  Description of Artificial Sequence: Synthetic coding sequence
atggacgccttccagggcatcctgaagttcttcctgaaccagaagaccgtcattggctacagcttcatggctctcctgacagtgggtagtgaacggctgttctcggtcgtggcattcaagtgtccctgtagtactgagaacatgacctatggcctcgtgttcctgttcgcacccgcttgggtacttctcattctcggtttttttttgaacaatagatcctggcggttatttacagggtgctgcgtaaatcctcggaagatatttcctagggggcactcatgccggtttttctacgtgctcggtcaaattactctgagttcactggttgccccggtaatgtggctgagcgtggccttgcttaatggtaccttttatgaatgcgccatgtcaggaacacgaagttctggtctgttagaactgatctgtaaggggaaacctaaggaatgttgggaggaattacataaagtcagctgcgggaagacaagcatgcttccaactgtgaatgaggagttaaaactgagtctgcaagcccaaagtcaaatcttaggctggtgtcttatttgtagtgcctccttcttcagtttgctgacaacctgttatgctagatgtcgctccaaggtgtcgtacctgcagctgtctttttggaaaacatacgcacaaaaggaaaaggaacagttggaaaatacattcttggattatgccaataagctgtccgagcgaaacttgaaatgcttcttcgagaacaaaagacccgatcctttccccatgcccaccttcgcagcctgggaggcggctagcgaattacactccttccatcaatctcaacagcattatagcactctccaccgtgtagtggataacggcttgcagctgagtccagaggatgacgagaccactatggttctggttggaaccgcacataacatgtag

SEQ ID NO: 42210 - DNA, 948 bp, Artificial Sequence
  Description of Artificial Sequence: Synthetic coding sequence
atggagaagttccgggccgtgctggacctgcacgtgaagcaccactctgccttaggctatgggctggttaccctgcttaccgctgggggcgagaggatcttttccgccgtggccttccagtgcccttgctcagctgcatggaacctgccatatgggttagtctttctgctcgttcccgcccttgcactgttcctcctggggtacgtgcttagcgcccgcacctggaggctgcttacgggctgctgttcctccgcgcgggcctcatgcggatcagccctgcgggggtcgctggtctgtacacagattagcgctgccgccgcactggctcccttgacctgggtggccgtcgctttgctgggaggcgccttctatgagtgcgcagctaccgggtcggccgcctttgcacagcggttgtgcctcggcagaaatcggtcatgcgccgcggaactccccctagtcccttgcaaccaggccaaagcctctgatgtgcaggacctcctgaaagatctgaaggctcagtcgcaggtactgggttggattctgattgccgtggtaatcatcatcctgctcatttttacgtccgtgacccggtgtttgagccccgtttcatttctgcagttgaagttttggaagatttatctcgaacaggagcagcaaatcctgaagagtaaagcaacagaacatgctaccgagctggccaaggaaaacattaaatgctttttcgagggaagtcatcctaaggagtacaacacaccatcaatgaaggagtggcagcagatttcgtccctctatactttcaaccccaaaggacaatactattccatgctccacaagtatgtcaacaggaaagagaaaacgcacagcatccggagcactgagggagatacagtgattccagtgctgggatttgttgatagtagcggcataaactcaacgcctgagttgtag

SEQ ID NO: 42211 - DNA, 204 bp, Artificial Sequence
  Description of Artificial Sequence: Synthetic coding sequence
atgcggaagccccaggccggcaccggcgaggccgcccgggacccctcgttgcggcctgcacggacagttctggtcggcgaccaggatgagtataccgcagcggagaataagtctcctcgcggaacactatgccctaccggcgagcagaggattcatgccagggaggatgcatgtattttctcccgccttttctccgagaagtag

SEQ ID NO: 42212 - DNA, 393 bp, Artificial Sequence
  Description of Artificial Sequence: Synthetic coding sequence
atggccgccccccccgagcccggcgagcccgaggagcggaaggccagctgtacctccctccacctgtcctactggaagagcctgaagctgctggggttcttagacgtggaaaataccccttgcgccaggcattctatcttgtacggcagcctgggctctgtggtggcagggtttggccattttcttttcacatcccggatccgacgatcctgcgatgtcggagtgggagggtttatactagtcactctgggatgctggttccattgtagatacaactacgccaagcagcggattcaagagcgcattgctagggaggaaatcaagaagaagattctctatgagggaacgcatctggaccctgagaggaaacataacggatccagtagcaactag

SEQ ID NO: 42213 - DNA, 357 bp, Artificial Sequence
  Description of Artificial Sequence: Synthetic coding sequence
atggccgccccccccgagcccggcgagcccgaggagcggaagagcctaaaactcctcggctttctcgacgttgaaaatacaccatgcgcacggcattctattctgtatggcagtctgggtagtgtcgtcgccggattcggtcatttcttgttcacgagcaggatacgccggtcttgtgatgtgggtgtgggcggatttattttagtcacgctgggatgctggtttcattgtcggtataactatgccaaacagcgcattcaagaacgtatcgctagggaggagatcaagaagaagatcctgtacgaaggaacccatttggatccggagcggaagcacaatggcagctcctcgaactag

SEQ ID NO: 42214 - DNA, 1680 bp, Artificial Sequence
  Description of Artificial Sequence: Synthetic coding sequence
atggtggagaagatcctgatccaccggatcctgaccctgttccccaacgccatcgctcgtaagctcctgttgatgctaacttttatcctgatcttctggattatctacctggcatctaaggaccacacgaaattctcattcaatttggaaaaccacatcatcctgaatcagggaaatattttcaagaaatactcccacagtgagacccctctatgtcctgccgtgagccctaaagagaccgagctccgtattaaagatattatggagaaactagaccaacagatccctcctcgaccatttacccacgtgaatactactacctccgccacacattctacagcaacgattctcaaccctcaggatacctactgtagaggagaccagctagacatcctgttagaggtaagggaccacctcgggcaccgtaaacagtatggcggtgattttcttcgcgcccggatgtactcgacagccctgatggcaggtgcctctggcaaggtgacagactttaacaatgggacctacctggtcagctttacactgttttgggagggccaggtctctcttagcctgctgctgatacacccctccgaaggcgtgtctgcgctctggagggccaggaaccaggggtgcgaccggattatcttcactggactcttcgccaaccggagctccaacgtatttaccgagtgtggactgaccctgaacacaaacgctgaactctgccagtacatggacgatagggatcaagaagcgttctattgtgttaggcctcagcacatgccatgtgaggccctgacacacatgactacaaggactcggaatatcagttatctgtcgaaggaggaatggcggctattccaccggagtaatattggagtcgagatgatgaaaaatttcacacccatcgaagtcattccgtgtaataaaagcgaaaacatcaagaaaaattgtcagattgggatgaaaacaccatttccctctggatataccctgaaaaagatgtggattaccgcattctgtaaacagataaagttcaacgagacaaaaaatattaatgactgccttgaaagaaagctcatttatctcatgggcgacagcaccctgcaccagtggatttactaccttcaaaaagccgtgaagactctaaaatatttcgatcaccatggggcaggcatctttaagacccacgtcctactggacgttgaaagacacatcctgatccagtggaagaagcatggacacccctttgtcaccaagaagctgttctctgtgaaagacgagaactacattccacgtgagatcgaccaagtcgcgggcgacaagaacactgcaattgtcatcaccctcggtcagcattttcgcccattccccatcaacatcttcatacggcgtgctatcaacatccagaaggctattgaacgcctgttcctaagatctcctgagactaaagtgatcctgaaaaccgaaaatacccgcgaaattgaacagaacgctgaaatgttttccgattttcacgggtatatccaaaatctgattatccgcgatatctttgtggacctcaatgtgggaattatcgatgcttgggatatgacaatagcgtattgcacaaacaacgcacaccctccagactatgtcatccaaaatcagattggaatgttccttaattatatctgctag

SEQ ID NO: 42215 - DNA, 1098 bp, Artificial Sequence
  Description of Artificial Sequence: Synthetic coding sequence
atggtggagaagatcctgatccaccggatcctgaccctgttccccaatgcgatcgcaagaaagctgcttctcatgcttacttttattctcatcttttggatcatctacctggctagcaaggatcacactaaattttctttcaatcttgagaatcacatcatcctgaatcagggcaacatatttaaaaagtattcacatagtgaaacaccgctgtgcccagcagtgtctcctaaagagacagaactgcggattaaagatattatggaaaagctggatcagcagatccctccccggccctttacccacgtaaacaccaccaccagcgcgactcacagcactgccaccattttgaatcctcaagatacatattgtagaggtgaccaactcgacatcttgttagaggtgcgggaccacctcggccatcgcaagcagtatgggggcgacttcctccgcgctcgcatgtacagtaccgcactcatggccggagcgtcagggaaggtaactgacttcaataatggcacatatttggtttccttcactctcttttgggaaggccaggtatcattatcactgcttctgatccaccccagtgaaggggtgtccgcgctgtggagggcaaggaatcaagggtgcgacaggattattttcaccggcctgtttgctaataggagttccaacgtgtttaccgaatgcggcctgaccctaaataccaatgccgaactttgtcagtacatggacgatagggaccaggaagcattctattgtgtgagaccacagcatatgccctgtgaagccctcacacatatgacaaccagaacacggaacattagctacctatccaaggaagagtggcgcttgttccatcgttccaacattggcgttgagatgatgaagaactttacccccatcgaagtgataccgtgccccgcactcttctatttcatattccgggatagtttgaccctgagcccaaggctggagtgcagcggcatgattagcgctcattgcaacctgtgcttacctggctcctcagactcccctgatagcgcatcgcacgtagcaggcatcacttccgtgcagcggcacacatggctctag

SEQ ID NO: 42216 - DNA, 726 bp, Artificial Sequence
  Description of Artificial Sequence: Synthetic coding sequence
tgacagaccgcccggtgccacagcggcctggtgagcagcgtgcaggctattatggccagcaccgctggctatattgtgagcacaagctgcaaacacattattgacgaccagcactggctttcttccgcctatacgcagttcgcagtcccatactttatctacgacatctatgcaatgttcctgtgccactggcacaaacatcaagtaaagggccacgggggggatgatggggccgctcgcgcaccgggctccacctgggcgatagctcggggctaccttcacaaagaatttctgatggtgttacatcatgcagccatggtacttgtgtgtttcccacttagcgtagtctggagacaggggaagggagatttcttcctgggctgtatgctgatggccgaagtgtccacgccttttgtgtgtctggggaagattcttatccagtataaacagcagcacaccctgctgcataaagttaacggagcactgatgctattaagctttctttgctgccgcgtccttctttttccatacttatattgggcttatgggcggcatgcggggttacctctccttgccgtacctctcgccattccggcacacgtcaatctgggtgccgcactgctgctggctccccagttatactggttctttctgatttgtcggggagcttgtcggctcttctggcctcgttctagacctccgcccgcatgtcaagcccaggactag

SEQ ID NO: 42217 - DNA, 825 bp, Artificial Sequence
  Description of Artificial Sequence: Synthetic coding sequence
atgctgacccccatggtggccggcggcgtggtgttccccggcctgtttctgctcagtaagaataccctgcagcgcctgccacagttgagatgggaggaagcagatgcggtgatagtatctgctcgactggtttccagcgtgcaagctatcatggcgtccactgccgggtacatagtttccaccagttgcaagcacataatcgacgaccaacactggctcagtagcgcgtatacacaatttgcggtgccctactttatctacgacatctacgctatgttcctttgccactggcataagcatcaggtcaaaggccacggcggagacgatggtgccgcgcgcgcacccggtagcacatgggctatcgctagaggttacttgcataaagagtttctgatggtgctgcatcacgccgccatggtgcttgtgtgcttccctctgtctgtggtgtggcgccaaggaaaaggggatttttttttgggttgtatgctaatggcagaagtttccacacctttcgtatgtcttgggaagatcctgatccagtataaacaacagcacaccctgcttcacaaagttaacggtgcattgatgctgttgagttttttatgctgcagggtgcttctcttcccgtacctctattgggcttacggcaggcatgcaggactacctttgttggccgtccccctcgccatccccgcccatgttaacctaggagctgcactcctcctggcaccccagctgtattggttctttctcatctgtcggggcgcctgtcgcctgttctggcccaggagtcgtcctcctcctgcatgccaggcccaggactag

SEQ ID NO: 42218 - DNA, 1287 bp, Artificial Sequence
  Description of Artificial Sequence: Synthetic coding sequence
atggcccggagcctgtgccccggcgcctggctgcggaagccctactacctccaagcgcgctttagctatgtcaggatgaaatacctcttcttcagctggctggtggtcttcgtgggatcctggatcatctacgtccagtacagcacttacaccgagctatgtagaggtaaagattgtaagaagattatctgtgataaatacaaaaccggggttatcgacggacctgcatgtaatagcttgtgcgtaaccgagaccttgtacttcggaaagtgcctgtccaccaagccgaacaatcagatgtacctgggcatatgggacaacctacccggcgtagttaagtgtcagatggagcaggccctacacttagactttggcacagagctggagcctcgaaaggagatcgtgcttttcgataaacctacccgtggcaccaccgtgcagaagttcaaggagatggtgtattccctgtttaaggccaagcttggcgatcagggcaacttgagcgagttggtaaatctgattctaacagtggccgacggcgacaaggatgggcaggtgtctttgggcgaggcaaaatcagcctgggccctgctgcagttgaacgagtttttactgatggttatcttgcaggataaggaacatacccccaagctgatgggcttttgtggcgacctgtatgtcatggaatccgtggaatacacgtctttatacggcatctcgttaccatgggtgattgagctgtttatcccctctggtttccggaggtcaatggaccagctgttcactccttcctggccacgtaaggccaagattgccattgggctgctggaatttgtggaggacgtttttcatgggccatacggcaacttcctcatgtgcgatacctctgccaagaacctcggctacaacgataagtatgatctcaaaatggtggacatgcgaaagattgtgccagagacaaacctgaaagagctcatcaaagaccgacactgcgagtcagacctggattgcgtgtacggcactgactgtcgaacatcgtgcgatcagtccaccatgaagtgtacgtcagaagtgattcagccaaacttggcaaaagcttgtcagcttctaaaagattacctgctgaggggcgccccaagcgaaatccgcgaggagctggagaagcagctgtatagctgcattgctctaaaagtgaccgccaaccagatggaaatggagcacagcttgatactgaacaatctgaaaacacttttatggaagaagatttcttacacgaatgatagttag

SEQ ID NO: 42219 - DNA, 489 bp, Artificial Sequence
  Description of Artificial Sequence: Synthetic coding sequence
atggcccggagcctgtgccccggcgcctggctgcggaagccctactatctacaagcccgattttcgtacgtgcgaatgaagtatttgttcttcagttggctggtcgttttcgtggggagctggattatctacgtgcaatactccacttacacggagctgtgtcgtggcaaggactgtaaaaagatcatttgtgacaagtacaaaaccggggtcatcgacggtcctgcctgtaactctctctgtgtgacagagacactatacttcgggaaatgtctctctacgaaacctaacaaccagatgtatctcggtatttgggacaatctgccaggggttgtgaaatgtcaaatggagcaggccctgcacctcgatttcggcacagagctggagcctcgcaaagaaatcgtactgttcgataagcctactcggggtactaccgtccagaagtttaaagaaatggtatactcactgttcaaagaccggcatagatag

SEQ ID NO: 42220 - DNA, 1035 bp, Artificial Sequence
  Description of Artificial Sequence: Synthetic coding sequence
atggtggagtggcggacctgcctgagcgtggcccccggccagcaggtgtattctgggttgtggcgcgacaaagatgttactattaaatgtggaatcgaagagactctggactcaaaagctagatccgatgccgctcccaggagggagctggtactctttgataagccaacacgcggaacaagtattaaggagtttcgggaaatgacgctctccttcttaaaagccaacttgggagatctcccatctctgcccgctctggtcgggcaagtgcttctgatggcagattttaataaggataacagggtgtctcttgccgaggccaaaagtgtctgggctcttcttcagaggaacgaatttctgctcttactgtccttgcaggaaaaggaacatgcttcacgcctcctgggttattgcggagacctctacctgacagaaggtgtgccacatggcgcatggcacgcagccgcccttccaccgctgctccgacctctccttcctcctgctctgcagggagcattacaacagtggctgggtcctgcttggccatggcgggcgaaaatcgcaattggcttgcttgaattcgtcgaggaacttttccacggtagttacggcaccttttacatgtgcgagactacattggccaacgtgggctacaccgccacttacgatttcaaaatggcagatctgcaacaggtagctcccgaagctactgttcggagattcctgcagggacgccgctgtgaacactcaaccgattgtacttatggacgggattgccgcgctccctgcgaccggctgatgcggcaatgcaagggtgaccttattcaacctaatttagccaaggtgtgtgccttgttgagggggtacctgctgccaggtgctcctgccgacctgcgggaagaactcgggactcagctgaggacctgtactactctttcaggcctggctagccaggtggaggcccaccactcccttgtcctgtctcacttaaaaactttactctggaaaaagatcagtaatacaaagtattcctag

SEQ ID NO: 42221 - DNA, 1296 bp, Artificial Sequence
  Description of Artificial Sequence: Synthetic coding sequence
atgcggcggctgcggcggctggcccacctggtgctgttctgccccttctccaaacgcctccagggacggctgcccggcctgagggtgcggtgcatcttcctcgcctggctgggggtgtttgcggggagctggctggtctacgtacactactcctcatactccgaaaggtgcagaggacacgtttgccaagtcgtaatttgtgaccagtaccgcaaggggatcataagcgggtcagtgtgccaggacctgtgtgaactgcatatggtggagtggcggacatgcctttcagtggcccccggtcagcaggtgtattcggggctctggcgcgacaaagacgtcacgattaaatgcggaattgaagaaacgctggactctaaggccaggtccgacgctgcccccaggagagaactggtgttattcgacaagcctactcgcggtacctcaattaaggaatttagggaaatgacgttatccttcctgaaggccaatctgggggatctgccatctctcccagcattggtggggcaggtgttgctgatggcagactttaacaaagacaatcgcgtgtctttggccgaggctaagagtgtctgggccctattgcagcgaaatgaattcctcctgctgctgtccctgcaggaaaaagaacatgcgtcaaggcttttgggctactgcggtgatttgtatctgaccgaaggcgtaccacacggtgcctggcacgctgctgccctccctcccctcctgcggccattactgccgcctgccctgcagggcgccctgcaacaatggctgggccctgcctggccttggcgggcaaaaattgccatcgggttgctggagttcgtggaggaactttttcacgggagctatggaacattttacatgtgtgaaactactctggccaacgtgggttacacagcaacttacgatttcaagatggcagatctccagcaggtggctcccgaggccactgtgagacggtttcttcagggacggagatgtgaacattcaacagattgcacgtacggacgtgactgtcgcgccccatgcgacaggcttatgcgacagtgtaagggcgaccttatccaaccgaacctcgccaaggtctgcgctctgctgcggggctaccttctacccggggcccctgccgacctaagagaagagctgggcactcaactccggacctgcaccactctctccgggctcgcgtcgcaggtggaggctcatcattctttggttttgtcccatctcaagaccctcctgtggaagaagatctctaacacaaaatatagctag

SEQ ID NO: 42222 - DNA, 1260 bp, Artificial Sequence
  Description of Artificial Sequence: Synthetic coding sequence
atggcccgggccgccggcgcccggggccccgccggctggtgccggcggagaggtcggtgcggcaggggcacactgttagcctttgccgcttggacagccggatgggtcctcgctgctgctctgcttctgagggctcaccctggtgtcttgagcgagcgatgcactgacgaaaaaagtcgcaggatccttgctgccctgtgccaagattaccagggaggcactctggcaggtgacctttgcgaagacttatgcgtcgcaggtgagcttcttttccagcggtgcctgcattacaatcggggcaagaaggtactccaagcggactggaggggccgcccggtagtactcaagtccaaggaagaagctttctccagtttccctcctctaagcctcctcgaggaagaggctggcgagggcggccaggatatgcccgaagctgagttgctgttaatggtagcaggggaagtgaagtcagcgctagggctcgaactgagcaacagtagtctcggaccctggtggcctggaaggaggggccctaggtggagggggcaactggctagcttatgggcactcctccagcaagaggagtatgtgtactttagcctgcttcaggatctgtcccctcatgtcctgcctgtactcgggtcttgtggacacttctatgcggtcgagtttttagctgcaggaagcccacatcatagagccctgtttccactcgatagagcgcctggtgcccccgggggaggtcaagcaaaggccataagcgacatagctctgtcatttcttgacatggtgaaccacttcgactcagacttcagccacaggctgcatttgtgtgacattaaaccggagaattttgcgatcaggtccgatttcacagttgttgccattgatgttgatatggccttttttgagccgaagatgcgcgaaatccttgagcagaactgcaccggcgacgaagattgcaacttcttcgactgcttttccaggtgtgatctgcgggtgaataaatgcggcgcccagagagtaaacaacaatctccaagtgatctgcgataagatctttcgacattggttttcagctcctctaaagtcctctgcggtaagctttcaactgcagttgcagttacaggaggccgttcaggagtgcgccgaccctggtgtcccaagtggcaacacccgccgggccgccagctcagtcttctggaaactgagacagctattgcaggccaccctccgggagctgcaagaagcggaaaaatag

SEQ ID NO: 42223 - DNA, 1050 bp, Artificial Sequence
  Description of Artificial Sequence: Synthetic coding sequence
atgcaccagagcctgacccagcagcggagcagcgacatgagcctgccagacagtatgggggctttcaatagacgcaagcggaattcgatttacgtgaccgtgacactgctgatagttagcgtcttgattcttacagttggcctcgccgcaactactagaacccaaaatgtcactgtaggggggtactatccaggagttatcttggggtttggctcatttttgggcatcattggctcaaacctaattgaaaacaagcggcaaatgctggtagcatcgattgtcttcatctctttcggcgtgattgccgcattttgctgtgccatcgtggatggcgtctttgctgccagacatatcgacttgaaacccctgtatgcgaatagatgtcattatgtgccgaagacgtctcagaaagaggctgaggaggtgatttcgtctagcacaaagaatagtcccagtactcgggtgatgcgtaatctgacccaggcggcccgcgaagttaattgcccgcacttaagccgcgaattctgcaccccacgtattagggggaatacctgcttttgctgtgatctgtacaactgtggcaatcgcgtcgaaatcacaggcggctattacgagtacattgacgtgtcatcatgccaggatatcatccacctctaccatctgttgtggtctgccaccatcctgaatatcgtagggctgtttctgggcatcattacagccgctgtgctggggggtttcaaggacatgaatcccactctccccgctctcaactgctctgttgaaaacacacaccctacagtgtcgtattacgcccacccacaagttgcatcatataacacctactatcatagtccaccacatctccctccctatagcgcttacgactttcagcatagcggggttttccccagcagtccacccagtggcctgagcgatgagccacagtccgccagcccatccccttcctacatgtggagcagttccgcaccgccccggtactctcccccctattaccctccatttgagaagccccccccatactccccttag

SEQ ID NO: 42224 - DNA, 558 bp, Artificial Sequence
  Description of Artificial Sequence: Synthetic coding sequence
atggtgaactgcccccacctgagccgggagttctgcaccccccggatacggggtaatacttgcttctgttgcgatctgtacaactgtgggaaccgtgttgaaataaccggaggatactacgagtacatcgatgtgtcctcctgccaggatataatccatctctaccacctattgtggtcagctacaattttaaacatcgtcgggttgtttctgggcatcatcaccgcggccgtgctcgggggatttaaagacatgaaccccaccctgcctgctctgaactgtagcgtagaaaatacgcaccctaccgtgagctactacgctcatccccaagtggcctcctacaatacctactaccactccccaccccacttgccgccctatagcgcatacgacttccaacactccggggttttcccttcatcccctccctctggtttgtctgacgagccacaatctgcttcaccctcgcctagctatatgtggagctccagcgccccgcctcgttattcccctccctattaccctcctttcgagaagcccccaccctactcaccgtag

SEQ ID NO: 42225 - DNA, 978 bp, Artificial Sequence
  Description of Artificial Sequence: Synthetic coding sequence
atgcaccagagcctgacccagcagcggagcagcgacatgagcctgcccgactccatgggggcttttaatcgtagaaaacggaattcaatatatgtgactgtgaccctgctaatcgtcagcgtgctgatcctaaccgtgggccttgcggctaccactaggacacaaaacgtgacagtcgggggctattacccaggagtaatactcggctttggttctttcctaggcattattgggagtaatctgatagagaataagcgccaaatgctggtggcgagtatcgtgttcataagtttcggtgtaattgcagccttttgttgtgcaatcgtcgacggggtctttgcagctcggcacatagacctcaagcccctgtatgctaaccgctgtcactatgtgccaaagaccagccaaaaagaggcagaggaggtaaactgtcctcacctttcccgggaattctgtacgccgagaatacgcggcaatacctgcttttgttgcgatttgtacaactgtggcaatcgtgtggaaattaccggaggatattacgagtatattgacgtcagcagctgtcaagatattattcatttgtaccatctcctctggtcagccaccattctgaatatcgtcgggctgtttctcgggattatcacagcagcagtactggggggatttaaggatatgaaccctactctccctgcgttaaactgctccgtggaaaatacacaccctaccgtgagctattacgcacacccccaggttgcttcatacaatacatattaccatagccctccacacctgcccccctacagtgcttatgactttcagcatagcggtgtttttccgagttcccccccttcaggtttaagtgatgagcctcagagtgcatcgccatcacctagctacatgtggtcaagttctgcacctccacggtactcccctccttactaccctcccttcgaaaagccacctccttattccccatag

SEQ ID NO: 42226 - DNA, 726 bp, Artificial Sequence
  Description of Artificial Sequence: Synthetic coding sequence
atgcaccagagcctgacccagcagcggagcagcgacatgagcctgccagactccatgggcgcatttaaccgacggaaacgaaactcgatttatgtgaccgttacgttactgatcgtgtcagttctaattctaacagtggggctggcagccacaactcgtacccagaatgttacagtcggtggctattaccctggggttatcctaggttttggcagtttcctcggcatcatcgggagtaacctgattgagaataaacgccagatgctggtcgcctctattgtgtttatcagcttcggagttattgcagccttctgctgtgctattgtggatggcgtgttcgcggcccggcatatcgacctgaaacccctctacgctaaccggtgtcattacgtgccgaagacatcccagaaagaggccgaggaaaatcccacactgccagccttgaactgcagtgtggaaaatacacatcccacagtatcctactatgctcacccacaggtggcctcctacaatacctactaccatagcccgcctcacctgcctccttattcagcctacgactttcagcatagcggcgtgtttcccagcagcccgccctctggcctttccgatgaaccccagagtgcatcgcccagtccttcctatatgtggagtagtagtgcccccccccgatacagcccaccctattaccccccatttgaaaaaccacccccatacagcccatag

SEQ ID NO: 42227 - DNA, 981 bp, Artificial Sequence
  Description of Artificial Sequence: Synthetic coding sequence
atgcagccccccgtgcccggccccctgggcctgctggaccccgccgagggcctgtcccggagaaaaaaaaccagcctgtggtttgtggggtccctccttctcgtctcggtgctgattgtgactgtggggctcgccgccactaccagaacagaaaatgtgactgtggggggatattacccaggcatcattttggggttcggatccttcctgggtatcatcgggatcaatctcgtggagaacaggaggcagatgctggtagcggccatcgtctttatttcatttggggtcgttgccgccttttgctgcgctatcgtggacggcgtgttcgcggctcaacacattgagccccgtcctttaacaacaggcagatgtcagttctactcatccggagtcgggtatttgtatgacgtctatcagaccgaagtgacctgtcactctctggacggaaaatgccaactgaaggtgagatccaacacctgctactgctgtgacctttacgcatgtggctccgccgagccatcaccagcctactacgagttcatcggagtgagtgggtgccaggacgtgcttcacctctatcgattactttgggcttctgctgtgctgaatgtgctggggctttttttggggattataaccgcagctgtgcttggggcatttaaagacatggtgccgctgtctcagctcgcctatggacccgcagtgcccccccagacactgtacaacccagcccagcagatccttgcatatgcaggctttcgacttacccctgagcctgttccgacttgttccagctatcctctccccctgcagccatgtagtcgatttcccgtcgccccgtcatctgctttagcgtcctctgaggacctgcagcctccttcaccaagctctagcgggtccggactgcccgggcaagcccccccatgctatgcaccgacctatttcccacctggcgaaaagcctcccccttatgccccatag

SEQ ID NO: 42228 - DNA, 1899 bp, Artificial Sequence
  Description of Artificial Sequence: Synthetic coding sequence
atgagcgactgctgcagcgcccccggcatcagctgggaggccggcgtggggcggccggctgtccccggattggaattgcagattcgcagaggcgctatgagtgaggagactgtgagcgaatcccaattcagcttgaagaccgcagctcttagagtttttgatcttcctctgacatggtactacagcctgtcccaaatcaaattttctcctgttgccaagaagctgtttgttgttacagccgtgtcagctatctctgtcatctttctggcacatcattttaaacgtaaaaggggaaaaaagaaaggtaaaatcttgccctgggagcctgaacacctgattctggagtatacaaagcgggccgccagcgacaagggatcttcctgtagctcatccagacaaaacctcactcttagtctttcgtccaccaaggacaagggttctcaggtttgtaactacgccaacggaggcctgttcagtaaatacagcggatcagctcagagtctggcatccgtgcaatccgtcaacagttgtcacagctgtgcctgcggcaattctaattcctgggacaaggctgatgaagatgacatcaagctcgtgaatatccctgtaactacgcccgaaaatctatatctgatgggaatggaactgtttgaggaagccttgcggcgatgggaacaggctctgacctttcgcaaccgccaggcagaagatgaagcttgtggctccattaagctgggtgctggcgacgccattgcagaggagaacgtggacgacatcatctctaccgaatttatccacaagctggaagctttgctgcagagagcctatagactgcaggaggaatttgaggccacactcggtgccagtgatccgaacagtctggcagacgacatcgacaaggatacagatataacaatgaaggggaacgtagaggatttcggccttcgagacactctgtcaattgcttcaaccgattccttcgcaagcgccgcggaactggctgagcacagggaagtccgacacacctacagcctggagtctctctgtcactgcccattttacgaagaggctatgcatctggtggaggagggaaagatctactcacgggtcctcaggacagagatgctggagtgcctcggggactctgatttcctagcaaaattgcactgtatcaggcaagcctttcaagtcatcttaagcgaatcagcaaacagaattttcctggctgaaagcggtcgcaagatcctgagcgcactgatagttaaagcgaggaaaaaccctaaaaagtttgaagacgtctttgacgagatgatctattttttagaacagaccgatcactggggatcgactgaaatggagttagccgcccgcggagttaagaatcttaacttctatgatgtggtgttggacttcatcctgatggactctttcgaagacctggagaatcctcccacaagcatacagaatgtagtcaacaaccgctggctgaactccagtttcaaagaaaccgccgtagctagtagttgctggtccgtgctgaagcagaagaggcagcaaatgaaaattccggatgggtttttcgctcatttttatgctatttgcgaacatatctcacctgtgcttgcttggggtttcctagggcccagaaacagtctgtacgacctgtgttgttttttcaaaaaccaggtcctgctgtttctgaaagacattttcgatttcgagaaggtcaggtatagcagcactgagacactggccgaggacttgatgcaattgttgatacgtagaaccgagctactgatggcatatttagaggcggacgcactgcgtcacaccagcagctgccttagcagccacgggcatgtgatgtccacaggactgcttgaagcaaaagtgcagtag

SEQ ID NO: 42229 - DNA, 1788 bp, Artificial Sequence
  Description of Artificial Sequence: Synthetic coding sequence
atgagcgactgctgcagcgcccccggcatcagctgggaggccggcgttggcaggcccgccgtgccaggattggagctgcagatcaagttctcacctgtggcaaaaaagctgtttgtggtgacagctgtcagcgcaatcagcgtcattttcctggcacaccatttcaaacggaagcgcggcaaaaagaagggcaaaatcctaccctgggaacccgaacacttaatacttgaatacaccaaaagagcagcctcagataaggggagttcttgttcctcatcaaggcaaaatctaactctgtcactgtctagcacaaaggataaaggcagccaggtttgcaattacgccaacggggggcttttctccaagtatagtgggtcagcccagagtctggcttccgtacagtccgttaattcctgccactcgtgcgcctgtggcaattcgaacagttgggataaagccgacgaagacgatataaagctcgtgaatattccagtcacaacacctgaaaacctgtacctaatggggatggagctgtttgaggaagccctaagaagatgggagcaggcgctgactttccgcaatcgtcaggccgaggatgaagcctgtggatccatcaaattaggcgcgggtgatgcaatcgcggaagaaaacgtcgatgacatcatctcgacggaattcattcacaaactggaagccctcctgcagagagcttaccgccttcaagaagagtttgaggctacattgggtgccagcgatcccaatagtcttgccgatgatatagacaaggacacagatataactatgaaaggaaatgttgaggactttggactacgtgataccctctcaattgccagtacagacagctttgcgtccgctgcagaactcgccgaacatcgagaggtacgtcacacatacagccttgagagtctctgtcattgccctttctatgaggaagccatgcatttagttgaggaggggaagatttattcaagagtgttacgaacagagatgctcgagtgtttgggagactctgatttcctggccaagctgcactgtattcgacaggcattccaggtgatactgagcgaatctgcaaatcgcatcttccttgccgagtctggtagaaaaatattaagtgctctaatcgttaaagcgcgcaagaatcctaaaaagttcgaggatgttttcgacgagatgatctatttcttagagcaaactgatcattggggatctacagagatggagctggccgctaggggcgtcaaaaacctcaacttttatgacgtcgtcttggactttattctgatggattcatttgaagaccttgagaatcctcccacatctattcaaaacgtggtcaacaatcggtggctgaattcctcgttcaaggaaacggcggtggcatcgagctgttggtccgttttgaaacagaagcggcagcagatgaagcagatccccgacggcttcttcgcccatttctacgcaatatgcgagcacatatcccccgtactggcctggggctttctggggcctcggaattctctttacgatctctgctgcttttttaaaaatcaggttctgctctttctcaaggatatcttcgacttcgagaaagtacgctacagcagcacagagactctggccgaggacttaatgcagttgctgatcagacggacggagttactgatggcttacctcgaggccgatgccctccgccacaccagctcgtgcctgagctctcacggacacgttatgtccaccggactgctggaagccaaggtacagtag

SEQ ID NO: 42230 - DNA, 972 bp, Artificial Sequence
  Description of Artificial Sequence: Synthetic coding sequence
atggccttccggcgggccgagggcaccagcatgatccaggccctggcaatgaccgtcgccgagatccctgtcttcttgtatacgacttttgggcagtcagccttctctcagttgagattaacccccggcctgaggaaagtcttattcgcgactgccctcggaacggtggccctagctcttgccgcccaccagctcaagcgtcgccgaagacgcaaaaaacaggtgggccccgaaatgggcggtgagcagctcggaactgtgcctctaccaattctgctcgcgcggaaagtccccagcgtgaaaaaaggttactcgagtcgaagggtacaatctccgtcatccaagtctaacgacacattgtccggcatttctagcattgagccatccaagcattccggaagctcccattcagttgccagcatgatggcagtgaatagctcaagccctactgcagcttgctccggcctgtgggatgccagaggaatggaagaatccttaacaacttctgacgggaatgcggagtctctgtatatgcaggggatggagctcttcgaagaggcccttcagaagtgggaacaagctctgagcgtcggccagcgcggtgactcaggctctacacctatgccgagagatgggctgaggaaccctgagactgctagtgagccactgtccgagaccgaaagccattctgttgcccgtctcgagtgttccggagctataagcgcccaatgcaacctaagatttctgggatcgcgagatagtcccgcctcagccagtcaggttgccggcatcaccgctcgggtgaccgccgagggcgtttgtcgggaggctggagtgcccgctgccccatgcttgccgcccgcaggcggagtccgcctacatctgccccgtagacagcatgccgctcggcctagagaggaccctcacgcagcaccagatcgagggctggcagcagctgctggcgggcggtag

SEQ ID NO: 42231 - DNA, 1782 bp, Artificial Sequence
  Description of Artificial Sequence: Synthetic coding sequence
atggccttccggcgggccgagggcaccagcatgatccaggccctggccatgaccgtggctgaaattcccgtgttcctgtatactacatttggccaaagcgccttttctcagttgcgcctcacaccaggccttcggaaagtgctgttcgcaaccgctcttggcacagttgctctggcattggcagcccaccaacttaagaggaggcgacgccggaagaagcaggtgggtccggagatgggcggcgaacagcttggtactgtgcctttgccaattctgttggcacgaaaggttccttcagtgaagaaggggtacagttctcgaagggttcaaagcccttccagtaaaagcaatgacacactgtccgggattagttccatcgagccttctaaacatagtggttccagccattcggtggccagcatgatggctgtaaattcttcctcccctaccgccgcatgcagcggtttatgggacgcacgcgggatggaggaaagtctgaccaccagtgacggtaacgccgaatcactgtatatgcaggggatggaactatttgaagaggcccttcagaagtgggaacaggctctgtctgtgggtcaacgaggtgactccgggtctaccccgatgcctcgcgacggactaagaaaccctgagacagctagtgagcccctgtccgagcccgaatcacaaagaaaggaatttgcagagaaacttgaatcgctgttacatagagcttaccacctgcaggaggaattcggatctacctttcctgccgattcgatgctcctagatttggagaggacgcttatgctcccactcaccgagggctccctccggctgcgcgccgatgacgaagattcactcacgtctgaggacagcttttttagcgcgactgaattgtttgaaagcctgcagacgggcgattacccgataccgctctcacgtccagccgccgcttatgaggaggcccttcagctggtcaaagagggccgggtcccgtgccgaactcttcgcactgaattgcttgggtgctactctgatcaggatttcttagctaaactgcattgcgtccgccaggcctttgagggcttactggaggataaatccaatcagctgttctttggaaaggtggggcgtcaaatggttaccggactcatgactaaagccgagaagtcgcccaaaggattcctcgagtcatacgaggagatgctctcctacgctctgaggcccgagacatgggccaccacccggctcgagctggaagggcggggcgtggtctgtatgagcttcttcgacatcgtgctggacttcatcctgatggatgcgtttgaggacctggaaaaccctcctgcttccgtcttagcagttttgcggaacaggtggttgagtgacagcttcaaggagactgcgctggccacggcttgctggtcagttctcaaggcaaagcgccgccttctgatggtgcctgatgggttcataagccatttttattccgtctccgagcacgtgtccccagtattggcattcggctttctgggcccaaagccacagcttgctgaggtctgcgcctttttcaagcaccagattgtgcagtatctccgggatatgtttgacctggacaatgtgcggtatacttcgctccctgcactcgctgacgacatactccagctaagtagaaggcgttcagagattctcctggggtatctgggtgtacccgctgcaagttcagccggggttaacggggctctgccccgcgagaacggaccgctaggggaactgcaatag

SEQ ID NO: 42232 - DNA, 1050 bp, Artificial Sequence
  Description of Artificial Sequence: Synthetic coding sequence
atggccttccggcgggccgagggcaccagcatgatccaggccctggcaatgacagtcgccgagattccagtgttcttatatactacattcgggcagtcagccttttcacagctacggttgactccaggcttaaggaaagtcctcttcgctaccgcattggggacggtggccttggcactcgccgcccaccagcttaagcgcaggcgtcggcgaaagaagcaggtgggacccgaaatggggggtgaacagttagggactgttcctctcccaatccttcttgctcgaaaggtgccctccgtgaaaaagggctattcgtcgagaagggtacagtcaccttcctccaagtctaacgacaccttatcaggaattagcagcatcgagccaagcaaacactcaggatcaagtcattctgtggcatccatgatggctgtaaattcctctagcccaaccgctgcatgctcagggctttgggacgccaggggcatggaagagtcactgaccacatcagatggcaatgctgagtcgctgtacatgcaaggcatggagctgttcgaggaggccttgcaaaagtgggagcaggccctgtcagtgggtcagaggggagattcaggttctacccctatgccccgggacggactccggaacccagaaactgccagtgagccactcagcgagcccgaatcacagagaaaagaatttgcagaaaaactcgagagtttgctgcatcgtgcttaccatctgcaggaggaattcggcagtaccttccctgcagactctatgttgctggatttagagagaacactgatgctcccattgaccgaaggttccctaaggctccgggctgacgacgaagacagccttacttctgaggattccttcttctctgcaacggagttgtttgaaagcctacaaacgggggattatcccattccattgtccagaccagctgcagcctatgaagaagctctccaactcgtaaaagagggccgagtgccatgtcggactctgcgtgccccaaaggcttcctggcgggctactagacgatgctag

SEQ ID NO: 42233 - DNA, 303 bp, Artificial Sequence
  Description of Artificial Sequence: Synthetic coding sequence
atggccttccggcgggccgagggcaccagcatgatccaggccctggcaatgaccgtggccgaaattccggtcttcctgtacacaacatttggacagtcagcttttagccagctacgcctgacccccggtttgcgcaaggtgttgttcgcgactgctctggggacagtcgcactggcacttgcagcccaccagctgaaacgacgcaggcgccgtaagaagcaggtgggtccggaaatgggcggcgaacaactggggactgttcctctccccatcctgctggcccgcaaagttcccagcgtgtag

SEQ ID NO: 42234 - DNA, 384 bp, Artificial Sequence
  Description of Artificial Sequence: Synthetic coding sequence
atgtggcgggagctgcggggctgccccggcggcgacgtggagaccgctcagcgactgtcgcagagaagacgcggaaaaagctctgaggccgttccagaaaagacatggagagcgcagcgaatgtcacagagacggcgcggggagtcttcagaggccgtccccgagaagacatggaaagaactgagaaatagtgagaccgtgcccgaaaaaacttggaaacagctgcgcagatgcctgcaggaggatgtggaaagggtgcaacgcctgtccctgctgctgcacctggccgtgtttttatggataattatcgcgattaatttctcgaactcgggagtcaagtcccagtcctcaacctaccttccgagcgggaaaattctgaaatag

SEQ ID NO: 42235 - DNA, 384 bp, Artificial Sequence
  Description of Artificial Sequence: Synthetic coding sequence
atgtggcgggagctgcggggctgccccggcggcgacgtggagaccgcccagcgactttctcagcgaagacgaggaaaaagttccgaggctgtgcccgagaaaacatggcgagcacagcgaatgtcccagcgacggagaggcgaaagctccgaggctgtgcccgagaaaacatggaaagaattacgaaattcagagactgtgccagagaagacatggaagcagctgaggcggtgtctgcaggaggacgtcgaacgggtgcagcgcctgagcttactgctgcacttggccgtgtttctgtggatcatcatcgcaatcaacttctctaacagcggcgtgaagagtcagtcatccacgtatctgccttctggaaagatactgaaatag

SEQ ID NO: 42236 - DNA, 4044 bp, Artificial Sequence
  Description of Artificial Sequence: Synthetic coding sequence
atggagaacctgcccttccccctgaagctgctgagcgccagcagcctaaacgctccttcctctaccccatgggtgcttgacatttttttaacactggtgttcgccttgggattcttctttttgctcttgccctaccttagctacttccggtgtgacgatcctccatcccctagcccaggtaagaggaaatgcccggtaggaaggagacgtcgaccccgggggaggatgaagaatcattccttacgggctggcagggaatgccccagagggctgcaagagacaagcgatctactgagccagctgcaatcattactgggaccacatctagacaaaggcgatttcgggcagctgagcggccctgacccccccggcgaagtaggagagagggccccagacggagccagtcagagcagtcacgagcctatggaggacgctgccccgatcttgtccccactggcgagtccagatccccaggcgaaacatcctcaggaccttgcctctacaccctccccaggccctatgacaactagtgtgagcagtttatctgcatcacagccccctgagccgagtttacccctggaacacccttcacctgagccccccgccctttttccacaccctccccataccccagatccccttgcatgttcaccgcctcccccaaaggggttcactgctcctccactgcgcgattcaaccctcatcacgccgagccactgtgactctgtcgctttgcctctgggaactgtgccccaatcgctcagccctcatgaagacttagtggcttcagtgccagccatcagcggactgggcggatcaaattcacatgtgtcggcgagttctcggtggcaggaaacagctcgtactagttgcgcattcaacagcagcgtgcagcaggatcatctctcccggcacccacccgagacctaccagatggaagcaggaagtctgttcctgctatcctctgacggtcagaacgcggtgggtatccaggtaacagaaaccgcaaaagtgaacatctgggaagaaaaagagaatgtgggttcgtttaccgatcggatgaccccagaaaagcacttgaattctctgaggaacttagccaagagcctcgacgcagaacaggacacgactaaccccaaacctttttggaatatgggggagaacagcaagcagctgcccggcccccagaagctgagcgacccccgactgtggcaggagagcttttggaagaactattcccagctcttttggggactccccagtttgcactccgaaagtcttgtcgcaaatgcttgggttacagacagatcatacaccctccagagtccaccatttttgtttaatgaaatgtctaacgtgtgtcccattcaaagagaaaccaccatgtcacctctcctttttcaggctcagcctccctcccacttgggccccgagtgtcagcctttcatctctagtaccccccagtttcggccgaccccaatggctcaggccgaggctcaggcccacctccagtctagttttccggtactgtcgcctgcttttccctctctgattaaaaatactggcgtggcttgccctgcctcccagaacaaggttcaggccctgagcctgcccgagacgcagcacccagaatggcctctgctgcggcgacagttagagggccgccttgcccttcccagtagggtgcagaaaagccaggatgttttttctgtctctaccccgaatttgcctcaggaaagcttgacttcaatcttaccagagaatttccccgtaagtcccgagcttagacggcagctcgagcaacacattaagaaatggatcatacagcactggggcaatttggggcggatccaagaatccctcgatctaatgcaactcagggatgagtcgccgggaacttcgcaggcgaaaggcaaaccttcgccctggcagtcatcaatgtccacgggcgaaagcagcaaagaggcgcagaaggtaaagttccagctcgaacgagatccttgcccacatctcggccaaatcctgggcgaaactccacagaacctttcacgggacatgaaatctttccctcgcaaggtgctgggggttacgtctgaggagtctgaacgtaatctgcgcaaacccctgaggagcgatagcgggtctgacctgttacggtgcactgagcgcacccatatagaaaacatcctgaaggcccacatgggacgcaatctaggacagaccaacgaaggattgatacccgtgcgcgtcaggagatcttggctcgcggtgaaccaagcactcccggtgtccaacacacacgtgaaaacatccaatcttgccgcacccaaaagcggaaaagcatgtgtgaacacagcccaggttttaagtttcttggaaccttgtacccagcagggtcttggcgcccacatcgtgcggttctgggcaaagcacagatggggccttccactacgtgtgcttaagcccattcagtgttttaaactcgaaaaggtttcctcactcagcctcacacagctggcaggaccttcctctgctacttgtgagtcaggggctgggagcgaagtcgaggtcgatatgtttcttcggaaaccccctatggctagcctgcgtaagcaagtcctaacaaaggccagcgatcatatgcctgaaagtctactggctagtagccctgcttggaagcagttccagcgggctcctaggggtattccttcctggaatgaccacggaccattgaagccgccacctgccgggcaggaaggacggtggcctagtaagcccctgacatactcattaacaggctctacacaacagtcaaggagcctcggcgcacagagctccaaagccggagaaacacgggaggcggtgccccagtgccgggtcccgctggaaacctgtatgctggcaaacttacaggccacttctgaggacatgcacgggttcgaggcccccggtacgtccaaatccagtttacaccctcgcgtctccgtcagccaggatccaaggaagctctgtttgatggaggaggtggtaaatgagtttgaacctgggatggccacgaaatccgagacccaacctcaggtatgtgctgcagtggtgctactgcccgatggtcaggcctctgtggttccacacgcgtctgaaaatcttgtctctcaggtgcctcaggggcacctgcaatcgatgccggcgggcaacatgcgcgcctcacaggagctgcacgacttgatggcagcaagacgatcaaagctcgtgcacgaggagccccggaatcccaattgtcagggaagttgcaaaaatcagaggcctatgttccctcctattcacaaaagcgagaagtccagaaagccgaacctggaaaagcatgaagagcggctggaaggcttgcgaacaccgcaactgacacccgtaaggaagactgaggatacacatcaagatgagggggtccaattgctcccatcgaagaagcagccgcctagtgtgtcccactttggggggaatattaaacagttttttcagtggatcttcagcaagaagaaatctaagcccgcccccgtgaccgccgaatcccagaagacagtgaaaaatcgctcatgtgtgtacagtagcagtgcggaagcccaaggtctgatgactgccgtgggccagatgcttgacgagaaaatgtcgctgtgccacgcccgtcatgcctcaaaagtaaaccaacacaagcagaagtttcaggccccggtgtgtggcttcccatgcaaccacagacatctgttctattccgagcatggtaggattctctcatatgcagccagctcccagcaggcaactctgaaaagccaagggtgccctaatcgcgatcggcaaattaggaaccaacagcccttgaaatcagtgagatgcaataacgaacagtgggggctgcgccacccccagatactgcatccaaaaaaggctgtctcgccggtgtcacctctgcagcattggccaaagactagtggcgcctcaagtcatcaccatcattgcccaagacactgtctgctgtgggaaggcatctag

SEQ ID NO: 42237 - DNA, 4044 bp, Artificial Sequence
  Description of Artificial Sequence: Synthetic coding sequence
atggagaacctgcccttccccctgaagctgctgagcgccagcagcttgaacgccccgtcgtcaaccccctgggtgctagatattttcctcacattggtgttcgccctggggttctttttcttactgctcccatacctgagctactttaggtgtgacgatcctccgtctccttctcctgggaaaaggaagtgccctgttggcagacggaggcgcccacgtggtcgaatgaagaatcacagcctacgtgcaggaagggagtgtcgacgcggccttcaggagacctccgacctgctgtctcaactccagagcctgctcggaccacatttagacaagggagacttcgggcaattgtcaggacctgacccacccggtgaagtcggagagagagcacctgatggggcgtctcaatcgagccacgaacccatggaggatgctgcccccatattgtcaccgctggccagtcctgacccacaggcaaagcacccacaggatcttgccagcactccaagtcctggccccatgaccacaagcgtctccagcctgtccgctagtcagcctcccgagccctctctgccccttgagcatccttctccagagcccccagccctgtttccccaccctccacatactcccgacccactcgcatgctcacccccccccccaaaaggattcaccgcccccccactgcgggacagcactctaattaccccctcccactgcgactccgtggccttgcccttgggcacggtgccacagagcttgagtccgcacgaggatctggtcgccagcgtcccagcaatcagcggactcggaggctcaaatagccacgttagtgctagctcccggtggcaggagaccgctaggacatcctgcgcattcaatagcagcgtgcagcaagatcatctaagccgtcaccctcccgagacctaccagatggaagcaggctcccttttcctgctaagcagcgacggacagaatgctgtgggcatacaagtgactgaaaccgctaaggtgaacatttgggaagaaaaggagaatgttggaagttttacagaccgcatgacgccagagaaacatctgaactctttacgaaatttggcgaagtcactggatgcggagcaggataccaccaaccccaagccgttttggaacatgggggaaaactctaaacagctgcctggcccgcagaagttttctgatcctaggctctggcaggagagcttttggaagaattactcccagctgttttggggtctcccatctctgcacagcgagagcctcgttgccaacgcttgggtaacagaccggtcttacaccctccaatcgcctccgtttctctttaacgaaatgtctaacgtatgcccaatccaaagagagactaccatgtcccctctgctgttccaggctcagcctcccagccaccttggtcctgaatgccagcctttcattagttctacgccccagtttcggcctacgcccatggcacaggctgaagcgcaggctcatctccagtccagctttccagtgctctcccccgctttccccagtctgatcaaaaatacaggagttgcttgccccgcctcgcaaaacaaggtgcaagcgttgtccttgccagaaactcagcatccagagtggcccctgctgcgacgccagctcgagggaagactcgcacttccgagccgagtccaaaagtcccaggacgtgtttagcgtgagtacccccaatctgccacaggagtccttgacctccatcctgcccgagaattttcctgtatcccccgaattacgtcgccagctagaacagcacatcaagaaatggatcatccagcattggggcaatctaggccggattcaggaatctttagacttaatgcagctccgagatgagtctccgggtacgagccaggcaaaaggcaaaccaagtccttggcaatcgtccatgtctacgggcgagagtagcaaagaggctcaaaaggtgaagtttcagctggagagggatccgtgcccacacctggggcagatcctgggcgaaacccctcagaacctaagtcgcgatatgaagtccttccctcgtaaggttctgggagtgacttccgaggaaagtgagaggaacctgcgaaagccgttacggtccgatagcggaagcgacttgctcaggtgcaccgagcgcacacatatcgaaaatattctcaaagctcatatgggacggaacttgggacagacgaatgaaggcctgatccctgtccgagtccgtagatcctggcttgctgtgaatcaggccctgcctgtttccaatacccatgtcaagacatcaaatctggccgcacctaaaagcgggaaggcctgcgtgaacaccgcccaggttttgtctttcttagagccatgcacccaacagggactcggggctcatattgtgcggttctgggctaagcatagatgggggctccccctgcgagtccttaaacccattcaatgttttaaactagagaaggtctccagcctttccctcacacagttggccggtccttccagtgccacttgcgaaagcggcgccggcagcgaagtcgaggttgatatgtttcttagaaagccccccatggcaagcttgcgcaaacaggtcctcacaaaagctagtgatcatatgcccgagtccctgctggcctcttcaccagcatggaagcagtttcaacgcgcccccagagggatacccagctggaatgatcacggaccactcaagcccccacctgcaggccaggagggtaggtggccatcaaagcccctcacatatagtctcaccggttctacgcaacagtctcgttcgttgggcgctcagagctccaaagccggtgaaacgagggaggcagtccctcaatgccgggttcctctggagacttgtatgcttgcgaatttacaggcgacgagtgaggatatgcacggctttgaggcccccggcacctcaaagtcaagcctccaccctagagtcagtgttagccaggacccgagaaaactctgcctgatggaagaagtggttaatgaattcgaaccagggatggctactaaatccgaaactcaacctcaagtgtgcgcagccgttgtgctcctccctgatgggcaagcttctgtagtgccgcatgcttcagagaacttagtgagccaggtgccacagggacatctgcagagtatgccaacaggtaacatgcgcgcatctcaggaattgcacgatctcatggctgcgaggcgaagcaagcttgtgcacgaagaacctaggaatccaaattgtcagggctcctgtaaaagtcagcggcccatgtttcctcccatccataagagtgaaaagagtcgcaagcctaacctcgaaaagcatgaggagcggctggagggactgcgcacaccccagctcactccggtgcggaaaaccgaagatacgcaccaggatgaaggagtccagctattgccttcgaaaaagcagcctcccagcgtttcccacttcggagggaatatcaagcaattcttccagtggatatttagcaagaagaaatccaagccagcaccagtgactgccgaaagtcaaaagacagtgaaaaaccgatcctgtgtgtatagctccagtgcagaagctcagggactgatgaccgctgtggggcagatgctggatgaaaagatgtccttatgccatgcaagacacgcctcgaaggtcaatcagcacaaacagaaattccaagcccctgtgtgtggatttccatgcaaccatagacatctgttctattccgaacatggcaggatcctgtcttacgccgcgagcagtcagcaggccactctgaaaagtcaagggtgccccaatcgggataggcagattaggaaccagcaacccttgaagagcgtgcggtgtaacaacgagcagtggggtctccgccaccctcagattttgcatcccaaaaaagcggtgagtcctgtgtctccgctccaacactggcccaaaactagcggggcttcatctcatcaccaccattgccctcgacattgcctgctatgggaagggatctag

SEQ ID NO: 42238 - DNA, 4044 bp, Artificial Sequence
  Description of Artificial Sequence: Synthetic coding sequence
atggagaacctgcccttccccctgaagctgctgagcgccagcagcctcaatgcgcctagctctaccccttgggtccttgacatattccttaccttagtgtttgctctgggttttttcttcctgttgttgccctatctctcctatttccggtgcgacgaccctccgagtccaagcccgggcaagcggaaatgcccggtgggacgtcgccgtcgcccacggggtagaatgaagaatcactctctcagagccggccgtgaatgcagacgcggactggaggagacaagcgacctgctgtctcaactgcagagtctcctagggccgcacctggacaagggagacttcgggcagctgagcggacccgatccaccaggcgaggtgggggaacgggcccccgatggcgcaagtcaatcctcccacgaacccatggaagacgccgcccctatcctgtctctactcgcctctcccgacccgcaggccaagcacccacaggacctggcctcaaccccttctcccggtcctatgaccacctctgtatcaagtctgtccgcttctcagccccccgaaccatcactgcccctcgagcaccccagtccagaaccacccgctttgttccctcaccccccccacactcctgacccacttgcttgtagcttgccccctcccaagggttttacggccccacctctgcgggattctacacttatcaccccctcacattgcgacagcgtagcactgcctttggggacagtgccacaatctctttccccccatgaagatctggtcgcatctgtgccagctatctccgggctaggggggtccaactcacacgtatcggccagctctcggtggcaagagaccgcacgcaccagctgcgcgtttaacagttcagtgcagcaggaccacctgtcccggcacccacccgagacgtgccagatggaagcgggaagtctctttctgctaagcagcgacgggcagaacgtcgttggaattcaagtgacagagacagcaaaagtgaatatatgggaagagaaagagaacgtcggatcctttacgaatcgcatgacccctgaaaagcacctgaattcgctgaggaatttagcaaagtccctcgacgccgagcaagatactacaaacccaaagcctttctggaatatgggcgagaactcaaaacaactgcccggcccccagaaactctccgaccctcgtctttggcaggagtcattctggaaaaactattcacagctgttctgggggctgcctagtctccacagcgagtcccttgtggctaacgcctgggtcaccgatagatcctatacactgcagtccccaccattcctgttcaatgaaatgtctaacgtgtgcccaatccagcgtgagacaacgatgagcccactccttttccaggcccagcctctctctcacctgggtcctgagtgccagccattcattagctccacccctcaattcaggccaacccctatggctcaggccgaagctcaggctcacctgcagtcttcttttcctgtgctgtcgcccgcattccccagtctcatccaaaatacaggcgttgcctgccctgcgagccagaacaaagtgcaggcactgtctctgcctgagacgcagcatcccgaatggcctctcttaaggagacagcttgaaggccgtctagcactgcctagcagagttcaaaagtcacaggacgttttctccgtgagcacccccaatcttccccaagagtccctcactagcatcctccccgagaatttccctgtctctcccgaactgcgccgacagcttgaacaacacatcaagaaatggattatccagcactggggcaacttaggtcgcatacaggagtctctagacctcatgcagttacaagacgagtcaccaggcacctctcaggccaaaggaaaaccctctccttggcagagtagtatgtccactggagaaagctctaaagaagcccagaaagtgaagttccaattggagagggatccttgcccccacttgggccagattttgggagaaactccacaaaatctgtcccgtgacatgaaatccttcccaagaaaggttttgggcgtgaccagcgaggagctggaacgaaatttgagaaagcccttgagatcagactccggctctgatctcttgagatgcaccgaaagaacccacatcgagaatatactgaaggcgcacatggggcgcaatctgggtcaaacaaacgaaggccttattcctgtgcgggttcggagatcttggctcgccgtgaaccaagcgctgcccgtctctaatacccatgtgaaaacatcaaacctggctgcacccaaatccggaaaggcttgtgttaataccgctcaggtactctcctttcttgagccatgcacccagcagggcctcggcgcccacattgtccgattctgggctaagcatcgttgggggcttcctctgcgcgtgctaaagcctatccagtgcttcaaattagagaaggtttcgtctctctcgttaacgcagcttgctggaccatcatctgctacttgtgaatccggcgccggcagcgaagtcgaagtggacatgttccttagaaaaccacccatggccagcctgaggaagcaagtgctgaccaaagcctctgatcacatgccagagagccttctggcctctagtccagcctggaagcaattccagcgcgcacctaggggcatcccctcgtggaacgaccatgagcctctcaagcctccacctgccgggcaggaaggacgctggccctccaagccccttacttactccttgaccgggtcgactcagcagagccgctcccttggagcccaaagctctaaagccggcgagacccgtgaggccgttccgcagtgccgggtgccgttggagacctgcatgttggccaacctacaggccacttccgaggatgtgcacggattcgaagctcctggaacatccaagtcctccctgcatcctcgggtgtccgtatcccaggatcccagaaaactgtgcctgatggaggaagttgtgagtgaatttgaacccggcatggcaacgaagtcagagacacaaccccaggtttgtgccgctgttgtgttacttccagacgggcaagcctctgtggtaccccatgcaagcgagaatttagtgagccaggtacctcaaggacatctgcagtccatgcctacaggcaacatgcgggccagtcaagagttgcacgatctgatggcagcccgccgcagtaagcttgtacatgaagagcctcggaaaccgaattgtcagggatcttgtaagagccaacgtcctatgtttccacctatccataagagcgaaaagttcagaaagccaaacctcgagaagcatgaggagcgccttgagggactgcgtaccccccaactaactccggttaggaagactgaggacacacatcaggatgagggagtgcaactgcttccaagcaagaaacagccaccttccgtctccccatttggggagaatattaagcagattttccagtggattttttcaaagaagaaatccaaacccgctcccgtgaccgctgagagccagaaaaccgtcaagaaccgcagctgcgtttacagcagctctgccgaggcacaggggctaatgaccgctgttgggcagatgttggatgagaaaatgtctctatgccacgcaagacacgctagcaaggtgaaccagcataaacagaagtttcaggccccggtgtgtggctttccatgcaaccaccgccacctgttttactcagaacatggaaggattctgtcgtatgcggcctcatcacaacaggccactctgaaaagtcaaggatgtcccaacagggatcggcagatcagaaaccagcagcctctgaagtcagtgcgatgtaataatgaacaatggggactcaggcacccacagatcctgcatccaaagaaagcagtttccccagtcagccccccccaacattggcccaagaccagcggagcgagttcacatcatcatcactgcccgcgacactgtcttttatgggaggggatttag

SEQ ID NO: 42239 - DNA, 4074 bp, Artificial Sequence
  Description of Artificial Sequence: Synthetic coding sequence
tgactgctggagagcaacgcccccatccacatggagaacctgcccttccccctgaaactcctgtcagccagctccctcaatgctccctcctcgacaccttgggtcctggacatctttctgaccctggtgttcgccctggggtttttcttcgtcctgctgccttatttgtcctatttccggtgtgacgaccctcccagtccgtcaccgggcaagcgtaaatgcccagtggggcgtcgcagaaggcccaggggaagaatgaagaatcacagcttacgggccgggagagagtgcaggaggggactcgaagaaaccagtgatttgttgtcacagctgcaaagcctgcttggacctcatcttgataagggggattttggacagctgagcgggcctgaccctcccggcgaggttggagagcgcgccccagacggtgcaagtcagagctcacacgagcctatggaagacgcggcccccattttgagccccctggccagtcccgaccctcaggcaaagcatccgcaggatctagcttctacaccctcacccggccccatgacaaccagcgttagcagcttaagtgcctcacagccccccgagcctagcctgccactggagcatcccagtcccgagcctcctgcactgtttccacaccctccgcacacccccgaccctctcgcttgcagcttgccaccaccaaagggatttaccgccccgccattgcgagactcgacacttattaccccctctcactgtgacagtgtggccttccctctcggaaccgttcctcagtccttgagtcctcacgaagatctggtcgccagtgtcccagccatcagtgggctcggcggaagcaattctcatgtttcagcatcaagcaggtggcaggagacagccaggacatcatgtgcgttcaatagcagcgtgcagcaagaccatctgtctcgtcaccctcctgagacttgtcagatggaggcagggagcctatttctcctgagctctgacggtcagaacgtcgtaggaatccaggttacagagaccgcgaaagtcaatatttgggaagagaaggaaaatgtagggtcatttactaatcgtatgactcccgagaagcacctgaactcactacgcaatctcgccaagagcctcgatgctgaacaggataccactaatcctaaaccattttggaacatgggggaaaatagcaaacagctgccaggtcctcaaaagctctcggatccccgcctgtggcaggagtctttttggaagaattatagccagctgttctgggggttgccttccctgcatagtgagtcactggtggccaacgcatgggtgactgatagatcttataccttgcagtcccctcctttcctatttaatgagatgtccaatgtgtgccccatccagcgagagaccacgatgagcccactgctgtttcaggcccagcccctgtctcacctcggtcctgagtgtcagccatttatctcctccaccccccaattccgtccaacccctatggctcaggctgaggcccaagcccatctgcagtcttcttttcctgtgctgtccccagcctttccaagtctgattcagaacactggagtggcttgcccggcttcccagaataaagttcaggccctatccctgcccgaaacccagcatcccgagtggccattactgaggagacaactcgaagggcgtctagccctcccctcgcgcgtacagaaatctcaagacgtattctctgtcagcacccctaatctgcctcaagagtccctgacttccatcctacccgaaaattttcccgtcagccctgaactccggcgccaactcgaacagcacatcaagaagtggattattcagcactggggtaacctagggcgcattcaggagtcacttgatctcatgcagctccgggatgaatccccgggaacaagccaagcaaagggaaaaccgtccccttggcagtcttctatgtcaaccggtgagtcgtcgaaagaagctcagaaagtgaaattccagctggagcgagatccatgcccgcacctcggacagattctgggcgagacaccccagaacttaagtcgagacatgaagtcctttcctcgaaaggtattgggtgtgacgagtgaggagctcgagcgtaacctcagaaaaccacttcgtagcgactccggctccgacctactgcgctgtactgagcgcactcatatagagaacattctgaaggcccacatgggaagaaatttagggcagacaaacgaaggattgattccggtacgtgtcaggcgctcctggctggcagtcaaccaggccctccccgtgagtaatacccatgtgaaaacatctaacttagccgcgcctaagtcagggaaggcctgcgtaaatacagctcaggtactttcatttctggagccctgcactcagcagggactgggtgcccacatcgtacgtttctgggctaagcacagatggggtctgcctctgcgggtgttaaagcccatacaatgctttaagctcgaaaaggtgagcagcctgtcactgacccaattggcaggcccatcttcagccacatgcgaatccggtgccgggtcagaagttgaagtggacatgttcttgaggaaacctccgatggccagcctcaggaaacaggtgctaactaaggcatcagaccacatgcccgagagcctgctggcaagttcccctgcctggaagcaatttcagagggccccacgcggcatacccagttggaatgaccatgagcccctaaaaccacctccagccgggcaggaggggagatggcccagcaagccactgacttactctctgacgggaagcatccagcagtctcgatctctgggagcacagtcgtcgaaagctggtgagacaagggaggccgtgccacagtgtcgggtaccactggaaacctgcatgctggctaacctgcaagcaaccagcgaggacgttcacggattcgaggcccctggtacttctaagtcctcattacatccaagggtgagtgtaagtcaagatcctcgcaagctctgcttaatggaagaggtggtgaatgaattcgaacccgggatggctacaaaatccgaaacccagccccaggtttgcgctgcagtagtcctacttccggacggacaagccagtgtggtcccgcacgcttccgaaaatctggtttcacaagtcccccagggccatctgcagtcaatgccaactgggaatatgagggctagccaggagttgcacgacctgatggccgcgcgaaggtctaagctggtacatgaggagccgaggaaccccaactgccagggtagttgcaaatcccagcgtcccatgtttccccctattcacaagtccgagaaaagccgaaaaccaaacttggagaagcatgaagagcgtctcgaaggtctcagaactccccagttaactcccgttaggaaaacagaggatactcatcaggacgaaggcgtacagctgctgccttcaaagaagcagcccccatctgtgagcccattcggcgagaacattaaacagatcttccaatggatcttctctaaaaagaagtccaagccggccccagtgactgccgaatcccagaagacagtgaaaaacagatccagggtgtatagttcttccgctgaagcccaaggtctgatgaccgcggtgggacagatgctcgataagaagatgtccctctgccatgcccgtcacgcctccaaagtgaatcagcacaagcagaagttccaggcccccgtctgtggctttccttgcaaccaccgtcatttgttctatagcgaacacggacggatattgagttatgctgcctcttcccagcaggccacgctcaagtctcaggggtgtcctaaccgtgacagacagattaggaatcagcagcccttaaaatctgtgcgatgcaataatgaacagtggggattgcggcatcctcagatcctgcacccgaagaaggcggtatctccagtctccccccctcaacattggcccaagacgtctggggcttcctctcatcatcatcactgtccaaggcactgcctcctgtgggaaggtatctag

SEQ ID NO: 42240 - DNA, 4044 bp, Artificial Sequence
  Description of Artificial Sequence: Synthetic coding sequence
atggagaacctgcccttccccctgaagctgctgagcgccagcagcctgaacgcaccttccagcacgccatgggtcctcgacatctttcttaccttagtgttcgccctaggattttttttcgtcttgctgccttacctctcctacttcagatgcgacgatccaccgtctccctcacccggcaagcgaaagtgcccagtgggaaggcgtcgccggcccaggggacgaatgaaaaatcattcactaagagctggtagggagtgtaggagaggcctggaagagacatccgaccttttaagccaattacaatccctgcttggaccacatctggataagggcgatttcggccagctgtctggtcctgaccccccaggcgaagtcggtgagagagcccctgacggagctagccagtcctcacatgagccgatggaagacgccgcccccattcttagccctctcgcctcccccgatccccaggcaaagcacccgcaagatctggcaagtaccccatcgcccggccccatgacaactagtgtgagttctttgtcggcatctcagccccccgaaccctccctgcccctggaacatccttctcccgaaccccccgcgctttttccgcatcctccccacactcccgaccccctggcctgtagtctcccacccccaaagggattcaccgctcctcccttgcgagacagtacgctgataacgcctagccactgtgacagtgtggccttccccctgggcaccgttcctcaatccttgagccctcacgaggatttggtcgcttccgtgcctgccatttcaggcctgggcggaagtaactctcatgtaagcgcaagctctagatggcaagagacggctcgaacttcttgtgctttcaattccagtgtgcagcaggatcaccttagccgccacccaccagaaacatgccaaatggaggccgggagcctattcctgcttagctcagatggccagaatgttgtcggcattcaggtaacagaaaccgctaaggtgaatatatgggaagagaaggaaaatgttggtagctttacgaacagaatgactcccgagaagcatctgaattcgttgagaaacctcgccaagagtctcgacgcagagcaggataccacaaatcctaaaccattctggaacatgggggaaaatagtaagcagttaccaggccctcaaaaactatcagatccccgcctctggcaggagtccttctggaagaactatagccagttattctgggggctgccttctcttcactctgagagcctggtcgccaacgcctgggttactgatcgctcttatactctccagtcccctcccttcctgttcaatgagatgtctaacgtgtgtcctattcagcgcgagactacaatgtcacccctactgtttcaggctcagcccctgtctcacctcggacctgagtgtcaaccttttatatcctccacgccacagtttcgcccgacgccaatggcgcaagctgaggctcaggcgcacctgcagagcagttttcctgtcctgagtccagcattcccgtcgctcatccagaacactggtgttgcctgcccagcatcccagaataaggtgcaggcgctaagcctgcctgagacccagcatccggaatggcccctcctgcggagacagctggagggcagactggctctgccatctagagtgcagaaatcccaagacgttttttcggtgagtacccccaatctgccacaggagagtcttacaagcattctgcccgagaactttccggtgagtccagagctccgaagacagttggaacagcatattaaaaagtggataatacagcactggggcaaccttggtcgaattcaggaatcattagacctaatgcagctgagagatgagtcaccaggaacatcccaagctaaaggaaagcccagtccatggcaatcctccatgtctactggtgaaagttccaaagaagcgcaaaaagtgaagttccaattggaaagggatccatgcccacatctggggcagattctgggcgaaaccccccagaacctgtcacgtgacatgaaatcctttccaagaaaggtcctcggcgtgacatccgaagaactggagcggaatcttagaaagcccctccgctctgactccgggtcagatctgttaagatgcactgagagaacccacattgagaatattcttaaggcccacatggggaggaacctggggcagacgaacgaggggctgatcccagtccgggtgcgacgctcctggctggctgtgaaccaagctctcccggtctccaatactcacgtgaagacttcaaatctggccgcccccaagtccggtaaggcttgtgttaatacagcacaggttctatccttcctggaaccttgcactcagcagggtcttggcgctcacatcgtgcgcttctgggcaaagcaccgctgggggttgccgctgagggtgttgaagccaatccagtgtttcaaactggaaaaagtgtcttccttatcacttacccagcttgccggaccttcttctgcaacttgcgaaagtggagctgggagcgaagtggaggtggatatgttcctaagaaagcccccaatggccagtctgcgtaagcaagttctcaccaaggcctcagaccatatgcccgaatctctgctcgcctcctctcctgcatggaagcagtttcaaagagcaccacgcggcatcccatcttggaacgaccacgagccgctcaaaccgcctcccgctggccaggaaggcagatggccctccaagccccttacatattctttaaccggtagcatccagcagtctaggagcctgggagcccagtcgagtaaagctggggagacgcgggaggccgtgccccaatgtagagtcccactggagacgtgtatgcttgcaaacctgcaagcaaccagcgaagacgtccatgggttcgaagccccgggcacgtccaaatcatcgctccatcctcgggtctccgtgagccaggatcctcgtaaactgtgcctgatggaggaggtggtaaacgaatttgaaccaggaatggctactaagagcgaaacacagccacaagtctgcgctgctgttgtcctccttcccgatggccaggctagtgtagtccctcacgcctcagaaaacctcgtttctcaggtgccccaggggcaccttcagtccatgccaactgggaacatgagggcctcccaggaattgcacgatctgatggccgcgagaaggtcaaagctagtgcacgaggagccccggaacccaaactgccagggatcttgcaaatcacagcggccaatgtttccaccaattcacaagtccgaaaaaagcaggaagccaaatctggagaaacatgaagaacgtttggaaggcctgcggacaccccaactcactccagtcagaaagacagaagacactcaccaagatgaaggcgtccaattgctgccctcaaagaagcagccgccctcagtatctccgttcggggaaaacatcaaacaaatatttcagtggatcttctccaaaaagaagtccaaaccagcgcccgtgactgctgagagccaaaagactgtgaaaaaccgctccagggtgtattctagtagtgccgaggctcagggtctgatgacagccgtaggacaaatgttggataagaagatgtctctgtgtcatgcacggcacgcctcaaaagtgaatcagcacaagcaaaagtttcaggctcctgtatgtggatttccctgtaaccatcggcatctgttttattccgaacacggtagaattctgagctatgccgcaagcagtcagcaggcaaccttgaaaagtcaagggtgtccaaaccgcgatcggcagatacgcaatcagcagccactgaagagcgtgagatgtaataacgaacagtgggggctaagacacccccagattctccacccgaaaaaagcggtcagccccgtgtccccgccccaacattggcccaagacttctggagcatcgtcccaccatcatcactgcccccgccactgtttactctgggagggcatctag
